United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 42

SEQ ID NO: 1875886 - RNA, 22 nt, Human herpesvirus 4 (Epstein-Barr virus)
cgggcguugccagacuccgcca

SEQ ID NO: 1875887 - RNA, 19 nt, Human herpesvirus 4 (Epstein-Barr virus)
gggucaacagguggucgug

SEQ ID NO: 1875888 - RNA, 15 nt, Human herpesvirus 4 (Epstein-Barr virus)
guaccagcugguggu

SEQ ID NO: 1875889 - RNA, 22 nt, Human herpesvirus 4 (Epstein-Barr virus)
uaacaagggaagagggaaaaga

SEQ ID NO: 1875890 - RNA, 10 nt, Human herpesvirus 4 (Epstein-Barr virus)
ccguggccuu

SEQ ID NO: 1875891 - RNA, 15 nt, Human herpesvirus 4 (Epstein-Barr virus)
cccggguggugagga

SEQ ID NO: 1875892 - RNA, 22 nt, Human herpesvirus 4 (Epstein-Barr virus)
gacuuuauacauaggucucggc

SEQ ID NO: 1875893 - RNA, 14 nt, Human herpesvirus 4 (Epstein-Barr virus)
gugacacagugccc

SEQ ID NO: 1875894 - RNA, 16 nt, Human herpesvirus 4 (Epstein-Barr virus)
accggggaggccaggu

SEQ ID NO: 1875895 - RNA, 18 nt, Human herpesvirus 4 (Epstein-Barr virus)
cagccagagccagccggg

SEQ ID NO: 1875896 - RNA, 23 nt, Human herpesvirus 4 (Epstein-Barr virus)
gucagcuguguacgugccucaga

SEQ ID NO: 1875897 - RNA, 17 nt, Human herpesvirus 4 (Epstein-Barr virus)
ggccugggaggugcuga

SEQ ID NO: 1875898 - RNA, 16 nt, Human herpesvirus 4 (Epstein-Barr virus)
uuccccccagccugag

SEQ ID NO: 1875899 - RNA, 17 nt, Human herpesvirus 4 (Epstein-Barr virus)
ccaaggcggcugcugag

SEQ ID NO: 1875900 - RNA, 15 nt, Human herpesvirus 4 (Epstein-Barr virus)
caggagucugcugcg

SEQ ID NO: 1875901 - RNA, 21 nt, Human herpesvirus 4 (Epstein-Barr virus)
agugcauggauauagcucugc

SEQ ID NO: 1875902 - RNA, 15 nt, Human herpesvirus 4 (Epstein-Barr virus)
gaaagugcuggccau

SEQ ID NO: 1875903 - RNA, 19 nt, Human herpesvirus 4 (Epstein-Barr virus)
gacagguacuaacacgcaa

SEQ ID NO: 1875904 - RNA, 21 nt, Human herpesvirus 4 (Epstein-Barr virus)
cgggugcacacgcucagcuca

SEQ ID NO: 1875905 - RNA, 14 nt, Human herpesvirus 4 (Epstein-Barr virus)
ccggcauccagugc

SEQ ID NO: 1875906 - RNA, 20 nt, Human herpesvirus 4 (Epstein-Barr virus)
uacaaacacgggccuggggc

SEQ ID NO: 1875907 - RNA, 20 nt, Human herpesvirus 4 (Epstein-Barr virus)
cgugguggcauuaaugucca

SEQ ID NO: 1875908 - RNA, 16 nt, Human herpesvirus 4 (Epstein-Barr virus)
cccaaagcgggugcag

SEQ ID NO: 1875909 - RNA, 17 nt, Human herpesvirus 4 (Epstein-Barr virus)
gugcagggauugggcuu

SEQ ID NO: 1875910 - RNA, 13 nt, Human herpesvirus 4 (Epstein-Barr virus)
gucaccaggccug

SEQ ID NO: 1875911 - RNA, 19 nt, Human herpesvirus 4 (Epstein-Barr virus)
caacccccggcucucaggc

SEQ ID NO: 1875912 - RNA, 14 nt, Human herpesvirus 4 (Epstein-Barr virus)
cgccaugcucaggg

SEQ ID NO: 1875913 - RNA, 17 nt, Human herpesvirus 4 (Epstein-Barr virus)
ggcccuuugccuggggc

SEQ ID NO: 1875914 - RNA, 18 nt, Human herpesvirus 4 (Epstein-Barr virus)
ggagccagcgcugggggu

SEQ ID NO: 1875915 - RNA, 19 nt, Human herpesvirus 4 (Epstein-Barr virus)
ggcagacaccaccugcucg

SEQ ID NO: 1875916 - RNA, 20 nt, Human herpesvirus 4 (Epstein-Barr virus)
gacacuuuagagcucuggag

SEQ ID NO: 1875917 - RNA, 20 nt, Human herpesvirus 4 (Epstein-Barr virus)
ccaaaaugcacccggacaug

SEQ ID NO: 1875918 - RNA, 15 nt, Human herpesvirus 4 (Epstein-Barr virus)
gccaugcaggccugg

SEQ ID NO: 1875919 - RNA, 12 nt, Human herpesvirus 4 (Epstein-Barr virus)
agucgaagcucu

SEQ ID NO: 1875920 - RNA, 15 nt, Human herpesvirus 4 (Epstein-Barr virus)
uggugaugcuugugc

SEQ ID NO: 1875921 - RNA, 16 nt, Human herpesvirus 4 (Epstein-Barr virus)
cagcucggccagcagg

SEQ ID NO: 1875922 - RNA, 16 nt, Human herpesvirus 4 (Epstein-Barr virus)
uaugcagaaggggccc

SEQ ID NO: 1875923 - RNA, 14 nt, Human herpesvirus 4 (Epstein-Barr virus)
caacgcauccacca

SEQ ID NO: 1875924 - RNA, 19 nt, Human herpesvirus 4 (Epstein-Barr virus)
gaaaguuguugggugaaag

SEQ ID NO: 1875925 - RNA, 20 nt, Human herpesvirus 4 (Epstein-Barr virus)
ucugggcagccagagccagc

SEQ ID NO: 1875926 - RNA, 13 nt, Human herpesvirus 4 (Epstein-Barr virus)
cugucuguaaacu

SEQ ID NO: 1875927 - RNA, 17 nt, Human herpesvirus 4 (Epstein-Barr virus)
guggccgucuggcaggg

SEQ ID NO: 1875928 - RNA, 16 nt, Human herpesvirus 4 (Epstein-Barr virus)
cagcagacaaggacag

SEQ ID NO: 1875929 - RNA, 15 nt, Human herpesvirus 4 (Epstein-Barr virus)
ccaggagucugcugc

SEQ ID NO: 1875930 - RNA, 20 nt, Human herpesvirus 4 (Epstein-Barr virus)
uggaucuacuuauuggagau

SEQ ID NO: 1875931 - RNA, 16 nt, Human herpesvirus 4 (Epstein-Barr virus)
gcccugucccuggagc

SEQ ID NO: 1875932 - RNA, 21 nt, Human herpesvirus 4 (Epstein-Barr virus)
gugcugccugggggcuuuguu

SEQ ID NO: 1875933 - RNA, 17 nt, Human herpesvirus 4 (Epstein-Barr virus)
gucccaggccuuagccc

SEQ ID NO: 1875934 - RNA, 15 nt, Human herpesvirus 4 (Epstein-Barr virus)
caccugcagggcuuc

SEQ ID NO: 1875935 - RNA, 14 nt, Human herpesvirus 4 (Epstein-Barr virus)
agcccuuggaacug

SEQ ID NO: 1875936 - RNA, 17 nt, Human herpesvirus 4 (Epstein-Barr virus)
cuggucgcccccucugc

SEQ ID NO: 1875937 - RNA, 15 nt, Human herpesvirus 4 (Epstein-Barr virus)
ccccggccucccgcu

SEQ ID NO: 1875938 - RNA, 15 nt, Human herpesvirus 4 (Epstein-Barr virus)
gugaucauggaaacc

SEQ ID NO: 1875939 - RNA, 19 nt, Human herpesvirus 4 (Epstein-Barr virus)
ugccuccggccgccccggg

SEQ ID NO: 1875940 - RNA, 19 nt, Human herpesvirus 4 (Epstein-Barr virus)
acguggguccccucugccg

SEQ ID NO: 1875941 - RNA, 18 nt, Human herpesvirus 4 (Epstein-Barr virus)
caccagggaggccuggga

SEQ ID NO: 1875942 - RNA, 15 nt, Human herpesvirus 4 (Epstein-Barr virus)
uuucagcaucacagg

SEQ ID NO: 1875943 - RNA, 14 nt, Human herpesvirus 4 (Epstein-Barr virus)
aguuuacuuucaag

SEQ ID NO: 1875944 - RNA, 22 nt, Human herpesvirus 4 (Epstein-Barr virus)
acacgccagagacaaggcaggc

SEQ ID NO: 1875945 - RNA, 13 nt, Human herpesvirus 4 (Epstein-Barr virus)
acuuagggccggg

SEQ ID NO: 1875946 - RNA, 15 nt, Human herpesvirus 4 (Epstein-Barr virus)
aggucgccggagguc

SEQ ID NO: 1875947 - RNA, 19 nt, Human herpesvirus 4 (Epstein-Barr virus)
cgaagcucuuggucaaggu

SEQ ID NO: 1875948 - RNA, 19 nt, Human herpesvirus 4 (Epstein-Barr virus)
cagcgccagcagggcacag

SEQ ID NO: 1875949 - RNA, 11 nt, Human herpesvirus 4 (Epstein-Barr virus)
gccuggggcuc

SEQ ID NO: 1875950 - RNA, 21 nt, Human herpesvirus 4 (Epstein-Barr virus)
uggacuggggugugaagggca

SEQ ID NO: 1875951 - RNA, 14 nt, Human herpesvirus 4 (Epstein-Barr virus)
cggcggcugcugcc

SEQ ID NO: 1875952 - RNA, 21 nt, Human herpesvirus 4 (Epstein-Barr virus)
aguccucauggcaggagaggc

SEQ ID NO: 1875953 - RNA, 13 nt, Human herpesvirus 4 (Epstein-Barr virus)
ucggccuccuggc

SEQ ID NO: 1875954 - RNA, 12 nt, Human herpesvirus 4 (Epstein-Barr virus)
agagcggcgaga

SEQ ID NO: 1875955 - RNA, 13 nt, Human herpesvirus 4 (Epstein-Barr virus)
auuauugauguga

SEQ ID NO: 1875956 - RNA, 18 nt, Human herpesvirus 4 (Epstein-Barr virus)
acugcguccaccuggcca

SEQ ID NO: 1875957 - RNA, 17 nt, Human herpesvirus 4 (Epstein-Barr virus)
cuuucaguggucaccgg

SEQ ID NO: 1875958 - RNA, 16 nt, Human herpesvirus 4 (Epstein-Barr virus)
cuucugucucggccuc

SEQ ID NO: 1875959 - RNA, 16 nt, Human herpesvirus 4 (Epstein-Barr virus)
gcuuuugucugccugg

SEQ ID NO: 1875960 - RNA, 19 nt, Human herpesvirus 4 (Epstein-Barr virus)
aggagcaggaggaggggca

SEQ ID NO: 1875961 - RNA, 18 nt, Human herpesvirus 4 (Epstein-Barr virus)
augccaaagcugaagaac

SEQ ID NO: 1875962 - RNA, 12 nt, Human herpesvirus 4 (Epstein-Barr virus)
ugcugccugggg

SEQ ID NO: 1875963 - RNA, 21 nt, Human herpesvirus 4 (Epstein-Barr virus)
caccacccccaccacccccac

SEQ ID NO: 1875964 - RNA, 12 nt, Human herpesvirus 4 (Epstein-Barr virus)
gcgccugcucca

SEQ ID NO: 1875965 - RNA, 15 nt, Human herpesvirus 4 (Epstein-Barr virus)
ccggcgccaccugca

SEQ ID NO: 1875966 - RNA, 14 nt, Human herpesvirus 4 (Epstein-Barr virus)
gacccgucgggcca

SEQ ID NO: 1875967 - RNA, 18 nt, Human herpesvirus 4 (Epstein-Barr virus)
gcagcccccuccuccagg

SEQ ID NO: 1875968 - RNA, 15 nt, Human herpesvirus 4 (Epstein-Barr virus)
gaaacuugggggcag

SEQ ID NO: 1875969 - RNA, 21 nt, Human herpesvirus 4 (Epstein-Barr virus)
gcaaccaauguaucccaaaua

SEQ ID NO: 1875970 - RNA, 16 nt, Human herpesvirus 4 (Epstein-Barr virus)
caucaagcagaaaggc

SEQ ID NO: 1875971 - RNA, 19 nt, Human herpesvirus 4 (Epstein-Barr virus)
ugucuaacacgcuuuuguc

SEQ ID NO: 1875972 - RNA, 14 nt, Human herpesvirus 4 (Epstein-Barr virus)
cgcggugguggccc

SEQ ID NO: 1875973 - RNA, 20 nt, Human herpesvirus 4 (Epstein-Barr virus)
cggugggaucaugaagcccc

SEQ ID NO: 1875974 - RNA, 22 nt, Human herpesvirus 4 (Epstein-Barr virus)
cacuggaugcaggaccuagaau

SEQ ID NO: 1875975 - RNA, 13 nt, Human herpesvirus 4 (Epstein-Barr virus)
ccugcggcccacu

SEQ ID NO: 1875976 - RNA, 21 nt, Human herpesvirus 4 (Epstein-Barr virus)
cccaccuuuuaauucucuucu

SEQ ID NO: 1875977 - RNA, 14 nt, Human herpesvirus 4 (Epstein-Barr virus)
gaacgugacaggca

SEQ ID NO: 1875978 - RNA, 17 nt, Human herpesvirus 4 (Epstein-Barr virus)
cuacaaccccuuccacg

SEQ ID NO: 1875979 - RNA, 19 nt, Human herpesvirus 4 (Epstein-Barr virus)
uccccauagacucccaugu

SEQ ID NO: 1875980 - RNA, 22 nt, Human herpesvirus 4 (Epstein-Barr virus)
aggaaggggccucggccugggg

SEQ ID NO: 1875981 - RNA, 16 nt, Human herpesvirus 4 (Epstein-Barr virus)
cauuguccucaccaag

SEQ ID NO: 1875982 - RNA, 15 nt, Human herpesvirus 4 (Epstein-Barr virus)
ucauggccgacgagg

SEQ ID NO: 1875983 - RNA, 22 nt, Human herpesvirus 4 (Epstein-Barr virus)
caccuggcuguacgccgccgcc

SEQ ID NO: 1875984 - RNA, 17 nt, Human herpesvirus 4 (Epstein-Barr virus)
uagaaugacagccuggu

SEQ ID NO: 1875985 - RNA, 10 nt, Human herpesvirus 4 (Epstein-Barr virus)
gucucagagg

SEQ ID NO: 1875986 - RNA, 20 nt, Human herpesvirus 4 (Epstein-Barr virus)
ggcucgccucauccuggccc

SEQ ID NO: 1875987 - RNA, 22 nt, Human herpesvirus 4 (Epstein-Barr virus)
cccugcaaacugacacacaggc

SEQ ID NO: 1875988 - RNA, 14 nt, Human herpesvirus 4 (Epstein-Barr virus)
ugccggaguuuucu

SEQ ID NO: 1875989 - RNA, 14 nt, Human herpesvirus 4 (Epstein-Barr virus)
gccugccaaagagc

SEQ ID NO: 1875990 - RNA, 18 nt, Human herpesvirus 4 (Epstein-Barr virus)
cacaagagccaucaccuc

SEQ ID NO: 1875991 - RNA, 15 nt, Human herpesvirus 4 (Epstein-Barr virus)
agggugaggcccagc

SEQ ID NO: 1875992 - RNA, 17 nt, Human herpesvirus 4 (Epstein-Barr virus)
ccccagcuucugaggcg

SEQ ID NO: 1875993 - RNA, 15 nt, Human herpesvirus 4 (Epstein-Barr virus)
uuaacauggacaugc

SEQ ID NO: 1875994 - RNA, 22 nt, Human herpesvirus 4 (Epstein-Barr virus)
gccuggcucaaacgcugcuugg

SEQ ID NO: 1875995 - RNA, 18 nt, Human herpesvirus 4 (Epstein-Barr virus)
ggcucggggcuggggaga

SEQ ID NO: 1875996 - RNA, 15 nt, Human herpesvirus 4 (Epstein-Barr virus)
cggcggaggccgagc

SEQ ID NO: 1875997 - RNA, 15 nt, Human herpesvirus 4 (Epstein-Barr virus)
gagagaagagagcgg

SEQ ID NO: 1875998 - RNA, 17 nt, Human herpesvirus 4 (Epstein-Barr virus)
cguggccaggcccgagg

SEQ ID NO: 1875999 - RNA, 17 nt, Human herpesvirus 4 (Epstein-Barr virus)
ggggcggguauagagca

SEQ ID NO: 1876000 - RNA, 23 nt, Human herpesvirus 4 (Epstein-Barr virus)
guagauggcgagacucuugaaga

SEQ ID NO: 1876001 - RNA, 10 nt, Human herpesvirus 4 (Epstein-Barr virus)
agcaggaggg

SEQ ID NO: 1876002 - RNA, 23 nt, Human herpesvirus 4 (Epstein-Barr virus)
gacugggucgugguuuucugccc

SEQ ID NO: 1876003 - RNA, 15 nt, Human herpesvirus 4 (Epstein-Barr virus)
aguggacaaggcagu

SEQ ID NO: 1876004 - RNA, 22 nt, Human herpesvirus 4 (Epstein-Barr virus)
guaaaauuuacaccugacccau

SEQ ID NO: 1876005 - RNA, 15 nt, Human herpesvirus 4 (Epstein-Barr virus)
uuacugggaaugccu

SEQ ID NO: 1876006 - RNA, 12 nt, Human herpesvirus 4 (Epstein-Barr virus)
cauggggcucug

SEQ ID NO: 1876007 - RNA, 14 nt, Human herpesvirus 4 (Epstein-Barr virus)
gcuggugcaccugc

SEQ ID NO: 1876008 - RNA, 18 nt, Human herpesvirus 4 (Epstein-Barr virus)
ccuccgccgccgcagccg

SEQ ID NO: 1876009 - RNA, 21 nt, Human herpesvirus 4 (Epstein-Barr virus)
cguuccuggccauggccgaga

SEQ ID NO: 1876010 - RNA, 16 nt, Human herpesvirus 4 (Epstein-Barr virus)
cggggagcggcaaggg

SEQ ID NO: 1876011 - RNA, 14 nt, Human herpesvirus 4 (Epstein-Barr virus)
auccccagcccagc

SEQ ID NO: 1876012 - RNA, 13 nt, Human herpesvirus 4 (Epstein-Barr virus)
cccuuucuaccag

SEQ ID NO: 1876013 - RNA, 20 nt, Human herpesvirus 4 (Epstein-Barr virus)
agguuuagcuauuccaccaa

SEQ ID NO: 1876014 - RNA, 17 nt, Human herpesvirus 4 (Epstein-Barr virus)
cuuacauucuuauugaa

SEQ ID NO: 1876015 - RNA, 19 nt, Human herpesvirus 4 (Epstein-Barr virus)
ggccucuacgccaggcucg

SEQ ID NO: 1876016 - RNA, 18 nt, Human herpesvirus 4 (Epstein-Barr virus)
ggacgaggacggggaaga

SEQ ID NO: 1876017 - RNA, 22 nt, Human herpesvirus 4 (Epstein-Barr virus)
ucuccagcgucauuucuuccaa

SEQ ID NO: 1876018 - RNA, 17 nt, Human herpesvirus 4 (Epstein-Barr virus)
uguguaaccucacugua

SEQ ID NO: 1876019 - RNA, 18 nt, Human herpesvirus 4 (Epstein-Barr virus)
acacgggggugcccccac

SEQ ID NO: 1876020 - RNA, 18 nt, Human herpesvirus 4 (Epstein-Barr virus)
agcugccucccugccccu

SEQ ID NO: 1876021 - RNA, 14 nt, Human herpesvirus 4 (Epstein-Barr virus)
acugcgaugagggc

SEQ ID NO: 1876022 - RNA, 22 nt, Human herpesvirus 4 (Epstein-Barr virus)
caacugcuauucugagcaccaa

SEQ ID NO: 1876023 - RNA, 15 nt, Human herpesvirus 4 (Epstein-Barr virus)
augaacccuggggca

SEQ ID NO: 1876024 - RNA, 17 nt, Human herpesvirus 4 (Epstein-Barr virus)
cagguagcaaggacccg

SEQ ID NO: 1876025 - RNA, 19 nt, Human herpesvirus 4 (Epstein-Barr virus)
ccguuauugaaaccacgcc

SEQ ID NO: 1876026 - RNA, 21 nt, Human herpesvirus 4 (Epstein-Barr virus)
ucuacaucccauaccuacacc

SEQ ID NO: 1876027 - RNA, 22 nt, Human herpesvirus 4 (Epstein-Barr virus)
aucucccgcuagauggcgcccu

SEQ ID NO: 1876028 - RNA, 16 nt, Human herpesvirus 4 (Epstein-Barr virus)
cacacuuaacuugacu

SEQ ID NO: 1876029 - RNA, 24 nt, Human herpesvirus 4 (Epstein-Barr virus)
uuacugcccagccuacucuccacu

SEQ ID NO: 1876030 - RNA, 22 nt, Human herpesvirus 4 (Epstein-Barr virus)
uccaugcaaguggaugcaucua

SEQ ID NO: 1876031 - RNA, 22 nt, Human herpesvirus 4 (Epstein-Barr virus)
caggccgccaugcucagggcca

SEQ ID NO: 1876032 - RNA, 16 nt, Human herpesvirus 4 (Epstein-Barr virus)
cccgggggaggagaag

SEQ ID NO: 1876033 - RNA, 16 nt, Human herpesvirus 4 (Epstein-Barr virus)
aaugaccgugcaugca

SEQ ID NO: 1876034 - RNA, 18 nt, Human herpesvirus 4 (Epstein-Barr virus)
gcaugccaccgugaaguu

SEQ ID NO: 1876035 - RNA, 14 nt, Human herpesvirus 4 (Epstein-Barr virus)
uggcuacuuugugu

SEQ ID NO: 1876036 - RNA, 14 nt, Human herpesvirus 4 (Epstein-Barr virus)
cccaguccgcgacc

SEQ ID NO: 1876037 - RNA, 16 nt, Human herpesvirus 4 (Epstein-Barr virus)
ucaucucaagggagga

SEQ ID NO: 1876038 - RNA, 16 nt, Human herpesvirus 4 (Epstein-Barr virus)
gucaccugcacagauc

SEQ ID NO: 1876039 - RNA, 14 nt, Human herpesvirus 4 (Epstein-Barr virus)
gcaccuagcccacu

SEQ ID NO: 1876040 - RNA, 14 nt, Human herpesvirus 4 (Epstein-Barr virus)
aaugacuaugagga

SEQ ID NO: 1876041 - RNA, 18 nt, Human herpesvirus 4 (Epstein-Barr virus)
gagcuguaacugugguuu

SEQ ID NO: 1876042 - RNA, 19 nt, Human herpesvirus 4 (Epstein-Barr virus)
agucgcguacucuguggag

SEQ ID NO: 1876043 - RNA, 18 nt, Human herpesvirus 4 (Epstein-Barr virus)
accuguuucggcgccgcc

SEQ ID NO: 1876044 - RNA, 21 nt, Human herpesvirus 4 (Epstein-Barr virus)
gagucacaccccacggccaug

SEQ ID NO: 1876045 - RNA, 23 nt, Human herpesvirus 4 (Epstein-Barr virus)
agagcagauuuccgucagccagg

SEQ ID NO: 1876046 - RNA, 22 nt, Human herpesvirus 4 (Epstein-Barr virus)
caaaccaugacaucacagagga

SEQ ID NO: 1876047 - RNA, 19 nt, Human herpesvirus 4 (Epstein-Barr virus)
cuugccguggcgccugggg

SEQ ID NO: 1876048 - RNA, 19 nt, Human herpesvirus 4 (Epstein-Barr virus)
ccugucugacuuggccccu

SEQ ID NO: 1876049 - RNA, 18 nt, Human herpesvirus 4 (Epstein-Barr virus)
gucucggcacccaggcag

SEQ ID NO: 1876050 - RNA, 20 nt, Human herpesvirus 4 (Epstein-Barr virus)
cagcgcggcagaggccucuc

SEQ ID NO: 1876051 - RNA, 15 nt, Human herpesvirus 4 (Epstein-Barr virus)
gcuacuugcucaggu

SEQ ID NO: 1876052 - RNA, 11 nt, Human herpesvirus 4 (Epstein-Barr virus)
ccauggccagg

SEQ ID NO: 1876053 - RNA, 22 nt, Human herpesvirus 4 (Epstein-Barr virus)
cugagccacuccggacgcagag

SEQ ID NO: 1876054 - RNA, 14 nt, Human herpesvirus 4 (Epstein-Barr virus)
uaaauaaacucauc

SEQ ID NO: 1876055 - RNA, 14 nt, Human herpesvirus 4 (Epstein-Barr virus)
ccuguguccugggc

SEQ ID NO: 1876056 - RNA, 13 nt, Human herpesvirus 4 (Epstein-Barr virus)
ggcugcuggcggc

SEQ ID NO: 1876057 - RNA, 23 nt, Human herpesvirus 4 (Epstein-Barr virus)
ggaccagaaggcuccggcggcag

SEQ ID NO: 1876058 - RNA, 20 nt, Human herpesvirus 4 (Epstein-Barr virus)
ccguugugaccgccaccggc

SEQ ID NO: 1876059 - RNA, 18 nt, Human herpesvirus 4 (Epstein-Barr virus)
ggagaugaccuccuacac

SEQ ID NO: 1876060 - RNA, 19 nt, Human herpesvirus 4 (Epstein-Barr virus)
agauuagggguaacccugu

SEQ ID NO: 1876061 - RNA, 13 nt, Human herpesvirus 4 (Epstein-Barr virus)
ggaggaagauggc

SEQ ID NO: 1876062 - RNA, 17 nt, Human herpesvirus 4 (Epstein-Barr virus)
gaaugcccccgggggcg

SEQ ID NO: 1876063 - RNA, 22 nt, Human herpesvirus 4 (Epstein-Barr virus)
cucucgaggucugcgaugaggc

SEQ ID NO: 1876064 - RNA, 16 nt, Human herpesvirus 4 (Epstein-Barr virus)
gauggcaaagguccca

SEQ ID NO: 1876065 - RNA, 22 nt, Human herpesvirus 4 (Epstein-Barr virus)
caucggggcggacgccuccucc

SEQ ID NO: 1876066 - RNA, 18 nt, Human herpesvirus 4 (Epstein-Barr virus)
cuucugggaacaccccca

SEQ ID NO: 1876067 - RNA, 12 nt, Human herpesvirus 4 (Epstein-Barr virus)
gcuuuucuccuc

SEQ ID NO: 1876068 - RNA, 17 nt, Human herpesvirus 4 (Epstein-Barr virus)
agccacauucuggaacu

SEQ ID NO: 1876069 - RNA, 18 nt, Human herpesvirus 4 (Epstein-Barr virus)
cuuagagucccugcgcca

SEQ ID NO: 1876070 - RNA, 13 nt, Human herpesvirus 4 (Epstein-Barr virus)
augcaguggguga

SEQ ID NO: 1876071 - RNA, 18 nt, Human herpesvirus 4 (Epstein-Barr virus)
cggcuagccugacuaagg

SEQ ID NO: 1876072 - RNA, 16 nt, Human herpesvirus 4 (Epstein-Barr virus)
ggaggaaacaggagga

SEQ ID NO: 1876073 - RNA, 14 nt, Human herpesvirus 4 (Epstein-Barr virus)
uauuuacaaacacu

SEQ ID NO: 1876074 - RNA, 22 nt, Human herpesvirus 4 (Epstein-Barr virus)
gcuccagugccuccgccugagc

SEQ ID NO: 1876075 - RNA, 15 nt, Human herpesvirus 4 (Epstein-Barr virus)
uccacucccagucca

SEQ ID NO: 1876076 - RNA, 13 nt, Human herpesvirus 4 (Epstein-Barr virus)
aauucagaccuga

SEQ ID NO: 1876077 - RNA, 17 nt, Human herpesvirus 4 (Epstein-Barr virus)
aggugggcugacacaga

SEQ ID NO: 1876078 - RNA, 15 nt, Human herpesvirus 4 (Epstein-Barr virus)
gucuggcagggggcc

SEQ ID NO: 1876079 - RNA, 13 nt, Human herpesvirus 4 (Epstein-Barr virus)
ggacaagacaguc

SEQ ID NO: 1876080 - RNA, 20 nt, Human herpesvirus 4 (Epstein-Barr virus)
gguguucccagaagagccag

SEQ ID NO: 1876081 - RNA, 16 nt, Human herpesvirus 4 (Epstein-Barr virus)
caacaggugcccgagc

SEQ ID NO: 1876082 - RNA, 19 nt, Human herpesvirus 4 (Epstein-Barr virus)
ggcccccagcuucugaggc

SEQ ID NO: 1876083 - RNA, 13 nt, Human herpesvirus 4 (Epstein-Barr virus)
agaugcugccgcu

SEQ ID NO: 1876084 - RNA, 23 nt, Human herpesvirus 4 (Epstein-Barr virus)
uagcccaggcacaucuggcaccu

SEQ ID NO: 1876085 - RNA, 13 nt, Human herpesvirus 4 (Epstein-Barr virus)
gcugccugggggc

SEQ ID NO: 1876086 - RNA, 16 nt, Human herpesvirus 4 (Epstein-Barr virus)
gcucucguugccaaaa

SEQ ID NO: 1876087 - RNA, 18 nt, Human herpesvirus 4 (Epstein-Barr virus)
augguguccggagacccc

SEQ ID NO: 1876088 - RNA, 13 nt, Human herpesvirus 4 (Epstein-Barr virus)
cuggaccagaagg

SEQ ID NO: 1876089 - RNA, 12 nt, Human herpesvirus 4 (Epstein-Barr virus)
guugucuuccca

SEQ ID NO: 1876090 - RNA, 17 nt, Human herpesvirus 4 (Epstein-Barr virus)
aggccagguagcccagc

SEQ ID NO: 1876091 - RNA, 22 nt, Human herpesvirus 4 (Epstein-Barr virus)
gugaaauaaaagcuucugguug

SEQ ID NO: 1876092 - RNA, 16 nt, Human herpesvirus 4 (Epstein-Barr virus)
aggucuccagagggca

SEQ ID NO: 1876093 - RNA, 19 nt, Human herpesvirus 4 (Epstein-Barr virus)
cacuugugguucuccugau

SEQ ID NO: 1876094 - RNA, 16 nt, Human herpesvirus 4 (Epstein-Barr virus)
cagaccugugugcugu

SEQ ID NO: 1876095 - RNA, 12 nt, Human herpesvirus 4 (Epstein-Barr virus)
uaaucuggaugu

SEQ ID NO: 1876096 - RNA, 21 nt, Human herpesvirus 4 (Epstein-Barr virus)
ccucagagggggugccugugc

SEQ ID NO: 1876097 - RNA, 18 nt, Human herpesvirus 4 (Epstein-Barr virus)
ccugucuccccucgagcg

SEQ ID NO: 1876098 - RNA, 14 nt, Human herpesvirus 4 (Epstein-Barr virus)
acugucacaccagu

SEQ ID NO: 1876099 - RNA, 14 nt, Human herpesvirus 4 (Epstein-Barr virus)
gucagaccugaaga

SEQ ID NO: 1876100 - RNA, 15 nt, Human herpesvirus 4 (Epstein-Barr virus)
ggccugcuggccgag

SEQ ID NO: 1876101 - RNA, 17 nt, Human herpesvirus 4 (Epstein-Barr virus)
gguccuguuccggggcg

SEQ ID NO: 1876102 - RNA, 16 nt, Human herpesvirus 4 (Epstein-Barr virus)
ccugacugacucuccc

SEQ ID NO: 1876103 - RNA, 18 nt, Human herpesvirus 4 (Epstein-Barr virus)
cccauccccagcccagcc

SEQ ID NO: 1876104 - RNA, 22 nt, Human herpesvirus 4 (Epstein-Barr virus)
ccagcaggcucaggccgccgca

SEQ ID NO: 1876105 - RNA, 14 nt, Human herpesvirus 4 (Epstein-Barr virus)
ggggagggagcccg

SEQ ID NO: 1876106 - RNA, 16 nt, Human herpesvirus 4 (Epstein-Barr virus)
ucuauaaaaauucaga

SEQ ID NO: 1876107 - RNA, 21 nt, Human herpesvirus 4 (Epstein-Barr virus)
cggugcugccagagccucugc

SEQ ID NO: 1876108 - RNA, 20 nt, Human herpesvirus 4 (Epstein-Barr virus)
gacguggguccccucugccg

SEQ ID NO: 1876109 - RNA, 21 nt, Human herpesvirus 4 (Epstein-Barr virus)
ucagccaccuccccuguggcc

SEQ ID NO: 1876110 - RNA, 16 nt, Human herpesvirus 4 (Epstein-Barr virus)
gcauggauauagcucu

SEQ ID NO: 1876111 - RNA, 11 nt, Human herpesvirus 4 (Epstein-Barr virus)
acauuggcagc

SEQ ID NO: 1876112 - RNA, 16 nt, Human herpesvirus 4 (Epstein-Barr virus)
acuucuggaacauuug

SEQ ID NO: 1876113 - RNA, 12 nt, Human herpesvirus 4 (Epstein-Barr virus)
aagcgggccuga

SEQ ID NO: 1876114 - RNA, 17 nt, Human herpesvirus 4 (Epstein-Barr virus)
caccggggaggccaggu

SEQ ID NO: 1876115 - RNA, 22 nt, Human herpesvirus 4 (Epstein-Barr virus)
augagggacguaucugggcacu

SEQ ID NO: 1876116 - RNA, 16 nt, Human herpesvirus 4 (Epstein-Barr virus)
ccguaaucuguggugg

SEQ ID NO: 1876117 - RNA, 12 nt, Human herpesvirus 4 (Epstein-Barr virus)
gcauccuaggca

SEQ ID NO: 1876118 - RNA, 17 nt, Human herpesvirus 4 (Epstein-Barr virus)
agcagaaggccauggag

SEQ ID NO: 1876119 - RNA, 11 nt, Human herpesvirus 4 (Epstein-Barr virus)
cuggagcuggu

SEQ ID NO: 1876120 - RNA, 16 nt, Human herpesvirus 4 (Epstein-Barr virus)
agauagccggccaggc

SEQ ID NO: 1876121 - RNA, 13 nt, Human herpesvirus 4 (Epstein-Barr virus)
ccucggugguggg

SEQ ID NO: 1876122 - RNA, 14 nt, Human herpesvirus 4 (Epstein-Barr virus)
uucugucucggccu

SEQ ID NO: 1876123 - RNA, 16 nt, Human herpesvirus 4 (Epstein-Barr virus)
gccaggcuggugacaa

SEQ ID NO: 1876124 - RNA, 22 nt, Human herpesvirus 4 (Epstein-Barr virus)
cauucccaaguguuuccagaca

SEQ ID NO: 1876125 - RNA, 15 nt, Human herpesvirus 4 (Epstein-Barr virus)
cugauggccuggaga

SEQ ID NO: 1876126 - RNA, 16 nt, Human herpesvirus 4 (Epstein-Barr virus)
aacugggcaucgggcu

SEQ ID NO: 1876127 - RNA, 17 nt, Human herpesvirus 4 (Epstein-Barr virus)
gcuucuuuuuggugaaa

SEQ ID NO: 1876128 - RNA, 21 nt, Human herpesvirus 4 (Epstein-Barr virus)
gaacugggaugaacccugggg

SEQ ID NO: 1876129 - RNA, 16 nt, Human herpesvirus 4 (Epstein-Barr virus)
caagauuguuccaggu

SEQ ID NO: 1876130 - RNA, 16 nt, Human herpesvirus 4 (Epstein-Barr virus)
accggcgcgggagccg

SEQ ID NO: 1876131 - RNA, 22 nt, Human herpesvirus 4 (Epstein-Barr virus)
gcccaccccacacucccuccag

SEQ ID NO: 1876132 - RNA, 17 nt, Human herpesvirus 4 (Epstein-Barr virus)
ccacacucccuccagaa

SEQ ID NO: 1876133 - RNA, 22 nt, Human herpesvirus 4 (Epstein-Barr virus)
aggccggggcgauaccuugggc

SEQ ID NO: 1876134 - RNA, 20 nt, Human herpesvirus 4 (Epstein-Barr virus)
gaagcagauagccggccagg

SEQ ID NO: 1876135 - RNA, 15 nt, Human herpesvirus 4 (Epstein-Barr virus)
caaccugauuccccc

SEQ ID NO: 1876136 - RNA, 20 nt, Human herpesvirus 4 (Epstein-Barr virus)
gcaaugggacgucuuguaaa

SEQ ID NO: 1876137 - RNA, 20 nt, Human herpesvirus 4 (Epstein-Barr virus)
gcaugcuuagugccccccuu

SEQ ID NO: 1876138 - RNA, 23 nt, Human herpesvirus 4 (Epstein-Barr virus)
aguaagaugcauacgcugaguga

SEQ ID NO: 1876139 - RNA, 20 nt, Human herpesvirus 4 (Epstein-Barr virus)
caugacaauuuuagaugagg

SEQ ID NO: 1876140 - RNA, 13 nt, Human herpesvirus 4 (Epstein-Barr virus)
uggucaagagcuu

SEQ ID NO: 1876141 - RNA, 17 nt, Human herpesvirus 4 (Epstein-Barr virus)
ugcacgagaccccuggg

SEQ ID NO: 1876142 - RNA, 19 nt, Human herpesvirus 4 (Epstein-Barr virus)
gccugagcugccuggugag

SEQ ID NO: 1876143 - RNA, 18 nt, Human herpesvirus 4 (Epstein-Barr virus)
gugauggguggagaggcc

SEQ ID NO: 1876144 - RNA, 17 nt, Human herpesvirus 4 (Epstein-Barr virus)
cugacggaaaucugcuc

SEQ ID NO: 1876145 - RNA, 19 nt, Human herpesvirus 4 (Epstein-Barr virus)
cuucccagcuaguagcccu

SEQ ID NO: 1876146 - RNA, 16 nt, Human herpesvirus 4 (Epstein-Barr virus)
gaaacacagcucuggc

SEQ ID NO: 1876147 - RNA, 22 nt, Human herpesvirus 4 (Epstein-Barr virus)
caccuguguccugggcaaggag

SEQ ID NO: 1876148 - RNA, 13 nt, Human herpesvirus 4 (Epstein-Barr virus)
caugagggcaccg

SEQ ID NO: 1876149 - RNA, 16 nt, Human herpesvirus 4 (Epstein-Barr virus)
ggaggugcugaggccc

SEQ ID NO: 1876150 - RNA, 22 nt, Human herpesvirus 4 (Epstein-Barr virus)
ggaggaugaagauccaacuccg

SEQ ID NO: 1876151 - RNA, 23 nt, Human herpesvirus 4 (Epstein-Barr virus)
guacccuuucuaccaggggcgag

SEQ ID NO: 1876152 - RNA, 16 nt, Human herpesvirus 4 (Epstein-Barr virus)
aucagacggggaggug

SEQ ID NO: 1876153 - RNA, 17 nt, Human herpesvirus 4 (Epstein-Barr virus)
acgccccgaaagcggcc

SEQ ID NO: 1876154 - RNA, 15 nt, Human herpesvirus 4 (Epstein-Barr virus)
auugguugaucuccu

SEQ ID NO: 1876155 - RNA, 19 nt, Human herpesvirus 4 (Epstein-Barr virus)
uacaucccauaccuacacc

SEQ ID NO: 1876156 - RNA, 13 nt, Human herpesvirus 4 (Epstein-Barr virus)
aucuggcucuccu

SEQ ID NO: 1876157 - RNA, 18 nt, Human herpesvirus 4 (Epstein-Barr virus)
agcugugugcgcgccgcc

SEQ ID NO: 1876158 - RNA, 15 nt, Human herpesvirus 4 (Epstein-Barr virus)
uaaccuaugccugga

SEQ ID NO: 1876159 - RNA, 16 nt, Human herpesvirus 4 (Epstein-Barr virus)
cucuggcugugcugac

SEQ ID NO: 1876160 - RNA, 17 nt, Human herpesvirus 4 (Epstein-Barr virus)
ggcuacaacaggcugcu

SEQ ID NO: 1876161 - RNA, 19 nt, Human herpesvirus 4 (Epstein-Barr virus)
aggccgcugccaggccgcc

SEQ ID NO: 1876162 - RNA, 17 nt, Human herpesvirus 4 (Epstein-Barr virus)
uccaggcccccgggugg

SEQ ID NO: 1876163 - RNA, 22 nt, Human herpesvirus 4 (Epstein-Barr virus)
ggcaucguuugugauucccaga

SEQ ID NO: 1876164 - RNA, 23 nt, Human herpesvirus 4 (Epstein-Barr virus)
ugacggugggcaugacacaggac

SEQ ID NO: 1876165 - RNA, 21 nt, Human herpesvirus 4 (Epstein-Barr virus)
agccgcuucagacagccgcgg

SEQ ID NO: 1876166 - RNA, 16 nt, Human herpesvirus 4 (Epstein-Barr virus)
cacccaggcagccuug

SEQ ID NO: 1876167 - RNA, 19 nt, Human herpesvirus 4 (Epstein-Barr virus)
uggaguuuuacggggggca

SEQ ID NO: 1876168 - RNA, 20 nt, Human herpesvirus 4 (Epstein-Barr virus)
caaccgccgugucagcugug

SEQ ID NO: 1876169 - RNA, 19 nt, Human herpesvirus 4 (Epstein-Barr virus)
accuuuugucuccccucug

SEQ ID NO: 1876170 - RNA, 23 nt, Human herpesvirus 4 (Epstein-Barr virus)
cagggccggaaccugagccugag

SEQ ID NO: 1876171 - RNA, 14 nt, Human herpesvirus 4 (Epstein-Barr virus)
cuagaagugcuggg

SEQ ID NO: 1876172 - RNA, 19 nt, Human herpesvirus 4 (Epstein-Barr virus)
acuaaaguuggucaggcug

SEQ ID NO: 1876173 - RNA, 16 nt, Human herpesvirus 4 (Epstein-Barr virus)
ccucgcucagcccacu

SEQ ID NO: 1876174 - RNA, 19 nt, Human herpesvirus 4 (Epstein-Barr virus)
cagugucccugcugcccau

SEQ ID NO: 1876175 - RNA, 16 nt, Human herpesvirus 4 (Epstein-Barr virus)
aaaggcgcaguccgcc

SEQ ID NO: 1876176 - RNA, 15 nt, Human herpesvirus 4 (Epstein-Barr virus)
acucggccacacagu

SEQ ID NO: 1876177 - RNA, 16 nt, Human herpesvirus 4 (Epstein-Barr virus)
ggccucucuggcugug

SEQ ID NO: 1876178 - RNA, 16 nt, Human herpesvirus 4 (Epstein-Barr virus)
cuucagggaaaaacug

SEQ ID NO: 1876179 - RNA, 21 nt, Human herpesvirus 4 (Epstein-Barr virus)
accacucaggaagcuggccag

SEQ ID NO: 1876180 - RNA, 20 nt, Human herpesvirus 4 (Epstein-Barr virus)
ccuuuaggcguaacuugucu

SEQ ID NO: 1876181 - RNA, 21 nt, Human herpesvirus 4 (Epstein-Barr virus)
ggcgucaggagacacggcucu

SEQ ID NO: 1876182 - RNA, 22 nt, Human herpesvirus 4 (Epstein-Barr virus)
guacaacuaccugucugauugc

SEQ ID NO: 1876183 - RNA, 13 nt, Human herpesvirus 4 (Epstein-Barr virus)
augaacccugggg

SEQ ID NO: 1876184 - RNA, 22 nt, Human herpesvirus 4 (Epstein-Barr virus)
ccucuggcacgccguggcccug

SEQ ID NO: 1876185 - RNA, 17 nt, Human herpesvirus 4 (Epstein-Barr virus)
cagcuccagggccagca

SEQ ID NO: 1876186 - RNA, 14 nt, Human herpesvirus 4 (Epstein-Barr virus)
guccgcugggccag

SEQ ID NO: 1876187 - RNA, 16 nt, Human herpesvirus 4 (Epstein-Barr virus)
caccggggaggccagg

SEQ ID NO: 1876188 - RNA, 19 nt, Human herpesvirus 4 (Epstein-Barr virus)
ggcuggaugcccucaugcg

SEQ ID NO: 1876189 - RNA, 17 nt, Human herpesvirus 4 (Epstein-Barr virus)
uaucccaaauaaauguu

SEQ ID NO: 1876190 - RNA, 13 nt, Human herpesvirus 4 (Epstein-Barr virus)
agagggaaaagag

SEQ ID NO: 1876191 - RNA, 12 nt, Human herpesvirus 4 (Epstein-Barr virus)
ccaccuggccac

SEQ ID NO: 1876192 - RNA, 20 nt, Human herpesvirus 4 (Epstein-Barr virus)
ccugagccacacccaccuau

SEQ ID NO: 1876193 - RNA, 15 nt, Human herpesvirus 4 (Epstein-Barr virus)
cgugcauggcagcag

SEQ ID NO: 1876194 - RNA, 16 nt, Human herpesvirus 4 (Epstein-Barr virus)
aacacucuuuuuucaa

SEQ ID NO: 1876195 - RNA, 13 nt, Human herpesvirus 4 (Epstein-Barr virus)
uaugcagucucaa

SEQ ID NO: 1876196 - RNA, 15 nt, Human herpesvirus 4 (Epstein-Barr virus)
agcucuaacuuggca

SEQ ID NO: 1876197 - RNA, 14 nt, Human herpesvirus 4 (Epstein-Barr virus)
auguccuguggugu

SEQ ID NO: 1876198 - RNA, 14 nt, Human herpesvirus 4 (Epstein-Barr virus)
cuacguguccaugu

SEQ ID NO: 1876199 - RNA, 19 nt, Human herpesvirus 4 (Epstein-Barr virus)
cuaggagaaggagccucgc

SEQ ID NO: 1876200 - RNA, 16 nt, Human herpesvirus 4 (Epstein-Barr virus)
ggucagacggccgcgc

SEQ ID NO: 1876201 - RNA, 14 nt, Human herpesvirus 4 (Epstein-Barr virus)
agcgcggcagaggc

SEQ ID NO: 1876202 - RNA, 17 nt, Human herpesvirus 4 (Epstein-Barr virus)
caagcaaacggccuggc

SEQ ID NO: 1876203 - RNA, 13 nt, Human herpesvirus 4 (Epstein-Barr virus)
ucuggugaaacug

SEQ ID NO: 1876204 - RNA, 20 nt, Human herpesvirus 4 (Epstein-Barr virus)
ucagcaucaaugucaaggcu

SEQ ID NO: 1876205 - RNA, 19 nt, Human herpesvirus 4 (Epstein-Barr virus)
gauaggggauuccugucca

SEQ ID NO: 1876206 - RNA, 22 nt, Human herpesvirus 4 (Epstein-Barr virus)
cagacacauucgggugaaggcu

SEQ ID NO: 1876207 - RNA, 15 nt, Human herpesvirus 4 (Epstein-Barr virus)
gucugcugccaugca

SEQ ID NO: 1876208 - RNA, 16 nt, Human herpesvirus 4 (Epstein-Barr virus)
ccaggucuugccgugg

SEQ ID NO: 1876209 - RNA, 18 nt, Human herpesvirus 4 (Epstein-Barr virus)
ccuggcggcccagcccga

SEQ ID NO: 1876210 - RNA, 18 nt, Human herpesvirus 4 (Epstein-Barr virus)
caugcuccuauggacacu

SEQ ID NO: 1876211 - RNA, 20 nt, Human herpesvirus 4 (Epstein-Barr virus)
gcacaaaggaaacugcugac

SEQ ID NO: 1876212 - RNA, 12 nt, Human herpesvirus 4 (Epstein-Barr virus)
caagggaagagg

SEQ ID NO: 1876213 - RNA, 16 nt, Human herpesvirus 4 (Epstein-Barr virus)
ggagucggugggcggu

SEQ ID NO: 1876214 - RNA, 16 nt, Human herpesvirus 4 (Epstein-Barr virus)
cuacgcgggccacagg

SEQ ID NO: 1876215 - RNA, 13 nt, Human herpesvirus 4 (Epstein-Barr virus)
ccuccuggccagc

SEQ ID NO: 1876216 - RNA, 16 nt, Human herpesvirus 4 (Epstein-Barr virus)
cagggcccguuccagg

SEQ ID NO: 1876217 - RNA, 12 nt, Human herpesvirus 4 (Epstein-Barr virus)
gggugggugcaa

SEQ ID NO: 1876218 - RNA, 22 nt, Human herpesvirus 4 (Epstein-Barr virus)
gucauuuauuaggcacaaacuu

SEQ ID NO: 1876219 - RNA, 21 nt, Human herpesvirus 4 (Epstein-Barr virus)
gguaaggcucuucgggcaaga

SEQ ID NO: 1876220 - RNA, 15 nt, Human herpesvirus 4 (Epstein-Barr virus)
aacaaugugaaccuu

SEQ ID NO: 1876221 - RNA, 17 nt, Human herpesvirus 4 (Epstein-Barr virus)
aguccaggggccacaca

SEQ ID NO: 1876222 - RNA, 22 nt, Human herpesvirus 4 (Epstein-Barr virus)
aggcuguugacaugagcaugga

SEQ ID NO: 1876223 - RNA, 16 nt, Human herpesvirus 4 (Epstein-Barr virus)
gcucccccuggacacu

SEQ ID NO: 1876224 - RNA, 23 nt, Human herpesvirus 4 (Epstein-Barr virus)
ucaugcgugaccaccuggccagg

SEQ ID NO: 1876225 - RNA, 18 nt, Human herpesvirus 4 (Epstein-Barr virus)
cugccgggaggugcuggg

SEQ ID NO: 1876226 - RNA, 23 nt, Human herpesvirus 4 (Epstein-Barr virus)
cgaggaggcggaagaccaggagc

SEQ ID NO: 1876227 - RNA, 20 nt, Human herpesvirus 4 (Epstein-Barr virus)
gcagaaucaccagagcccag

SEQ ID NO: 1876228 - RNA, 14 nt, Human herpesvirus 4 (Epstein-Barr virus)
cugcuaagccagga

SEQ ID NO: 1876229 - RNA, 17 nt, Human herpesvirus 4 (Epstein-Barr virus)
uacaucccauaccuaca

SEQ ID NO: 1876230 - RNA, 13 nt, Human herpesvirus 4 (Epstein-Barr virus)
cucaaccgccagg

SEQ ID NO: 1876231 - RNA, 21 nt, Human herpesvirus 4 (Epstein-Barr virus)
cccuuucuaccaggggcgagc

SEQ ID NO: 1876232 - RNA, 20 nt, Human herpesvirus 4 (Epstein-Barr virus)
accagcccuuuuuccagugg

SEQ ID NO: 1876233 - RNA, 19 nt, Human herpesvirus 4 (Epstein-Barr virus)
ccucgguggccugcucacc

SEQ ID NO: 1876234 - RNA, 11 nt, Human herpesvirus 4 (Epstein-Barr virus)
cacccccacca

SEQ ID NO: 1876235 - RNA, 18 nt, Human herpesvirus 4 (Epstein-Barr virus)
ggugccaaugggcgcggg

SEQ ID NO: 1876236 - RNA, 14 nt, Human herpesvirus 4 (Epstein-Barr virus)
cuucuggaacauuu

SEQ ID NO: 1876237 - RNA, 16 nt, Human herpesvirus 4 (Epstein-Barr virus)
cagggcaaagccacaa

SEQ ID NO: 1876238 - RNA, 21 nt, Human herpesvirus 4 (Epstein-Barr virus)
agccucugccacaaggccagc

SEQ ID NO: 1876239 - RNA, 14 nt, Human herpesvirus 4 (Epstein-Barr virus)
cagcuccagggcca

SEQ ID NO: 1876240 - RNA, 12 nt, Human herpesvirus 4 (Epstein-Barr virus)
guucuccugauu

SEQ ID NO: 1876241 - RNA, 23 nt, Human herpesvirus 4 (Epstein-Barr virus)
gcagccuugcguggugcuguccu

SEQ ID NO: 1876242 - RNA, 17 nt, Human herpesvirus 4 (Epstein-Barr virus)
ccaguuccccccagccu

SEQ ID NO: 1876243 - RNA, 22 nt, Human herpesvirus 4 (Epstein-Barr virus)
cucuggucgcccccucugccuc

SEQ ID NO: 1876244 - RNA, 20 nt, Human herpesvirus 4 (Epstein-Barr virus)
uguccucccuaaccgccugg

SEQ ID NO: 1876245 - RNA, 18 nt, Human herpesvirus 4 (Epstein-Barr virus)
cgggggcgacugccgccg

SEQ ID NO: 1876246 - RNA, 12 nt, Human herpesvirus 4 (Epstein-Barr virus)
cgucaggagggc

SEQ ID NO: 1876247 - RNA, 16 nt, Human herpesvirus 4 (Epstein-Barr virus)
aguaggugccuccaga

SEQ ID NO: 1876248 - RNA, 23 nt, Human herpesvirus 4 (Epstein-Barr virus)
agacguguguggcuguagccacc

SEQ ID NO: 1876249 - RNA, 23 nt, Human herpesvirus 4 (Epstein-Barr virus)
gaggcguguggaaguacgagauc

SEQ ID NO: 1876250 - RNA, 17 nt, Human herpesvirus 4 (Epstein-Barr virus)
cagggcccuggucaggg

SEQ ID NO: 1876251 - RNA, 23 nt, Human herpesvirus 4 (Epstein-Barr virus)
acaggcccucgagccauuugagg

SEQ ID NO: 1876252 - RNA, 14 nt, Human herpesvirus 4 (Epstein-Barr virus)
ggaggccagguagc

SEQ ID NO: 1876253 - RNA, 18 nt, Human herpesvirus 4 (Epstein-Barr virus)
ccauaccuacaccacccc

SEQ ID NO: 1876254 - RNA, 21 nt, Human herpesvirus 4 (Epstein-Barr virus)
ccuugggugaccuggccaggc

SEQ ID NO: 1876255 - RNA, 17 nt, Human herpesvirus 4 (Epstein-Barr virus)
ucaccugcacagaucug

SEQ ID NO: 1876256 - RNA, 16 nt, Human herpesvirus 4 (Epstein-Barr virus)
cugcaccggagccugc

SEQ ID NO: 1876257 - RNA, 19 nt, Human herpesvirus 4 (Epstein-Barr virus)
cucugauuauagcucuggc

SEQ ID NO: 1876258 - RNA, 21 nt, Human herpesvirus 4 (Epstein-Barr virus)
agaaguuaccugguauuucug

SEQ ID NO: 1876259 - RNA, 14 nt, Human herpesvirus 4 (Epstein-Barr virus)
aucaccccgagucc

SEQ ID NO: 1876260 - RNA, 22 nt, Human herpesvirus 4 (Epstein-Barr virus)
uccaacauuaaagccuccucgc

SEQ ID NO: 1876261 - RNA, 18 nt, Human herpesvirus 4 (Epstein-Barr virus)
uucccucgaaucccuacc

SEQ ID NO: 1876262 - RNA, 20 nt, Human herpesvirus 4 (Epstein-Barr virus)
ugcuggagauuuucccacug

SEQ ID NO: 1876263 - RNA, 21 nt, Human herpesvirus 4 (Epstein-Barr virus)
ggccgagcagggacuggcggc

SEQ ID NO: 1876264 - RNA, 15 nt, Human herpesvirus 4 (Epstein-Barr virus)
gguggugggcugcug

SEQ ID NO: 1876265 - RNA, 17 nt, Human herpesvirus 4 (Epstein-Barr virus)
ccuuggaacugacgggc

SEQ ID NO: 1876266 - RNA, 18 nt, Human herpesvirus 4 (Epstein-Barr virus)
gcucaggccaugcgcgcc

SEQ ID NO: 1876267 - RNA, 13 nt, Human herpesvirus 4 (Epstein-Barr virus)
agcuggccaggcu

SEQ ID NO: 1876268 - RNA, 19 nt, Human herpesvirus 4 (Epstein-Barr virus)
guuuauggcauaaugggag

SEQ ID NO: 1876269 - RNA, 23 nt, Human herpesvirus 4 (Epstein-Barr virus)
caucucgcuggcucgccucaucc

SEQ ID NO: 1876270 - RNA, 15 nt, Human herpesvirus 4 (Epstein-Barr virus)
guguacgugccucag

SEQ ID NO: 1876271 - RNA, 14 nt, Human herpesvirus 4 (Epstein-Barr virus)
gccgcugccaggcc

SEQ ID NO: 1876272 - RNA, 20 nt, Human herpesvirus 4 (Epstein-Barr virus)
gccaaccugcucucucugga

SEQ ID NO: 1876273 - RNA, 17 nt, Human herpesvirus 4 (Epstein-Barr virus)
guggccucuacgccagg

SEQ ID NO: 1876274 - RNA, 15 nt, Human herpesvirus 4 (Epstein-Barr virus)
uacauuccaguuucc

SEQ ID NO: 1876275 - RNA, 12 nt, Human herpesvirus 4 (Epstein-Barr virus)
cagauuucuagu

SEQ ID NO: 1876276 - RNA, 14 nt, Human herpesvirus 4 (Epstein-Barr virus)
ucaugcgugaccac

SEQ ID NO: 1876277 - RNA, 18 nt, Human herpesvirus 4 (Epstein-Barr virus)
ugcuucuaccaagacucc

SEQ ID NO: 1876278 - RNA, 13 nt, Human herpesvirus 4 (Epstein-Barr virus)
gagccgggggcau

SEQ ID NO: 1876279 - RNA, 22 nt, Human herpesvirus 4 (Epstein-Barr virus)
caguagccgaauaucuggaggu

SEQ ID NO: 1876280 - RNA, 16 nt, Human herpesvirus 4 (Epstein-Barr virus)
auaaauaucuuccugu

SEQ ID NO: 1876281 - RNA, 20 nt, Human herpesvirus 4 (Epstein-Barr virus)
cuccuacacacaucagaccu

SEQ ID NO: 1876282 - RNA, 14 nt, Human herpesvirus 4 (Epstein-Barr virus)
uagugcagggggcu

SEQ ID NO: 1876283 - RNA, 22 nt, Human herpesvirus 4 (Epstein-Barr virus)
cagugggccucucuggcugugc

SEQ ID NO: 1876284 - RNA, 13 nt, Human herpesvirus 4 (Epstein-Barr virus)
acugcgaaaauuc

SEQ ID NO: 1876285 - RNA, 16 nt, Human herpesvirus 4 (Epstein-Barr virus)
caucauaacugagcag

SEQ ID NO: 1876286 - RNA, 23 nt, Human herpesvirus 4 (Epstein-Barr virus)
agagcuccgccaccuccgggggc

SEQ ID NO: 1876287 - RNA, 14 nt, Human herpesvirus 4 (Epstein-Barr virus)
uugcuauucaauca

SEQ ID NO: 1876288 - RNA, 18 nt, Human herpesvirus 4 (Epstein-Barr virus)
cauuuuuagccccagccc

SEQ ID NO: 1876289 - RNA, 21 nt, Human herpesvirus 4 (Epstein-Barr virus)
cucucuggcugugcugacccu

SEQ ID NO: 1876290 - RNA, 19 nt, Human herpesvirus 4 (Epstein-Barr virus)
cgugcaugcagcgcccugu

SEQ ID NO: 1876291 - RNA, 13 nt, Human herpesvirus 4 (Epstein-Barr virus)
ggggcggcagcgg

SEQ ID NO: 1876292 - RNA, 21 nt, Human herpesvirus 4 (Epstein-Barr virus)
cacugauaauacgcccgacaa

SEQ ID NO: 1876293 - RNA, 21 nt, Human herpesvirus 4 (Epstein-Barr virus)
ccugucucucuuugagggggc

SEQ ID NO: 1876294 - RNA, 17 nt, Human herpesvirus 4 (Epstein-Barr virus)
cacggggccgugcaccu

SEQ ID NO: 1876295 - RNA, 21 nt, Human herpesvirus 4 (Epstein-Barr virus)
uggcacacauuacggugcugg

SEQ ID NO: 1876296 - RNA, 15 nt, Human herpesvirus 4 (Epstein-Barr virus)
ccucagaggaggagg

SEQ ID NO: 1876297 - RNA, 19 nt, Human herpesvirus 4 (Epstein-Barr virus)
cgagggugaggcccagccc

SEQ ID NO: 1876298 - RNA, 15 nt, Human herpesvirus 4 (Epstein-Barr virus)
guggaccucaaagaa

SEQ ID NO: 1876299 - RNA, 10 nt, Human herpesvirus 4 (Epstein-Barr virus)
aggccgccgc

SEQ ID NO: 1876300 - RNA, 15 nt, Human herpesvirus 4 (Epstein-Barr virus)
gcagaugaggccccu

SEQ ID NO: 1876301 - RNA, 13 nt, Human herpesvirus 4 (Epstein-Barr virus)
cgcccccucugcc

SEQ ID NO: 1876302 - RNA, 19 nt, Human herpesvirus 4 (Epstein-Barr virus)
cgugaccaccuggccaggg

SEQ ID NO: 1876303 - RNA, 21 nt, Human herpesvirus 4 (Epstein-Barr virus)
uagaauuguuaguuuaaacag

SEQ ID NO: 1876304 - RNA, 22 nt, Human herpesvirus 4 (Epstein-Barr virus)
augcuguugaggcaaaagacua

SEQ ID NO: 1876305 - RNA, 21 nt, Human herpesvirus 4 (Epstein-Barr virus)
cagcucggccagcaggccggc

SEQ ID NO: 1876306 - RNA, 20 nt, Human herpesvirus 4 (Epstein-Barr virus)
uggggaguuagcauuggcgu

SEQ ID NO: 1876307 - RNA, 13 nt, Human herpesvirus 4 (Epstein-Barr virus)
gcaagcagcaccu

SEQ ID NO: 1876308 - RNA, 21 nt, Human herpesvirus 4 (Epstein-Barr virus)
ggcgucgggaaacacagcucu

SEQ ID NO: 1876309 - RNA, 18 nt, Human herpesvirus 4 (Epstein-Barr virus)
guagccuugggggccugg

SEQ ID NO: 1876310 - RNA, 21 nt, Human herpesvirus 4 (Epstein-Barr virus)
agaugauaaugaugaggagca

SEQ ID NO: 1876311 - RNA, 18 nt, Human herpesvirus 4 (Epstein-Barr virus)
gcgcccugucaccaggcc

SEQ ID NO: 1876312 - RNA, 24 nt, Human herpesvirus 4 (Epstein-Barr virus)
ccgcaccccccgccaccacggugc

SEQ ID NO: 1876313 - RNA, 17 nt, Human herpesvirus 4 (Epstein-Barr virus)
ccgguccccccagaagc

SEQ ID NO: 1876314 - RNA, 23 nt, Human herpesvirus 4 (Epstein-Barr virus)
auagcgugaagucgguguccagg

SEQ ID NO: 1876315 - RNA, 15 nt, Human herpesvirus 4 (Epstein-Barr virus)
cagaugcagugggug

SEQ ID NO: 1876316 - RNA, 18 nt, Human herpesvirus 4 (Epstein-Barr virus)
ggcugcucccgccucagg

SEQ ID NO: 1876317 - RNA, 17 nt, Human herpesvirus 4 (Epstein-Barr virus)
ugacccuucugcugcug

SEQ ID NO: 1876318 - RNA, 22 nt, Human herpesvirus 4 (Epstein-Barr virus)
agggcucaccagggaggccugg

SEQ ID NO: 1876319 - RNA, 17 nt, Human herpesvirus 4 (Epstein-Barr virus)
aggggccucggccuggg

SEQ ID NO: 1876320 - RNA, 17 nt, Human herpesvirus 4 (Epstein-Barr virus)
cugccuggaucugagcu

SEQ ID NO: 1876321 - RNA, 18 nt, Human herpesvirus 4 (Epstein-Barr virus)
gaugcauacgcugaguga

SEQ ID NO: 1876322 - RNA, 17 nt, Human herpesvirus 4 (Epstein-Barr virus)
guagaggcgcgggucug

SEQ ID NO: 1876323 - RNA, 16 nt, Human herpesvirus 4 (Epstein-Barr virus)
gccacugcaggcugga

SEQ ID NO: 1876324 - RNA, 22 nt, Human herpesvirus 4 (Epstein-Barr virus)
ugucucuuucuggccaaccugc

SEQ ID NO: 1876325 - RNA, 14 nt, Human herpesvirus 4 (Epstein-Barr virus)
uggguccccucugc

SEQ ID NO: 1876326 - RNA, 14 nt, Human herpesvirus 4 (Epstein-Barr virus)
agacaccuggccca

SEQ ID NO: 1876327 - RNA, 22 nt, Human herpesvirus 4 (Epstein-Barr virus)
caggguuucuaggacgcugucc

SEQ ID NO: 1876328 - RNA, 20 nt, Human herpesvirus 4 (Epstein-Barr virus)
gcacaucuggcaccuguccu

SEQ ID NO: 1876329 - RNA, 21 nt, Human herpesvirus 4 (Epstein-Barr virus)
caggugcccgagccccgccug

SEQ ID NO: 1876330 - RNA, 15 nt, Human herpesvirus 4 (Epstein-Barr virus)
ucaaggcagucucca

SEQ ID NO: 1876331 - RNA, 18 nt, Human herpesvirus 4 (Epstein-Barr virus)
cagagagccacauucugg

SEQ ID NO: 1876332 - RNA, 19 nt, Human herpesvirus 4 (Epstein-Barr virus)
ccugaagcuugcuggggcg

SEQ ID NO: 1876333 - RNA, 17 nt, Human herpesvirus 4 (Epstein-Barr virus)
auacaugucucagaggc

SEQ ID NO: 1876334 - RNA, 18 nt, Human herpesvirus 4 (Epstein-Barr virus)
aaguacgagaucuucccc

SEQ ID NO: 1876335 - RNA, 18 nt, Human herpesvirus 4 (Epstein-Barr virus)
cgugguuuucugccccuc

SEQ ID NO: 1876336 - RNA, 21 nt, Human herpesvirus 4 (Epstein-Barr virus)
caggauguucacgugggcccc

SEQ ID NO: 1876337 - RNA, 16 nt, Human herpesvirus 4 (Epstein-Barr virus)
gacucaggcccucauu

SEQ ID NO: 1876338 - RNA, 17 nt, Human herpesvirus 4 (Epstein-Barr virus)
ccacggccguagcccag

SEQ ID NO: 1876339 - RNA, 23 nt, Human herpesvirus 4 (Epstein-Barr virus)
cucagagggggugccugugccuc

SEQ ID NO: 1876340 - RNA, 16 nt, Human herpesvirus 4 (Epstein-Barr virus)
cguuaacauggacaug

SEQ ID NO: 1876341 - RNA, 19 nt, Human herpesvirus 4 (Epstein-Barr virus)
cugaccucccgcccugagc

SEQ ID NO: 1876342 - RNA, 16 nt, Human herpesvirus 4 (Epstein-Barr virus)
ugucucggccuccugg

SEQ ID NO: 1876343 - RNA, 18 nt, Human herpesvirus 4 (Epstein-Barr virus)
gccuuccucugccuggcc

SEQ ID NO: 1876344 - RNA, 16 nt, Human herpesvirus 4 (Epstein-Barr virus)
ccuggcuccccauaga

SEQ ID NO: 1876345 - RNA, 16 nt, Human herpesvirus 4 (Epstein-Barr virus)
ugcccagggcagacug

SEQ ID NO: 1876346 - RNA, 14 nt, Human herpesvirus 4 (Epstein-Barr virus)
gugcagggggcucg

SEQ ID NO: 1876347 - RNA, 20 nt, Human herpesvirus 4 (Epstein-Barr virus)
cauuggcugcaaagggaccc

SEQ ID NO: 1876348 - RNA, 13 nt, Human herpesvirus 4 (Epstein-Barr virus)
ccacucagacucu

SEQ ID NO: 1876349 - RNA, 20 nt, Human herpesvirus 4 (Epstein-Barr virus)
gcucccgggcaaacagggca

SEQ ID NO: 1876350 - RNA, 19 nt, Human herpesvirus 4 (Epstein-Barr virus)
ggucagugauggaaagguu

SEQ ID NO: 1876351 - RNA, 14 nt, Human herpesvirus 4 (Epstein-Barr virus)
cuacgcagaggcca

SEQ ID NO: 1876352 - RNA, 21 nt, Human herpesvirus 4 (Epstein-Barr virus)
gugggcgcgugcacauauacc

SEQ ID NO: 1876353 - RNA, 18 nt, Human herpesvirus 4 (Epstein-Barr virus)
ggcauguguacuuguccu

SEQ ID NO: 1876354 - RNA, 15 nt, Human herpesvirus 4 (Epstein-Barr virus)
gcaccggagccacca

SEQ ID NO: 1876355 - RNA, 20 nt, Human herpesvirus 4 (Epstein-Barr virus)
acccuugcccucuccagcaa

SEQ ID NO: 1876356 - RNA, 13 nt, Human herpesvirus 4 (Epstein-Barr virus)
uaacaggacaugu

SEQ ID NO: 1876357 - RNA, 21 nt, Human herpesvirus 4 (Epstein-Barr virus)
agauagccacccgcuguauga

SEQ ID NO: 1876358 - RNA, 19 nt, Human herpesvirus 4 (Epstein-Barr virus)
ucccaccaccccccccacc

SEQ ID NO: 1876359 - RNA, 23 nt, Human herpesvirus 4 (Epstein-Barr virus)
cuuccagacuaugcauacacuga

SEQ ID NO: 1876360 - RNA, 20 nt, Human herpesvirus 4 (Epstein-Barr virus)
cccagggcagacugcacagg

SEQ ID NO: 1876361 - RNA, 20 nt, Human herpesvirus 4 (Epstein-Barr virus)
cagaguucccggcugcuccc

SEQ ID NO: 1876362 - RNA, 17 nt, Human herpesvirus 4 (Epstein-Barr virus)
cuccagccacggcgacc

SEQ ID NO: 1876363 - RNA, 14 nt, Human herpesvirus 4 (Epstein-Barr virus)
ccgccgccgcagcc

SEQ ID NO: 1876364 - RNA, 21 nt, Human herpesvirus 4 (Epstein-Barr virus)
uccuugggugaccuggccagg

SEQ ID NO: 1876365 - RNA, 23 nt, Human herpesvirus 4 (Epstein-Barr virus)
guacugcagugggccucucuggc

SEQ ID NO: 1876366 - RNA, 21 nt, Human herpesvirus 4 (Epstein-Barr virus)
uucuggcgauuuuaaucugga

SEQ ID NO: 1876367 - RNA, 21 nt, Human herpesvirus 4 (Epstein-Barr virus)
ucugcgccagccccgcccucc

SEQ ID NO: 1876368 - RNA, 23 nt, Human herpesvirus 4 (Epstein-Barr virus)
cugguacguuggcuucugcugcu

SEQ ID NO: 1876369 - RNA, 18 nt, Human herpesvirus 4 (Epstein-Barr virus)
agaggaugaggcugauga

SEQ ID NO: 1876370 - RNA, 22 nt, Human herpesvirus 4 (Epstein-Barr virus)
cuggccggcuaucugcuucugg

SEQ ID NO: 1876371 - RNA, 14 nt, Human herpesvirus 4 (Epstein-Barr virus)
agguccaucccgga

SEQ ID NO: 1876372 - RNA, 13 nt, Human herpesvirus 4 (Epstein-Barr virus)
gaauccgcgcagc

SEQ ID NO: 1876373 - RNA, 21 nt, Human herpesvirus 4 (Epstein-Barr virus)
ccuccaccgccgguuaacuuu

SEQ ID NO: 1876374 - RNA, 15 nt, Human herpesvirus 4 (Epstein-Barr virus)
cacaacuaccaggca

SEQ ID NO: 1876375 - RNA, 19 nt, Human herpesvirus 4 (Epstein-Barr virus)
ccuguggagauuaggggua

SEQ ID NO: 1876376 - RNA, 14 nt, Human herpesvirus 4 (Epstein-Barr virus)
ggagucuggacgug

SEQ ID NO: 1876377 - RNA, 19 nt, Human herpesvirus 4 (Epstein-Barr virus)
aggcccccggcuggccgcc

SEQ ID NO: 1876378 - RNA, 20 nt, Human herpesvirus 4 (Epstein-Barr virus)
aggaagcuggccaggcuggu

SEQ ID NO: 1876379 - RNA, 21 nt, Human herpesvirus 4 (Epstein-Barr virus)
caggccgccaugcucagggcc

SEQ ID NO: 1876380 - RNA, 19 nt, Human herpesvirus 4 (Epstein-Barr virus)
ucgcgccccaucuuggccc

SEQ ID NO: 1876381 - RNA, 15 nt, Human herpesvirus 4 (Epstein-Barr virus)
cuccaggcuccugga

SEQ ID NO: 1876382 - RNA, 15 nt, Human herpesvirus 4 (Epstein-Barr virus)
cccucugccuccggc

SEQ ID NO: 1876383 - RNA, 19 nt, Human herpesvirus 4 (Epstein-Barr virus)
ccaggcccccgggugggcu

SEQ ID NO: 1876384 - RNA, 17 nt, Human herpesvirus 4 (Epstein-Barr virus)
ggggaggagaagagagg

SEQ ID NO: 1876385 - RNA, 22 nt, Human herpesvirus 4 (Epstein-Barr virus)
agguuugagaaucugggcuggg

SEQ ID NO: 1876386 - RNA, 17 nt, Human herpesvirus 4 (Epstein-Barr virus)
aagggcaccgugggaaa

SEQ ID NO: 1876387 - RNA, 19 nt, Human herpesvirus 4 (Epstein-Barr virus)
auuggggugauccuguagc

SEQ ID NO: 1876388 - RNA, 17 nt, Human herpesvirus 4 (Epstein-Barr virus)
acugugcacucucuccc

SEQ ID NO: 1876389 - RNA, 16 nt, Human herpesvirus 4 (Epstein-Barr virus)
gagggaaaaggcccua

SEQ ID NO: 1876390 - RNA, 14 nt, Human herpesvirus 4 (Epstein-Barr virus)
uguuuccagacacc

SEQ ID NO: 1876391 - RNA, 21 nt, Human herpesvirus 4 (Epstein-Barr virus)
cguccucgugagucugcugga

SEQ ID NO: 1876392 - RNA, 13 nt, Human herpesvirus 4 (Epstein-Barr virus)
cuggccagcaccc

SEQ ID NO: 1876393 - RNA, 16 nt, Human herpesvirus 4 (Epstein-Barr virus)
cugccccucagccugc

SEQ ID NO: 1876394 - RNA, 14 nt, Human herpesvirus 4 (Epstein-Barr virus)
cugccccucagccu

SEQ ID NO: 1876395 - RNA, 22 nt, Human herpesvirus 4 (Epstein-Barr virus)
guaaagaucuaccccagcugca

SEQ ID NO: 1876396 - RNA, 20 nt, Human herpesvirus 4 (Epstein-Barr virus)
gaccaccuacggcagccgcu

SEQ ID NO: 1876397 - RNA, 20 nt, Human herpesvirus 4 (Epstein-Barr virus)
ucucaaacggggaaggagga

SEQ ID NO: 1876398 - RNA, 14 nt, Human herpesvirus 4 (Epstein-Barr virus)
gaacccuagccacc

SEQ ID NO: 1876399 - RNA, 16 nt, Human herpesvirus 4 (Epstein-Barr virus)
ugccgucccagggccg

SEQ ID NO: 1876400 - RNA, 14 nt, Human herpesvirus 4 (Epstein-Barr virus)
gugucaauaauuuc

SEQ ID NO: 1876401 - RNA, 14 nt, Human herpesvirus 4 (Epstein-Barr virus)
cucaaggcagucuc

SEQ ID NO: 1876402 - RNA, 15 nt, Human herpesvirus 4 (Epstein-Barr virus)
uccaccaccuucacc

SEQ ID NO: 1876403 - RNA, 17 nt, Human herpesvirus 4 (Epstein-Barr virus)
gguguagugggugggca

SEQ ID NO: 1876404 - RNA, 13 nt, Human herpesvirus 4 (Epstein-Barr virus)
cccagccacagca

SEQ ID NO: 1876405 - RNA, 16 nt, Human herpesvirus 4 (Epstein-Barr virus)
ccuagguacucuuggu

SEQ ID NO: 1876406 - RNA, 15 nt, Human herpesvirus 4 (Epstein-Barr virus)
acaggaccuggaaau

SEQ ID NO: 1876407 - RNA, 16 nt, Human herpesvirus 4 (Epstein-Barr virus)
aaccaugccaucucug

SEQ ID NO: 1876408 - RNA, 19 nt, Human herpesvirus 4 (Epstein-Barr virus)
gugaggccugagagccggg

SEQ ID NO: 1876409 - RNA, 16 nt, Human herpesvirus 4 (Epstein-Barr virus)
gucgcguacucugugg

SEQ ID NO: 1876410 - RNA, 17 nt, Human herpesvirus 4 (Epstein-Barr virus)
augcucagggccacggc

SEQ ID NO: 1876411 - RNA, 21 nt, Human herpesvirus 4 (Epstein-Barr virus)
gagguccuggacgagggggcg

SEQ ID NO: 1876412 - RNA, 12 nt, Human herpesvirus 4 (Epstein-Barr virus)
ggucgggggcac

SEQ ID NO: 1876413 - RNA, 13 nt, Human herpesvirus 4 (Epstein-Barr virus)
gcagccagagcca

SEQ ID NO: 1876414 - RNA, 16 nt, Human herpesvirus 4 (Epstein-Barr virus)
ggcaaaggucccaggc

SEQ ID NO: 1876415 - RNA, 23 nt, Human herpesvirus 4 (Epstein-Barr virus)
ccagcgccuccucgcaggccccc

SEQ ID NO: 1876416 - RNA, 16 nt, Human herpesvirus 4 (Epstein-Barr virus)
ccccauagacucccau

SEQ ID NO: 1876417 - RNA, 21 nt, Human herpesvirus 4 (Epstein-Barr virus)
ggauggaagagaggggcaggg

SEQ ID NO: 1876418 - RNA, 16 nt, Human herpesvirus 4 (Epstein-Barr virus)
ucacagaccagccccu

SEQ ID NO: 1876419 - RNA, 11 nt, Human herpesvirus 4 (Epstein-Barr virus)
cacugacccau

SEQ ID NO: 1876420 - RNA, 19 nt, Human herpesvirus 4 (Epstein-Barr virus)
ccaggcagaugaggccccu

SEQ ID NO: 1876421 - RNA, 23 nt, Human herpesvirus 4 (Epstein-Barr virus)
gucuucugucucggccuccuggc

SEQ ID NO: 1876422 - RNA, 21 nt, Human herpesvirus 4 (Epstein-Barr virus)
gcggcagcggacgguggggcu

SEQ ID NO: 1876423 - RNA, 22 nt, Human herpesvirus 4 (Epstein-Barr virus)
ggcugggugggagagcgcggcc

SEQ ID NO: 1876424 - RNA, 17 nt, Human herpesvirus 4 (Epstein-Barr virus)
gaggcugcgccugagcu

SEQ ID NO: 1876425 - RNA, 15 nt, Human herpesvirus 4 (Epstein-Barr virus)
ucaaguaccagcugg

SEQ ID NO: 1876426 - RNA, 15 nt, Human herpesvirus 4 (Epstein-Barr virus)
ucccccuccauucca

SEQ ID NO: 1876427 - RNA, 13 nt, Human herpesvirus 4 (Epstein-Barr virus)
agagcgacgagga

SEQ ID NO: 1876428 - RNA, 22 nt, Human herpesvirus 4 (Epstein-Barr virus)
aucucugauuauagcucuggca

SEQ ID NO: 1876429 - RNA, 18 nt, Human herpesvirus 4 (Epstein-Barr virus)
uuagcagccuccgggccg

SEQ ID NO: 1876430 - RNA, 19 nt, Human herpesvirus 4 (Epstein-Barr virus)
ccaugacgcugcugcuacu

SEQ ID NO: 1876431 - RNA, 22 nt, Human herpesvirus 4 (Epstein-Barr virus)
caggaccuggaaauggccuagg

SEQ ID NO: 1876432 - RNA, 13 nt, Human herpesvirus 4 (Epstein-Barr virus)
ggcgcgggagccg

SEQ ID NO: 1876433 - RNA, 15 nt, Human herpesvirus 4 (Epstein-Barr virus)
ccacucuugccucgg

SEQ ID NO: 1876434 - RNA, 21 nt, Human herpesvirus 4 (Epstein-Barr virus)
ccaugucugggggacucuucu

SEQ ID NO: 1876435 - RNA, 23 nt, Human herpesvirus 4 (Epstein-Barr virus)
cacggcaccgucagccacacaau

SEQ ID NO: 1876436 - RNA, 14 nt, Human herpesvirus 4 (Epstein-Barr virus)
cugugcugacccuu

SEQ ID NO: 1876437 - RNA, 15 nt, Human herpesvirus 4 (Epstein-Barr virus)
cagcuccgcccucac

SEQ ID NO: 1876438 - RNA, 18 nt, Human herpesvirus 4 (Epstein-Barr virus)
gcagcuacacucuggggu

SEQ ID NO: 1876439 - RNA, 14 nt, Human herpesvirus 4 (Epstein-Barr virus)
gcccgagccccgcc

SEQ ID NO: 1876440 - RNA, 15 nt, Human herpesvirus 4 (Epstein-Barr virus)
gccugacugacucuc

SEQ ID NO: 1876441 - RNA, 19 nt, Human herpesvirus 4 (Epstein-Barr virus)
agaugcauacgcugaguga

SEQ ID NO: 1876442 - RNA, 14 nt, Human herpesvirus 4 (Epstein-Barr virus)
ggcgggcgggcuug

SEQ ID NO: 1876443 - RNA, 21 nt, Human herpesvirus 4 (Epstein-Barr virus)
aacacgcuuuugucugccugg

SEQ ID NO: 1876444 - RNA, 11 nt, Human
aaaaaauuggu

SEQ ID NO: 1876445 - RNA, 14 nt, Human
aaaaacacaaaagu

SEQ ID NO: 1876446 - RNA, 14 nt, Human
aaaaauugugauca

SEQ ID NO: 1876447 - RNA, 18 nt, Human
aaaaauugguucuuuauu

SEQ ID NO: 1876448 - RNA, 12 nt, Human
aaaaagaggcua

SEQ ID NO: 1876449 - RNA, 14 nt, Human
aaaaagacagggcu

SEQ ID NO: 1876450 - RNA, 16 nt, Human
aaaaagaugacccauu

SEQ ID NO: 1876451 - RNA, 15 nt, Human
aaaaacugauuuuuu

SEQ ID NO: 1876452 - RNA, 14 nt, Human
aaaaagaaguaggg

SEQ ID NO: 1876453 - RNA, 19 nt, Human
aaaaacuuugccagccauu

SEQ ID NO: 1876454 - RNA, 14 nt, Human
aaaaacauggccuu

SEQ ID NO: 1876455 - RNA, 13 nt, Human
aaaaacugauuuu

SEQ ID NO: 1876456 - RNA, 17 nt, Human
aaaacaagaaaguuucc

SEQ ID NO: 1876457 - RNA, 22 nt, Human
aaaacaacuauggaucagaaua

SEQ ID NO: 1876458 - RNA, 18 nt, Human
aaaacaagaaaguuuccc

SEQ ID NO: 1876459 - RNA, 12 nt, Human
aaaacacauuuu

SEQ ID NO: 1876460 - RNA, 21 nt, Human
aagucucucauucuaggccuc

SEQ ID NO: 1876461 - RNA, 17 nt, Human
aagucucuaacaaugua

SEQ ID NO: 1876462 - RNA, 19 nt, Human
aagucucuggaauuugaaa

SEQ ID NO: 1876463 - RNA, 16 nt, Human
aagucuuagauguaua

SEQ ID NO: 1876464 - RNA, 11 nt, Human
aaguacuucuu

SEQ ID NO: 1876465 - RNA, 15 nt, Human
aagguuuaggcuggu

SEQ ID NO: 1876466 - RNA, 19 nt, Human
aagguuuaggcugguggcc

SEQ ID NO: 1876467 - RNA, 20 nt, Human
aagguuuaggcugguggccc

SEQ ID NO: 1876468 - RNA, 21 nt, Human
aagguuuaggcugguggccca

SEQ ID NO: 1876469 - RNA, 14 nt, Human
aaguacuuuuggca

SEQ ID NO: 1876470 - RNA, 15 nt, Human
aaguacuuuuggcau

SEQ ID NO: 1876471 - RNA, 22 nt, Human
aagguuuaggcugguggcccag

SEQ ID NO: 1876472 - RNA, 23 nt, Human
aaguccaggcuuuuuuaucaugu

SEQ ID NO: 1876473 - RNA, 16 nt, Human
aaguaucccuacugua

SEQ ID NO: 1876474 - RNA, 15 nt, Human
aaguaugggaaauga

SEQ ID NO: 1876475 - RNA, 20 nt, Human
aagguuaauguucaucaucc

SEQ ID NO: 1876476 - RNA, 13 nt, Human
aagguuguauugc

SEQ ID NO: 1876477 - RNA, 17 nt, Human
aagguuguauugcauau

SEQ ID NO: 1876478 - RNA, 18 nt, Human
aagguuguuuugaaacug

SEQ ID NO: 1876479 - RNA, 15 nt, Human
aagguuaauaaagua

SEQ ID NO: 1876480 - RNA, 16 nt, Human
aagguuaauaaaguaa

SEQ ID NO: 1876481 - RNA, 11 nt, Human
aaggugggagg

SEQ ID NO: 1876482 - RNA, 18 nt, Human
aaggugcugacggccagg

SEQ ID NO: 1876483 - RNA, 13 nt, Human
aauaaacuaaaga

SEQ ID NO: 1876484 - RNA, 18 nt, Human
aauaaacuggcagcucag

SEQ ID NO: 1876485 - RNA, 19 nt, Human
aauaaacuauuuguaaagu

SEQ ID NO: 1876486 - RNA, 22 nt, Human
aauaaguuaacuauuuuauuuu

SEQ ID NO: 1876487 - RNA, 16 nt, Human
aauaaacgucuuaaau

SEQ ID NO: 1876488 - RNA, 17 nt, Human
aauaaacgucuuaaaua

SEQ ID NO: 1876489 - RNA, 17 nt, Human
aagugguauagaaaugc

SEQ ID NO: 1876490 - RNA, 13 nt, Human
aagugguauagaa

SEQ ID NO: 1876491 - RNA, 17 nt, Human
aaguggugguaacccug

SEQ ID NO: 1876492 - RNA, 18 nt, Human
aaguggugguaacccugg

SEQ ID NO: 1876493 - RNA, 15 nt, Human
aaguuguuaauaaaa

SEQ ID NO: 1876494 - RNA, 18 nt, Human
aaguuguucaaacauuua

SEQ ID NO: 1876495 - RNA, 21 nt, Human
aauaauccuaaacauaugaau

SEQ ID NO: 1876496 - RNA, 13 nt, Human
aauaaucuuauua

SEQ ID NO: 1876497 - RNA, 19 nt, Human
aauaaucuuauuagggaga

SEQ ID NO: 1876498 - RNA, 23 nt, Human
aauaaucuuauuagggagaaaau

SEQ ID NO: 1876499 - RNA, 13 nt, Human
aauaaucauugga

SEQ ID NO: 1876500 - RNA, 12 nt, Human
aauaauguaaga

SEQ ID NO: 1876501 - RNA, 19 nt, Human
aauaauguaagacaaauau

SEQ ID NO: 1876502 - RNA, 16 nt, Human
aauaaugugaaacugg

SEQ ID NO: 1876503 - RNA, 13 nt, Human
aauaaugucucug

SEQ ID NO: 1876504 - RNA, 12 nt, Human
aauaaugucucu

SEQ ID NO: 1876505 - RNA, 11 nt, Human
aauaaugucuc

SEQ ID NO: 1876506 - RNA, 22 nt, Human
aagugcugggauuacaggugug

SEQ ID NO: 1876507 - RNA, 14 nt, Human
aagcagagaagcuc

SEQ ID NO: 1876508 - RNA, 16 nt, Human
aagcagagaagcucuc

SEQ ID NO: 1876509 - RNA, 14 nt, Human
aagcagaggaagga

SEQ ID NO: 1876510 - RNA, 14 nt, Human
aagcagacagcucc

SEQ ID NO: 1876511 - RNA, 15 nt, Human
aagcagacagcucca

SEQ ID NO: 1876512 - RNA, 12 nt, Human
aagcagacagcu

SEQ ID NO: 1876513 - RNA, 17 nt, Human
aagauuuuaaucaaguu

SEQ ID NO: 1876514 - RNA, 18 nt, Human
aagauuuuaaucaaguug

SEQ ID NO: 1876515 - RNA, 11 nt, Human
aagcagcucuu

SEQ ID NO: 1876516 - RNA, 17 nt, Human
aagcagcucuccccuca

SEQ ID NO: 1876517 - RNA, 14 nt, Human
aagcagcucucccc

SEQ ID NO: 1876518 - RNA, 20 nt, Human
aagccaggaauuucccagga

SEQ ID NO: 1876519 - RNA, 21 nt, Human
aagccaggaauuucccaggac

SEQ ID NO: 1876520 - RNA, 22 nt, Human
aagccaggaauuucccaggacc

SEQ ID NO: 1876521 - RNA, 20 nt, Human
aagccagaagcuaagcugca

SEQ ID NO: 1876522 - RNA, 21 nt, Human
aagaacacccuauauuuugca

SEQ ID NO: 1876523 - RNA, 19 nt, Human
aagaacacccuauauuuug

SEQ ID NO: 1876524 - RNA, 16 nt, Human
aagaacacccucuaaa

SEQ ID NO: 1876525 - RNA, 15 nt, Human
aagaacaauauugac

SEQ ID NO: 1876526 - RNA, 21 nt, Human
aagaacaauauugacuuuguc

SEQ ID NO: 1876527 - RNA, 21 nt, Human
aagaaauuuccacucaggucu

SEQ ID NO: 1876528 - RNA, 13 nt, Human
aagaaauuaugug

SEQ ID NO: 1876529 - RNA, 16 nt, Human
aagaaaugcaaaaauc

SEQ ID NO: 1876530 - RNA, 22 nt, Human
aagaaauuaugugccagauuua

SEQ ID NO: 1876531 - RNA, 18 nt, Human
aagccauaauuguucuua

SEQ ID NO: 1876532 - RNA, 15 nt, Human
aagccaucuuucuuu

SEQ ID NO: 1876533 - RNA, 21 nt, Human
aagcuaaauccuuuacuguua

SEQ ID NO: 1876534 - RNA, 17 nt, Human
aagcuaauaaaauauca

SEQ ID NO: 1876535 - RNA, 21 nt, Human
aagcugcacccucaggcaggu

SEQ ID NO: 1876536 - RNA, 20 nt, Human
aagcugcacccucaggcagg

SEQ ID NO: 1876537 - RNA, 21 nt, Human
aagcuaauaaaauaucauuca

SEQ ID NO: 1876538 - RNA, 20 nt, Human
aagcuaauaaaauaucauuc

SEQ ID NO: 1876539 - RNA, 18 nt, Human
aagcuaauaaaauaucau

SEQ ID NO: 1876540 - RNA, 22 nt, Human
aagcugcacccucaggcaggug

SEQ ID NO: 1876541 - RNA, 23 nt, Human
aagcugccuccccucuccuuccu

SEQ ID NO: 1876542 - RNA, 12 nt, Human
aagcguggugga

SEQ ID NO: 1876543 - RNA, 11 nt, Human
aagcugggcag

SEQ ID NO: 1876544 - RNA, 18 nt, Human
aaggacauugcggacagc

SEQ ID NO: 1876545 - RNA, 15 nt, Human
aagcugggcagguug

SEQ ID NO: 1876546 - RNA, 13 nt, Human
aagcugggcaggu

SEQ ID NO: 1876547 - RNA, 17 nt, Human
aaggcaaggcugucaau

SEQ ID NO: 1876548 - RNA, 18 nt, Human
aaggcaaggcugucaauu

SEQ ID NO: 1876549 - RNA, 15 nt, Human
aaggcaaaaauguaa

SEQ ID NO: 1876550 - RNA, 14 nt, Human
aaggcaaaaaugua

SEQ ID NO: 1876551 - RNA, 21 nt, Human
aaugaugauccuaggcauuug

SEQ ID NO: 1876552 - RNA, 17 nt, Human
aaugaagauacugaaau

SEQ ID NO: 1876553 - RNA, 12 nt, Human
aaugaagauacu

SEQ ID NO: 1876554 - RNA, 22 nt, Human
aaucugcuuuuuaaagaaugcu

SEQ ID NO: 1876555 - RNA, 21 nt, Human
aaucugcugguuuuaacaacu

SEQ ID NO: 1876556 - RNA, 23 nt, Human
aaugaaccacaucuugcucugcu

SEQ ID NO: 1876557 - RNA, 17 nt, Human
aaugaaccacaucuugc

SEQ ID NO: 1876558 - RNA, 16 nt, Human
aaugaaccacaucuug

SEQ ID NO: 1876559 - RNA, 21 nt, Human
aauccaggcagauccaggacu

SEQ ID NO: 1876560 - RNA, 22 nt, Human
aauccaggcagauccaggacua

SEQ ID NO: 1876561 - RNA, 20 nt, Human
aauccaggcagauccaggac

SEQ ID NO: 1876562 - RNA, 18 nt, Human
aaucuccaaaauaaaacu

SEQ ID NO: 1876563 - RNA, 14 nt, Human
aaucuccaaaauaa

SEQ ID NO: 1876564 - RNA, 13 nt, Human
aaucuccaaaaua

SEQ ID NO: 1876565 - RNA, 18 nt, Human
aaucccaaauuugauuga

SEQ ID NO: 1876566 - RNA, 11 nt, Human
aaucccaaauu

SEQ ID NO: 1876567 - RNA, 16 nt, Human
aaucccaaauuugauu

SEQ ID NO: 1876568 - RNA, 19 nt, Human
aaugaugccaugaggaaca

SEQ ID NO: 1876569 - RNA, 17 nt, Human
aaugaucuuuucaaguu

SEQ ID NO: 1876570 - RNA, 18 nt, Human
aauauaggaacuuaaaua

SEQ ID NO: 1876571 - RNA, 14 nt, Human
aauauaauacugua

SEQ ID NO: 1876572 - RNA, 21 nt, Human
aauauaggaacuuaaauaaug

SEQ ID NO: 1876573 - RNA, 20 nt, Human
aauauaggaacuuaaauaau

SEQ ID NO: 1876574 - RNA, 13 nt, Human
aauauacacacag

SEQ ID NO: 1876575 - RNA, 17 nt, Human
aauauggacacuuaaua

SEQ ID NO: 1876576 - RNA, 21 nt, Human
aauauggacacuuaauacuac

SEQ ID NO: 1876577 - RNA, 18 nt, Human
aauaugguguacauucuu

SEQ ID NO: 1876578 - RNA, 20 nt, Human
aaugucucuuuaaugucaca

SEQ ID NO: 1876579 - RNA, 17 nt, Human
aaugucugagugaaccu

SEQ ID NO: 1876580 - RNA, 18 nt, Human
aaugucucugugagacuc

SEQ ID NO: 1876581 - RNA, 17 nt, Human
aaugucucugugagacu

SEQ ID NO: 1876582 - RNA, 14 nt, Human
aaugucuauuaagg

SEQ ID NO: 1876583 - RNA, 22 nt, Human
aaugucuaguuguaacaccaug

SEQ ID NO: 1876584 - RNA, 17 nt, Human
aaugucagugugacuga

SEQ ID NO: 1876585 - RNA, 21 nt, Human
aaugucagugugacugaucuc

SEQ ID NO: 1876586 - RNA, 15 nt, Human
aaugucagugugacu

SEQ ID NO: 1876587 - RNA, 16 nt, Human
aaugucagugugacug

SEQ ID NO: 1876588 - RNA, 13 nt, Human
aaugucaguguga

SEQ ID NO: 1876589 - RNA, 22 nt, Human
aaugucaguauguggaagugug

SEQ ID NO: 1876590 - RNA, 16 nt, Human
aaugucaguaugugga

SEQ ID NO: 1876591 - RNA, 15 nt, Human
aaugggcagagcaga

SEQ ID NO: 1876592 - RNA, 13 nt, Human
aaugggcagagca

SEQ ID NO: 1876593 - RNA, 12 nt, Human
aauggggccaga

SEQ ID NO: 1876594 - RNA, 13 nt, Human
aauggggccagau

SEQ ID NO: 1876595 - RNA, 14 nt, Human
aauggggccagauc

SEQ ID NO: 1876596 - RNA, 17 nt, Human
aaugguaggcauuuccu

SEQ ID NO: 1876597 - RNA, 18 nt, Human
aaugguaggcauuuccua

SEQ ID NO: 1876598 - RNA, 19 nt, Human
aauguuugccucugccucu

SEQ ID NO: 1876599 - RNA, 13 nt, Human
aauguuuuaaauu

SEQ ID NO: 1876600 - RNA, 14 nt, Human
aauguuuuaaauuc

SEQ ID NO: 1876601 - RNA, 15 nt, Human
aauguuuuaaauucu

SEQ ID NO: 1876602 - RNA, 18 nt, Human
aauguuugccucugccuc

SEQ ID NO: 1876603 - RNA, 17 nt, Human
aaugucuucuagaauau

SEQ ID NO: 1876604 - RNA, 18 nt, Human
aauuaaaacacaacaucu

SEQ ID NO: 1876605 - RNA, 18 nt, Human
aauuaguggcacuugcuu

SEQ ID NO: 1876606 - RNA, 21 nt, Human
aaauagucuagacuaaaagau

SEQ ID NO: 1876607 - RNA, 20 nt, Human
aaauagucuagacuaaaaga

SEQ ID NO: 1876608 - RNA, 14 nt, Human
aaauauaauugaca

SEQ ID NO: 1876609 - RNA, 16 nt, Human
aaauggaaaugggcag

SEQ ID NO: 1876610 - RNA, 18 nt, Human
aaauggaagacagcucuu

SEQ ID NO: 1876611 - RNA, 20 nt, Human
aaaugcuuuuuauuucugca

SEQ ID NO: 1876612 - RNA, 20 nt, Human
aaauggacguguuaugacuc

SEQ ID NO: 1876613 - RNA, 21 nt, Human
aaauggacguguuaugacucc

SEQ ID NO: 1876614 - RNA, 22 nt, Human
aaauggacguguuaugacucca

SEQ ID NO: 1876615 - RNA, 13 nt, Human
aaaucuugaaauu

SEQ ID NO: 1876616 - RNA, 21 nt, Human
aaauggcgucuggaaguccaa

SEQ ID NO: 1876617 - RNA, 22 nt, Human
aaauggcuucagaauuaaaacu

SEQ ID NO: 1876618 - RNA, 23 nt, Human
aaauggcugcaucccccccaccu

SEQ ID NO: 1876619 - RNA, 22 nt, Human
aaagucucucauucuaggccuc

SEQ ID NO: 1876620 - RNA, 19 nt, Human
aaagucucuggaauuugaa

SEQ ID NO: 1876621 - RNA, 16 nt, Human
aaagggacugagaaau

SEQ ID NO: 1876622 - RNA, 21 nt, Human
aaagggaacugaacauuccag

SEQ ID NO: 1876623 - RNA, 16 nt, Human
aaagggaacugaacau

SEQ ID NO: 1876624 - RNA, 23 nt, Human
aaagucuugugacuagugcugaa

SEQ ID NO: 1876625 - RNA, 22 nt, Human
aaagucuugugacuagugcuga

SEQ ID NO: 1876626 - RNA, 21 nt, Human
aaagucuugugacuagugcug

SEQ ID NO: 1876627 - RNA, 19 nt, Human
aaagucuugugacuagugc

SEQ ID NO: 1876628 - RNA, 18 nt, Human
aaagucuugugacuagug

SEQ ID NO: 1876629 - RNA, 15 nt, Human
aaagucuugugacua

SEQ ID NO: 1876630 - RNA, 20 nt, Human
aaagugaaaguccagaaacu

SEQ ID NO: 1876631 - RNA, 20 nt, Human
aaagucucuggaauuugaaa

SEQ ID NO: 1876632 - RNA, 22 nt, Human
aaagucucuggaauuugaaaca

SEQ ID NO: 1876633 - RNA, 20 nt, Human
aaauaaagcuugcaacaaaa

SEQ ID NO: 1876634 - RNA, 12 nt, Human
aaauaaagcccu

SEQ ID NO: 1876635 - RNA, 23 nt, Human
aaauaaaggaugugauuguggaa

SEQ ID NO: 1876636 - RNA, 13 nt, Human
aaauaaaggaacc

SEQ ID NO: 1876637 - RNA, 12 nt, Human
aaauaacaauga

SEQ ID NO: 1876638 - RNA, 17 nt, Human
aaauaaacgucuuaaau

SEQ ID NO: 1876639 - RNA, 14 nt, Human
aaagugcugggauu

SEQ ID NO: 1876640 - RNA, 12 nt, Human
aaagugcuggga

SEQ ID NO: 1876641 - RNA, 14 nt, Human
aaagugcugcggag

SEQ ID NO: 1876642 - RNA, 18 nt, Human
aaauaaaaggaagccaaa

SEQ ID NO: 1876643 - RNA, 11 nt, Human
aaagugcuggg

SEQ ID NO: 1876644 - RNA, 23 nt, Human
aaagugagacuuugaggguguau

SEQ ID NO: 1876645 - RNA, 19 nt, Human
aaauaaauuugguucuaau

SEQ ID NO: 1876646 - RNA, 21 nt, Human
aaagaaaaauuauuaaaggaa

SEQ ID NO: 1876647 - RNA, 12 nt, Human
aaagaaaacuug

SEQ ID NO: 1876648 - RNA, 20 nt, Human
aaagaaaacuuguauuaugu

SEQ ID NO: 1876649 - RNA, 17 nt, Human
aaagaguacucuuguuu

SEQ ID NO: 1876650 - RNA, 13 nt, Human
aaagaguagaauu

SEQ ID NO: 1876651 - RNA, 18 nt, Human
aaagaguagaauugcauu

SEQ ID NO: 1876652 - RNA, 12 nt, Human
aaagaguacucu

SEQ ID NO: 1876653 - RNA, 20 nt, Human
aaagauauaugaauaugaca

SEQ ID NO: 1876654 - RNA, 11 nt, Human
aaagaacaucc

SEQ ID NO: 1876655 - RNA, 15 nt, Human
aaagaaauuaugugc

SEQ ID NO: 1876656 - RNA, 19 nt, Human
aaagaaaugucuauuaagg

SEQ ID NO: 1876657 - RNA, 13 nt, Human
aaagaaauuaugu

SEQ ID NO: 1876658 - RNA, 21 nt, Human
aaagaucuguuuugaaggcaa

SEQ ID NO: 1876659 - RNA, 19 nt, Human
aaacacuguucucugcccu

SEQ ID NO: 1876660 - RNA, 22 nt, Human
aaacacuguucucugcccucca

SEQ ID NO: 1876661 - RNA, 20 nt, Human
aaacagacucgauucauauu

SEQ ID NO: 1876662 - RNA, 13 nt, Human
aaacacucuugaa

SEQ ID NO: 1876663 - RNA, 14 nt, Human
aaacacucuugaaa

SEQ ID NO: 1876664 - RNA, 17 nt, Human
aaacacucuugaaaaau

SEQ ID NO: 1876665 - RNA, 18 nt, Human
aaacacuguucucugccc

SEQ ID NO: 1876666 - RNA, 13 nt, Human
aaaauucagugga

SEQ ID NO: 1876667 - RNA, 14 nt, Human
aaaauucaauugua

SEQ ID NO: 1876668 - RNA, 17 nt, Human
aaaauucaauuguaaau

SEQ ID NO: 1876669 - RNA, 15 nt, Human
aaaacacauuuuucu

SEQ ID NO: 1876670 - RNA, 13 nt, Human
aaaacacauuuuu

SEQ ID NO: 1876671 - RNA, 15 nt, Human
aacaagaaaguuucc

SEQ ID NO: 1876672 - RNA, 15 nt, Human
aacaaagcagccacg

SEQ ID NO: 1876673 - RNA, 14 nt, Human
aacaaagcagccac

SEQ ID NO: 1876674 - RNA, 16 nt, Human
aacaagaaaguuuccc

SEQ ID NO: 1876675 - RNA, 21 nt, Human
aacaagaagccacagaccuag

SEQ ID NO: 1876676 - RNA, 22 nt, Human
aacaagaccaccacuucgaaac

SEQ ID NO: 1876677 - RNA, 19 nt, Human
aacacauuuuucuuaggga

SEQ ID NO: 1876678 - RNA, 14 nt, Human
aacaccaagcacag

SEQ ID NO: 1876679 - RNA, 17 nt, Human
aacaccaagcacagcag

SEQ ID NO: 1876680 - RNA, 18 nt, Human
aacaccaagcacagcagc

SEQ ID NO: 1876681 - RNA, 19 nt, Human
aacaccaagcacagcagcc

SEQ ID NO: 1876682 - RNA, 21 nt, Human
aacaccaagcacagcagccug

SEQ ID NO: 1876683 - RNA, 13 nt, Human
aaauugcaaaucu

SEQ ID NO: 1876684 - RNA, 14 nt, Human
aaauugcaaaucuu

SEQ ID NO: 1876685 - RNA, 19 nt, Human
aaauugcaaaucuugaaau

SEQ ID NO: 1876686 - RNA, 15 nt, Human
aacaaagaaauuaug

SEQ ID NO: 1876687 - RNA, 17 nt, Human
aacaaagaaauuaugug

SEQ ID NO: 1876688 - RNA, 13 nt, Human
aacaaaaauuagg

SEQ ID NO: 1876689 - RNA, 14 nt, Human
aacaaaaauuaggu

SEQ ID NO: 1876690 - RNA, 9 nt, Human
aacaaaaca

SEQ ID NO: 1876691 - RNA, 14 nt, Human
aacacgcaccugcc

SEQ ID NO: 1876692 - RNA, 15 nt, Human
aacacgcaccugccu

SEQ ID NO: 1876693 - RNA, 19 nt, Human
aacacgcaccugccucagg

SEQ ID NO: 1876694 - RNA, 13 nt, Human
aacagcugccucu

SEQ ID NO: 1876695 - RNA, 13 nt, Human
aacaugauuuggg

SEQ ID NO: 1876696 - RNA, 17 nt, Human
aaccaguguuguggauu

SEQ ID NO: 1876697 - RNA, 18 nt, Human
aaccaguccccccacccu

SEQ ID NO: 1876698 - RNA, 22 nt, Human
aaccaguccccccacccucauu

SEQ ID NO: 1876699 - RNA, 14 nt, Human
aaccagcuaagaaa

SEQ ID NO: 1876700 - RNA, 16 nt, Human
aaccagcuaagaaaag

SEQ ID NO: 1876701 - RNA, 21 nt, Human
aaccagcuaagaaaagauuuu

SEQ ID NO: 1876702 - RNA, 22 nt, Human
aaccacucuaucaaguauuaua

SEQ ID NO: 1876703 - RNA, 23 nt, Human
aacauguaauuaaguacuaugua

SEQ ID NO: 1876704 - RNA, 14 nt, Human
aacauguaauuaag

SEQ ID NO: 1876705 - RNA, 21 nt, Human
aacauguaauuaaguacuaug

SEQ ID NO: 1876706 - RNA, 14 nt, Human
aaccagaucauugu

SEQ ID NO: 1876707 - RNA, 12 nt, Human
aaccagaucauu

SEQ ID NO: 1876708 - RNA, 14 nt, Human
aacccuggugacca

SEQ ID NO: 1876709 - RNA, 19 nt, Human
aacugauuuuuuuuuccuu

SEQ ID NO: 1876710 - RNA, 17 nt, Human
aacugauuuuuuuuucc

SEQ ID NO: 1876711 - RNA, 15 nt, Human
aacugaauuuugucu

SEQ ID NO: 1876712 - RNA, 19 nt, Human
aacuuaaauaaugugaaac

SEQ ID NO: 1876713 - RNA, 17 nt, Human
aacuuaaauaaugugaa

SEQ ID NO: 1876714 - RNA, 21 nt, Human
aacuuaugaccucuuccuuua

SEQ ID NO: 1876715 - RNA, 21 nt, Human
aacuuauuaaauggaaacuga

SEQ ID NO: 1876716 - RNA, 14 nt, Human
aacugaauuuuguc

SEQ ID NO: 1876717 - RNA, 15 nt, Human
aacucaguuuuaacu

SEQ ID NO: 1876718 - RNA, 18 nt, Human
aacucaguuuuaacuaga

SEQ ID NO: 1876719 - RNA, 12 nt, Human
aacucaccccag

SEQ ID NO: 1876720 - RNA, 21 nt, Human
aacucaauauuuuccaugaaa

SEQ ID NO: 1876721 - RNA, 20 nt, Human
aacucaauauuuuccaugaa

SEQ ID NO: 1876722 - RNA, 14 nt, Human
aacucaauauuuuc

SEQ ID NO: 1876723 - RNA, 13 nt, Human
aacucaauauuuu

SEQ ID NO: 1876724 - RNA, 12 nt, Human
aacucaauauuu

SEQ ID NO: 1876725 - RNA, 15 nt, Human
aacucaccccagccc

SEQ ID NO: 1876726 - RNA, 15 nt, Human
aacucaccugccccu

SEQ ID NO: 1876727 - RNA, 16 nt, Human
aacucaccugccccuc

SEQ ID NO: 1876728 - RNA, 13 nt, Human
aacuucacauauu

SEQ ID NO: 1876729 - RNA, 14 nt, Human
aacuuuuuuuuaag

SEQ ID NO: 1876730 - RNA, 20 nt, Human
aacuuuuuuuuaaguuacac

SEQ ID NO: 1876731 - RNA, 19 nt, Human
aacuuuuauaaacuuuacc

SEQ ID NO: 1876732 - RNA, 16 nt, Human
aacuuuuauaaacuuu

SEQ ID NO: 1876733 - RNA, 20 nt, Human
aacuuugaccucugcagcaa

SEQ ID NO: 1876734 - RNA, 19 nt, Human
aacuuugaccucugcagca

SEQ ID NO: 1876735 - RNA, 15 nt, Human
aacuuuuauaaacuu

SEQ ID NO: 1876736 - RNA, 12 nt, Human
aacuuuuauaaa

SEQ ID NO: 1876737 - RNA, 17 nt, Human
aacuuugaccucugcag

SEQ ID NO: 1876738 - RNA, 14 nt, Human
aacuuugaccucug

SEQ ID NO: 1876739 - RNA, 13 nt, Human
aacuuugaccucu

SEQ ID NO: 1876740 - RNA, 15 nt, Human
accuugugucuguac

SEQ ID NO: 1876741 - RNA, 13 nt, Human
accuugugucugu

SEQ ID NO: 1876742 - RNA, 12 nt, Human
accuugugucug

SEQ ID NO: 1876743 - RNA, 21 nt, Human
accuugugucuguacacgugu

SEQ ID NO: 1876744 - RNA, 18 nt, Human
accuugugucuguacacg

SEQ ID NO: 1876745 - RNA, 14 nt, Human
accuuggcugcagg

SEQ ID NO: 1876746 - RNA, 16 nt, Human
accuuucaauaggaaa

SEQ ID NO: 1876747 - RNA, 12 nt, Human
accuuggcucaa

SEQ ID NO: 1876748 - RNA, 12 nt, Human
accuuggcugca

SEQ ID NO: 1876749 - RNA, 14 nt, Human
accuuggcucaagu

SEQ ID NO: 1876750 - RNA, 21 nt, Human
accuguauaaguggaggcacu

SEQ ID NO: 1876751 - RNA, 23 nt, Human
accuguauaaguggaggcacuuu

SEQ ID NO: 1876752 - RNA, 17 nt, Human
accuuucaauaggaaaa

SEQ ID NO: 1876753 - RNA, 21 nt, Human
accuuucaauaggaaaaacug

SEQ ID NO: 1876754 - RNA, 23 nt, Human
accuuucaauaggaaaaacugau

SEQ ID NO: 1876755 - RNA, 15 nt, Human
accuuucaaagccau

SEQ ID NO: 1876756 - RNA, 18 nt, Human
accuuucaaagccauuuu

SEQ ID NO: 1876757 - RNA, 18 nt, Human
accuuucauaaucuuugc

SEQ ID NO: 1876758 - RNA, 21 nt, Human
accucugcacaagcugcaccc

SEQ ID NO: 1876759 - RNA, 16 nt, Human
accucuuaauauucug

SEQ ID NO: 1876760 - RNA, 16 nt, Human
accucugcacaagcug

SEQ ID NO: 1876761 - RNA, 18 nt, Human
accucugcacaagcugca

SEQ ID NO: 1876762 - RNA, 23 nt, Human
accugccccucaacucuccucca

SEQ ID NO: 1876763 - RNA, 18 nt, Human
accugcccccgcaucccc

SEQ ID NO: 1876764 - RNA, 20 nt, Human
accugcccccgcauccccug

SEQ ID NO: 1876765 - RNA, 23 nt, Human
accugcccccgcauccccugccu

SEQ ID NO: 1876766 - RNA, 14 nt, Human
accucuucuggcuc

SEQ ID NO: 1876767 - RNA, 16 nt, Human
accucuucuggcucaa

SEQ ID NO: 1876768 - RNA, 17 nt, Human
accugccccaacucucc

SEQ ID NO: 1876769 - RNA, 13 nt, Human
acguggcugcuuc

SEQ ID NO: 1876770 - RNA, 14 nt, Human
acguggcugcuuca

SEQ ID NO: 1876771 - RNA, 15 nt, Human
acguggcugcuucaa

SEQ ID NO: 1876772 - RNA, 15 nt, Human
acgcugugcugcccu

SEQ ID NO: 1876773 - RNA, 16 nt, Human
acgcugugcugcccug

SEQ ID NO: 1876774 - RNA, 17 nt, Human
acgcugugcugcccugc

SEQ ID NO: 1876775 - RNA, 18 nt, Human
acgcugugcugcccugcc

SEQ ID NO: 1876776 - RNA, 19 nt, Human
acgugauuuugcuguagaa

SEQ ID NO: 1876777 - RNA, 22 nt, Human
acuaaguuuuuauggcuuuugu

SEQ ID NO: 1876778 - RNA, 15 nt, Human
acuaaguuuuuaugg

SEQ ID NO: 1876779 - RNA, 13 nt, Human
acuaagcagagga

SEQ ID NO: 1876780 - RNA, 14 nt, Human
acuaagcagaggag

SEQ ID NO: 1876781 - RNA, 15 nt, Human
acuaagcagaggagg

SEQ ID NO: 1876782 - RNA, 12 nt, Human
acuaagcagagg

SEQ ID NO: 1876783 - RNA, 18 nt, Human
acgccacugcacuauagc

SEQ ID NO: 1876784 - RNA, 17 nt, Human
acgauuucuguuuagau

SEQ ID NO: 1876785 - RNA, 14 nt, Human
acgauuucuguuua

SEQ ID NO: 1876786 - RNA, 13 nt, Human
acgauuucuguuu

SEQ ID NO: 1876787 - RNA, 12 nt, Human
acgauuucuguu

SEQ ID NO: 1876788 - RNA, 18 nt, Human
acgauuuagaaagaagcc

SEQ ID NO: 1876789 - RNA, 14 nt, Human
acuagcuauggugu

SEQ ID NO: 1876790 - RNA, 17 nt, Human
acuaggggacaaagcaa

SEQ ID NO: 1876791 - RNA, 21 nt, Human
acuagggugaggguuuucugu

SEQ ID NO: 1876792 - RNA, 14 nt, Human
acuagguaacuuca

SEQ ID NO: 1876793 - RNA, 15 nt, Human
acuagguaacuucau

SEQ ID NO: 1876794 - RNA, 16 nt, Human
acuagguaacuucaua

SEQ ID NO: 1876795 - RNA, 15 nt, Human
acuaggauacugcug

SEQ ID NO: 1876796 - RNA, 18 nt, Human
acuaggaaauccauucac

SEQ ID NO: 1876797 - RNA, 13 nt, Human
acucagucuuuaa

SEQ ID NO: 1876798 - RNA, 17 nt, Human
acucagggcagcgccag

SEQ ID NO: 1876799 - RNA, 20 nt, Human
acucagggcagcgccaggcu

SEQ ID NO: 1876800 - RNA, 21 nt, Human
acucagggcagcgccaggcug

SEQ ID NO: 1876801 - RNA, 22 nt, Human
acucagggcagcgccaggcuga

SEQ ID NO: 1876802 - RNA, 17 nt, Human
acucaggcccaaagccu

SEQ ID NO: 1876803 - RNA, 22 nt, Human
acucagcucuuggcuccacugg

SEQ ID NO: 1876804 - RNA, 12 nt, Human
acuccccuccuu

SEQ ID NO: 1876805 - RNA, 13 nt, Human
acuccccugcugg

SEQ ID NO: 1876806 - RNA, 17 nt, Human
acuccccugcugggugu

SEQ ID NO: 1876807 - RNA, 17 nt, Human
acuccccgaagucuuuu

SEQ ID NO: 1876808 - RNA, 14 nt, Human
acucccccaggugg

SEQ ID NO: 1876809 - RNA, 14 nt, Human
acuccccgaagucu

SEQ ID NO: 1876810 - RNA, 16 nt, Human
acuccccgaagucuuu

SEQ ID NO: 1876811 - RNA, 15 nt, Human
acucaguuuuaacua

SEQ ID NO: 1876812 - RNA, 22 nt, Human
acucaguuuuaacuagaauuua

SEQ ID NO: 1876813 - RNA, 11 nt, Human
acuauaaugua

SEQ ID NO: 1876814 - RNA, 17 nt, Human
acucaaacucuuaaaac

SEQ ID NO: 1876815 - RNA, 16 nt, Human
acucaaacucuuaaaa

SEQ ID NO: 1876816 - RNA, 11 nt, Human
acucagaucca

SEQ ID NO: 1876817 - RNA, 12 nt, Human
acucagauccag

SEQ ID NO: 1876818 - RNA, 14 nt, Human
acucagauccaggg

SEQ ID NO: 1876819 - RNA, 16 nt, Human
acucagauccagggac

SEQ ID NO: 1876820 - RNA, 17 nt, Human
acucagauccagggaca

SEQ ID NO: 1876821 - RNA, 19 nt, Human
acucagauccagggacaga

SEQ ID NO: 1876822 - RNA, 14 nt, Human
acucaaaggccaga

SEQ ID NO: 1876823 - RNA, 19 nt, Human
acucaaaguuucagagacc

SEQ ID NO: 1876824 - RNA, 20 nt, Human
acucaaaguuucagagacca

SEQ ID NO: 1876825 - RNA, 22 nt, Human
acucaaaguuucagagaccauu

SEQ ID NO: 1876826 - RNA, 15 nt, Human
acucagcacaaggcc

SEQ ID NO: 1876827 - RNA, 13 nt, Human
acucccuuucaac

SEQ ID NO: 1876828 - RNA, 12 nt, Human
acucccuuucaa

SEQ ID NO: 1876829 - RNA, 14 nt, Human
acucuaucaaguau

SEQ ID NO: 1876830 - RNA, 15 nt, Human
acucuauagacucua

SEQ ID NO: 1876831 - RNA, 18 nt, Human
acucuauagacucuagga

SEQ ID NO: 1876832 - RNA, 16 nt, Human
acucuaucaaguauua

SEQ ID NO: 1876833 - RNA, 14 nt, Human
acucugggcuccag

SEQ ID NO: 1876834 - RNA, 16 nt, Human
acucugggcuccagag

SEQ ID NO: 1876835 - RNA, 16 nt, Human
acucugugucaggugg

SEQ ID NO: 1876836 - RNA, 11 nt, Human
acucuuaaaac

SEQ ID NO: 1876837 - RNA, 18 nt, Human
acucuuaaaacccaagug

SEQ ID NO: 1876838 - RNA, 20 nt, Human
acucuguugcaagugcaaua

SEQ ID NO: 1876839 - RNA, 21 nt, Human
acucuacccucuuagaaaaac

SEQ ID NO: 1876840 - RNA, 13 nt, Human
acucuacccucuu

SEQ ID NO: 1876841 - RNA, 18 nt, Human
acucuacccucuuagaaa

SEQ ID NO: 1876842 - RNA, 15 nt, Human
acuucuuucagcaga

SEQ ID NO: 1876843 - RNA, 19 nt, Human
acuucugccauauucuguu

SEQ ID NO: 1876844 - RNA, 18 nt, Human
acuucugccauauucugu

SEQ ID NO: 1876845 - RNA, 22 nt, Human
acuucugccagcauaauacuug

SEQ ID NO: 1876846 - RNA, 23 nt, Human
acuucacauauugauuuccguua

SEQ ID NO: 1876847 - RNA, 18 nt, Human
acuuguaaaggaauuuaa

SEQ ID NO: 1876848 - RNA, 15 nt, Human
acuuggucugugaga

SEQ ID NO: 1876849 - RNA, 14 nt, Human
acuuggucugugag

SEQ ID NO: 1876850 - RNA, 20 nt, Human
acuuguaaaggaauuuaaaa

SEQ ID NO: 1876851 - RNA, 19 nt, Human
acuuguaaaggaauuuaaa

SEQ ID NO: 1876852 - RNA, 21 nt, Human
acuuggucugugagaugcuag

SEQ ID NO: 1876853 - RNA, 13 nt, Human
acuguuucaaacu

SEQ ID NO: 1876854 - RNA, 22 nt, Human
acuguuuggacuuuuauuuugg

SEQ ID NO: 1876855 - RNA, 24 nt, Human
acuguuuuaauuuauacuggcaug

SEQ ID NO: 1876856 - RNA, 15 nt, Human
acuguugucccugca

SEQ ID NO: 1876857 - RNA, 15 nt, Human
acuuauuuauauaaa

SEQ ID NO: 1876858 - RNA, 15 nt, Human
acuuauuuaaacucu

SEQ ID NO: 1876859 - RNA, 13 nt, Human
acuuauuuaaugc

SEQ ID NO: 1876860 - RNA, 19 nt, Human
acuucacauauugauuucc

SEQ ID NO: 1876861 - RNA, 23 nt, Human
acuuauuguagcauccuggaaua

SEQ ID NO: 1876862 - RNA, 20 nt, Human
acuuauuguagcauccugga

SEQ ID NO: 1876863 - RNA, 17 nt, Human
acugucuucucccugca

SEQ ID NO: 1876864 - RNA, 12 nt, Human
acugucuuuccu

SEQ ID NO: 1876865 - RNA, 12 nt, Human
acugucuucagu

SEQ ID NO: 1876866 - RNA, 23 nt, Human
acugucuguguuuuuuuggcagu

SEQ ID NO: 1876867 - RNA, 18 nt, Human
acugugaugcccugcccu

SEQ ID NO: 1876868 - RNA, 14 nt, Human
acugucuuuccuag

SEQ ID NO: 1876869 - RNA, 16 nt, Human
acugugccaugugcca

SEQ ID NO: 1876870 - RNA, 17 nt, Human
acuguccugggccugca

SEQ ID NO: 1876871 - RNA, 16 nt, Human
acuguccugggccugc

SEQ ID NO: 1876872 - RNA, 19 nt, Human
acuguccugggccugcaga

SEQ ID NO: 1876873 - RNA, 14 nt, Human
acuggagaaaaugg

SEQ ID NO: 1876874 - RNA, 14 nt, Human
acuggacuccggcc

SEQ ID NO: 1876875 - RNA, 16 nt, Human
acuggacuccggcccu

SEQ ID NO: 1876876 - RNA, 19 nt, Human
acuggacuccggcccuccu

SEQ ID NO: 1876877 - RNA, 18 nt, Human
acuggacuccggcccucc

SEQ ID NO: 1876878 - RNA, 14 nt, Human
acuggaagcacagc

SEQ ID NO: 1876879 - RNA, 15 nt, Human
acuggaagcacagcu

SEQ ID NO: 1876880 - RNA, 16 nt, Human
acuggaagcacagcuu

SEQ ID NO: 1876881 - RNA, 12 nt, Human
acugcauuuuag

SEQ ID NO: 1876882 - RNA, 17 nt, Human
acugccaaaaugcucua

SEQ ID NO: 1876883 - RNA, 18 nt, Human
acugccaaaaugcucuag

SEQ ID NO: 1876884 - RNA, 23 nt, Human
agaaaauggaagacagcucuuau

SEQ ID NO: 1876885 - RNA, 15 nt, Human
agaaaauggacgugu

SEQ ID NO: 1876886 - RNA, 20 nt, Human
agaaaauggacguguuauga

SEQ ID NO: 1876887 - RNA, 22 nt, Human
agaaaauggacguguuaugacu

SEQ ID NO: 1876888 - RNA, 23 nt, Human
agaaaauggacguguuaugacuc

SEQ ID NO: 1876889 - RNA, 19 nt, Human
agaaaauguuauuuaacag

SEQ ID NO: 1876890 - RNA, 13 nt, Human
agaaaauguuauu

SEQ ID NO: 1876891 - RNA, 16 nt, Human
agaaaauguuauuuaa

SEQ ID NO: 1876892 - RNA, 18 nt, Human
agaaaauguuauuuaaca

SEQ ID NO: 1876893 - RNA, 17 nt, Human
agaaaauucaauuguaa

SEQ ID NO: 1876894 - RNA, 18 nt, Human
agaaaauucaauuguaaa

SEQ ID NO: 1876895 - RNA, 16 nt, Human
agaaaauguugagaau

SEQ ID NO: 1876896 - RNA, 17 nt, Human
agaaaauguugagaauc

SEQ ID NO: 1876897 - RNA, 12 nt, Human
agaaaauucaau

SEQ ID NO: 1876898 - RNA, 13 nt, Human
agaaaauucaauu

SEQ ID NO: 1876899 - RNA, 15 nt, Human
agaaaauucaauugu

SEQ ID NO: 1876900 - RNA, 20 nt, Human
agaaaagggaacugaacauu

SEQ ID NO: 1876901 - RNA, 21 nt, Human
agaaaaguugaauuuuacaug

SEQ ID NO: 1876902 - RNA, 18 nt, Human
agaaaaguugaauuuuac

SEQ ID NO: 1876903 - RNA, 22 nt, Human
acuuuuauaaacuuuaccuuuu

SEQ ID NO: 1876904 - RNA, 19 nt, Human
acuuuuauaaacuuuaccu

SEQ ID NO: 1876905 - RNA, 15 nt, Human
acuuuuauaaacuuu

SEQ ID NO: 1876906 - RNA, 23 nt, Human
acuuuuauacucuuucuguauau

SEQ ID NO: 1876907 - RNA, 23 nt, Human
acuuuguucuggcucuuccaggc

SEQ ID NO: 1876908 - RNA, 17 nt, Human
acuuucuacaaugugaa

SEQ ID NO: 1876909 - RNA, 19 nt, Human
acuuucuacaaugugaacu

SEQ ID NO: 1876910 - RNA, 21 nt, Human
acuuucuacaaugugaacuuu

SEQ ID NO: 1876911 - RNA, 23 nt, Human
acuuuccuucauucaacccaccu

SEQ ID NO: 1876912 - RNA, 23 nt, Human
acuuucauuuuuuuccaggcugg

SEQ ID NO: 1876913 - RNA, 21 nt, Human
acuuucauuuuuuuccaggcu

SEQ ID NO: 1876914 - RNA, 23 nt, Human
acuuuagggaaguacuuuuggca

SEQ ID NO: 1876915 - RNA, 15 nt, Human
acuuuagggcuguaa

SEQ ID NO: 1876916 - RNA, 22 nt, Human
acuuuagggcuguaaaaugcau

SEQ ID NO: 1876917 - RNA, 23 nt, Human
acuuuagggcuguaaaaugcaug

SEQ ID NO: 1876918 - RNA, 18 nt, Human
acuuucagugaaagcauc

SEQ ID NO: 1876919 - RNA, 20 nt, Human
acuuucauuuuuuuccaggc

SEQ ID NO: 1876920 - RNA, 17 nt, Human
acuuucauuuuuuucca

SEQ ID NO: 1876921 - RNA, 14 nt, Human
acuuucauuggaaa

SEQ ID NO: 1876922 - RNA, 23 nt, Human
agaaaggaggggauagagagaga

SEQ ID NO: 1876923 - RNA, 20 nt, Human
agaaaggaggggauagagag

SEQ ID NO: 1876924 - RNA, 15 nt, Human
agaaauaaaguuucu

SEQ ID NO: 1876925 - RNA, 19 nt, Human
agaaauaaaaggaagccaa

SEQ ID NO: 1876926 - RNA, 20 nt, Human
agaaauaaaaggaagccaaa

SEQ ID NO: 1876927 - RNA, 18 nt, Human
agaaauaaaguuucuguu

SEQ ID NO: 1876928 - RNA, 18 nt, Human
agaaauaaaguuugcuua

SEQ ID NO: 1876929 - RNA, 16 nt, Human
aauuauaauauacuau

SEQ ID NO: 1876930 - RNA, 14 nt, Human
aauuauaaaagcca

SEQ ID NO: 1876931 - RNA, 13 nt, Human
aauuuugaaaaac

SEQ ID NO: 1876932 - RNA, 15 nt, Human
aauuuuauaaacaaa

SEQ ID NO: 1876933 - RNA, 19 nt, Human
aauuuuaguagagacaggg

SEQ ID NO: 1876934 - RNA, 13 nt, Human
acaaagacugagu

SEQ ID NO: 1876935 - RNA, 14 nt, Human
acaaagagaaaaag

SEQ ID NO: 1876936 - RNA, 20 nt, Human
acaaagagaaaaagaaaugc

SEQ ID NO: 1876937 - RNA, 21 nt, Human
acaaagagaaaaagaaaugca

SEQ ID NO: 1876938 - RNA, 21 nt, Human
acaaaccuguuucugcagcca

SEQ ID NO: 1876939 - RNA, 15 nt, Human
acaaacgggcucagc

SEQ ID NO: 1876940 - RNA, 20 nt, Human
acaaaauguaggguuauaau

SEQ ID NO: 1876941 - RNA, 20 nt, Human
acaaaauggaauacucuuau

SEQ ID NO: 1876942 - RNA, 21 nt, Human
aauuuugaauaaauaaaugua

SEQ ID NO: 1876943 - RNA, 19 nt, Human
acaaaauggaauacucuua

SEQ ID NO: 1876944 - RNA, 15 nt, Human
acaaaauggaauacu

SEQ ID NO: 1876945 - RNA, 24 nt, Human
acaacuugcacguauuuuaauagc

SEQ ID NO: 1876946 - RNA, 17 nt, Human
acaacuauggaucagaa

SEQ ID NO: 1876947 - RNA, 17 nt, Human
acaacuuuaagaggaca

SEQ ID NO: 1876948 - RNA, 20 nt, Human
acaagucagucauucagaua

SEQ ID NO: 1876949 - RNA, 12 nt, Human
acaccagagccc

SEQ ID NO: 1876950 - RNA, 14 nt, Human
acaccacuacauuc

SEQ ID NO: 1876951 - RNA, 21 nt, Human
acaccacuacauucuguuaau

SEQ ID NO: 1876952 - RNA, 14 nt, Human
acaccagacagaca

SEQ ID NO: 1876953 - RNA, 12 nt, Human
acacagcucugu

SEQ ID NO: 1876954 - RNA, 11 nt, Human
acacagcucug

SEQ ID NO: 1876955 - RNA, 14 nt, Human
acacagcucugucc

SEQ ID NO: 1876956 - RNA, 21 nt, Human
acacagaaaccuuuuuaaaaa

SEQ ID NO: 1876957 - RNA, 13 nt, Human
acacagaaaccuu

SEQ ID NO: 1876958 - RNA, 18 nt, Human
acacagaaaccuuuuuaa

SEQ ID NO: 1876959 - RNA, 19 nt, Human
acacagaaaccuuuuuaaa

SEQ ID NO: 1876960 - RNA, 15 nt, Human
acacagacucauauu

SEQ ID NO: 1876961 - RNA, 16 nt, Human
acacagacucauauua

SEQ ID NO: 1876962 - RNA, 15 nt, Human
acacuaaccacgcug

SEQ ID NO: 1876963 - RNA, 14 nt, Human
acacuaaccacgcu

SEQ ID NO: 1876964 - RNA, 15 nt, Human
acacggacacucaaa

SEQ ID NO: 1876965 - RNA, 18 nt, Human
acacggagcccagcccuc

SEQ ID NO: 1876966 - RNA, 22 nt, Human
acacggagcccagcccucccca

SEQ ID NO: 1876967 - RNA, 15 nt, Human
acaauuuauuauggc

SEQ ID NO: 1876968 - RNA, 22 nt, Human
acaaugugucuuucuuuuugga

SEQ ID NO: 1876969 - RNA, 23 nt, Human
acaaugugucuuucuuuuuggac

SEQ ID NO: 1876970 - RNA, 17 nt, Human
acaauguuaacauuuuu

SEQ ID NO: 1876971 - RNA, 16 nt, Human
acaauuuauuauggca

SEQ ID NO: 1876972 - RNA, 18 nt, Human
acacaaacgggcucagca

SEQ ID NO: 1876973 - RNA, 14 nt, Human
acacaaacuguaaa

SEQ ID NO: 1876974 - RNA, 15 nt, Human
acacaaacuguaaau

SEQ ID NO: 1876975 - RNA, 16 nt, Human
acacaaacuguaaaua

SEQ ID NO: 1876976 - RNA, 19 nt, Human
acacaaacuguaaauaaaa

SEQ ID NO: 1876977 - RNA, 22 nt, Human
acacaaagagaaaaagaaaugc

SEQ ID NO: 1876978 - RNA, 19 nt, Human
acaaugugaacuuuauuaa

SEQ ID NO: 1876979 - RNA, 22 nt, Human
acaaugugaacuuuauuaaaua

SEQ ID NO: 1876980 - RNA, 21 nt, Human
acacugcugcuccagugcagg

SEQ ID NO: 1876981 - RNA, 21 nt, Human
acacugauuuccccuuuugca

SEQ ID NO: 1876982 - RNA, 13 nt, Human
acacugucuugaa

SEQ ID NO: 1876983 - RNA, 19 nt, Human
acagaacaaauguuuguuu

SEQ ID NO: 1876984 - RNA, 14 nt, Human
acagaacacugucu

SEQ ID NO: 1876985 - RNA, 12 nt, Human
acagaacacugu

SEQ ID NO: 1876986 - RNA, 16 nt, Human
acagaagaaggcagca

SEQ ID NO: 1876987 - RNA, 12 nt, Human
acagaagcagcu

SEQ ID NO: 1876988 - RNA, 20 nt, Human
acagaagaaggcagcaggug

SEQ ID NO: 1876989 - RNA, 13 nt, Human
acagaagcagcuc

SEQ ID NO: 1876990 - RNA, 14 nt, Human
acagaagcagcucu

SEQ ID NO: 1876991 - RNA, 15 nt, Human
acagaagcagcucuu

SEQ ID NO: 1876992 - RNA, 22 nt, Human
acacugagaauguaagaacuac

SEQ ID NO: 1876993 - RNA, 20 nt, Human
acacugagaauguaagaacu

SEQ ID NO: 1876994 - RNA, 19 nt, Human
acacugagaauguaagaac

SEQ ID NO: 1876995 - RNA, 22 nt, Human
acacugaugcuuagauguucca

SEQ ID NO: 1876996 - RNA, 22 nt, Human
acacugauuuccccuuuugcau

SEQ ID NO: 1876997 - RNA, 15 nt, Human
acacugauccagccc

SEQ ID NO: 1876998 - RNA, 19 nt, Human
acagagucucacuguugcc

SEQ ID NO: 1876999 - RNA, 17 nt, Human
acagagucucacuguug

SEQ ID NO: 1877000 - RNA, 14 nt, Human
acagagucucacug

SEQ ID NO: 1877001 - RNA, 12 nt, Human
acagagucucac

SEQ ID NO: 1877002 - RNA, 22 nt, Human
acagaggggguggccucccaac

SEQ ID NO: 1877003 - RNA, 23 nt, Human
acagaguacuuggcuguuagccc

SEQ ID NO: 1877004 - RNA, 22 nt, Human
acagaauacuguuaaaggaaaa

SEQ ID NO: 1877005 - RNA, 19 nt, Human
acagccacggccaggccag

SEQ ID NO: 1877006 - RNA, 19 nt, Human
acagcauuuuccucugcuu

SEQ ID NO: 1877007 - RNA, 14 nt, Human
acagcauuuuccuc

SEQ ID NO: 1877008 - RNA, 15 nt, Human
acagcauuuuccucu

SEQ ID NO: 1877009 - RNA, 18 nt, Human
acagcauuuuccucugcu

SEQ ID NO: 1877010 - RNA, 15 nt, Human
acagccaugauucuu

SEQ ID NO: 1877011 - RNA, 18 nt, Human
acagcccaaagaaggaaa

SEQ ID NO: 1877012 - RNA, 17 nt, Human
acagcccaaagaaggaa

SEQ ID NO: 1877013 - RNA, 16 nt, Human
acagcccaaagaagga

SEQ ID NO: 1877014 - RNA, 16 nt, Human
acaggcaagcaccucc

SEQ ID NO: 1877015 - RNA, 15 nt, Human
acaggcaagcaccuc

SEQ ID NO: 1877016 - RNA, 18 nt, Human
acaggcaagcaccuccug

SEQ ID NO: 1877017 - RNA, 19 nt, Human
acaggcaagcaccuccugc

SEQ ID NO: 1877018 - RNA, 17 nt, Human
acaggggccagaagaug

SEQ ID NO: 1877019 - RNA, 23 nt, Human
acaggggccagaagaugaacaga

SEQ ID NO: 1877020 - RNA, 12 nt, Human
acaggggccaga

SEQ ID NO: 1877021 - RNA, 14 nt, Human
acaggggccagaag

SEQ ID NO: 1877022 - RNA, 15 nt, Human
acaggggcaggagga

SEQ ID NO: 1877023 - RNA, 20 nt, Human
acagcugcuccuagagggag

SEQ ID NO: 1877024 - RNA, 21 nt, Human
acagcugcuccuagagggagg

SEQ ID NO: 1877025 - RNA, 23 nt, Human
acaggugugaaccaccacaccca

SEQ ID NO: 1877026 - RNA, 20 nt, Human
acaggugugaaccaccacac

SEQ ID NO: 1877027 - RNA, 22 nt, Human
acagguagaauuaucuaauuua

SEQ ID NO: 1877028 - RNA, 15 nt, Human
acagguaauauaaaa

SEQ ID NO: 1877029 - RNA, 15 nt, Human
acagcuccuucuguc

SEQ ID NO: 1877030 - RNA, 20 nt, Human
acagcucugcauacucauua

SEQ ID NO: 1877031 - RNA, 14 nt, Human
acagcugccuggga

SEQ ID NO: 1877032 - RNA, 23 nt, Human
acagcugccugggaucccucauc

SEQ ID NO: 1877033 - RNA, 10 nt, Human
acagcugcuc

SEQ ID NO: 1877034 - RNA, 14 nt, Human
acagcuccuucugu

SEQ ID NO: 1877035 - RNA, 13 nt, Human
acagcuccuucug

SEQ ID NO: 1877036 - RNA, 12 nt, Human
acagcuccuucu

SEQ ID NO: 1877037 - RNA, 16 nt, Human
acauccugugccucca

SEQ ID NO: 1877038 - RNA, 15 nt, Human
acaucgcacugugga

SEQ ID NO: 1877039 - RNA, 20 nt, Human
acauccaauauuuucuuuaa

SEQ ID NO: 1877040 - RNA, 22 nt, Human
acaucagcacgauuucuguuua

SEQ ID NO: 1877041 - RNA, 13 nt, Human
acauaaauuagag

SEQ ID NO: 1877042 - RNA, 21 nt, Human
acaucagcacgauuucuguuu

SEQ ID NO: 1877043 - RNA, 20 nt, Human
acaucagcacgauuucuguu

SEQ ID NO: 1877044 - RNA, 23 nt, Human
acauaaacaagaccacguuucua

SEQ ID NO: 1877045 - RNA, 13 nt, Human
acauaaagcaaau

SEQ ID NO: 1877046 - RNA, 21 nt, Human
acauaaagcaaauagacacag

SEQ ID NO: 1877047 - RNA, 15 nt, Human
acauaaagcaaauag

SEQ ID NO: 1877048 - RNA, 18 nt, Human
acauaaagcaaauagaca

SEQ ID NO: 1877049 - RNA, 18 nt, Human
acagguuugggaccccug

SEQ ID NO: 1877050 - RNA, 15 nt, Human
acagguuugggaccc

SEQ ID NO: 1877051 - RNA, 19 nt, Human
acaugcaaggucauuuuuu

SEQ ID NO: 1877052 - RNA, 15 nt, Human
acaucuaagccugaa

SEQ ID NO: 1877053 - RNA, 13 nt, Human
acaucuaagccug

SEQ ID NO: 1877054 - RNA, 20 nt, Human
acaugcacagcuaacaugga

SEQ ID NO: 1877055 - RNA, 23 nt, Human
acaugcacagcuaacauggaagu

SEQ ID NO: 1877056 - RNA, 21 nt, Human
acauguuuuucuucucccuca

SEQ ID NO: 1877057 - RNA, 13 nt, Human
acauguuacaaca

SEQ ID NO: 1877058 - RNA, 20 nt, Human
accaagccuggucagcccaa

SEQ ID NO: 1877059 - RNA, 19 nt, Human
accaagccuggucagccca

SEQ ID NO: 1877060 - RNA, 14 nt, Human
accacuacauucug

SEQ ID NO: 1877061 - RNA, 19 nt, Human
accacguuucuaaaggcua

SEQ ID NO: 1877062 - RNA, 15 nt, Human
accacguuucuaaag

SEQ ID NO: 1877063 - RNA, 13 nt, Human
accagcagccugg

SEQ ID NO: 1877064 - RNA, 14 nt, Human
accagcagccugga

SEQ ID NO: 1877065 - RNA, 17 nt, Human
accagcagccuggaccc

SEQ ID NO: 1877066 - RNA, 17 nt, Human
accagcagcgccuuucc

SEQ ID NO: 1877067 - RNA, 18 nt, Human
accagcagcgccuuuccc

SEQ ID NO: 1877068 - RNA, 15 nt, Human
acauuuggaauacuu

SEQ ID NO: 1877069 - RNA, 16 nt, Human
acauuuggaauacuuu

SEQ ID NO: 1877070 - RNA, 17 nt, Human
acauuuggaauacuuuu

SEQ ID NO: 1877071 - RNA, 18 nt, Human
acauuuggaauacuuuuu

SEQ ID NO: 1877072 - RNA, 21 nt, Human
acauuuguagcauccucuuua

SEQ ID NO: 1877073 - RNA, 23 nt, Human
accaacugucacucauugcugag

SEQ ID NO: 1877074 - RNA, 12 nt, Human
acauuuggaaua

SEQ ID NO: 1877075 - RNA, 16 nt, Human
accccgacgccacagc

SEQ ID NO: 1877076 - RNA, 20 nt, Human
accccggggugcccacaggc

SEQ ID NO: 1877077 - RNA, 21 nt, Human
accccggggugcccacaggcc

SEQ ID NO: 1877078 - RNA, 23 nt, Human
accccggggugcccacaggccgc

SEQ ID NO: 1877079 - RNA, 14 nt, Human
accccgucaacaaa

SEQ ID NO: 1877080 - RNA, 15 nt, Human
accccggccaccugc

SEQ ID NO: 1877081 - RNA, 13 nt, Human
acccaagggccug

SEQ ID NO: 1877082 - RNA, 16 nt, Human
acccaagggccuggcc

SEQ ID NO: 1877083 - RNA, 15 nt, Human
acccacaagaaauga

SEQ ID NO: 1877084 - RNA, 13 nt, Human
acccaauccaaau

SEQ ID NO: 1877085 - RNA, 14 nt, Human
acccaauccaaaug

SEQ ID NO: 1877086 - RNA, 17 nt, Human
acccaugcugcccugug

SEQ ID NO: 1877087 - RNA, 18 nt, Human
acccaugcugcccuguga

SEQ ID NO: 1877088 - RNA, 20 nt, Human
acccaugaguuggggucugg

SEQ ID NO: 1877089 - RNA, 21 nt, Human
acccaugaguuggggucuggc

SEQ ID NO: 1877090 - RNA, 19 nt, Human
acccaugcugcccugugag

SEQ ID NO: 1877091 - RNA, 16 nt, Human
acccaugcugcccugu

SEQ ID NO: 1877092 - RNA, 17 nt, Human
accaucaugucuggcua

SEQ ID NO: 1877093 - RNA, 16 nt, Human
accaucaugucuggcu

SEQ ID NO: 1877094 - RNA, 18 nt, Human
accaucccugaaggcccc

SEQ ID NO: 1877095 - RNA, 21 nt, Human
accaucccugaaggccccgcc

SEQ ID NO: 1877096 - RNA, 22 nt, Human
accaucccugaaggccccgccc

SEQ ID NO: 1877097 - RNA, 15 nt, Human
acccaagcuuagaac

SEQ ID NO: 1877098 - RNA, 14 nt, Human
accaucaugucugg

SEQ ID NO: 1877099 - RNA, 12 nt, Human
accaucauccua

SEQ ID NO: 1877100 - RNA, 20 nt, Human
accccucaacaccucugcac

SEQ ID NO: 1877101 - RNA, 15 nt, Human
auauggacacuuaau

SEQ ID NO: 1877102 - RNA, 20 nt, Human
auauggacacuuaauacuac

SEQ ID NO: 1877103 - RNA, 19 nt, Human
auauggaacuuacauuguu

SEQ ID NO: 1877104 - RNA, 14 nt, Human
auaugcuuauacac

SEQ ID NO: 1877105 - RNA, 16 nt, Human
auaugcuuauacacuu

SEQ ID NO: 1877106 - RNA, 19 nt, Human
auaugcuuauacacuuaca

SEQ ID NO: 1877107 - RNA, 17 nt, Human
auaugcaguuuuccuua

SEQ ID NO: 1877108 - RNA, 22 nt, Human
auauccuucuagaucauacaca

SEQ ID NO: 1877109 - RNA, 22 nt, Human
auaugccugggcagaaggaaga

SEQ ID NO: 1877110 - RNA, 18 nt, Human
auauccauucuuucugau

SEQ ID NO: 1877111 - RNA, 17 nt, Human
auauccauucuuucuga

SEQ ID NO: 1877112 - RNA, 17 nt, Human
auauucaggaagcucag

SEQ ID NO: 1877113 - RNA, 14 nt, Human
auauucaggaagcu

SEQ ID NO: 1877114 - RNA, 16 nt, Human
auauucaggaagcuca

SEQ ID NO: 1877115 - RNA, 13 nt, Human
auauucaggaagc

SEQ ID NO: 1877116 - RNA, 22 nt, Human
auauuauaauuuuuuucaauau

SEQ ID NO: 1877117 - RNA, 18 nt, Human
auauuuaguguucauaaa

SEQ ID NO: 1877118 - RNA, 16 nt, Human
auauuuauaaaaauaa

SEQ ID NO: 1877119 - RNA, 14 nt, Human
auauuuagcuccaa

SEQ ID NO: 1877120 - RNA, 14 nt, Human
auauuuauaaaacu

SEQ ID NO: 1877121 - RNA, 14 nt, Human
auauuuauuaccuc

SEQ ID NO: 1877122 - RNA, 16 nt, Human
auauuuauuaccucug

SEQ ID NO: 1877123 - RNA, 22 nt, Human
auauaauguuguuauuuaaaga

SEQ ID NO: 1877124 - RNA, 21 nt, Human
auauaauguuguuauuuaaag

SEQ ID NO: 1877125 - RNA, 15 nt, Human
auauaaguguguguu

SEQ ID NO: 1877126 - RNA, 16 nt, Human
auaguaugguggcugg

SEQ ID NO: 1877127 - RNA, 15 nt, Human
auauaagugauugcu

SEQ ID NO: 1877128 - RNA, 15 nt, Human
auaguaugguggcug

SEQ ID NO: 1877129 - RNA, 15 nt, Human
auacuugaaaauuaa

SEQ ID NO: 1877130 - RNA, 16 nt, Human
auacuugaaaauuaac

SEQ ID NO: 1877131 - RNA, 21 nt, Human
auacuuccuuaugcuucuuuc

SEQ ID NO: 1877132 - RNA, 16 nt, Human
auauaggaacuuaaau

SEQ ID NO: 1877133 - RNA, 16 nt, Human
auauagcccagccagg

SEQ ID NO: 1877134 - RNA, 17 nt, Human
auaccucugugugcucc

SEQ ID NO: 1877135 - RNA, 16 nt, Human
auaccucugugugcuc

SEQ ID NO: 1877136 - RNA, 17 nt, Human
auaccugggauacugug

SEQ ID NO: 1877137 - RNA, 13 nt, Human
auaccuaagcaaa

SEQ ID NO: 1877138 - RNA, 13 nt, Human
auaccuguccccc

SEQ ID NO: 1877139 - RNA, 20 nt, Human
auaccugggauacugugccc

SEQ ID NO: 1877140 - RNA, 12 nt, Human
auaccugucccc

SEQ ID NO: 1877141 - RNA, 16 nt, Human
auaauuauaauauacu

SEQ ID NO: 1877142 - RNA, 14 nt, Human
auaauuacuauguc

SEQ ID NO: 1877143 - RNA, 16 nt, Human
auacuuaagcaaaagu

SEQ ID NO: 1877144 - RNA, 14 nt, Human
auacuuaagcaaaa

SEQ ID NO: 1877145 - RNA, 18 nt, Human
auaaugugaaacuggauu

SEQ ID NO: 1877146 - RNA, 22 nt, Human
auaaguuaacuauuuuauuuuc

SEQ ID NO: 1877147 - RNA, 19 nt, Human
auaaguguguguuuuucau

SEQ ID NO: 1877148 - RNA, 22 nt, Human
auaaguguguguuuuucauaaa

SEQ ID NO: 1877149 - RNA, 21 nt, Human
auaaugugaaacuggauuaaa

SEQ ID NO: 1877150 - RNA, 19 nt, Human
auaaugugaaacuggauua

SEQ ID NO: 1877151 - RNA, 19 nt, Human
auaaguauuuaauucaugu

SEQ ID NO: 1877152 - RNA, 14 nt, Human
auaaguguauuuuu

SEQ ID NO: 1877153 - RNA, 16 nt, Human
auaaguguauuuuuca

SEQ ID NO: 1877154 - RNA, 19 nt, Human
auaacagauuuuuuuugga

SEQ ID NO: 1877155 - RNA, 15 nt, Human
agugauuaccaggga

SEQ ID NO: 1877156 - RNA, 18 nt, Human
agugauuaccagggacug

SEQ ID NO: 1877157 - RNA, 14 nt, Human
agugauuacuguca

SEQ ID NO: 1877158 - RNA, 16 nt, Human
agugucuuuccacucc

SEQ ID NO: 1877159 - RNA, 23 nt, Human
agugugacaaggauugcuacugu

SEQ ID NO: 1877160 - RNA, 18 nt, Human
agugugaauaaagugcug

SEQ ID NO: 1877161 - RNA, 20 nt, Human
agugugaagcuuccuuggcu

SEQ ID NO: 1877162 - RNA, 19 nt, Human
aguuaagacaugauuuccu

SEQ ID NO: 1877163 - RNA, 20 nt, Human
aguuaagacaugauuuccuu

SEQ ID NO: 1877164 - RNA, 16 nt, Human
aguuaacuauuuuauu

SEQ ID NO: 1877165 - RNA, 15 nt, Human
aguuguuacauuuuu

SEQ ID NO: 1877166 - RNA, 13 nt, Human
aguuguuacauuu

SEQ ID NO: 1877167 - RNA, 23 nt, Human
aguuguuaauaaaaguacauguu

SEQ ID NO: 1877168 - RNA, 16 nt, Human
aguuguuacauuuuua

SEQ ID NO: 1877169 - RNA, 18 nt, Human
aguuacagacaaagcgug

SEQ ID NO: 1877170 - RNA, 13 nt, Human
aguuaagaccugg

SEQ ID NO: 1877171 - RNA, 16 nt, Human
aguuaagaccuggcag

SEQ ID NO: 1877172 - RNA, 17 nt, Human
aguuaagaccuggcagc

SEQ ID NO: 1877173 - RNA, 20 nt, Human
aguuacagccuguuaguaac

SEQ ID NO: 1877174 - RNA, 22 nt, Human
aguuacagccuguuaguaacau

SEQ ID NO: 1877175 - RNA, 23 nt, Human
aguugaauugaggggauuaauau

SEQ ID NO: 1877176 - RNA, 19 nt, Human
aguuguaccgcaaugugac

SEQ ID NO: 1877177 - RNA, 18 nt, Human
aguuguaccgcaauguga

SEQ ID NO: 1877178 - RNA, 15 nt, Human
aguugaauuuuacau

SEQ ID NO: 1877179 - RNA, 23 nt, Human
aguuguaucagcacguguggccu

SEQ ID NO: 1877180 - RNA, 20 nt, Human
aguuguaucagcacgugugg

SEQ ID NO: 1877181 - RNA, 16 nt, Human
agucaagugaaaaagg

SEQ ID NO: 1877182 - RNA, 20 nt, Human
agucaagcuccuccucccug

SEQ ID NO: 1877183 - RNA, 22 nt, Human
agucaagcuccuccucccugca

SEQ ID NO: 1877184 - RNA, 13 nt, Human
agucaagcuccuc

SEQ ID NO: 1877185 - RNA, 14 nt, Human
agucaagcuccucc

SEQ ID NO: 1877186 - RNA, 15 nt, Human
agucaagcuccuccu

SEQ ID NO: 1877187 - RNA, 16 nt, Human
agucaagcuccuccuc

SEQ ID NO: 1877188 - RNA, 17 nt, Human
agucaagcuccuccucc

SEQ ID NO: 1877189 - RNA, 18 nt, Human
agucaagcuccuccuccc

SEQ ID NO: 1877190 - RNA, 20 nt, Human
agucaagugaaaaaggagga

SEQ ID NO: 1877191 - RNA, 17 nt, Human
agucaauauuuuuagau

SEQ ID NO: 1877192 - RNA, 14 nt, Human
aguccaauguggca

SEQ ID NO: 1877193 - RNA, 11 nt, Human
aguccaagcug

SEQ ID NO: 1877194 - RNA, 14 nt, Human
aguccaagcuggga

SEQ ID NO: 1877195 - RNA, 16 nt, Human
aguccaagcugggaga

SEQ ID NO: 1877196 - RNA, 15 nt, Human
agucauuggcugucu

SEQ ID NO: 1877197 - RNA, 17 nt, Human
agucauucguucugugg

SEQ ID NO: 1877198 - RNA, 20 nt, Human
agucauucucauugaauuau

SEQ ID NO: 1877199 - RNA, 23 nt, Human
agucauucagauaugauucaaau

SEQ ID NO: 1877200 - RNA, 20 nt, Human
agucauucagauaugauuca

SEQ ID NO: 1877201 - RNA, 15 nt, Human
agucauucagauaug

SEQ ID NO: 1877202 - RNA, 13 nt, Human
agugauccuccca

SEQ ID NO: 1877203 - RNA, 16 nt, Human
aguccacaguggaacc

SEQ ID NO: 1877204 - RNA, 20 nt, Human
aguccagaaacuguucccac

SEQ ID NO: 1877205 - RNA, 18 nt, Human
augggaaucaagauuuaa

SEQ ID NO: 1877206 - RNA, 18 nt, Human
augggaaggugggcgggc

SEQ ID NO: 1877207 - RNA, 21 nt, Human
augggaaggugggcgggcagg

SEQ ID NO: 1877208 - RNA, 21 nt, Human
augggaaugaaugucagugug

SEQ ID NO: 1877209 - RNA, 15 nt, Human
augggaaugaauguc

SEQ ID NO: 1877210 - RNA, 18 nt, Human
auggcucuaaaaaguuuu

SEQ ID NO: 1877211 - RNA, 12 nt, Human
auggcuccucuc

SEQ ID NO: 1877212 - RNA, 13 nt, Human
auggcuccucuca

SEQ ID NO: 1877213 - RNA, 23 nt, Human
auggcugccaaugggagcucaug

SEQ ID NO: 1877214 - RNA, 19 nt, Human
auggaugggggaacucaga

SEQ ID NO: 1877215 - RNA, 12 nt, Human
auggauggaaaa

SEQ ID NO: 1877216 - RNA, 21 nt, Human
auggauggaaaacgcucucua

SEQ ID NO: 1877217 - RNA, 13 nt, Human
auggaugccaaua

SEQ ID NO: 1877218 - RNA, 22 nt, Human
auggaugccaauauuaaaucug

SEQ ID NO: 1877219 - RNA, 23 nt, Human
auggaugccaauauuaaaucugc

SEQ ID NO: 1877220 - RNA, 21 nt, Human
auggaaaacgcucucuacucu

SEQ ID NO: 1877221 - RNA, 19 nt, Human
auggaaaugggcagagcag

SEQ ID NO: 1877222 - RNA, 20 nt, Human
auggaaaugggcagagcaga

SEQ ID NO: 1877223 - RNA, 22 nt, Human
augcuuuuuauuauuauuauuu

SEQ ID NO: 1877224 - RNA, 16 nt, Human
augcuuuuuauuucug

SEQ ID NO: 1877225 - RNA, 19 nt, Human
augcuuuuuauuucugcau

SEQ ID NO: 1877226 - RNA, 23 nt, Human
augcuuuuuauuucugcauaugu

SEQ ID NO: 1877227 - RNA, 19 nt, Human
auggaaaacgcucucuacu

SEQ ID NO: 1877228 - RNA, 22 nt, Human
augcuuuuauauuuuuuuaaaa

SEQ ID NO: 1877229 - RNA, 14 nt, Human
augcuucuuucaaa

SEQ ID NO: 1877230 - RNA, 18 nt, Human
augcacauauggacucug

SEQ ID NO: 1877231 - RNA, 20 nt, Human
augcaugaaguaauaugcac

SEQ ID NO: 1877232 - RNA, 23 nt, Human
augcaugaaguaauaugcacaca

SEQ ID NO: 1877233 - RNA, 18 nt, Human
augcauuugaaaauuuug

SEQ ID NO: 1877234 - RNA, 12 nt, Human
augcauuugaaa

SEQ ID NO: 1877235 - RNA, 10 nt, Human
augcauuuga

SEQ ID NO: 1877236 - RNA, 17 nt, Human
augccugguggcagcug

SEQ ID NO: 1877237 - RNA, 16 nt, Human
augccugguggcagcu

SEQ ID NO: 1877238 - RNA, 15 nt, Human
augccugguggcagc

SEQ ID NO: 1877239 - RNA, 21 nt, Human
augccuggauggggcugcacc

SEQ ID NO: 1877240 - RNA, 23 nt, Human
augccuggauggggcugcaccgg

SEQ ID NO: 1877241 - RNA, 17 nt, Human
augccugggcagaagga

SEQ ID NO: 1877242 - RNA, 21 nt, Human
augcacagcuaacauggaagu

SEQ ID NO: 1877243 - RNA, 23 nt, Human
augcacacauuuuuuaaaugcac

SEQ ID NO: 1877244 - RNA, 14 nt, Human
augcacagcuaaca

SEQ ID NO: 1877245 - RNA, 22 nt, Human
augcacacauuuuuuaaaugca

SEQ ID NO: 1877246 - RNA, 19 nt, Human
augcacacauuuuuuaaau

SEQ ID NO: 1877247 - RNA, 17 nt, Human
augcacacauuuuuuaa

SEQ ID NO: 1877248 - RNA, 19 nt, Human
augaugugggucaaggaau

SEQ ID NO: 1877249 - RNA, 19 nt, Human
augauguguacccaaacgu

SEQ ID NO: 1877250 - RNA, 21 nt, Human
augccuuuguacuuuagggaa

SEQ ID NO: 1877251 - RNA, 14 nt, Human
augccuuuuauuuc

SEQ ID NO: 1877252 - RNA, 22 nt, Human
augucuuguacauguguagccu

SEQ ID NO: 1877253 - RNA, 17 nt, Human
augucuuguacaugugu

SEQ ID NO: 1877254 - RNA, 14 nt, Human
augucuuguacaug

SEQ ID NO: 1877255 - RNA, 20 nt, Human
augucuuggacacuguacaa

SEQ ID NO: 1877256 - RNA, 19 nt, Human
augucuuggacacuguaca

SEQ ID NO: 1877257 - RNA, 16 nt, Human
augucuuggacacugu

SEQ ID NO: 1877258 - RNA, 13 nt, Human
augucuuggacac

SEQ ID NO: 1877259 - RNA, 16 nt, Human
auguaaucaauguuuc

SEQ ID NO: 1877260 - RNA, 15 nt, Human
auguaaucaauguuu

SEQ ID NO: 1877261 - RNA, 16 nt, Human
auguaaguaaacgguc

SEQ ID NO: 1877262 - RNA, 17 nt, Human
auguaagcucuacugag

SEQ ID NO: 1877263 - RNA, 23 nt, Human
auggugacuuuugaaaagaggug

SEQ ID NO: 1877264 - RNA, 24 nt, Human
auggugaaaccccgucucuacuaa

SEQ ID NO: 1877265 - RNA, 17 nt, Human
auguacauguacugauu

SEQ ID NO: 1877266 - RNA, 20 nt, Human
auguacaggaugcuuugguu

SEQ ID NO: 1877267 - RNA, 14 nt, Human
auguacaagaugaa

SEQ ID NO: 1877268 - RNA, 20 nt, Human
auguacaauaagaacuucua

SEQ ID NO: 1877269 - RNA, 14 nt, Human
auguacaggaugcu

SEQ ID NO: 1877270 - RNA, 17 nt, Human
auguacaggaugcuuug

SEQ ID NO: 1877271 - RNA, 15 nt, Human
auguacaugagaagg

SEQ ID NO: 1877272 - RNA, 17 nt, Human
augucacaggcaggucc

SEQ ID NO: 1877273 - RNA, 16 nt, Human
augucacaggcagguc

SEQ ID NO: 1877274 - RNA, 14 nt, Human
augucacaggcagg

SEQ ID NO: 1877275 - RNA, 15 nt, Human
augucacaggcaggu

SEQ ID NO: 1877276 - RNA, 14 nt, Human
auguguagccugug

SEQ ID NO: 1877277 - RNA, 18 nt, Human
auguucucugaggacacu

SEQ ID NO: 1877278 - RNA, 18 nt, Human
auguuucuuuguaaugaa

SEQ ID NO: 1877279 - RNA, 20 nt, Human
auguucuuucacccuuuucu

SEQ ID NO: 1877280 - RNA, 15 nt, Human
auguucuuaauucuu

SEQ ID NO: 1877281 - RNA, 20 nt, Human
auguucuuaguggauguucu

SEQ ID NO: 1877282 - RNA, 22 nt, Human
auguucugacccugcuucaaau

SEQ ID NO: 1877283 - RNA, 18 nt, Human
auguuuuaagaggcaggg

SEQ ID NO: 1877284 - RNA, 16 nt, Human
auguuuuaagaggcag

SEQ ID NO: 1877285 - RNA, 16 nt, Human
auguuugcacuuguga

SEQ ID NO: 1877286 - RNA, 14 nt, Human
auuaaaugcccagc

SEQ ID NO: 1877287 - RNA, 15 nt, Human
auuaaaugcccagcc

SEQ ID NO: 1877288 - RNA, 16 nt, Human
auuaaaugcccagccc

SEQ ID NO: 1877289 - RNA, 13 nt, Human
auuaaauucacaa

SEQ ID NO: 1877290 - RNA, 13 nt, Human
auuaaauucuugc

SEQ ID NO: 1877291 - RNA, 14 nt, Human
auuaaauucacaaa

SEQ ID NO: 1877292 - RNA, 16 nt, Human
auuaaauucacaaacu

SEQ ID NO: 1877293 - RNA, 17 nt, Human
auuaaauucacaaacuu

SEQ ID NO: 1877294 - RNA, 18 nt, Human
auuaaauucacaaacuuu

SEQ ID NO: 1877295 - RNA, 14 nt, Human
auguguaaguauuc

SEQ ID NO: 1877296 - RNA, 21 nt, Human
augugguuacacagugugaau

SEQ ID NO: 1877297 - RNA, 16 nt, Human
augugggucaaggaau

SEQ ID NO: 1877298 - RNA, 18 nt, Human
augugggggucugugugu

SEQ ID NO: 1877299 - RNA, 17 nt, Human
augugggggucugugug

SEQ ID NO: 1877300 - RNA, 16 nt, Human
augugggggucugugu

SEQ ID NO: 1877301 - RNA, 22 nt, Human
aucuuauaauuuaaaauaugcu

SEQ ID NO: 1877302 - RNA, 15 nt, Human
aucugggcacugaag

SEQ ID NO: 1877303 - RNA, 19 nt, Human
aucuggaaccucagccugg

SEQ ID NO: 1877304 - RNA, 20 nt, Human
aucuggaaccucagccuggc

SEQ ID NO: 1877305 - RNA, 21 nt, Human
aucuggaaccucagccuggcc

SEQ ID NO: 1877306 - RNA, 22 nt, Human
aucuggaaccucagccuggcca

SEQ ID NO: 1877307 - RNA, 21 nt, Human
aucuggaaucuggagaccagg

SEQ ID NO: 1877308 - RNA, 19 nt, Human
aucuuccaacucaaacucu

SEQ ID NO: 1877309 - RNA, 22 nt, Human
aucuuaucaagaguugugacaa

SEQ ID NO: 1877310 - RNA, 18 nt, Human
aucuuaucauggucucag

SEQ ID NO: 1877311 - RNA, 20 nt, Human
aucuuaucauggucucaguc

SEQ ID NO: 1877312 - RNA, 15 nt, Human
aucucucuucuuuuc

SEQ ID NO: 1877313 - RNA, 14 nt, Human
aucucucugcccaa

SEQ ID NO: 1877314 - RNA, 20 nt, Human
aucugcucuccuuccuggag

SEQ ID NO: 1877315 - RNA, 17 nt, Human
aucugcucuccuuccug

SEQ ID NO: 1877316 - RNA, 16 nt, Human
aucugcucuccuuccu

SEQ ID NO: 1877317 - RNA, 15 nt, Human
aucugcucuccuucc

SEQ ID NO: 1877318 - RNA, 14 nt, Human
aucugcucuccuuc

SEQ ID NO: 1877319 - RNA, 13 nt, Human
aucugcucuccuu

SEQ ID NO: 1877320 - RNA, 21 nt, Human
aucugcucuccuuccuggagc

SEQ ID NO: 1877321 - RNA, 14 nt, Human
aucugcuggaguuu

SEQ ID NO: 1877322 - RNA, 18 nt, Human
aucugcuggaguuucaug

SEQ ID NO: 1877323 - RNA, 19 nt, Human
aucuggaacccagacucag

SEQ ID NO: 1877324 - RNA, 23 nt, Human
aucuggaacccagacucagacau

SEQ ID NO: 1877325 - RNA, 11 nt, Human
aucuggaaccu

SEQ ID NO: 1877326 - RNA, 16 nt, Human
aucuggaaccucagcc

SEQ ID NO: 1877327 - RNA, 17 nt, Human
aucuggaaccucagccu

SEQ ID NO: 1877328 - RNA, 18 nt, Human
aucuggaaccucagccug

SEQ ID NO: 1877329 - RNA, 22 nt, Human
aucucucgugauugauaagaac

SEQ ID NO: 1877330 - RNA, 18 nt, Human
aucucuaacagcucagga

SEQ ID NO: 1877331 - RNA, 20 nt, Human
aucucuaacagcucaggauc

SEQ ID NO: 1877332 - RNA, 17 nt, Human
aucuugaagacuuuucu

SEQ ID NO: 1877333 - RNA, 23 nt, Human
aucuugaaauuaagaaggcaaaa

SEQ ID NO: 1877334 - RNA, 21 nt, Human
aucuugaaauuaagaaggcaa

SEQ ID NO: 1877335 - RNA, 22 nt, Human
aucuugaaauuaagaaggcaaa

SEQ ID NO: 1877336 - RNA, 17 nt, Human
aucuucuuuauaauucu

SEQ ID NO: 1877337 - RNA, 12 nt, Human
aucuugaaauua

SEQ ID NO: 1877338 - RNA, 22 nt, Human
augaaaaaauauauaucaaaua

SEQ ID NO: 1877339 - RNA, 14 nt, Human
augaaaaaauauau

SEQ ID NO: 1877340 - RNA, 17 nt, Human
augaaaaaauauauauc

SEQ ID NO: 1877341 - RNA, 12 nt, Human
augaaaacuuau

SEQ ID NO: 1877342 - RNA, 17 nt, Human
augacuccagaauuucc

SEQ ID NO: 1877343 - RNA, 12 nt, Human
augacuccagaa

SEQ ID NO: 1877344 - RNA, 16 nt, Human
augacuccagaauuuc

SEQ ID NO: 1877345 - RNA, 19 nt, Human
augacucaggacauccccc

SEQ ID NO: 1877346 - RNA, 15 nt, Human
augacucaagauucc

SEQ ID NO: 1877347 - RNA, 16 nt, Human
augacucaagauuccc

SEQ ID NO: 1877348 - RNA, 19 nt, Human
augacucaagauucccagg

SEQ ID NO: 1877349 - RNA, 20 nt, Human
augacucaagauucccagga

SEQ ID NO: 1877350 - RNA, 21 nt, Human
augacucaagauucccaggag

SEQ ID NO: 1877351 - RNA, 22 nt, Human
augacucaagauucccaggagu

SEQ ID NO: 1877352 - RNA, 23 nt, Human
augacucaagauucccaggaguu

SEQ ID NO: 1877353 - RNA, 16 nt, Human
augacuaauucuugca

SEQ ID NO: 1877354 - RNA, 17 nt, Human
augacuaauucuugcau

SEQ ID NO: 1877355 - RNA, 18 nt, Human
augaagcuuuuaugugaa

SEQ ID NO: 1877356 - RNA, 19 nt, Human
augaagcuuuuaugugaaa

SEQ ID NO: 1877357 - RNA, 20 nt, Human
augaagcuuuuaugugaaac

SEQ ID NO: 1877358 - RNA, 21 nt, Human
augaagcuuuuaugugaaaca

SEQ ID NO: 1877359 - RNA, 12 nt, Human
augacccagugg

SEQ ID NO: 1877360 - RNA, 18 nt, Human
augaccucuuccuuuagg

SEQ ID NO: 1877361 - RNA, 13 nt, Human
augagccuggcaa

SEQ ID NO: 1877362 - RNA, 14 nt, Human
augagccuggcaag

SEQ ID NO: 1877363 - RNA, 14 nt, Human
auccuccucagauc

SEQ ID NO: 1877364 - RNA, 13 nt, Human
aucgaugcagugc

SEQ ID NO: 1877365 - RNA, 23 nt, Human
auccucauacccacccccaccca

SEQ ID NO: 1877366 - RNA, 11 nt, Human
auccuccucag

SEQ ID NO: 1877367 - RNA, 13 nt, Human
auccuccaggugc

SEQ ID NO: 1877368 - RNA, 14 nt, Human
auccuccaggugca

SEQ ID NO: 1877369 - RNA, 19 nt, Human
auccuccaggugcacaagc

SEQ ID NO: 1877370 - RNA, 22 nt, Human
auccuccaggugcacaagcucc

SEQ ID NO: 1877371 - RNA, 20 nt, Human
auccacccaccucagccucc

SEQ ID NO: 1877372 - RNA, 18 nt, Human
auccacccaccucagccu

SEQ ID NO: 1877373 - RNA, 15 nt, Human
aucccuacuguaauu

SEQ ID NO: 1877374 - RNA, 22 nt, Human
aucccuaggucuugggagcucu

SEQ ID NO: 1877375 - RNA, 18 nt, Human
auccucauacccaccccc

SEQ ID NO: 1877376 - RNA, 19 nt, Human
auccucauacccaccccca

SEQ ID NO: 1877377 - RNA, 22 nt, Human
auccucauacccacccccaccc

SEQ ID NO: 1877378 - RNA, 11 nt, Human
aucagccuggg

SEQ ID NO: 1877379 - RNA, 20 nt, Human
aucagccugggcaaugugau

SEQ ID NO: 1877380 - RNA, 21 nt, Human
aucagccugggcaaugugaua

SEQ ID NO: 1877381 - RNA, 12 nt, Human
aucagcugcuac

SEQ ID NO: 1877382 - RNA, 13 nt, Human
aucagcugcuacu

SEQ ID NO: 1877383 - RNA, 23 nt, Human
aucagcugcuacuacuccuguag

SEQ ID NO: 1877384 - RNA, 15 nt, Human
aucaucuuugugaag

SEQ ID NO: 1877385 - RNA, 13 nt, Human
aucaucugccgug

SEQ ID NO: 1877386 - RNA, 12 nt, Human
agacuaaaagau

SEQ ID NO: 1877387 - RNA, 12 nt, Human
agacuaaaugaa

SEQ ID NO: 1877388 - RNA, 13 nt, Human
agacuaaaugaaa

SEQ ID NO: 1877389 - RNA, 19 nt, Human
agacggagucccaccuugg

SEQ ID NO: 1877390 - RNA, 18 nt, Human
agacgggggcagagaggg

SEQ ID NO: 1877391 - RNA, 14 nt, Human
agacguguuugugu

SEQ ID NO: 1877392 - RNA, 13 nt, Human
agaccauaauguu

SEQ ID NO: 1877393 - RNA, 13 nt, Human
agaccaucccuga

SEQ ID NO: 1877394 - RNA, 15 nt, Human
agaccagggagccuu

SEQ ID NO: 1877395 - RNA, 14 nt, Human
agaccaucccugaa

SEQ ID NO: 1877396 - RNA, 17 nt, Human
agaccaucccugaaggc

SEQ ID NO: 1877397 - RNA, 18 nt, Human
agaccaucccugaaggcc

SEQ ID NO: 1877398 - RNA, 21 nt, Human
agaccaucccugaaggccccg

SEQ ID NO: 1877399 - RNA, 18 nt, Human
agacagcccgggcucugc

SEQ ID NO: 1877400 - RNA, 20 nt, Human
agacagcccgggcucugccu

SEQ ID NO: 1877401 - RNA, 17 nt, Human
agacagcccgggcucug

SEQ ID NO: 1877402 - RNA, 16 nt, Human
agaccaccacuucgaa

SEQ ID NO: 1877403 - RNA, 21 nt, Human
agacaauuuauuauggcacau

SEQ ID NO: 1877404 - RNA, 15 nt, Human
agacaauuuauuaug

SEQ ID NO: 1877405 - RNA, 19 nt, Human
agacaaugacuuacuguac

SEQ ID NO: 1877406 - RNA, 17 nt, Human
agacaaugacuuacugu

SEQ ID NO: 1877407 - RNA, 13 nt, Human
agacaaugacuua

SEQ ID NO: 1877408 - RNA, 19 nt, Human
agacugaucaggaccucca

SEQ ID NO: 1877409 - RNA, 14 nt, Human
agacugaucaggac

SEQ ID NO: 1877410 - RNA, 16 nt, Human
agacugaucaggaccu

SEQ ID NO: 1877411 - RNA, 17 nt, Human
agacugaucaggaccuc

SEQ ID NO: 1877412 - RNA, 23 nt, Human
agacugaguacguugugcauuug

SEQ ID NO: 1877413 - RNA, 18 nt, Human
agagccuggugcugcugc

SEQ ID NO: 1877414 - RNA, 16 nt, Human
agagccuggugcugcu

SEQ ID NO: 1877415 - RNA, 23 nt, Human
agagaggguggugaccucugccu

SEQ ID NO: 1877416 - RNA, 18 nt, Human
agagaaaguacuucucca

SEQ ID NO: 1877417 - RNA, 23 nt, Human
agagaaaggggagcccacugucc

SEQ ID NO: 1877418 - RNA, 10 nt, Human
agagaagaga

SEQ ID NO: 1877419 - RNA, 21 nt, Human
agagaagagauugugguuuca

SEQ ID NO: 1877420 - RNA, 18 nt, Human
agagaaaggggagcccac

SEQ ID NO: 1877421 - RNA, 14 nt, Human
agagaaagcgcaga

SEQ ID NO: 1877422 - RNA, 19 nt, Human
agagaaaggggagcccacu

SEQ ID NO: 1877423 - RNA, 21 nt, Human
agagaaaggggagcccacugu

SEQ ID NO: 1877424 - RNA, 21 nt, Human
agauaggucagugcaaauacu

SEQ ID NO: 1877425 - RNA, 15 nt, Human
agauagccaaggcca

SEQ ID NO: 1877426 - RNA, 16 nt, Human
agauagccaaggccaa

SEQ ID NO: 1877427 - RNA, 15 nt, Human
agauaguuacuauau

SEQ ID NO: 1877428 - RNA, 19 nt, Human
agaucuucaaacagaauaa

SEQ ID NO: 1877429 - RNA, 18 nt, Human
agaucuguuuugaaggca

SEQ ID NO: 1877430 - RNA, 19 nt, Human
agaucuguccucagccuug

SEQ ID NO: 1877431 - RNA, 23 nt, Human
agaucuguccucagccuugccag

SEQ ID NO: 1877432 - RNA, 14 nt, Human
agaucuguuuugaa

SEQ ID NO: 1877433 - RNA, 21 nt, Human
agaucuguuuugaaggcaaaa

SEQ ID NO: 1877434 - RNA, 13 nt, Human
agauagccaaggc

SEQ ID NO: 1877435 - RNA, 17 nt, Human
agauacuuugcuagccg

SEQ ID NO: 1877436 - RNA, 22 nt, Human
agauacuuggggggcugaggug

SEQ ID NO: 1877437 - RNA, 18 nt, Human
agaggggcagauggaaag

SEQ ID NO: 1877438 - RNA, 22 nt, Human
agaggggaacagacuggaagca

SEQ ID NO: 1877439 - RNA, 18 nt, Human
agaggggaaaagagauga

SEQ ID NO: 1877440 - RNA, 16 nt, Human
agaggggaagagacuu

SEQ ID NO: 1877441 - RNA, 18 nt, Human
agaggaugcugugaaauu

SEQ ID NO: 1877442 - RNA, 18 nt, Human
agaggauaauuagcaucu

SEQ ID NO: 1877443 - RNA, 16 nt, Human
agaggggaaaagagau

SEQ ID NO: 1877444 - RNA, 13 nt, Human
agaggagaggggc

SEQ ID NO: 1877445 - RNA, 14 nt, Human
agccgucaccccug

SEQ ID NO: 1877446 - RNA, 19 nt, Human
agccucccaaagugcuggg

SEQ ID NO: 1877447 - RNA, 18 nt, Human
agccucccaaagugcugg

SEQ ID NO: 1877448 - RNA, 21 nt, Human
agccgagaucacgccacugca

SEQ ID NO: 1877449 - RNA, 19 nt, Human
agccgagauugcaccacug

SEQ ID NO: 1877450 - RNA, 20 nt, Human
agccgagauugcaccacugc

SEQ ID NO: 1877451 - RNA, 14 nt, Human
agcccugaguuccu

SEQ ID NO: 1877452 - RNA, 14 nt, Human
agccgcuggggcca

SEQ ID NO: 1877453 - RNA, 22 nt, Human
agccgcuggggccaguuggucc

SEQ ID NO: 1877454 - RNA, 22 nt, Human
agccucccgaguagcugggacu

SEQ ID NO: 1877455 - RNA, 13 nt, Human
agccucccugaag

SEQ ID NO: 1877456 - RNA, 11 nt, Human
agccuccugag

SEQ ID NO: 1877457 - RNA, 14 nt, Human
agccucccugaagc

SEQ ID NO: 1877458 - RNA, 15 nt, Human
agccucccugaagcc

SEQ ID NO: 1877459 - RNA, 16 nt, Human
agccucccugaagccu

SEQ ID NO: 1877460 - RNA, 17 nt, Human
agccucccgaguagcug

SEQ ID NO: 1877461 - RNA, 22 nt, Human
agccucccgaauagcugggacu

SEQ ID NO: 1877462 - RNA, 20 nt, Human
agccucccgaauagcuggga

SEQ ID NO: 1877463 - RNA, 19 nt, Human
agccucccgaauagcuggg

SEQ ID NO: 1877464 - RNA, 18 nt, Human
agccucccgaauagcugg

SEQ ID NO: 1877465 - RNA, 20 nt, Human
agccucccaaagugcuggga

SEQ ID NO: 1877466 - RNA, 19 nt, Human
agccuccugaguagcugga

SEQ ID NO: 1877467 - RNA, 20 nt, Human
agccgagaucacgccacugc

SEQ ID NO: 1877468 - RNA, 19 nt, Human
agccgagaucacgccacug

SEQ ID NO: 1877469 - RNA, 15 nt, Human
agcccugagcuuucu

SEQ ID NO: 1877470 - RNA, 13 nt, Human
agcccugacccug

SEQ ID NO: 1877471 - RNA, 15 nt, Human
agcccugacccugug

SEQ ID NO: 1877472 - RNA, 17 nt, Human
agcccugacccugugga

SEQ ID NO: 1877473 - RNA, 21 nt, Human
agcccugacccuguggaagca

SEQ ID NO: 1877474 - RNA, 16 nt, Human
agccccagugcccaca

SEQ ID NO: 1877475 - RNA, 20 nt, Human
agccccaucccaaacccuuc

SEQ ID NO: 1877476 - RNA, 11 nt, Human
agccccauccu

SEQ ID NO: 1877477 - RNA, 23 nt, Human
agcccaaagugguauagaaaugc

SEQ ID NO: 1877478 - RNA, 20 nt, Human
agcccaaagugguauagaaa

SEQ ID NO: 1877479 - RNA, 16 nt, Human
agcccaagggaucugg

SEQ ID NO: 1877480 - RNA, 21 nt, Human
agcccaagggaucugguccua

SEQ ID NO: 1877481 - RNA, 22 nt, Human
agcccaagggaucugguccuac

SEQ ID NO: 1877482 - RNA, 21 nt, Human
agcaucuuugaauacaaagaa

SEQ ID NO: 1877483 - RNA, 23 nt, Human
agccaaagcuaggccuggccaga

SEQ ID NO: 1877484 - RNA, 20 nt, Human
agccaaagcuaggccuggcc

SEQ ID NO: 1877485 - RNA, 19 nt, Human
agccaaagcuaggccuggc

SEQ ID NO: 1877486 - RNA, 14 nt, Human
agcaugcacaaauu

SEQ ID NO: 1877487 - RNA, 12 nt, Human
agcaugccugga

SEQ ID NO: 1877488 - RNA, 17 nt, Human
agcaugaucugaaaaau

SEQ ID NO: 1877489 - RNA, 20 nt, Human
agccagaggagagaggaccc

SEQ ID NO: 1877490 - RNA, 16 nt, Human
agccaaggcucuguuu

SEQ ID NO: 1877491 - RNA, 13 nt, Human
agccagaggucug

SEQ ID NO: 1877492 - RNA, 22 nt, Human
agccaaggccaaaggaagcaca

SEQ ID NO: 1877493 - RNA, 23 nt, Human
agccaaggccaaaggaagcacau

SEQ ID NO: 1877494 - RNA, 21 nt, Human
agccaaggcucuguuuaugcu

SEQ ID NO: 1877495 - RNA, 13 nt, Human
agccagcacacag

SEQ ID NO: 1877496 - RNA, 16 nt, Human
agcccaaagaaggaaa

SEQ ID NO: 1877497 - RNA, 15 nt, Human
agcagccagccguga

SEQ ID NO: 1877498 - RNA, 10 nt, Human
agcagccacg

SEQ ID NO: 1877499 - RNA, 13 nt, Human
agcagccacgagg

SEQ ID NO: 1877500 - RNA, 19 nt, Human
agcacuaaggugugcucug

SEQ ID NO: 1877501 - RNA, 20 nt, Human
agcacuaaggugugcucuga

SEQ ID NO: 1877502 - RNA, 21 nt, Human
agcagccacauuccugaugcu

SEQ ID NO: 1877503 - RNA, 14 nt, Human
agauguagaggaga

SEQ ID NO: 1877504 - RNA, 21 nt, Human
agaugggagaaucacuugaac

SEQ ID NO: 1877505 - RNA, 22 nt, Human
agauguaauuguuugucuuuaa

SEQ ID NO: 1877506 - RNA, 21 nt, Human
agguaccccuuucuggcucuc

SEQ ID NO: 1877507 - RNA, 17 nt, Human
agguaccccuuucuggc

SEQ ID NO: 1877508 - RNA, 17 nt, Human
aggucccuaauaaagcu

SEQ ID NO: 1877509 - RNA, 18 nt, Human
aggucccuaauaaagcug

SEQ ID NO: 1877510 - RNA, 19 nt, Human
aggucccuaauaaagcugu

SEQ ID NO: 1877511 - RNA, 20 nt, Human
aggucccuaauaaagcugug

SEQ ID NO: 1877512 - RNA, 18 nt, Human
agguaauauaaaaagcuu

SEQ ID NO: 1877513 - RNA, 17 nt, Human
agguaaggaauaccugu

SEQ ID NO: 1877514 - RNA, 17 nt, Human
aggggccgcugccaccc

SEQ ID NO: 1877515 - RNA, 11 nt, Human
agguucuaaaa

SEQ ID NO: 1877516 - RNA, 14 nt, Human
agguucccaagcuc

SEQ ID NO: 1877517 - RNA, 15 nt, Human
agguucccaagcuca

SEQ ID NO: 1877518 - RNA, 16 nt, Human
agguucccaagcucag

SEQ ID NO: 1877519 - RNA, 13 nt, Human
agguucagcuugu

SEQ ID NO: 1877520 - RNA, 17 nt, Human
agguucaugcaaacuuu

SEQ ID NO: 1877521 - RNA, 17 nt, Human
agguucaaagauauuuu

SEQ ID NO: 1877522 - RNA, 14 nt, Human
agguuaauguucau

SEQ ID NO: 1877523 - RNA, 15 nt, Human
agguuaauaaaguaa

SEQ ID NO: 1877524 - RNA, 23 nt, Human
agguggcaucagugucuuuccac

SEQ ID NO: 1877525 - RNA, 22 nt, Human
agguggcaucagugucuuucca

SEQ ID NO: 1877526 - RNA, 17 nt, Human
aggugcugccauccagg

SEQ ID NO: 1877527 - RNA, 16 nt, Human
aggugcugccauccag

SEQ ID NO: 1877528 - RNA, 16 nt, Human
aggugcugacggccag

SEQ ID NO: 1877529 - RNA, 17 nt, Human
aggugcugacggccagg

SEQ ID NO: 1877530 - RNA, 20 nt, Human
aggugcugacggccagggag

SEQ ID NO: 1877531 - RNA, 14 nt, Human
aggucgaggcagga

SEQ ID NO: 1877532 - RNA, 15 nt, Human
agguggaaauaaacu

SEQ ID NO: 1877533 - RNA, 16 nt, Human
agguggaagagggcug

SEQ ID NO: 1877534 - RNA, 16 nt, Human
agggcacaaagauggg

SEQ ID NO: 1877535 - RNA, 17 nt, Human
agggcacaccgggcacu

SEQ ID NO: 1877536 - RNA, 21 nt, Human
agggcacaccgggcacucaga

SEQ ID NO: 1877537 - RNA, 20 nt, Human
agggcacaccgggcacucag

SEQ ID NO: 1877538 - RNA, 22 nt, Human
agggcacagaaaauggaagaca

SEQ ID NO: 1877539 - RNA, 15 nt, Human
agggccuggccugag

SEQ ID NO: 1877540 - RNA, 14 nt, Human
agggcacaggccau

SEQ ID NO: 1877541 - RNA, 17 nt, Human
agggcacaggccaugga

SEQ ID NO: 1877542 - RNA, 19 nt, Human
agggcacaggccauggaug

SEQ ID NO: 1877543 - RNA, 16 nt, Human
agggccuggccugagc

SEQ ID NO: 1877544 - RNA, 17 nt, Human
agggccuggccugagcu

SEQ ID NO: 1877545 - RNA, 19 nt, Human
agggcgggaggauguucug

SEQ ID NO: 1877546 - RNA, 18 nt, Human
agggccuggccugagcug

SEQ ID NO: 1877547 - RNA, 21 nt, Human
aggggauagagagagaccacu

SEQ ID NO: 1877548 - RNA, 18 nt, Human
aggggauuaauaugaaaa

SEQ ID NO: 1877549 - RNA, 15 nt, Human
aggggcacagggucu

SEQ ID NO: 1877550 - RNA, 15 nt, Human
aggggcagauggaaa

SEQ ID NO: 1877551 - RNA, 19 nt, Human
aggggcagauggaaaggag

SEQ ID NO: 1877552 - RNA, 15 nt, Human
aggggccgcugccac

SEQ ID NO: 1877553 - RNA, 16 nt, Human
aggggccgcugccacc

SEQ ID NO: 1877554 - RNA, 22 nt, Human
aggggccgcugccacccaccuc

SEQ ID NO: 1877555 - RNA, 13 nt, Human
aggggcccggcca

SEQ ID NO: 1877556 - RNA, 15 nt, Human
aggggcccggccagc

SEQ ID NO: 1877557 - RNA, 17 nt, Human
aggggcccggccagcca

SEQ ID NO: 1877558 - RNA, 19 nt, Human
aggggcccggccagccaug

SEQ ID NO: 1877559 - RNA, 21 nt, Human
aggggcccggccagccauguc

SEQ ID NO: 1877560 - RNA, 23 nt, Human
aggggcccggccagccaugucug

SEQ ID NO: 1877561 - RNA, 18 nt, Human
aggcugccucucccauca

SEQ ID NO: 1877562 - RNA, 20 nt, Human
agggacucaucauuuccauu

SEQ ID NO: 1877563 - RNA, 21 nt, Human
agggacgcuacccgggaaggg

SEQ ID NO: 1877564 - RNA, 21 nt, Human
agggacgcuuugggagaaugu

SEQ ID NO: 1877565 - RNA, 12 nt, Human
agggacagaggg

SEQ ID NO: 1877566 - RNA, 17 nt, Human
agggacagaggccccag

SEQ ID NO: 1877567 - RNA, 20 nt, Human
agggacagaggccccagccu

SEQ ID NO: 1877568 - RNA, 21 nt, Human
agggacagaggccccagccuc

SEQ ID NO: 1877569 - RNA, 22 nt, Human
agggacagaggccccagccucc

SEQ ID NO: 1877570 - RNA, 13 nt, Human
agggacagagggg

SEQ ID NO: 1877571 - RNA, 20 nt, Human
agggacagaggggguggccu

SEQ ID NO: 1877572 - RNA, 23 nt, Human
aggcuagugugguguuuccuggc

SEQ ID NO: 1877573 - RNA, 19 nt, Human
aggcuauggggauagaugu

SEQ ID NO: 1877574 - RNA, 22 nt, Human
aggcuauggggauagaugugug

SEQ ID NO: 1877575 - RNA, 21 nt, Human
aggcuauggggauagaugugu

SEQ ID NO: 1877576 - RNA, 18 nt, Human
aggcugaggcuggcacag

SEQ ID NO: 1877577 - RNA, 21 nt, Human
aggcugcaagguuuaggcugg

SEQ ID NO: 1877578 - RNA, 22 nt, Human
aggcugcaagguuuaggcuggu

SEQ ID NO: 1877579 - RNA, 18 nt, Human
aggcugcagccaggccac

SEQ ID NO: 1877580 - RNA, 21 nt, Human
aggaccuccaagccacugagc

SEQ ID NO: 1877581 - RNA, 15 nt, Human
aggaccuccaagcca

SEQ ID NO: 1877582 - RNA, 14 nt, Human
aggaccucagguga

SEQ ID NO: 1877583 - RNA, 20 nt, Human
aggaccucaggugagaagca

SEQ ID NO: 1877584 - RNA, 11 nt, Human
aggagaagcca

SEQ ID NO: 1877585 - RNA, 12 nt, Human
aggagaagccag

SEQ ID NO: 1877586 - RNA, 13 nt, Human
aggagaagccagg

SEQ ID NO: 1877587 - RNA, 21 nt, Human
aggagaacucauguuauuuuu

SEQ ID NO: 1877588 - RNA, 15 nt, Human
aggagagcuagcagc

SEQ ID NO: 1877589 - RNA, 14 nt, Human
aggagaagccagga

SEQ ID NO: 1877590 - RNA, 15 nt, Human
aggagaagccaggaa

SEQ ID NO: 1877591 - RNA, 14 nt, Human
aggagaggggcaca

SEQ ID NO: 1877592 - RNA, 16 nt, Human
aggagaggggcacagg

SEQ ID NO: 1877593 - RNA, 18 nt, Human
aggagaggggcacagggu

SEQ ID NO: 1877594 - RNA, 20 nt, Human
aggaccccuccaugugggcu

SEQ ID NO: 1877595 - RNA, 23 nt, Human
aggaccagcucaggacagaugcc

SEQ ID NO: 1877596 - RNA, 13 nt, Human
aggaccagcucag

SEQ ID NO: 1877597 - RNA, 14 nt, Human
aggaccagcucagg

SEQ ID NO: 1877598 - RNA, 15 nt, Human
aggaccagcucagga

SEQ ID NO: 1877599 - RNA, 18 nt, Human
aggaccagcucaggacag

SEQ ID NO: 1877600 - RNA, 12 nt, Human
aggaccagcuca

SEQ ID NO: 1877601 - RNA, 15 nt, Human
aggaacuacugagga

SEQ ID NO: 1877602 - RNA, 16 nt, Human
aggaacugcugggcuu

SEQ ID NO: 1877603 - RNA, 20 nt, Human
aggauguucugggacacagu

SEQ ID NO: 1877604 - RNA, 14 nt, Human
aggauguugaaaaa

SEQ ID NO: 1877605 - RNA, 17 nt, Human
aggauguugaaaaaguu

SEQ ID NO: 1877606 - RNA, 17 nt, Human
aggaggggauagagaga

SEQ ID NO: 1877607 - RNA, 13 nt, Human
aggaggggccgcu

SEQ ID NO: 1877608 - RNA, 16 nt, Human
aggauucuuccucccu

SEQ ID NO: 1877609 - RNA, 12 nt, Human
aggauucuuccu

SEQ ID NO: 1877610 - RNA, 19 nt, Human
aggauuccucuuuucucug

SEQ ID NO: 1877611 - RNA, 15 nt, Human
aggauuccucuuuuc

SEQ ID NO: 1877612 - RNA, 16 nt, Human
aggauuccucuuuucu

SEQ ID NO: 1877613 - RNA, 16 nt, Human
agcuccucacucaccu

SEQ ID NO: 1877614 - RNA, 13 nt, Human
agcuccuccuccc

SEQ ID NO: 1877615 - RNA, 14 nt, Human
agcuccuccucccu

SEQ ID NO: 1877616 - RNA, 15 nt, Human
agcuccuccucccug

SEQ ID NO: 1877617 - RNA, 16 nt, Human
agcuccuccucccugc

SEQ ID NO: 1877618 - RNA, 17 nt, Human
agcuccuccucccugca

SEQ ID NO: 1877619 - RNA, 23 nt, Human
agcuccuccucccugcaucugac

SEQ ID NO: 1877620 - RNA, 21 nt, Human
agcuccuccucccugcaucug

SEQ ID NO: 1877621 - RNA, 21 nt, Human
agcuggucccacucaguccau

SEQ ID NO: 1877622 - RNA, 22 nt, Human
agcugggugucaagagggucug

SEQ ID NO: 1877623 - RNA, 17 nt, Human
agcugggugucaagagg

SEQ ID NO: 1877624 - RNA, 15 nt, Human
agcugggucaggcag

SEQ ID NO: 1877625 - RNA, 16 nt, Human
agcugggucaggcagg

SEQ ID NO: 1877626 - RNA, 17 nt, Human
agcugggucaggcaggg

SEQ ID NO: 1877627 - RNA, 17 nt, Human
agcugcuccuagaggga

SEQ ID NO: 1877628 - RNA, 18 nt, Human
agcugcuccuagagggag

SEQ ID NO: 1877629 - RNA, 19 nt, Human
agcugcuccuagagggagg

SEQ ID NO: 1877630 - RNA, 20 nt, Human
agcugcuccuagagggaggg

SEQ ID NO: 1877631 - RNA, 22 nt, Human
agcugcuccuagagggaggggc

SEQ ID NO: 1877632 - RNA, 16 nt, Human
agcugacccagccccu

SEQ ID NO: 1877633 - RNA, 23 nt, Human
agcugacccagccccuugagaaa

SEQ ID NO: 1877634 - RNA, 21 nt, Human
agcugaggccacacucagcac

SEQ ID NO: 1877635 - RNA, 22 nt, Human
agcugaggccacacucagcaca

SEQ ID NO: 1877636 - RNA, 15 nt, Human
agcugagugaaaaau

SEQ ID NO: 1877637 - RNA, 19 nt, Human
agcuucucauccugcaggc

SEQ ID NO: 1877638 - RNA, 14 nt, Human
agcuuccuuggcuu

SEQ ID NO: 1877639 - RNA, 15 nt, Human
agcuuccuuggcuuu

SEQ ID NO: 1877640 - RNA, 20 nt, Human
aggaaauggcuguggagugu

SEQ ID NO: 1877641 - RNA, 21 nt, Human
agcuuuuaugugaaacauguu

SEQ ID NO: 1877642 - RNA, 14 nt, Human
aggaaaaacagguc

SEQ ID NO: 1877643 - RNA, 15 nt, Human
agcuuuucccuuuuu

SEQ ID NO: 1877644 - RNA, 13 nt, Human
aggaaaaacugau

SEQ ID NO: 1877645 - RNA, 15 nt, Human
aggaaaaacugauuu

SEQ ID NO: 1877646 - RNA, 17 nt, Human
cugcuaucaaagagguu

SEQ ID NO: 1877647 - RNA, 24 nt, Human
cugcugaaggcucgagcaugccug

SEQ ID NO: 1877648 - RNA, 23 nt, Human
cugcugaaggcucgagcaugccu

SEQ ID NO: 1877649 - RNA, 18 nt, Human
cugcugaaggcucgagca

SEQ ID NO: 1877650 - RNA, 23 nt, Human
cugccuguucagcuccagcucac

SEQ ID NO: 1877651 - RNA, 20 nt, Human
cugccuguucagcuccagcu

SEQ ID NO: 1877652 - RNA, 20 nt, Human
cugcuacucaaguagcauuu

SEQ ID NO: 1877653 - RNA, 23 nt, Human
cugcuacucaaguagcauuuacu

SEQ ID NO: 1877654 - RNA, 17 nt, Human
cugcuacuggcaaaagg

SEQ ID NO: 1877655 - RNA, 18 nt, Human
cugcuacuguaauuuuau

SEQ ID NO: 1877656 - RNA, 14 nt, Human
cugccuccuuugug

SEQ ID NO: 1877657 - RNA, 14 nt, Human
cugccucgaacugg

SEQ ID NO: 1877658 - RNA, 23 nt, Human
cugccuccuuugugaggaagccg

SEQ ID NO: 1877659 - RNA, 17 nt, Human
cugccuccuuugugagg

SEQ ID NO: 1877660 - RNA, 21 nt, Human
cugccuccuuugugaggaagc

SEQ ID NO: 1877661 - RNA, 20 nt, Human
cugccucgaacuggcugcaa

SEQ ID NO: 1877662 - RNA, 15 nt, Human
cugccucgaaacaca

SEQ ID NO: 1877663 - RNA, 18 nt, Human
cugccucgaaacacagaa

SEQ ID NO: 1877664 - RNA, 19 nt, Human
cugccucgaacuggcugca

SEQ ID NO: 1877665 - RNA, 21 nt, Human
cugccucucacagcugaguug

SEQ ID NO: 1877666 - RNA, 22 nt, Human
cugccucucacagcugaguugu

SEQ ID NO: 1877667 - RNA, 14 nt, Human
cugccucucacagc

SEQ ID NO: 1877668 - RNA, 16 nt, Human
cugccucucacagcug

SEQ ID NO: 1877669 - RNA, 19 nt, Human
cugccucgaaacacagaaa

SEQ ID NO: 1877670 - RNA, 22 nt, Human
cugcccuuaccugccaggaagc

SEQ ID NO: 1877671 - RNA, 23 nt, Human
cugcccuuaccugccaggaagcc

SEQ ID NO: 1877672 - RNA, 11 nt, Human
cugcccugugg

SEQ ID NO: 1877673 - RNA, 12 nt, Human
cugcccuguggg

SEQ ID NO: 1877674 - RNA, 14 nt, Human
cugcccugugggcc

SEQ ID NO: 1877675 - RNA, 19 nt, Human
cugcccuuaccugccagga

SEQ ID NO: 1877676 - RNA, 24 nt, Human
cugcccugugaguacuacaguccu

SEQ ID NO: 1877677 - RNA, 20 nt, Human
cuggcagaguugaagacaga

SEQ ID NO: 1877678 - RNA, 21 nt, Human
cuggcagaguugaagacagag

SEQ ID NO: 1877679 - RNA, 23 nt, Human
cuggcagccccuguucuggcaga

SEQ ID NO: 1877680 - RNA, 22 nt, Human
cuggcagaguugaagacagagc

SEQ ID NO: 1877681 - RNA, 17 nt, Human
cugggacuacaggugug

SEQ ID NO: 1877682 - RNA, 21 nt, Human
cugggacuacaggcacccacc

SEQ ID NO: 1877683 - RNA, 17 nt, Human
cugggacuacaggcacc

SEQ ID NO: 1877684 - RNA, 13 nt, Human
cuggcucuuccag

SEQ ID NO: 1877685 - RNA, 14 nt, Human
cuggcucuuccagg

SEQ ID NO: 1877686 - RNA, 15 nt, Human
cuggcucuuccaggc

SEQ ID NO: 1877687 - RNA, 14 nt, Human
cuggcuccccaaag

SEQ ID NO: 1877688 - RNA, 15 nt, Human
cuggcucccaggaca

SEQ ID NO: 1877689 - RNA, 15 nt, Human
cuggcuccccaaagg

SEQ ID NO: 1877690 - RNA, 16 nt, Human
cuggcucccaggacac

SEQ ID NO: 1877691 - RNA, 14 nt, Human
cuggcucccaggac

SEQ ID NO: 1877692 - RNA, 18 nt, Human
cuggccgcgccaaauaau

SEQ ID NO: 1877693 - RNA, 16 nt, Human
cuggccgaguccaagc

SEQ ID NO: 1877694 - RNA, 17 nt, Human
cuggccgaguccaagcu

SEQ ID NO: 1877695 - RNA, 18 nt, Human
cuggccgaguccaagcug

SEQ ID NO: 1877696 - RNA, 20 nt, Human
cuggccgaguccaagcuggg

SEQ ID NO: 1877697 - RNA, 23 nt, Human
cuggccgaguccaagcugggaga

SEQ ID NO: 1877698 - RNA, 13 nt, Human
cuggcagcucagc

SEQ ID NO: 1877699 - RNA, 17 nt, Human
cuggcagcucagcuucc

SEQ ID NO: 1877700 - RNA, 23 nt, Human
cuggcccuaugcuuccggccucc

SEQ ID NO: 1877701 - RNA, 16 nt, Human
cuggcagcucagagag

SEQ ID NO: 1877702 - RNA, 17 nt, Human
cuggcagcucagagagg

SEQ ID NO: 1877703 - RNA, 19 nt, Human
cuggcagcucagagagggu

SEQ ID NO: 1877704 - RNA, 18 nt, Human
cuggaugcagccucacag

SEQ ID NO: 1877705 - RNA, 15 nt, Human
cuggaugcagccuca

SEQ ID NO: 1877706 - RNA, 15 nt, Human
cuggauccugaaaua

SEQ ID NO: 1877707 - RNA, 16 nt, Human
cuggaugcagccucac

SEQ ID NO: 1877708 - RNA, 17 nt, Human
cuggaugcagccucaca

SEQ ID NO: 1877709 - RNA, 14 nt, Human
cugcuucaaggauc

SEQ ID NO: 1877710 - RNA, 16 nt, Human
cugcuucaaggauccu

SEQ ID NO: 1877711 - RNA, 19 nt, Human
cugcuucaaggauccugag

SEQ ID NO: 1877712 - RNA, 20 nt, Human
cugcuucaaggauccugagc

SEQ ID NO: 1877713 - RNA, 19 nt, Human
cuggaaacauucaggagcu

SEQ ID NO: 1877714 - RNA, 23 nt, Human
cugcuucagccucccgaguagcu

SEQ ID NO: 1877715 - RNA, 14 nt, Human
cugcuuccagugag

SEQ ID NO: 1877716 - RNA, 24 nt, Human
cuggaguggccacuaagcagagga

SEQ ID NO: 1877717 - RNA, 13 nt, Human
cuggaguggccac

SEQ ID NO: 1877718 - RNA, 14 nt, Human
cuggaguggccacu

SEQ ID NO: 1877719 - RNA, 23 nt, Human
cuggaguggccacuaagcagagg

SEQ ID NO: 1877720 - RNA, 21 nt, Human
cuggagaaaauggacguguua

SEQ ID NO: 1877721 - RNA, 22 nt, Human
cugucuaaugaaaccugugucu

SEQ ID NO: 1877722 - RNA, 14 nt, Human
cugucuaaaaaaca

SEQ ID NO: 1877723 - RNA, 18 nt, Human
cugucuaaaaaacaaaac

SEQ ID NO: 1877724 - RNA, 18 nt, Human
cuguaggaagguuaaugu

SEQ ID NO: 1877725 - RNA, 13 nt, Human
cugucagucacag

SEQ ID NO: 1877726 - RNA, 14 nt, Human
cugucagucacagc

SEQ ID NO: 1877727 - RNA, 15 nt, Human
cugucagucacagcc

SEQ ID NO: 1877728 - RNA, 17 nt, Human
cugucagucacagccac

SEQ ID NO: 1877729 - RNA, 20 nt, Human
cuguccugggagugagcugg

SEQ ID NO: 1877730 - RNA, 14 nt, Human
cuguccugggagug

SEQ ID NO: 1877731 - RNA, 13 nt, Human
cuguccugggagu

SEQ ID NO: 1877732 - RNA, 14 nt, Human
cugucauuugagca

SEQ ID NO: 1877733 - RNA, 18 nt, Human
cugucagucacagccacc

SEQ ID NO: 1877734 - RNA, 14 nt, Human
cugucaucugugca

SEQ ID NO: 1877735 - RNA, 21 nt, Human
cugucaucugugcacugccca

SEQ ID NO: 1877736 - RNA, 15 nt, Human
cugucaucugugcac

SEQ ID NO: 1877737 - RNA, 16 nt, Human
cugguuuuucaguuuu

SEQ ID NO: 1877738 - RNA, 15 nt, Human
cugguuuuucaguuu

SEQ ID NO: 1877739 - RNA, 14 nt, Human
cugguuuuucaguu

SEQ ID NO: 1877740 - RNA, 16 nt, Human
cuguacuugcucuuga

SEQ ID NO: 1877741 - RNA, 19 nt, Human
cuguacuugcucuugaugc

SEQ ID NO: 1877742 - RNA, 20 nt, Human
cuguacuugcucuugaugcc

SEQ ID NO: 1877743 - RNA, 15 nt, Human
cuguagagugggagc

SEQ ID NO: 1877744 - RNA, 17 nt, Human
cuguaaauuuggcuucu

SEQ ID NO: 1877745 - RNA, 18 nt, Human
cuguaaauuuggcuucug

SEQ ID NO: 1877746 - RNA, 18 nt, Human
cuggucuuauuuguaaag

SEQ ID NO: 1877747 - RNA, 20 nt, Human
cuggucugaugacuugcuua

SEQ ID NO: 1877748 - RNA, 23 nt, Human
cuggugaccuuccaagagccuga

SEQ ID NO: 1877749 - RNA, 22 nt, Human
cuggugaccuuccaagagccug

SEQ ID NO: 1877750 - RNA, 15 nt, Human
cuguuggccagugug

SEQ ID NO: 1877751 - RNA, 12 nt, Human
cuguuggccagu

SEQ ID NO: 1877752 - RNA, 20 nt, Human
cuuaaaaaugguuuaaaugg

SEQ ID NO: 1877753 - RNA, 13 nt, Human
cuuaaaaaugguu

SEQ ID NO: 1877754 - RNA, 19 nt, Human
cuuaaauaaugugaaacug

SEQ ID NO: 1877755 - RNA, 16 nt, Human
cuuaaauaaugugaaa

SEQ ID NO: 1877756 - RNA, 14 nt, Human
cuuaaauaauguga

SEQ ID NO: 1877757 - RNA, 13 nt, Human
cuuaaauaaugug

SEQ ID NO: 1877758 - RNA, 20 nt, Human
cuuaaaauacgguaccuggc

SEQ ID NO: 1877759 - RNA, 18 nt, Human
cugugaacgauuuagaaa

SEQ ID NO: 1877760 - RNA, 17 nt, Human
cugugcucuggacaggc

SEQ ID NO: 1877761 - RNA, 23 nt, Human
cugugagaugcuagaacucccuu

SEQ ID NO: 1877762 - RNA, 22 nt, Human
cugugaacgauuuagaaagaag

SEQ ID NO: 1877763 - RNA, 23 nt, Human
cugugaauugagcugcagaaacg

SEQ ID NO: 1877764 - RNA, 15 nt, Human
cugugaauugagcug

SEQ ID NO: 1877765 - RNA, 19 nt, Human
cugugaauugagcugcaga

SEQ ID NO: 1877766 - RNA, 21 nt, Human
cugugaauugagcugcagaaa

SEQ ID NO: 1877767 - RNA, 12 nt, Human
cuguucagcugg

SEQ ID NO: 1877768 - RNA, 18 nt, Human
cuguucagcugguugagg

SEQ ID NO: 1877769 - RNA, 22 nt, Human
cuguucagcuccagcucaccag

SEQ ID NO: 1877770 - RNA, 19 nt, Human
cuguucagcuccagcucac

SEQ ID NO: 1877771 - RNA, 18 nt, Human
cuguucagcuccagcuca

SEQ ID NO: 1877772 - RNA, 16 nt, Human
cuguucagcuccagcu

SEQ ID NO: 1877773 - RNA, 19 nt, Human
cuguuaucaaaacuuucuu

SEQ ID NO: 1877774 - RNA, 19 nt, Human
cuguuaucccugccugguc

SEQ ID NO: 1877775 - RNA, 15 nt, Human
cuguucagcuccagc

SEQ ID NO: 1877776 - RNA, 17 nt, Human
cuguuauccuauuuaga

SEQ ID NO: 1877777 - RNA, 19 nt, Human
cugugcucuggacaggcau

SEQ ID NO: 1877778 - RNA, 18 nt, Human
cugugcucuggacaggca

SEQ ID NO: 1877779 - RNA, 14 nt, Human
cugugagcccagcu

SEQ ID NO: 1877780 - RNA, 22 nt, Human
cugugucagguggggcagcuug

SEQ ID NO: 1877781 - RNA, 17 nt, Human
cuguuacugucuucagu

SEQ ID NO: 1877782 - RNA, 15 nt, Human
cuguuagcagacagg

SEQ ID NO: 1877783 - RNA, 13 nt, Human
cuguuagcagaca

SEQ ID NO: 1877784 - RNA, 19 nt, Human
cuuuuaugugaaacauguu

SEQ ID NO: 1877785 - RNA, 17 nt, Human
cuuuuauugacacagaa

SEQ ID NO: 1877786 - RNA, 18 nt, Human
cuuuuauugacacagaaa

SEQ ID NO: 1877787 - RNA, 18 nt, Human
gaaaauuuugauguuuua

SEQ ID NO: 1877788 - RNA, 14 nt, Human
gaaaauuuuaaaaa

SEQ ID NO: 1877789 - RNA, 14 nt, Human
gaaaauuaacauga

SEQ ID NO: 1877790 - RNA, 21 nt, Human
gaaaauguugagaaucccaaa

SEQ ID NO: 1877791 - RNA, 20 nt, Human
gaaaagcggacaucagcugg

SEQ ID NO: 1877792 - RNA, 13 nt, Human
gaaaauuaacacu

SEQ ID NO: 1877793 - RNA, 15 nt, Human
gaaaauuaacacugc

SEQ ID NO: 1877794 - RNA, 18 nt, Human
gaaaagcggacaucagcu

SEQ ID NO: 1877795 - RNA, 14 nt, Human
gaaaagcagcucuc

SEQ ID NO: 1877796 - RNA, 17 nt, Human
gaaaagcagcucucccc

SEQ ID NO: 1877797 - RNA, 23 nt, Human
gaaaacuuaugaccucuuccuuu

SEQ ID NO: 1877798 - RNA, 18 nt, Human
gaaaacuuguauuaugug

SEQ ID NO: 1877799 - RNA, 18 nt, Human
cuuuugccguuauuaaaa

SEQ ID NO: 1877800 - RNA, 14 nt, Human
cuuuugcuuuauuc

SEQ ID NO: 1877801 - RNA, 17 nt, Human
cuuuugucuaugggacu

SEQ ID NO: 1877802 - RNA, 14 nt, Human
cuuuugucccagaa

SEQ ID NO: 1877803 - RNA, 16 nt, Human
cuuuuggucuguguga

SEQ ID NO: 1877804 - RNA, 15 nt, Human
cuuuuggucugugug

SEQ ID NO: 1877805 - RNA, 16 nt, Human
cuuuuuuuggcccagg

SEQ ID NO: 1877806 - RNA, 15 nt, Human
cuuuuuuuggcccag

SEQ ID NO: 1877807 - RNA, 15 nt, Human
cuuuuuuucuuuggu

SEQ ID NO: 1877808 - RNA, 14 nt, Human
cuuuuuuuuaaguu

SEQ ID NO: 1877809 - RNA, 14 nt, Human
cuuuuuuuucuuua

SEQ ID NO: 1877810 - RNA, 15 nt, Human
cuuuuuuuucuuuaa

SEQ ID NO: 1877811 - RNA, 18 nt, Human
cuuuugugcauuaucuag

SEQ ID NO: 1877812 - RNA, 14 nt, Human
cuuuugugcauuau

SEQ ID NO: 1877813 - RNA, 13 nt, Human
cuuuugugucuua

SEQ ID NO: 1877814 - RNA, 14 nt, Human
gaaaaaauauauau

SEQ ID NO: 1877815 - RNA, 19 nt, Human
gaaaaaauauuuuccugcc

SEQ ID NO: 1877816 - RNA, 21 nt, Human
cuuuuuuuuuuuuuuugacaa

SEQ ID NO: 1877817 - RNA, 15 nt, Human
cuuuuuuuuguaugu

SEQ ID NO: 1877818 - RNA, 21 nt, Human
gaacaaggcaaggcugucaau

SEQ ID NO: 1877819 - RNA, 14 nt, Human
gaacaaggcaaggc

SEQ ID NO: 1877820 - RNA, 15 nt, Human
gaacaaggcaaggcu

SEQ ID NO: 1877821 - RNA, 17 nt, Human
gaacaaggcaaggcugu

SEQ ID NO: 1877822 - RNA, 18 nt, Human
gaacaaggcaaggcuguc

SEQ ID NO: 1877823 - RNA, 20 nt, Human
gaaacuguucccaccugcug

SEQ ID NO: 1877824 - RNA, 21 nt, Human
gaaacuguucccaccugcugg

SEQ ID NO: 1877825 - RNA, 22 nt, Human
gaaacuguucccaccugcugga

SEQ ID NO: 1877826 - RNA, 17 nt, Human
gaaagaauuucauaugc

SEQ ID NO: 1877827 - RNA, 16 nt, Human
gaaagacagagcuggg

SEQ ID NO: 1877828 - RNA, 14 nt, Human
gaaagacagagcug

SEQ ID NO: 1877829 - RNA, 11 nt, Human
gaaacuuggau

SEQ ID NO: 1877830 - RNA, 16 nt, Human
gaacaagcaaacccag

SEQ ID NO: 1877831 - RNA, 21 nt, Human
gaacaagcaaacccagacggc

SEQ ID NO: 1877832 - RNA, 23 nt, Human
gaacaaauuuacagagacagaaa

SEQ ID NO: 1877833 - RNA, 19 nt, Human
gaaauuuuuauuaaauuau

SEQ ID NO: 1877834 - RNA, 18 nt, Human
gaacaaauuuacagagac

SEQ ID NO: 1877835 - RNA, 17 nt, Human
gaacaaauuuacagaga

SEQ ID NO: 1877836 - RNA, 17 nt, Human
gaaaucaccgaaaacgu

SEQ ID NO: 1877837 - RNA, 17 nt, Human
gaaaugaaagcagggac

SEQ ID NO: 1877838 - RNA, 18 nt, Human
gaaauuuuuauuaaauua

SEQ ID NO: 1877839 - RNA, 18 nt, Human
gaaaugaaagcagggacu

SEQ ID NO: 1877840 - RNA, 21 nt, Human
gaaaguacuucuccacccugc

SEQ ID NO: 1877841 - RNA, 22 nt, Human
gaaaguacuucuccacccugcu

SEQ ID NO: 1877842 - RNA, 13 nt, Human
gaaagguuuugag

SEQ ID NO: 1877843 - RNA, 19 nt, Human
gaaaggcuccaggagcagc

SEQ ID NO: 1877844 - RNA, 17 nt, Human
gaaaggcuccaggagca

SEQ ID NO: 1877845 - RNA, 18 nt, Human
gaaaggcuccaggagcag

SEQ ID NO: 1877846 - RNA, 18 nt, Human
gaaagacuaucuaaaugu

SEQ ID NO: 1877847 - RNA, 17 nt, Human
gaaagacagcuucucau

SEQ ID NO: 1877848 - RNA, 16 nt, Human
gaaagacagcuucuca

SEQ ID NO: 1877849 - RNA, 12 nt, Human
cuuccucccucc

SEQ ID NO: 1877850 - RNA, 13 nt, Human
cuuccucccuccc

SEQ ID NO: 1877851 - RNA, 14 nt, Human
cuuccucccucccu

SEQ ID NO: 1877852 - RNA, 18 nt, Human
cuuccucccucccucuuu

SEQ ID NO: 1877853 - RNA, 19 nt, Human
cuucugaacuuggcgcugc

SEQ ID NO: 1877854 - RNA, 15 nt, Human
cuucugacccaugcu

SEQ ID NO: 1877855 - RNA, 22 nt, Human
cuucugaacuuggcgcugcccc

SEQ ID NO: 1877856 - RNA, 16 nt, Human
cuucuauauauuguau

SEQ ID NO: 1877857 - RNA, 15 nt, Human
cuucuauaauuguau

SEQ ID NO: 1877858 - RNA, 17 nt, Human
cuucuaccucuuggcug

SEQ ID NO: 1877859 - RNA, 23 nt, Human
cuucugaacuuggcgcugccccu

SEQ ID NO: 1877860 - RNA, 18 nt, Human
cuucugacccaugcugcc

SEQ ID NO: 1877861 - RNA, 16 nt, Human
cuucugacccaugcug

SEQ ID NO: 1877862 - RNA, 17 nt, Human
cuucugacccaugcugc

SEQ ID NO: 1877863 - RNA, 13 nt, Human
cuucuuauacauu

SEQ ID NO: 1877864 - RNA, 16 nt, Human
cuucuuauacauuuga

SEQ ID NO: 1877865 - RNA, 19 nt, Human
cuucuuauggaauugauuu

SEQ ID NO: 1877866 - RNA, 23 nt, Human
cuucuuauggaauugauuugcau

SEQ ID NO: 1877867 - RNA, 22 nt, Human
cuucuuauggaauugauuugca

SEQ ID NO: 1877868 - RNA, 12 nt, Human
cuucuugaaggu

SEQ ID NO: 1877869 - RNA, 21 nt, Human
cuucuucuacuucagucuucu

SEQ ID NO: 1877870 - RNA, 17 nt, Human
cuuucaauaggaaaaac

SEQ ID NO: 1877871 - RNA, 18 nt, Human
cuuucaauaggaaaaacu

SEQ ID NO: 1877872 - RNA, 20 nt, Human
cuuuaaugucacaggcaggu

SEQ ID NO: 1877873 - RNA, 19 nt, Human
cuuuaaugucacaggcagg

SEQ ID NO: 1877874 - RNA, 18 nt, Human
cuuuaaugucacaggcag

SEQ ID NO: 1877875 - RNA, 17 nt, Human
cuuuaaugucacaggca

SEQ ID NO: 1877876 - RNA, 22 nt, Human
cuuuaaugucacaggcaggucc

SEQ ID NO: 1877877 - RNA, 23 nt, Human
cuuuaaugcaucuagauuaugga

SEQ ID NO: 1877878 - RNA, 12 nt, Human
cuuuaaugcuuu

SEQ ID NO: 1877879 - RNA, 14 nt, Human
cuuucaauaggaaa

SEQ ID NO: 1877880 - RNA, 15 nt, Human
cuuucaauaggaaaa

SEQ ID NO: 1877881 - RNA, 21 nt, Human
cuugucuuuggacccugaggc

SEQ ID NO: 1877882 - RNA, 22 nt, Human
cuugucuuuggacccugaggcc

SEQ ID NO: 1877883 - RNA, 21 nt, Human
cuuuaagggaguguacuccca

SEQ ID NO: 1877884 - RNA, 23 nt, Human
cuuuaagggaguguacucccagg

SEQ ID NO: 1877885 - RNA, 12 nt, Human
cuuuaaugcauc

SEQ ID NO: 1877886 - RNA, 13 nt, Human
cuuuaaugcaucu

SEQ ID NO: 1877887 - RNA, 14 nt, Human
cuuuaaugcaucua

SEQ ID NO: 1877888 - RNA, 14 nt, Human
cuuuaagaggacau

SEQ ID NO: 1877889 - RNA, 15 nt, Human
cuugguccugcugca

SEQ ID NO: 1877890 - RNA, 16 nt, Human
cuugguccugcugcag

SEQ ID NO: 1877891 - RNA, 17 nt, Human
cuugguccugcugcagu

SEQ ID NO: 1877892 - RNA, 18 nt, Human
cuugguccugcugcaguu

SEQ ID NO: 1877893 - RNA, 20 nt, Human
cuugguccugcugcaguugc

SEQ ID NO: 1877894 - RNA, 13 nt, Human
cuugucuguagau

SEQ ID NO: 1877895 - RNA, 13 nt, Human
cuugucucugggc

SEQ ID NO: 1877896 - RNA, 14 nt, Human
cuugucucugggcu

SEQ ID NO: 1877897 - RNA, 20 nt, Human
cuugucuuuggacccugagg

SEQ ID NO: 1877898 - RNA, 20 nt, Human
cuugucucccagcucagggc

SEQ ID NO: 1877899 - RNA, 22 nt, Human
cuugguccugcugcaguugcca

SEQ ID NO: 1877900 - RNA, 23 nt, Human
cuuggucucagugucaaugcagc

SEQ ID NO: 1877901 - RNA, 20 nt, Human
cuugguucccauuugcuccu

SEQ ID NO: 1877902 - RNA, 20 nt, Human
cuugguuccagccugccacu

SEQ ID NO: 1877903 - RNA, 16 nt, Human
cuugguucccauuugc

SEQ ID NO: 1877904 - RNA, 19 nt, Human
cuugguuccagccugccac

SEQ ID NO: 1877905 - RNA, 17 nt, Human
cuugguuccagccugcc

SEQ ID NO: 1877906 - RNA, 15 nt, Human
cuugauguguuaucu

SEQ ID NO: 1877907 - RNA, 19 nt, Human
cuugauucauaaugacuua

SEQ ID NO: 1877908 - RNA, 13 nt, Human
cuugauucugcag

SEQ ID NO: 1877909 - RNA, 17 nt, Human
cuugauucugcaguaaa

SEQ ID NO: 1877910 - RNA, 20 nt, Human
cuugauucugcaguaaaucu

SEQ ID NO: 1877911 - RNA, 21 nt, Human
cuugauucugcaguaaaucuu

SEQ ID NO: 1877912 - RNA, 22 nt, Human
cuugauucugcaguaaaucuuu

SEQ ID NO: 1877913 - RNA, 19 nt, Human
cuugccgucuaccugaggg

SEQ ID NO: 1877914 - RNA, 23 nt, Human
cuugccgcgucgcccucccaggc

SEQ ID NO: 1877915 - RNA, 18 nt, Human
cuugccgucuaccugagg

SEQ ID NO: 1877916 - RNA, 18 nt, Human
cuugccgcgucgcccucc

SEQ ID NO: 1877917 - RNA, 21 nt, Human
cuugccgcgucgcccucccag

SEQ ID NO: 1877918 - RNA, 22 nt, Human
cuuggccgcaccuaaagcagcc

SEQ ID NO: 1877919 - RNA, 21 nt, Human
cuuggccgcaccuaaagcagc

SEQ ID NO: 1877920 - RNA, 23 nt, Human
cuuggcgcugccccuggcagccc

SEQ ID NO: 1877921 - RNA, 21 nt, Human
cuuggcgcugccccuggcagc

SEQ ID NO: 1877922 - RNA, 22 nt, Human
cuuggcgcugccccuggcagcc

SEQ ID NO: 1877923 - RNA, 22 nt, Human
cuuggauuguccccgacccuug

SEQ ID NO: 1877924 - RNA, 17 nt, Human
cuugccucuguccccuu

SEQ ID NO: 1877925 - RNA, 18 nt, Human
cuuggauuguccccgacc

SEQ ID NO: 1877926 - RNA, 20 nt, Human
cuuggauuguccccgacccu

SEQ ID NO: 1877927 - RNA, 15 nt, Human
cuuggauuguccccg

SEQ ID NO: 1877928 - RNA, 20 nt, Human
gcaaccuccgccucuugggu

SEQ ID NO: 1877929 - RNA, 16 nt, Human
gcaaccucuuggccug

SEQ ID NO: 1877930 - RNA, 23 nt, Human
gcaaccucuuggccugaucagac

SEQ ID NO: 1877931 - RNA, 14 nt, Human
gcaaccugcuucca

SEQ ID NO: 1877932 - RNA, 19 nt, Human
gcaaccuccgccucuuggg

SEQ ID NO: 1877933 - RNA, 16 nt, Human
gcaacccccagccugc

SEQ ID NO: 1877934 - RNA, 15 nt, Human
gcaacccccagccug

SEQ ID NO: 1877935 - RNA, 14 nt, Human
gcaacccccagccu

SEQ ID NO: 1877936 - RNA, 19 nt, Human
gcaaccccaggcugaagca

SEQ ID NO: 1877937 - RNA, 14 nt, Human
gcaaccacuaagaa

SEQ ID NO: 1877938 - RNA, 17 nt, Human
gcaaccagggagcugca

SEQ ID NO: 1877939 - RNA, 23 nt, Human
gcaaccagggagcugcaggggca

SEQ ID NO: 1877940 - RNA, 13 nt, Human
gcaacaggcuggg

SEQ ID NO: 1877941 - RNA, 15 nt, Human
gcaacaggcugggcu

SEQ ID NO: 1877942 - RNA, 14 nt, Human
gcaacaggcugggc

SEQ ID NO: 1877943 - RNA, 23 nt, Human
gcaaaaggaucuuuguggccaag

SEQ ID NO: 1877944 - RNA, 19 nt, Human
gcaacaggcugggcuucag

SEQ ID NO: 1877945 - RNA, 16 nt, Human
gcaacaggcugggcuu

SEQ ID NO: 1877946 - RNA, 13 nt, Human
gcaacauccaaaa

SEQ ID NO: 1877947 - RNA, 17 nt, Human
gcaacauccaaaauagu

SEQ ID NO: 1877948 - RNA, 13 nt, Human
gcaaccaccacca

SEQ ID NO: 1877949 - RNA, 16 nt, Human
gcaaccaccaccaacc

SEQ ID NO: 1877950 - RNA, 18 nt, Human
gcaaccaccaccaaccac

SEQ ID NO: 1877951 - RNA, 15 nt, Human
gcaagugagagcugg

SEQ ID NO: 1877952 - RNA, 16 nt, Human
gcaagugagagcuggg

SEQ ID NO: 1877953 - RNA, 12 nt, Human
gauucuucugcu

SEQ ID NO: 1877954 - RNA, 15 nt, Human
gauucuucugcuuca

SEQ ID NO: 1877955 - RNA, 13 nt, Human
gauucuucugcuu

SEQ ID NO: 1877956 - RNA, 20 nt, Human
gauucuucugcuucagccuc

SEQ ID NO: 1877957 - RNA, 16 nt, Human
gauuuaacagaaaugu

SEQ ID NO: 1877958 - RNA, 18 nt, Human
gauuuaacagaaauguac

SEQ ID NO: 1877959 - RNA, 17 nt, Human
gauuuaacagaaaugua

SEQ ID NO: 1877960 - RNA, 19 nt, Human
gauuuaacagaaauguaca

SEQ ID NO: 1877961 - RNA, 11 nt, Human
gauuucacucu

SEQ ID NO: 1877962 - RNA, 16 nt, Human
gauuuuuuuuuccuuc

SEQ ID NO: 1877963 - RNA, 12 nt, Human
gauuucacucuc

SEQ ID NO: 1877964 - RNA, 17 nt, Human
gauuuuuuuuuccuuca

SEQ ID NO: 1877965 - RNA, 18 nt, Human
gauuuuuuuuuccuucag

SEQ ID NO: 1877966 - RNA, 17 nt, Human
gcaaaagaugcuucuca

SEQ ID NO: 1877967 - RNA, 22 nt, Human
gcaaaagaugcuucucacugcc

SEQ ID NO: 1877968 - RNA, 20 nt, Human
gcaaaaggaucuuuguggcc

SEQ ID NO: 1877969 - RNA, 21 nt, Human
gcaaaaggaucuuuguggcca

SEQ ID NO: 1877970 - RNA, 14 nt, Human
gcaaaaauauuuau

SEQ ID NO: 1877971 - RNA, 23 nt, Human
gcaaaaauauuuauaaaacuucu

SEQ ID NO: 1877972 - RNA, 14 nt, Human
gcaaaaaggcagga

SEQ ID NO: 1877973 - RNA, 21 nt, Human
gauuuuuuuuuccuucagugc

SEQ ID NO: 1877974 - RNA, 21 nt, Human
gauggaaguugcagugagcug

SEQ ID NO: 1877975 - RNA, 13 nt, Human
gauggaaugaugg

SEQ ID NO: 1877976 - RNA, 23 nt, Human
gauacaguuacucagaauucucu

SEQ ID NO: 1877977 - RNA, 19 nt, Human
gauacaguuacucagaauu

SEQ ID NO: 1877978 - RNA, 16 nt, Human
gauacaguuacucaga

SEQ ID NO: 1877979 - RNA, 20 nt, Human
gauacauccaaagcagacag

SEQ ID NO: 1877980 - RNA, 21 nt, Human
gauacauccaaagcagacagc

SEQ ID NO: 1877981 - RNA, 23 nt, Human
gauacauccaaagcagacagcuc

SEQ ID NO: 1877982 - RNA, 21 nt, Human
gauacauacaccagcauuccu

SEQ ID NO: 1877983 - RNA, 17 nt, Human
gauacauccaaagcaga

SEQ ID NO: 1877984 - RNA, 21 nt, Human
gauacuguaucaugacaaaga

SEQ ID NO: 1877985 - RNA, 17 nt, Human
gauacugucucuuucau

SEQ ID NO: 1877986 - RNA, 17 nt, Human
gauacuguaucaugaca

SEQ ID NO: 1877987 - RNA, 12 nt, Human
gauacugaaaua

SEQ ID NO: 1877988 - RNA, 23 nt, Human
gauacugcuacuguaauuuuaua

SEQ ID NO: 1877989 - RNA, 19 nt, Human
gauccaagcuggucccacu

SEQ ID NO: 1877990 - RNA, 17 nt, Human
gauccaagcugguccca

SEQ ID NO: 1877991 - RNA, 16 nt, Human
gauccaagcugguccc

SEQ ID NO: 1877992 - RNA, 12 nt, Human
gauccaagcugg

SEQ ID NO: 1877993 - RNA, 16 nt, Human
gaucaacaucuuuucu

SEQ ID NO: 1877994 - RNA, 14 nt, Human
gaucaacaucuuuu

SEQ ID NO: 1877995 - RNA, 13 nt, Human
gauccaaaagaag

SEQ ID NO: 1877996 - RNA, 20 nt, Human
gaucaacaucuuuucuugcc

SEQ ID NO: 1877997 - RNA, 17 nt, Human
gaucaacaucuuuucuu

SEQ ID NO: 1877998 - RNA, 23 nt, Human
gauccaaaagaagcccccagcua

SEQ ID NO: 1877999 - RNA, 16 nt, Human
gauccaaaagaagccc

SEQ ID NO: 1878000 - RNA, 19 nt, Human
gauccaaaagaagccccca

SEQ ID NO: 1878001 - RNA, 20 nt, Human
gauccaaaagaagcccccag

SEQ ID NO: 1878002 - RNA, 22 nt, Human
gauccaaaagaagcccccagcu

SEQ ID NO: 1878003 - RNA, 19 nt, Human
gauccacccaccucagccu

SEQ ID NO: 1878004 - RNA, 18 nt, Human
gauccacccaccucagcc

SEQ ID NO: 1878005 - RNA, 21 nt, Human
gauccaagcuggucccacuca

SEQ ID NO: 1878006 - RNA, 18 nt, Human
gaucaaccagcuaagaaa

SEQ ID NO: 1878007 - RNA, 21 nt, Human
gauccacccaccucagccucc

SEQ ID NO: 1878008 - RNA, 20 nt, Human
gauccacccaccucagccuc

SEQ ID NO: 1878009 - RNA, 22 nt, Human
gauccacccaccucagccuccc

SEQ ID NO: 1878010 - RNA, 13 nt, Human
gauauuugugcau

SEQ ID NO: 1878011 - RNA, 15 nt, Human
gauauuuugcuuugu

SEQ ID NO: 1878012 - RNA, 17 nt, Human
gauauuuuuuucuuuuc

SEQ ID NO: 1878013 - RNA, 20 nt, Human
gaucaaaagguuaauaaagu

SEQ ID NO: 1878014 - RNA, 23 nt, Human
gaucaaaagguuaauaaaguaau

SEQ ID NO: 1878015 - RNA, 17 nt, Human
gaucaaaggcacacagc

SEQ ID NO: 1878016 - RNA, 21 nt, Human
gaugcuucuucagagacuccu

SEQ ID NO: 1878017 - RNA, 17 nt, Human
gauggaacacggccaca

SEQ ID NO: 1878018 - RNA, 17 nt, Human
gaugcuucuucagagac

SEQ ID NO: 1878019 - RNA, 20 nt, Human
gaugcuucuucagagacucc

SEQ ID NO: 1878020 - RNA, 22 nt, Human
gaugauuggaggggggaggugg

SEQ ID NO: 1878021 - RNA, 13 nt, Human
gaugauccuaggc

SEQ ID NO: 1878022 - RNA, 14 nt, Human
gaugauccuaggca

SEQ ID NO: 1878023 - RNA, 18 nt, Human
gaucuggaaccucagccu

SEQ ID NO: 1878024 - RNA, 19 nt, Human
gaucuggaaccucagccug

SEQ ID NO: 1878025 - RNA, 20 nt, Human
gaucuggaaccucagccugg

SEQ ID NO: 1878026 - RNA, 21 nt, Human
gaucuggaaccucagccuggc

SEQ ID NO: 1878027 - RNA, 15 nt, Human
gaucuggaacccaga

SEQ ID NO: 1878028 - RNA, 16 nt, Human
gaucuggaacccagac

SEQ ID NO: 1878029 - RNA, 17 nt, Human
gaucuggaacccagacu

SEQ ID NO: 1878030 - RNA, 18 nt, Human
gaucuggaacccagacuc

SEQ ID NO: 1878031 - RNA, 20 nt, Human
gaucuggaacccagacucag

SEQ ID NO: 1878032 - RNA, 12 nt, Human
gaucuggaaccu

SEQ ID NO: 1878033 - RNA, 16 nt, Human
gaucuggaaccucagc

SEQ ID NO: 1878034 - RNA, 17 nt, Human
gaucuggaaccucagcc

SEQ ID NO: 1878035 - RNA, 12 nt, Human
gaucuggaaccc

SEQ ID NO: 1878036 - RNA, 14 nt, Human
gaucuggaacccag

SEQ ID NO: 1878037 - RNA, 20 nt, Human
gaucucugcagggccgccag

SEQ ID NO: 1878038 - RNA, 17 nt, Human
gaucugacaugauuccu

SEQ ID NO: 1878039 - RNA, 19 nt, Human
gaucugacaugauuccuuc

SEQ ID NO: 1878040 - RNA, 19 nt, Human
gaucucuugagccugggag

SEQ ID NO: 1878041 - RNA, 21 nt, Human
gaucugacaugauuccuuccu

SEQ ID NO: 1878042 - RNA, 22 nt, Human
gaucugacaugauuccuuccug

SEQ ID NO: 1878043 - RNA, 15 nt, Human
gaucucugcagggcc

SEQ ID NO: 1878044 - RNA, 16 nt, Human
gaucucugcagggccg

SEQ ID NO: 1878045 - RNA, 23 nt, Human
gaucucugcaggaaauggcugug

SEQ ID NO: 1878046 - RNA, 18 nt, Human
gaucucuugagccuggga

SEQ ID NO: 1878047 - RNA, 12 nt, Human
gaucucugcagg

SEQ ID NO: 1878048 - RNA, 12 nt, Human
gauccagccugg

SEQ ID NO: 1878049 - RNA, 23 nt, Human
gauccagcccugaguuccuagcc

SEQ ID NO: 1878050 - RNA, 19 nt, Human
gcaagugagagcugggugu

SEQ ID NO: 1878051 - RNA, 18 nt, Human
gcaagugagagcugggug

SEQ ID NO: 1878052 - RNA, 20 nt, Human
gcacucagaagacacugaug

SEQ ID NO: 1878053 - RNA, 13 nt, Human
gcagaacagugau

SEQ ID NO: 1878054 - RNA, 12 nt, Human
gcagaacaguga

SEQ ID NO: 1878055 - RNA, 17 nt, Human
gcagaaacgaagccauc

SEQ ID NO: 1878056 - RNA, 23 nt, Human
gcagaaacgaagccaucuuucuu

SEQ ID NO: 1878057 - RNA, 16 nt, Human
gcagaaaauugccuaa

SEQ ID NO: 1878058 - RNA, 22 nt, Human
gcacuuuguucuggcucuucca

SEQ ID NO: 1878059 - RNA, 15 nt, Human
gcacuccccugcugg

SEQ ID NO: 1878060 - RNA, 18 nt, Human
gcacuuuguucuggcucu

SEQ ID NO: 1878061 - RNA, 19 nt, Human
gcacuuuguucuggcucuu

SEQ ID NO: 1878062 - RNA, 13 nt, Human
gcacuccccugcu

SEQ ID NO: 1878063 - RNA, 14 nt, Human
gcacuccccugcug

SEQ ID NO: 1878064 - RNA, 14 nt, Human
gcacuccagccugg

SEQ ID NO: 1878065 - RNA, 15 nt, Human
gcacuccagccuggg

SEQ ID NO: 1878066 - RNA, 22 nt, Human
gcagaacagugauuaccaggga

SEQ ID NO: 1878067 - RNA, 18 nt, Human
gcagaacagugauuacca

SEQ ID NO: 1878068 - RNA, 19 nt, Human
gcagaacuaaacucauuua

SEQ ID NO: 1878069 - RNA, 21 nt, Human
gcagaacuaaacucauuuaua

SEQ ID NO: 1878070 - RNA, 19 nt, Human
gcagagcugcgggcugggu

SEQ ID NO: 1878071 - RNA, 17 nt, Human
gcagagcugcgggcugg

SEQ ID NO: 1878072 - RNA, 21 nt, Human
gcagaggaaagcaaaggagau

SEQ ID NO: 1878073 - RNA, 12 nt, Human
gcagaggagggg

SEQ ID NO: 1878074 - RNA, 14 nt, Human
gcagaggaggggcc

SEQ ID NO: 1878075 - RNA, 21 nt, Human
gcagaggaggggccgcugcca

SEQ ID NO: 1878076 - RNA, 15 nt, Human
gcagaggaggggccg

SEQ ID NO: 1878077 - RNA, 13 nt, Human
gcagaggaaagca

SEQ ID NO: 1878078 - RNA, 14 nt, Human
gcagaggaaagcaa

SEQ ID NO: 1878079 - RNA, 18 nt, Human
gcagaggaaagcaaagga

SEQ ID NO: 1878080 - RNA, 20 nt, Human
gcagaggaaagcaaaggaga

SEQ ID NO: 1878081 - RNA, 17 nt, Human
gcagcauauucaggaag

SEQ ID NO: 1878082 - RNA, 18 nt, Human
gcagcauauucaggaagc

SEQ ID NO: 1878083 - RNA, 19 nt, Human
gcagcauauucaggaagcu

SEQ ID NO: 1878084 - RNA, 23 nt, Human
gcagcauauucaggaagcucagg

SEQ ID NO: 1878085 - RNA, 14 nt, Human
gcagagggcacaga

SEQ ID NO: 1878086 - RNA, 12 nt, Human
gcagccaggaca

SEQ ID NO: 1878087 - RNA, 20 nt, Human
gcagccaggccacuggcccc

SEQ ID NO: 1878088 - RNA, 23 nt, Human
gcagccagccgugagugcagacc

SEQ ID NO: 1878089 - RNA, 22 nt, Human
gcagccagccgugagugcagac

SEQ ID NO: 1878090 - RNA, 13 nt, Human
gcagccagccgug

SEQ ID NO: 1878091 - RNA, 15 nt, Human
gcagccacauuccug

SEQ ID NO: 1878092 - RNA, 18 nt, Human
gcagcccaccccucaaca

SEQ ID NO: 1878093 - RNA, 18 nt, Human
gcauacguacacauuuua

SEQ ID NO: 1878094 - RNA, 22 nt, Human
gcaguuggccagagagccuggu

SEQ ID NO: 1878095 - RNA, 14 nt, Human
gcaguuggccagag

SEQ ID NO: 1878096 - RNA, 17 nt, Human
gcauacguacacauuuu

SEQ ID NO: 1878097 - RNA, 16 nt, Human
gcauacguacacauuu

SEQ ID NO: 1878098 - RNA, 15 nt, Human
gcauacguacacauu

SEQ ID NO: 1878099 - RNA, 13 nt, Human
gcaguuuaaagca

SEQ ID NO: 1878100 - RNA, 17 nt, Human
gcagucuguccaggcuc

SEQ ID NO: 1878101 - RNA, 13 nt, Human
gcagugagcagag

SEQ ID NO: 1878102 - RNA, 20 nt, Human
gcagcucuggacagccccac

SEQ ID NO: 1878103 - RNA, 12 nt, Human
gcagcucucccc

SEQ ID NO: 1878104 - RNA, 18 nt, Human
gcagcugaaauaugcugg

SEQ ID NO: 1878105 - RNA, 19 nt, Human
gcagcugaaauaugcuggc

SEQ ID NO: 1878106 - RNA, 22 nt, Human
gcagcugaaauaugcuggcugg

SEQ ID NO: 1878107 - RNA, 18 nt, Human
gcauccuccacaauagca

SEQ ID NO: 1878108 - RNA, 19 nt, Human
gcauccuaaagauaaagcc

SEQ ID NO: 1878109 - RNA, 20 nt, Human
gcauccuaaagauaaagcca

SEQ ID NO: 1878110 - RNA, 16 nt, Human
gcauccccugccucca

SEQ ID NO: 1878111 - RNA, 14 nt, Human
gcauccccugccuc

SEQ ID NO: 1878112 - RNA, 15 nt, Human
gcauccccugccucc

SEQ ID NO: 1878113 - RNA, 17 nt, Human
gcauccccugccuccau

SEQ ID NO: 1878114 - RNA, 13 nt, Human
gcauccccugccu

SEQ ID NO: 1878115 - RNA, 23 nt, Human
gcauccacuucuuucagcagacu

SEQ ID NO: 1878116 - RNA, 18 nt, Human
gcauccaguaucuugaag

SEQ ID NO: 1878117 - RNA, 14 nt, Human
gcauccaguaucuu

SEQ ID NO: 1878118 - RNA, 17 nt, Human
gcauccaguaucuugaa

SEQ ID NO: 1878119 - RNA, 20 nt, Human
gcaucuagcaugucgucaaa

SEQ ID NO: 1878120 - RNA, 13 nt, Human
gcauccuggcacc

SEQ ID NO: 1878121 - RNA, 14 nt, Human
gcauccuggcaccc

SEQ ID NO: 1878122 - RNA, 21 nt, Human
gcauggcugccaaugggagcu

SEQ ID NO: 1878123 - RNA, 15 nt, Human
gcauggucacacacu

SEQ ID NO: 1878124 - RNA, 18 nt, Human
gcauggucacacacugau

SEQ ID NO: 1878125 - RNA, 15 nt, Human
gcauggugccccagg

SEQ ID NO: 1878126 - RNA, 16 nt, Human
gcauggugccccagga

SEQ ID NO: 1878127 - RNA, 17 nt, Human
gcauggugccccaggac

SEQ ID NO: 1878128 - RNA, 18 nt, Human
gcauggugccccaggacc

SEQ ID NO: 1878129 - RNA, 19 nt, Human
gcauggugccccaggacca

SEQ ID NO: 1878130 - RNA, 20 nt, Human
gcauggugccccaggaccag

SEQ ID NO: 1878131 - RNA, 21 nt, Human
gcauggugccccaggaccagc

SEQ ID NO: 1878132 - RNA, 23 nt, Human
gcauggugccccaggaccagcuc

SEQ ID NO: 1878133 - RNA, 15 nt, Human
gcauuuacuuugugu

SEQ ID NO: 1878134 - RNA, 22 nt, Human
gcauuuaaaagauacaguuacu

SEQ ID NO: 1878135 - RNA, 18 nt, Human
gcauuuaaaagauacagu

SEQ ID NO: 1878136 - RNA, 17 nt, Human
gcauuuaaaagauacag

SEQ ID NO: 1878137 - RNA, 16 nt, Human
gcauuuaaaagauaca

SEQ ID NO: 1878138 - RNA, 16 nt, Human
gcauugugggaagggg

SEQ ID NO: 1878139 - RNA, 18 nt, Human
gcauugugggaaggggag

SEQ ID NO: 1878140 - RNA, 19 nt, Human
gcaugugaugagaggaaau

SEQ ID NO: 1878141 - RNA, 18 nt, Human
gcaugugaugagaggaaa

SEQ ID NO: 1878142 - RNA, 21 nt, Human
gcaugugaugagaggaaauca

SEQ ID NO: 1878143 - RNA, 13 nt, Human
gcauugugggaag

SEQ ID NO: 1878144 - RNA, 15 nt, Human
gcauugugggaaggg

SEQ ID NO: 1878145 - RNA, 21 nt, Human
gacacagcucuucuccaggcu

SEQ ID NO: 1878146 - RNA, 20 nt, Human
gacacagcucuucuccaggc

SEQ ID NO: 1878147 - RNA, 19 nt, Human
gacacagcucuucuccagg

SEQ ID NO: 1878148 - RNA, 12 nt, Human
gacacagcucuu

SEQ ID NO: 1878149 - RNA, 18 nt, Human
gacaaaguuccaaaaugc

SEQ ID NO: 1878150 - RNA, 20 nt, Human
gacaaaguuccaaaaugcca

SEQ ID NO: 1878151 - RNA, 15 nt, Human
gacaaagucaagcca

SEQ ID NO: 1878152 - RNA, 19 nt, Human
gacacagaaaauguugaga

SEQ ID NO: 1878153 - RNA, 21 nt, Human
gacacagaaaauguugagaau

SEQ ID NO: 1878154 - RNA, 20 nt, Human
gacaaagaggccuuuaacca

SEQ ID NO: 1878155 - RNA, 14 nt, Human
gacaaaaagcuacu

SEQ ID NO: 1878156 - RNA, 23 nt, Human
gaauucaaacuggggccuccaga

SEQ ID NO: 1878157 - RNA, 16 nt, Human
gaauucaaacuggggc

SEQ ID NO: 1878158 - RNA, 18 nt, Human
gaauucaaacuggggccu

SEQ ID NO: 1878159 - RNA, 21 nt, Human
gaauucaaacuggggccucca

SEQ ID NO: 1878160 - RNA, 22 nt, Human
gaauucaaacuggggccuccag

SEQ ID NO: 1878161 - RNA, 18 nt, Human
gaauuauuuuaaaagaua

SEQ ID NO: 1878162 - RNA, 16 nt, Human
gaauuauuuuaaaaga

SEQ ID NO: 1878163 - RNA, 13 nt, Human
gaauuauuuuaaa

SEQ ID NO: 1878164 - RNA, 15 nt, Human
gaauuagcugcuucu

SEQ ID NO: 1878165 - RNA, 14 nt, Human
gaauuaugaaacuu

SEQ ID NO: 1878166 - RNA, 19 nt, Human
gaauguuugccucugccuc

SEQ ID NO: 1878167 - RNA, 18 nt, Human
gaauguuugccucugccu

SEQ ID NO: 1878168 - RNA, 15 nt, Human
gaauguuuuaaauuc

SEQ ID NO: 1878169 - RNA, 16 nt, Human
gaauguuuuaaauucu

SEQ ID NO: 1878170 - RNA, 15 nt, Human
gaauuaacacaugau

SEQ ID NO: 1878171 - RNA, 14 nt, Human
gaauuaacacauga

SEQ ID NO: 1878172 - RNA, 21 nt, Human
gaauuaaguuagggaauggca

SEQ ID NO: 1878173 - RNA, 18 nt, Human
gaauuaaguuagggaaug

SEQ ID NO: 1878174 - RNA, 18 nt, Human
gaaugcacaaacagaggc

SEQ ID NO: 1878175 - RNA, 17 nt, Human
gaauguuugccucugcc

SEQ ID NO: 1878176 - RNA, 16 nt, Human
gaauguuugccucugc

SEQ ID NO: 1878177 - RNA, 19 nt, Human
gaaugcacaaacagaggcc

SEQ ID NO: 1878178 - RNA, 15 nt, Human
gaauguuugccucug

SEQ ID NO: 1878179 - RNA, 20 nt, Human
gaaugaugauccuaggcauu

SEQ ID NO: 1878180 - RNA, 14 nt, Human
gaaugaugccauga

SEQ ID NO: 1878181 - RNA, 14 nt, Human
gaaugauuaauuaa

SEQ ID NO: 1878182 - RNA, 20 nt, Human
gaaugaauggcuaagcaaaa

SEQ ID NO: 1878183 - RNA, 15 nt, Human
gaaugaauggcuaag

SEQ ID NO: 1878184 - RNA, 14 nt, Human
gaaugaauggcuaa

SEQ ID NO: 1878185 - RNA, 22 nt, Human
gaauauugcugauggugcaaug

SEQ ID NO: 1878186 - RNA, 23 nt, Human
gaauauugcugauggugcaauga

SEQ ID NO: 1878187 - RNA, 24 nt, Human
gaauauugcugauggugcaaugac

SEQ ID NO: 1878188 - RNA, 15 nt, Human
gaauauauaaccagu

SEQ ID NO: 1878189 - RNA, 11 nt, Human
gaauauugcug

SEQ ID NO: 1878190 - RNA, 12 nt, Human
gaauauugcuga

SEQ ID NO: 1878191 - RNA, 13 nt, Human
gaauauugcugau

SEQ ID NO: 1878192 - RNA, 22 nt, Human
gaauaucuccgucaacucauau

SEQ ID NO: 1878193 - RNA, 23 nt, Human
gacauugcggacagccacggcca

SEQ ID NO: 1878194 - RNA, 17 nt, Human
gacauugcggacagcca

SEQ ID NO: 1878195 - RNA, 23 nt, Human
gacauuggcaccuaauccaggca

SEQ ID NO: 1878196 - RNA, 14 nt, Human
gacauugcguuuga

SEQ ID NO: 1878197 - RNA, 21 nt, Human
gacauugcguuugaccuuuua

SEQ ID NO: 1878198 - RNA, 16 nt, Human
gacacugggaggccag

SEQ ID NO: 1878199 - RNA, 17 nt, Human
gacacugggaggccagu

SEQ ID NO: 1878200 - RNA, 23 nt, Human
gacacugggaggccagugagcca

SEQ ID NO: 1878201 - RNA, 18 nt, Human
gacagcuccuucuguccu

SEQ ID NO: 1878202 - RNA, 17 nt, Human
gacagcuccuucugucc

SEQ ID NO: 1878203 - RNA, 16 nt, Human
gacagcuccuucuguc

SEQ ID NO: 1878204 - RNA, 16 nt, Human
gacagcccgggcucug

SEQ ID NO: 1878205 - RNA, 14 nt, Human
gacagcccgggcuc

SEQ ID NO: 1878206 - RNA, 14 nt, Human
gacagccccacccu

SEQ ID NO: 1878207 - RNA, 15 nt, Human
gacagccccacccug

SEQ ID NO: 1878208 - RNA, 19 nt, Human
gacagcuccuucuguccua

SEQ ID NO: 1878209 - RNA, 12 nt, Human
gacagcucugca

SEQ ID NO: 1878210 - RNA, 10 nt, Human
gacagcucuu

SEQ ID NO: 1878211 - RNA, 12 nt, Human
gacagucccugc

SEQ ID NO: 1878212 - RNA, 11 nt, Human
gacagcucuua

SEQ ID NO: 1878213 - RNA, 14 nt, Human
gacagucccugcca

SEQ ID NO: 1878214 - RNA, 15 nt, Human
gacagucccugccaa

SEQ ID NO: 1878215 - RNA, 16 nt, Human
gacagucccugccaau

SEQ ID NO: 1878216 - RNA, 20 nt, Human
gacagucccugccaauggac

SEQ ID NO: 1878217 - RNA, 17 nt, Human
gacauguuuuccgugaa

SEQ ID NO: 1878218 - RNA, 18 nt, Human
gacgcugugcugcccugc

SEQ ID NO: 1878219 - RNA, 16 nt, Human
gacgcugugcugcccu

SEQ ID NO: 1878220 - RNA, 17 nt, Human
gacgcugugcugcccug

SEQ ID NO: 1878221 - RNA, 22 nt, Human
gacgcuacccgggaagggggcu

SEQ ID NO: 1878222 - RNA, 23 nt, Human
gacgcuacccgggaagggggcug

SEQ ID NO: 1878223 - RNA, 14 nt, Human
gacgcucucuggcc

SEQ ID NO: 1878224 - RNA, 21 nt, Human
gaccucaguuuuaucauuuuc

SEQ ID NO: 1878225 - RNA, 20 nt, Human
gaccucaguuuuaucauuuu

SEQ ID NO: 1878226 - RNA, 13 nt, Human
gaccucagggcac

SEQ ID NO: 1878227 - RNA, 16 nt, Human
gaccuccaagccacug

SEQ ID NO: 1878228 - RNA, 22 nt, Human
gaccucugcagcaauaaagcag

SEQ ID NO: 1878229 - RNA, 18 nt, Human
gaccucugcagcaauaaa

SEQ ID NO: 1878230 - RNA, 16 nt, Human
gaccucugcagcaaua

SEQ ID NO: 1878231 - RNA, 23 nt, Human
gacgccacagcccagccacggac

SEQ ID NO: 1878232 - RNA, 22 nt, Human
gacgccacagcccagccacgga

SEQ ID NO: 1878233 - RNA, 13 nt, Human
gaccucugccuga

SEQ ID NO: 1878234 - RNA, 12 nt, Human
gacgccauccca

SEQ ID NO: 1878235 - RNA, 13 nt, Human
gacgccaucccag

SEQ ID NO: 1878236 - RNA, 15 nt, Human
gacgccaucccagcc

SEQ ID NO: 1878237 - RNA, 21 nt, Human
gacgccaucccagccccaaug

SEQ ID NO: 1878238 - RNA, 21 nt, Human
gaccucaggugauccacccac

SEQ ID NO: 1878239 - RNA, 20 nt, Human
gaccucaggugauccaccca

SEQ ID NO: 1878240 - RNA, 19 nt, Human
gaccucaggugauccaccc

SEQ ID NO: 1878241 - RNA, 21 nt, Human
gaccucaggugagaagcagag

SEQ ID NO: 1878242 - RNA, 19 nt, Human
gaccucaggccugggggcu

SEQ ID NO: 1878243 - RNA, 18 nt, Human
gaccucaggugagaagca

SEQ ID NO: 1878244 - RNA, 19 nt, Human
gaccucaggugagaagcag

SEQ ID NO: 1878245 - RNA, 14 nt, Human
gaccucaggccugg

SEQ ID NO: 1878246 - RNA, 16 nt, Human
gacccugaaggggcca

SEQ ID NO: 1878247 - RNA, 14 nt, Human
gagcaucaggccag

SEQ ID NO: 1878248 - RNA, 21 nt, Human
gagcaugccuggauggggcug

SEQ ID NO: 1878249 - RNA, 13 nt, Human
gagcaugccugga

SEQ ID NO: 1878250 - RNA, 15 nt, Human
gagcaucaggccagg

SEQ ID NO: 1878251 - RNA, 16 nt, Human
gagcaucaggccaggc

SEQ ID NO: 1878252 - RNA, 13 nt, Human
gagcaucaggcca

SEQ ID NO: 1878253 - RNA, 17 nt, Human
gagccccgaggccuucu

SEQ ID NO: 1878254 - RNA, 14 nt, Human
gagccccgaggccu

SEQ ID NO: 1878255 - RNA, 13 nt, Human
gagccccgaggcc

SEQ ID NO: 1878256 - RNA, 12 nt, Human
gagcccugggag

SEQ ID NO: 1878257 - RNA, 22 nt, Human
gagccccuucugcucagcucug

SEQ ID NO: 1878258 - RNA, 17 nt, Human
gagccccuucugcucag

SEQ ID NO: 1878259 - RNA, 20 nt, Human
gagccccuucugcucagcuc

SEQ ID NO: 1878260 - RNA, 21 nt, Human
gagccccuucugcucagcucu

SEQ ID NO: 1878261 - RNA, 20 nt, Human
gagccccugucuagagaggg

SEQ ID NO: 1878262 - RNA, 21 nt, Human
gagccccugucuagagaggga

SEQ ID NO: 1878263 - RNA, 22 nt, Human
gagccccugucuagagagggag

SEQ ID NO: 1878264 - RNA, 16 nt, Human
gagcccugggaggcuc

SEQ ID NO: 1878265 - RNA, 18 nt, Human
gagcccugggaggcucug

SEQ ID NO: 1878266 - RNA, 19 nt, Human
gagcccugggaggcucugg

SEQ ID NO: 1878267 - RNA, 20 nt, Human
gagcccugggaggcucugga

SEQ ID NO: 1878268 - RNA, 14 nt, Human
gagcccugguggca

SEQ ID NO: 1878269 - RNA, 13 nt, Human
gagcccugguggc

SEQ ID NO: 1878270 - RNA, 23 nt, Human
gagcuggccgcgccaaauaaugu

SEQ ID NO: 1878271 - RNA, 13 nt, Human
gagcuggccccgc

SEQ ID NO: 1878272 - RNA, 14 nt, Human
gagcuggccccgcc

SEQ ID NO: 1878273 - RNA, 16 nt, Human
gagcuggccccgccgc

SEQ ID NO: 1878274 - RNA, 17 nt, Human
gagcuggccccgccgcc

SEQ ID NO: 1878275 - RNA, 23 nt, Human
gaggggcagauggaaaggagccu

SEQ ID NO: 1878276 - RNA, 12 nt, Human
gaggggagaagc

SEQ ID NO: 1878277 - RNA, 14 nt, Human
gagggccugcaagg

SEQ ID NO: 1878278 - RNA, 17 nt, Human
gagggccugcaagggag

SEQ ID NO: 1878279 - RNA, 21 nt, Human
gagggccugcaagggagugag

SEQ ID NO: 1878280 - RNA, 19 nt, Human
gaggcauuuguuugaacug

SEQ ID NO: 1878281 - RNA, 22 nt, Human
gaggcaugugaugagaggaaau

SEQ ID NO: 1878282 - RNA, 20 nt, Human
gaggcaugugaugagaggaa

SEQ ID NO: 1878283 - RNA, 21 nt, Human
gaggcaugugaugagaggaaa

SEQ ID NO: 1878284 - RNA, 21 nt, Human
gaggcauuuguuugaacugau

SEQ ID NO: 1878285 - RNA, 15 nt, Human
gaggcuccacuuggu

SEQ ID NO: 1878286 - RNA, 17 nt, Human
gaggcuccacuuggucu

SEQ ID NO: 1878287 - RNA, 20 nt, Human
gaggcucuggagcccacugu

SEQ ID NO: 1878288 - RNA, 18 nt, Human
gaggcugagaugggagaa

SEQ ID NO: 1878289 - RNA, 16 nt, Human
gaggcugaggcaagag

SEQ ID NO: 1878290 - RNA, 22 nt, Human
gaggacaguauuuguggggagg

SEQ ID NO: 1878291 - RNA, 20 nt, Human
gaggacauaaugggguccug

SEQ ID NO: 1878292 - RNA, 20 nt, Human
gaggacgcucucuggccuuc

SEQ ID NO: 1878293 - RNA, 21 nt, Human
gaggacgcucucuggccuucg

SEQ ID NO: 1878294 - RNA, 23 nt, Human
gaggacuuuucuuuguggcuucc

SEQ ID NO: 1878295 - RNA, 20 nt, Human
gaggacuuuucuuuguggcu

SEQ ID NO: 1878296 - RNA, 16 nt, Human
gaggacuuuucuuugu

SEQ ID NO: 1878297 - RNA, 14 nt, Human
gaggagaaacugga

SEQ ID NO: 1878298 - RNA, 12 nt, Human
gaggagaaacug

SEQ ID NO: 1878299 - RNA, 12 nt, Human
gaggagagagga

SEQ ID NO: 1878300 - RNA, 14 nt, Human
gaggagagaggacc

SEQ ID NO: 1878301 - RNA, 15 nt, Human
gaggagagaggaccc

SEQ ID NO: 1878302 - RNA, 18 nt, Human
gaggcagggucucacucu

SEQ ID NO: 1878303 - RNA, 20 nt, Human
gaggcagggucucacucugu

SEQ ID NO: 1878304 - RNA, 19 nt, Human
gaggcagggucucacucug

SEQ ID NO: 1878305 - RNA, 22 nt, Human
gaggcagggucucacucugucg

SEQ ID NO: 1878306 - RNA, 14 nt, Human
gagauuggaaggaa

SEQ ID NO: 1878307 - RNA, 21 nt, Human
gagauugugccccugcacucc

SEQ ID NO: 1878308 - RNA, 17 nt, Human
gagauucaguuuucauu

SEQ ID NO: 1878309 - RNA, 16 nt, Human
gagaugcuagaacucc

SEQ ID NO: 1878310 - RNA, 18 nt, Human
gagagggaggcaagcccu

SEQ ID NO: 1878311 - RNA, 20 nt, Human
gagaugcuagaacucccuuu

SEQ ID NO: 1878312 - RNA, 20 nt, Human
gagagcugggugucaagagg

SEQ ID NO: 1878313 - RNA, 12 nt, Human
gagaggaaauca

SEQ ID NO: 1878314 - RNA, 15 nt, Human
gagaggacccccuga

SEQ ID NO: 1878315 - RNA, 20 nt, Human
gagaggcaauggcuccuuca

SEQ ID NO: 1878316 - RNA, 16 nt, Human
gagaggcccucuggag

SEQ ID NO: 1878317 - RNA, 20 nt, Human
gagaggcccucuggaguggc

SEQ ID NO: 1878318 - RNA, 23 nt, Human
gagaggcccucuggaguggccac

SEQ ID NO: 1878319 - RNA, 13 nt, Human
gagagcugggugu

SEQ ID NO: 1878320 - RNA, 15 nt, Human
gagagcuagcagcag

SEQ ID NO: 1878321 - RNA, 21 nt, Human
gagagcuagcagcagggaggg

SEQ ID NO: 1878322 - RNA, 18 nt, Human
gagagccuuccaggggug

SEQ ID NO: 1878323 - RNA, 20 nt, Human
gagagccuuccagggguggg

SEQ ID NO: 1878324 - RNA, 20 nt, Human
gagacuccucaguucuugcc

SEQ ID NO: 1878325 - RNA, 13 nt, Human
gagacuccugcag

SEQ ID NO: 1878326 - RNA, 14 nt, Human
gagacuccugcagg

SEQ ID NO: 1878327 - RNA, 15 nt, Human
gagagccuuccaggg

SEQ ID NO: 1878328 - RNA, 16 nt, Human
gagagccuuccagggg

SEQ ID NO: 1878329 - RNA, 20 nt, Human
gacuuuuccaacccucauca

SEQ ID NO: 1878330 - RNA, 19 nt, Human
gacuuuuuuuuuuuauaau

SEQ ID NO: 1878331 - RNA, 10 nt, Human
gagaaaaaga

SEQ ID NO: 1878332 - RNA, 14 nt, Human
gagaaaaagaaaug

SEQ ID NO: 1878333 - RNA, 15 nt, Human
gagaaaaagaaaugc

SEQ ID NO: 1878334 - RNA, 16 nt, Human
gagaaaaagaaaugca

SEQ ID NO: 1878335 - RNA, 12 nt, Human
gagaaaaagacc

SEQ ID NO: 1878336 - RNA, 15 nt, Human
gagaaaacagaccua

SEQ ID NO: 1878337 - RNA, 14 nt, Human
gacuuuuccaaccc

SEQ ID NO: 1878338 - RNA, 19 nt, Human
gacuuuuccaacccucauc

SEQ ID NO: 1878339 - RNA, 18 nt, Human
gagaaguucauauuucuu

SEQ ID NO: 1878340 - RNA, 19 nt, Human
gagaccuggcacuggaugc

SEQ ID NO: 1878341 - RNA, 18 nt, Human
gagacgggggcagagagg

SEQ ID NO: 1878342 - RNA, 19 nt, Human
gagacggagucccaccuug

SEQ ID NO: 1878343 - RNA, 16 nt, Human
gagacggagucccacc

SEQ ID NO: 1878344 - RNA, 19 nt, Human
gagaccuggacacaggccu

SEQ ID NO: 1878345 - RNA, 20 nt, Human
gagaccuggacacaggccug

SEQ ID NO: 1878346 - RNA, 14 nt, Human
gagacggaguccca

SEQ ID NO: 1878347 - RNA, 20 nt, Human
gagaccgggguauccugggg

SEQ ID NO: 1878348 - RNA, 23 nt, Human
gagaaugaaagggcccagagagg

SEQ ID NO: 1878349 - RNA, 15 nt, Human
gagaaugaaagggcc

SEQ ID NO: 1878350 - RNA, 21 nt, Human
gagaaucuacccccagaucca

SEQ ID NO: 1878351 - RNA, 22 nt, Human
gcccaggccccugccacccugg

SEQ ID NO: 1878352 - RNA, 21 nt, Human
gcccaggccccugccacccug

SEQ ID NO: 1878353 - RNA, 20 nt, Human
gcccaggccccugccacccu

SEQ ID NO: 1878354 - RNA, 12 nt, Human
gcccaggccccu

SEQ ID NO: 1878355 - RNA, 11 nt, Human
gcccaggcccc

SEQ ID NO: 1878356 - RNA, 11 nt, Human
gcccaggcagg

SEQ ID NO: 1878357 - RNA, 14 nt, Human
gcccaggaugcugc

SEQ ID NO: 1878358 - RNA, 18 nt, Human
gcccaggaccaucauccu

SEQ ID NO: 1878359 - RNA, 18 nt, Human
gcauuuacuuuguguuca

SEQ ID NO: 1878360 - RNA, 19 nt, Human
gcauuuaggccaugggaca

SEQ ID NO: 1878361 - RNA, 17 nt, Human
gcauuuacugugucuuu

SEQ ID NO: 1878362 - RNA, 18 nt, Human
gcauuuacugugucuuug

SEQ ID NO: 1878363 - RNA, 15 nt, Human
gcccacgcccccacu

SEQ ID NO: 1878364 - RNA, 16 nt, Human
gcccacgcccccacug

SEQ ID NO: 1878365 - RNA, 17 nt, Human
gcccacgcccccacugg

SEQ ID NO: 1878366 - RNA, 21 nt, Human
gcccacgcccccacuggugac

SEQ ID NO: 1878367 - RNA, 13 nt, Human
gcccacuucugcc

SEQ ID NO: 1878368 - RNA, 17 nt, Human
gcccacuguccugggcc

SEQ ID NO: 1878369 - RNA, 18 nt, Human
gcccacuguccugggccu

SEQ ID NO: 1878370 - RNA, 21 nt, Human
gcccacuguccugggccugca

SEQ ID NO: 1878371 - RNA, 23 nt, Human
gcccacuguccugggccugcaga

SEQ ID NO: 1878372 - RNA, 24 nt, Human
gcccacuguccugggccugcagaa

SEQ ID NO: 1878373 - RNA, 24 nt, Human
gcccaggaaaggcuccaggagcag

SEQ ID NO: 1878374 - RNA, 22 nt, Human
gcccaggaaaggcuccaggagc

SEQ ID NO: 1878375 - RNA, 23 nt, Human
gcccaggaaaggcuccaggagca

SEQ ID NO: 1878376 - RNA, 21 nt, Human
gcccacgcuggagugcaguga

SEQ ID NO: 1878377 - RNA, 19 nt, Human
gcccacgcuggagugcagu

SEQ ID NO: 1878378 - RNA, 23 nt, Human
gcccacgcuggagugcagugagc

SEQ ID NO: 1878379 - RNA, 15 nt, Human
gcccacuguacuugc

SEQ ID NO: 1878380 - RNA, 20 nt, Human
gcccacuguacuugcucuug

SEQ ID NO: 1878381 - RNA, 22 nt, Human
gcccacuguacuugcucuugau

SEQ ID NO: 1878382 - RNA, 15 nt, Human
gcccacuguccuggg

SEQ ID NO: 1878383 - RNA, 20 nt, Human
gccccaaaacucuccucugc

SEQ ID NO: 1878384 - RNA, 21 nt, Human
gccccaaaacucuccucugcu

SEQ ID NO: 1878385 - RNA, 11 nt, Human
gccccaaaagg

SEQ ID NO: 1878386 - RNA, 16 nt, Human
gccccugcugguucag

SEQ ID NO: 1878387 - RNA, 15 nt, Human
gccccugcugguuca

SEQ ID NO: 1878388 - RNA, 12 nt, Human
gccccuggcagc

SEQ ID NO: 1878389 - RNA, 15 nt, Human
gccccuggcagcccc

SEQ ID NO: 1878390 - RNA, 12 nt, Human
gccccugcuggu

SEQ ID NO: 1878391 - RNA, 11 nt, Human
gcccccugccc

SEQ ID NO: 1878392 - RNA, 17 nt, Human
gcccccaggacugggcc

SEQ ID NO: 1878393 - RNA, 16 nt, Human
gcccccaggacugggc

SEQ ID NO: 1878394 - RNA, 15 nt, Human
gcccccaggacuggg

SEQ ID NO: 1878395 - RNA, 14 nt, Human
gcccccaggacugg

SEQ ID NO: 1878396 - RNA, 13 nt, Human
gcccccaggacug

SEQ ID NO: 1878397 - RNA, 12 nt, Human
gcccccaggacu

SEQ ID NO: 1878398 - RNA, 21 nt, Human
gcccccagcuaagaaccugga

SEQ ID NO: 1878399 - RNA, 22 nt, Human
gcccccagcuaagaaccuggaa

SEQ ID NO: 1878400 - RNA, 23 nt, Human
gcccccagcuaagaaccuggaac

SEQ ID NO: 1878401 - RNA, 15 nt, Human
gcccccagcuaagaa

SEQ ID NO: 1878402 - RNA, 22 nt, Human
gccucauguccacugguucuuc

SEQ ID NO: 1878403 - RNA, 13 nt, Human
gccucgaacuggc

SEQ ID NO: 1878404 - RNA, 22 nt, Human
gccuccuuugugaggaagccgc

SEQ ID NO: 1878405 - RNA, 16 nt, Human
gccucgaacuggcugc

SEQ ID NO: 1878406 - RNA, 16 nt, Human
gccucgaaacacagaa

SEQ ID NO: 1878407 - RNA, 17 nt, Human
gccuccagaacucacug

SEQ ID NO: 1878408 - RNA, 15 nt, Human
gccuccauccugagg

SEQ ID NO: 1878409 - RNA, 14 nt, Human
gccuccauccugag

SEQ ID NO: 1878410 - RNA, 13 nt, Human
gccuccauccuga

SEQ ID NO: 1878411 - RNA, 12 nt, Human
gccuccagaacu

SEQ ID NO: 1878412 - RNA, 19 nt, Human
gccuagcauacguacacau

SEQ ID NO: 1878413 - RNA, 12 nt, Human
gccuagcauacg

SEQ ID NO: 1878414 - RNA, 17 nt, Human
gccuacaggagugagca

SEQ ID NO: 1878415 - RNA, 22 nt, Human
gccuacagcuuugaucccugac

SEQ ID NO: 1878416 - RNA, 23 nt, Human
gccuacagcuuugaucccugaca

SEQ ID NO: 1878417 - RNA, 13 nt, Human
gcccugugcucca

SEQ ID NO: 1878418 - RNA, 18 nt, Human
gcccugcgguagauggga

SEQ ID NO: 1878419 - RNA, 14 nt, Human
gcccugcccaccug

SEQ ID NO: 1878420 - RNA, 15 nt, Human
gcccugcccaccugg

SEQ ID NO: 1878421 - RNA, 21 nt, Human
gcccugugggcccccaaaugg

SEQ ID NO: 1878422 - RNA, 23 nt, Human
gcccuuaccugccaggaagccag

SEQ ID NO: 1878423 - RNA, 19 nt, Human
gcccuuagcagggaaacag

SEQ ID NO: 1878424 - RNA, 16 nt, Human
gcccugugggccccca

SEQ ID NO: 1878425 - RNA, 17 nt, Human
gcccugugggcccccaa

SEQ ID NO: 1878426 - RNA, 21 nt, Human
gcccuuaccugccaggaagcc

SEQ ID NO: 1878427 - RNA, 22 nt, Human
gcccuuaccugccaggaagcca

SEQ ID NO: 1878428 - RNA, 16 nt, Human
gccuacaggagugagc

SEQ ID NO: 1878429 - RNA, 21 nt, Human
gccccugcugguucaggguug

SEQ ID NO: 1878430 - RNA, 16 nt, Human
gccccuggcagccccu

SEQ ID NO: 1878431 - RNA, 17 nt, Human
gccccuggcagccccug

SEQ ID NO: 1878432 - RNA, 20 nt, Human
gcucagggccuggcucaggu

SEQ ID NO: 1878433 - RNA, 16 nt, Human
gcucagagcaguguuu

SEQ ID NO: 1878434 - RNA, 18 nt, Human
gcucagaggcgcacugug

SEQ ID NO: 1878435 - RNA, 19 nt, Human
gcucagaggcgcacuguga

SEQ ID NO: 1878436 - RNA, 20 nt, Human
gcucagaggcgcacugugac

SEQ ID NO: 1878437 - RNA, 21 nt, Human
gcucagaggcgcacugugacc

SEQ ID NO: 1878438 - RNA, 21 nt, Human
gcucacugcuaagaauauuug

SEQ ID NO: 1878439 - RNA, 22 nt, Human
gcucaggagcccugggaggcuc

SEQ ID NO: 1878440 - RNA, 23 nt, Human
gcucaggagcccugggaggcucu

SEQ ID NO: 1878441 - RNA, 13 nt, Human
gcucaggaguuug

SEQ ID NO: 1878442 - RNA, 18 nt, Human
gcucagggccuggcucag

SEQ ID NO: 1878443 - RNA, 19 nt, Human
gcucagggccuggcucagg

SEQ ID NO: 1878444 - RNA, 20 nt, Human
gcuaggaccccuccaugugg

SEQ ID NO: 1878445 - RNA, 22 nt, Human
gcuaggaccccuccaugugggc

SEQ ID NO: 1878446 - RNA, 21 nt, Human
gcuaggaauuguguuuauaau

SEQ ID NO: 1878447 - RNA, 16 nt, Human
gcuaguugggcuuccu

SEQ ID NO: 1878448 - RNA, 14 nt, Human
gcuaguugggcuuc

SEQ ID NO: 1878449 - RNA, 18 nt, Human
gcuauuaaaacucuuuua

SEQ ID NO: 1878450 - RNA, 19 nt, Human
gcuauuaaaacucuuuuaa

SEQ ID NO: 1878451 - RNA, 18 nt, Human
gcuauucaguaauaacuc

SEQ ID NO: 1878452 - RNA, 22 nt, Human
gcuaagugauccucccaccuca

SEQ ID NO: 1878453 - RNA, 18 nt, Human
gcuaagugauccucccac

SEQ ID NO: 1878454 - RNA, 23 nt, Human
gcgauucuucugcuucagccucc

SEQ ID NO: 1878455 - RNA, 21 nt, Human
gcgcagcauauucaggaagcu

SEQ ID NO: 1878456 - RNA, 22 nt, Human
gcgauucuucugcuucagccuc

SEQ ID NO: 1878457 - RNA, 12 nt, Human
gccuugccagag

SEQ ID NO: 1878458 - RNA, 23 nt, Human
gccuugaccauucuccaccugcc

SEQ ID NO: 1878459 - RNA, 23 nt, Human
gccuugaacuuugaccucugcag

SEQ ID NO: 1878460 - RNA, 16 nt, Human
gccuugaccauucucc

SEQ ID NO: 1878461 - RNA, 22 nt, Human
gccuugaccauucuccaccugc

SEQ ID NO: 1878462 - RNA, 17 nt, Human
gccuggcucccaggaca

SEQ ID NO: 1878463 - RNA, 18 nt, Human
gccuggcucccaggacac

SEQ ID NO: 1878464 - RNA, 16 nt, Human
gccuggcucccaggac

SEQ ID NO: 1878465 - RNA, 23 nt, Human
gccuggcuccaaacccucgaggc

SEQ ID NO: 1878466 - RNA, 22 nt, Human
gccucuguccccuucucucauc

SEQ ID NO: 1878467 - RNA, 21 nt, Human
gccucuguccccuucucucau

SEQ ID NO: 1878468 - RNA, 20 nt, Human
gccucuguccccuucucuca

SEQ ID NO: 1878469 - RNA, 19 nt, Human
gccucuguccccuucucuc

SEQ ID NO: 1878470 - RNA, 18 nt, Human
gccucuguccccuucucu

SEQ ID NO: 1878471 - RNA, 15 nt, Human
gccucuguccccuuc

SEQ ID NO: 1878472 - RNA, 23 nt, Human
gccugggaucccucauccucaua

SEQ ID NO: 1878473 - RNA, 11 nt, Human
gccugggcaga

SEQ ID NO: 1878474 - RNA, 19 nt, Human
gccugugccucugggacug

SEQ ID NO: 1878475 - RNA, 17 nt, Human
gccuguucagcuccagc

SEQ ID NO: 1878476 - RNA, 16 nt, Human
gccuguucagcuccag

SEQ ID NO: 1878477 - RNA, 15 nt, Human
gccuguucagcucca

SEQ ID NO: 1878478 - RNA, 16 nt, Human
gccuucucugaaggac

SEQ ID NO: 1878479 - RNA, 15 nt, Human
gccuucucugaagga

SEQ ID NO: 1878480 - RNA, 15 nt, Human
gccuucuaaaggugu

SEQ ID NO: 1878481 - RNA, 21 nt, Human
gccuucuuuucucccuuuuaa

SEQ ID NO: 1878482 - RNA, 15 nt, Human
gccuucuuuugauua

SEQ ID NO: 1878483 - RNA, 14 nt, Human
gccuugaacuuuga

SEQ ID NO: 1878484 - RNA, 22 nt, Human
gccuucuuuugauuauguuuuu

SEQ ID NO: 1878485 - RNA, 13 nt, Human
gcggauggccgga

SEQ ID NO: 1878486 - RNA, 22 nt, Human
gcggcucccggggcagggcagc

SEQ ID NO: 1878487 - RNA, 15 nt, Human
gcggcuggacuugga

SEQ ID NO: 1878488 - RNA, 15 nt, Human
gcggcucccggggca

SEQ ID NO: 1878489 - RNA, 16 nt, Human
gcggccuuuggcuuca

SEQ ID NO: 1878490 - RNA, 16 nt, Human
gcggcggagcuggccc

SEQ ID NO: 1878491 - RNA, 18 nt, Human
gcggcggagcuggccccg

SEQ ID NO: 1878492 - RNA, 20 nt, Human
gcggcggagcuggccccgcc

SEQ ID NO: 1878493 - RNA, 18 nt, Human
gcguggacucugcacaug

SEQ ID NO: 1878494 - RNA, 17 nt, Human
gcguggacucugcacau

SEQ ID NO: 1878495 - RNA, 14 nt, Human
gcguggacucugca

SEQ ID NO: 1878496 - RNA, 13 nt, Human
gcguggacucugc

SEQ ID NO: 1878497 - RNA, 14 nt, Human
gcgggagccucccu

SEQ ID NO: 1878498 - RNA, 19 nt, Human
gcgggaauggcagcugcca

SEQ ID NO: 1878499 - RNA, 15 nt, Human
gcggcuggcagccca

SEQ ID NO: 1878500 - RNA, 16 nt, Human
gcggcuggacuuggag

SEQ ID NO: 1878501 - RNA, 20 nt, Human
gcuguaguccucauaaaaag

SEQ ID NO: 1878502 - RNA, 19 nt, Human
gcuguaucccaugagccuc

SEQ ID NO: 1878503 - RNA, 17 nt, Human
gcuguaucccaugagcc

SEQ ID NO: 1878504 - RNA, 20 nt, Human
gcuguuggcugggggccuca

SEQ ID NO: 1878505 - RNA, 16 nt, Human
gcuguuggcugggggc

SEQ ID NO: 1878506 - RNA, 15 nt, Human
gcuguuggcuggggg

SEQ ID NO: 1878507 - RNA, 17 nt, Human
gcugugcugcccugccc

SEQ ID NO: 1878508 - RNA, 15 nt, Human
gcugugcugcccugc

SEQ ID NO: 1878509 - RNA, 16 nt, Human
gcugugcugcccugcc

SEQ ID NO: 1878510 - RNA, 13 nt, Human
gcugugcucugga

SEQ ID NO: 1878511 - RNA, 18 nt, Human
gcugugcacaaaguggca

SEQ ID NO: 1878512 - RNA, 16 nt, Human
gcugugcucuggacag

SEQ ID NO: 1878513 - RNA, 15 nt, Human
gcugugcucuggaca

SEQ ID NO: 1878514 - RNA, 18 nt, Human
gcugugcucuggacaggc

SEQ ID NO: 1878515 - RNA, 14 nt, Human
gcugugcugcccug

SEQ ID NO: 1878516 - RNA, 22 nt, Human
gcugggguggggaccucaggcc

SEQ ID NO: 1878517 - RNA, 23 nt, Human
gcugggguggggaccucaggccu

SEQ ID NO: 1878518 - RNA, 18 nt, Human
gcuggguucuacccaggu

SEQ ID NO: 1878519 - RNA, 17 nt, Human
gcuggguucuacccagg

SEQ ID NO: 1878520 - RNA, 20 nt, Human
gcuggguucuacccaggugc

SEQ ID NO: 1878521 - RNA, 21 nt, Human
gcuggguucuacccaggugcu

SEQ ID NO: 1878522 - RNA, 23 nt, Human
gcuggcuguuggcugggggccuc

SEQ ID NO: 1878523 - RNA, 20 nt, Human
gcuggcuguuggcugggggc

SEQ ID NO: 1878524 - RNA, 20 nt, Human
gcugggaauaagugccagga

SEQ ID NO: 1878525 - RNA, 12 nt, Human
gcugggccccug

SEQ ID NO: 1878526 - RNA, 13 nt, Human
gcugggccccugc

SEQ ID NO: 1878527 - RNA, 14 nt, Human
gcugggccccugcc

SEQ ID NO: 1878528 - RNA, 18 nt, Human
gcugggccccugccucuc

SEQ ID NO: 1878529 - RNA, 20 nt, Human
gcugggccccugccucucug

SEQ ID NO: 1878530 - RNA, 17 nt, Human
gcugggguggggaccuc

SEQ ID NO: 1878531 - RNA, 19 nt, Human
gcugggguggggaccucag

SEQ ID NO: 1878532 - RNA, 12 nt, Human
gcugcugaaggc

SEQ ID NO: 1878533 - RNA, 14 nt, Human
gcuggcgugcagug

SEQ ID NO: 1878534 - RNA, 13 nt, Human
gcuggacuuggag

SEQ ID NO: 1878535 - RNA, 19 nt, Human
gcuggcuguuggcuggggg

SEQ ID NO: 1878536 - RNA, 18 nt, Human
gcuggcuguuggcugggg

SEQ ID NO: 1878537 - RNA, 18 nt, Human
gcuggcgugcaguggugc

SEQ ID NO: 1878538 - RNA, 15 nt, Human
gcuggcgugcagugg

SEQ ID NO: 1878539 - RNA, 15 nt, Human
gcugagcaaacaugu

SEQ ID NO: 1878540 - RNA, 23 nt, Human
gcugagggugagugggugaauaa

SEQ ID NO: 1878541 - RNA, 19 nt, Human
gcugaggccacacucagca

SEQ ID NO: 1878542 - RNA, 21 nt, Human
gcugaggccacacucagcaca

SEQ ID NO: 1878543 - RNA, 14 nt, Human
gcugaggugggagg

SEQ ID NO: 1878544 - RNA, 15 nt, Human
gcugaggcaauucua

SEQ ID NO: 1878545 - RNA, 14 nt, Human
gcugaggcaauucu

SEQ ID NO: 1878546 - RNA, 13 nt, Human
gcugagccccugu

SEQ ID NO: 1878547 - RNA, 15 nt, Human
gcugagccccugucu

SEQ ID NO: 1878548 - RNA, 22 nt, Human
gcugagccccugucuagagagg

SEQ ID NO: 1878549 - RNA, 23 nt, Human
gcugagccccugucuagagaggg

SEQ ID NO: 1878550 - RNA, 18 nt, Human
gcugcacccucaggcagg

SEQ ID NO: 1878551 - RNA, 19 nt, Human
gcugcacccucaggcaggu

SEQ ID NO: 1878552 - RNA, 13 nt, Human
gcugcaccggcug

SEQ ID NO: 1878553 - RNA, 12 nt, Human
gcugcaagguuu

SEQ ID NO: 1878554 - RNA, 19 nt, Human
gcugcaagguuuaggcugg

SEQ ID NO: 1878555 - RNA, 21 nt, Human
gcugcaagguuuaggcuggug

SEQ ID NO: 1878556 - RNA, 14 nt, Human
gcugccucauuuag

SEQ ID NO: 1878557 - RNA, 21 nt, Human
gcugccucauuuagagaggaa

SEQ ID NO: 1878558 - RNA, 21 nt, Human
gcugccuccccucuccuuccu

SEQ ID NO: 1878559 - RNA, 16 nt, Human
gcugccucucccauca

SEQ ID NO: 1878560 - RNA, 20 nt, Human
gcugccugggaucccucauc

SEQ ID NO: 1878561 - RNA, 13 nt, Human
gcugccuguucag

SEQ ID NO: 1878562 - RNA, 12 nt, Human
gcugccuguuca

SEQ ID NO: 1878563 - RNA, 17 nt, Human
gcugccuguucagcucc

SEQ ID NO: 1878564 - RNA, 21 nt, Human
gcugccugggaucccucaucc

SEQ ID NO: 1878565 - RNA, 20 nt, Human
gcugccccuggcagccccug

SEQ ID NO: 1878566 - RNA, 18 nt, Human
gcugccccuggcagcccc

SEQ ID NO: 1878567 - RNA, 19 nt, Human
gcugccccuggcagccccu

SEQ ID NO: 1878568 - RNA, 23 nt, Human
gcugcagccaggccacuggcccc

SEQ ID NO: 1878569 - RNA, 15 nt, Human
gcugcagccaggcca

SEQ ID NO: 1878570 - RNA, 22 nt, Human
gcugccccucaucucucugccc

SEQ ID NO: 1878571 - RNA, 23 nt, Human
ggaaaucaccgaaaacguggcug

SEQ ID NO: 1878572 - RNA, 21 nt, Human
ggaagccagcaggcucucagg

SEQ ID NO: 1878573 - RNA, 18 nt, Human
ggaagccgcuggggccag

SEQ ID NO: 1878574 - RNA, 22 nt, Human
ggaagccagcaggcucucaggc

SEQ ID NO: 1878575 - RNA, 23 nt, Human
ggaagccagcaggcucucaggcc

SEQ ID NO: 1878576 - RNA, 12 nt, Human
ggacaccgggca

SEQ ID NO: 1878577 - RNA, 15 nt, Human
ggacacccccucgcu

SEQ ID NO: 1878578 - RNA, 13 nt, Human
ggacacccuguga

SEQ ID NO: 1878579 - RNA, 23 nt, Human
ggacacccugugauggggcccug

SEQ ID NO: 1878580 - RNA, 17 nt, Human
ggacagggaggugaccc

SEQ ID NO: 1878581 - RNA, 13 nt, Human
ggacaggcuggcu

SEQ ID NO: 1878582 - RNA, 15 nt, Human
ggacaggcuggcucc

SEQ ID NO: 1878583 - RNA, 23 nt, Human
ggacaggcuggcuccagaugcag

SEQ ID NO: 1878584 - RNA, 18 nt, Human
ggacaguauuugugggga

SEQ ID NO: 1878585 - RNA, 17 nt, Human
ggacaggggcaggagga

SEQ ID NO: 1878586 - RNA, 19 nt, Human
ggacaguauuuguggggag

SEQ ID NO: 1878587 - RNA, 13 nt, Human
ggacauggacaag

SEQ ID NO: 1878588 - RNA, 14 nt, Human
ggacauggacaagg

SEQ ID NO: 1878589 - RNA, 16 nt, Human
ggacaugcgguagcca

SEQ ID NO: 1878590 - RNA, 19 nt, Human
ggacaugcgguagccagca

SEQ ID NO: 1878591 - RNA, 21 nt, Human
ggacaugcgguagccagcaca

SEQ ID NO: 1878592 - RNA, 12 nt, Human
ggacaguggcag

SEQ ID NO: 1878593 - RNA, 13 nt, Human
ggacaguggcagg

SEQ ID NO: 1878594 - RNA, 14 nt, Human
ggacaguggcagga

SEQ ID NO: 1878595 - RNA, 14 nt, Human
ggacaucagcuggu

SEQ ID NO: 1878596 - RNA, 20 nt, Human
ggacauccccccgccaaaag

SEQ ID NO: 1878597 - RNA, 16 nt, Human
ggacaguggcaggaca

SEQ ID NO: 1878598 - RNA, 17 nt, Human
ggacaguggcaggacag

SEQ ID NO: 1878599 - RNA, 19 nt, Human
ggacauaaugggguccugg

SEQ ID NO: 1878600 - RNA, 23 nt, Human
ggacauaaugggguccuggccau

SEQ ID NO: 1878601 - RNA, 18 nt, Human
ggacauagcgaauacaaa

SEQ ID NO: 1878602 - RNA, 13 nt, Human
ggacacaggccug

SEQ ID NO: 1878603 - RNA, 18 nt, Human
ggacacaggccugcucuc

SEQ ID NO: 1878604 - RNA, 13 nt, Human
ggacacagcucuu

SEQ ID NO: 1878605 - RNA, 12 nt, Human
ggacacccugug

SEQ ID NO: 1878606 - RNA, 12 nt, Human
ggaaucaagauu

SEQ ID NO: 1878607 - RNA, 18 nt, Human
ggaaugaagcaaugcuuc

SEQ ID NO: 1878608 - RNA, 19 nt, Human
ggaaugaaugucaguguga

SEQ ID NO: 1878609 - RNA, 12 nt, Human
ggacacagcucu

SEQ ID NO: 1878610 - RNA, 20 nt, Human
ggaaugagauuaauuccuuu

SEQ ID NO: 1878611 - RNA, 16 nt, Human
ggaauauauaaccagu

SEQ ID NO: 1878612 - RNA, 16 nt, Human
ggaauaccuguccccc

SEQ ID NO: 1878613 - RNA, 19 nt, Human
ggaauaccugucccccuga

SEQ ID NO: 1878614 - RNA, 19 nt, Human
ggaauacucuuauaucuau

SEQ ID NO: 1878615 - RNA, 12 nt, Human
ggaauacuuuuu

SEQ ID NO: 1878616 - RNA, 17 nt, Human
ggaauacuuuuuguuau

SEQ ID NO: 1878617 - RNA, 22 nt, Human
ggaagcucagggccuggcucag

SEQ ID NO: 1878618 - RNA, 21 nt, Human
ggaagcucagggccuggcuca

SEQ ID NO: 1878619 - RNA, 15 nt, Human
ggaauaccugucccc

SEQ ID NO: 1878620 - RNA, 16 nt, Human
ggaagcucagggccug

SEQ ID NO: 1878621 - RNA, 17 nt, Human
ggaagcucagggccugg

SEQ ID NO: 1878622 - RNA, 20 nt, Human
ggaagccgugcucgccccag

SEQ ID NO: 1878623 - RNA, 18 nt, Human
gcuuugcuuucugcucag

SEQ ID NO: 1878624 - RNA, 19 nt, Human
gcuuugcuuucugcucagc

SEQ ID NO: 1878625 - RNA, 12 nt, Human
gcuuugcugcug

SEQ ID NO: 1878626 - RNA, 18 nt, Human
gcuuugcugcugaaggcu

SEQ ID NO: 1878627 - RNA, 19 nt, Human
gcuuugcugcugaaggcuc

SEQ ID NO: 1878628 - RNA, 16 nt, Human
gcuuaacuucacauau

SEQ ID NO: 1878629 - RNA, 13 nt, Human
gcuguuuccauag

SEQ ID NO: 1878630 - RNA, 16 nt, Human
gcuucuucagagacuc

SEQ ID NO: 1878631 - RNA, 12 nt, Human
gcuuaaugaaaa

SEQ ID NO: 1878632 - RNA, 17 nt, Human
gcuuaacuucacauauu

SEQ ID NO: 1878633 - RNA, 19 nt, Human
gcuucuucagagacuccug

SEQ ID NO: 1878634 - RNA, 21 nt, Human
gcuucuucagagacuccugca

SEQ ID NO: 1878635 - RNA, 23 nt, Human
gcuucuucagagacuccugcagg

SEQ ID NO: 1878636 - RNA, 17 nt, Human
gcuugaccgugaggcca

SEQ ID NO: 1878637 - RNA, 18 nt, Human
gcuugaccgugaggccag

SEQ ID NO: 1878638 - RNA, 19 nt, Human
gcuugaccgugaggccaga

SEQ ID NO: 1878639 - RNA, 23 nt, Human
gcuugggcuucauccuccucaga

SEQ ID NO: 1878640 - RNA, 16 nt, Human
gcuuggggaccagagc

SEQ ID NO: 1878641 - RNA, 23 nt, Human
gcuuucuacccagcgagcccugg

SEQ ID NO: 1878642 - RNA, 12 nt, Human
gcuuugauucau

SEQ ID NO: 1878643 - RNA, 15 nt, Human
gcuuugauucauagu

SEQ ID NO: 1878644 - RNA, 20 nt, Human
gcuuugauucauaguaacuu

SEQ ID NO: 1878645 - RNA, 19 nt, Human
gcuuugcaaccauuuucau

SEQ ID NO: 1878646 - RNA, 22 nt, Human
gcuuucuacccagcgagcccug

SEQ ID NO: 1878647 - RNA, 19 nt, Human
gcuuucuacccagcgagcc

SEQ ID NO: 1878648 - RNA, 13 nt, Human
gcuuucuacccag

SEQ ID NO: 1878649 - RNA, 22 nt, Human
gcuuggggaccagagcugccac

SEQ ID NO: 1878650 - RNA, 17 nt, Human
gcuuggggaccagagcu

SEQ ID NO: 1878651 - RNA, 18 nt, Human
gcuuggggaccagagcug

SEQ ID NO: 1878652 - RNA, 20 nt, Human
gcuuggggaccagagcugcc

SEQ ID NO: 1878653 - RNA, 21 nt, Human
gcuuggggaccagagcugcca

SEQ ID NO: 1878654 - RNA, 20 nt, Human
gcuuuucccuuuuuuuaagu

SEQ ID NO: 1878655 - RNA, 21 nt, Human
gcuuuucccuuuuuuuaagua

SEQ ID NO: 1878656 - RNA, 22 nt, Human
gcuuuuccucaaagggagagag

SEQ ID NO: 1878657 - RNA, 17 nt, Human
gcuuuucuuucuaccaa

SEQ ID NO: 1878658 - RNA, 16 nt, Human
ggaaaaaauaacaaug

SEQ ID NO: 1878659 - RNA, 19 nt, Human
gcuuuugugcauuaucuag

SEQ ID NO: 1878660 - RNA, 13 nt, Human
gcuuuugugcauu

SEQ ID NO: 1878661 - RNA, 15 nt, Human
gcuuuuuaauauuga

SEQ ID NO: 1878662 - RNA, 17 nt, Human
gcuuuugugucuuacau

SEQ ID NO: 1878663 - RNA, 20 nt, Human
ggaaacagcuaaugggacac

SEQ ID NO: 1878664 - RNA, 19 nt, Human
ggaaaaaaaucguccaggg

SEQ ID NO: 1878665 - RNA, 13 nt, Human
ggaaacagaggcu

SEQ ID NO: 1878666 - RNA, 15 nt, Human
ggaaacccagcucug

SEQ ID NO: 1878667 - RNA, 21 nt, Human
ggaaacuaggugcauauuuau

SEQ ID NO: 1878668 - RNA, 17 nt, Human
ggaaacuggaugagguc

SEQ ID NO: 1878669 - RNA, 16 nt, Human
ggaaagcccugugcuc

SEQ ID NO: 1878670 - RNA, 19 nt, Human
ggaaaggagccuaggccag

SEQ ID NO: 1878671 - RNA, 21 nt, Human
ggaaaggagccuaggccaggu

SEQ ID NO: 1878672 - RNA, 19 nt, Human
ggaaagcaaaggagauugg

SEQ ID NO: 1878673 - RNA, 16 nt, Human
ggaaagaguaggaaga

SEQ ID NO: 1878674 - RNA, 17 nt, Human
ggaaagaguaggaagac

SEQ ID NO: 1878675 - RNA, 20 nt, Human
ggaaagacuuuuccaacccu

SEQ ID NO: 1878676 - RNA, 14 nt, Human
ggaaagaggcucug

SEQ ID NO: 1878677 - RNA, 15 nt, Human
ggcucacugcagccu

SEQ ID NO: 1878678 - RNA, 14 nt, Human
ggcucacugcagcc

SEQ ID NO: 1878679 - RNA, 13 nt, Human
ggcucacugcagc

SEQ ID NO: 1878680 - RNA, 19 nt, Human
ggcucccggggcagggcag

SEQ ID NO: 1878681 - RNA, 13 nt, Human
ggcucccuuccca

SEQ ID NO: 1878682 - RNA, 15 nt, Human
ggcucuuccaggcug

SEQ ID NO: 1878683 - RNA, 17 nt, Human
ggcucuuccaggcuggg

SEQ ID NO: 1878684 - RNA, 18 nt, Human
ggcucuuccaggcuggga

SEQ ID NO: 1878685 - RNA, 19 nt, Human
ggcucuugaacugagcuug

SEQ ID NO: 1878686 - RNA, 18 nt, Human
ggcucuugaacugagcuu

SEQ ID NO: 1878687 - RNA, 20 nt, Human
ggcucuugaacugagcuugg

SEQ ID NO: 1878688 - RNA, 12 nt, Human
ggcuggcaugau

SEQ ID NO: 1878689 - RNA, 22 nt, Human
ggcuggcaugauccaagcaaga

SEQ ID NO: 1878690 - RNA, 22 nt, Human
ggcugaccacagcacagccaac

SEQ ID NO: 1878691 - RNA, 13 nt, Human
ggcuggccuggcc

SEQ ID NO: 1878692 - RNA, 14 nt, Human
ggcuggccuggccc

SEQ ID NO: 1878693 - RNA, 15 nt, Human
ggcuggccuggcccc

SEQ ID NO: 1878694 - RNA, 20 nt, Human
ggcuggccucccaaaugagc

SEQ ID NO: 1878695 - RNA, 11 nt, Human
aaaaaaaccaa

SEQ ID NO: 1878696 - RNA, 11 nt, Human
aaaaaaagaaa

SEQ ID NO: 1878697 - RNA, 14 nt, Human
aaaaaaagaucugu

SEQ ID NO: 1878698 - RNA, 11 nt, Human
aaaaaaagaca

SEQ ID NO: 1878699 - RNA, 22 nt, Human
aaaaaacugcugacuguuuucu

SEQ ID NO: 1878700 - RNA, 12 nt, Human
aaaaaagaaaau

SEQ ID NO: 1878701 - RNA, 23 nt, Human
aaaaaguuuugcccuuuuuaagg

SEQ ID NO: 1878702 - RNA, 13 nt, Human
aaaaauacaaaaa

SEQ ID NO: 1878703 - RNA, 14 nt, Human
ggcuggguuggagg

SEQ ID NO: 1878704 - RNA, 22 nt, Human
ggcuggguucuacccaggugcu

SEQ ID NO: 1878705 - RNA, 14 nt, Human
aaaaauaaaaaaca

SEQ ID NO: 1878706 - RNA, 19 nt, Human
aaaaaguuugguucugugu

SEQ ID NO: 1878707 - RNA, 21 nt, Human
aaaaaggaugcacagaguugu

SEQ ID NO: 1878708 - RNA, 12 nt, Human
aaaaaggcagga

SEQ ID NO: 1878709 - RNA, 14 nt, Human
aaaaaggaggaaga

SEQ ID NO: 1878710 - RNA, 17 nt, Human
ggccucccacagacuca

SEQ ID NO: 1878711 - RNA, 21 nt, Human
ggccgcccgggcccagaggag

SEQ ID NO: 1878712 - RNA, 17 nt, Human
ggccgcccgggcccaga

SEQ ID NO: 1878713 - RNA, 22 nt, Human
ggccgcgccaaauaaugucucu

SEQ ID NO: 1878714 - RNA, 13 nt, Human
ggccucagugcca

SEQ ID NO: 1878715 - RNA, 17 nt, Human
ggccucccaacucaccc

SEQ ID NO: 1878716 - RNA, 18 nt, Human
ggccucccaacucacccc

SEQ ID NO: 1878717 - RNA, 19 nt, Human
ggccucccaacucacccca

SEQ ID NO: 1878718 - RNA, 23 nt, Human
ggccucccaacucaccccagccc

SEQ ID NO: 1878719 - RNA, 14 nt, Human
ggccucccacagac

SEQ ID NO: 1878720 - RNA, 16 nt, Human
ggccucccacagacuc

SEQ ID NO: 1878721 - RNA, 20 nt, Human
ggccucccaacucaccccag

SEQ ID NO: 1878722 - RNA, 22 nt, Human
ggccucccaacucaccccagcc

SEQ ID NO: 1878723 - RNA, 16 nt, Human
ggccagaugcaccagc

SEQ ID NO: 1878724 - RNA, 15 nt, Human
ggccagaugcaccag

SEQ ID NO: 1878725 - RNA, 22 nt, Human
ggccagagggagugacagaggc

SEQ ID NO: 1878726 - RNA, 17 nt, Human
ggccagauccagccugg

SEQ ID NO: 1878727 - RNA, 18 nt, Human
ggccagauccagccuggg

SEQ ID NO: 1878728 - RNA, 17 nt, Human
ggccagaugcaccagcc

SEQ ID NO: 1878729 - RNA, 13 nt, Human
ggccccagccucc

SEQ ID NO: 1878730 - RNA, 21 nt, Human
ggccccugccucucugcaggu

SEQ ID NO: 1878731 - RNA, 13 nt, Human
ggccccugccucu

SEQ ID NO: 1878732 - RNA, 17 nt, Human
ggccccugccucucugc

SEQ ID NO: 1878733 - RNA, 18 nt, Human
ggccccugccucucugca

SEQ ID NO: 1878734 - RNA, 19 nt, Human
ggccccugccucucugcag

SEQ ID NO: 1878735 - RNA, 16 nt, Human
ggccugcaagggagug

SEQ ID NO: 1878736 - RNA, 14 nt, Human
ggccugcacaguga

SEQ ID NO: 1878737 - RNA, 14 nt, Human
ggccuggcagcuca

SEQ ID NO: 1878738 - RNA, 16 nt, Human
ggccuggcagcucagc

SEQ ID NO: 1878739 - RNA, 15 nt, Human
ggccuggccagaugc

SEQ ID NO: 1878740 - RNA, 12 nt, Human
ggccuggccaga

SEQ ID NO: 1878741 - RNA, 16 nt, Human
ggccuggccagaugca

SEQ ID NO: 1878742 - RNA, 20 nt, Human
ggccugccuccagggcugga

SEQ ID NO: 1878743 - RNA, 19 nt, Human
ggccugccuccagggcugg

SEQ ID NO: 1878744 - RNA, 18 nt, Human
ggccugccuccagggcug

SEQ ID NO: 1878745 - RNA, 13 nt, Human
ggccugcuccaga

SEQ ID NO: 1878746 - RNA, 14 nt, Human
ggccugcuccagac

SEQ ID NO: 1878747 - RNA, 15 nt, Human
ggccugcuccagacc

SEQ ID NO: 1878748 - RNA, 16 nt, Human
ggccugcuccagaccu

SEQ ID NO: 1878749 - RNA, 17 nt, Human
ggccugcuccagaccug

SEQ ID NO: 1878750 - RNA, 18 nt, Human
ggccugcuccagaccuga

SEQ ID NO: 1878751 - RNA, 20 nt, Human
ggcuaagcuucacuguaaaa

SEQ ID NO: 1878752 - RNA, 21 nt, Human
ggcuaaacauccaauauuuuc

SEQ ID NO: 1878753 - RNA, 21 nt, Human
ggcgaucgcggcggagcuggc

SEQ ID NO: 1878754 - RNA, 21 nt, Human
ggcgucuguucccccuucaca

SEQ ID NO: 1878755 - RNA, 16 nt, Human
ggccuucggccuccau

SEQ ID NO: 1878756 - RNA, 22 nt, Human
ggccuucggccuccauccugag

SEQ ID NO: 1878757 - RNA, 18 nt, Human
ggccuucggccuccaucc

SEQ ID NO: 1878758 - RNA, 20 nt, Human
ggcuaagugauccucccacc

SEQ ID NO: 1878759 - RNA, 16 nt, Human
ggcuaauguacugcau

SEQ ID NO: 1878760 - RNA, 13 nt, Human
ggcuaauuuuugu

SEQ ID NO: 1878761 - RNA, 13 nt, Human
ggcuaccuuugua

SEQ ID NO: 1878762 - RNA, 14 nt, Human
ggcuaccuuuguau

SEQ ID NO: 1878763 - RNA, 16 nt, Human
ggcuagagguucaaag

SEQ ID NO: 1878764 - RNA, 18 nt, Human
ggcacaccgggcacucag

SEQ ID NO: 1878765 - RNA, 18 nt, Human
ggcacaucagcacgauuu

SEQ ID NO: 1878766 - RNA, 19 nt, Human
ggcacacgccucccacugg

SEQ ID NO: 1878767 - RNA, 12 nt, Human
ggcacacgccuc

SEQ ID NO: 1878768 - RNA, 15 nt, Human
ggcacacgccuccca

SEQ ID NO: 1878769 - RNA, 17 nt, Human
ggcacacgccucccacu

SEQ ID NO: 1878770 - RNA, 18 nt, Human
ggcacacgccucccacug

SEQ ID NO: 1878771 - RNA, 16 nt, Human
ggcacugcuuccagug

SEQ ID NO: 1878772 - RNA, 10 nt, Human
ggcaaaauaa

SEQ ID NO: 1878773 - RNA, 23 nt, Human
ggcaaaaggaucuuuguggccaa

SEQ ID NO: 1878774 - RNA, 20 nt, Human
ggauuucaugauuucauuuc

SEQ ID NO: 1878775 - RNA, 23 nt, Human
ggauuuccugcuuugggaagccg

SEQ ID NO: 1878776 - RNA, 16 nt, Human
ggauuuuugucuugug

SEQ ID NO: 1878777 - RNA, 14 nt, Human
ggauuuuugucuug

SEQ ID NO: 1878778 - RNA, 15 nt, Human
ggcaaaaaggcagga

SEQ ID NO: 1878779 - RNA, 22 nt, Human
ggcagccuggcucccaggacac

SEQ ID NO: 1878780 - RNA, 14 nt, Human
ggcagcgccaggcu

SEQ ID NO: 1878781 - RNA, 19 nt, Human
ggcagccuggcucccagga

SEQ ID NO: 1878782 - RNA, 18 nt, Human
ggcagccuggcucccagg

SEQ ID NO: 1878783 - RNA, 14 nt, Human
ggcagccuggcucc

SEQ ID NO: 1878784 - RNA, 21 nt, Human
ggcagccuggcucccaggaca

SEQ ID NO: 1878785 - RNA, 20 nt, Human
ggcagccuggcucccaggac

SEQ ID NO: 1878786 - RNA, 18 nt, Human
ggcaggaggaucacuuga

SEQ ID NO: 1878787 - RNA, 21 nt, Human
ggcagcgccaggcugaccaca

SEQ ID NO: 1878788 - RNA, 22 nt, Human
ggcagggccgcccgggcccaga

SEQ ID NO: 1878789 - RNA, 18 nt, Human
ggcagggccaacccuucu

SEQ ID NO: 1878790 - RNA, 20 nt, Human
ggcaggggagggucagccag

SEQ ID NO: 1878791 - RNA, 22 nt, Human
ggcaggggagggucagccaggg

SEQ ID NO: 1878792 - RNA, 22 nt, Human
ggcagggagcggccggccagcc

SEQ ID NO: 1878793 - RNA, 21 nt, Human
ggcagccccauucugccugcc

SEQ ID NO: 1878794 - RNA, 20 nt, Human
ggcagccccauucugccugc

SEQ ID NO: 1878795 - RNA, 16 nt, Human
ggcagccccauucugc

SEQ ID NO: 1878796 - RNA, 22 nt, Human
ggcagccccauucugccugccc

SEQ ID NO: 1878797 - RNA, 22 nt, Human
ggcacugcuuccagugaggcuc

SEQ ID NO: 1878798 - RNA, 20 nt, Human
ggcacugcuuccagugaggc

SEQ ID NO: 1878799 - RNA, 14 nt, Human
ggcagccaggccac

SEQ ID NO: 1878800 - RNA, 13 nt, Human
ggcagccaggcca

SEQ ID NO: 1878801 - RNA, 14 nt, Human
ggcauuugcugaau

SEQ ID NO: 1878802 - RNA, 11 nt, Human
ggcauuuccua

SEQ ID NO: 1878803 - RNA, 21 nt, Human
ggccagagagccuggugcugc

SEQ ID NO: 1878804 - RNA, 18 nt, Human
ggccagagagccuggugc

SEQ ID NO: 1878805 - RNA, 22 nt, Human
ggccagagagccuggugcugcu

SEQ ID NO: 1878806 - RNA, 18 nt, Human
ggccagagacacaagccu

SEQ ID NO: 1878807 - RNA, 19 nt, Human
ggccagagggagugacaga

SEQ ID NO: 1878808 - RNA, 17 nt, Human
ggccagagggagugaca

SEQ ID NO: 1878809 - RNA, 17 nt, Human
ggccagagacacaagcc

SEQ ID NO: 1878810 - RNA, 15 nt, Human
ggccagaccugcaga

SEQ ID NO: 1878811 - RNA, 18 nt, Human
ggccagaccugcagacgc

SEQ ID NO: 1878812 - RNA, 22 nt, Human
ggccagaccugcagacgcccag

SEQ ID NO: 1878813 - RNA, 13 nt, Human
ggccaaggagcug

SEQ ID NO: 1878814 - RNA, 18 nt, Human
ggccagacaugccacaag

SEQ ID NO: 1878815 - RNA, 17 nt, Human
ggcauuuguuugaacug

SEQ ID NO: 1878816 - RNA, 14 nt, Human
ggccaaaggaagca

SEQ ID NO: 1878817 - RNA, 16 nt, Human
ggccaaaggaagcaca

SEQ ID NO: 1878818 - RNA, 19 nt, Human
ggccaaaggaagcacaugc

SEQ ID NO: 1878819 - RNA, 22 nt, Human
ggaggugggauccuccaggugc

SEQ ID NO: 1878820 - RNA, 23 nt, Human
ggaggugggauccuccaggugca

SEQ ID NO: 1878821 - RNA, 22 nt, Human
ggagguaaggaauaccuguccc

SEQ ID NO: 1878822 - RNA, 21 nt, Human
ggagggugacgggggugaacu

SEQ ID NO: 1878823 - RNA, 15 nt, Human
ggaggcucuggagcc

SEQ ID NO: 1878824 - RNA, 15 nt, Human
ggaggcucagguccc

SEQ ID NO: 1878825 - RNA, 20 nt, Human
ggaggcuaaagcccagagac

SEQ ID NO: 1878826 - RNA, 13 nt, Human
ggaggggggaggu

SEQ ID NO: 1878827 - RNA, 14 nt, Human
ggaggggggaggug

SEQ ID NO: 1878828 - RNA, 15 nt, Human
ggaguggccacagaa

SEQ ID NO: 1878829 - RNA, 16 nt, Human
ggaguggccacagaaa

SEQ ID NO: 1878830 - RNA, 12 nt, Human
ggagugggccca

SEQ ID NO: 1878831 - RNA, 22 nt, Human
ggagugggcccaaugcacuuug

SEQ ID NO: 1878832 - RNA, 22 nt, Human
ggaguggggaagugaucuuuug

SEQ ID NO: 1878833 - RNA, 13 nt, Human
ggagugugugucu

SEQ ID NO: 1878834 - RNA, 15 nt, Human
ggaguuaagaccugg

SEQ ID NO: 1878835 - RNA, 16 nt, Human
ggaguuaagaccuggc

SEQ ID NO: 1878836 - RNA, 18 nt, Human
ggaguuaagaccuggcag

SEQ ID NO: 1878837 - RNA, 23 nt, Human
ggaguuaagaccuggcagcucug

SEQ ID NO: 1878838 - RNA, 12 nt, Human
ggaguuaucuaa

SEQ ID NO: 1878839 - RNA, 11 nt, Human
ggaguguguaa

SEQ ID NO: 1878840 - RNA, 22 nt, Human
ggaguguguaauuuaaaauugu

SEQ ID NO: 1878841 - RNA, 15 nt, Human
ggaguguacucccag

SEQ ID NO: 1878842 - RNA, 18 nt, Human
ggaguguacucccagggc

SEQ ID NO: 1878843 - RNA, 19 nt, Human
ggaguguacucccagggcu

SEQ ID NO: 1878844 - RNA, 18 nt, Human
ggaucucuugagccuggg

SEQ ID NO: 1878845 - RNA, 21 nt, Human
ggaucuuuggacagaagcagc

SEQ ID NO: 1878846 - RNA, 18 nt, Human
ggaucuauacuugcuuug

SEQ ID NO: 1878847 - RNA, 16 nt, Human
ggaguucaucuugaau

SEQ ID NO: 1878848 - RNA, 15 nt, Human
ggauccugagccaga

SEQ ID NO: 1878849 - RNA, 16 nt, Human
ggauccugagccagau

SEQ ID NO: 1878850 - RNA, 18 nt, Human
ggauccugagccagauuu

SEQ ID NO: 1878851 - RNA, 19 nt, Human
ggauccugagccagauuuc

SEQ ID NO: 1878852 - RNA, 20 nt, Human
ggauccugagccagauuuca

SEQ ID NO: 1878853 - RNA, 23 nt, Human
ggauccugagccagauuucacuc

SEQ ID NO: 1878854 - RNA, 12 nt, Human
ggauuuaacaga

SEQ ID NO: 1878855 - RNA, 15 nt, Human
ggaugguguucaaaa

SEQ ID NO: 1878856 - RNA, 16 nt, Human
ggauuguccccgaccc

SEQ ID NO: 1878857 - RNA, 20 nt, Human
ggauuguccccgacccuugc

SEQ ID NO: 1878858 - RNA, 17 nt, Human
ggauuuaacagaaaugu

SEQ ID NO: 1878859 - RNA, 16 nt, Human
ggauuuaacagaaaug

SEQ ID NO: 1878860 - RNA, 22 nt, Human
ggauuuaacagaaauguacagc

SEQ ID NO: 1878861 - RNA, 14 nt, Human
ggauuguaguccca

SEQ ID NO: 1878862 - RNA, 13 nt, Human
ggauuguccccga

SEQ ID NO: 1878863 - RNA, 22 nt, Human
ggaucuuuggacagaagcagcu

SEQ ID NO: 1878864 - RNA, 15 nt, Human
ggaucuuuguggcca

SEQ ID NO: 1878865 - RNA, 14 nt, Human
ggaugaaaaaauaa

SEQ ID NO: 1878866 - RNA, 15 nt, Human
ggaugggggaacuca

SEQ ID NO: 1878867 - RNA, 17 nt, Human
ggaugggggaacucaga

SEQ ID NO: 1878868 - RNA, 16 nt, Human
ggaucuuuguggccaa

SEQ ID NO: 1878869 - RNA, 17 nt, Human
ggaucuuuguggccaag

SEQ ID NO: 1878870 - RNA, 21 nt, Human
ggaugggggaacucagaucca

SEQ ID NO: 1878871 - RNA, 22 nt, Human
ggaugggggaacucagauccag

SEQ ID NO: 1878872 - RNA, 23 nt, Human
ggaugggggaacucagauccagg

SEQ ID NO: 1878873 - RNA, 20 nt, Human
gggccgccagggagaccugg

SEQ ID NO: 1878874 - RNA, 17 nt, Human
gggccauguugugccuc

SEQ ID NO: 1878875 - RNA, 16 nt, Human
gggccauucuccacag

SEQ ID NO: 1878876 - RNA, 18 nt, Human
gggccauucuccacagca

SEQ ID NO: 1878877 - RNA, 20 nt, Human
gggccgcccgggcccagagg

SEQ ID NO: 1878878 - RNA, 23 nt, Human
gggccgccagggagaccuggaca

SEQ ID NO: 1878879 - RNA, 13 nt, Human
gggccgcugccac

SEQ ID NO: 1878880 - RNA, 14 nt, Human
gggccgcugccacc

SEQ ID NO: 1878881 - RNA, 15 nt, Human
gggccgcugccaccc

SEQ ID NO: 1878882 - RNA, 21 nt, Human
gggccgcugccacccaccucc

SEQ ID NO: 1878883 - RNA, 17 nt, Human
gggccgggcagaggggc

SEQ ID NO: 1878884 - RNA, 12 nt, Human
gggccaggagcc

SEQ ID NO: 1878885 - RNA, 13 nt, Human
gggccagauccag

SEQ ID NO: 1878886 - RNA, 14 nt, Human
gggccagauccagc

SEQ ID NO: 1878887 - RNA, 16 nt, Human
gggccagauccagccu

SEQ ID NO: 1878888 - RNA, 17 nt, Human
gggccagauccagccug

SEQ ID NO: 1878889 - RNA, 15 nt, Human
gggccagagccaggg

SEQ ID NO: 1878890 - RNA, 11 nt, Human
gggccagagcc

SEQ ID NO: 1878891 - RNA, 12 nt, Human
gggccagagcca

SEQ ID NO: 1878892 - RNA, 13 nt, Human
gggccagagccag

SEQ ID NO: 1878893 - RNA, 14 nt, Human
gggccagagccagg

SEQ ID NO: 1878894 - RNA, 13 nt, Human
gggccaggagccu

SEQ ID NO: 1878895 - RNA, 14 nt, Human
gggccaggagccuc

SEQ ID NO: 1878896 - RNA, 18 nt, Human
gggccagauccagccugg

SEQ ID NO: 1878897 - RNA, 15 nt, Human
gggcgugguggugag

SEQ ID NO: 1878898 - RNA, 17 nt, Human
gggcgucuguucccccu

SEQ ID NO: 1878899 - RNA, 21 nt, Human
gggcggugagaggggaacaga

SEQ ID NO: 1878900 - RNA, 16 nt, Human
gggccugcgagggcag

SEQ ID NO: 1878901 - RNA, 13 nt, Human
gggccugcuccag

SEQ ID NO: 1878902 - RNA, 14 nt, Human
gggccugcuccaga

SEQ ID NO: 1878903 - RNA, 15 nt, Human
gggccugcuccagac

SEQ ID NO: 1878904 - RNA, 17 nt, Human
gggccugcuccagaccu

SEQ ID NO: 1878905 - RNA, 18 nt, Human
gggccugcuccagaccug

SEQ ID NO: 1878906 - RNA, 18 nt, Human
gggccucuuaugggcugg

SEQ ID NO: 1878907 - RNA, 22 nt, Human
gggccucgguguggagaagcgg

SEQ ID NO: 1878908 - RNA, 14 nt, Human
gggccucagugcca

SEQ ID NO: 1878909 - RNA, 13 nt, Human
gggccucagugcc

SEQ ID NO: 1878910 - RNA, 15 nt, Human
gggccucagugccac

SEQ ID NO: 1878911 - RNA, 17 nt, Human
gggcuggguucuaccca

SEQ ID NO: 1878912 - RNA, 18 nt, Human
aaaaugguuuaaaugguc

SEQ ID NO: 1878913 - RNA, 16 nt, Human
aaaaugguuuaaaugg

SEQ ID NO: 1878914 - RNA, 23 nt, Human
aaaauggcuucagaauuaaaacu

SEQ ID NO: 1878915 - RNA, 20 nt, Human
gggcugcaccggcuggccug

SEQ ID NO: 1878916 - RNA, 21 nt, Human
gggcugcaccggcuggccugg

SEQ ID NO: 1878917 - RNA, 15 nt, Human
gggcugggcagagga

SEQ ID NO: 1878918 - RNA, 19 nt, Human
gggcucagcggggacagcu

SEQ ID NO: 1878919 - RNA, 17 nt, Human
gggcucagcggggacag

SEQ ID NO: 1878920 - RNA, 18 nt, Human
gggcuaguugggcuuccu

SEQ ID NO: 1878921 - RNA, 22 nt, Human
gggcucagcaaaagaugcuucu

SEQ ID NO: 1878922 - RNA, 15 nt, Human
gggcuaguugggcuu

SEQ ID NO: 1878923 - RNA, 21 nt, Human
gggcucagcggggacagcucc

SEQ ID NO: 1878924 - RNA, 10 nt, Human
gggcuccaga

SEQ ID NO: 1878925 - RNA, 13 nt, Human
gggcuccagacac

SEQ ID NO: 1878926 - RNA, 17 nt, Human
gggcugcaccggcuggc

SEQ ID NO: 1878927 - RNA, 19 nt, Human
gggcugcaccggcuggccu

SEQ ID NO: 1878928 - RNA, 16 nt, Human
aaaauaucauucagca

SEQ ID NO: 1878929 - RNA, 14 nt, Human
aaaauaucauucag

SEQ ID NO: 1878930 - RNA, 13 nt, Human
aaaauaucauuca

SEQ ID NO: 1878931 - RNA, 13 nt, Human
aaaauagacacuc

SEQ ID NO: 1878932 - RNA, 16 nt, Human
aaaauauuuuccugcc

SEQ ID NO: 1878933 - RNA, 13 nt, Human
aaaauauuuauaa

SEQ ID NO: 1878934 - RNA, 21 nt, Human
aaaauauuuauaaaacuucuc

SEQ ID NO: 1878935 - RNA, 14 nt, Human
aaaauauuuaaagg

SEQ ID NO: 1878936 - RNA, 16 nt, Human
aaaauggaaccaggcu

SEQ ID NO: 1878937 - RNA, 22 nt, Human
aaaaugcuuuuuauuucugcau

SEQ ID NO: 1878938 - RNA, 20 nt, Human
aaaauggaagacagcucuua

SEQ ID NO: 1878939 - RNA, 22 nt, Human
gggccacuucuggguggggcag

SEQ ID NO: 1878940 - RNA, 16 nt, Human
gggccagacaugccac

SEQ ID NO: 1878941 - RNA, 13 nt, Human
aaaaugcuuuuua

SEQ ID NO: 1878942 - RNA, 18 nt, Human
aaaaugcuuuuuauuucu

SEQ ID NO: 1878943 - RNA, 19 nt, Human
aaaaugcuuuuuauuucug

SEQ ID NO: 1878944 - RNA, 23 nt, Human
aaaaugauguguacccaaacgug

SEQ ID NO: 1878945 - RNA, 18 nt, Human
aaaaugcagcagggaugc

SEQ ID NO: 1878946 - RNA, 18 nt, Human
aaaaugcaacaacaugua

SEQ ID NO: 1878947 - RNA, 11 nt, Human
aaaaugagaaa

SEQ ID NO: 1878948 - RNA, 12 nt, Human
aaaaugagaaau

SEQ ID NO: 1878949 - RNA, 19 nt, Human
aaaauauuuugaucuucaa

SEQ ID NO: 1878950 - RNA, 15 nt, Human
aaaaucugcuaggga

SEQ ID NO: 1878951 - RNA, 15 nt, Human
aaaauauuuugaucu

SEQ ID NO: 1878952 - RNA, 17 nt, Human
aaaauauuuugaucuuc

SEQ ID NO: 1878953 - RNA, 13 nt, Human
aaaauaccaagga

SEQ ID NO: 1878954 - RNA, 19 nt, Human
aaaauaaccggauauauac

SEQ ID NO: 1878955 - RNA, 16 nt, Human
aaaauaagaauagaaa

SEQ ID NO: 1878956 - RNA, 11 nt, Human
aaaaggcagga

SEQ ID NO: 1878957 - RNA, 19 nt, Human
aaaaggaucuuuguggcca

SEQ ID NO: 1878958 - RNA, 20 nt, Human
aaaaggaucuuuguggccaa

SEQ ID NO: 1878959 - RNA, 23 nt, Human
aaaaggaucuuuguggccaagga

SEQ ID NO: 1878960 - RNA, 17 nt, Human
aaaagguuaauaaagua

SEQ ID NO: 1878961 - RNA, 16 nt, Human
aaaagguuaauaaagu

SEQ ID NO: 1878962 - RNA, 22 nt, Human
aaaaggagccaauuuaaagaaa

SEQ ID NO: 1878963 - RNA, 13 nt, Human
aaaaggaugcaca

SEQ ID NO: 1878964 - RNA, 22 nt, Human
aaaaggaugcacagaguuguua

SEQ ID NO: 1878965 - RNA, 19 nt, Human
aaaaggaugcacagaguug

SEQ ID NO: 1878966 - RNA, 15 nt, Human
aaaaggaugcacaga

SEQ ID NO: 1878967 - RNA, 14 nt, Human
aaaaggaugcacag

SEQ ID NO: 1878968 - RNA, 13 nt, Human
ggguccagaagga

SEQ ID NO: 1878969 - RNA, 17 nt, Human
ggguccagaaggagaca

SEQ ID NO: 1878970 - RNA, 21 nt, Human
gggucaugcccuccucuccca

SEQ ID NO: 1878971 - RNA, 13 nt, Human
ggguccuggccau

SEQ ID NO: 1878972 - RNA, 15 nt, Human
ggguccuggccaucc

SEQ ID NO: 1878973 - RNA, 16 nt, Human
ggguccuggccauccc

SEQ ID NO: 1878974 - RNA, 17 nt, Human
ggguccuggccauccca

SEQ ID NO: 1878975 - RNA, 19 nt, Human
aaacauuuugucauauaag

SEQ ID NO: 1878976 - RNA, 13 nt, Human
aaacauuuucaca

SEQ ID NO: 1878977 - RNA, 14 nt, Human
aaacauuuucacac

SEQ ID NO: 1878978 - RNA, 16 nt, Human
aaacauuuucacacaa

SEQ ID NO: 1878979 - RNA, 22 nt, Human
aaacauuuucacacaauacaau

SEQ ID NO: 1878980 - RNA, 22 nt, Human
gggucacucuggcagcucagag

SEQ ID NO: 1878981 - RNA, 12 nt, Human
gggucaaggaau

SEQ ID NO: 1878982 - RNA, 18 nt, Human
gggucauagauguuuccu

SEQ ID NO: 1878983 - RNA, 14 nt, Human
gggucaugcccucc

SEQ ID NO: 1878984 - RNA, 16 nt, Human
gggucaugcccuccuc

SEQ ID NO: 1878985 - RNA, 18 nt, Human
gggucauucauggccugg

SEQ ID NO: 1878986 - RNA, 21 nt, Human
gggucaucuguaccucugccu

SEQ ID NO: 1878987 - RNA, 14 nt, Human
gggucacucuggca

SEQ ID NO: 1878988 - RNA, 20 nt, Human
gggucacucuggcagcucag

SEQ ID NO: 1878989 - RNA, 11 nt, Human
gggguccuggc

SEQ ID NO: 1878990 - RNA, 13 nt, Human
gggguccuggcca

SEQ ID NO: 1878991 - RNA, 14 nt, Human
gggguccuggccau

SEQ ID NO: 1878992 - RNA, 18 nt, Human
aaaccuuauuguaccucu

SEQ ID NO: 1878993 - RNA, 16 nt, Human
aaaccuuauuguaccu

SEQ ID NO: 1878994 - RNA, 17 nt, Human
aaaccuuauuguaccuc

SEQ ID NO: 1878995 - RNA, 22 nt, Human
aaaccugugucucugagaguag

SEQ ID NO: 1878996 - RNA, 20 nt, Human
aaaccuucacacacagacug

SEQ ID NO: 1878997 - RNA, 11 nt, Human
aaaccuucaca

SEQ ID NO: 1878998 - RNA, 18 nt, Human
aaacgaagccaucuuucu

SEQ ID NO: 1878999 - RNA, 19 nt, Human
aaacgaagccaucuuucuu

SEQ ID NO: 1879000 - RNA, 18 nt, Human
aaaccugggauucaggaa

SEQ ID NO: 1879001 - RNA, 21 nt, Human
aaaccugggauucaggaaugu

SEQ ID NO: 1879002 - RNA, 15 nt, Human
aaaccagaggcagcu

SEQ ID NO: 1879003 - RNA, 19 nt, Human
aaaccaccagaagcccaga

SEQ ID NO: 1879004 - RNA, 15 nt, Human
aaaccaaaaacugaa

SEQ ID NO: 1879005 - RNA, 18 nt, Human
aaaccaccagaagcccag

SEQ ID NO: 1879006 - RNA, 15 nt, Human
aaaccaccagaagcc

SEQ ID NO: 1879007 - RNA, 14 nt, Human
ggggaccagagcug

SEQ ID NO: 1879008 - RNA, 17 nt, Human
ggggcccaugaaagagg

SEQ ID NO: 1879009 - RNA, 18 nt, Human
aaaauguauguguaagua

SEQ ID NO: 1879010 - RNA, 19 nt, Human
aaaauguaaaggagucaaa

SEQ ID NO: 1879011 - RNA, 12 nt, Human
ggggaccagagc

SEQ ID NO: 1879012 - RNA, 13 nt, Human
ggggaccagagcu

SEQ ID NO: 1879013 - RNA, 21 nt, Human
ggggucacucuggcagcucag

SEQ ID NO: 1879014 - RNA, 17 nt, Human
gggguccagggagcagg

SEQ ID NO: 1879015 - RNA, 18 nt, Human
ggggucaugcccuccucu

SEQ ID NO: 1879016 - RNA, 19 nt, Human
ggggucaugcccuccucuc

SEQ ID NO: 1879017 - RNA, 21 nt, Human
ggggucaugcccuccucuccc

SEQ ID NO: 1879018 - RNA, 13 nt, Human
ggggguggccucc

SEQ ID NO: 1879019 - RNA, 15 nt, Human
gggggcugggcagag

SEQ ID NO: 1879020 - RNA, 22 nt, Human
gggggcuucauacacaugagau

SEQ ID NO: 1879021 - RNA, 11 nt, Human
gggggcuggga

SEQ ID NO: 1879022 - RNA, 17 nt, Human
gggggaucacagccucu

SEQ ID NO: 1879023 - RNA, 13 nt, Human
ggggcccggccag

SEQ ID NO: 1879024 - RNA, 15 nt, Human
ggggcccggccagcc

SEQ ID NO: 1879025 - RNA, 15 nt, Human
ggggcccugccuccu

SEQ ID NO: 1879026 - RNA, 21 nt, Human
gguccagaaggagacaggcag

SEQ ID NO: 1879027 - RNA, 22 nt, Human
ggucauacuaucuacucuccuc

SEQ ID NO: 1879028 - RNA, 16 nt, Human
ggucauagcagugcuu

SEQ ID NO: 1879029 - RNA, 21 nt, Human
ggucauacuaucuacucuccu

SEQ ID NO: 1879030 - RNA, 14 nt, Human
ggucagugcaaaua

SEQ ID NO: 1879031 - RNA, 19 nt, Human
gguaucaggugcugccauc

SEQ ID NO: 1879032 - RNA, 22 nt, Human
aaacuugauguguuaucucuua

SEQ ID NO: 1879033 - RNA, 17 nt, Human
aaacuuccccaucuucu

SEQ ID NO: 1879034 - RNA, 19 nt, Human
gguccaggauuccucuuuu

SEQ ID NO: 1879035 - RNA, 23 nt, Human
aaacuuccagugcaacacugaag

SEQ ID NO: 1879036 - RNA, 14 nt, Human
gguaucaggugcug

SEQ ID NO: 1879037 - RNA, 13 nt, Human
gguauagaaaugc

SEQ ID NO: 1879038 - RNA, 20 nt, Human
gguaggguaagugagagagg

SEQ ID NO: 1879039 - RNA, 20 nt, Human
gguaaggaauaccugucccc

SEQ ID NO: 1879040 - RNA, 18 nt, Human
gguaggaacugcugggcu

SEQ ID NO: 1879041 - RNA, 13 nt, Human
gguaaaauacuuc

SEQ ID NO: 1879042 - RNA, 13 nt, Human
gguaacaggcaga

SEQ ID NO: 1879043 - RNA, 22 nt, Human
gguaaaucagacuaugaaguuu

SEQ ID NO: 1879044 - RNA, 18 nt, Human
ggguuuuccaaugugacu

SEQ ID NO: 1879045 - RNA, 20 nt, Human
ggguuuugccauguuggcca

SEQ ID NO: 1879046 - RNA, 23 nt, Human
ggguuuugccauguuggccaggc

SEQ ID NO: 1879047 - RNA, 19 nt, Human
gggugggacacccugugau

SEQ ID NO: 1879048 - RNA, 14 nt, Human
aaacuuaaucuaaa

SEQ ID NO: 1879049 - RNA, 19 nt, Human
aaacuuaaucuaaauggaa

SEQ ID NO: 1879050 - RNA, 15 nt, Human
gggugggacacccug

SEQ ID NO: 1879051 - RNA, 18 nt, Human
gggugggacacccuguga

SEQ ID NO: 1879052 - RNA, 21 nt, Human
aaacguggcugcuucaaggau

SEQ ID NO: 1879053 - RNA, 13 nt, Human
aaacgcagacacu

SEQ ID NO: 1879054 - RNA, 14 nt, Human
aaacuaaaaauaau

SEQ ID NO: 1879055 - RNA, 21 nt, Human
aaacuguucccaccugcugga

SEQ ID NO: 1879056 - RNA, 20 nt, Human
aaacuguucccaccugcugg

SEQ ID NO: 1879057 - RNA, 14 nt, Human
guaaucaauguuuc

SEQ ID NO: 1879058 - RNA, 16 nt, Human
guaaucccagcuacuu

SEQ ID NO: 1879059 - RNA, 20 nt, Human
guaaucccagcuacuuggga

SEQ ID NO: 1879060 - RNA, 23 nt, Human
guaauccuagcacuuugggaggc

SEQ ID NO: 1879061 - RNA, 22 nt, Human
guaauccucaagaaauaaaagg

SEQ ID NO: 1879062 - RNA, 20 nt, Human
guaauuugugauacaaugcu

SEQ ID NO: 1879063 - RNA, 17 nt, Human
guaauuugugauacaau

SEQ ID NO: 1879064 - RNA, 15 nt, Human
guaauuugugauaca

SEQ ID NO: 1879065 - RNA, 21 nt, Human
guaauuuuuuuaucgucacug

SEQ ID NO: 1879066 - RNA, 21 nt, Human
guaacccuggugguugcuguu

SEQ ID NO: 1879067 - RNA, 23 nt, Human
guaacccagauuuugcuguauau

SEQ ID NO: 1879068 - RNA, 14 nt, Human
guaacccugguggu

SEQ ID NO: 1879069 - RNA, 14 nt, Human
aaauaaugugaaac

SEQ ID NO: 1879070 - RNA, 22 nt, Human
aaauaaugugaaacuggauuaa

SEQ ID NO: 1879071 - RNA, 22 nt, Human
aaaguguauuuuuuuacuaaua

SEQ ID NO: 1879072 - RNA, 13 nt, Human
guaaaccuuuuau

SEQ ID NO: 1879073 - RNA, 16 nt, Human
guaaacgcugucccua

SEQ ID NO: 1879074 - RNA, 20 nt, Human
guaaacgcugucccuaguaa

SEQ ID NO: 1879075 - RNA, 20 nt, Human
guaacaggaaaauuuuaaaa

SEQ ID NO: 1879076 - RNA, 16 nt, Human
guaacaagccacccca

SEQ ID NO: 1879077 - RNA, 19 nt, Human
guaacaggaaaauuuuaaa

SEQ ID NO: 1879078 - RNA, 15 nt, Human
guaaagcuagaaaug

SEQ ID NO: 1879079 - RNA, 16 nt, Human
guaaagcuagaaauga

SEQ ID NO: 1879080 - RNA, 13 nt, Human
guaacaaaugaac

SEQ ID NO: 1879081 - RNA, 16 nt, Human
guaaauuuggcuucug

SEQ ID NO: 1879082 - RNA, 13 nt, Human
guaaauuuggcuu

SEQ ID NO: 1879083 - RNA, 15 nt, Human
guaaauuuggcuucu

SEQ ID NO: 1879084 - RNA, 14 nt, Human
guaaaguccccaga

SEQ ID NO: 1879085 - RNA, 15 nt, Human
aaauaucauucagca

SEQ ID NO: 1879086 - RNA, 14 nt, Human
aaauaucauucagc

SEQ ID NO: 1879087 - RNA, 13 nt, Human
aaauaucauucag

SEQ ID NO: 1879088 - RNA, 16 nt, Human
aaauaucauucagcaa

SEQ ID NO: 1879089 - RNA, 17 nt, Human
aaauaucauucagcaac

SEQ ID NO: 1879090 - RNA, 22 nt, Human
aaauauauuuaagauaauuaua

SEQ ID NO: 1879091 - RNA, 16 nt, Human
aaauauauuuuaagac

SEQ ID NO: 1879092 - RNA, 22 nt, Human
aaauauauuuuaagacgaaaca

SEQ ID NO: 1879093 - RNA, 12 nt, Human
aaauauauuuaa

SEQ ID NO: 1879094 - RNA, 21 nt, Human
aaauauauuuaagauaauuau

SEQ ID NO: 1879095 - RNA, 20 nt, Human
aaauauauuuaagauaauua

SEQ ID NO: 1879096 - RNA, 18 nt, Human
aaauauaugcuaagucuu

SEQ ID NO: 1879097 - RNA, 14 nt, Human
aaauauauaucaaa

SEQ ID NO: 1879098 - RNA, 16 nt, Human
guacacacacauacac

SEQ ID NO: 1879099 - RNA, 19 nt, Human
aaauaccagccaguaaaug

SEQ ID NO: 1879100 - RNA, 21 nt, Human
aaauaccagccaguaaauggg

SEQ ID NO: 1879101 - RNA, 20 nt, Human
aaauaccagccaguaaaugg

SEQ ID NO: 1879102 - RNA, 15 nt, Human
aaauauaggaacuua

SEQ ID NO: 1879103 - RNA, 21 nt, Human
aaauacgugggcauucaaaug

SEQ ID NO: 1879104 - RNA, 20 nt, Human
aaauacgugggcauucaaau

SEQ ID NO: 1879105 - RNA, 19 nt, Human
aaauauuaagaaagacuau

SEQ ID NO: 1879106 - RNA, 12 nt, Human
aaauauugucuu

SEQ ID NO: 1879107 - RNA, 17 nt, Human
aaauauugucuuuuugu

SEQ ID NO: 1879108 - RNA, 20 nt, Human
aaauauugucuuuuuguaug

SEQ ID NO: 1879109 - RNA, 19 nt, Human
aaaucagccugcuccagcu

SEQ ID NO: 1879110 - RNA, 21 nt, Human
aaaucagccugcuccagcugu

SEQ ID NO: 1879111 - RNA, 23 nt, Human
aaaucagccugcuccagcuguuc

SEQ ID NO: 1879112 - RNA, 15 nt, Human
aaauauggacacuua

SEQ ID NO: 1879113 - RNA, 16 nt, Human
aaauauggacacuuaa

SEQ ID NO: 1879114 - RNA, 20 nt, Human
aaauauggacacuuaauacu

SEQ ID NO: 1879115 - RNA, 13 nt, Human
aaauauggaacuu

SEQ ID NO: 1879116 - RNA, 16 nt, Human
aaauauggaacuuaca

SEQ ID NO: 1879117 - RNA, 17 nt, Human
aaauauggaacuuacau

SEQ ID NO: 1879118 - RNA, 18 nt, Human
aaauauggaacuuacauu

SEQ ID NO: 1879119 - RNA, 21 nt, Human
aaauauggaacuuacauuguu

SEQ ID NO: 1879120 - RNA, 12 nt, Human
aaauaucugaaa

SEQ ID NO: 1879121 - RNA, 14 nt, Human
aaauaucugaaaau

SEQ ID NO: 1879122 - RNA, 17 nt, Human
aaauaucugaaaaugua

SEQ ID NO: 1879123 - RNA, 18 nt, Human
aaauaucugaaaauguau

SEQ ID NO: 1879124 - RNA, 19 nt, Human
aaauaucugaaaauguaug

SEQ ID NO: 1879125 - RNA, 21 nt, Human
aaauaucugaaaauguaugug

SEQ ID NO: 1879126 - RNA, 22 nt, Human
aaauaucugaaaauguaugugu

SEQ ID NO: 1879127 - RNA, 23 nt, Human
aaauaucugaaaauguaugugua

SEQ ID NO: 1879128 - RNA, 23 nt, Human
aaauaucugagcucuuugcacua

SEQ ID NO: 1879129 - RNA, 15 nt, Human
aaagcagcguuucua

SEQ ID NO: 1879130 - RNA, 12 nt, Human
aaagcagccacg

SEQ ID NO: 1879131 - RNA, 15 nt, Human
aaagcagccacgagg

SEQ ID NO: 1879132 - RNA, 16 nt, Human
aaagcuaggccuggcc

SEQ ID NO: 1879133 - RNA, 14 nt, Human
aaagcuaggccugg

SEQ ID NO: 1879134 - RNA, 13 nt, Human
aaagcagugcaug

SEQ ID NO: 1879135 - RNA, 14 nt, Human
aaagcuagaaauga

SEQ ID NO: 1879136 - RNA, 16 nt, Human
aaagcagugcaugcug

SEQ ID NO: 1879137 - RNA, 17 nt, Human
aaagcuaggccuggcca

SEQ ID NO: 1879138 - RNA, 12 nt, Human
aaagcugccagc

SEQ ID NO: 1879139 - RNA, 13 nt, Human
aaagcugccagcc

SEQ ID NO: 1879140 - RNA, 22 nt, Human
aaagcugccagccgagauagcc

SEQ ID NO: 1879141 - RNA, 17 nt, Human
aaagcuguauuuugaaa

SEQ ID NO: 1879142 - RNA, 15 nt, Human
aaagcuguauuuuga

SEQ ID NO: 1879143 - RNA, 14 nt, Human
aaagcuguguggca

SEQ ID NO: 1879144 - RNA, 23 nt, Human
aaagcuguggccagcuuguuauu

SEQ ID NO: 1879145 - RNA, 14 nt, Human
gguggcaccagcag

SEQ ID NO: 1879146 - RNA, 20 nt, Human
gguggcaccagcagccugga

SEQ ID NO: 1879147 - RNA, 16 nt, Human
aaagcagaacagugau

SEQ ID NO: 1879148 - RNA, 19 nt, Human
aaacuuuaugcuaagugaa

SEQ ID NO: 1879149 - RNA, 12 nt, Human
aaacuuuaugcu

SEQ ID NO: 1879150 - RNA, 20 nt, Human
aaagggcccagagagggugg

SEQ ID NO: 1879151 - RNA, 18 nt, Human
aaagguucaugcaaacuu

SEQ ID NO: 1879152 - RNA, 14 nt, Human
aaagguguuguccc

SEQ ID NO: 1879153 - RNA, 18 nt, Human
aaagguguugucccuucu

SEQ ID NO: 1879154 - RNA, 19 nt, Human
aaagguuguuuugaaacug

SEQ ID NO: 1879155 - RNA, 14 nt, Human
aaaggugauaucca

SEQ ID NO: 1879156 - RNA, 12 nt, Human
gguggcuggguu

SEQ ID NO: 1879157 - RNA, 18 nt, Human
gguggcuggguuggaggg

SEQ ID NO: 1879158 - RNA, 21 nt, Human
aaaguaaaaacaaagaaauua

SEQ ID NO: 1879159 - RNA, 13 nt, Human
aaagguuuugagc

SEQ ID NO: 1879160 - RNA, 19 nt, Human
gguggggaccucaggccug

SEQ ID NO: 1879161 - RNA, 13 nt, Human
ggugggacacccu

SEQ ID NO: 1879162 - RNA, 16 nt, Human
ggugggacacccugug

SEQ ID NO: 1879163 - RNA, 17 nt, Human
ggugggacacccuguga

SEQ ID NO: 1879164 - RNA, 20 nt, Human
ggugggaggaucucuugagc

SEQ ID NO: 1879165 - RNA, 22 nt, Human
gguucccuuuuuuggcugcuga

SEQ ID NO: 1879166 - RNA, 23 nt, Human
gguucccuuugacgccaucccag

SEQ ID NO: 1879167 - RNA, 16 nt, Human
gguucccaagcucaga

SEQ ID NO: 1879168 - RNA, 20 nt, Human
gguucggauuugggguggau

SEQ ID NO: 1879169 - RNA, 17 nt, Human
gguucccauuugcuccu

SEQ ID NO: 1879170 - RNA, 13 nt, Human
gguucccaagcuc

SEQ ID NO: 1879171 - RNA, 16 nt, Human
gguuccagccugccac

SEQ ID NO: 1879172 - RNA, 15 nt, Human
gguuccagccugcca

SEQ ID NO: 1879173 - RNA, 19 nt, Human
gguguuuccuggcacugcu

SEQ ID NO: 1879174 - RNA, 17 nt, Human
gguguuuccuggcacug

SEQ ID NO: 1879175 - RNA, 11 nt, Human
gguguggggga

SEQ ID NO: 1879176 - RNA, 13 nt, Human
ggugugggggaag

SEQ ID NO: 1879177 - RNA, 15 nt, Human
gguguggugcagugu

SEQ ID NO: 1879178 - RNA, 17 nt, Human
gguguggugcaguguga

SEQ ID NO: 1879179 - RNA, 17 nt, Human
gguguugacaugugcuu

SEQ ID NO: 1879180 - RNA, 13 nt, Human
ggugggggccucg

SEQ ID NO: 1879181 - RNA, 18 nt, Human
gguggggggcuucauaca

SEQ ID NO: 1879182 - RNA, 16 nt, Human
gguggggggcuucaua

SEQ ID NO: 1879183 - RNA, 14 nt, Human
gguguggagaagcg

SEQ ID NO: 1879184 - RNA, 23 nt, Human
gguguggagaagcggcuggcagc

SEQ ID NO: 1879185 - RNA, 12 nt, Human
gguguggagaag

SEQ ID NO: 1879186 - RNA, 20 nt, Human
gguuuguaaauuaacuuuua

SEQ ID NO: 1879187 - RNA, 22 nt, Human
gguuuguuuagaagaagugugu

SEQ ID NO: 1879188 - RNA, 17 nt, Human
gguuuucacauuggaaa

SEQ ID NO: 1879189 - RNA, 22 nt, Human
gguuucuaaagcugccagccga

SEQ ID NO: 1879190 - RNA, 16 nt, Human
gguuucuaaagcugcc

SEQ ID NO: 1879191 - RNA, 15 nt, Human
gguuucagaaaugug

SEQ ID NO: 1879192 - RNA, 21 nt, Human
aaaguaucccuacuguaauuu

SEQ ID NO: 1879193 - RNA, 20 nt, Human
aaaguagaagucuuagaugu

SEQ ID NO: 1879194 - RNA, 22 nt, Human
aaaguagaagucuuagauguau

SEQ ID NO: 1879195 - RNA, 18 nt, Human
aaaguacacuguuucaaa

SEQ ID NO: 1879196 - RNA, 19 nt, Human
aaaguacacuguuucaaac

SEQ ID NO: 1879197 - RNA, 20 nt, Human
aaagugguauagaaaugcug

SEQ ID NO: 1879198 - RNA, 17 nt, Human
aaagugguauagaaaug

SEQ ID NO: 1879199 - RNA, 16 nt, Human
aaagugguauagaaau

SEQ ID NO: 1879200 - RNA, 21 nt, Human
aaaguguauuuuuuuacuaau

SEQ ID NO: 1879201 - RNA, 14 nt, Human
aaaguguauuuuuu

SEQ ID NO: 1879202 - RNA, 21 nt, Human
aaaguauccugcuucugauau

SEQ ID NO: 1879203 - RNA, 17 nt, Human
aaagugggcuugauucu

SEQ ID NO: 1879204 - RNA, 16 nt, Human
auuucagcagcugcag

SEQ ID NO: 1879205 - RNA, 15 nt, Human
auuucagauuuguga

SEQ ID NO: 1879206 - RNA, 23 nt, Human
auuucagacucccauuccugaag

SEQ ID NO: 1879207 - RNA, 18 nt, Human
auuucagacucccauucc

SEQ ID NO: 1879208 - RNA, 14 nt, Human
auuuauacaaauua

SEQ ID NO: 1879209 - RNA, 15 nt, Human
auuuauacuggcaug

SEQ ID NO: 1879210 - RNA, 16 nt, Human
auuuauacuggcaugc

SEQ ID NO: 1879211 - RNA, 17 nt, Human
auuuauacuguauauau

SEQ ID NO: 1879212 - RNA, 14 nt, Human
auuuaaugaaagac

SEQ ID NO: 1879213 - RNA, 18 nt, Human
auuuauacaaauuagaaa

SEQ ID NO: 1879214 - RNA, 16 nt, Human
auuucuguuuagauaa

SEQ ID NO: 1879215 - RNA, 14 nt, Human
auuucuguuuagau

SEQ ID NO: 1879216 - RNA, 12 nt, Human
auuucuguuuag

SEQ ID NO: 1879217 - RNA, 17 nt, Human
auuucaucugcucuccu

SEQ ID NO: 1879218 - RNA, 16 nt, Human
auuucaucugcucucc

SEQ ID NO: 1879219 - RNA, 15 nt, Human
auuucaucugcucuc

SEQ ID NO: 1879220 - RNA, 14 nt, Human
auuucaucugcucu

SEQ ID NO: 1879221 - RNA, 11 nt, Human
auuucaucugc

SEQ ID NO: 1879222 - RNA, 16 nt, Human
auuguaaggaaugauu

SEQ ID NO: 1879223 - RNA, 18 nt, Human
auuguaagcaugcacaaa

SEQ ID NO: 1879224 - RNA, 16 nt, Human
auuguaaauugaauca

SEQ ID NO: 1879225 - RNA, 17 nt, Human
auuguaaauugaaucag

SEQ ID NO: 1879226 - RNA, 23 nt, Human
auuguaaauugaaucaguauaaa

SEQ ID NO: 1879227 - RNA, 15 nt, Human
auuguaaggaaugau

SEQ ID NO: 1879228 - RNA, 18 nt, Human
auugauccagaaagaaaa

SEQ ID NO: 1879229 - RNA, 19 nt, Human
auugauccagaaagaaaac

SEQ ID NO: 1879230 - RNA, 22 nt, Human
auugauccagaaagaaaacuug

SEQ ID NO: 1879231 - RNA, 13 nt, Human
auuguaaaauggu

SEQ ID NO: 1879232 - RNA, 18 nt, Human
auugaugggauuugguca

SEQ ID NO: 1879233 - RNA, 14 nt, Human
auuguaaaacaggu

SEQ ID NO: 1879234 - RNA, 19 nt, Human
auuguucuuaguuugcagu

SEQ ID NO: 1879235 - RNA, 24 nt, Human
auuguuccagcaguuuucaaguca

SEQ ID NO: 1879236 - RNA, 13 nt, Human
auuguacaguuuu

SEQ ID NO: 1879237 - RNA, 19 nt, Human
auuguacacaccuuauauu

SEQ ID NO: 1879238 - RNA, 17 nt, Human
auucuugccaaauauaa

SEQ ID NO: 1879239 - RNA, 14 nt, Human
auucugagagcugu

SEQ ID NO: 1879240 - RNA, 13 nt, Human
auucugagagcug

SEQ ID NO: 1879241 - RNA, 16 nt, Human
auucucuccuguaccu

SEQ ID NO: 1879242 - RNA, 21 nt, Human
auucucuccuguaccucuuga

SEQ ID NO: 1879243 - RNA, 19 nt, Human
auucucuccuguaccucuu

SEQ ID NO: 1879244 - RNA, 21 nt, Human
auuccugaugcuucuucagag

SEQ ID NO: 1879245 - RNA, 13 nt, Human
auuccugaacagg

SEQ ID NO: 1879246 - RNA, 15 nt, Human
auuccugaagaacca

SEQ ID NO: 1879247 - RNA, 17 nt, Human
auuccucuuuucucugc

SEQ ID NO: 1879248 - RNA, 13 nt, Human
auuccucuuugcu

SEQ ID NO: 1879249 - RNA, 14 nt, Human
auuccucuuugcuu

SEQ ID NO: 1879250 - RNA, 15 nt, Human
auuccucuuugcuuu

SEQ ID NO: 1879251 - RNA, 16 nt, Human
auuccucuuugcuuug

SEQ ID NO: 1879252 - RNA, 17 nt, Human
auuccucuuugcuuugc

SEQ ID NO: 1879253 - RNA, 18 nt, Human
auuccucuuugcuuugcu

SEQ ID NO: 1879254 - RNA, 12 nt, Human
auuccucuuuuc

SEQ ID NO: 1879255 - RNA, 15 nt, Human
auuccucuuuucucu

SEQ ID NO: 1879256 - RNA, 16 nt, Human
auuccugaagaaccag

SEQ ID NO: 1879257 - RNA, 19 nt, Human
auuccugaagaaccagucc

SEQ ID NO: 1879258 - RNA, 17 nt, Human
auucuuuccugaggcug

SEQ ID NO: 1879259 - RNA, 22 nt, Human
auucuuuccugaggcugggcuc

SEQ ID NO: 1879260 - RNA, 17 nt, Human
auucuuucgaaagaaga

SEQ ID NO: 1879261 - RNA, 19 nt, Human
auucuuugaccuguuggga

SEQ ID NO: 1879262 - RNA, 15 nt, Human
auucuuucugauaac

SEQ ID NO: 1879263 - RNA, 16 nt, Human
auugauccagaaagaa

SEQ ID NO: 1879264 - RNA, 17 nt, Human
auugauccagaaagaaa

SEQ ID NO: 1879265 - RNA, 17 nt, Human
auugagcugcagaaacg

SEQ ID NO: 1879266 - RNA, 13 nt, Human
auugauauuugug

SEQ ID NO: 1879267 - RNA, 16 nt, Human
auugauauuugugcau

SEQ ID NO: 1879268 - RNA, 18 nt, Human
auugauauuugugcauuu

SEQ ID NO: 1879269 - RNA, 22 nt, Human
auugauauuugugcauuuucua

SEQ ID NO: 1879270 - RNA, 19 nt, Human
auugauauuugugcauuuu

SEQ ID NO: 1879271 - RNA, 18 nt, Human
auucacaagacccaaaag

SEQ ID NO: 1879272 - RNA, 14 nt, Human
auucacaaacuuuu

SEQ ID NO: 1879273 - RNA, 22 nt, Human
auucacaaacuuuuauacucuu

SEQ ID NO: 1879274 - RNA, 21 nt, Human
auucaauuguaaauugaauca

SEQ ID NO: 1879275 - RNA, 22 nt, Human
auucaauuguaaauugaaucag

SEQ ID NO: 1879276 - RNA, 13 nt, Human
auucacaaacuuu

SEQ ID NO: 1879277 - RNA, 18 nt, Human
auuaaauucuugcaaagu

SEQ ID NO: 1879278 - RNA, 14 nt, Human
auuaaauucuugca

SEQ ID NO: 1879279 - RNA, 20 nt, Human
auuaaauucuugcaaaguau

SEQ ID NO: 1879280 - RNA, 20 nt, Human
auuauguguguuuuaaaaug

SEQ ID NO: 1879281 - RNA, 21 nt, Human
auuauguguguuuuaaaauga

SEQ ID NO: 1879282 - RNA, 15 nt, Human
auuauguguguuuua

SEQ ID NO: 1879283 - RNA, 17 nt, Human
auucacaaacuuuuaua

SEQ ID NO: 1879284 - RNA, 20 nt, Human
auucauauuuacuucuuaua

SEQ ID NO: 1879285 - RNA, 16 nt, Human
auucaucccaacuguc

SEQ ID NO: 1879286 - RNA, 18 nt, Human
auucauauuuacuucuua

SEQ ID NO: 1879287 - RNA, 19 nt, Human
auucauauuuacuucuuau

SEQ ID NO: 1879288 - RNA, 12 nt, Human
auuccucuggga

SEQ ID NO: 1879289 - RNA, 13 nt, Human
auuccucugggaa

SEQ ID NO: 1879290 - RNA, 22 nt, Human
auuccucugggaauguuacauu

SEQ ID NO: 1879291 - RNA, 20 nt, Human
auuccaaagaguagaauugc

SEQ ID NO: 1879292 - RNA, 22 nt, Human
auucaucucucuuuaauauaaa

SEQ ID NO: 1879293 - RNA, 17 nt, Human
auucaucucucuuuaau

SEQ ID NO: 1879294 - RNA, 17 nt, Human
auucaucccaacugucu

SEQ ID NO: 1879295 - RNA, 18 nt, Human
auuuugauccaagcuggu

SEQ ID NO: 1879296 - RNA, 21 nt, Human
auuuuaucuuugauucuccuu

SEQ ID NO: 1879297 - RNA, 20 nt, Human
auuuuaucuuugauucuccu

SEQ ID NO: 1879298 - RNA, 15 nt, Human
auuuuaucuuugauu

SEQ ID NO: 1879299 - RNA, 13 nt, Human
auuuuaucuuuga

SEQ ID NO: 1879300 - RNA, 23 nt, Human
auuuuaucuuugauucuccuuca

SEQ ID NO: 1879301 - RNA, 22 nt, Human
auuuuaucuuugauucuccuuc

SEQ ID NO: 1879302 - RNA, 12 nt, Human
auuuucuuuaau

SEQ ID NO: 1879303 - RNA, 15 nt, Human
auuuucuuuaaugcu

SEQ ID NO: 1879304 - RNA, 18 nt, Human
auuuucuuuaaugcuuuu

SEQ ID NO: 1879305 - RNA, 19 nt, Human
auuuucuuuaaugcuuuua

SEQ ID NO: 1879306 - RNA, 16 nt, Human
auuuguuugaacugau

SEQ ID NO: 1879307 - RNA, 14 nt, Human
auuuguuugaacug

SEQ ID NO: 1879308 - RNA, 20 nt, Human
auuuguuugaacugauaaag

SEQ ID NO: 1879309 - RNA, 14 nt, Human
auuuuauaauucug

SEQ ID NO: 1879310 - RNA, 15 nt, Human
auuuuauacauuaac

SEQ ID NO: 1879311 - RNA, 13 nt, Human
auuuguuugaacu

SEQ ID NO: 1879312 - RNA, 13 nt, Human
auuuuuaaagaaa

SEQ ID NO: 1879313 - RNA, 20 nt, Human
auuuuuaaagaaaaguuuug

SEQ ID NO: 1879314 - RNA, 17 nt, Human
auuuuuuuuuccuucag

SEQ ID NO: 1879315 - RNA, 21 nt, Human
auuuuuacguuugaagacauu

SEQ ID NO: 1879316 - RNA, 23 nt, Human
caaaaaaaccucuuaauauucug

SEQ ID NO: 1879317 - RNA, 12 nt, Human
caaaagcugcuc

SEQ ID NO: 1879318 - RNA, 12 nt, Human
auuuuuuuuucc

SEQ ID NO: 1879319 - RNA, 13 nt, Human
auuuuuuuuuccu

SEQ ID NO: 1879320 - RNA, 16 nt, Human
auuuuuuuuuccuuca

SEQ ID NO: 1879321 - RNA, 13 nt, Human
auuuuuaagugcu

SEQ ID NO: 1879322 - RNA, 19 nt, Human
caaaagcugggcagguugg

SEQ ID NO: 1879323 - RNA, 14 nt, Human
caaaagcugcucag

SEQ ID NO: 1879324 - RNA, 15 nt, Human
caaaagcugggcagg

SEQ ID NO: 1879325 - RNA, 14 nt, Human
caaaccacacugga

SEQ ID NO: 1879326 - RNA, 22 nt, Human
caaaccaccagaagcccagaau

SEQ ID NO: 1879327 - RNA, 20 nt, Human
caaaccaccagaagcccaga

SEQ ID NO: 1879328 - RNA, 16 nt, Human
caaaccaccagaagcc

SEQ ID NO: 1879329 - RNA, 15 nt, Human
caaaccaccagaagc

SEQ ID NO: 1879330 - RNA, 15 nt, Human
caaaccacacuggac

SEQ ID NO: 1879331 - RNA, 17 nt, Human
caacccccagccugcua

SEQ ID NO: 1879332 - RNA, 16 nt, Human
caacccccagccugcu

SEQ ID NO: 1879333 - RNA, 15 nt, Human
caacccccagccugc

SEQ ID NO: 1879334 - RNA, 19 nt, Human
caacccaaauguucaucaa

SEQ ID NO: 1879335 - RNA, 21 nt, Human
caaccacuaagaauucaaacu

SEQ ID NO: 1879336 - RNA, 17 nt, Human
caacucaccccagcccc

SEQ ID NO: 1879337 - RNA, 16 nt, Human
caacucaccccagccc

SEQ ID NO: 1879338 - RNA, 13 nt, Human
caacucaccccag

SEQ ID NO: 1879339 - RNA, 15 nt, Human
caacucaccccagcc

SEQ ID NO: 1879340 - RNA, 22 nt, Human
caagacccuuguggucccaccc

SEQ ID NO: 1879341 - RNA, 18 nt, Human
caagacccuugugguccc

SEQ ID NO: 1879342 - RNA, 19 nt, Human
caagacccuugugguccca

SEQ ID NO: 1879343 - RNA, 23 nt, Human
caagaauuucuaggacugaauua

SEQ ID NO: 1879344 - RNA, 18 nt, Human
caaccacugcgaccacaa

SEQ ID NO: 1879345 - RNA, 23 nt, Human
caacaaaccuguuucugcagcca

SEQ ID NO: 1879346 - RNA, 12 nt, Human
caacacaaagag

SEQ ID NO: 1879347 - RNA, 13 nt, Human
caacacaaagaga

SEQ ID NO: 1879348 - RNA, 15 nt, Human
caacacaaagagaaa

SEQ ID NO: 1879349 - RNA, 16 nt, Human
caacacaaagagaaaa

SEQ ID NO: 1879350 - RNA, 20 nt, Human
caacacaaagagaaaaagaa

SEQ ID NO: 1879351 - RNA, 22 nt, Human
caacacaaagagaaaaagaaau

SEQ ID NO: 1879352 - RNA, 23 nt, Human
caacacaaagagaaaaagaaaug

SEQ ID NO: 1879353 - RNA, 21 nt, Human
caaaucugcuuuuuaaagaau

SEQ ID NO: 1879354 - RNA, 22 nt, Human
caaaugagggucuugguuccag

SEQ ID NO: 1879355 - RNA, 23 nt, Human
caaaucuaggaaaauauuuugau

SEQ ID NO: 1879356 - RNA, 20 nt, Human
caaaucuaggaaaauauuuu

SEQ ID NO: 1879357 - RNA, 22 nt, Human
caaauccagccugcugccugcu

SEQ ID NO: 1879358 - RNA, 20 nt, Human
caaauccuugugggaaaaga

SEQ ID NO: 1879359 - RNA, 17 nt, Human
caaaucagcugcuacua

SEQ ID NO: 1879360 - RNA, 16 nt, Human
caaagucaagccacau

SEQ ID NO: 1879361 - RNA, 13 nt, Human
caaagaugcagcc

SEQ ID NO: 1879362 - RNA, 20 nt, Human
caaagaucuguccucagccu

SEQ ID NO: 1879363 - RNA, 21 nt, Human
caaagaucuguccucagccuu

SEQ ID NO: 1879364 - RNA, 14 nt, Human
caaagaugcagccg

SEQ ID NO: 1879365 - RNA, 20 nt, Human
caaaguacacuguuucaaac

SEQ ID NO: 1879366 - RNA, 16 nt, Human
caaaguacacuguuuc

SEQ ID NO: 1879367 - RNA, 21 nt, Human
caaaguacacuguuucaaacu

SEQ ID NO: 1879368 - RNA, 22 nt, Human
caacaccucugcacaagcugca

SEQ ID NO: 1879369 - RNA, 20 nt, Human
caacaccuuguuucccucuc

SEQ ID NO: 1879370 - RNA, 12 nt, Human
cacaagccaggg

SEQ ID NO: 1879371 - RNA, 15 nt, Human
cacaagccagggugu

SEQ ID NO: 1879372 - RNA, 14 nt, Human
cacaagccuucggc

SEQ ID NO: 1879373 - RNA, 12 nt, Human
caauuuaaaaaa

SEQ ID NO: 1879374 - RNA, 14 nt, Human
cacaagacccuugu

SEQ ID NO: 1879375 - RNA, 16 nt, Human
cacaagacccuugugg

SEQ ID NO: 1879376 - RNA, 12 nt, Human
caauuuaaagca

SEQ ID NO: 1879377 - RNA, 23 nt, Human
caaugcuggcuguuggcuggggg

SEQ ID NO: 1879378 - RNA, 22 nt, Human
caaugcuggcuguuggcugggg

SEQ ID NO: 1879379 - RNA, 19 nt, Human
caauauuuauuauuuucac

SEQ ID NO: 1879380 - RNA, 19 nt, Human
caauucuuacaaacaugug

SEQ ID NO: 1879381 - RNA, 18 nt, Human
caauucuuacaaacaugu

SEQ ID NO: 1879382 - RNA, 17 nt, Human
caauucuuacaaacaug

SEQ ID NO: 1879383 - RNA, 22 nt, Human
caaugcugugcccuaaagugua

SEQ ID NO: 1879384 - RNA, 13 nt, Human
caaguauuauacc

SEQ ID NO: 1879385 - RNA, 15 nt, Human
caaguugaauugagg

SEQ ID NO: 1879386 - RNA, 17 nt, Human
caaguuguucaaacauu

SEQ ID NO: 1879387 - RNA, 22 nt, Human
caaguaauccaccugccucggc

SEQ ID NO: 1879388 - RNA, 20 nt, Human
caagauucccaggaguucug

SEQ ID NO: 1879389 - RNA, 21 nt, Human
caagauucccaggaguucugc

SEQ ID NO: 1879390 - RNA, 14 nt, Human
caagauucccagga

SEQ ID NO: 1879391 - RNA, 15 nt, Human
caagauucccaggag

SEQ ID NO: 1879392 - RNA, 16 nt, Human
caagauucccaggagu

SEQ ID NO: 1879393 - RNA, 19 nt, Human
caagauucccaggaguucu

SEQ ID NO: 1879394 - RNA, 13 nt, Human
caagauucccagg

SEQ ID NO: 1879395 - RNA, 16 nt, Human
caaguagcauuuacug

SEQ ID NO: 1879396 - RNA, 17 nt, Human
caaguagcauuuacugu

SEQ ID NO: 1879397 - RNA, 21 nt, Human
caauaaaaaaaagaaaugaaa

SEQ ID NO: 1879398 - RNA, 13 nt, Human
caauaaaaaaaag

SEQ ID NO: 1879399 - RNA, 16 nt, Human
caauaaaaaaaagaaa

SEQ ID NO: 1879400 - RNA, 19 nt, Human
caauaaaaaaaagaaauga

SEQ ID NO: 1879401 - RNA, 20 nt, Human
caauaaaaaaaagaaaugaa

SEQ ID NO: 1879402 - RNA, 17 nt, Human
cacaucuugcucugcug

SEQ ID NO: 1879403 - RNA, 16 nt, Human
cacaucuugcucugcu

SEQ ID NO: 1879404 - RNA, 13 nt, Human
cacaucuaagccu

SEQ ID NO: 1879405 - RNA, 14 nt, Human
cacaucuaagccug

SEQ ID NO: 1879406 - RNA, 22 nt, Human
cacaucagcacgauuucuguuu

SEQ ID NO: 1879407 - RNA, 24 nt, Human
cacaucagcuccacuuucagugaa

SEQ ID NO: 1879408 - RNA, 21 nt, Human
cacaucagcacgauuucuguu

SEQ ID NO: 1879409 - RNA, 20 nt, Human
cacaucagcacgauuucugu

SEQ ID NO: 1879410 - RNA, 18 nt, Human
cacaucuugcucugcuga

SEQ ID NO: 1879411 - RNA, 19 nt, Human
cacaucuugcucugcugac

SEQ ID NO: 1879412 - RNA, 17 nt, Human
cacaucuaagccugaag

SEQ ID NO: 1879413 - RNA, 16 nt, Human
cacauuuggaauacuu

SEQ ID NO: 1879414 - RNA, 17 nt, Human
cacauuuggaauacuuu

SEQ ID NO: 1879415 - RNA, 19 nt, Human
cacauuuggaauacuuuuu

SEQ ID NO: 1879416 - RNA, 14 nt, Human
cacauuuuucagau

SEQ ID NO: 1879417 - RNA, 15 nt, Human
cacauuuuauuuuau

SEQ ID NO: 1879418 - RNA, 21 nt, Human
cacauuuuuuaaaugcaccug

SEQ ID NO: 1879419 - RNA, 17 nt, Human
cacauuuuuuaaaugca

SEQ ID NO: 1879420 - RNA, 14 nt, Human
cacauuuuucuuag

SEQ ID NO: 1879421 - RNA, 13 nt, Human
cacauuuuucuua

SEQ ID NO: 1879422 - RNA, 18 nt, Human
cacauuuuucagauauaa

SEQ ID NO: 1879423 - RNA, 17 nt, Human
caccaacauacucccau

SEQ ID NO: 1879424 - RNA, 20 nt, Human
caccaacauacucccaucug

SEQ ID NO: 1879425 - RNA, 21 nt, Human
caccaacauacucccaucugu

SEQ ID NO: 1879426 - RNA, 23 nt, Human
cacccaggagccccgaggccuuc

SEQ ID NO: 1879427 - RNA, 20 nt, Human
cacccaggagccccgaggcc

SEQ ID NO: 1879428 - RNA, 19 nt, Human
cacccagcccacuucugcc

SEQ ID NO: 1879429 - RNA, 24 nt, Human
cacccaggagccccgaggccuucu

SEQ ID NO: 1879430 - RNA, 21 nt, Human
caccagcccuuagcagggaaa

SEQ ID NO: 1879431 - RNA, 15 nt, Human
caccagcagccugga

SEQ ID NO: 1879432 - RNA, 15 nt, Human
caccagcauuccuuu

SEQ ID NO: 1879433 - RNA, 14 nt, Human
caccagcauuccuu

SEQ ID NO: 1879434 - RNA, 23 nt, Human
caccaacauacucccaucuguga

SEQ ID NO: 1879435 - RNA, 14 nt, Human
caccagcagccugg

SEQ ID NO: 1879436 - RNA, 12 nt, Human
caccagcagccu

SEQ ID NO: 1879437 - RNA, 17 nt, Human
cacccagcccacuucug

SEQ ID NO: 1879438 - RNA, 16 nt, Human
cacccagcccacuucu

SEQ ID NO: 1879439 - RNA, 17 nt, Human
caccaggaaccucuuca

SEQ ID NO: 1879440 - RNA, 19 nt, Human
cacaguauuacuucugcua

SEQ ID NO: 1879441 - RNA, 18 nt, Human
cacaguauuacuucugcu

SEQ ID NO: 1879442 - RNA, 16 nt, Human
cacaguauuacuucug

SEQ ID NO: 1879443 - RNA, 14 nt, Human
cacaggucuuuccu

SEQ ID NO: 1879444 - RNA, 16 nt, Human
cacaguagucuugaug

SEQ ID NO: 1879445 - RNA, 13 nt, Human
cacaguagucuug

SEQ ID NO: 1879446 - RNA, 15 nt, Human
cacaggucuuuccua

SEQ ID NO: 1879447 - RNA, 10 nt, Human
cacagcucuu

SEQ ID NO: 1879448 - RNA, 23 nt, Human
cacagcucuguccugggagugag

SEQ ID NO: 1879449 - RNA, 20 nt, Human
cacagcucuguccugggagu

SEQ ID NO: 1879450 - RNA, 22 nt, Human
cacagcuaacauggaaguacua

SEQ ID NO: 1879451 - RNA, 23 nt, Human
cacagguaugaccuucuaggaag

SEQ ID NO: 1879452 - RNA, 19 nt, Human
cacagacccugcccugugg

SEQ ID NO: 1879453 - RNA, 20 nt, Human
cacagacccugcccuguggg

SEQ ID NO: 1879454 - RNA, 21 nt, Human
cacagacccugcccugugggc

SEQ ID NO: 1879455 - RNA, 22 nt, Human
cacagacccugcccugugggcc

SEQ ID NO: 1879456 - RNA, 15 nt, Human
cacagcuaacaugga

SEQ ID NO: 1879457 - RNA, 16 nt, Human
cacagcuaacauggaa

SEQ ID NO: 1879458 - RNA, 21 nt, Human
caccuugugucuguacacgug

SEQ ID NO: 1879459 - RNA, 17 nt, Human
caccuugugucuguaca

SEQ ID NO: 1879460 - RNA, 15 nt, Human
caccuugugucugua

SEQ ID NO: 1879461 - RNA, 14 nt, Human
caccuuugaagaag

SEQ ID NO: 1879462 - RNA, 17 nt, Human
caccuuuguccccaccg

SEQ ID NO: 1879463 - RNA, 14 nt, Human
caccuuugucccca

SEQ ID NO: 1879464 - RNA, 15 nt, Human
caccuuuguccccac

SEQ ID NO: 1879465 - RNA, 13 nt, Human
caccuuggcucaa

SEQ ID NO: 1879466 - RNA, 14 nt, Human
caccuuggcucaag

SEQ ID NO: 1879467 - RNA, 17 nt, Human
caccuuggcaccagaca

SEQ ID NO: 1879468 - RNA, 19 nt, Human
caccuugacagggcacacc

SEQ ID NO: 1879469 - RNA, 17 nt, Human
caccugccagggacaga

SEQ ID NO: 1879470 - RNA, 23 nt, Human
caccucaagaagaagaggggcau

SEQ ID NO: 1879471 - RNA, 13 nt, Human
caccugccaggga

SEQ ID NO: 1879472 - RNA, 14 nt, Human
caccugccagggac

SEQ ID NO: 1879473 - RNA, 16 nt, Human
caccugccagggacag

SEQ ID NO: 1879474 - RNA, 13 nt, Human
caccuauuuccau

SEQ ID NO: 1879475 - RNA, 15 nt, Human
caccuaaagcagcca

SEQ ID NO: 1879476 - RNA, 22 nt, Human
caccuaaauaaccaaucuacaa

SEQ ID NO: 1879477 - RNA, 23 nt, Human
caccuaaauaaccaaucuacaau

SEQ ID NO: 1879478 - RNA, 17 nt, Human
caccuaaagcagccagc

SEQ ID NO: 1879479 - RNA, 14 nt, Human
caccuaaagcagcc

SEQ ID NO: 1879480 - RNA, 21 nt, Human
caccuacaugagguacugaga

SEQ ID NO: 1879481 - RNA, 17 nt, Human
caccuaauccaggcaga

SEQ ID NO: 1879482 - RNA, 13 nt, Human
caccguucugugc

SEQ ID NO: 1879483 - RNA, 14 nt, Human
caccguucugugca

SEQ ID NO: 1879484 - RNA, 15 nt, Human
caccguucugugcac

SEQ ID NO: 1879485 - RNA, 23 nt, Human
cacuacggaauaguuggcuagga

SEQ ID NO: 1879486 - RNA, 15 nt, Human
cacuaauacaccagg

SEQ ID NO: 1879487 - RNA, 20 nt, Human
cacggagggugacgggggug

SEQ ID NO: 1879488 - RNA, 19 nt, Human
cacggagcccagcccuccc

SEQ ID NO: 1879489 - RNA, 16 nt, Human
cacggccaggccagag

SEQ ID NO: 1879490 - RNA, 15 nt, Human
cacggccaggccaga

SEQ ID NO: 1879491 - RNA, 14 nt, Human
cacggccaggccag

SEQ ID NO: 1879492 - RNA, 19 nt, Human
cacucuuauugcccacgcu

SEQ ID NO: 1879493 - RNA, 18 nt, Human
cacucuuauugcccacgc

SEQ ID NO: 1879494 - RNA, 17 nt, Human
cacucuuauugcccacg

SEQ ID NO: 1879495 - RNA, 18 nt, Human
cacuccccgaagucuuuu

SEQ ID NO: 1879496 - RNA, 19 nt, Human
cacuccccgaagucuuuug

SEQ ID NO: 1879497 - RNA, 17 nt, Human
cacucuugaaaaaugca

SEQ ID NO: 1879498 - RNA, 16 nt, Human
cacucuuggagccugc

SEQ ID NO: 1879499 - RNA, 15 nt, Human
cacucuuggagccug

SEQ ID NO: 1879500 - RNA, 14 nt, Human
cacucuuggagccu

SEQ ID NO: 1879501 - RNA, 13 nt, Human
cacucuucucagc

SEQ ID NO: 1879502 - RNA, 16 nt, Human
cacugaaauauacaca

SEQ ID NO: 1879503 - RNA, 20 nt, Human
cacugaaauauacacacagc

SEQ ID NO: 1879504 - RNA, 14 nt, Human
cacucuucucagcc

SEQ ID NO: 1879505 - RNA, 17 nt, Human
cacucuucucagccacu

SEQ ID NO: 1879506 - RNA, 19 nt, Human
cacucuuggagccugcaga

SEQ ID NO: 1879507 - RNA, 17 nt, Human
cacucuuggagccugca

SEQ ID NO: 1879508 - RNA, 17 nt, Human
cacuguugcccaggcug

SEQ ID NO: 1879509 - RNA, 19 nt, Human
cacuguuucaaacuuuacu

SEQ ID NO: 1879510 - RNA, 23 nt, Human
cacuuguccagcugagcgccagg

SEQ ID NO: 1879511 - RNA, 20 nt, Human
cacuuggucugugagaugcu

SEQ ID NO: 1879512 - RNA, 17 nt, Human
cacuuggucugugagau

SEQ ID NO: 1879513 - RNA, 17 nt, Human
cacuugugauuauuuau

SEQ ID NO: 1879514 - RNA, 16 nt, Human
cacuguugcccaggcu

SEQ ID NO: 1879515 - RNA, 15 nt, Human
cacuguugcccaggc

SEQ ID NO: 1879516 - RNA, 14 nt, Human
cacuguugcccagg

SEQ ID NO: 1879517 - RNA, 17 nt, Human
cacuggugacaugucuu

SEQ ID NO: 1879518 - RNA, 23 nt, Human
cacuggggauugggccccugcca

SEQ ID NO: 1879519 - RNA, 23 nt, Human
cacugggcuuggggaccagagcu

SEQ ID NO: 1879520 - RNA, 18 nt, Human
cacuggggauugggcccc

SEQ ID NO: 1879521 - RNA, 17 nt, Human
cacuggggauugggccc

SEQ ID NO: 1879522 - RNA, 16 nt, Human
cacuggggauugggcc

SEQ ID NO: 1879523 - RNA, 15 nt, Human
cacuggggauugggc

SEQ ID NO: 1879524 - RNA, 22 nt, Human
cacugggcuuggggaccagagc

SEQ ID NO: 1879525 - RNA, 19 nt, Human
cacuuucagugaaagcauc

SEQ ID NO: 1879526 - RNA, 18 nt, Human
cacuuucagugaaagcau

SEQ ID NO: 1879527 - RNA, 17 nt, Human
cacuuucagugaaagca

SEQ ID NO: 1879528 - RNA, 22 nt, Human
cagaaguuucugccgcagcccu

SEQ ID NO: 1879529 - RNA, 20 nt, Human
cagaaguuucugccgcagcc

SEQ ID NO: 1879530 - RNA, 21 nt, Human
cagaaguuucugccgcagccc

SEQ ID NO: 1879531 - RNA, 21 nt, Human
cagaauaaacuggcagcucag

SEQ ID NO: 1879532 - RNA, 15 nt, Human
cagaauagccacauu

SEQ ID NO: 1879533 - RNA, 19 nt, Human
cagaauagauagcacugaa

SEQ ID NO: 1879534 - RNA, 21 nt, Human
cagaauagccacauuuggaau

SEQ ID NO: 1879535 - RNA, 22 nt, Human
cagaauagccacauuuggaaua

SEQ ID NO: 1879536 - RNA, 22 nt, Human
cagaauacuguuaaaggaaaaa

SEQ ID NO: 1879537 - RNA, 14 nt, Human
cagaauacacuuaa

SEQ ID NO: 1879538 - RNA, 17 nt, Human
cagaaauguguuaucac

SEQ ID NO: 1879539 - RNA, 11 nt, Human
cagaacacugu

SEQ ID NO: 1879540 - RNA, 19 nt, Human
cagggcucccacagagaca

SEQ ID NO: 1879541 - RNA, 15 nt, Human
cagggcucccacaga

SEQ ID NO: 1879542 - RNA, 16 nt, Human
cagggcugaggccucu

SEQ ID NO: 1879543 - RNA, 18 nt, Human
cagggcucccacagagac

SEQ ID NO: 1879544 - RNA, 15 nt, Human
cagggcuggacugag

SEQ ID NO: 1879545 - RNA, 14 nt, Human
cagggcuggacuga

SEQ ID NO: 1879546 - RNA, 18 nt, Human
cagggcugaggccucuca

SEQ ID NO: 1879547 - RNA, 20 nt, Human
caggggaaaaucagccugcu

SEQ ID NO: 1879548 - RNA, 18 nt, Human
cagggcuggacugaggcc

SEQ ID NO: 1879549 - RNA, 19 nt, Human
caggggaaaaucagccugc

SEQ ID NO: 1879550 - RNA, 19 nt, Human
cagggcuggacugaggccu

SEQ ID NO: 1879551 - RNA, 17 nt, Human
cagggcuggacugaggc

SEQ ID NO: 1879552 - RNA, 16 nt, Human
cagggcuggacugagg

SEQ ID NO: 1879553 - RNA, 23 nt, Human
cagggcucagcggggacagcucc

SEQ ID NO: 1879554 - RNA, 21 nt, Human
cagggcucagcggggacagcu

SEQ ID NO: 1879555 - RNA, 16 nt, Human
cagggaugguguucaa

SEQ ID NO: 1879556 - RNA, 13 nt, Human
cagggaugcccug

SEQ ID NO: 1879557 - RNA, 14 nt, Human
cagggaugcccugg

SEQ ID NO: 1879558 - RNA, 16 nt, Human
cagggaugcccuggag

SEQ ID NO: 1879559 - RNA, 20 nt, Human
cagggaugcccuggaggugg

SEQ ID NO: 1879560 - RNA, 21 nt, Human
cagggaugcccuggagguggc

SEQ ID NO: 1879561 - RNA, 22 nt, Human
cagggaugcccuggagguggcu

SEQ ID NO: 1879562 - RNA, 23 nt, Human
cagggaugcccuggagguggcug

SEQ ID NO: 1879563 - RNA, 18 nt, Human
cagggagcugcaggggca

SEQ ID NO: 1879564 - RNA, 15 nt, Human
cagggagcggccggc

SEQ ID NO: 1879565 - RNA, 17 nt, Human
cagggagcggccggcca

SEQ ID NO: 1879566 - RNA, 19 nt, Human
cagggagcggccggccagc

SEQ ID NO: 1879567 - RNA, 21 nt, Human
cagggagcggccggccagccc

SEQ ID NO: 1879568 - RNA, 23 nt, Human
cagggagcggccggccagccccu

SEQ ID NO: 1879569 - RNA, 14 nt, Human
cagggagcugcagg

SEQ ID NO: 1879570 - RNA, 15 nt, Human
cagggagcugcaggg

SEQ ID NO: 1879571 - RNA, 17 nt, Human
cagggagcugcaggggc

SEQ ID NO: 1879572 - RNA, 20 nt, Human
caggcugggcuucaguggca

SEQ ID NO: 1879573 - RNA, 15 nt, Human
caggcugggagagcc

SEQ ID NO: 1879574 - RNA, 12 nt, Human
caggcugggaga

SEQ ID NO: 1879575 - RNA, 14 nt, Human
caggcugggagagc

SEQ ID NO: 1879576 - RNA, 22 nt, Human
caggcugggcuucaguggcagc

SEQ ID NO: 1879577 - RNA, 21 nt, Human
caggcugggcuucaguggcag

SEQ ID NO: 1879578 - RNA, 20 nt, Human
cagggagcauuuuccuccau

SEQ ID NO: 1879579 - RNA, 22 nt, Human
cagggagccuuugguucuggcc

SEQ ID NO: 1879580 - RNA, 16 nt, Human
caggcuggcuccagau

SEQ ID NO: 1879581 - RNA, 20 nt, Human
caggcuggcuccagaugcag

SEQ ID NO: 1879582 - RNA, 17 nt, Human
caggcuggcuccagaug

SEQ ID NO: 1879583 - RNA, 18 nt, Human
caggcuggcuccagaugc

SEQ ID NO: 1879584 - RNA, 16 nt, Human
caggccagagggagug

SEQ ID NO: 1879585 - RNA, 20 nt, Human
caggccaggcccucugccca

SEQ ID NO: 1879586 - RNA, 19 nt, Human
caggccaggcccucugccc

SEQ ID NO: 1879587 - RNA, 17 nt, Human
caggccaggcccucugc

SEQ ID NO: 1879588 - RNA, 18 nt, Human
caggccaggcccucugcc

SEQ ID NO: 1879589 - RNA, 17 nt, Human
caggccagcugcuuggg

SEQ ID NO: 1879590 - RNA, 19 nt, Human
caggccagcugcuugggcu

SEQ ID NO: 1879591 - RNA, 21 nt, Human
caggccagcugcuugggcuuc

SEQ ID NO: 1879592 - RNA, 23 nt, Human
caggccagcugcuugggcuucau

SEQ ID NO: 1879593 - RNA, 14 nt, Human
caggcagauccagg

SEQ ID NO: 1879594 - RNA, 15 nt, Human
caggccagagggagu

SEQ ID NO: 1879595 - RNA, 13 nt, Human
caggccagaggga

SEQ ID NO: 1879596 - RNA, 18 nt, Human
caggcagauacaggaaaa

SEQ ID NO: 1879597 - RNA, 13 nt, Human
caggcagauccag

SEQ ID NO: 1879598 - RNA, 22 nt, Human
caggugcacaagcuccaagcuc

SEQ ID NO: 1879599 - RNA, 21 nt, Human
caggugcacaagcuccaagcu

SEQ ID NO: 1879600 - RNA, 21 nt, Human
cagguuggugggggccucggu

SEQ ID NO: 1879601 - RNA, 23 nt, Human
caguaaagaacaucccuccuggg

SEQ ID NO: 1879602 - RNA, 14 nt, Human
cagguuuaagcugu

SEQ ID NO: 1879603 - RNA, 12 nt, Human
cagguuuuccug

SEQ ID NO: 1879604 - RNA, 16 nt, Human
cagguuuuccugaaga

SEQ ID NO: 1879605 - RNA, 23 nt, Human
caggugauccacccaccucagcc

SEQ ID NO: 1879606 - RNA, 22 nt, Human
caggugauccacccaccucagc

SEQ ID NO: 1879607 - RNA, 15 nt, Human
caggugcacaagcuc

SEQ ID NO: 1879608 - RNA, 15 nt, Human
caggugcaaccaggg

SEQ ID NO: 1879609 - RNA, 18 nt, Human
caggugcaaccagggagc

SEQ ID NO: 1879610 - RNA, 24 nt, Human
caggugcaaccagggagcugcagg

SEQ ID NO: 1879611 - RNA, 17 nt, Human
caggugcacaagcucca

SEQ ID NO: 1879612 - RNA, 18 nt, Human
caggugcacaagcuccaa

SEQ ID NO: 1879613 - RNA, 19 nt, Human
caggugcacaagcuccaag

SEQ ID NO: 1879614 - RNA, 20 nt, Human
caggugcacaagcuccaagc

SEQ ID NO: 1879615 - RNA, 21 nt, Human
caggugauccacccaccucag

SEQ ID NO: 1879616 - RNA, 15 nt, Human
cagucacauuccaag

SEQ ID NO: 1879617 - RNA, 15 nt, Human
cagucaauauuuuua

SEQ ID NO: 1879618 - RNA, 14 nt, Human
cagucaauuaacaa

SEQ ID NO: 1879619 - RNA, 15 nt, Human
cagucaauuaacaau

SEQ ID NO: 1879620 - RNA, 12 nt, Human
cagucacagcca

SEQ ID NO: 1879621 - RNA, 13 nt, Human
cagucacagccac

SEQ ID NO: 1879622 - RNA, 14 nt, Human
cagucacagccacc

SEQ ID NO: 1879623 - RNA, 16 nt, Human
cagucacagccacccc

SEQ ID NO: 1879624 - RNA, 17 nt, Human
cagucacugaauuccau

SEQ ID NO: 1879625 - RNA, 17 nt, Human
cagucuggaaugcagug

SEQ ID NO: 1879626 - RNA, 15 nt, Human
cagucuggaaugcag

SEQ ID NO: 1879627 - RNA, 13 nt, Human
cagugcaugcugu

SEQ ID NO: 1879628 - RNA, 14 nt, Human
cagugcaugcuguc

SEQ ID NO: 1879629 - RNA, 23 nt, Human
cagugggagcugccuguucagcu

SEQ ID NO: 1879630 - RNA, 20 nt, Human
cagugggagcugccuguuca

SEQ ID NO: 1879631 - RNA, 17 nt, Human
cagugcccacaggauca

SEQ ID NO: 1879632 - RNA, 15 nt, Human
cagugcccacaggau

SEQ ID NO: 1879633 - RNA, 13 nt, Human
cagugcccacagg

SEQ ID NO: 1879634 - RNA, 16 nt, Human
cagugcaugcuguccc

SEQ ID NO: 1879635 - RNA, 17 nt, Human
cagugcaugcugucccu

SEQ ID NO: 1879636 - RNA, 21 nt, Human
caguggugcgaucuggguuca

SEQ ID NO: 1879637 - RNA, 18 nt, Human
caguggugguuuucuguu

SEQ ID NO: 1879638 - RNA, 20 nt, Human
caguggugcgaucuggguuc

SEQ ID NO: 1879639 - RNA, 14 nt, Human
caguggggaaugaa

SEQ ID NO: 1879640 - RNA, 21 nt, Human
cagugggccuggccagcaggu

SEQ ID NO: 1879641 - RNA, 15 nt, Human
cagugggccuggcca

SEQ ID NO: 1879642 - RNA, 14 nt, Human
cagugggccuggcc

SEQ ID NO: 1879643 - RNA, 11 nt, Human
cagccaggaca

SEQ ID NO: 1879644 - RNA, 16 nt, Human
cagccaggacaccggg

SEQ ID NO: 1879645 - RNA, 12 nt, Human
cagccaggacac

SEQ ID NO: 1879646 - RNA, 20 nt, Human
cagccaggacaccgggcagg

SEQ ID NO: 1879647 - RNA, 14 nt, Human
cagccagccgugag

SEQ ID NO: 1879648 - RNA, 20 nt, Human
cagcaucauggagguuugaa

SEQ ID NO: 1879649 - RNA, 23 nt, Human
cagccagggccugcgagggcagc

SEQ ID NO: 1879650 - RNA, 16 nt, Human
cagccagggccugcga

SEQ ID NO: 1879651 - RNA, 21 nt, Human
cagccagggccugcgagggca

SEQ ID NO: 1879652 - RNA, 22 nt, Human
cagccagggccugcgagggcag

SEQ ID NO: 1879653 - RNA, 13 nt, Human
cagcauaauacuu

SEQ ID NO: 1879654 - RNA, 20 nt, Human
cagcaguuuucaagucaaau

SEQ ID NO: 1879655 - RNA, 17 nt, Human
cagcauagaaguaacuu

SEQ ID NO: 1879656 - RNA, 17 nt, Human
cagauugcaacaggcug

SEQ ID NO: 1879657 - RNA, 20 nt, Human
cagauucuuuccugaggcug

SEQ ID NO: 1879658 - RNA, 22 nt, Human
cagauucuuuccugaggcuggg

SEQ ID NO: 1879659 - RNA, 20 nt, Human
cagcacgauuucuguuuaga

SEQ ID NO: 1879660 - RNA, 19 nt, Human
cagcacgauuucuguuuag

SEQ ID NO: 1879661 - RNA, 18 nt, Human
cagcacgauuucuguuua

SEQ ID NO: 1879662 - RNA, 16 nt, Human
cagcacgauuucuguu

SEQ ID NO: 1879663 - RNA, 15 nt, Human
cagaucauccagaag

SEQ ID NO: 1879664 - RNA, 23 nt, Human
cagaucauuaucagccugugcca

SEQ ID NO: 1879665 - RNA, 16 nt, Human
cagaucaguguaccau

SEQ ID NO: 1879666 - RNA, 22 nt, Human
cagaggggguggccucccaacu

SEQ ID NO: 1879667 - RNA, 23 nt, Human
cagaggggguggccucccaacuc

SEQ ID NO: 1879668 - RNA, 21 nt, Human
cagaguaauccaagcaaaugu

SEQ ID NO: 1879669 - RNA, 16 nt, Human
cagagguugcagugag

SEQ ID NO: 1879670 - RNA, 17 nt, Human
cagagguugcagugagc

SEQ ID NO: 1879671 - RNA, 15 nt, Human
cagauucuuuccuga

SEQ ID NO: 1879672 - RNA, 17 nt, Human
cagauucuuuccugagg

SEQ ID NO: 1879673 - RNA, 18 nt, Human
cagauucuuuccugaggc

SEQ ID NO: 1879674 - RNA, 19 nt, Human
cagauucuuuccugaggcu

SEQ ID NO: 1879675 - RNA, 20 nt, Human
cagcugugcucuggacaggc

SEQ ID NO: 1879676 - RNA, 19 nt, Human
cagcugugcucuggacagg

SEQ ID NO: 1879677 - RNA, 24 nt, Human
cagcugugcucuggacaggcaugu

SEQ ID NO: 1879678 - RNA, 21 nt, Human
cagcuguuuaugcauagauaa

SEQ ID NO: 1879679 - RNA, 19 nt, Human
cagcugagggugagugggu

SEQ ID NO: 1879680 - RNA, 23 nt, Human
cagcugagugaaaaaucugugga

SEQ ID NO: 1879681 - RNA, 12 nt, Human
cagcugaguugu

SEQ ID NO: 1879682 - RNA, 18 nt, Human
cagcugagugaaaaaucu

SEQ ID NO: 1879683 - RNA, 13 nt, Human
cagcugaugacuc

SEQ ID NO: 1879684 - RNA, 15 nt, Human
cagcugaugacucaa

SEQ ID NO: 1879685 - RNA, 16 nt, Human
cagcugaugacucaag

SEQ ID NO: 1879686 - RNA, 21 nt, Human
cagcugaugacucaagauucc

SEQ ID NO: 1879687 - RNA, 22 nt, Human
cagcugaugacucaagauuccc

SEQ ID NO: 1879688 - RNA, 23 nt, Human
cagcugaugacucaagauuccca

SEQ ID NO: 1879689 - RNA, 14 nt, Human
cagcugaugaguua

SEQ ID NO: 1879690 - RNA, 20 nt, Human
cagcugaugaguuacagccu

SEQ ID NO: 1879691 - RNA, 12 nt, Human
cagcugccuggg

SEQ ID NO: 1879692 - RNA, 13 nt, Human
cagcugccuggga

SEQ ID NO: 1879693 - RNA, 14 nt, Human
cagcugccugggau

SEQ ID NO: 1879694 - RNA, 21 nt, Human
cagcuccggccuguccuccaa

SEQ ID NO: 1879695 - RNA, 16 nt, Human
cagcuccggccugucc

SEQ ID NO: 1879696 - RNA, 16 nt, Human
caggaaaagcugcuga

SEQ ID NO: 1879697 - RNA, 15 nt, Human
caggaaaagcugcug

SEQ ID NO: 1879698 - RNA, 18 nt, Human
caggaaaagcugcugaca

SEQ ID NO: 1879699 - RNA, 21 nt, Human
cagcggggacagcuccuucug

SEQ ID NO: 1879700 - RNA, 12 nt, Human
cagcgccuuucc

SEQ ID NO: 1879701 - RNA, 13 nt, Human
cagcgccuuuccc

SEQ ID NO: 1879702 - RNA, 19 nt, Human
cagcggggacagcuccuuc

SEQ ID NO: 1879703 - RNA, 18 nt, Human
cagcggggacagcuccuu

SEQ ID NO: 1879704 - RNA, 12 nt, Human
cagccugcucca

SEQ ID NO: 1879705 - RNA, 15 nt, Human
cagccugcuccagcu

SEQ ID NO: 1879706 - RNA, 18 nt, Human
cagcgccaggcugaccac

SEQ ID NO: 1879707 - RNA, 19 nt, Human
cagcgccaggcugaccaca

SEQ ID NO: 1879708 - RNA, 20 nt, Human
cagcgccaggcugaccacag

SEQ ID NO: 1879709 - RNA, 21 nt, Human
cagcgccaggcugaccacagc

SEQ ID NO: 1879710 - RNA, 22 nt, Human
cagcgccaggcugaccacagca

SEQ ID NO: 1879711 - RNA, 19 nt, Human
cagccugcuaauuccccag

SEQ ID NO: 1879712 - RNA, 17 nt, Human
cagccucugaaaaccaa

SEQ ID NO: 1879713 - RNA, 19 nt, Human
cagccgagauagccaaggc

SEQ ID NO: 1879714 - RNA, 20 nt, Human
cagccgagauagccaaggcc

SEQ ID NO: 1879715 - RNA, 23 nt, Human
cauucuaggccuccuggcccagg

SEQ ID NO: 1879716 - RNA, 22 nt, Human
cauucuacuugcucuggaccug

SEQ ID NO: 1879717 - RNA, 23 nt, Human
cauucuacuugcucuggaccugc

SEQ ID NO: 1879718 - RNA, 13 nt, Human
cauucuccaccug

SEQ ID NO: 1879719 - RNA, 14 nt, Human
cauucuccaccugc

SEQ ID NO: 1879720 - RNA, 16 nt, Human
cauucuccaccugcca

SEQ ID NO: 1879721 - RNA, 18 nt, Human
cauucuccacagcaaccc

SEQ ID NO: 1879722 - RNA, 15 nt, Human
cauucuccacagcaa

SEQ ID NO: 1879723 - RNA, 17 nt, Human
cauucuccacagcaacc

SEQ ID NO: 1879724 - RNA, 13 nt, Human
cauucuaaugaug

SEQ ID NO: 1879725 - RNA, 22 nt, Human
cauucuaaugauggcccauucu

SEQ ID NO: 1879726 - RNA, 14 nt, Human
cauucguucugugg

SEQ ID NO: 1879727 - RNA, 16 nt, Human
cauucgguguggugca

SEQ ID NO: 1879728 - RNA, 15 nt, Human
cauucuacugaaaag

SEQ ID NO: 1879729 - RNA, 11 nt, Human
cauucuacuug

SEQ ID NO: 1879730 - RNA, 12 nt, Human
cauucuacuugc

SEQ ID NO: 1879731 - RNA, 19 nt, Human
cauucuaaugauggcccau

SEQ ID NO: 1879732 - RNA, 13 nt, Human
cauucuacuugcu

SEQ ID NO: 1879733 - RNA, 14 nt, Human
cauucuacuugcuc

SEQ ID NO: 1879734 - RNA, 15 nt, Human
cauucuacuugcucu

SEQ ID NO: 1879735 - RNA, 16 nt, Human
cauucuacuugcucug

SEQ ID NO: 1879736 - RNA, 17 nt, Human
cauucuacuugcucugg

SEQ ID NO: 1879737 - RNA, 18 nt, Human
cauucuacuugcucugga

SEQ ID NO: 1879738 - RNA, 20 nt, Human
cauucuacuugcucuggacc

SEQ ID NO: 1879739 - RNA, 21 nt, Human
cauucuacuugcucuggaccu

SEQ ID NO: 1879740 - RNA, 13 nt, Human
cauguugugccuc

SEQ ID NO: 1879741 - RNA, 18 nt, Human
cauguugugccucccugg

SEQ ID NO: 1879742 - RNA, 19 nt, Human
cauguugugccucccuggu

SEQ ID NO: 1879743 - RNA, 21 nt, Human
cauguugugccucccugguga

SEQ ID NO: 1879744 - RNA, 20 nt, Human
cauguugugccucccuggug

SEQ ID NO: 1879745 - RNA, 15 nt, Human
cauguuggccaggcu

SEQ ID NO: 1879746 - RNA, 14 nt, Human
cauguuggccaggc

SEQ ID NO: 1879747 - RNA, 16 nt, Human
cauguuggccaggcug

SEQ ID NO: 1879748 - RNA, 13 nt, Human
cauguagcccccu

SEQ ID NO: 1879749 - RNA, 17 nt, Human
cauguagcccccuggcc

SEQ ID NO: 1879750 - RNA, 18 nt, Human
cauguagcccccuggccu

SEQ ID NO: 1879751 - RNA, 20 nt, Human
cauguagcccccuggccucu

SEQ ID NO: 1879752 - RNA, 21 nt, Human
cauguagcccccuggccucug

SEQ ID NO: 1879753 - RNA, 22 nt, Human
cauguagcccccuggccucugu

SEQ ID NO: 1879754 - RNA, 14 nt, Human
cauguagaaaacaa

SEQ ID NO: 1879755 - RNA, 22 nt, Human
cauggcuauaaacaauuacaug

SEQ ID NO: 1879756 - RNA, 17 nt, Human
cauggcugccaauggga

SEQ ID NO: 1879757 - RNA, 17 nt, Human
cauggcucccccuccac

SEQ ID NO: 1879758 - RNA, 14 nt, Human
caugggaaugaaug

SEQ ID NO: 1879759 - RNA, 15 nt, Human
caugggaaugaaugu

SEQ ID NO: 1879760 - RNA, 16 nt, Human
caugggaaugaauguc

SEQ ID NO: 1879761 - RNA, 17 nt, Human
caugggaaugaauguca

SEQ ID NO: 1879762 - RNA, 13 nt, Human
caugauguuuucc

SEQ ID NO: 1879763 - RNA, 20 nt, Human
caugauuuacagagaaguga

SEQ ID NO: 1879764 - RNA, 12 nt, Human
caugauuuccuu

SEQ ID NO: 1879765 - RNA, 14 nt, Human
caugauuuccuuga

SEQ ID NO: 1879766 - RNA, 16 nt, Human
caugauuuccuugaau

SEQ ID NO: 1879767 - RNA, 17 nt, Human
caugauuuccuugaaug

SEQ ID NO: 1879768 - RNA, 23 nt, Human
caugcuacacacugcauguuugu

SEQ ID NO: 1879769 - RNA, 20 nt, Human
caugcuacacacugcauguu

SEQ ID NO: 1879770 - RNA, 14 nt, Human
caugcuacacacug

SEQ ID NO: 1879771 - RNA, 18 nt, Human
caugauuuccuugaaugu

SEQ ID NO: 1879772 - RNA, 20 nt, Human
caugauggcaacagaucugg

SEQ ID NO: 1879773 - RNA, 20 nt, Human
cauauggacucugcacauga

SEQ ID NO: 1879774 - RNA, 17 nt, Human
cauauggacucugcaca

SEQ ID NO: 1879775 - RNA, 15 nt, Human
cauauggacucugca

SEQ ID NO: 1879776 - RNA, 18 nt, Human
cauauggacucugcacau

SEQ ID NO: 1879777 - RNA, 22 nt, Human
caguggugguuuucuguucuuu

SEQ ID NO: 1879778 - RNA, 21 nt, Human
caguggugguuuucuguucuu

SEQ ID NO: 1879779 - RNA, 20 nt, Human
caguggugguuuucuguucu

SEQ ID NO: 1879780 - RNA, 19 nt, Human
caguggugguuuucuguuc

SEQ ID NO: 1879781 - RNA, 18 nt, Human
cauauucuguuggccagu

SEQ ID NO: 1879782 - RNA, 17 nt, Human
cauauucuguuggccag

SEQ ID NO: 1879783 - RNA, 16 nt, Human
cauauuaccacagaca

SEQ ID NO: 1879784 - RNA, 14 nt, Human
cauauuaauacaau

SEQ ID NO: 1879785 - RNA, 23 nt, Human
cauauuaauacaaugaugcuauu

SEQ ID NO: 1879786 - RNA, 15 nt, Human
cauccuggcacccgg

SEQ ID NO: 1879787 - RNA, 12 nt, Human
caucacuucccu

SEQ ID NO: 1879788 - RNA, 14 nt, Human
caucacuucccuac

SEQ ID NO: 1879789 - RNA, 15 nt, Human
cauccccugugggaa

SEQ ID NO: 1879790 - RNA, 21 nt, Human
cauccccuguagagugggagc

SEQ ID NO: 1879791 - RNA, 22 nt, Human
cauccuggcacccggccccugc

SEQ ID NO: 1879792 - RNA, 12 nt, Human
cauccuggaaua

SEQ ID NO: 1879793 - RNA, 13 nt, Human
caucgcacugugg

SEQ ID NO: 1879794 - RNA, 14 nt, Human
caucgcacugugga

SEQ ID NO: 1879795 - RNA, 13 nt, Human
caucgccagacaa

SEQ ID NO: 1879796 - RNA, 16 nt, Human
caucgccagcugauga

SEQ ID NO: 1879797 - RNA, 20 nt, Human
caucgccagcugaugacuca

SEQ ID NO: 1879798 - RNA, 21 nt, Human
caucgccagcugaugacucaa

SEQ ID NO: 1879799 - RNA, 20 nt, Human
caucugcucuccuuccugga

SEQ ID NO: 1879800 - RNA, 18 nt, Human
caucugcucuccuuccug

SEQ ID NO: 1879801 - RNA, 16 nt, Human
caucugcucuccuucc

SEQ ID NO: 1879802 - RNA, 16 nt, Human
caucuggaaucuggag

SEQ ID NO: 1879803 - RNA, 21 nt, Human
caucuggaaucuggagaccag

SEQ ID NO: 1879804 - RNA, 17 nt, Human
caucugugcacugccca

SEQ ID NO: 1879805 - RNA, 18 nt, Human
caucugugcacugcccau

SEQ ID NO: 1879806 - RNA, 21 nt, Human
caucugugcacugcccaugga

SEQ ID NO: 1879807 - RNA, 14 nt, Human
ccaaucauuuuaau

SEQ ID NO: 1879808 - RNA, 12 nt, Human
ccaaucauuuua

SEQ ID NO: 1879809 - RNA, 22 nt, Human
ccaauauuuucuuuaaugcuuu

SEQ ID NO: 1879810 - RNA, 17 nt, Human
ccaauauuuaccagacc

SEQ ID NO: 1879811 - RNA, 20 nt, Human
ccaauauuuucuuuaaugcu

SEQ ID NO: 1879812 - RNA, 22 nt, Human
ccaaucauuuuaauuauuauuc

SEQ ID NO: 1879813 - RNA, 15 nt, Human
ccaaucauauuaaua

SEQ ID NO: 1879814 - RNA, 15 nt, Human
ccaaugauggucacc

SEQ ID NO: 1879815 - RNA, 14 nt, Human
ccaaugcacuuugu

SEQ ID NO: 1879816 - RNA, 13 nt, Human
ccaagcucugcuc

SEQ ID NO: 1879817 - RNA, 17 nt, Human
ccaagcucugcuccucu

SEQ ID NO: 1879818 - RNA, 12 nt, Human
ccaagcucugcu

SEQ ID NO: 1879819 - RNA, 18 nt, Human
ccaagcucugcuccucuc

SEQ ID NO: 1879820 - RNA, 23 nt, Human
ccaagcugccuccccucuccuuc

SEQ ID NO: 1879821 - RNA, 16 nt, Human
ccaacucaccccagcc

SEQ ID NO: 1879822 - RNA, 17 nt, Human
ccaacucaccccagccc

SEQ ID NO: 1879823 - RNA, 18 nt, Human
ccaacucaccccagcccc

SEQ ID NO: 1879824 - RNA, 18 nt, Human
ccaaauguucaucaauga

SEQ ID NO: 1879825 - RNA, 21 nt, Human
ccaacucuagcuggggguggg

SEQ ID NO: 1879826 - RNA, 14 nt, Human
ccaacucuagcugg

SEQ ID NO: 1879827 - RNA, 23 nt, Human
ccaaauggaaaugggcagagcag

SEQ ID NO: 1879828 - RNA, 14 nt, Human
ccaacucaccccag

SEQ ID NO: 1879829 - RNA, 17 nt, Human
ccaaauguucaucaaug

SEQ ID NO: 1879830 - RNA, 17 nt, Human
ccaaugggagcucaugg

SEQ ID NO: 1879831 - RNA, 15 nt, Human
ccaauguaggagcug

SEQ ID NO: 1879832 - RNA, 19 nt, Human
ccaaugugaacagcggcug

SEQ ID NO: 1879833 - RNA, 17 nt, Human
ccaauguaggagcugcc

SEQ ID NO: 1879834 - RNA, 20 nt, Human
ccaauguaggagcugccuug

SEQ ID NO: 1879835 - RNA, 22 nt, Human
cauuuuuuuuaagaaaaaggau

SEQ ID NO: 1879836 - RNA, 20 nt, Human
ccaaaacucuccucugcugc

SEQ ID NO: 1879837 - RNA, 21 nt, Human
ccaaaacucuccucugcugcu

SEQ ID NO: 1879838 - RNA, 22 nt, Human
ccaaaagaagcccccagcuaag

SEQ ID NO: 1879839 - RNA, 16 nt, Human
cauuuguguugaagag

SEQ ID NO: 1879840 - RNA, 12 nt, Human
cauuuguauauu

SEQ ID NO: 1879841 - RNA, 20 nt, Human
cauuuguguugaagagguuu

SEQ ID NO: 1879842 - RNA, 17 nt, Human
cauuuuuuuccaggcug

SEQ ID NO: 1879843 - RNA, 15 nt, Human
cauuuuuuuccaggc

SEQ ID NO: 1879844 - RNA, 18 nt, Human
cauuuuuuuccaggcugg

SEQ ID NO: 1879845 - RNA, 21 nt, Human
ccaccuuugaagaaguaagga

SEQ ID NO: 1879846 - RNA, 17 nt, Human
ccaccgccuccuacagc

SEQ ID NO: 1879847 - RNA, 13 nt, Human
ccaccgcccagag

SEQ ID NO: 1879848 - RNA, 17 nt, Human
ccaccgcccagagaccc

SEQ ID NO: 1879849 - RNA, 13 nt, Human
ccaccgccuccua

SEQ ID NO: 1879850 - RNA, 13 nt, Human
ccaccgcagacag

SEQ ID NO: 1879851 - RNA, 18 nt, Human
ccaccgaagccgccugug

SEQ ID NO: 1879852 - RNA, 22 nt, Human
ccaccgcagacaggaccaggga

SEQ ID NO: 1879853 - RNA, 16 nt, Human
ccacgcccccacuggu

SEQ ID NO: 1879854 - RNA, 17 nt, Human
ccacgcccccacuggug

SEQ ID NO: 1879855 - RNA, 18 nt, Human
ccacgcccccacugguga

SEQ ID NO: 1879856 - RNA, 19 nt, Human
ccacgcccccacuggugac

SEQ ID NO: 1879857 - RNA, 23 nt, Human
ccacagcgcuggccgggaccccg

SEQ ID NO: 1879858 - RNA, 14 nt, Human
ccacagcacagcca

SEQ ID NO: 1879859 - RNA, 19 nt, Human
ccacagcaaccccaggcug

SEQ ID NO: 1879860 - RNA, 20 nt, Human
ccacagcaaccccaggcuga

SEQ ID NO: 1879861 - RNA, 15 nt, Human
ccaccaucaagccac

SEQ ID NO: 1879862 - RNA, 17 nt, Human
ccaccacacccagccca

SEQ ID NO: 1879863 - RNA, 21 nt, Human
ccaccacacugauccagcccu

SEQ ID NO: 1879864 - RNA, 13 nt, Human
ccaccaucaagcc

SEQ ID NO: 1879865 - RNA, 14 nt, Human
ccaccaucaagcca

SEQ ID NO: 1879866 - RNA, 17 nt, Human
ccacucccugcaaccug

SEQ ID NO: 1879867 - RNA, 14 nt, Human
ccacuccuccuagc

SEQ ID NO: 1879868 - RNA, 22 nt, Human
ccugccucccgcccccuuggcu

SEQ ID NO: 1879869 - RNA, 19 nt, Human
ccugccucgaacuggcugc

SEQ ID NO: 1879870 - RNA, 23 nt, Human
ccugccuccagggcuggacugag

SEQ ID NO: 1879871 - RNA, 14 nt, Human
ccugccuccauccu

SEQ ID NO: 1879872 - RNA, 17 nt, Human
ccugccuccauccuagu

SEQ ID NO: 1879873 - RNA, 21 nt, Human
ccugccuccagggcuggacug

SEQ ID NO: 1879874 - RNA, 20 nt, Human
ccugccuccagggcuggacu

SEQ ID NO: 1879875 - RNA, 17 nt, Human
ccugccuccagggcugg

SEQ ID NO: 1879876 - RNA, 16 nt, Human
ccugccuccagggcug

SEQ ID NO: 1879877 - RNA, 15 nt, Human
ccugccuccagggcu

SEQ ID NO: 1879878 - RNA, 15 nt, Human
ccugccuccaggaac

SEQ ID NO: 1879879 - RNA, 20 nt, Human
ccugccuccaggaaccacac

SEQ ID NO: 1879880 - RNA, 23 nt, Human
ccugccucgaacuggcugcaaag

SEQ ID NO: 1879881 - RNA, 21 nt, Human
ccugccucgaacuggcugcaa

SEQ ID NO: 1879882 - RNA, 17 nt, Human
ccugcugcaguugccag

SEQ ID NO: 1879883 - RNA, 19 nt, Human
ccugcugcaguugccaguc

SEQ ID NO: 1879884 - RNA, 21 nt, Human
ccugcugcaguugccagucac

SEQ ID NO: 1879885 - RNA, 20 nt, Human
ccugcugcaguugccaguca

SEQ ID NO: 1879886 - RNA, 12 nt, Human
ccugccuccagg

SEQ ID NO: 1879887 - RNA, 14 nt, Human
ccugccuccaggaa

SEQ ID NO: 1879888 - RNA, 13 nt, Human
ccugcccaggccc

SEQ ID NO: 1879889 - RNA, 24 nt, Human
ccugccccaacucuccccugaccu

SEQ ID NO: 1879890 - RNA, 20 nt, Human
ccugccccaaucccuuuauu

SEQ ID NO: 1879891 - RNA, 12 nt, Human
ccugcccaccug

SEQ ID NO: 1879892 - RNA, 13 nt, Human
ccugcccaccugg

SEQ ID NO: 1879893 - RNA, 14 nt, Human
ccugcccaccuggc

SEQ ID NO: 1879894 - RNA, 20 nt, Human
ccugcccaccuggccucugc

SEQ ID NO: 1879895 - RNA, 19 nt, Human
ccugcacuugcagacucua

SEQ ID NO: 1879896 - RNA, 18 nt, Human
ccugcacuugcagacucu

SEQ ID NO: 1879897 - RNA, 17 nt, Human
ccugcacuugcagacuc

SEQ ID NO: 1879898 - RNA, 16 nt, Human
ccugcacuugcagacu

SEQ ID NO: 1879899 - RNA, 16 nt, Human
ccucuuucccucccuu

SEQ ID NO: 1879900 - RNA, 13 nt, Human
ccucuuucccucc

SEQ ID NO: 1879901 - RNA, 20 nt, Human
ccugaccacgcuuucuagcu

SEQ ID NO: 1879902 - RNA, 11 nt, Human
ccucuuucccu

SEQ ID NO: 1879903 - RNA, 20 nt, Human
ccuguaaucauauaauaaau

SEQ ID NO: 1879904 - RNA, 15 nt, Human
ccuguaaucacagcu

SEQ ID NO: 1879905 - RNA, 18 nt, Human
ccuguaaucccagcacuu

SEQ ID NO: 1879906 - RNA, 15 nt, Human
ccugguuuagccugg

SEQ ID NO: 1879907 - RNA, 16 nt, Human
ccugguucucaucuuu

SEQ ID NO: 1879908 - RNA, 15 nt, Human
ccugguucucaucuu

SEQ ID NO: 1879909 - RNA, 14 nt, Human
ccugguucucaucu

SEQ ID NO: 1879910 - RNA, 23 nt, Human
ccuggugggccaacaaagaacac

SEQ ID NO: 1879911 - RNA, 16 nt, Human
ccugggggcucucaug

SEQ ID NO: 1879912 - RNA, 14 nt, Human
ccuggugggccaac

SEQ ID NO: 1879913 - RNA, 21 nt, Human
ccugguggcagugggagcugc

SEQ ID NO: 1879914 - RNA, 18 nt, Human
ccugggggcugggcagag

SEQ ID NO: 1879915 - RNA, 12 nt, Human
ccugggggcucu

SEQ ID NO: 1879916 - RNA, 13 nt, Human
ccugggggcucuc

SEQ ID NO: 1879917 - RNA, 14 nt, Human
ccugggggcucuca

SEQ ID NO: 1879918 - RNA, 12 nt, Human
ccugggccugca

SEQ ID NO: 1879919 - RNA, 15 nt, Human
ccugucuaaugaaac

SEQ ID NO: 1879920 - RNA, 22 nt, Human
ccugucuaaugaaaccuguguc

SEQ ID NO: 1879921 - RNA, 14 nt, Human
ccugucuagagagg

SEQ ID NO: 1879922 - RNA, 16 nt, Human
ccugucuagagaggga

SEQ ID NO: 1879923 - RNA, 17 nt, Human
ccugucuagagagggag

SEQ ID NO: 1879924 - RNA, 15 nt, Human
ccugucugccagggc

SEQ ID NO: 1879925 - RNA, 14 nt, Human
ccuggccucugugc

SEQ ID NO: 1879926 - RNA, 22 nt, Human
ccuggccucugcacuccccugc

SEQ ID NO: 1879927 - RNA, 13 nt, Human
ccuggccucugug

SEQ ID NO: 1879928 - RNA, 22 nt, Human
ccuggccuagcauacguacaca

SEQ ID NO: 1879929 - RNA, 20 nt, Human
ccuggccucugcacuccccu

SEQ ID NO: 1879930 - RNA, 21 nt, Human
ccuggccucugcacuccccug

SEQ ID NO: 1879931 - RNA, 17 nt, Human
ccucccaccucagccuc

SEQ ID NO: 1879932 - RNA, 15 nt, Human
ccucccaccucagcc

SEQ ID NO: 1879933 - RNA, 19 nt, Human
ccuccaaccuggggggcag

SEQ ID NO: 1879934 - RNA, 19 nt, Human
ccuccaacaccaagcacag

SEQ ID NO: 1879935 - RNA, 16 nt, Human
ccucccaucucacaca

SEQ ID NO: 1879936 - RNA, 13 nt, Human
ccucccaucucac

SEQ ID NO: 1879937 - RNA, 20 nt, Human
ccucagccuggccagacaca

SEQ ID NO: 1879938 - RNA, 21 nt, Human
ccucagccuggccagacacag

SEQ ID NO: 1879939 - RNA, 22 nt, Human
ccucagccuggccagacacagg

SEQ ID NO: 1879940 - RNA, 17 nt, Human
ccucagccuugccagag

SEQ ID NO: 1879941 - RNA, 18 nt, Human
ccucagccuugccagaga

SEQ ID NO: 1879942 - RNA, 19 nt, Human
ccucagccuugccagagau

SEQ ID NO: 1879943 - RNA, 20 nt, Human
ccucagccuugccagagauc

SEQ ID NO: 1879944 - RNA, 21 nt, Human
ccucagccuugccagagaucc

SEQ ID NO: 1879945 - RNA, 14 nt, Human
ccggccccugcugg

SEQ ID NO: 1879946 - RNA, 15 nt, Human
cccuucgcuccugug

SEQ ID NO: 1879947 - RNA, 14 nt, Human
cccuucgcuccugu

SEQ ID NO: 1879948 - RNA, 21 nt, Human
cccuucucuccagccccugga

SEQ ID NO: 1879949 - RNA, 22 nt, Human
cccuucucuccagccccuggau

SEQ ID NO: 1879950 - RNA, 23 nt, Human
ccgcaggauuugggcucuuggaa

SEQ ID NO: 1879951 - RNA, 15 nt, Human
ccgcagugugcacua

SEQ ID NO: 1879952 - RNA, 23 nt, Human
ccgcagugugcacuaaggggccc

SEQ ID NO: 1879953 - RNA, 22 nt, Human
ccgcagugugcacuaaggggcc

SEQ ID NO: 1879954 - RNA, 13 nt, Human
ccgcauccccugc

SEQ ID NO: 1879955 - RNA, 14 nt, Human
ccgcauccccugcc

SEQ ID NO: 1879956 - RNA, 15 nt, Human
ccgcauccccugccu

SEQ ID NO: 1879957 - RNA, 16 nt, Human
ccgcauccccugccuc

SEQ ID NO: 1879958 - RNA, 17 nt, Human
ccgcauccccugccucc

SEQ ID NO: 1879959 - RNA, 18 nt, Human
ccgcauccccugccucca

SEQ ID NO: 1879960 - RNA, 22 nt, Human
ccgcauccccugccuccauccu

SEQ ID NO: 1879961 - RNA, 13 nt, Human
ccggccccugcug

SEQ ID NO: 1879962 - RNA, 13 nt, Human
cccuucgcuccug

SEQ ID NO: 1879963 - RNA, 20 nt, Human
cccugugauggggcccugcc

SEQ ID NO: 1879964 - RNA, 18 nt, Human
cccugugauggggcccug

SEQ ID NO: 1879965 - RNA, 19 nt, Human
cccugugauggggcccugc

SEQ ID NO: 1879966 - RNA, 17 nt, Human
cccugugauggggcccu

SEQ ID NO: 1879967 - RNA, 16 nt, Human
cccugucuagagaggg

SEQ ID NO: 1879968 - RNA, 17 nt, Human
cccugucuagagaggga

SEQ ID NO: 1879969 - RNA, 20 nt, Human
cccugucuagagagggaggc

SEQ ID NO: 1879970 - RNA, 16 nt, Human
cccugucugccagggc

SEQ ID NO: 1879971 - RNA, 16 nt, Human
cccugucuaaugaaac

SEQ ID NO: 1879972 - RNA, 12 nt, Human
cccugucuagag

SEQ ID NO: 1879973 - RNA, 20 nt, Human
cccugucucaaaaaaagaaa

SEQ ID NO: 1879974 - RNA, 23 nt, Human
cccugucucaaaaaaagaaaaag

SEQ ID NO: 1879975 - RNA, 23 nt, Human
ccagcguggcgcaguggcccuga

SEQ ID NO: 1879976 - RNA, 13 nt, Human
ccagcuaagaacc

SEQ ID NO: 1879977 - RNA, 14 nt, Human
ccagcuaagaaccu

SEQ ID NO: 1879978 - RNA, 15 nt, Human
ccagcuaagaaccug

SEQ ID NO: 1879979 - RNA, 17 nt, Human
ccagcuaagaaccugga

SEQ ID NO: 1879980 - RNA, 18 nt, Human
ccagcuaagaaccuggaa

SEQ ID NO: 1879981 - RNA, 19 nt, Human
ccagcuaagaaccuggaac

SEQ ID NO: 1879982 - RNA, 17 nt, Human
ccagcuacaccuuucuc

SEQ ID NO: 1879983 - RNA, 13 nt, Human
ccagcucaggaca

SEQ ID NO: 1879984 - RNA, 19 nt, Human
ccagcucaggacagaugcc

SEQ ID NO: 1879985 - RNA, 23 nt, Human
ccagcucaggacagaugccacac

SEQ ID NO: 1879986 - RNA, 20 nt, Human
ccagcucaggacagaugcca

SEQ ID NO: 1879987 - RNA, 19 nt, Human
ccagcagccuggacccugu

SEQ ID NO: 1879988 - RNA, 20 nt, Human
ccagcagccuggacccugug

SEQ ID NO: 1879989 - RNA, 15 nt, Human
ccagcagccuggacc

SEQ ID NO: 1879990 - RNA, 14 nt, Human
ccagcagccuggac

SEQ ID NO: 1879991 - RNA, 10 nt, Human
ccagccccuu

SEQ ID NO: 1879992 - RNA, 21 nt, Human
ccagccccuggccccaggacc

SEQ ID NO: 1879993 - RNA, 23 nt, Human
ccagccccuggccccaggaccug

SEQ ID NO: 1879994 - RNA, 21 nt, Human
ccagccccuggaugcagccuc

SEQ ID NO: 1879995 - RNA, 13 nt, Human
ccagccccuggcc

SEQ ID NO: 1879996 - RNA, 21 nt, Human
ccaggaaaggcuccaggagca

SEQ ID NO: 1879997 - RNA, 22 nt, Human
ccaggaaaggcuccaggagcag

SEQ ID NO: 1879998 - RNA, 23 nt, Human
ccaggaaaggcuccaggagcagc

SEQ ID NO: 1879999 - RNA, 23 nt, Human
ccagcagagcaccuuagacaguc

SEQ ID NO: 1880000 - RNA, 19 nt, Human
ccagcagagcaccuuagac

SEQ ID NO: 1880001 - RNA, 20 nt, Human
ccacucucccccacccccuc

SEQ ID NO: 1880002 - RNA, 21 nt, Human
ccaggaguguggccacguggg

SEQ ID NO: 1880003 - RNA, 18 nt, Human
ccaggauuccucuuuucu

SEQ ID NO: 1880004 - RNA, 15 nt, Human
ccaggauuccucuuu

SEQ ID NO: 1880005 - RNA, 13 nt, Human
ccaggcugggaga

SEQ ID NO: 1880006 - RNA, 14 nt, Human
ccaggcugggagag

SEQ ID NO: 1880007 - RNA, 15 nt, Human
ccaggcugggagagc

SEQ ID NO: 1880008 - RNA, 17 nt, Human
ccaggcugggagagccu

SEQ ID NO: 1880009 - RNA, 18 nt, Human
ccaggcugggagagccuu

SEQ ID NO: 1880010 - RNA, 21 nt, Human
ccaggcugggagagccuucca

SEQ ID NO: 1880011 - RNA, 22 nt, Human
ccaggcugggagagccuuccag

SEQ ID NO: 1880012 - RNA, 21 nt, Human
ccagucacugugagcucccag

SEQ ID NO: 1880013 - RNA, 17 nt, Human
ccaguccccccacccuc

SEQ ID NO: 1880014 - RNA, 15 nt, Human
ccaguccccccaccc

SEQ ID NO: 1880015 - RNA, 12 nt, Human
ccagucaccccg

SEQ ID NO: 1880016 - RNA, 13 nt, Human
ccagucaccccgg

SEQ ID NO: 1880017 - RNA, 20 nt, Human
ccagucaccccggccaccug

SEQ ID NO: 1880018 - RNA, 21 nt, Human
ccagucaccccggccaccugc

SEQ ID NO: 1880019 - RNA, 22 nt, Human
ccagggggccagucccugaggc

SEQ ID NO: 1880020 - RNA, 13 nt, Human
ccauuuccugaga

SEQ ID NO: 1880021 - RNA, 18 nt, Human
ccauuuauacaaauuaga

SEQ ID NO: 1880022 - RNA, 21 nt, Human
ccauugaaggcuuaaacccau

SEQ ID NO: 1880023 - RNA, 17 nt, Human
ccauugaaggcuuaaac

SEQ ID NO: 1880024 - RNA, 12 nt, Human
ccauugaaggcu

SEQ ID NO: 1880025 - RNA, 11 nt, Human
ccauugaaggc

SEQ ID NO: 1880026 - RNA, 17 nt, Human
ccauucuuucugauaac

SEQ ID NO: 1880027 - RNA, 15 nt, Human
ccauucuuuuguaau

SEQ ID NO: 1880028 - RNA, 16 nt, Human
ccauucuuuuguaauu

SEQ ID NO: 1880029 - RNA, 18 nt, Human
ccauucuuuuguaauuua

SEQ ID NO: 1880030 - RNA, 22 nt, Human
ccauucuuuuguaauuuaaaug

SEQ ID NO: 1880031 - RNA, 12 nt, Human
ccauucuuucug

SEQ ID NO: 1880032 - RNA, 13 nt, Human
ccauucuuucuga

SEQ ID NO: 1880033 - RNA, 15 nt, Human
ccaugggccuccugu

SEQ ID NO: 1880034 - RNA, 14 nt, Human
ccaugggccuccug

SEQ ID NO: 1880035 - RNA, 23 nt, Human
ccaucccaaacccuucagugcca

SEQ ID NO: 1880036 - RNA, 12 nt, Human
ccaucccagccc

SEQ ID NO: 1880037 - RNA, 13 nt, Human
ccaugggccuccu

SEQ ID NO: 1880038 - RNA, 16 nt, Human
ccaugaguccccuguu

SEQ ID NO: 1880039 - RNA, 14 nt, Human
ccaugaguccccug

SEQ ID NO: 1880040 - RNA, 15 nt, Human
ccaugaguccccugu

SEQ ID NO: 1880041 - RNA, 19 nt, Human
ccaugagccucagcauccu

SEQ ID NO: 1880042 - RNA, 13 nt, Human
ccaugaguccccu

SEQ ID NO: 1880043 - RNA, 18 nt, Human
ccaugagccucagcaucc

SEQ ID NO: 1880044 - RNA, 14 nt, Human
ccaugagccucagc

SEQ ID NO: 1880045 - RNA, 16 nt, Human
ccauccccuguagagu

SEQ ID NO: 1880046 - RNA, 22 nt, Human
ccauccccuguagagugggagc

SEQ ID NO: 1880047 - RNA, 17 nt, Human
ccauccccgcagugugc

SEQ ID NO: 1880048 - RNA, 14 nt, Human
ccauccccgcagug

SEQ ID NO: 1880049 - RNA, 23 nt, Human
cccagcugugcucuggacaggca

SEQ ID NO: 1880050 - RNA, 21 nt, Human
cccagcugugcucuggacagg

SEQ ID NO: 1880051 - RNA, 11 nt, Human
cccagcuguuu

SEQ ID NO: 1880052 - RNA, 22 nt, Human
cccagcuuaaaggggcuagagu

SEQ ID NO: 1880053 - RNA, 19 nt, Human
cccaggaaaggcuccagga

SEQ ID NO: 1880054 - RNA, 23 nt, Human
cccaggaaaggcuccaggagcag

SEQ ID NO: 1880055 - RNA, 21 nt, Human
cccaggaaaggcuccaggagc

SEQ ID NO: 1880056 - RNA, 22 nt, Human
cccaggaaaggcuccaggagca

SEQ ID NO: 1880057 - RNA, 15 nt, Human
cccaggcuuagucac

SEQ ID NO: 1880058 - RNA, 20 nt, Human
cccaggcuuagucacugaga

SEQ ID NO: 1880059 - RNA, 21 nt, Human
cccaggcuggcgugcaguggu

SEQ ID NO: 1880060 - RNA, 14 nt, Human
cccagcccacuucu

SEQ ID NO: 1880061 - RNA, 17 nt, Human
cccagcccacuucugcc

SEQ ID NO: 1880062 - RNA, 24 nt, Human
cccagcacugaggaagaacggggc

SEQ ID NO: 1880063 - RNA, 15 nt, Human
cccagcacuuuggga

SEQ ID NO: 1880064 - RNA, 15 nt, Human
cccagcacugaggaa

SEQ ID NO: 1880065 - RNA, 15 nt, Human
ccauuucucuccuca

SEQ ID NO: 1880066 - RNA, 12 nt, Human
ccauuucuauuu

SEQ ID NO: 1880067 - RNA, 13 nt, Human
ccauuucuauuua

SEQ ID NO: 1880068 - RNA, 14 nt, Human
ccauuucuauuuau

SEQ ID NO: 1880069 - RNA, 17 nt, Human
ccauuucuauuuauuua

SEQ ID NO: 1880070 - RNA, 11 nt, Human
ccauuucucuc

SEQ ID NO: 1880071 - RNA, 22 nt, Human
cccauucugccugcccaggccc

SEQ ID NO: 1880072 - RNA, 21 nt, Human
cccauucugccugcccaggcc

SEQ ID NO: 1880073 - RNA, 20 nt, Human
cccauucugccugcccaggc

SEQ ID NO: 1880074 - RNA, 19 nt, Human
cccauuucuauuuauuuac

SEQ ID NO: 1880075 - RNA, 20 nt, Human
cccauuucuauuuauuuacu

SEQ ID NO: 1880076 - RNA, 17 nt, Human
ccccauccucuguacag

SEQ ID NO: 1880077 - RNA, 20 nt, Human
ccccagcaagugagagcugg

SEQ ID NO: 1880078 - RNA, 19 nt, Human
ccccagcaagugagagcug

SEQ ID NO: 1880079 - RNA, 22 nt, Human
ccccauccucuguacagagccc

SEQ ID NO: 1880080 - RNA, 19 nt, Human
ccccauccucuguacagag

SEQ ID NO: 1880081 - RNA, 21 nt, Human
ccccauccucuguacagagcc

SEQ ID NO: 1880082 - RNA, 17 nt, Human
ccccagcaagugagagc

SEQ ID NO: 1880083 - RNA, 23 nt, Human
ccccagauugcaacaggcugggc

SEQ ID NO: 1880084 - RNA, 22 nt, Human
ccccagauugcaacaggcuggg

SEQ ID NO: 1880085 - RNA, 21 nt, Human
ccccagauugcaacaggcugg

SEQ ID NO: 1880086 - RNA, 23 nt, Human
cccauucugccugcccaggcccc

SEQ ID NO: 1880087 - RNA, 15 nt, Human
cccauuucuauuuau

SEQ ID NO: 1880088 - RNA, 16 nt, Human
cccauuucuauuuauu

SEQ ID NO: 1880089 - RNA, 17 nt, Human
cccauuucuauuuauuu

SEQ ID NO: 1880090 - RNA, 22 nt, Human
cccagggcuuacggcccuggcc

SEQ ID NO: 1880091 - RNA, 17 nt, Human
ccccuucgcuccugugu

SEQ ID NO: 1880092 - RNA, 15 nt, Human
ccccuucgcuccugu

SEQ ID NO: 1880093 - RNA, 14 nt, Human
ccccuucgcuccug

SEQ ID NO: 1880094 - RNA, 19 nt, Human
ccccuucgcuccugugucu

SEQ ID NO: 1880095 - RNA, 16 nt, Human
ccccuucucucaucuc

SEQ ID NO: 1880096 - RNA, 13 nt, Human
ccccuucucucau

SEQ ID NO: 1880097 - RNA, 20 nt, Human
ccccugaccugugagcccag

SEQ ID NO: 1880098 - RNA, 15 nt, Human
ccccugaccugugag

SEQ ID NO: 1880099 - RNA, 18 nt, Human
ccccugcacuccagccug

SEQ ID NO: 1880100 - RNA, 14 nt, Human
ccccauucugccug

SEQ ID NO: 1880101 - RNA, 13 nt, Human
ccccauucugccu

SEQ ID NO: 1880102 - RNA, 15 nt, Human
ccccauucugccugc

SEQ ID NO: 1880103 - RNA, 13 nt, Human
ccccaugcacugu

SEQ ID NO: 1880104 - RNA, 19 nt, Human
ccccaugcacugugaagga

SEQ ID NO: 1880105 - RNA, 23 nt, Human
ccccaugcacugugaaggacccu

SEQ ID NO: 1880106 - RNA, 12 nt, Human
cccggcugcgga

SEQ ID NO: 1880107 - RNA, 12 nt, Human
cccgggaagggg

SEQ ID NO: 1880108 - RNA, 17 nt, Human
ccccuucugacccaugc

SEQ ID NO: 1880109 - RNA, 14 nt, Human
ccccuucugcucag

SEQ ID NO: 1880110 - RNA, 19 nt, Human
ccccuucugcucagcucug

SEQ ID NO: 1880111 - RNA, 20 nt, Human
ccccuucugcucagcucugg

SEQ ID NO: 1880112 - RNA, 21 nt, Human
ccccuucugcucagcucuggg

SEQ ID NO: 1880113 - RNA, 17 nt, Human
cccucaagaggaaguga

SEQ ID NO: 1880114 - RNA, 15 nt, Human
cccucagagugcaag

SEQ ID NO: 1880115 - RNA, 21 nt, Human
cggcucccggggcagggcagc

SEQ ID NO: 1880116 - RNA, 17 nt, Human
cgggccacagagaaagu

SEQ ID NO: 1880117 - RNA, 11 nt, Human
cgggcucagca

SEQ ID NO: 1880118 - RNA, 15 nt, Human
cgggcgcacugccuc

SEQ ID NO: 1880119 - RNA, 16 nt, Human
cgggcgcacugccucu

SEQ ID NO: 1880120 - RNA, 17 nt, Human
cgggcgcacugccucuc

SEQ ID NO: 1880121 - RNA, 22 nt, Human
cgggcgcacugccucucacagc

SEQ ID NO: 1880122 - RNA, 15 nt, Human
cgggcucagcaaaag

SEQ ID NO: 1880123 - RNA, 18 nt, Human
cgggcgcacugccucuca

SEQ ID NO: 1880124 - RNA, 14 nt, Human
cgggcucugccucc

SEQ ID NO: 1880125 - RNA, 16 nt, Human
cgggcucugccuccca

SEQ ID NO: 1880126 - RNA, 15 nt, Human
cggggacagcuccuu

SEQ ID NO: 1880127 - RNA, 18 nt, Human
cgguguggagaagcggcu

SEQ ID NO: 1880128 - RNA, 20 nt, Human
cgguguggugcagugugaaa

SEQ ID NO: 1880129 - RNA, 17 nt, Human
cgggcucugccucccau

SEQ ID NO: 1880130 - RNA, 14 nt, Human
cggggacagcuccu

SEQ ID NO: 1880131 - RNA, 22 nt, Human
cggcucccggggcagggcagcc

SEQ ID NO: 1880132 - RNA, 14 nt, Human
cgggccacagagaa

SEQ ID NO: 1880133 - RNA, 12 nt, Human
cgggccacagag

SEQ ID NO: 1880134 - RNA, 16 nt, Human
cggcuccaggcuccuu

SEQ ID NO: 1880135 - RNA, 15 nt, Human
cggcuccaggcuccu

SEQ ID NO: 1880136 - RNA, 14 nt, Human
cggcuccaggcucc

SEQ ID NO: 1880137 - RNA, 13 nt, Human
cggcuccaggcuc

SEQ ID NO: 1880138 - RNA, 15 nt, Human
cggcuccacuaggac

SEQ ID NO: 1880139 - RNA, 12 nt, Human
cggcuccaggcu

SEQ ID NO: 1880140 - RNA, 17 nt, Human
cggcucacugcagccuc

SEQ ID NO: 1880141 - RNA, 16 nt, Human
cggcucacugcagccu

SEQ ID NO: 1880142 - RNA, 14 nt, Human
cggcucacugcagc

SEQ ID NO: 1880143 - RNA, 15 nt, Human
cggcucacugcagcc

SEQ ID NO: 1880144 - RNA, 20 nt, Human
cggagucccaccuuggcugc

SEQ ID NO: 1880145 - RNA, 18 nt, Human
cggagucccaccuuggcu

SEQ ID NO: 1880146 - RNA, 16 nt, Human
cggagucccaccuugg

SEQ ID NO: 1880147 - RNA, 13 nt, Human
cggagcuggcccc

SEQ ID NO: 1880148 - RNA, 16 nt, Human
cggagcuggccccgcc

SEQ ID NO: 1880149 - RNA, 21 nt, Human
cggagcuggccccgccgccug

SEQ ID NO: 1880150 - RNA, 16 nt, Human
cgcugccacccaccuc

SEQ ID NO: 1880151 - RNA, 17 nt, Human
cgcugccacccaccucc

SEQ ID NO: 1880152 - RNA, 20 nt, Human
cgcugccacccaccucccug

SEQ ID NO: 1880153 - RNA, 15 nt, Human
cgccucccacugggg

SEQ ID NO: 1880154 - RNA, 17 nt, Human
cgccuggguccagggga

SEQ ID NO: 1880155 - RNA, 14 nt, Human
cgugcacacaccag

SEQ ID NO: 1880156 - RNA, 18 nt, Human
cgugauuuugcuguagaa

SEQ ID NO: 1880157 - RNA, 22 nt, Human
cgugaucaaagccacacucugg

SEQ ID NO: 1880158 - RNA, 20 nt, Human
cguguaaccauggacccaau

SEQ ID NO: 1880159 - RNA, 17 nt, Human
cgugaguccuggcaugg

SEQ ID NO: 1880160 - RNA, 17 nt, Human
cgugaggccagagacac

SEQ ID NO: 1880161 - RNA, 16 nt, Human
cgugaguccuggcaug

SEQ ID NO: 1880162 - RNA, 16 nt, Human
cguaaagcuagaaaug

SEQ ID NO: 1880163 - RNA, 14 nt, Human
cguaaaauuaagaa

SEQ ID NO: 1880164 - RNA, 18 nt, Human
cgguguggugcaguguga

SEQ ID NO: 1880165 - RNA, 16 nt, Human
cgguuuuacugcagcu

SEQ ID NO: 1880166 - RNA, 18 nt, Human
cgcaggagcacacccagc

SEQ ID NO: 1880167 - RNA, 23 nt, Human
cgcaggagcacacccagccccca

SEQ ID NO: 1880168 - RNA, 22 nt, Human
cgcaggauucuuccucccuccc

SEQ ID NO: 1880169 - RNA, 19 nt, Human
cgcauggucacacacugau

SEQ ID NO: 1880170 - RNA, 16 nt, Human
cgcauggucacacacu

SEQ ID NO: 1880171 - RNA, 14 nt, Human
cgauagugguggug

SEQ ID NO: 1880172 - RNA, 20 nt, Human
cgagucauucguucugugga

SEQ ID NO: 1880173 - RNA, 13 nt, Human
cgaguccaagcug

SEQ ID NO: 1880174 - RNA, 14 nt, Human
cgaguccaagcugg

SEQ ID NO: 1880175 - RNA, 15 nt, Human
cgaguccaagcuggg

SEQ ID NO: 1880176 - RNA, 15 nt, Human
cgauauacucuagau

SEQ ID NO: 1880177 - RNA, 18 nt, Human
cgagucauucguucugug

SEQ ID NO: 1880178 - RNA, 19 nt, Human
cgagucauucguucugugg

SEQ ID NO: 1880179 - RNA, 17 nt, Human
cgccagauucuuuccug

SEQ ID NO: 1880180 - RNA, 19 nt, Human
cgccaaauaaugucucugu

SEQ ID NO: 1880181 - RNA, 17 nt, Human
cgccaaauaaugucucu

SEQ ID NO: 1880182 - RNA, 14 nt, Human
cgccucccacuggg

SEQ ID NO: 1880183 - RNA, 13 nt, Human
cgccucccacugg

SEQ ID NO: 1880184 - RNA, 19 nt, Human
cgccuggcugcagccugcg

SEQ ID NO: 1880185 - RNA, 16 nt, Human
cgaccuuggccgcacc

SEQ ID NO: 1880186 - RNA, 11 nt, Human
cgaccuuggcc

SEQ ID NO: 1880187 - RNA, 23 nt, Human
cgacgccacagcccagccacgga

SEQ ID NO: 1880188 - RNA, 15 nt, Human
cgacgccacagccca

SEQ ID NO: 1880189 - RNA, 14 nt, Human
cgaccuuggccgca

SEQ ID NO: 1880190 - RNA, 19 nt, Human
cgacccuugccgucuaccu

SEQ ID NO: 1880191 - RNA, 20 nt, Human
cgacccuugccgucuaccug

SEQ ID NO: 1880192 - RNA, 14 nt, Human
cgacuaauuucaaa

SEQ ID NO: 1880193 - RNA, 18 nt, Human
cgacucuauagacucuag

SEQ ID NO: 1880194 - RNA, 20 nt, Human
cgacucuauagacucuagga

SEQ ID NO: 1880195 - RNA, 17 nt, Human
cgacugccaucuuggac

SEQ ID NO: 1880196 - RNA, 17 nt, Human
cgacugcccggcagggu

SEQ ID NO: 1880197 - RNA, 17 nt, Human
cgacacugggaggccag

SEQ ID NO: 1880198 - RNA, 16 nt, Human
cgacagcauuuuccuc

SEQ ID NO: 1880199 - RNA, 13 nt, Human
cgacaaugcaaac

SEQ ID NO: 1880200 - RNA, 12 nt, Human
cgacaaugcaaa

SEQ ID NO: 1880201 - RNA, 21 nt, Human
ccuuuuuuagaguugauacua

SEQ ID NO: 1880202 - RNA, 16 nt, Human
cgaauuuuaaaagaug

SEQ ID NO: 1880203 - RNA, 13 nt, Human
ccuuuuuuaaaag

SEQ ID NO: 1880204 - RNA, 20 nt, Human
ccuuuuuuaaaaguaaaugu

SEQ ID NO: 1880205 - RNA, 19 nt, Human
ccuuucauuuacuguggcu

SEQ ID NO: 1880206 - RNA, 18 nt, Human
ccuuucauuuacuguggc

SEQ ID NO: 1880207 - RNA, 22 nt, Human
ccuuucauuuacuguggcuucu

SEQ ID NO: 1880208 - RNA, 16 nt, Human
ccuuucauuuacugug

SEQ ID NO: 1880209 - RNA, 14 nt, Human
ccuuucauuuacug

SEQ ID NO: 1880210 - RNA, 15 nt, Human
ccuuuugagugccuu

SEQ ID NO: 1880211 - RNA, 17 nt, Human
ccuuuugagugccuuac

SEQ ID NO: 1880212 - RNA, 21 nt, Human
ccuuucaauaggaaaaacuga

SEQ ID NO: 1880213 - RNA, 14 nt, Human
ccuuuacggacacc

SEQ ID NO: 1880214 - RNA, 19 nt, Human
ccuuuacggacacccccuc

SEQ ID NO: 1880215 - RNA, 13 nt, Human
ccuuuaaugcauc

SEQ ID NO: 1880216 - RNA, 16 nt, Human
ccuugccgucuaccug

SEQ ID NO: 1880217 - RNA, 23 nt, Human
cuagcauacguacacauuuuauu

SEQ ID NO: 1880218 - RNA, 21 nt, Human
cuagcauacguacacauuuua

SEQ ID NO: 1880219 - RNA, 23 nt, Human
cuagaauuugauaugugaacagu

SEQ ID NO: 1880220 - RNA, 22 nt, Human
cuagaauuuauucaauuccucu

SEQ ID NO: 1880221 - RNA, 23 nt, Human
cuagaauuuauucaauuccucug

SEQ ID NO: 1880222 - RNA, 22 nt, Human
cuagaagauuuugaaauuuuua

SEQ ID NO: 1880223 - RNA, 13 nt, Human
cuagaacucccuu

SEQ ID NO: 1880224 - RNA, 12 nt, Human
cuagaacucccu

SEQ ID NO: 1880225 - RNA, 20 nt, Human
cuacucauacuuaagcaaaa

SEQ ID NO: 1880226 - RNA, 21 nt, Human
cuacucauacuuaagcaaaag

SEQ ID NO: 1880227 - RNA, 17 nt, Human
cuaccuuuguauucucu

SEQ ID NO: 1880228 - RNA, 18 nt, Human
cuacaugagguacugaga

SEQ ID NO: 1880229 - RNA, 20 nt, Human
cuacaugagguacugagagu

SEQ ID NO: 1880230 - RNA, 20 nt, Human
cuacaguccucccaucucac

SEQ ID NO: 1880231 - RNA, 19 nt, Human
cuacaguugaaaaacagcu

SEQ ID NO: 1880232 - RNA, 21 nt, Human
cuacaguugaaaaacagcuga

SEQ ID NO: 1880233 - RNA, 14 nt, Human
cuacaguguacagu

SEQ ID NO: 1880234 - RNA, 13 nt, Human
cuacaguguacag

SEQ ID NO: 1880235 - RNA, 22 nt, Human
cuacaguugaaaaacagcugag

SEQ ID NO: 1880236 - RNA, 19 nt, Human
cuacaguccucccaucuca

SEQ ID NO: 1880237 - RNA, 18 nt, Human
cuaauuucaaaaugcuuu

SEQ ID NO: 1880238 - RNA, 19 nt, Human
cuaauuucaaaaugcuuuu

SEQ ID NO: 1880239 - RNA, 22 nt, Human
cuaauuucaaaaugcuuuuuau

SEQ ID NO: 1880240 - RNA, 17 nt, Human
cuaauuucaaaaugcuu

SEQ ID NO: 1880241 - RNA, 21 nt, Human
cuaauuuaucuugucucuggg

SEQ ID NO: 1880242 - RNA, 17 nt, Human
cuaauuuauaaaaaggu

SEQ ID NO: 1880243 - RNA, 23 nt, Human
cuaagugauccucccaccucagc

SEQ ID NO: 1880244 - RNA, 20 nt, Human
cuaaguuuuuauggcuuuug

SEQ ID NO: 1880245 - RNA, 21 nt, Human
cuaagugguacuaacuuuccu

SEQ ID NO: 1880246 - RNA, 23 nt, Human
cuaaguuuuuauggcuuuugugc

SEQ ID NO: 1880247 - RNA, 22 nt, Human
cuaauucuuugaccuguuggga

SEQ ID NO: 1880248 - RNA, 21 nt, Human
cuaauucuuugaccuguuggg

SEQ ID NO: 1880249 - RNA, 14 nt, Human
cuaauuuauaaaaa

SEQ ID NO: 1880250 - RNA, 13 nt, Human
cuaauuuauaaaa

SEQ ID NO: 1880251 - RNA, 17 nt, Human
cuaauucuugcauauuu

SEQ ID NO: 1880252 - RNA, 20 nt, Human
cucaaacucuugaccucagg

SEQ ID NO: 1880253 - RNA, 13 nt, Human
cucaaacuccuga

SEQ ID NO: 1880254 - RNA, 14 nt, Human
cucaaacuccugac

SEQ ID NO: 1880255 - RNA, 11 nt, Human
cucaauauuuu

SEQ ID NO: 1880256 - RNA, 15 nt, Human
cucaaugcacugaca

SEQ ID NO: 1880257 - RNA, 13 nt, Human
cucaaugcacuga

SEQ ID NO: 1880258 - RNA, 13 nt, Human
cucaauauuuucc

SEQ ID NO: 1880259 - RNA, 18 nt, Human
cuaucucccccagcccca

SEQ ID NO: 1880260 - RNA, 16 nt, Human
cuaucucccccagccc

SEQ ID NO: 1880261 - RNA, 17 nt, Human
cuaucucccccagcccc

SEQ ID NO: 1880262 - RNA, 19 nt, Human
cuauuaaggugauauauuu

SEQ ID NO: 1880263 - RNA, 23 nt, Human
cuauuaaggugauauauuuaaaa

SEQ ID NO: 1880264 - RNA, 21 nt, Human
cuauuaaggugauauauuuaa

SEQ ID NO: 1880265 - RNA, 18 nt, Human
cucaaaagcugggcaggu

SEQ ID NO: 1880266 - RNA, 17 nt, Human
cucaaaaaaagaaaaag

SEQ ID NO: 1880267 - RNA, 18 nt, Human
cuaucguaaaauuaagaa

SEQ ID NO: 1880268 - RNA, 17 nt, Human
cuaucguaaaauuaaga

SEQ ID NO: 1880269 - RNA, 14 nt, Human
cuaucuaaauguug

SEQ ID NO: 1880270 - RNA, 15 nt, Human
cuaucucccccagcc

SEQ ID NO: 1880271 - RNA, 15 nt, Human
cuaucuacucuccuc

SEQ ID NO: 1880272 - RNA, 16 nt, Human
cuaucuacucuccuca

SEQ ID NO: 1880273 - RNA, 17 nt, Human
cuaucuacucuccucau

SEQ ID NO: 1880274 - RNA, 21 nt, Human
cuaguuugauuaaauucuugc

SEQ ID NO: 1880275 - RNA, 22 nt, Human
cuaguuugauuaaauucuugca

SEQ ID NO: 1880276 - RNA, 15 nt, Human
cuaguuugauuaaau

SEQ ID NO: 1880277 - RNA, 13 nt, Human
cuaguuugauuaa

SEQ ID NO: 1880278 - RNA, 22 nt, Human
cuaguuguuugauucagacagc

SEQ ID NO: 1880279 - RNA, 23 nt, Human
cuaguuguuugauucagacagcu

SEQ ID NO: 1880280 - RNA, 12 nt, Human
cuagccagagga

SEQ ID NO: 1880281 - RNA, 19 nt, Human
cuagccaccgccuccuaca

SEQ ID NO: 1880282 - RNA, 13 nt, Human
cuagccagaggag

SEQ ID NO: 1880283 - RNA, 15 nt, Human
cuagccagaggagag

SEQ ID NO: 1880284 - RNA, 16 nt, Human
cuccaacucagaaggg

SEQ ID NO: 1880285 - RNA, 18 nt, Human
cuccaaccuggggggcag

SEQ ID NO: 1880286 - RNA, 13 nt, Human
cuccaagaauuuc

SEQ ID NO: 1880287 - RNA, 21 nt, Human
cuccaaccugcaaagaucugu

SEQ ID NO: 1880288 - RNA, 16 nt, Human
cucauguucugcuuuc

SEQ ID NO: 1880289 - RNA, 15 nt, Human
cucauguucugcuuu

SEQ ID NO: 1880290 - RNA, 16 nt, Human
cucaugccccuggcug

SEQ ID NO: 1880291 - RNA, 17 nt, Human
cucaugccccuggcugg

SEQ ID NO: 1880292 - RNA, 15 nt, Human
cuccaagaccuucuc

SEQ ID NO: 1880293 - RNA, 14 nt, Human
cuccaagaauuucu

SEQ ID NO: 1880294 - RNA, 22 nt, Human
cuccaagaccuucuccuucacc

SEQ ID NO: 1880295 - RNA, 13 nt, Human
cuccaagcaggac

SEQ ID NO: 1880296 - RNA, 14 nt, Human
cuccaagcaggaca

SEQ ID NO: 1880297 - RNA, 22 nt, Human
cuccaagcaggacauggacaag

SEQ ID NO: 1880298 - RNA, 24 nt, Human
cuccaagcaggacauggacaagga

SEQ ID NO: 1880299 - RNA, 23 nt, Human
cuccaagcccaguucagcuuggg

SEQ ID NO: 1880300 - RNA, 13 nt, Human
cuccaagccagcg

SEQ ID NO: 1880301 - RNA, 13 nt, Human
cuccaagcuccca

SEQ ID NO: 1880302 - RNA, 14 nt, Human
cuccaagcucccag

SEQ ID NO: 1880303 - RNA, 15 nt, Human
cuccaagcucccagg

SEQ ID NO: 1880304 - RNA, 16 nt, Human
cuccaagcucccaggc

SEQ ID NO: 1880305 - RNA, 22 nt, Human
cuccacuuggucugugagaugc

SEQ ID NO: 1880306 - RNA, 21 nt, Human
cuccacuuggucugugagaug

SEQ ID NO: 1880307 - RNA, 17 nt, Human
cuccacuuggucuguga

SEQ ID NO: 1880308 - RNA, 16 nt, Human
cuccacuuggucugug

SEQ ID NO: 1880309 - RNA, 15 nt, Human
cuccacuuggucugu

SEQ ID NO: 1880310 - RNA, 13 nt, Human
cuccacuuggucu

SEQ ID NO: 1880311 - RNA, 14 nt, Human
cucaugccccuggc

SEQ ID NO: 1880312 - RNA, 23 nt, Human
cucaguacuuuggaggccccuau

SEQ ID NO: 1880313 - RNA, 12 nt, Human
cucaguacuuug

SEQ ID NO: 1880314 - RNA, 17 nt, Human
cucaguacuuuggaggc

SEQ ID NO: 1880315 - RNA, 18 nt, Human
cucaguacuuuggaggcc

SEQ ID NO: 1880316 - RNA, 19 nt, Human
cucaguacuuuggaggccc

SEQ ID NO: 1880317 - RNA, 20 nt, Human
cucaguacuuuggaggcccc

SEQ ID NO: 1880318 - RNA, 21 nt, Human
cucaguacuuuggaggccccu

SEQ ID NO: 1880319 - RNA, 20 nt, Human
cuccacuuucuagccagagg

SEQ ID NO: 1880320 - RNA, 16 nt, Human
cuccacuuucuagcca

SEQ ID NO: 1880321 - RNA, 19 nt, Human
cuccacuuucuagccagag

SEQ ID NO: 1880322 - RNA, 23 nt, Human
cuccacuuggucugugagaugcu

SEQ ID NO: 1880323 - RNA, 12 nt, Human
cuccccauggag

SEQ ID NO: 1880324 - RNA, 17 nt, Human
cuccccauggagccagc

SEQ ID NO: 1880325 - RNA, 16 nt, Human
cuccagggcuggacug

SEQ ID NO: 1880326 - RNA, 15 nt, Human
cuccagggcuggacu

SEQ ID NO: 1880327 - RNA, 14 nt, Human
cuccagggcuggac

SEQ ID NO: 1880328 - RNA, 13 nt, Human
cuccagggcugga

SEQ ID NO: 1880329 - RNA, 12 nt, Human
cuccagggcugg

SEQ ID NO: 1880330 - RNA, 20 nt, Human
cuccagggcuggacugaggc

SEQ ID NO: 1880331 - RNA, 19 nt, Human
cuccagggcuggacugagg

SEQ ID NO: 1880332 - RNA, 18 nt, Human
cuccagggcuggacugag

SEQ ID NO: 1880333 - RNA, 17 nt, Human
cuccagggcuggacuga

SEQ ID NO: 1880334 - RNA, 21 nt, Human
cuccagggcuggacugaggcc

SEQ ID NO: 1880335 - RNA, 14 nt, Human
cucucacauuacug

SEQ ID NO: 1880336 - RNA, 13 nt, Human
cucucacauuacu

SEQ ID NO: 1880337 - RNA, 17 nt, Human
cucucacagcugaguug

SEQ ID NO: 1880338 - RNA, 16 nt, Human
cucguucucccuggga

SEQ ID NO: 1880339 - RNA, 21 nt, Human
cucuaaagaguuuauuuuaag

SEQ ID NO: 1880340 - RNA, 21 nt, Human
cucgugguaggacuguagaaa

SEQ ID NO: 1880341 - RNA, 14 nt, Human
cucguucucccugg

SEQ ID NO: 1880342 - RNA, 15 nt, Human
cucgaacuggcugca

SEQ ID NO: 1880343 - RNA, 14 nt, Human
cucgaacuggcugc

SEQ ID NO: 1880344 - RNA, 13 nt, Human
cucgaacuggcug

SEQ ID NO: 1880345 - RNA, 15 nt, Human
cucccccccaugcac

SEQ ID NO: 1880346 - RNA, 13 nt, Human
cucccccccaugc

SEQ ID NO: 1880347 - RNA, 22 nt, Human
cucccccagccccauccucugu

SEQ ID NO: 1880348 - RNA, 15 nt, Human
cucccccagccccau

SEQ ID NO: 1880349 - RNA, 20 nt, Human
cucccccagccccauccucu

SEQ ID NO: 1880350 - RNA, 14 nt, Human
cuccucuuccaggc

SEQ ID NO: 1880351 - RNA, 16 nt, Human
cuccuggcccacugca

SEQ ID NO: 1880352 - RNA, 18 nt, Human
cuccuggcccacugcauc

SEQ ID NO: 1880353 - RNA, 16 nt, Human
cuccucugcugcuggc

SEQ ID NO: 1880354 - RNA, 18 nt, Human
cuccucugcugcuggcug

SEQ ID NO: 1880355 - RNA, 12 nt, Human
cuccuacagccc

SEQ ID NO: 1880356 - RNA, 16 nt, Human
cugaccugguccacag

SEQ ID NO: 1880357 - RNA, 17 nt, Human
cugaccugguccacagg

SEQ ID NO: 1880358 - RNA, 18 nt, Human
cugaccugguccacaggg

SEQ ID NO: 1880359 - RNA, 20 nt, Human
cugaccugguccacagggca

SEQ ID NO: 1880360 - RNA, 21 nt, Human
cugaccugguccacagggcac

SEQ ID NO: 1880361 - RNA, 23 nt, Human
cugagacagcccgggcucugccu

SEQ ID NO: 1880362 - RNA, 21 nt, Human
cugagacucgcgacaaugcaa

SEQ ID NO: 1880363 - RNA, 21 nt, Human
cugacccaugcugcccuguga

SEQ ID NO: 1880364 - RNA, 22 nt, Human
cugacccaugcugcccugugag

SEQ ID NO: 1880365 - RNA, 22 nt, Human
cugagaggacuuuucuuugugg

SEQ ID NO: 1880366 - RNA, 21 nt, Human
cugagaggacuuuucuuugug

SEQ ID NO: 1880367 - RNA, 12 nt, Human
cugagaggccac

SEQ ID NO: 1880368 - RNA, 17 nt, Human
cugagaguagagucacu

SEQ ID NO: 1880369 - RNA, 22 nt, Human
cugagacucgcgacaaugcaaa

SEQ ID NO: 1880370 - RNA, 12 nt, Human
cugagagaaaua

SEQ ID NO: 1880371 - RNA, 20 nt, Human
cugaguagcuggauuacagg

SEQ ID NO: 1880372 - RNA, 20 nt, Human
cugaggaauccagacccggc

SEQ ID NO: 1880373 - RNA, 17 nt, Human
cugaggaauccagaccc

SEQ ID NO: 1880374 - RNA, 20 nt, Human
cugaggacacuaaccacgcu

SEQ ID NO: 1880375 - RNA, 21 nt, Human
cugaggaauccagacccggcu

SEQ ID NO: 1880376 - RNA, 23 nt, Human
cugaggacacuaaccacgcugga

SEQ ID NO: 1880377 - RNA, 21 nt, Human
cugagaucaaaacgguuuuac

SEQ ID NO: 1880378 - RNA, 18 nt, Human
cugagaucucugcaggaa

SEQ ID NO: 1880379 - RNA, 17 nt, Human
cugagaucucugcagga

SEQ ID NO: 1880380 - RNA, 16 nt, Human
cugagaucucugcagg

SEQ ID NO: 1880381 - RNA, 14 nt, Human
cugagcuuucugcu

SEQ ID NO: 1880382 - RNA, 15 nt, Human
cugagcuuucugcua

SEQ ID NO: 1880383 - RNA, 19 nt, Human
cugaguagcuggauuacag

SEQ ID NO: 1880384 - RNA, 21 nt, Human
cugaguacguugugcauuugg

SEQ ID NO: 1880385 - RNA, 12 nt, Human
cugaggugggag

SEQ ID NO: 1880386 - RNA, 20 nt, Human
cugaguacguugugcauuug

SEQ ID NO: 1880387 - RNA, 19 nt, Human
cugaguacguugugcauuu

SEQ ID NO: 1880388 - RNA, 17 nt, Human
cugaguacguugugcau

SEQ ID NO: 1880389 - RNA, 18 nt, Human
cugaguacguugugcauu

SEQ ID NO: 1880390 - RNA, 18 nt, Human
cucuucaaggacuuucug

SEQ ID NO: 1880391 - RNA, 17 nt, Human
cucuuagcuccccucca

SEQ ID NO: 1880392 - RNA, 15 nt, Human
cucuuagcuccccuc

SEQ ID NO: 1880393 - RNA, 18 nt, Human
cucuuagcuccccuccaa

SEQ ID NO: 1880394 - RNA, 19 nt, Human
cucuuagcuccccuccaac

SEQ ID NO: 1880395 - RNA, 14 nt, Human
cucuucaaucucuu

SEQ ID NO: 1880396 - RNA, 19 nt, Human
cucuucagaucucuaacuu

SEQ ID NO: 1880397 - RNA, 18 nt, Human
cucuucagaucucuaacu

SEQ ID NO: 1880398 - RNA, 13 nt, Human
cucuuauugccca

SEQ ID NO: 1880399 - RNA, 21 nt, Human
cucuuagcauuuuaauuagau

SEQ ID NO: 1880400 - RNA, 14 nt, Human
cucuuagauggauu

SEQ ID NO: 1880401 - RNA, 20 nt, Human
cucuuauugcccacgcugga

SEQ ID NO: 1880402 - RNA, 19 nt, Human
cucuuauugcccacgcugg

SEQ ID NO: 1880403 - RNA, 15 nt, Human
cucuuauugcccacg

SEQ ID NO: 1880404 - RNA, 14 nt, Human
cucuuauugcccac

SEQ ID NO: 1880405 - RNA, 21 nt, Human
cucuucagaaagugugcuuua

SEQ ID NO: 1880406 - RNA, 14 nt, Human
cucugucagucaca

SEQ ID NO: 1880407 - RNA, 16 nt, Human
cucugucagucacagc

SEQ ID NO: 1880408 - RNA, 17 nt, Human
cucugucagucacagcc

SEQ ID NO: 1880409 - RNA, 19 nt, Human
cucugucagucacagccac

SEQ ID NO: 1880410 - RNA, 20 nt, Human
cucugucagucacagccacc

SEQ ID NO: 1880411 - RNA, 16 nt, Human
cucugcugacagacac

SEQ ID NO: 1880412 - RNA, 14 nt, Human
cucugcugacagac

SEQ ID NO: 1880413 - RNA, 13 nt, Human
cucugcugacaga

SEQ ID NO: 1880414 - RNA, 13 nt, Human
cucugcuccccag

SEQ ID NO: 1880415 - RNA, 14 nt, Human
cucugguccauaga

SEQ ID NO: 1880416 - RNA, 20 nt, Human
cucugcuccucuccccagca

SEQ ID NO: 1880417 - RNA, 18 nt, Human
cucugcuccucuccccag

SEQ ID NO: 1880418 - RNA, 13 nt, Human
cucugcuccucuc

SEQ ID NO: 1880419 - RNA, 14 nt, Human
cucugcaggucccu

SEQ ID NO: 1880420 - RNA, 15 nt, Human
cucugcaggucccua

SEQ ID NO: 1880421 - RNA, 16 nt, Human
cucugcaggucccuaa

SEQ ID NO: 1880422 - RNA, 17 nt, Human
cucugcaggucccuaau

SEQ ID NO: 1880423 - RNA, 13 nt, Human
cucugcagcaaua

SEQ ID NO: 1880424 - RNA, 21 nt, Human
cucugcacuccccugcugggu

SEQ ID NO: 1880425 - RNA, 18 nt, Human
cucugcacuccccugcug

SEQ ID NO: 1880426 - RNA, 20 nt, Human
cucugcacuccccugcuggg

SEQ ID NO: 1880427 - RNA, 15 nt, Human
cucuccccugaccug

SEQ ID NO: 1880428 - RNA, 17 nt, Human
cucuccccugaccugug

SEQ ID NO: 1880429 - RNA, 17 nt, Human
cucuugagccuugaacu

SEQ ID NO: 1880430 - RNA, 16 nt, Human
cucuugagccuugaac

SEQ ID NO: 1880431 - RNA, 18 nt, Human
cucuugagccuugaacuu

SEQ ID NO: 1880432 - RNA, 23 nt, Human
cucuugagccuugaacuuugacc

SEQ ID NO: 1880433 - RNA, 22 nt, Human
cugacaacacucauugaccuga

SEQ ID NO: 1880434 - RNA, 23 nt, Human
cugacaacacucauugaccugag

SEQ ID NO: 1880435 - RNA, 19 nt, Human
cugaaggccccgcccaggc

SEQ ID NO: 1880436 - RNA, 17 nt, Human
cugaaggcuggguucug

SEQ ID NO: 1880437 - RNA, 21 nt, Human
cugaaggccccgcccaggcuu

SEQ ID NO: 1880438 - RNA, 23 nt, Human
cugaaggacauugcggacagcca

SEQ ID NO: 1880439 - RNA, 23 nt, Human
cugaagccuuugcauuuuggaga

SEQ ID NO: 1880440 - RNA, 21 nt, Human
cugaagcuaucguaaaauuaa

SEQ ID NO: 1880441 - RNA, 22 nt, Human
cugaagcuaucguaaaauuaag

SEQ ID NO: 1880442 - RNA, 19 nt, Human
cugaagccuuucuuuugga

SEQ ID NO: 1880443 - RNA, 22 nt, Human
cugaaaauugaugggauuuggu

SEQ ID NO: 1880444 - RNA, 15 nt, Human
cugaaacaacuugga

SEQ ID NO: 1880445 - RNA, 16 nt, Human
cugaaacaacuuggaa

SEQ ID NO: 1880446 - RNA, 20 nt, Human
cugaaacaacuuggaaagau

SEQ ID NO: 1880447 - RNA, 13 nt, Human
cucuugaugccug

SEQ ID NO: 1880448 - RNA, 15 nt, Human
cucuugaugccuggc

SEQ ID NO: 1880449 - RNA, 16 nt, Human
cucuugaugccuggcg

SEQ ID NO: 1880450 - RNA, 21 nt, Human
cucuugaugccuggcggggug

SEQ ID NO: 1880451 - RNA, 21 nt, Human
cucuugauuauccauauugag

SEQ ID NO: 1880452 - RNA, 12 nt, Human
cucuuuucucug

SEQ ID NO: 1880453 - RNA, 21 nt, Human
cucuuuugcuuuauuccagaa

SEQ ID NO: 1880454 - RNA, 22 nt, Human
gugucuguacacguguccugua

SEQ ID NO: 1880455 - RNA, 21 nt, Human
gugucuguacacguguccugu

SEQ ID NO: 1880456 - RNA, 16 nt, Human
gugucuguacacgugu

SEQ ID NO: 1880457 - RNA, 13 nt, Human
gugucuguacacg

SEQ ID NO: 1880458 - RNA, 12 nt, Human
gugucuguacac

SEQ ID NO: 1880459 - RNA, 19 nt, Human
gugucagguggggcagcuu

SEQ ID NO: 1880460 - RNA, 23 nt, Human
gugugaaccaccacacccagccc

SEQ ID NO: 1880461 - RNA, 18 nt, Human
gugucagguggggcagcu

SEQ ID NO: 1880462 - RNA, 14 nt, Human
gugucagguggggc

SEQ ID NO: 1880463 - RNA, 22 nt, Human
gugucaccugaagacucauucu

SEQ ID NO: 1880464 - RNA, 14 nt, Human
gugucaccugaaga

SEQ ID NO: 1880465 - RNA, 17 nt, Human
guguauuuaacagggag

SEQ ID NO: 1880466 - RNA, 18 nt, Human
guguauuuaacagggagg

SEQ ID NO: 1880467 - RNA, 20 nt, Human
aagcaaaugugaaucauuuu

SEQ ID NO: 1880468 - RNA, 14 nt, Human
aagcaaaaagugau

SEQ ID NO: 1880469 - RNA, 17 nt, Human
aagcaacccaaauguuc

SEQ ID NO: 1880470 - RNA, 21 nt, Human
guguaugugggggucugugug

SEQ ID NO: 1880471 - RNA, 13 nt, Human
guguauguggggg

SEQ ID NO: 1880472 - RNA, 23 nt, Human
aagauggcacuuauaaccaaagc

SEQ ID NO: 1880473 - RNA, 23 nt, Human
aagaucaaaagguuaauaaagua

SEQ ID NO: 1880474 - RNA, 20 nt, Human
aagaucaaaagguuaauaaa

SEQ ID NO: 1880475 - RNA, 15 nt, Human
gugcugcugcugcug

SEQ ID NO: 1880476 - RNA, 14 nt, Human
gugcugcugcugcu

SEQ ID NO: 1880477 - RNA, 23 nt, Human
gugguucacucuuggagccugca

SEQ ID NO: 1880478 - RNA, 22 nt, Human
gugguucacucuuggagccugc

SEQ ID NO: 1880479 - RNA, 15 nt, Human
gugguuucagaaaug

SEQ ID NO: 1880480 - RNA, 18 nt, Human
gugguugcuguuuuccuc

SEQ ID NO: 1880481 - RNA, 23 nt, Human
gugcugcccugcccaccuggccu

SEQ ID NO: 1880482 - RNA, 19 nt, Human
gugcugcggagcaagagga

SEQ ID NO: 1880483 - RNA, 20 nt, Human
gugguugcuguuuuccuccc

SEQ ID NO: 1880484 - RNA, 19 nt, Human
gugguugcuguuuuccucc

SEQ ID NO: 1880485 - RNA, 13 nt, Human
gugguugugaucc

SEQ ID NO: 1880486 - RNA, 21 nt, Human
aagagggagggagggcuccag

SEQ ID NO: 1880487 - RNA, 22 nt, Human
aagagggagggagggcuccaga

SEQ ID NO: 1880488 - RNA, 14 nt, Human
aagaggcagggucu

SEQ ID NO: 1880489 - RNA, 11 nt, Human
aagaggcaggg

SEQ ID NO: 1880490 - RNA, 17 nt, Human
aagauagcuucacccca

SEQ ID NO: 1880491 - RNA, 18 nt, Human
aagaggugugcaagagag

SEQ ID NO: 1880492 - RNA, 16 nt, Human
aagaggugugcaagag

SEQ ID NO: 1880493 - RNA, 15 nt, Human
aagcacgaaauguua

SEQ ID NO: 1880494 - RNA, 16 nt, Human
aagcacuaaacaaaga

SEQ ID NO: 1880495 - RNA, 17 nt, Human
aagcaccuccugccucg

SEQ ID NO: 1880496 - RNA, 16 nt, Human
aagcaccuccugccuc

SEQ ID NO: 1880497 - RNA, 15 nt, Human
aagcaccuccugccu

SEQ ID NO: 1880498 - RNA, 14 nt, Human
aagcaccuccugcc

SEQ ID NO: 1880499 - RNA, 13 nt, Human
aagcaccuccugc

SEQ ID NO: 1880500 - RNA, 21 nt, Human
aagcacaugccucucucaggc

SEQ ID NO: 1880501 - RNA, 16 nt, Human
guguuucuuuaguuuu

SEQ ID NO: 1880502 - RNA, 13 nt, Human
guguuucuuuagu

SEQ ID NO: 1880503 - RNA, 13 nt, Human
gugugaaugaaca

SEQ ID NO: 1880504 - RNA, 16 nt, Human
gugugaauaaagugcu

SEQ ID NO: 1880505 - RNA, 16 nt, Human
aagcacacuugacauc

SEQ ID NO: 1880506 - RNA, 21 nt, Human
aagcacaaugucucacauggg

SEQ ID NO: 1880507 - RNA, 19 nt, Human
aagcacacucauccccuca

SEQ ID NO: 1880508 - RNA, 12 nt, Human
guguuugaagca

SEQ ID NO: 1880509 - RNA, 14 nt, Human
aagcacaugccucu

SEQ ID NO: 1880510 - RNA, 11 nt, Human
aagcacagcag

SEQ ID NO: 1880511 - RNA, 16 nt, Human
aagcacagcagccugg

SEQ ID NO: 1880512 - RNA, 15 nt, Human
aagcacaugccucuc

SEQ ID NO: 1880513 - RNA, 16 nt, Human
aagcacaugccucucu

SEQ ID NO: 1880514 - RNA, 19 nt, Human
aagcacaugccucucucag

SEQ ID NO: 1880515 - RNA, 20 nt, Human
aagcacaugccucucucagg

SEQ ID NO: 1880516 - RNA, 20 nt, Human
aagccaaagcuaggccuggc

SEQ ID NO: 1880517 - RNA, 18 nt, Human
aagccaaagcuaggccug

SEQ ID NO: 1880518 - RNA, 17 nt, Human
aagccaaagcuaggccu

SEQ ID NO: 1880519 - RNA, 12 nt, Human
aagccaaagagu

SEQ ID NO: 1880520 - RNA, 23 nt, Human
aagcaugcacaaauucugucucu

SEQ ID NO: 1880521 - RNA, 12 nt, Human
aagcaugugaga

SEQ ID NO: 1880522 - RNA, 15 nt, Human
aagcauguguuugca

SEQ ID NO: 1880523 - RNA, 19 nt, Human
guuauuauauuuacaaaug

SEQ ID NO: 1880524 - RNA, 19 nt, Human
guuagagguucccuuugac

SEQ ID NO: 1880525 - RNA, 13 nt, Human
guuacuguaauuc

SEQ ID NO: 1880526 - RNA, 13 nt, Human
guuauuuaaagaa

SEQ ID NO: 1880527 - RNA, 20 nt, Human
guuauuggccuuuucuauuc

SEQ ID NO: 1880528 - RNA, 20 nt, Human
guuauuauauuuacaaaugg

SEQ ID NO: 1880529 - RNA, 12 nt, Human
guuaauaaaagu

SEQ ID NO: 1880530 - RNA, 18 nt, Human
aagcccaauauuauaauu

SEQ ID NO: 1880531 - RNA, 18 nt, Human
guuaaucauuagguguga

SEQ ID NO: 1880532 - RNA, 16 nt, Human
aagccucccacgacug

SEQ ID NO: 1880533 - RNA, 15 nt, Human
aagccuccuccagcc

SEQ ID NO: 1880534 - RNA, 18 nt, Human
aagccuggucagcccaaa

SEQ ID NO: 1880535 - RNA, 15 nt, Human
aagccuguuuaagag

SEQ ID NO: 1880536 - RNA, 18 nt, Human
aagccuguuuaagagaca

SEQ ID NO: 1880537 - RNA, 16 nt, Human
aagccuuccacacuca

SEQ ID NO: 1880538 - RNA, 23 nt, Human
guucagcuuguaaauagcucagg

SEQ ID NO: 1880539 - RNA, 12 nt, Human
guucagcuuggg

SEQ ID NO: 1880540 - RNA, 22 nt, Human
guucaggguuggccccugcccg

SEQ ID NO: 1880541 - RNA, 21 nt, Human
guucaggguuggccccugccc

SEQ ID NO: 1880542 - RNA, 20 nt, Human
guucaggguuggccccugcc

SEQ ID NO: 1880543 - RNA, 21 nt, Human
aagccgugauuuucauugcug

SEQ ID NO: 1880544 - RNA, 22 nt, Human
aagccgugcucgccccagcagg

SEQ ID NO: 1880545 - RNA, 23 nt, Human
aagccuaaaagugggcuugauuc

SEQ ID NO: 1880546 - RNA, 18 nt, Human
guucagguaacaggcaga

SEQ ID NO: 1880547 - RNA, 17 nt, Human
guucagguaacaggcag

SEQ ID NO: 1880548 - RNA, 14 nt, Human
guucuaguugcuug

SEQ ID NO: 1880549 - RNA, 19 nt, Human
guucuagcauggcugccaa

SEQ ID NO: 1880550 - RNA, 14 nt, Human
guucucugaggaca

SEQ ID NO: 1880551 - RNA, 15 nt, Human
guucucugcccucca

SEQ ID NO: 1880552 - RNA, 12 nt, Human
guucucugagga

SEQ ID NO: 1880553 - RNA, 15 nt, Human
guucucucuucucca

SEQ ID NO: 1880554 - RNA, 16 nt, Human
guucuuaagacgugau

SEQ ID NO: 1880555 - RNA, 13 nt, Human
guucuuaauucuu

SEQ ID NO: 1880556 - RNA, 17 nt, Human
guucucugcccuccaag

SEQ ID NO: 1880557 - RNA, 18 nt, Human
guucucugcccuccaaga

SEQ ID NO: 1880558 - RNA, 17 nt, Human
guucuuaauucuuagcu

SEQ ID NO: 1880559 - RNA, 14 nt, Human
guucuuaauucuua

SEQ ID NO: 1880560 - RNA, 14 nt, Human
guucuugguuugua

SEQ ID NO: 1880561 - RNA, 17 nt, Human
guucuugccacuuuuuu

SEQ ID NO: 1880562 - RNA, 18 nt, Human
guucuugguuuguaaauu

SEQ ID NO: 1880563 - RNA, 15 nt, Human
guucuugguuuguaa

SEQ ID NO: 1880564 - RNA, 14 nt, Human
guugauagcacaga

SEQ ID NO: 1880565 - RNA, 19 nt, Human
guugauagcacagacccug

SEQ ID NO: 1880566 - RNA, 20 nt, Human
guugacuugacagaacacug

SEQ ID NO: 1880567 - RNA, 19 nt, Human
guugacuugacagaacacu

SEQ ID NO: 1880568 - RNA, 16 nt, Human
guugagaaucccaaau

SEQ ID NO: 1880569 - RNA, 19 nt, Human
guugagaaucccaaauuug

SEQ ID NO: 1880570 - RNA, 17 nt, Human
aagcucugcuccucucc

SEQ ID NO: 1880571 - RNA, 19 nt, Human
aagcucuugaagacacuga

SEQ ID NO: 1880572 - RNA, 20 nt, Human
aagcucuugaagacacugaa

SEQ ID NO: 1880573 - RNA, 17 nt, Human
aagcucuugaagacacu

SEQ ID NO: 1880574 - RNA, 22 nt, Human
aagcucagaggcgcacugugac

SEQ ID NO: 1880575 - RNA, 23 nt, Human
aagcucagaggcgcacugugacc

SEQ ID NO: 1880576 - RNA, 18 nt, Human
aagcuauaaauuccucuu

SEQ ID NO: 1880577 - RNA, 21 nt, Human
aagcuuccaugauucuauuua

SEQ ID NO: 1880578 - RNA, 13 nt, Human
aagcuuccuuggc

SEQ ID NO: 1880579 - RNA, 11 nt, Human
aagcuuagaac

SEQ ID NO: 1880580 - RNA, 10 nt, Human
aagcuuagaa

SEQ ID NO: 1880581 - RNA, 21 nt, Human
aagcucuugaagacacugaaa

SEQ ID NO: 1880582 - RNA, 12 nt, Human
guuccccagaga

SEQ ID NO: 1880583 - RNA, 13 nt, Human
guuccccagagaa

SEQ ID NO: 1880584 - RNA, 21 nt, Human
guucccccuucacaaagccca

SEQ ID NO: 1880585 - RNA, 14 nt, Human
guuccccagagaaa

SEQ ID NO: 1880586 - RNA, 19 nt, Human
aagcuuuuaugugaaacau

SEQ ID NO: 1880587 - RNA, 21 nt, Human
aagcuuuuaugugaaacaugu

SEQ ID NO: 1880588 - RNA, 21 nt, Human
guucccuuuuuuggcugcuga

SEQ ID NO: 1880589 - RNA, 22 nt, Human
guucccuuuuuuggcugcugaa

SEQ ID NO: 1880590 - RNA, 11 nt, Human
aaguauuuugc

SEQ ID NO: 1880591 - RNA, 21 nt, Human
aagucacuggccaguggcugg

SEQ ID NO: 1880592 - RNA, 15 nt, Human
aagucaaauuaauaa

SEQ ID NO: 1880593 - RNA, 19 nt, Human
aagucaaauuaauaaucuu

SEQ ID NO: 1880594 - RNA, 21 nt, Human
aaguauucuuauuuaaugaaa

SEQ ID NO: 1880595 - RNA, 19 nt, Human
aaguauuauaccuuuuuua

SEQ ID NO: 1880596 - RNA, 16 nt, Human
aaguauuauaccuuuu

SEQ ID NO: 1880597 - RNA, 23 nt, Human
aaguauucuuauuuaaugaaaga

SEQ ID NO: 1880598 - RNA, 21 nt, Human
aaguauugcugaguccaacaa

SEQ ID NO: 1880599 - RNA, 20 nt, Human
aaguacuucuccacccugcu

SEQ ID NO: 1880600 - RNA, 19 nt, Human
aaguacuucuccacccugc

SEQ ID NO: 1880601 - RNA, 18 nt, Human
aaguacuucuccacccug

SEQ ID NO: 1880602 - RNA, 15 nt, Human
aaguauuauaccuuu

SEQ ID NO: 1880603 - RNA, 14 nt, Human
aaguacuauaauuu

SEQ ID NO: 1880604 - RNA, 17 nt, Human
aaguacuauaauuuacc

SEQ ID NO: 1880605 - RNA, 13 nt, Human
aaguacuauguau

SEQ ID NO: 1880606 - RNA, 22 nt, Human
guuuuaaggaugcuuguacaua

SEQ ID NO: 1880607 - RNA, 19 nt, Human
guuuuaacuagaauuuauu

SEQ ID NO: 1880608 - RNA, 19 nt, Human
guuuuaauuuauacuggca

SEQ ID NO: 1880609 - RNA, 21 nt, Human
guuuuaauuuauacuggcaug

SEQ ID NO: 1880610 - RNA, 19 nt, Human
guuuucuguucuuucuggc

SEQ ID NO: 1880611 - RNA, 21 nt, Human
guuuugaaggcaaaauugcaa

SEQ ID NO: 1880612 - RNA, 16 nt, Human
guuuucuguucuuucu

SEQ ID NO: 1880613 - RNA, 15 nt, Human
guuuucuguucuuuc

SEQ ID NO: 1880614 - RNA, 14 nt, Human
guuuucuguucuuu

SEQ ID NO: 1880615 - RNA, 20 nt, Human
aaguaauaugcacacauuuu

SEQ ID NO: 1880616 - RNA, 18 nt, Human
aaguaauaugcacacauu

SEQ ID NO: 1880617 - RNA, 17 nt, Human
aaguaauaugcacacau

SEQ ID NO: 1880618 - RNA, 13 nt, Human
aaguaacuuuaaa

SEQ ID NO: 1880619 - RNA, 21 nt, Human
aaguaauaugcacacauuuuu

SEQ ID NO: 1880620 - RNA, 19 nt, Human
guuuggacaaaauggaaua

SEQ ID NO: 1880621 - RNA, 15 nt, Human
guuuuaaagcuucca

SEQ ID NO: 1880622 - RNA, 22 nt, Human
guuuuaaagaccugacaccuuu

SEQ ID NO: 1880623 - RNA, 12 nt, Human
guuuuaaauucu

SEQ ID NO: 1880624 - RNA, 22 nt, Human
guuucaauuccaccugcaauca

SEQ ID NO: 1880625 - RNA, 17 nt, Human
guuucaaacuuuacuau

SEQ ID NO: 1880626 - RNA, 14 nt, Human
guuuaugauuccac

SEQ ID NO: 1880627 - RNA, 21 nt, Human
guuuaagugacugauggcuaa

SEQ ID NO: 1880628 - RNA, 17 nt, Human
aaggaaacccagcucug

SEQ ID NO: 1880629 - RNA, 22 nt, Human
aaggaaacccagcucuggucca

SEQ ID NO: 1880630 - RNA, 23 nt, Human
guuguuugauucagacagcugcc

SEQ ID NO: 1880631 - RNA, 16 nt, Human
aaggcugggggaagaa

SEQ ID NO: 1880632 - RNA, 14 nt, Human
aaggcugggggaag

SEQ ID NO: 1880633 - RNA, 13 nt, Human
guuucagaaaugu

SEQ ID NO: 1880634 - RNA, 11 nt, Human
guuucagaaau

SEQ ID NO: 1880635 - RNA, 19 nt, Human
aaggcugggggaagaagcu

SEQ ID NO: 1880636 - RNA, 22 nt, Human
aaggcugggggaagaagcucuc

SEQ ID NO: 1880637 - RNA, 20 nt, Human
aaggcugucaauuacaggaa

SEQ ID NO: 1880638 - RNA, 16 nt, Human
aaggggacccccgccc

SEQ ID NO: 1880639 - RNA, 20 nt, Human
aaggggacccccgcccccug

SEQ ID NO: 1880640 - RNA, 15 nt, Human
aaggcuuaaacccau

SEQ ID NO: 1880641 - RNA, 13 nt, Human
aaggggagaguaa

SEQ ID NO: 1880642 - RNA, 12 nt, Human
aagggggcuggg

SEQ ID NO: 1880643 - RNA, 23 nt, Human
aagggggcugggacaugggaaag

SEQ ID NO: 1880644 - RNA, 17 nt, Human
aaggggguggugucucc

SEQ ID NO: 1880645 - RNA, 21 nt, Human
aagggguaggauuacuaggug

SEQ ID NO: 1880646 - RNA, 16 nt, Human
aagguuucugaaaauu

SEQ ID NO: 1880647 - RNA, 18 nt, Human
aagguuugguccagccug

SEQ ID NO: 1880648 - RNA, 18 nt, Human
aaguaacuuuaaauuaug

SEQ ID NO: 1880649 - RNA, 17 nt, Human
aaguuuccccaccagug

SEQ ID NO: 1880650 - RNA, 19 nt, Human
aaguuauuuuuaauuuggu

SEQ ID NO: 1880651 - RNA, 18 nt, Human
aaguuuccuuccagccca

SEQ ID NO: 1880652 - RNA, 19 nt, Human
aaguuuccuuccagcccag

SEQ ID NO: 1880653 - RNA, 20 nt, Human
aaguuuccuuccagcccaga

SEQ ID NO: 1880654 - RNA, 21 nt, Human
aaguuuccuuccagcccagaa

SEQ ID NO: 1880655 - RNA, 19 nt, Human
aaguuucugccgcagcccu

SEQ ID NO: 1880656 - RNA, 21 nt, Human
aaguuucugccgcagcccugc

SEQ ID NO: 1880657 - RNA, 16 nt, Human
aaguuugauuucauua

SEQ ID NO: 1880658 - RNA, 15 nt, Human
aaguuugauuucauu

SEQ ID NO: 1880659 - RNA, 9 nt, Human
uaaaauggu

SEQ ID NO: 1880660 - RNA, 20 nt, Human
aaguuugagaucagccuggg

SEQ ID NO: 1880661 - RNA, 16 nt, Human
uaaaauguaucuucca

SEQ ID NO: 1880662 - RNA, 16 nt, Human
uaaaauugugaugugu

SEQ ID NO: 1880663 - RNA, 15 nt, Human
uaaaauugugaugug

SEQ ID NO: 1880664 - RNA, 23 nt, Human
aaguguauuuuuuuacuaauaga

SEQ ID NO: 1880665 - RNA, 12 nt, Human
aagugccagaaa

SEQ ID NO: 1880666 - RNA, 12 nt, Human
aaguguguguuu

SEQ ID NO: 1880667 - RNA, 13 nt, Human
aagugugguagag

SEQ ID NO: 1880668 - RNA, 23 nt, Human
aagugugcuuuaugcugaaacag

SEQ ID NO: 1880669 - RNA, 20 nt, Human
aagugugggucugugugugu

SEQ ID NO: 1880670 - RNA, 18 nt, Human
aagugugggucugugugu

SEQ ID NO: 1880671 - RNA, 17 nt, Human
aagugugggucugugug

SEQ ID NO: 1880672 - RNA, 10 nt, Human
aagugugggu

SEQ ID NO: 1880673 - RNA, 21 nt, Human
aagugugcuuuaugcugaaac

SEQ ID NO: 1880674 - RNA, 14 nt, Human
aaguuacacauuuu

SEQ ID NO: 1880675 - RNA, 16 nt, Human
aaguguguguuuuuca

SEQ ID NO: 1880676 - RNA, 21 nt, Human
aaguguguguuuuucauaaag

SEQ ID NO: 1880677 - RNA, 20 nt, Human
aaguuaugggaauaccugug

SEQ ID NO: 1880678 - RNA, 16 nt, Human
uaaaauaucauucagc

SEQ ID NO: 1880679 - RNA, 17 nt, Human
uaaaauaucauucagca

SEQ ID NO: 1880680 - RNA, 15 nt, Human
uaaaauaucauucag

SEQ ID NO: 1880681 - RNA, 14 nt, Human
uaaaauaucauuca

SEQ ID NO: 1880682 - RNA, 23 nt, Human
aagugauccucccaccucagccu

SEQ ID NO: 1880683 - RNA, 21 nt, Human
aagugauucuccugccucagc

SEQ ID NO: 1880684 - RNA, 22 nt, Human
aagugcaauaaaucugacccag

SEQ ID NO: 1880685 - RNA, 23 nt, Human
aagugcaauaaaucugacccagu

SEQ ID NO: 1880686 - RNA, 20 nt, Human
aagugauccucccaccucag

SEQ ID NO: 1880687 - RNA, 19 nt, Human
aagugauccucccaccuca

SEQ ID NO: 1880688 - RNA, 13 nt, Human
aagugauccuccc

SEQ ID NO: 1880689 - RNA, 21 nt, Human
uaaaauaccagccaguaaaug

SEQ ID NO: 1880690 - RNA, 13 nt, Human
uaaaagucuugug

SEQ ID NO: 1880691 - RNA, 19 nt, Human
uaaaagaaagaaagaaaaa

SEQ ID NO: 1880692 - RNA, 13 nt, Human
uaaaacuuuuuau

SEQ ID NO: 1880693 - RNA, 23 nt, Human
uaaaacuuuuuauauuuuauaca

SEQ ID NO: 1880694 - RNA, 20 nt, Human
uaaaaguacauguuaaacuu

SEQ ID NO: 1880695 - RNA, 19 nt, Human
uaaaagugggcuugauucu

SEQ ID NO: 1880696 - RNA, 14 nt, Human
uaaaauaaauauug

SEQ ID NO: 1880697 - RNA, 18 nt, Human
uaaaauaaauauugucuu

SEQ ID NO: 1880698 - RNA, 17 nt, Human
uaaaauaaauauugucu

SEQ ID NO: 1880699 - RNA, 20 nt, Human
uaaaaagcuuccaugauucu

SEQ ID NO: 1880700 - RNA, 21 nt, Human
uaaaaaaaaaccugagcccca

SEQ ID NO: 1880701 - RNA, 22 nt, Human
uaaaaaugagguacucuccugg

SEQ ID NO: 1880702 - RNA, 15 nt, Human
uaaaaaugagguacu

SEQ ID NO: 1880703 - RNA, 23 nt, Human
uaaaaaucucaaauuucuaaauc

SEQ ID NO: 1880704 - RNA, 13 nt, Human
uaaaacccaagug

SEQ ID NO: 1880705 - RNA, 15 nt, Human
uaaaacuacaaaaau

SEQ ID NO: 1880706 - RNA, 14 nt, Human
uaaaacucuuuuaa

SEQ ID NO: 1880707 - RNA, 18 nt, Human
uaaaacuggcuuuggcuu

SEQ ID NO: 1880708 - RNA, 17 nt, Human
uaaaacuggcuuuggcu

SEQ ID NO: 1880709 - RNA, 15 nt, Human
uaaaacuuuuuaaaa

SEQ ID NO: 1880710 - RNA, 12 nt, Human
uaaaacuuuuua

SEQ ID NO: 1880711 - RNA, 20 nt, Human
uaaaacuucucaagauacug

SEQ ID NO: 1880712 - RNA, 13 nt, Human
aacauucaggagc

SEQ ID NO: 1880713 - RNA, 14 nt, Human
aacauucaggagcu

SEQ ID NO: 1880714 - RNA, 22 nt, Human
aacauauaauguuguuauuuaa

SEQ ID NO: 1880715 - RNA, 17 nt, Human
aacauguauaauauuuu

SEQ ID NO: 1880716 - RNA, 21 nt, Human
aacaguuuuuuaugcuaauca

SEQ ID NO: 1880717 - RNA, 21 nt, Human
aacauauaauguuguuauuua

SEQ ID NO: 1880718 - RNA, 18 nt, Human
aacauauaauguuguuau

SEQ ID NO: 1880719 - RNA, 13 nt, Human
aacauauaauguu

SEQ ID NO: 1880720 - RNA, 14 nt, Human
aacauaaagcaaau

SEQ ID NO: 1880721 - RNA, 19 nt, Human
aacauaaagcaaauagaca

SEQ ID NO: 1880722 - RNA, 18 nt, Human
aacaguccauugaaaggg

SEQ ID NO: 1880723 - RNA, 15 nt, Human
guccgugcugacagc

SEQ ID NO: 1880724 - RNA, 19 nt, Human
guccgugcugacagcugcu

SEQ ID NO: 1880725 - RNA, 20 nt, Human
guccgugcugacagcugcuc

SEQ ID NO: 1880726 - RNA, 21 nt, Human
guccgugcugacagcugcucc

SEQ ID NO: 1880727 - RNA, 22 nt, Human
guccgugcugacagcugcuccu

SEQ ID NO: 1880728 - RNA, 22 nt, Human
gucuaugggacucaaugcacug

SEQ ID NO: 1880729 - RNA, 20 nt, Human
gucuauuuacggaacucaaa

SEQ ID NO: 1880730 - RNA, 23 nt, Human
gucuaggcaggaccuguggccaa

SEQ ID NO: 1880731 - RNA, 23 nt, Human
gucuagccuauguggauuuuuuc

SEQ ID NO: 1880732 - RNA, 20 nt, Human
gucuagauggcuccucucag

SEQ ID NO: 1880733 - RNA, 21 nt, Human
gucuagauggcuccucucagu

SEQ ID NO: 1880734 - RNA, 18 nt, Human
gucgcgcaccgaaaaacu

SEQ ID NO: 1880735 - RNA, 14 nt, Human
gucuaccugagggg

SEQ ID NO: 1880736 - RNA, 13 nt, Human
gucuaccugaggg

SEQ ID NO: 1880737 - RNA, 15 nt, Human
gucuaccugaggggc

SEQ ID NO: 1880738 - RNA, 16 nt, Human
gucuaccugaggggcc

SEQ ID NO: 1880739 - RNA, 14 nt, Human
guccucuuuucuga

SEQ ID NO: 1880740 - RNA, 20 nt, Human
guccucuuuacaugaaacua

SEQ ID NO: 1880741 - RNA, 19 nt, Human
guccugcugcaguugccag

SEQ ID NO: 1880742 - RNA, 16 nt, Human
guccuggcaugggaau

SEQ ID NO: 1880743 - RNA, 12 nt, Human
gucgaggcagga

SEQ ID NO: 1880744 - RNA, 15 nt, Human
gucgagucaaaaugu

SEQ ID NO: 1880745 - RNA, 16 nt, Human
gucgaggacagggagg

SEQ ID NO: 1880746 - RNA, 16 nt, Human
aacacuguucucugcc

SEQ ID NO: 1880747 - RNA, 17 nt, Human
aacacuguucucugccc

SEQ ID NO: 1880748 - RNA, 18 nt, Human
aacacuguucucugcccu

SEQ ID NO: 1880749 - RNA, 17 nt, Human
gucauuugagcagggcu

SEQ ID NO: 1880750 - RNA, 19 nt, Human
aacacuguucucugcccuc

SEQ ID NO: 1880751 - RNA, 21 nt, Human
aacacucacauuuauucugcu

SEQ ID NO: 1880752 - RNA, 21 nt, Human
aacacugggagaaaugaaaaa

SEQ ID NO: 1880753 - RNA, 17 nt, Human
aacacucauugaccuga

SEQ ID NO: 1880754 - RNA, 19 nt, Human
aacacaaacgggcucagca

SEQ ID NO: 1880755 - RNA, 13 nt, Human
aacacaaacugua

SEQ ID NO: 1880756 - RNA, 15 nt, Human
aacacaaacuguaaa

SEQ ID NO: 1880757 - RNA, 16 nt, Human
aacacaaacuguaaau

SEQ ID NO: 1880758 - RNA, 19 nt, Human
aacacaaacuguaaauaaa

SEQ ID NO: 1880759 - RNA, 20 nt, Human
aacacaaagagaaaaagaaa

SEQ ID NO: 1880760 - RNA, 17 nt, Human
aaauuucucuacugucu

SEQ ID NO: 1880761 - RNA, 19 nt, Human
aaauuucuaaaucuccaaa

SEQ ID NO: 1880762 - RNA, 23 nt, Human
guccaugaagauguagaggagaa

SEQ ID NO: 1880763 - RNA, 22 nt, Human
guccaugaagauguagaggaga

SEQ ID NO: 1880764 - RNA, 19 nt, Human
gucauuugagcagggcuca

SEQ ID NO: 1880765 - RNA, 15 nt, Human
gucccaccccacaca

SEQ ID NO: 1880766 - RNA, 22 nt, Human
guccccaccgcagacaggacca

SEQ ID NO: 1880767 - RNA, 22 nt, Human
guccccagacuccaccaagccu

SEQ ID NO: 1880768 - RNA, 20 nt, Human
gucccaccccacacacgcca

SEQ ID NO: 1880769 - RNA, 18 nt, Human
guccccaccgcagacagg

SEQ ID NO: 1880770 - RNA, 19 nt, Human
gucccugguggcagcucac

SEQ ID NO: 1880771 - RNA, 15 nt, Human
gucccuaauaaagcu

SEQ ID NO: 1880772 - RNA, 18 nt, Human
gucccugguggcagcuca

SEQ ID NO: 1880773 - RNA, 18 nt, Human
gucccuuacgugaguccu

SEQ ID NO: 1880774 - RNA, 19 nt, Human
gucccuuacgugaguccug

SEQ ID NO: 1880775 - RNA, 12 nt, Human
gucccuaauaaa

SEQ ID NO: 1880776 - RNA, 22 nt, Human
guccccuguuuguuucugaaag

SEQ ID NO: 1880777 - RNA, 18 nt, Human
guccccuguuuguuucug

SEQ ID NO: 1880778 - RNA, 12 nt, Human
guccccagagaa

SEQ ID NO: 1880779 - RNA, 23 nt, Human
guccccagagaaagcgcagaugc

SEQ ID NO: 1880780 - RNA, 15 nt, Human
gucagaaacaggacc

SEQ ID NO: 1880781 - RNA, 23 nt, Human
gucagaaguuucugccgcagccc

SEQ ID NO: 1880782 - RNA, 21 nt, Human
gucagaaguuucugccgcagc

SEQ ID NO: 1880783 - RNA, 21 nt, Human
gucacugcuuaacuucacaua

SEQ ID NO: 1880784 - RNA, 15 nt, Human
gucacugcuuaacuu

SEQ ID NO: 1880785 - RNA, 15 nt, Human
gucacugcucuggac

SEQ ID NO: 1880786 - RNA, 22 nt, Human
gucagguggggcagcuugaggg

SEQ ID NO: 1880787 - RNA, 18 nt, Human
gucagguggggcagcuug

SEQ ID NO: 1880788 - RNA, 17 nt, Human
gucagguggggcagcuu

SEQ ID NO: 1880789 - RNA, 16 nt, Human
gucagguggggcagcu

SEQ ID NO: 1880790 - RNA, 12 nt, Human
aaauuucuaaau

SEQ ID NO: 1880791 - RNA, 15 nt, Human
aaauuucuaaaucuc

SEQ ID NO: 1880792 - RNA, 13 nt, Human
aaauuucuaaauc

SEQ ID NO: 1880793 - RNA, 13 nt, Human
gucagguuugagu

SEQ ID NO: 1880794 - RNA, 23 nt, Human
gucacauggccuaugcacauaug

SEQ ID NO: 1880795 - RNA, 21 nt, Human
gucacauggccuaugcacaua

SEQ ID NO: 1880796 - RNA, 18 nt, Human
gucacauuccugaacagg

SEQ ID NO: 1880797 - RNA, 22 nt, Human
gucaccaaaucagcugcuacua

SEQ ID NO: 1880798 - RNA, 12 nt, Human
gucacaggcagg

SEQ ID NO: 1880799 - RNA, 20 nt, Human
gucacaggaaguagaggagg

SEQ ID NO: 1880800 - RNA, 21 nt, Human
gucaauuuuguuauguauauu

SEQ ID NO: 1880801 - RNA, 23 nt, Human
gucacaaagaacauguagaaaac

SEQ ID NO: 1880802 - RNA, 15 nt, Human
gucacaggaaguaga

SEQ ID NO: 1880803 - RNA, 13 nt, Human
gucacaggaagua

SEQ ID NO: 1880804 - RNA, 22 nt, Human
gucaauuacaggaaguacugga

SEQ ID NO: 1880805 - RNA, 23 nt, Human
gucacucuggcagcucagagagg

SEQ ID NO: 1880806 - RNA, 15 nt, Human
gucaccaagcccagu

SEQ ID NO: 1880807 - RNA, 12 nt, Human
gucaccaagccc

SEQ ID NO: 1880808 - RNA, 14 nt, Human
gucacugagacagc

SEQ ID NO: 1880809 - RNA, 15 nt, Human
gucacugagacagcc

SEQ ID NO: 1880810 - RNA, 16 nt, Human
gucacugagacagccc

SEQ ID NO: 1880811 - RNA, 10 nt, Human
gucacugcuu

SEQ ID NO: 1880812 - RNA, 17 nt, Human
gucacugagacagcccg

SEQ ID NO: 1880813 - RNA, 18 nt, Human
gucacugagacagcccgg

SEQ ID NO: 1880814 - RNA, 21 nt, Human
gucacugagacagcccgggcu

SEQ ID NO: 1880815 - RNA, 23 nt, Human
gucacugagacagcccgggcucu

SEQ ID NO: 1880816 - RNA, 13 nt, Human
guauuuauaaaua

SEQ ID NO: 1880817 - RNA, 16 nt, Human
guauuuacgcuuugau

SEQ ID NO: 1880818 - RNA, 17 nt, Human
guauuuacgcuuugauu

SEQ ID NO: 1880819 - RNA, 19 nt, Human
guauuuacgcuuugauuca

SEQ ID NO: 1880820 - RNA, 20 nt, Human
guauuguuugggauccuauu

SEQ ID NO: 1880821 - RNA, 9 nt, Human
guauuuaac

SEQ ID NO: 1880822 - RNA, 23 nt, Human
guauuguuugggauccuauugaa

SEQ ID NO: 1880823 - RNA, 21 nt, Human
aaaugucucuuuaaugucaca

SEQ ID NO: 1880824 - RNA, 16 nt, Human
aaaugucuauuaaggu

SEQ ID NO: 1880825 - RNA, 17 nt, Human
aaauguauauauguaua

SEQ ID NO: 1880826 - RNA, 18 nt, Human
aaauguaugauuacauca

SEQ ID NO: 1880827 - RNA, 17 nt, Human
aaauguaucuuauucac

SEQ ID NO: 1880828 - RNA, 14 nt, Human
aaauguaucuucca

SEQ ID NO: 1880829 - RNA, 14 nt, Human
aaauguaucuuauu

SEQ ID NO: 1880830 - RNA, 16 nt, Human
aaaucauucauuuucu

SEQ ID NO: 1880831 - RNA, 21 nt, Human
guauucucuccuguaccucuu

SEQ ID NO: 1880832 - RNA, 18 nt, Human
guauucucuccuguaccu

SEQ ID NO: 1880833 - RNA, 17 nt, Human
aaauuguauuacaaauc

SEQ ID NO: 1880834 - RNA, 17 nt, Human
aaauuccaagugauuga

SEQ ID NO: 1880835 - RNA, 14 nt, Human
aaauucacaaacuu

SEQ ID NO: 1880836 - RNA, 15 nt, Human
aaauucacaaacuuu

SEQ ID NO: 1880837 - RNA, 17 nt, Human
aaauucaauuguaaauu

SEQ ID NO: 1880838 - RNA, 19 nt, Human
aaauucaauuguaaauuga

SEQ ID NO: 1880839 - RNA, 20 nt, Human
aaauucaauuguaaauugaa

SEQ ID NO: 1880840 - RNA, 23 nt, Human
aaauucaauuguaaauugaauca

SEQ ID NO: 1880841 - RNA, 17 nt, Human
aaauucacaaacuuuua

SEQ ID NO: 1880842 - RNA, 18 nt, Human
aaauucacaaacuuuuau

SEQ ID NO: 1880843 - RNA, 16 nt, Human
aaauuccccacccuga

SEQ ID NO: 1880844 - RNA, 20 nt, Human
aaauucccaacaaacauuga

SEQ ID NO: 1880845 - RNA, 21 nt, Human
aaauuaggauguaaaucugcu

SEQ ID NO: 1880846 - RNA, 23 nt, Human
aaauuaugugccagauuuaugca

SEQ ID NO: 1880847 - RNA, 15 nt, Human
aaauucaauuguaaa

SEQ ID NO: 1880848 - RNA, 21 nt, Human
aaauucaacguuaauaauucu

SEQ ID NO: 1880849 - RNA, 20 nt, Human
gucucuuuuuuuggcccagg

SEQ ID NO: 1880850 - RNA, 21 nt, Human
gucucuuuuuuuggcccaggc

SEQ ID NO: 1880851 - RNA, 22 nt, Human
gucucuuucaugaguuuuuccc

SEQ ID NO: 1880852 - RNA, 14 nt, Human
gucucaaaaaaaca

SEQ ID NO: 1880853 - RNA, 12 nt, Human
gucuauuugaga

SEQ ID NO: 1880854 - RNA, 17 nt, Human
gucucaaaaaaagaaaa

SEQ ID NO: 1880855 - RNA, 19 nt, Human
gucucaaaaaaagaaaaag

SEQ ID NO: 1880856 - RNA, 14 nt, Human
gucugacaggcaau

SEQ ID NO: 1880857 - RNA, 13 nt, Human
gucugacaggcaa

SEQ ID NO: 1880858 - RNA, 12 nt, Human
gucugacaggca

SEQ ID NO: 1880859 - RNA, 18 nt, Human
gucugacaggcaaugcug

SEQ ID NO: 1880860 - RNA, 15 nt, Human
gucugacaggcaaug

SEQ ID NO: 1880861 - RNA, 20 nt, Human
gucugacaggcaaugcuggc

SEQ ID NO: 1880862 - RNA, 14 nt, Human
gucuggaaguccaa

SEQ ID NO: 1880863 - RNA, 19 nt, Human
gucuuauauauuguagaua

SEQ ID NO: 1880864 - RNA, 16 nt, Human
gucuggaaugcagugg

SEQ ID NO: 1880865 - RNA, 15 nt, Human
gucuggaaugcagug

SEQ ID NO: 1880866 - RNA, 18 nt, Human
gucuggaaugcaguggua

SEQ ID NO: 1880867 - RNA, 21 nt, Human
gucuugugacuagugcugaag

SEQ ID NO: 1880868 - RNA, 20 nt, Human
gucuugugacuagugcugaa

SEQ ID NO: 1880869 - RNA, 19 nt, Human
gucuugugacuagugcuga

SEQ ID NO: 1880870 - RNA, 13 nt, Human
gucuugugacuag

SEQ ID NO: 1880871 - RNA, 22 nt, Human
gucuucaaccagggauuguuuc

SEQ ID NO: 1880872 - RNA, 20 nt, Human
gucuuguguuucuuuaguuu

SEQ ID NO: 1880873 - RNA, 22 nt, Human
gucuuuccacuccuccuagcca

SEQ ID NO: 1880874 - RNA, 12 nt, Human
aacuauggccug

SEQ ID NO: 1880875 - RNA, 18 nt, Human
aacuauggaucagaauag

SEQ ID NO: 1880876 - RNA, 12 nt, Human
aacguggcugcu

SEQ ID NO: 1880877 - RNA, 13 nt, Human
aacguggcugcuu

SEQ ID NO: 1880878 - RNA, 17 nt, Human
aacguuuuuccuguucu

SEQ ID NO: 1880879 - RNA, 21 nt, Human
aacuaggugcauauuuauaaa

SEQ ID NO: 1880880 - RNA, 17 nt, Human
aacuagggaagauaaua

SEQ ID NO: 1880881 - RNA, 15 nt, Human
aaccuuauuguaccu

SEQ ID NO: 1880882 - RNA, 16 nt, Human
aaccuuauuguaccuc

SEQ ID NO: 1880883 - RNA, 17 nt, Human
aaccuuauuguaccucu

SEQ ID NO: 1880884 - RNA, 18 nt, Human
aaccuuauuguaccucuc

SEQ ID NO: 1880885 - RNA, 19 nt, Human
aaccuuauuguaccucucu

SEQ ID NO: 1880886 - RNA, 12 nt, Human
aaccuggggggc

SEQ ID NO: 1880887 - RNA, 14 nt, Human
aaccugggauucag

SEQ ID NO: 1880888 - RNA, 17 nt, Human
aaccugggauucaggaa

SEQ ID NO: 1880889 - RNA, 20 nt, Human
aaccugggauucaggaaugu

SEQ ID NO: 1880890 - RNA, 21 nt, Human
aaccugggauucaggaaugug

SEQ ID NO: 1880891 - RNA, 12 nt, Human
gucuuuccuaga

SEQ ID NO: 1880892 - RNA, 15 nt, Human
aacgucuuaaauauu

SEQ ID NO: 1880893 - RNA, 17 nt, Human
aaccuucuggccuccca

SEQ ID NO: 1880894 - RNA, 19 nt, Human
aaccuucacacacagacug

SEQ ID NO: 1880895 - RNA, 14 nt, Human
aacgucuuaaauau

SEQ ID NO: 1880896 - RNA, 12 nt, Human
aacgucuuaaau

SEQ ID NO: 1880897 - RNA, 12 nt, Human
aaccuucuggcc

SEQ ID NO: 1880898 - RNA, 13 nt, Human
aacgucugugcca

SEQ ID NO: 1880899 - RNA, 16 nt, Human
gugagacucugucuca

SEQ ID NO: 1880900 - RNA, 14 nt, Human
gugagacucugucu

SEQ ID NO: 1880901 - RNA, 22 nt, Human
gugagacucgagaacuuucauu

SEQ ID NO: 1880902 - RNA, 20 nt, Human
gugagacucgagaacuuuca

SEQ ID NO: 1880903 - RNA, 17 nt, Human
gugagacucgagaacuu

SEQ ID NO: 1880904 - RNA, 22 nt, Human
gugagacccugucucaaaaaaa

SEQ ID NO: 1880905 - RNA, 19 nt, Human
gugacaugucuuuucuugc

SEQ ID NO: 1880906 - RNA, 19 nt, Human
gugaaguuuaauugacuua

SEQ ID NO: 1880907 - RNA, 23 nt, Human
gugaauaauacaguaucucaggg

SEQ ID NO: 1880908 - RNA, 15 nt, Human
gugaaguugcuucuu

SEQ ID NO: 1880909 - RNA, 13 nt, Human
gugaauaaagugc

SEQ ID NO: 1880910 - RNA, 22 nt, Human
gugacagagugagacucugucu

SEQ ID NO: 1880911 - RNA, 20 nt, Human
gugacagagugagacucugu

SEQ ID NO: 1880912 - RNA, 23 nt, Human
gugacagaggcagccccauucug

SEQ ID NO: 1880913 - RNA, 14 nt, Human
gugaauaaagugcu

SEQ ID NO: 1880914 - RNA, 20 nt, Human
aacugauuuuuuuuuccuuc

SEQ ID NO: 1880915 - RNA, 21 nt, Human
aacugauuuuuuuuuccuuca

SEQ ID NO: 1880916 - RNA, 13 nt, Human
aacucuuuuaaca

SEQ ID NO: 1880917 - RNA, 14 nt, Human
aacucuuuuaacag

SEQ ID NO: 1880918 - RNA, 22 nt, Human
aacugauuuuuuuuuccuucag

SEQ ID NO: 1880919 - RNA, 23 nt, Human
aacugauuuuuuuuuccuucagu

SEQ ID NO: 1880920 - RNA, 16 nt, Human
aacugcauuggcuuug

SEQ ID NO: 1880921 - RNA, 18 nt, Human
aacugccaaaaugcucua

SEQ ID NO: 1880922 - RNA, 17 nt, Human
aacucuugauuauccau

SEQ ID NO: 1880923 - RNA, 11 nt, Human
aacucuugauu

SEQ ID NO: 1880924 - RNA, 22 nt, Human
aacucuccucugcugcuggcug

SEQ ID NO: 1880925 - RNA, 23 nt, Human
aacucuccucugcugcuggcugg

SEQ ID NO: 1880926 - RNA, 12 nt, Human
aacucucugaac

SEQ ID NO: 1880927 - RNA, 18 nt, Human
gugagacucugucucaaa

SEQ ID NO: 1880928 - RNA, 12 nt, Human
gugaggcucugc

SEQ ID NO: 1880929 - RNA, 13 nt, Human
gugaggcucugcc

SEQ ID NO: 1880930 - RNA, 14 nt, Human
gugaggcucugccc

SEQ ID NO: 1880931 - RNA, 15 nt, Human
gugaggcucugcccu

SEQ ID NO: 1880932 - RNA, 16 nt, Human
gugaggcucugcccuu

SEQ ID NO: 1880933 - RNA, 17 nt, Human
gugaggcucugcccuug

SEQ ID NO: 1880934 - RNA, 19 nt, Human
gugagucaccaagcccagu

SEQ ID NO: 1880935 - RNA, 17 nt, Human
gugagggagggcuguca

SEQ ID NO: 1880936 - RNA, 19 nt, Human
aacucuccucugcugcugg

SEQ ID NO: 1880937 - RNA, 21 nt, Human
aacucuccucugcugcuggcu

SEQ ID NO: 1880938 - RNA, 17 nt, Human
gugagucaccaagccca

SEQ ID NO: 1880939 - RNA, 23 nt, Human
gugaguacuacaguccucccauc

SEQ ID NO: 1880940 - RNA, 18 nt, Human
gugaggcucugcccuugg

SEQ ID NO: 1880941 - RNA, 14 nt, Human
gugcuccuccuugg

SEQ ID NO: 1880942 - RNA, 14 nt, Human
gugcucgccccagc

SEQ ID NO: 1880943 - RNA, 16 nt, Human
gugcucgccccagcag

SEQ ID NO: 1880944 - RNA, 14 nt, Human
gugcucgcccugcg

SEQ ID NO: 1880945 - RNA, 22 nt, Human
gugcuccauggcugccaucuca

SEQ ID NO: 1880946 - RNA, 18 nt, Human
gugcuccauggcugccau

SEQ ID NO: 1880947 - RNA, 19 nt, Human
gugcucaggagcccuggga

SEQ ID NO: 1880948 - RNA, 18 nt, Human
gugcucaggagcccuggg

SEQ ID NO: 1880949 - RNA, 19 nt, Human
gugcuaucucccccagccc

SEQ ID NO: 1880950 - RNA, 16 nt, Human
gugcucaggagcccug

SEQ ID NO: 1880951 - RNA, 14 nt, Human
gugcucuggacagg

SEQ ID NO: 1880952 - RNA, 13 nt, Human
gugcucuggacag

SEQ ID NO: 1880953 - RNA, 16 nt, Human
gugcucugaucaucca

SEQ ID NO: 1880954 - RNA, 15 nt, Human
gugcucuccaagccc

SEQ ID NO: 1880955 - RNA, 12 nt, Human
gugcugcccugc

SEQ ID NO: 1880956 - RNA, 13 nt, Human
gugcugcccugcc

SEQ ID NO: 1880957 - RNA, 14 nt, Human
gugcugcccugccc

SEQ ID NO: 1880958 - RNA, 15 nt, Human
gugcugcccugccca

SEQ ID NO: 1880959 - RNA, 17 nt, Human
gugcuaggaacacuccu

SEQ ID NO: 1880960 - RNA, 15 nt, Human
gugcuaucuccccca

SEQ ID NO: 1880961 - RNA, 18 nt, Human
gugcuaucucccccagcc

SEQ ID NO: 1880962 - RNA, 16 nt, Human
gugcuacaggggccag

SEQ ID NO: 1880963 - RNA, 19 nt, Human
gugcuacaggggccagaag

SEQ ID NO: 1880964 - RNA, 20 nt, Human
gugcuacaggggccagaaga

SEQ ID NO: 1880965 - RNA, 14 nt, Human
aagaagagaaagaa

SEQ ID NO: 1880966 - RNA, 14 nt, Human
aagaagagccacag

SEQ ID NO: 1880967 - RNA, 15 nt, Human
aagaagagccacagu

SEQ ID NO: 1880968 - RNA, 22 nt, Human
aagaaaauaguggugugauuug

SEQ ID NO: 1880969 - RNA, 21 nt, Human
aagaaaauaguggugugauuu

SEQ ID NO: 1880970 - RNA, 15 nt, Human
aagaaaauaguggug

SEQ ID NO: 1880971 - RNA, 13 nt, Human
aagaaaacaucua

SEQ ID NO: 1880972 - RNA, 16 nt, Human
aagaaaacaucuauuc

SEQ ID NO: 1880973 - RNA, 16 nt, Human
aagaaaauaccaagga

SEQ ID NO: 1880974 - RNA, 19 nt, Human
aagaaagcccuuaggaaga

SEQ ID NO: 1880975 - RNA, 16 nt, Human
aagaaagaaaaucagg

SEQ ID NO: 1880976 - RNA, 13 nt, Human
aagaaagaaaauc

SEQ ID NO: 1880977 - RNA, 14 nt, Human
aagaaagaaaauca

SEQ ID NO: 1880978 - RNA, 17 nt, Human
aagaaaaaugagccugg

SEQ ID NO: 1880979 - RNA, 18 nt, Human
aagaaaaaugagccuggc

SEQ ID NO: 1880980 - RNA, 19 nt, Human
aagaaaaaauauuuucccu

SEQ ID NO: 1880981 - RNA, 13 nt, Human
aagaaaaagaaaa

SEQ ID NO: 1880982 - RNA, 18 nt, Human
aagaaaaagaaaaagaaa

SEQ ID NO: 1880983 - RNA, 19 nt, Human
gugccagauuuaugcauau

SEQ ID NO: 1880984 - RNA, 23 nt, Human
aacuuuaccuuuuuuauacauaa

SEQ ID NO: 1880985 - RNA, 22 nt, Human
aacuuuaccuuuuuuauacaua

SEQ ID NO: 1880986 - RNA, 21 nt, Human
aacuuuaccuuuuuuauacau

SEQ ID NO: 1880987 - RNA, 21 nt, Human
gugcauuuggugguuucagaa

SEQ ID NO: 1880988 - RNA, 23 nt, Human
gugccaaaaacaacaacaaaaug

SEQ ID NO: 1880989 - RNA, 19 nt, Human
gugcauuugaggucuguuc

SEQ ID NO: 1880990 - RNA, 17 nt, Human
gugcauuugaggucugu

SEQ ID NO: 1880991 - RNA, 21 nt, Human
gugcacaugcacgugugugca

SEQ ID NO: 1880992 - RNA, 23 nt, Human
gugcacaagcuccaagcucccag

SEQ ID NO: 1880993 - RNA, 18 nt, Human
gugcaaugaccuuucaau

SEQ ID NO: 1880994 - RNA, 13 nt, Human
gugcacaagcucc

SEQ ID NO: 1880995 - RNA, 16 nt, Human
gugcacaagcuccaag

SEQ ID NO: 1880996 - RNA, 21 nt, Human
gugcacaagcuccaagcuccc

SEQ ID NO: 1880997 - RNA, 20 nt, Human
gugaucuuuuguucccaucc

SEQ ID NO: 1880998 - RNA, 15 nt, Human
gugaucucagaucag

SEQ ID NO: 1880999 - RNA, 14 nt, Human
gugaucucagauca

SEQ ID NO: 1881000 - RNA, 10 nt, Human
gugauguguc

SEQ ID NO: 1881001 - RNA, 15 nt, Human
gugaugugaagccaa

SEQ ID NO: 1881002 - RNA, 17 nt, Human
gugauuaccagggacug

SEQ ID NO: 1881003 - RNA, 16 nt, Human
gugauuaccagggacu

SEQ ID NO: 1881004 - RNA, 11 nt, Human
gugauuaccag

SEQ ID NO: 1881005 - RNA, 19 nt, Human
gugcaauaaaucugaccca

SEQ ID NO: 1881006 - RNA, 21 nt, Human
gugcaauaaaucugacccagu

SEQ ID NO: 1881007 - RNA, 22 nt, Human
gugcaauaaaucugacccagug

SEQ ID NO: 1881008 - RNA, 23 nt, Human
gugcaauaaaucugacccagugc

SEQ ID NO: 1881009 - RNA, 22 nt, Human
aacuucaccauauuaccacaga

SEQ ID NO: 1881010 - RNA, 22 nt, Human
aacuucacauauugauuuccgu

SEQ ID NO: 1881011 - RNA, 14 nt, Human
aacuucacauauug

SEQ ID NO: 1881012 - RNA, 13 nt, Human
aacuucagacaua

SEQ ID NO: 1881013 - RNA, 21 nt, Human
aacuugagaacuuuauuucca

SEQ ID NO: 1881014 - RNA, 18 nt, Human
aacuugagaacuuuauuu

SEQ ID NO: 1881015 - RNA, 22 nt, Human
aacuugagaacuuuauuuccaa

SEQ ID NO: 1881016 - RNA, 21 nt, Human
acaaagaugggugaaggcugg

SEQ ID NO: 1881017 - RNA, 22 nt, Human
acaaagaugggugaaggcuggc

SEQ ID NO: 1881018 - RNA, 12 nt, Human
acaaagcagcca

SEQ ID NO: 1881019 - RNA, 18 nt, Human
acaaaggcaaagggucca

SEQ ID NO: 1881020 - RNA, 13 nt, Human
acaaagcagccac

SEQ ID NO: 1881021 - RNA, 22 nt, Human
acaaaggaugcccaaagaugca

SEQ ID NO: 1881022 - RNA, 14 nt, Human
acaaagggcccaga

SEQ ID NO: 1881023 - RNA, 18 nt, Human
acaaaaggauaaugaaua

SEQ ID NO: 1881024 - RNA, 22 nt, Human
acaaaagcaugugagacugguu

SEQ ID NO: 1881025 - RNA, 11 nt, Human
acaaaagcaug

SEQ ID NO: 1881026 - RNA, 21 nt, Human
aauuguguuuauaauuuuaaa

SEQ ID NO: 1881027 - RNA, 20 nt, Human
aauuguguuuauaauuuuaa

SEQ ID NO: 1881028 - RNA, 16 nt, Human
aauuguuacaaauugu

SEQ ID NO: 1881029 - RNA, 19 nt, Human
uagaggagaaacuggaacu

SEQ ID NO: 1881030 - RNA, 15 nt, Human
uagauauaugcucug

SEQ ID NO: 1881031 - RNA, 22 nt, Human
uagaggagaaacuggaacucuc

SEQ ID NO: 1881032 - RNA, 19 nt, Human
uagauauaugcucugcaug

SEQ ID NO: 1881033 - RNA, 15 nt, Human
uagccagaggacugu

SEQ ID NO: 1881034 - RNA, 18 nt, Human
acaaauuuacagagacag

SEQ ID NO: 1881035 - RNA, 19 nt, Human
acaaauuuacagagacaga

SEQ ID NO: 1881036 - RNA, 18 nt, Human
uagccagcacacagggca

SEQ ID NO: 1881037 - RNA, 19 nt, Human
uagccagcacacagggcag

SEQ ID NO: 1881038 - RNA, 20 nt, Human
uagccagcacacagggcagu

SEQ ID NO: 1881039 - RNA, 16 nt, Human
acaaauuuuuauuucu

SEQ ID NO: 1881040 - RNA, 18 nt, Human
acaaauuuuuauuucuaa

SEQ ID NO: 1881041 - RNA, 11 nt, Human
uagccagagga

SEQ ID NO: 1881042 - RNA, 15 nt, Human
uagccagaggagaga

SEQ ID NO: 1881043 - RNA, 16 nt, Human
uagccacauuuggaau

SEQ ID NO: 1881044 - RNA, 23 nt, Human
acaacacucauugaccugaggcc

SEQ ID NO: 1881045 - RNA, 21 nt, Human
acaacacucauugaccugagg

SEQ ID NO: 1881046 - RNA, 21 nt, Human
acaaauuuuuauuucuaaaau

SEQ ID NO: 1881047 - RNA, 19 nt, Human
acaagaccacguuucuaaa

SEQ ID NO: 1881048 - RNA, 19 nt, Human
acaagacccuugugguccc

SEQ ID NO: 1881049 - RNA, 20 nt, Human
acaagacccaaaaggcagaa

SEQ ID NO: 1881050 - RNA, 19 nt, Human
uagcauggcugccaauggg

SEQ ID NO: 1881051 - RNA, 14 nt, Human
uagauggcuccucu

SEQ ID NO: 1881052 - RNA, 14 nt, Human
uagauggauucucc

SEQ ID NO: 1881053 - RNA, 16 nt, Human
uagaugcuggcccagg

SEQ ID NO: 1881054 - RNA, 18 nt, Human
uagaugcuggcccagggc

SEQ ID NO: 1881055 - RNA, 21 nt, Human
uagaugcuggcccagggccca

SEQ ID NO: 1881056 - RNA, 22 nt, Human
uagaugcuggcccagggcccag

SEQ ID NO: 1881057 - RNA, 13 nt, Human
uagaugcuggccc

SEQ ID NO: 1881058 - RNA, 14 nt, Human
uagaugcuggccca

SEQ ID NO: 1881059 - RNA, 15 nt, Human
uagaugcuggcccag

SEQ ID NO: 1881060 - RNA, 21 nt, Human
uagccaaggccaaaggaagca

SEQ ID NO: 1881061 - RNA, 22 nt, Human
uagcauuuugcuaaaugugaau

SEQ ID NO: 1881062 - RNA, 14 nt, Human
uagccaaggccaaa

SEQ ID NO: 1881063 - RNA, 16 nt, Human
uagcauuuugcuaaau

SEQ ID NO: 1881064 - RNA, 20 nt, Human
uaggaggaccagagcuacug

SEQ ID NO: 1881065 - RNA, 23 nt, Human
uaggagcugccuuggcucagaca

SEQ ID NO: 1881066 - RNA, 18 nt, Human
uaggagcugccuuggcuc

SEQ ID NO: 1881067 - RNA, 14 nt, Human
uaggacuguagaaa

SEQ ID NO: 1881068 - RNA, 13 nt, Human
uaggacuguagaa

SEQ ID NO: 1881069 - RNA, 12 nt, Human
uaggagaagcca

SEQ ID NO: 1881070 - RNA, 15 nt, Human
uaggagaagccagga

SEQ ID NO: 1881071 - RNA, 16 nt, Human
uaggagaagccaggaa

SEQ ID NO: 1881072 - RNA, 21 nt, Human
uagcuuacaagccagcuggag

SEQ ID NO: 1881073 - RNA, 13 nt, Human
uagcuguugagcu

SEQ ID NO: 1881074 - RNA, 16 nt, Human
uagcuguugagcuguu

SEQ ID NO: 1881075 - RNA, 17 nt, Human
uagcuguugagcuguuu

SEQ ID NO: 1881076 - RNA, 19 nt, Human
uaggacucaaaguuucaga

SEQ ID NO: 1881077 - RNA, 21 nt, Human
uagggaaggauacaaaagcau

SEQ ID NO: 1881078 - RNA, 12 nt, Human
uaggcauuuccu

SEQ ID NO: 1881079 - RNA, 21 nt, Human
uagggaauggcacagcccaaa

SEQ ID NO: 1881080 - RNA, 14 nt, Human
uaggcauuguggga

SEQ ID NO: 1881081 - RNA, 16 nt, Human
uaggcauuugcugaau

SEQ ID NO: 1881082 - RNA, 20 nt, Human
uaggcauuugcugaauacag

SEQ ID NO: 1881083 - RNA, 18 nt, Human
uaggagggaguuaucuaa

SEQ ID NO: 1881084 - RNA, 21 nt, Human
uaggagggaguuaucuaaaag

SEQ ID NO: 1881085 - RNA, 16 nt, Human
uaggagggaguuaucu

SEQ ID NO: 1881086 - RNA, 14 nt, Human
acaaggagggcaca

SEQ ID NO: 1881087 - RNA, 21 nt, Human
acaaggauagaugcuggccca

SEQ ID NO: 1881088 - RNA, 15 nt, Human
acaaggacuuccugu

SEQ ID NO: 1881089 - RNA, 16 nt, Human
acaaggauagaugcug

SEQ ID NO: 1881090 - RNA, 17 nt, Human
acaaggauagaugcugg

SEQ ID NO: 1881091 - RNA, 18 nt, Human
acaaggauagaugcuggc

SEQ ID NO: 1881092 - RNA, 18 nt, Human
acaagaccacguuucuaa

SEQ ID NO: 1881093 - RNA, 21 nt, Human
acaauaaguuaacuauuuuau

SEQ ID NO: 1881094 - RNA, 14 nt, Human
acaauaccuuauuu

SEQ ID NO: 1881095 - RNA, 12 nt, Human
acaaugacuuac

SEQ ID NO: 1881096 - RNA, 19 nt, Human
acaaugacuuacuguacau

SEQ ID NO: 1881097 - RNA, 20 nt, Human
acaaugacuaauucuugcau

SEQ ID NO: 1881098 - RNA, 18 nt, Human
acaaugacuuacuguaca

SEQ ID NO: 1881099 - RNA, 17 nt, Human
acaaugacuuacuguac

SEQ ID NO: 1881100 - RNA, 14 nt, Human
acacauaccuuugg

SEQ ID NO: 1881101 - RNA, 15 nt, Human
acacauacccucuuc

SEQ ID NO: 1881102 - RNA, 17 nt, Human
acacauaccuuugguua

SEQ ID NO: 1881103 - RNA, 13 nt, Human
acacauaugaggg

SEQ ID NO: 1881104 - RNA, 17 nt, Human
acacauaugagggggaa

SEQ ID NO: 1881105 - RNA, 19 nt, Human
uauaaaagccuguuuaaga

SEQ ID NO: 1881106 - RNA, 22 nt, Human
uauaaaagggacugagaaauuu

SEQ ID NO: 1881107 - RNA, 19 nt, Human
uauaaaaauaaaaaacacu

SEQ ID NO: 1881108 - RNA, 20 nt, Human
uauaaaagccuguuuaagag

SEQ ID NO: 1881109 - RNA, 20 nt, Human
uaguuccaccaucaagccac

SEQ ID NO: 1881110 - RNA, 15 nt, Human
uaguuacuauaugcc

SEQ ID NO: 1881111 - RNA, 18 nt, Human
uauaaaaagcuuccauga

SEQ ID NO: 1881112 - RNA, 20 nt, Human
acacauuuuauuuuauuaug

SEQ ID NO: 1881113 - RNA, 19 nt, Human
acacauuuuauuuuauuau

SEQ ID NO: 1881114 - RNA, 14 nt, Human
acacauuuuauuuu

SEQ ID NO: 1881115 - RNA, 21 nt, Human
acacaugagcaucaggccagg

SEQ ID NO: 1881116 - RNA, 18 nt, Human
acacaugauccugcaauu

SEQ ID NO: 1881117 - RNA, 17 nt, Human
acaccauugaaggcuua

SEQ ID NO: 1881118 - RNA, 17 nt, Human
acacccucaaccucuuc

SEQ ID NO: 1881119 - RNA, 18 nt, Human
acacccucaaccucuucu

SEQ ID NO: 1881120 - RNA, 22 nt, Human
acacucacauuuauucugcuca

SEQ ID NO: 1881121 - RNA, 20 nt, Human
acacucacauuuauucugcu

SEQ ID NO: 1881122 - RNA, 15 nt, Human
uauaaguguguguuu

SEQ ID NO: 1881123 - RNA, 15 nt, Human
acacucaaaagcugg

SEQ ID NO: 1881124 - RNA, 17 nt, Human
acacuaugguauuugag

SEQ ID NO: 1881125 - RNA, 18 nt, Human
acacuaugguauuugagu

SEQ ID NO: 1881126 - RNA, 19 nt, Human
acacuaugguauuugagug

SEQ ID NO: 1881127 - RNA, 22 nt, Human
acacuaugguauuugaguguuu

SEQ ID NO: 1881128 - RNA, 16 nt, Human
acaccgggcacucaga

SEQ ID NO: 1881129 - RNA, 21 nt, Human
acaccucugcacaagcugcac

SEQ ID NO: 1881130 - RNA, 20 nt, Human
acacuaaccacgcuggaccu

SEQ ID NO: 1881131 - RNA, 23 nt, Human
acaccuuuuauugacacagaaaa

SEQ ID NO: 1881132 - RNA, 21 nt, Human
acaccuuuuauugacacagaa

SEQ ID NO: 1881133 - RNA, 14 nt, Human
acaccuuucuccuu

SEQ ID NO: 1881134 - RNA, 17 nt, Human
acaccuuucuccuuugu

SEQ ID NO: 1881135 - RNA, 22 nt, Human
acaccuuucuccuuuguacuuu

SEQ ID NO: 1881136 - RNA, 15 nt, Human
acaccuuauauuuac

SEQ ID NO: 1881137 - RNA, 23 nt, Human
uaguaccaaucauuuuaauuauu

SEQ ID NO: 1881138 - RNA, 16 nt, Human
uaguaccauuuauaca

SEQ ID NO: 1881139 - RNA, 16 nt, Human
uaguaccaaucauuuu

SEQ ID NO: 1881140 - RNA, 19 nt, Human
uaguaacuucuuauggaau

SEQ ID NO: 1881141 - RNA, 18 nt, Human
uaguaacuucuuauggaa

SEQ ID NO: 1881142 - RNA, 18 nt, Human
acacaguauuacuucugc

SEQ ID NO: 1881143 - RNA, 15 nt, Human
acacacugaugcuua

SEQ ID NO: 1881144 - RNA, 17 nt, Human
acacacugaugcuuaga

SEQ ID NO: 1881145 - RNA, 22 nt, Human
acacaguauuacuucugcuaca

SEQ ID NO: 1881146 - RNA, 19 nt, Human
acacaguauuacuucugcu

SEQ ID NO: 1881147 - RNA, 20 nt, Human
acacagugugaauaaagugc

SEQ ID NO: 1881148 - RNA, 21 nt, Human
uagugaaucacguaaagcuag

SEQ ID NO: 1881149 - RNA, 23 nt, Human
uaguuaagacaugauuuccuuga

SEQ ID NO: 1881150 - RNA, 14 nt, Human
uaguuaagacauga

SEQ ID NO: 1881151 - RNA, 19 nt, Human
uaguuaagacaugauuucc

SEQ ID NO: 1881152 - RNA, 21 nt, Human
uaguuaagacaugauuuccuu

SEQ ID NO: 1881153 - RNA, 18 nt, Human
uaguaccauuuauacaaa

SEQ ID NO: 1881154 - RNA, 19 nt, Human
uaguaccauuuauacaaau

SEQ ID NO: 1881155 - RNA, 20 nt, Human
uaguaccauuuauacaaauu

SEQ ID NO: 1881156 - RNA, 21 nt, Human
uaguccgugcugacagcugcu

SEQ ID NO: 1881157 - RNA, 22 nt, Human
uaguccgugcugacagcugcuc

SEQ ID NO: 1881158 - RNA, 23 nt, Human
uaguccgugcugacagcugcucc

SEQ ID NO: 1881159 - RNA, 19 nt, Human
acaaugugaaaagaaaaau

SEQ ID NO: 1881160 - RNA, 15 nt, Human
acaauguauuuucuu

SEQ ID NO: 1881161 - RNA, 12 nt, Human
acaaugugaacu

SEQ ID NO: 1881162 - RNA, 17 nt, Human
acaaugugaaaagaaaa

SEQ ID NO: 1881163 - RNA, 23 nt, Human
acacaaugugucuuucuuuuugg

SEQ ID NO: 1881164 - RNA, 17 nt, Human
acaaugugaacuuuauu

SEQ ID NO: 1881165 - RNA, 17 nt, Human
acacaaugugucuuucu

SEQ ID NO: 1881166 - RNA, 19 nt, Human
acaauggauaggcacagga

SEQ ID NO: 1881167 - RNA, 24 nt, Human
acaaugcugugcccuaaaguguau

SEQ ID NO: 1881168 - RNA, 23 nt, Human
acaaugcugugcccuaaagugua

SEQ ID NO: 1881169 - RNA, 22 nt, Human
acaaugcugugcccuaaagugu

SEQ ID NO: 1881170 - RNA, 21 nt, Human
acaaugcugugcccuaaagug

SEQ ID NO: 1881171 - RNA, 21 nt, Human
acacacgcgugcacacaccag

SEQ ID NO: 1881172 - RNA, 20 nt, Human
acacaccagagcccaccuug

SEQ ID NO: 1881173 - RNA, 15 nt, Human
acacaccagagccca

SEQ ID NO: 1881174 - RNA, 14 nt, Human
acacaccagagccc

SEQ ID NO: 1881175 - RNA, 21 nt, Human
acacacugcauguuugugauu

SEQ ID NO: 1881176 - RNA, 13 nt, Human
acacacugaugcu

SEQ ID NO: 1881177 - RNA, 22 nt, Human
acacacacgcgugcacacacca

SEQ ID NO: 1881178 - RNA, 14 nt, Human
acacacagcucugu

SEQ ID NO: 1881179 - RNA, 13 nt, Human
acacacagcucug

SEQ ID NO: 1881180 - RNA, 17 nt, Human
acacacagcucuguccu

SEQ ID NO: 1881181 - RNA, 19 nt, Human
acacacagcucuguccugg

SEQ ID NO: 1881182 - RNA, 13 nt, Human
uaugcuaaucagg

SEQ ID NO: 1881183 - RNA, 20 nt, Human
uaugccuuugauguauuuuc

SEQ ID NO: 1881184 - RNA, 17 nt, Human
uaugcuaaaauacauuu

SEQ ID NO: 1881185 - RNA, 17 nt, Human
uaugccugggcagaagg

SEQ ID NO: 1881186 - RNA, 22 nt, Human
uaugccguuacuuuucauauuu

SEQ ID NO: 1881187 - RNA, 24 nt, Human
uaugcauuugaaaauuuugauguu

SEQ ID NO: 1881188 - RNA, 23 nt, Human
uaugcauuugaaaauuuugaugu

SEQ ID NO: 1881189 - RNA, 11 nt, Human
uaugcauuuga

SEQ ID NO: 1881190 - RNA, 23 nt, Human
uauggcuuuugugcauuaucuag

SEQ ID NO: 1881191 - RNA, 20 nt, Human
uauggggauagaugugugga

SEQ ID NO: 1881192 - RNA, 15 nt, Human
uaugcuuauacacuu

SEQ ID NO: 1881193 - RNA, 17 nt, Human
uauggcuuuugugcauu

SEQ ID NO: 1881194 - RNA, 21 nt, Human
uauggcuuuugugcauuaucu

SEQ ID NO: 1881195 - RNA, 18 nt, Human
uauggcuuuugugcauua

SEQ ID NO: 1881196 - RNA, 19 nt, Human
uaucuuugauucuccuuca

SEQ ID NO: 1881197 - RNA, 22 nt, Human
uaucuuugauucuccuucagcc

SEQ ID NO: 1881198 - RNA, 18 nt, Human
acagcccgggcucugccu

SEQ ID NO: 1881199 - RNA, 19 nt, Human
acagcccgggcucugccuc

SEQ ID NO: 1881200 - RNA, 20 nt, Human
acagcccgggcucugccucc

SEQ ID NO: 1881201 - RNA, 21 nt, Human
acagcaaggagauuuacaacu

SEQ ID NO: 1881202 - RNA, 17 nt, Human
acagcccgggcucugcc

SEQ ID NO: 1881203 - RNA, 12 nt, Human
acagaucuggaa

SEQ ID NO: 1881204 - RNA, 23 nt, Human
acagaucgaaccguuuugaagcu

SEQ ID NO: 1881205 - RNA, 14 nt, Human
acagagcccacgcc

SEQ ID NO: 1881206 - RNA, 15 nt, Human
acagagcccacgccc

SEQ ID NO: 1881207 - RNA, 18 nt, Human
acagagcccacgccccca

SEQ ID NO: 1881208 - RNA, 19 nt, Human
acagagcccacgcccccac

SEQ ID NO: 1881209 - RNA, 17 nt, Human
acagcaaggagauuuac

SEQ ID NO: 1881210 - RNA, 14 nt, Human
acagaucuggaacc

SEQ ID NO: 1881211 - RNA, 16 nt, Human
acagaucuggaaccuc

SEQ ID NO: 1881212 - RNA, 20 nt, Human
acagaucuggaaccucagcc

SEQ ID NO: 1881213 - RNA, 21 nt, Human
acagaucuggaaccucagccu

SEQ ID NO: 1881214 - RNA, 22 nt, Human
acagaucuggaaccucagccug

SEQ ID NO: 1881215 - RNA, 14 nt, Human
acagaugaauguau

SEQ ID NO: 1881216 - RNA, 17 nt, Human
acagaugaauguauuua

SEQ ID NO: 1881217 - RNA, 18 nt, Human
acagaugccacacaagga

SEQ ID NO: 1881218 - RNA, 23 nt, Human
uaucaagcuaauaaaauaucauu

SEQ ID NO: 1881219 - RNA, 15 nt, Human
uaucaagcuaauaaa

SEQ ID NO: 1881220 - RNA, 13 nt, Human
uaucaagcuaaua

SEQ ID NO: 1881221 - RNA, 12 nt, Human
uaucaagcuaau

SEQ ID NO: 1881222 - RNA, 17 nt, Human
uauccauauugagucaa

SEQ ID NO: 1881223 - RNA, 15 nt, Human
uaucuauauuuuaca

SEQ ID NO: 1881224 - RNA, 18 nt, Human
acagagaaaguacuucuc

SEQ ID NO: 1881225 - RNA, 11 nt, Human
acagagaaagu

SEQ ID NO: 1881226 - RNA, 13 nt, Human
uaucucccccagc

SEQ ID NO: 1881227 - RNA, 15 nt, Human
uaucuccaagaccag

SEQ ID NO: 1881228 - RNA, 16 nt, Human
uaucucccccagcccc

SEQ ID NO: 1881229 - RNA, 14 nt, Human
uaucucccccagcc

SEQ ID NO: 1881230 - RNA, 23 nt, Human
uaucuauauuuuacauaaauuua

SEQ ID NO: 1881231 - RNA, 13 nt, Human
acagacccugccc

SEQ ID NO: 1881232 - RNA, 14 nt, Human
acagacccugcccu

SEQ ID NO: 1881233 - RNA, 15 nt, Human
acagacccugcccug

SEQ ID NO: 1881234 - RNA, 16 nt, Human
uauauuuaguaucuuu

SEQ ID NO: 1881235 - RNA, 23 nt, Human
uauauuuagcuccaaaccuucac

SEQ ID NO: 1881236 - RNA, 19 nt, Human
uauauuguguuuguguauu

SEQ ID NO: 1881237 - RNA, 18 nt, Human
uauauuguguuuguguau

SEQ ID NO: 1881238 - RNA, 17 nt, Human
uauaaguguguguuuuu

SEQ ID NO: 1881239 - RNA, 23 nt, Human
uauaaguguguguuuuucauaaa

SEQ ID NO: 1881240 - RNA, 13 nt, Human
uauacaaauuaga

SEQ ID NO: 1881241 - RNA, 14 nt, Human
uauacaaauuagaa

SEQ ID NO: 1881242 - RNA, 16 nt, Human
uauacaaauuagaaaa

SEQ ID NO: 1881243 - RNA, 18 nt, Human
uauacaaauuagaaaaug

SEQ ID NO: 1881244 - RNA, 17 nt, Human
uauacaaauuagaaaau

SEQ ID NO: 1881245 - RNA, 18 nt, Human
uauaauuuuuuucaauau

SEQ ID NO: 1881246 - RNA, 21 nt, Human
uauaauuuuuuucaauauuua

SEQ ID NO: 1881247 - RNA, 17 nt, Human
acagaaauguacagcaa

SEQ ID NO: 1881248 - RNA, 16 nt, Human
acagaaauguacagca

SEQ ID NO: 1881249 - RNA, 14 nt, Human
acagaaauguacag

SEQ ID NO: 1881250 - RNA, 20 nt, Human
acagaaaauggaagacagcu

SEQ ID NO: 1881251 - RNA, 17 nt, Human
acagaaaauucuucucc

SEQ ID NO: 1881252 - RNA, 21 nt, Human
uaugucuuggacacuguacaa

SEQ ID NO: 1881253 - RNA, 19 nt, Human
uaugucuuggacacuguac

SEQ ID NO: 1881254 - RNA, 17 nt, Human
uaugucuuggacacugu

SEQ ID NO: 1881255 - RNA, 14 nt, Human
uaugucuuggacac

SEQ ID NO: 1881256 - RNA, 14 nt, Human
uaugugaaacaugu

SEQ ID NO: 1881257 - RNA, 22 nt, Human
acaggcauguucucugaggaca

SEQ ID NO: 1881258 - RNA, 20 nt, Human
acaggcauguucucugagga

SEQ ID NO: 1881259 - RNA, 19 nt, Human
acaggcauguucucugagg

SEQ ID NO: 1881260 - RNA, 18 nt, Human
acaggcauguucucugag

SEQ ID NO: 1881261 - RNA, 15 nt, Human
acaggcauguucucu

SEQ ID NO: 1881262 - RNA, 17 nt, Human
uaugugaaacauguuuc

SEQ ID NO: 1881263 - RNA, 22 nt, Human
uaugugaacaguuguguuugaa

SEQ ID NO: 1881264 - RNA, 12 nt, Human
uaugugaacagu

SEQ ID NO: 1881265 - RNA, 15 nt, Human
uaugugaaacaaugu

SEQ ID NO: 1881266 - RNA, 23 nt, Human
uaugugccagauuuaugcauauu

SEQ ID NO: 1881267 - RNA, 20 nt, Human
uauguggaguucaucuugaa

SEQ ID NO: 1881268 - RNA, 16 nt, Human
uauguggaaguguggg

SEQ ID NO: 1881269 - RNA, 12 nt, Human
uauguggaagug

SEQ ID NO: 1881270 - RNA, 17 nt, Human
uauguuuuuuaaaauau

SEQ ID NO: 1881271 - RNA, 15 nt, Human
uauguuuuuuuucug

SEQ ID NO: 1881272 - RNA, 22 nt, Human
uauguuuuuuuucugcuggaaa

SEQ ID NO: 1881273 - RNA, 18 nt, Human
uauguuuuuguguauuug

SEQ ID NO: 1881274 - RNA, 14 nt, Human
uauguuuuugugua

SEQ ID NO: 1881275 - RNA, 15 nt, Human
uauuaaaacucuuuu

SEQ ID NO: 1881276 - RNA, 17 nt, Human
acaggaaaagcugcuga

SEQ ID NO: 1881277 - RNA, 16 nt, Human
acaggaaaagcugcug

SEQ ID NO: 1881278 - RNA, 15 nt, Human
acaggaaaagcugcu

SEQ ID NO: 1881279 - RNA, 13 nt, Human
acaggaaguacug

SEQ ID NO: 1881280 - RNA, 17 nt, Human
acaggaaguagaggagg

SEQ ID NO: 1881281 - RNA, 21 nt, Human
acagcggcuggacuuggaggu

SEQ ID NO: 1881282 - RNA, 22 nt, Human
acagcggcuggacuuggaggua

SEQ ID NO: 1881283 - RNA, 13 nt, Human
acagcuaacaugg

SEQ ID NO: 1881284 - RNA, 21 nt, Human
acagcuuugcugcugaaggcu

SEQ ID NO: 1881285 - RNA, 15 nt, Human
acagcuuugcugcug

SEQ ID NO: 1881286 - RNA, 11 nt, Human
acagcuuugcu

SEQ ID NO: 1881287 - RNA, 12 nt, Human
acagcuuugcug

SEQ ID NO: 1881288 - RNA, 13 nt, Human
acaggcaggucca

SEQ ID NO: 1881289 - RNA, 14 nt, Human
acaggaucagucug

SEQ ID NO: 1881290 - RNA, 16 nt, Human
acaggagugagcacua

SEQ ID NO: 1881291 - RNA, 16 nt, Human
acaggcagguccaggg

SEQ ID NO: 1881292 - RNA, 14 nt, Human
acaggcagguccag

SEQ ID NO: 1881293 - RNA, 14 nt, Human
acaggcauguucuc

SEQ ID NO: 1881294 - RNA, 23 nt, Human
acaggaccagggauuuccaugau

SEQ ID NO: 1881295 - RNA, 22 nt, Human
acaggacaugcgguagccagca

SEQ ID NO: 1881296 - RNA, 14 nt, Human
acaggacacaguca

SEQ ID NO: 1881297 - RNA, 15 nt, Human
acaggacacagucag

SEQ ID NO: 1881298 - RNA, 16 nt, Human
acaggacacagucaga

SEQ ID NO: 1881299 - RNA, 23 nt, Human
acaggcugggcuucaguggcagc

SEQ ID NO: 1881300 - RNA, 22 nt, Human
acaggcugggcuucaguggcag

SEQ ID NO: 1881301 - RNA, 12 nt, Human
acaggcugggcu

SEQ ID NO: 1881302 - RNA, 21 nt, Human
acagggaggacgcucucuggc

SEQ ID NO: 1881303 - RNA, 20 nt, Human
acagggaggacgcucucugg

SEQ ID NO: 1881304 - RNA, 22 nt, Human
acagggacugaaaaccucuccu

SEQ ID NO: 1881305 - RNA, 20 nt, Human
acagggcacaccgggcacuc

SEQ ID NO: 1881306 - RNA, 12 nt, Human
acagggcacacc

SEQ ID NO: 1881307 - RNA, 10 nt, Human
acagggaggg

SEQ ID NO: 1881308 - RNA, 12 nt, Human
acagggagggga

SEQ ID NO: 1881309 - RNA, 14 nt, Human
acaguagucuugau

SEQ ID NO: 1881310 - RNA, 23 nt, Human
acaguagucuugaugaccaaagu

SEQ ID NO: 1881311 - RNA, 15 nt, Human
acagucagauuucca

SEQ ID NO: 1881312 - RNA, 21 nt, Human
acagucagauuuccagucucc

SEQ ID NO: 1881313 - RNA, 21 nt, Human
uauucagcucauggacuucug

SEQ ID NO: 1881314 - RNA, 18 nt, Human
uauucaauuccucuggga

SEQ ID NO: 1881315 - RNA, 14 nt, Human
uauucaauuccucu

SEQ ID NO: 1881316 - RNA, 15 nt, Human
uauucaauuccucug

SEQ ID NO: 1881317 - RNA, 16 nt, Human
uauucaauuccucugg

SEQ ID NO: 1881318 - RNA, 17 nt, Human
uauucaauuccucuggg

SEQ ID NO: 1881319 - RNA, 16 nt, Human
uauucaauauccuuug

SEQ ID NO: 1881320 - RNA, 16 nt, Human
uauucaggaagcucag

SEQ ID NO: 1881321 - RNA, 14 nt, Human
uauucaggaagcuc

SEQ ID NO: 1881322 - RNA, 20 nt, Human
uauucaguaauaacucuacc

SEQ ID NO: 1881323 - RNA, 13 nt, Human
uauuacuucugcu

SEQ ID NO: 1881324 - RNA, 14 nt, Human
uauuacuucugcua

SEQ ID NO: 1881325 - RNA, 21 nt, Human
uauuagggagaaaauucaauu

SEQ ID NO: 1881326 - RNA, 15 nt, Human
uauuagggagaaaau

SEQ ID NO: 1881327 - RNA, 16 nt, Human
uauuagggagaaaauu

SEQ ID NO: 1881328 - RNA, 14 nt, Human
uauuaguaccauag

SEQ ID NO: 1881329 - RNA, 18 nt, Human
uacauguguagccugugc

SEQ ID NO: 1881330 - RNA, 19 nt, Human
uacauguguagccugugca

SEQ ID NO: 1881331 - RNA, 16 nt, Human
uacauguguagccugu

SEQ ID NO: 1881332 - RNA, 13 nt, Human
uacauucuguuaa

SEQ ID NO: 1881333 - RNA, 21 nt, Human
aauuaagaaaggauaaaguug

SEQ ID NO: 1881334 - RNA, 15 nt, Human
aauuaagagagucua

SEQ ID NO: 1881335 - RNA, 19 nt, Human
aauuaagaaggcaaaaaug

SEQ ID NO: 1881336 - RNA, 23 nt, Human
aauuaagaaggcaaaaauguaaa

SEQ ID NO: 1881337 - RNA, 13 nt, Human
aauuaagaaggca

SEQ ID NO: 1881338 - RNA, 14 nt, Human
aauuaagaaggcaa

SEQ ID NO: 1881339 - RNA, 16 nt, Human
aauuaagaaggcaaaa

SEQ ID NO: 1881340 - RNA, 21 nt, Human
aauguucucucuucuccaccu

SEQ ID NO: 1881341 - RNA, 11 nt, Human
aauuaacuuuu

SEQ ID NO: 1881342 - RNA, 16 nt, Human
aauguuaacauuuuug

SEQ ID NO: 1881343 - RNA, 16 nt, Human
uacaggugugagucac

SEQ ID NO: 1881344 - RNA, 18 nt, Human
uacagaugaauguauuua

SEQ ID NO: 1881345 - RNA, 22 nt, Human
uacagaugaauguauuuauuug

SEQ ID NO: 1881346 - RNA, 24 nt, Human
uacauaaugcgugcauaccacuuu

SEQ ID NO: 1881347 - RNA, 23 nt, Human
uacauaaugcgugcauaccacuu

SEQ ID NO: 1881348 - RNA, 21 nt, Human
uacauaaugcgugcauaccac

SEQ ID NO: 1881349 - RNA, 22 nt, Human
uacauauaagugauugcugguu

SEQ ID NO: 1881350 - RNA, 12 nt, Human
uacauaucuuua

SEQ ID NO: 1881351 - RNA, 16 nt, Human
uacauaucuuuauuaa

SEQ ID NO: 1881352 - RNA, 22 nt, Human
uacauaucuuuauuaaucacua

SEQ ID NO: 1881353 - RNA, 19 nt, Human
uacauccaaagcagacagc

SEQ ID NO: 1881354 - RNA, 20 nt, Human
uacauccaaagcagacagcu

SEQ ID NO: 1881355 - RNA, 23 nt, Human
uacauccaaagcagacagcucca

SEQ ID NO: 1881356 - RNA, 15 nt, Human
aaugugaaacuggau

SEQ ID NO: 1881357 - RNA, 14 nt, Human
aaugugaaacugga

SEQ ID NO: 1881358 - RNA, 19 nt, Human
aaugugaaaagaaaaauga

SEQ ID NO: 1881359 - RNA, 17 nt, Human
aaugugccuaguucuuu

SEQ ID NO: 1881360 - RNA, 19 nt, Human
aauguauguguaaguauuc

SEQ ID NO: 1881361 - RNA, 20 nt, Human
aauguauguguaaguauucu

SEQ ID NO: 1881362 - RNA, 14 nt, Human
uacauacaccagca

SEQ ID NO: 1881363 - RNA, 22 nt, Human
aauguauuacaguggggaauga

SEQ ID NO: 1881364 - RNA, 17 nt, Human
uacacguguccuguagu

SEQ ID NO: 1881365 - RNA, 13 nt, Human
uacacguguccug

SEQ ID NO: 1881366 - RNA, 22 nt, Human
uacagacaacaaaccuguuucu

SEQ ID NO: 1881367 - RNA, 19 nt, Human
uacacauuuuauuuuauua

SEQ ID NO: 1881368 - RNA, 22 nt, Human
uacacauuuuauuuuauuaugc

SEQ ID NO: 1881369 - RNA, 21 nt, Human
uacacauuuuauuuuauuaug

SEQ ID NO: 1881370 - RNA, 23 nt, Human
uacacauuuuauuuuauuaugca

SEQ ID NO: 1881371 - RNA, 15 nt, Human
uacacuaaaagguga

SEQ ID NO: 1881372 - RNA, 12 nt, Human
aauggcagccuu

SEQ ID NO: 1881373 - RNA, 20 nt, Human
aauggcacagcccaaagaag

SEQ ID NO: 1881374 - RNA, 17 nt, Human
aauggcacagcccaaag

SEQ ID NO: 1881375 - RNA, 16 nt, Human
aauggcagccuuggca

SEQ ID NO: 1881376 - RNA, 19 nt, Human
aauggcacagcccaaagaa

SEQ ID NO: 1881377 - RNA, 13 nt, Human
aauggcuccuuca

SEQ ID NO: 1881378 - RNA, 20 nt, Human
aauggcgucuggaaguccaa

SEQ ID NO: 1881379 - RNA, 23 nt, Human
aaugcuguacaucuauuuuggau

SEQ ID NO: 1881380 - RNA, 13 nt, Human
aaugcccagcccc

SEQ ID NO: 1881381 - RNA, 12 nt, Human
aaugcuguacau

SEQ ID NO: 1881382 - RNA, 13 nt, Human
aaugcuguacauc

SEQ ID NO: 1881383 - RNA, 15 nt, Human
aaugcuguacaucua

SEQ ID NO: 1881384 - RNA, 17 nt, Human
aaugcuguacaucuauu

SEQ ID NO: 1881385 - RNA, 11 nt, Human
aaugcccagcc

SEQ ID NO: 1881386 - RNA, 12 nt, Human
aaugcccagccc

SEQ ID NO: 1881387 - RNA, 16 nt, Human
aaugcuucaucccuuu

SEQ ID NO: 1881388 - RNA, 14 nt, Human
aauggaaacugaaa

SEQ ID NO: 1881389 - RNA, 20 nt, Human
aauggaaaugggcagagcag

SEQ ID NO: 1881390 - RNA, 21 nt, Human
aauggaaaugggcagagcaga

SEQ ID NO: 1881391 - RNA, 14 nt, Human
aauggaaccacucu

SEQ ID NO: 1881392 - RNA, 23 nt, Human
aauggacguguuaugacuccaga

SEQ ID NO: 1881393 - RNA, 20 nt, Human
aauggacuaacuugucuuug

SEQ ID NO: 1881394 - RNA, 22 nt, Human
aaugcacuuuguucuggcucuu

SEQ ID NO: 1881395 - RNA, 22 nt, Human
uacaaugugaacuuuauuaaau

SEQ ID NO: 1881396 - RNA, 20 nt, Human
aaugcagcagggaugcccug

SEQ ID NO: 1881397 - RNA, 22 nt, Human
aaugcagcagggaugcccugga

SEQ ID NO: 1881398 - RNA, 21 nt, Human
aaugccauggacagaagaagg

SEQ ID NO: 1881399 - RNA, 21 nt, Human
uacaaugcugugcccuaaagu

SEQ ID NO: 1881400 - RNA, 18 nt, Human
aaugaccuuucaauagga

SEQ ID NO: 1881401 - RNA, 16 nt, Human
aaugaccuuucaauag

SEQ ID NO: 1881402 - RNA, 17 nt, Human
aaugaccuuucaauagg

SEQ ID NO: 1881403 - RNA, 21 nt, Human
aaugcacuuuguucuggcucu

SEQ ID NO: 1881404 - RNA, 14 nt, Human
uacaaugugaacuu

SEQ ID NO: 1881405 - RNA, 15 nt, Human
uacaaugugaacuuu

SEQ ID NO: 1881406 - RNA, 16 nt, Human
uacaaugugaacuuua

SEQ ID NO: 1881407 - RNA, 17 nt, Human
uacaaugugaacuuuau

SEQ ID NO: 1881408 - RNA, 20 nt, Human
uacaaugugaacuuuauuaa

SEQ ID NO: 1881409 - RNA, 21 nt, Human
uacaaugugaacuuuauuaaa

SEQ ID NO: 1881410 - RNA, 14 nt, Human
uacuauauuuaugg

SEQ ID NO: 1881411 - RNA, 13 nt, Human
uacuacuccugua

SEQ ID NO: 1881412 - RNA, 16 nt, Human
uacguuugaagacauu

SEQ ID NO: 1881413 - RNA, 22 nt, Human
uacguuugaagacauugcacca

SEQ ID NO: 1881414 - RNA, 17 nt, Human
uacuacuccuguaggaa

SEQ ID NO: 1881415 - RNA, 14 nt, Human
uacuauguaucaau

SEQ ID NO: 1881416 - RNA, 14 nt, Human
uacucuccucaucu

SEQ ID NO: 1881417 - RNA, 16 nt, Human
uacucuccucaucucu

SEQ ID NO: 1881418 - RNA, 22 nt, Human
uacucuccuggaaauauuaaga

SEQ ID NO: 1881419 - RNA, 23 nt, Human
uacucuccuggaaauauuaagaa

SEQ ID NO: 1881420 - RNA, 23 nt, Human
uacuauggcccuggccuagcaua

SEQ ID NO: 1881421 - RNA, 15 nt, Human
uacuaucuacucucc

SEQ ID NO: 1881422 - RNA, 17 nt, Human
uacuaucuacucuccuc

SEQ ID NO: 1881423 - RNA, 12 nt, Human
uacuauguauca

SEQ ID NO: 1881424 - RNA, 13 nt, Human
uacuauguaucaa

SEQ ID NO: 1881425 - RNA, 22 nt, Human
uacgccaggggaaaaucagccu

SEQ ID NO: 1881426 - RNA, 13 nt, Human
aauuccucuggga

SEQ ID NO: 1881427 - RNA, 14 nt, Human
aauuccucugggaa

SEQ ID NO: 1881428 - RNA, 18 nt, Human
uacgggaggguaaggcug

SEQ ID NO: 1881429 - RNA, 12 nt, Human
uacguacacauu

SEQ ID NO: 1881430 - RNA, 16 nt, Human
uacguugugcauuugg

SEQ ID NO: 1881431 - RNA, 15 nt, Human
uacguugugcauuug

SEQ ID NO: 1881432 - RNA, 14 nt, Human
uacguacacauuuu

SEQ ID NO: 1881433 - RNA, 13 nt, Human
uacguacacauuu

SEQ ID NO: 1881434 - RNA, 21 nt, Human
aauugcauuuuuuaaaacaag

SEQ ID NO: 1881435 - RNA, 20 nt, Human
aauugcauuuuuuaaaacaa

SEQ ID NO: 1881436 - RNA, 19 nt, Human
aauugaugggauuugguca

SEQ ID NO: 1881437 - RNA, 23 nt, Human
uacuguaauuugugauacaaugc

SEQ ID NO: 1881438 - RNA, 21 nt, Human
uacuguacaugaaaacacauu

SEQ ID NO: 1881439 - RNA, 22 nt, Human
uacuguacaugaaaacacauuu

SEQ ID NO: 1881440 - RNA, 21 nt, Human
aauugacccacaagaaaugaa

SEQ ID NO: 1881441 - RNA, 14 nt, Human
aauugacuuauuua

SEQ ID NO: 1881442 - RNA, 22 nt, Human
aauugacccacaagaaaugaaa

SEQ ID NO: 1881443 - RNA, 12 nt, Human
uacucuguguca

SEQ ID NO: 1881444 - RNA, 21 nt, Human
uacucugugucagguggggca

SEQ ID NO: 1881445 - RNA, 16 nt, Human
uacuggagaaaaugga

SEQ ID NO: 1881446 - RNA, 21 nt, Human
uacucugcuuuuuuucuacug

SEQ ID NO: 1881447 - RNA, 19 nt, Human
uacuguaaggcaaucaugg

SEQ ID NO: 1881448 - RNA, 18 nt, Human
uacuguaauuugugauac

SEQ ID NO: 1881449 - RNA, 20 nt, Human
uacuguaauuugugauacaa

SEQ ID NO: 1881450 - RNA, 19 nt, Human
uacuguaauuugugauaca

SEQ ID NO: 1881451 - RNA, 18 nt, Human
uacuguaaggcaaucaug

SEQ ID NO: 1881452 - RNA, 22 nt, Human
uacuggcaaaaggaucuuugug

SEQ ID NO: 1881453 - RNA, 18 nt, Human
uacuggcaaaaggaucuu

SEQ ID NO: 1881454 - RNA, 22 nt, Human
aauuauuauuuauauauguauu

SEQ ID NO: 1881455 - RNA, 16 nt, Human
aauuauuauuuggccc

SEQ ID NO: 1881456 - RNA, 22 nt, Human
aauuaguaggcucauuuacugu

SEQ ID NO: 1881457 - RNA, 21 nt, Human
aauuaguaggcucauuuacug

SEQ ID NO: 1881458 - RNA, 20 nt, Human
aauucaaacuggggccucca

SEQ ID NO: 1881459 - RNA, 18 nt, Human
aauuccaagugauugaaa

SEQ ID NO: 1881460 - RNA, 18 nt, Human
aauucaacguuaauaauu

SEQ ID NO: 1881461 - RNA, 21 nt, Human
aauucaacguuaauaauucug

SEQ ID NO: 1881462 - RNA, 19 nt, Human
aauucacaaacuuuuauac

SEQ ID NO: 1881463 - RNA, 14 nt, Human
aauucacaaacuuu

SEQ ID NO: 1881464 - RNA, 22 nt, Human
aauuccacuuauaggaauugac

SEQ ID NO: 1881465 - RNA, 12 nt, Human
aauuccccagau

SEQ ID NO: 1881466 - RNA, 14 nt, Human
aauuccccacccug

SEQ ID NO: 1881467 - RNA, 17 nt, Human
aauucccaacaaacauu

SEQ ID NO: 1881468 - RNA, 21 nt, Human
aauuaccuugagccaguaauu

SEQ ID NO: 1881469 - RNA, 11 nt, Human
aauuacaggaa

SEQ ID NO: 1881470 - RNA, 15 nt, Human
uaccuguauucccag

SEQ ID NO: 1881471 - RNA, 15 nt, Human
aauuagccaagugug

SEQ ID NO: 1881472 - RNA, 13 nt, Human
aauuacucaggaa

SEQ ID NO: 1881473 - RNA, 19 nt, Human
aauuacucaggaagaacac

SEQ ID NO: 1881474 - RNA, 14 nt, Human
aauuagcugcuucu

SEQ ID NO: 1881475 - RNA, 15 nt, Human
aauuagcugcuucua

SEQ ID NO: 1881476 - RNA, 23 nt, Human
uaccugccaggaagccagcaggc

SEQ ID NO: 1881477 - RNA, 18 nt, Human
uaccugccaggaagccag

SEQ ID NO: 1881478 - RNA, 20 nt, Human
uaccugccaggaagccagca

SEQ ID NO: 1881479 - RNA, 10 nt, Human
uaccuguccc

SEQ ID NO: 1881480 - RNA, 13 nt, Human
uaccugucccccu

SEQ ID NO: 1881481 - RNA, 14 nt, Human
uaccugucccccug

SEQ ID NO: 1881482 - RNA, 16 nt, Human
uaccugucccccugac

SEQ ID NO: 1881483 - RNA, 17 nt, Human
uaccugucccccugaca

SEQ ID NO: 1881484 - RNA, 19 nt, Human
uaaucuuuucacaaauaaa

SEQ ID NO: 1881485 - RNA, 18 nt, Human
uaaucuuuucacaaauaa

SEQ ID NO: 1881486 - RNA, 17 nt, Human
uaaucuuuucacaaaua

SEQ ID NO: 1881487 - RNA, 16 nt, Human
uaaucuuuucacaaau

SEQ ID NO: 1881488 - RNA, 15 nt, Human
uaaucuuuucacaaa

SEQ ID NO: 1881489 - RNA, 17 nt, Human
uaaugaaugaaacauuu

SEQ ID NO: 1881490 - RNA, 14 nt, Human
uaauauuuuuaauu

SEQ ID NO: 1881491 - RNA, 15 nt, Human
uaauauuuuuaauua

SEQ ID NO: 1881492 - RNA, 17 nt, Human
uaauccaggcagaucca

SEQ ID NO: 1881493 - RNA, 18 nt, Human
uaauccaggcagauccag

SEQ ID NO: 1881494 - RNA, 19 nt, Human
uaauccaggcagauccagg

SEQ ID NO: 1881495 - RNA, 14 nt, Human
uaaucccagcaauu

SEQ ID NO: 1881496 - RNA, 22 nt, Human
uaauccaggcagauccaggacu

SEQ ID NO: 1881497 - RNA, 23 nt, Human
uaauccaggcagauccaggacua

SEQ ID NO: 1881498 - RNA, 19 nt, Human
uaaucccagcacuuuggga

SEQ ID NO: 1881499 - RNA, 14 nt, Human
uaaucccagcuacu

SEQ ID NO: 1881500 - RNA, 19 nt, Human
uaaucccagcuacuuggga

SEQ ID NO: 1881501 - RNA, 16 nt, Human
uaauagacaauuuauu

SEQ ID NO: 1881502 - RNA, 14 nt, Human
uaauagacaauuua

SEQ ID NO: 1881503 - RNA, 19 nt, Human
uaauacaccacuacauucu

SEQ ID NO: 1881504 - RNA, 18 nt, Human
uaauacaccacuacauuc

SEQ ID NO: 1881505 - RNA, 16 nt, Human
uaauacaccacuacau

SEQ ID NO: 1881506 - RNA, 22 nt, Human
aaucuuaucaagaguugugaca

SEQ ID NO: 1881507 - RNA, 15 nt, Human
aaucuuaucaugguc

SEQ ID NO: 1881508 - RNA, 21 nt, Human
aaucuuaucauggucucaguc

SEQ ID NO: 1881509 - RNA, 19 nt, Human
uaauagcgucauaacuaga

SEQ ID NO: 1881510 - RNA, 22 nt, Human
uaauagacaauuuauuauggca

SEQ ID NO: 1881511 - RNA, 18 nt, Human
uaauagacaauuuauuau

SEQ ID NO: 1881512 - RNA, 17 nt, Human
uaauagacuaaaugaaa

SEQ ID NO: 1881513 - RNA, 23 nt, Human
aaugaauguuuacacucuuugua

SEQ ID NO: 1881514 - RNA, 22 nt, Human
aaugaaugucagugugacugau

SEQ ID NO: 1881515 - RNA, 13 nt, Human
aaugacacagucu

SEQ ID NO: 1881516 - RNA, 22 nt, Human
aaugaauggcuaagcaaaaugu

SEQ ID NO: 1881517 - RNA, 13 nt, Human
aaugaaugucagu

SEQ ID NO: 1881518 - RNA, 13 nt, Human
aaucuuucugcag

SEQ ID NO: 1881519 - RNA, 17 nt, Human
aaugaaacauuuuguca

SEQ ID NO: 1881520 - RNA, 16 nt, Human
aaugaaagacuguaca

SEQ ID NO: 1881521 - RNA, 17 nt, Human
aaugaaagacuguacaa

SEQ ID NO: 1881522 - RNA, 17 nt, Human
aaugaaaccugugucuc

SEQ ID NO: 1881523 - RNA, 14 nt, Human
aaugaaacuuggau

SEQ ID NO: 1881524 - RNA, 18 nt, Human
uaaugucacaggcagguc

SEQ ID NO: 1881525 - RNA, 19 nt, Human
uaaugucucugugagacuc

SEQ ID NO: 1881526 - RNA, 11 nt, Human
uaaugucucug

SEQ ID NO: 1881527 - RNA, 22 nt, Human
uaaugucuguaucacucugugu

SEQ ID NO: 1881528 - RNA, 13 nt, Human
uaauguacugcau

SEQ ID NO: 1881529 - RNA, 15 nt, Human
aaucuuuaauuuuac

SEQ ID NO: 1881530 - RNA, 16 nt, Human
aaucuuuaauuuuaca

SEQ ID NO: 1881531 - RNA, 21 nt, Human
aaucauauaauaaauguacau

SEQ ID NO: 1881532 - RNA, 18 nt, Human
aaucauauaauaaaugua

SEQ ID NO: 1881533 - RNA, 15 nt, Human
aaucaucuuugugaa

SEQ ID NO: 1881534 - RNA, 19 nt, Human
aaucauauuaauacaauga

SEQ ID NO: 1881535 - RNA, 12 nt, Human
uaauaaacacuc

SEQ ID NO: 1881536 - RNA, 18 nt, Human
uaauaaacacucuugaaa

SEQ ID NO: 1881537 - RNA, 16 nt, Human
uaaguuguuauuucag

SEQ ID NO: 1881538 - RNA, 13 nt, Human
uaaguacuaugua

SEQ ID NO: 1881539 - RNA, 16 nt, Human
uaaguacuauguauca

SEQ ID NO: 1881540 - RNA, 17 nt, Human
uaaguacuauguaucaa

SEQ ID NO: 1881541 - RNA, 19 nt, Human
uaaguacuauguaucaaug

SEQ ID NO: 1881542 - RNA, 20 nt, Human
uaaguauucuuauuuaauga

SEQ ID NO: 1881543 - RNA, 19 nt, Human
uaaguauucuuauuuaaug

SEQ ID NO: 1881544 - RNA, 15 nt, Human
uaagcuuugacacug

SEQ ID NO: 1881545 - RNA, 19 nt, Human
aaucuuauaauuuaaaaua

SEQ ID NO: 1881546 - RNA, 19 nt, Human
aaucuacacuccagugaga

SEQ ID NO: 1881547 - RNA, 15 nt, Human
aaucuggagaccagg

SEQ ID NO: 1881548 - RNA, 13 nt, Human
aauccuuuacugu

SEQ ID NO: 1881549 - RNA, 14 nt, Human
aauccuggggaaca

SEQ ID NO: 1881550 - RNA, 11 nt, Human
aauccuggcug

SEQ ID NO: 1881551 - RNA, 21 nt, Human
aauccuggggaacauagaacu

SEQ ID NO: 1881552 - RNA, 12 nt, Human
aauccgcccauc

SEQ ID NO: 1881553 - RNA, 23 nt, Human
aaucccuuuauuacccccuccuu

SEQ ID NO: 1881554 - RNA, 19 nt, Human
aaucccuuuauuacccccu

SEQ ID NO: 1881555 - RNA, 23 nt, Human
aaucauuaggugugacugaauuu

SEQ ID NO: 1881556 - RNA, 17 nt, Human
aaucauuaggugugacu

SEQ ID NO: 1881557 - RNA, 15 nt, Human
aaucauuagguguga

SEQ ID NO: 1881558 - RNA, 20 nt, Human
aauaucagcaagucucuuua

SEQ ID NO: 1881559 - RNA, 13 nt, Human
aauaucagacuuu

SEQ ID NO: 1881560 - RNA, 24 nt, Human
aauauauuuguguauuuaacaggg

SEQ ID NO: 1881561 - RNA, 18 nt, Human
aauauauuuuaagacgaa

SEQ ID NO: 1881562 - RNA, 19 nt, Human
aauauauuuguguauuuaa

SEQ ID NO: 1881563 - RNA, 21 nt, Human
aauauauuuguguauuuaaca

SEQ ID NO: 1881564 - RNA, 23 nt, Human
uaacauauaauguuguuauuuaa

SEQ ID NO: 1881565 - RNA, 14 nt, Human
uaacauauaauguu

SEQ ID NO: 1881566 - RNA, 23 nt, Human
uaacauggacaugaucuucuuua

SEQ ID NO: 1881567 - RNA, 17 nt, Human
uaacauguaauuaagua

SEQ ID NO: 1881568 - RNA, 18 nt, Human
uaacauggacaugaucuu

SEQ ID NO: 1881569 - RNA, 13 nt, Human
aauaguuggcuag

SEQ ID NO: 1881570 - RNA, 22 nt, Human
aauaguugaaccuauuucucuu

SEQ ID NO: 1881571 - RNA, 21 nt, Human
uaaaauuuggccaaacaagug

SEQ ID NO: 1881572 - RNA, 13 nt, Human
aauauauuugugu

SEQ ID NO: 1881573 - RNA, 14 nt, Human
aauauauuugugua

SEQ ID NO: 1881574 - RNA, 14 nt, Human
aauauauuuuaaga

SEQ ID NO: 1881575 - RNA, 15 nt, Human
aauauauuuuaagac

SEQ ID NO: 1881576 - RNA, 22 nt, Human
aauaguggugugauuuggggau

SEQ ID NO: 1881577 - RNA, 16 nt, Human
aauaguggugugauuu

SEQ ID NO: 1881578 - RNA, 20 nt, Human
uaacgauaaaagacagugaa

SEQ ID NO: 1881579 - RNA, 18 nt, Human
uaacauggugugcuucuu

SEQ ID NO: 1881580 - RNA, 20 nt, Human
uaacuagaacugaauuuugu

SEQ ID NO: 1881581 - RNA, 17 nt, Human
uaacuagaacugaauuu

SEQ ID NO: 1881582 - RNA, 15 nt, Human
uaacuagaauuuauu

SEQ ID NO: 1881583 - RNA, 17 nt, Human
uaacuagaauuuauuca

SEQ ID NO: 1881584 - RNA, 18 nt, Human
uaacuagaauuuauucaa

SEQ ID NO: 1881585 - RNA, 14 nt, Human
uaacuagaacugaa

SEQ ID NO: 1881586 - RNA, 12 nt, Human
uaacuagaacug

SEQ ID NO: 1881587 - RNA, 14 nt, Human
uaacuucaccauau

SEQ ID NO: 1881588 - RNA, 17 nt, Human
uaacuuccaauuuacau

SEQ ID NO: 1881589 - RNA, 21 nt, Human
uaacuucacauauugauuucc

SEQ ID NO: 1881590 - RNA, 22 nt, Human
uaacuuaaaagaacauguauau

SEQ ID NO: 1881591 - RNA, 18 nt, Human
uaagaagugaaaaucuac

SEQ ID NO: 1881592 - RNA, 13 nt, Human
uaagaauauuuga

SEQ ID NO: 1881593 - RNA, 13 nt, Human
uaagacaaauaug

SEQ ID NO: 1881594 - RNA, 14 nt, Human
uaagaauauuugaa

SEQ ID NO: 1881595 - RNA, 15 nt, Human
uaagaauauuugaau

SEQ ID NO: 1881596 - RNA, 16 nt, Human
uaagacaugauuuccu

SEQ ID NO: 1881597 - RNA, 16 nt, Human
uaacuuucugaaauaa

SEQ ID NO: 1881598 - RNA, 23 nt, Human
uaacuucuuauggaauugauuug

SEQ ID NO: 1881599 - RNA, 18 nt, Human
aauauuugguuuuccugu

SEQ ID NO: 1881600 - RNA, 23 nt, Human
aauauuuugaucuucaacaaauu

SEQ ID NO: 1881601 - RNA, 13 nt, Human
aauauuuugaucu

SEQ ID NO: 1881602 - RNA, 20 nt, Human
aauauuuugaucuucaacaa

SEQ ID NO: 1881603 - RNA, 21 nt, Human
aauauuuugaucuucaacaaa

SEQ ID NO: 1881604 - RNA, 14 nt, Human
aauauuuuuagaua

SEQ ID NO: 1881605 - RNA, 22 nt, Human
uaagcuguuacugucuucagua

SEQ ID NO: 1881606 - RNA, 11 nt, Human
uaagcuguuuc

SEQ ID NO: 1881607 - RNA, 16 nt, Human
uaagcuguuuccauag

SEQ ID NO: 1881608 - RNA, 13 nt, Human
uaagcagaggagg

SEQ ID NO: 1881609 - RNA, 15 nt, Human
uaagcagaggagggg

SEQ ID NO: 1881610 - RNA, 16 nt, Human
uaagcagaggaggggc

SEQ ID NO: 1881611 - RNA, 17 nt, Human
uaagcagaggaggggcc

SEQ ID NO: 1881612 - RNA, 18 nt, Human
uaagcacacuugacauca

SEQ ID NO: 1881613 - RNA, 12 nt, Human
aauauuccagag

SEQ ID NO: 1881614 - RNA, 10 nt, Human
aauauucugg

SEQ ID NO: 1881615 - RNA, 15 nt, Human
uaagagaaaugagcu

SEQ ID NO: 1881616 - RNA, 17 nt, Human
uaagacaugauuuccuu

SEQ ID NO: 1881617 - RNA, 19 nt, Human
uaagacaugauuuccuuga

SEQ ID NO: 1881618 - RNA, 17 nt, Human
aauaugcacacauuuuu

SEQ ID NO: 1881619 - RNA, 16 nt, Human
aauaugcacacauuuu

SEQ ID NO: 1881620 - RNA, 22 nt, Human
aauaugcacacauuuuuuaaau

SEQ ID NO: 1881621 - RNA, 12 nt, Human
aauauuuagugu

SEQ ID NO: 1881622 - RNA, 13 nt, Human
aauauuuauaaaa

SEQ ID NO: 1881623 - RNA, 16 nt, Human
aauauuuauaaaacuu

SEQ ID NO: 1881624 - RNA, 17 nt, Human
aauauuuauaaaacuuc

SEQ ID NO: 1881625 - RNA, 14 nt, Human
aauauuugaaugua

SEQ ID NO: 1881626 - RNA, 23 nt, Human
aauauuugaauguaugcuucaua

SEQ ID NO: 1881627 - RNA, 21 nt, Human
aauauuugaauguaugcuuca

SEQ ID NO: 1881628 - RNA, 19 nt, Human
aauauuuauaaaacuucuc

SEQ ID NO: 1881629 - RNA, 14 nt, Human
aauauuguacaguu

SEQ ID NO: 1881630 - RNA, 15 nt, Human
aauauugacuuuguc

SEQ ID NO: 1881631 - RNA, 16 nt, Human
aauauugacuuugucu

SEQ ID NO: 1881632 - RNA, 14 nt, Human
aauauugacuuugu

SEQ ID NO: 1881633 - RNA, 23 nt, Human
aauauuguacaguuuuuauugcu

SEQ ID NO: 1881634 - RNA, 13 nt, Human
aauauugucuuuu

SEQ ID NO: 1881635 - RNA, 17 nt, Human
aauauuguacaguuuuu

SEQ ID NO: 1881636 - RNA, 15 nt, Human
aauauuguacaguuu

SEQ ID NO: 1881637 - RNA, 21 nt, Human
aauauugucuuuuuguauguc

SEQ ID NO: 1881638 - RNA, 16 nt, Human
ucaauucuugccaaau

SEQ ID NO: 1881639 - RNA, 13 nt, Human
ucaauuguaaauu

SEQ ID NO: 1881640 - RNA, 14 nt, Human
ucaauuguaaauug

SEQ ID NO: 1881641 - RNA, 18 nt, Human
ucaauuguaaauugaauc

SEQ ID NO: 1881642 - RNA, 16 nt, Human
accaaagcgaauuuua

SEQ ID NO: 1881643 - RNA, 21 nt, Human
accaaaguccuuuuuuuccau

SEQ ID NO: 1881644 - RNA, 17 nt, Human
ucacaaaggaugcccaa

SEQ ID NO: 1881645 - RNA, 21 nt, Human
ucacaaacuuuuauacucuuu

SEQ ID NO: 1881646 - RNA, 12 nt, Human
ucacaaagccca

SEQ ID NO: 1881647 - RNA, 15 nt, Human
ucacaaagcccaagg

SEQ ID NO: 1881648 - RNA, 14 nt, Human
ucacaaaaaagaag

SEQ ID NO: 1881649 - RNA, 15 nt, Human
ucacaaacuuuuaua

SEQ ID NO: 1881650 - RNA, 17 nt, Human
ucacaaacuuuuauacu

SEQ ID NO: 1881651 - RNA, 20 nt, Human
ucaauuuccaagagcugagg

SEQ ID NO: 1881652 - RNA, 18 nt, Human
ucaauuuccaagagcuga

SEQ ID NO: 1881653 - RNA, 13 nt, Human
ucaauuuccaaga

SEQ ID NO: 1881654 - RNA, 16 nt, Human
ucacaaccugaaccua

SEQ ID NO: 1881655 - RNA, 19 nt, Human
ucacaaccugaaccuagga

SEQ ID NO: 1881656 - RNA, 16 nt, Human
ucacaaagcccaaggg

SEQ ID NO: 1881657 - RNA, 14 nt, Human
ucacaaccugaacc

SEQ ID NO: 1881658 - RNA, 20 nt, Human
ucacagaugggugcuuggag

SEQ ID NO: 1881659 - RNA, 23 nt, Human
ucacagcaagucacuggccagug

SEQ ID NO: 1881660 - RNA, 13 nt, Human
ucacagccucuga

SEQ ID NO: 1881661 - RNA, 16 nt, Human
ucacaguucucuccuu

SEQ ID NO: 1881662 - RNA, 20 nt, Human
ucacaguucucuccuucuuc

SEQ ID NO: 1881663 - RNA, 21 nt, Human
ucaccauguuggccaggcugg

SEQ ID NO: 1881664 - RNA, 15 nt, Human
ucaccauguuggcca

SEQ ID NO: 1881665 - RNA, 22 nt, Human
ucacaguucuuugggccagaca

SEQ ID NO: 1881666 - RNA, 19 nt, Human
ucacaguucuuugggccag

SEQ ID NO: 1881667 - RNA, 20 nt, Human
ucacaguucuuugggccaga

SEQ ID NO: 1881668 - RNA, 19 nt, Human
accacaucuugcucugcug

SEQ ID NO: 1881669 - RNA, 18 nt, Human
accacaucuugcucugcu

SEQ ID NO: 1881670 - RNA, 17 nt, Human
accacaucuugcucugc

SEQ ID NO: 1881671 - RNA, 18 nt, Human
accacaugugcacaugca

SEQ ID NO: 1881672 - RNA, 24 nt, Human
accacauuggagauguuuaguaau

SEQ ID NO: 1881673 - RNA, 20 nt, Human
accaccacacccagcccacu

SEQ ID NO: 1881674 - RNA, 15 nt, Human
accaccacacccagc

SEQ ID NO: 1881675 - RNA, 16 nt, Human
ucacugugagcuccca

SEQ ID NO: 1881676 - RNA, 15 nt, Human
ucacugucuuuccua

SEQ ID NO: 1881677 - RNA, 16 nt, Human
ucacugucuuuccuag

SEQ ID NO: 1881678 - RNA, 17 nt, Human
ucacugucuuuccuaga

SEQ ID NO: 1881679 - RNA, 15 nt, Human
ucacugcagccucaa

SEQ ID NO: 1881680 - RNA, 23 nt, Human
ucacuguugcccaggcuggcgug

SEQ ID NO: 1881681 - RNA, 14 nt, Human
ucacugcagccuca

SEQ ID NO: 1881682 - RNA, 22 nt, Human
ucacugagacagcccgggcucu

SEQ ID NO: 1881683 - RNA, 17 nt, Human
ucacugagacagcccgg

SEQ ID NO: 1881684 - RNA, 21 nt, Human
ucacugagacagcccgggcuc

SEQ ID NO: 1881685 - RNA, 16 nt, Human
ucacugagacagcccg

SEQ ID NO: 1881686 - RNA, 17 nt, Human
accaguguuguggauuu

SEQ ID NO: 1881687 - RNA, 15 nt, Human
accaguguuguggau

SEQ ID NO: 1881688 - RNA, 17 nt, Human
accaguccccccacccu

SEQ ID NO: 1881689 - RNA, 16 nt, Human
accagucauuuuucag

SEQ ID NO: 1881690 - RNA, 15 nt, Human
accaguccccccacc

SEQ ID NO: 1881691 - RNA, 14 nt, Human
accagucauuuuuc

SEQ ID NO: 1881692 - RNA, 15 nt, Human
accagucauuuuuca

SEQ ID NO: 1881693 - RNA, 10 nt, Human
ucacuugagu

SEQ ID NO: 1881694 - RNA, 22 nt, Human
ucacuugaggucaggaguuccu

SEQ ID NO: 1881695 - RNA, 23 nt, Human
ucacuugaacccgggaggcagag

SEQ ID NO: 1881696 - RNA, 12 nt, Human
ucacuugagacc

SEQ ID NO: 1881697 - RNA, 18 nt, Human
ucacguaaagcuagaaau

SEQ ID NO: 1881698 - RNA, 23 nt, Human
ucacuacccuaauagacuaaaug

SEQ ID NO: 1881699 - RNA, 23 nt, Human
ucacguuuuguuuugugccaacc

SEQ ID NO: 1881700 - RNA, 20 nt, Human
ucacguaaagcuagaaauga

SEQ ID NO: 1881701 - RNA, 19 nt, Human
ucacguaaagcuagaaaug

SEQ ID NO: 1881702 - RNA, 22 nt, Human
ucacguuucauguaauccucaa

SEQ ID NO: 1881703 - RNA, 22 nt, Human
accagcgugugacuacuccccc

SEQ ID NO: 1881704 - RNA, 15 nt, Human
accacucaaaggcca

SEQ ID NO: 1881705 - RNA, 23 nt, Human
accagcuaagaaaagauuuuaau

SEQ ID NO: 1881706 - RNA, 22 nt, Human
accagcuaagaaaagauuuuaa

SEQ ID NO: 1881707 - RNA, 13 nt, Human
accagcucaggac

SEQ ID NO: 1881708 - RNA, 14 nt, Human
accagcucaggaca

SEQ ID NO: 1881709 - RNA, 15 nt, Human
accagcucaggacag

SEQ ID NO: 1881710 - RNA, 16 nt, Human
accagcucaggacaga

SEQ ID NO: 1881711 - RNA, 15 nt, Human
accacuacauucugu

SEQ ID NO: 1881712 - RNA, 13 nt, Human
accaccagaagcc

SEQ ID NO: 1881713 - RNA, 16 nt, Human
accacuacauucuguu

SEQ ID NO: 1881714 - RNA, 17 nt, Human
accacuacauucuguua

SEQ ID NO: 1881715 - RNA, 20 nt, Human
accagcugaaaguugggacu

SEQ ID NO: 1881716 - RNA, 23 nt, Human
accagcucaggacagaugccaca

SEQ ID NO: 1881717 - RNA, 12 nt, Human
accagcugaaag

SEQ ID NO: 1881718 - RNA, 17 nt, Human
accaggaaccucuucag

SEQ ID NO: 1881719 - RNA, 20 nt, Human
ucaagucggaucuaguccag

SEQ ID NO: 1881720 - RNA, 22 nt, Human
ucaaguccucuuuucugagagg

SEQ ID NO: 1881721 - RNA, 20 nt, Human
ucaacugccaaaaugcucua

SEQ ID NO: 1881722 - RNA, 22 nt, Human
ucaauaucuuuuuuuuaauaaa

SEQ ID NO: 1881723 - RNA, 14 nt, Human
ucaauauccuuugc

SEQ ID NO: 1881724 - RNA, 16 nt, Human
ucaauauccuuugccu

SEQ ID NO: 1881725 - RNA, 23 nt, Human
ucaaugaaugaaugaauggcuaa

SEQ ID NO: 1881726 - RNA, 10 nt, Human
ucaauauuua

SEQ ID NO: 1881727 - RNA, 11 nt, Human
ucaauauuuau

SEQ ID NO: 1881728 - RNA, 20 nt, Human
ucaauauuuauuauuuucac

SEQ ID NO: 1881729 - RNA, 12 nt, Human
ucaauauuuauu

SEQ ID NO: 1881730 - RNA, 13 nt, Human
ucaauauuuauua

SEQ ID NO: 1881731 - RNA, 21 nt, Human
acauuuuuuaaaugcaccugg

SEQ ID NO: 1881732 - RNA, 17 nt, Human
acauuuuuuaaaugcac

SEQ ID NO: 1881733 - RNA, 16 nt, Human
acauuuuuuaaaugca

SEQ ID NO: 1881734 - RNA, 14 nt, Human
acauuuuuuaaaug

SEQ ID NO: 1881735 - RNA, 11 nt, Human
acauuuuguau

SEQ ID NO: 1881736 - RNA, 18 nt, Human
acauuuuggugagaaaug

SEQ ID NO: 1881737 - RNA, 19 nt, Human
acauuuuuaagugcugcau

SEQ ID NO: 1881738 - RNA, 23 nt, Human
acauuuuuaagugcugcauuuaa

SEQ ID NO: 1881739 - RNA, 22 nt, Human
acauuuuuaagugcugcauuua

SEQ ID NO: 1881740 - RNA, 21 nt, Human
acauuuuuaagugcugcauuu

SEQ ID NO: 1881741 - RNA, 14 nt, Human
acauugcaauagaa

SEQ ID NO: 1881742 - RNA, 16 nt, Human
acauugcaauagaaau

SEQ ID NO: 1881743 - RNA, 15 nt, Human
acauugcaauagaaa

SEQ ID NO: 1881744 - RNA, 16 nt, Human
acauuguuaaaauaaa

SEQ ID NO: 1881745 - RNA, 17 nt, Human
acauuguugagcuauug

SEQ ID NO: 1881746 - RNA, 16 nt, Human
acauuguucaauuaga

SEQ ID NO: 1881747 - RNA, 20 nt, Human
acauuguucaauuagaauag

SEQ ID NO: 1881748 - RNA, 20 nt, Human
acauuuuauuuuauuaugca

SEQ ID NO: 1881749 - RNA, 19 nt, Human
acauuuuauuuuauuaugc

SEQ ID NO: 1881750 - RNA, 14 nt, Human
acauuuuauuuuau

SEQ ID NO: 1881751 - RNA, 18 nt, Human
acauuuuauuuuauuaug

SEQ ID NO: 1881752 - RNA, 17 nt, Human
acauuuuggugagaaau

SEQ ID NO: 1881753 - RNA, 14 nt, Human
acauuguugagcua

SEQ ID NO: 1881754 - RNA, 13 nt, Human
acauuuucacaca

SEQ ID NO: 1881755 - RNA, 15 nt, Human
acauuuucacacaau

SEQ ID NO: 1881756 - RNA, 20 nt, Human
acauuuucacacaauacaau

SEQ ID NO: 1881757 - RNA, 23 nt, Human
acaugaaucccacccacauguga

SEQ ID NO: 1881758 - RNA, 21 nt, Human
acaugaaucccacccacaugu

SEQ ID NO: 1881759 - RNA, 20 nt, Human
acaugaaucccacccacaug

SEQ ID NO: 1881760 - RNA, 20 nt, Human
acaugagguacugagaguga

SEQ ID NO: 1881761 - RNA, 20 nt, Human
acaugaauauuuaguguuca

SEQ ID NO: 1881762 - RNA, 12 nt, Human
acagucccugcc

SEQ ID NO: 1881763 - RNA, 20 nt, Human
acagucagauuuccagucuc

SEQ ID NO: 1881764 - RNA, 21 nt, Human
acaugcuacacacugcauguu

SEQ ID NO: 1881765 - RNA, 15 nt, Human
acaugcuacacacug

SEQ ID NO: 1881766 - RNA, 23 nt, Human
acaugagguacugagagugaaca

SEQ ID NO: 1881767 - RNA, 20 nt, Human
acaugcgguagccagcacac

SEQ ID NO: 1881768 - RNA, 22 nt, Human
acaugcgguagccagcacacag

SEQ ID NO: 1881769 - RNA, 23 nt, Human
acaugcgguagccagcacacagg

SEQ ID NO: 1881770 - RNA, 18 nt, Human
acaugcgguagccagcac

SEQ ID NO: 1881771 - RNA, 15 nt, Human
acauguaauuaagua

SEQ ID NO: 1881772 - RNA, 21 nt, Human
acaugguaaacgcugucccua

SEQ ID NO: 1881773 - RNA, 17 nt, Human
acauguaauuaaguacu

SEQ ID NO: 1881774 - RNA, 19 nt, Human
acauguaauuaaguacuau

SEQ ID NO: 1881775 - RNA, 21 nt, Human
acauguaauuaaguacuaugu

SEQ ID NO: 1881776 - RNA, 22 nt, Human
acauguaauuaaguacuaugua

SEQ ID NO: 1881777 - RNA, 22 nt, Human
acauggcuggagcuagaauuug

SEQ ID NO: 1881778 - RNA, 13 nt, Human
ucaaauuucuaaa

SEQ ID NO: 1881779 - RNA, 17 nt, Human
ucaaccaaugccaaaaa

SEQ ID NO: 1881780 - RNA, 16 nt, Human
ucaacaaauugcccuu

SEQ ID NO: 1881781 - RNA, 20 nt, Human
ucaacugcaucaagauguga

SEQ ID NO: 1881782 - RNA, 19 nt, Human
ucaacugccaaaaugcucu

SEQ ID NO: 1881783 - RNA, 18 nt, Human
ucaacccccauuucuauu

SEQ ID NO: 1881784 - RNA, 17 nt, Human
ucaaccagggauuguuu

SEQ ID NO: 1881785 - RNA, 20 nt, Human
ucaaccagggauuguuucug

SEQ ID NO: 1881786 - RNA, 22 nt, Human
ucaaccagggauuguuucuguu

SEQ ID NO: 1881787 - RNA, 14 nt, Human
ucaaccagcagaug

SEQ ID NO: 1881788 - RNA, 14 nt, Human
acauuccugaugcu

SEQ ID NO: 1881789 - RNA, 15 nt, Human
acauuccugaacagg

SEQ ID NO: 1881790 - RNA, 14 nt, Human
acauuccugaacag

SEQ ID NO: 1881791 - RNA, 23 nt, Human
acauguaauuaaguacuauguau

SEQ ID NO: 1881792 - RNA, 18 nt, Human
acauguagaaaacaaaau

SEQ ID NO: 1881793 - RNA, 15 nt, Human
acauguccaagaagc

SEQ ID NO: 1881794 - RNA, 19 nt, Human
acauguccaagaagcccag

SEQ ID NO: 1881795 - RNA, 20 nt, Human
acccgggcagggcucccaca

SEQ ID NO: 1881796 - RNA, 19 nt, Human
acccucgaggcggaucuuu

SEQ ID NO: 1881797 - RNA, 16 nt, Human
acccugaaagcccuga

SEQ ID NO: 1881798 - RNA, 18 nt, Human
acccugaaagcccugagc

SEQ ID NO: 1881799 - RNA, 14 nt, Human
acccugaggcccag

SEQ ID NO: 1881800 - RNA, 18 nt, Human
acccugaaggggccauga

SEQ ID NO: 1881801 - RNA, 12 nt, Human
acccugaagggg

SEQ ID NO: 1881802 - RNA, 17 nt, Human
acccugaaggggccaug

SEQ ID NO: 1881803 - RNA, 12 nt, Human
acccuucuuuuc

SEQ ID NO: 1881804 - RNA, 17 nt, Human
acccugcccugugggcc

SEQ ID NO: 1881805 - RNA, 22 nt, Human
acccugcccugugggcccccaa

SEQ ID NO: 1881806 - RNA, 15 nt, Human
acccugaggcccaga

SEQ ID NO: 1881807 - RNA, 16 nt, Human
acccugaggcccagag

SEQ ID NO: 1881808 - RNA, 17 nt, Human
acccugaggcccagagg

SEQ ID NO: 1881809 - RNA, 15 nt, Human
acccugcccuguggg

SEQ ID NO: 1881810 - RNA, 15 nt, Human
accgaaaacguggcu

SEQ ID NO: 1881811 - RNA, 19 nt, Human
accgaaaaacuaaaaauaa

SEQ ID NO: 1881812 - RNA, 17 nt, Human
acccuugccgucuaccu

SEQ ID NO: 1881813 - RNA, 20 nt, Human
acccuuguggucccacccca

SEQ ID NO: 1881814 - RNA, 23 nt, Human
acccuuguggucccaccccacac

SEQ ID NO: 1881815 - RNA, 17 nt, Human
acccgggaggcagaggu

SEQ ID NO: 1881816 - RNA, 12 nt, Human
acccgggaaggg

SEQ ID NO: 1881817 - RNA, 13 nt, Human
acccgggaagggg

SEQ ID NO: 1881818 - RNA, 20 nt, Human
acccggccccugcugguuca

SEQ ID NO: 1881819 - RNA, 17 nt, Human
acccggccccugcuggu

SEQ ID NO: 1881820 - RNA, 22 nt, Human
acccggccccugcugguucagg

SEQ ID NO: 1881821 - RNA, 16 nt, Human
acccggccccugcugg

SEQ ID NO: 1881822 - RNA, 15 nt, Human
acccggccccugcug

SEQ ID NO: 1881823 - RNA, 14 nt, Human
acccggccccugcu

SEQ ID NO: 1881824 - RNA, 22 nt, Human
ucagguaacaggcagauacagg

SEQ ID NO: 1881825 - RNA, 21 nt, Human
ucagguaacaggcagauacag

SEQ ID NO: 1881826 - RNA, 23 nt, Human
ucagguaacaggcagauacagga

SEQ ID NO: 1881827 - RNA, 16 nt, Human
ucaggguuggccccug

SEQ ID NO: 1881828 - RNA, 19 nt, Human
ucagggucccugguggcag

SEQ ID NO: 1881829 - RNA, 23 nt, Human
ucaggccaggcccucugcccacu

SEQ ID NO: 1881830 - RNA, 22 nt, Human
ucagcuuguaaauagcucaggu

SEQ ID NO: 1881831 - RNA, 21 nt, Human
ucagcuuguaaauagcucagg

SEQ ID NO: 1881832 - RNA, 15 nt, Human
ucagcuccagcucac

SEQ ID NO: 1881833 - RNA, 14 nt, Human
ucagcuccagcuca

SEQ ID NO: 1881834 - RNA, 21 nt, Human
ucaggccaggcccucugccca

SEQ ID NO: 1881835 - RNA, 22 nt, Human
ucaggccaggcccucugcccac

SEQ ID NO: 1881836 - RNA, 20 nt, Human
ucaggccaggcccucugccc

SEQ ID NO: 1881837 - RNA, 15 nt, Human
accccaguuuuuguu

SEQ ID NO: 1881838 - RNA, 18 nt, Human
accccaucucuacaaaaa

SEQ ID NO: 1881839 - RNA, 19 nt, Human
acccccuccuucagacacc

SEQ ID NO: 1881840 - RNA, 16 nt, Human
acccccucgcuuggac

SEQ ID NO: 1881841 - RNA, 12 nt, Human
acccccuccuuc

SEQ ID NO: 1881842 - RNA, 15 nt, Human
acccccuccuucaga

SEQ ID NO: 1881843 - RNA, 16 nt, Human
acccccuccuucagac

SEQ ID NO: 1881844 - RNA, 17 nt, Human
acccccuccuucagaca

SEQ ID NO: 1881845 - RNA, 11 nt, Human
acccccuccuu

SEQ ID NO: 1881846 - RNA, 23 nt, Human
ucagcggggacagcuccuucugu

SEQ ID NO: 1881847 - RNA, 21 nt, Human
ucagcggggacagcuccuucu

SEQ ID NO: 1881848 - RNA, 20 nt, Human
ucagcggggacagcuccuuc

SEQ ID NO: 1881849 - RNA, 19 nt, Human
ucagcggggacagcuccuu

SEQ ID NO: 1881850 - RNA, 12 nt, Human
ucagcuccagcu

SEQ ID NO: 1881851 - RNA, 18 nt, Human
ucagcuccacuuucagug

SEQ ID NO: 1881852 - RNA, 16 nt, Human
accccuggugguucac

SEQ ID NO: 1881853 - RNA, 15 nt, Human
accccugggggcucu

SEQ ID NO: 1881854 - RNA, 16 nt, Human
accccugggggcucuc

SEQ ID NO: 1881855 - RNA, 17 nt, Human
accccugggggcucuca

SEQ ID NO: 1881856 - RNA, 18 nt, Human
accauaauguuacauuau

SEQ ID NO: 1881857 - RNA, 15 nt, Human
accauaauguuacau

SEQ ID NO: 1881858 - RNA, 13 nt, Human
accauaauguuac

SEQ ID NO: 1881859 - RNA, 12 nt, Human
ucagauuugaac

SEQ ID NO: 1881860 - RNA, 21 nt, Human
ucagauuugaacucuucaauc

SEQ ID NO: 1881861 - RNA, 18 nt, Human
accaguguuguggauuua

SEQ ID NO: 1881862 - RNA, 15 nt, Human
ucagcaaaagaugcu

SEQ ID NO: 1881863 - RNA, 19 nt, Human
ucagccacccugaggccuc

SEQ ID NO: 1881864 - RNA, 20 nt, Human
ucagccacccugaggccucu

SEQ ID NO: 1881865 - RNA, 12 nt, Human
ucagccagcacu

SEQ ID NO: 1881866 - RNA, 14 nt, Human
ucagccagcacuug

SEQ ID NO: 1881867 - RNA, 23 nt, Human
ucagccagcacuuguccagcuga

SEQ ID NO: 1881868 - RNA, 22 nt, Human
ucagauuugccuuauuggcagc

SEQ ID NO: 1881869 - RNA, 17 nt, Human
ucagauuugccuuauug

SEQ ID NO: 1881870 - RNA, 22 nt, Human
accccagccccaaaacucuccu

SEQ ID NO: 1881871 - RNA, 13 nt, Human
accccagccccaa

SEQ ID NO: 1881872 - RNA, 17 nt, Human
accccacacacgccaga

SEQ ID NO: 1881873 - RNA, 23 nt, Human
acccaggagccccgaggccuucu

SEQ ID NO: 1881874 - RNA, 19 nt, Human
acccaggagccccgaggcc

SEQ ID NO: 1881875 - RNA, 14 nt, Human
ucagccagagaagc

SEQ ID NO: 1881876 - RNA, 23 nt, Human
ucaugauuucauuucaacuguuu

SEQ ID NO: 1881877 - RNA, 17 nt, Human
ucaugauuucauuucaa

SEQ ID NO: 1881878 - RNA, 14 nt, Human
ucaugcaaacuuua

SEQ ID NO: 1881879 - RNA, 17 nt, Human
ucaugaaagauucaaug

SEQ ID NO: 1881880 - RNA, 16 nt, Human
ucaugaaagauucaau

SEQ ID NO: 1881881 - RNA, 20 nt, Human
ucaucuacucauuuaaagua

SEQ ID NO: 1881882 - RNA, 13 nt, Human
ucaucuaggauuu

SEQ ID NO: 1881883 - RNA, 17 nt, Human
ucaucgccagacaacug

SEQ ID NO: 1881884 - RNA, 14 nt, Human
ucaucgaaucuacu

SEQ ID NO: 1881885 - RNA, 21 nt, Human
ucaucgaaucuacuaauucca

SEQ ID NO: 1881886 - RNA, 16 nt, Human
ucaucccaacugucuu

SEQ ID NO: 1881887 - RNA, 17 nt, Human
ucaugugaaaucauuca

SEQ ID NO: 1881888 - RNA, 16 nt, Human
ucaugugaaaucauuc

SEQ ID NO: 1881889 - RNA, 23 nt, Human
ucaugcaaacuuuauuuuguguu

SEQ ID NO: 1881890 - RNA, 17 nt, Human
ucauguuuacagaggac

SEQ ID NO: 1881891 - RNA, 17 nt, Human
accgcagacaggaccag

SEQ ID NO: 1881892 - RNA, 12 nt, Human
accgcagacagg

SEQ ID NO: 1881893 - RNA, 16 nt, Human
accgcagacaggacca

SEQ ID NO: 1881894 - RNA, 22 nt, Human
accuagaaauugacacaagugg

SEQ ID NO: 1881895 - RNA, 15 nt, Human
accuaggggcgccgc

SEQ ID NO: 1881896 - RNA, 12 nt, Human
accuauuuccau

SEQ ID NO: 1881897 - RNA, 11 nt, Human
accuauuucuc

SEQ ID NO: 1881898 - RNA, 14 nt, Human
accuauuucucuuu

SEQ ID NO: 1881899 - RNA, 19 nt, Human
accuauuucucuuucuuua

SEQ ID NO: 1881900 - RNA, 22 nt, Human
accuauuucucuuucuuuacaa

SEQ ID NO: 1881901 - RNA, 14 nt, Human
accucaccuagaaa

SEQ ID NO: 1881902 - RNA, 15 nt, Human
accucaccuagaaau

SEQ ID NO: 1881903 - RNA, 20 nt, Human
accucccacaaaggagagcu

SEQ ID NO: 1881904 - RNA, 19 nt, Human
ucaguuuuaucauuuucaa

SEQ ID NO: 1881905 - RNA, 17 nt, Human
ucaguuuuaucauuuuc

SEQ ID NO: 1881906 - RNA, 16 nt, Human
ucaguuuuaucauuuu

SEQ ID NO: 1881907 - RNA, 15 nt, Human
ucaguuuuugugaaa

SEQ ID NO: 1881908 - RNA, 17 nt, Human
ucaguuuuugugaaaag

SEQ ID NO: 1881909 - RNA, 16 nt, Human
ucaguuuucaggagug

SEQ ID NO: 1881910 - RNA, 12 nt, Human
ucaguuuucauu

SEQ ID NO: 1881911 - RNA, 13 nt, Human
ucaguuuucauuu

SEQ ID NO: 1881912 - RNA, 11 nt, Human
ucaguggcagc

SEQ ID NO: 1881913 - RNA, 15 nt, Human
ucaguggauuuccca

SEQ ID NO: 1881914 - RNA, 16 nt, Human
ucagugccuuauggaa

SEQ ID NO: 1881915 - RNA, 18 nt, Human
ucagugccuuauggaaca

SEQ ID NO: 1881916 - RNA, 13 nt, Human
ucaguggcagcug

SEQ ID NO: 1881917 - RNA, 12 nt, Human
ucaguggcagcu

SEQ ID NO: 1881918 - RNA, 17 nt, Human
ucaguggcgagaaauaa

SEQ ID NO: 1881919 - RNA, 12 nt, Human
ucagugccacua

SEQ ID NO: 1881920 - RNA, 16 nt, Human
ucagugccaaaaacaa

SEQ ID NO: 1881921 - RNA, 12 nt, Human
ucaguaugugga

SEQ ID NO: 1881922 - RNA, 16 nt, Human
ucaguauguggaagug

SEQ ID NO: 1881923 - RNA, 14 nt, Human
ucaguauguggaag

SEQ ID NO: 1881924 - RNA, 17 nt, Human
accgaaaacguggcugc

SEQ ID NO: 1881925 - RNA, 19 nt, Human
accgaaaacguggcugcuu

SEQ ID NO: 1881926 - RNA, 15 nt, Human
ucaguauaaacaaag

SEQ ID NO: 1881927 - RNA, 17 nt, Human
ucaguauaaacaaaguu

SEQ ID NO: 1881928 - RNA, 9 nt, Human
ucagugccu

SEQ ID NO: 1881929 - RNA, 10 nt, Human
ucagugccuu

SEQ ID NO: 1881930 - RNA, 11 nt, Human
ucagugccuua

SEQ ID NO: 1881931 - RNA, 12 nt, Human
ucagugccuuau

SEQ ID NO: 1881932 - RNA, 14 nt, Human
ucagugccuuaugg

SEQ ID NO: 1881933 - RNA, 15 nt, Human
ucagugccuuaugga

SEQ ID NO: 1881934 - RNA, 16 nt, Human
ucauauaauaaaugua

SEQ ID NO: 1881935 - RNA, 15 nt, Human
ucauauaauaaaugu

SEQ ID NO: 1881936 - RNA, 18 nt, Human
ucauauaagauucauauu

SEQ ID NO: 1881937 - RNA, 21 nt, Human
ucauaguaugguggcuggguu

SEQ ID NO: 1881938 - RNA, 19 nt, Human
ucauaguaugguggcuggg

SEQ ID NO: 1881939 - RNA, 18 nt, Human
ucauaguaugguggcugg

SEQ ID NO: 1881940 - RNA, 15 nt, Human
ucauaguaugguggc

SEQ ID NO: 1881941 - RNA, 14 nt, Human
ucauaaccuagccu

SEQ ID NO: 1881942 - RNA, 20 nt, Human
ucauaaaaagcaaaacaaaa

SEQ ID NO: 1881943 - RNA, 16 nt, Human
ucauaaauuuaugguu

SEQ ID NO: 1881944 - RNA, 22 nt, Human
ucauauguaccauguacaugaa

SEQ ID NO: 1881945 - RNA, 14 nt, Human
ucauauugaauaua

SEQ ID NO: 1881946 - RNA, 21 nt, Human
ucauauguaccauguacauga

SEQ ID NO: 1881947 - RNA, 20 nt, Human
ucauaugcaaagcauauuaa

SEQ ID NO: 1881948 - RNA, 15 nt, Human
ucauauuuacuucuu

SEQ ID NO: 1881949 - RNA, 23 nt, Human
ucauauuuacuucuuauacauuu

SEQ ID NO: 1881950 - RNA, 13 nt, Human
ucauauuugcacu

SEQ ID NO: 1881951 - RNA, 14 nt, Human
ucauauuugcacua

SEQ ID NO: 1881952 - RNA, 15 nt, Human
ucauauuuucaugcu

SEQ ID NO: 1881953 - RNA, 16 nt, Human
acgaaauguuauuuuu

SEQ ID NO: 1881954 - RNA, 23 nt, Human
acgaaauguuauuuuuuaauuau

SEQ ID NO: 1881955 - RNA, 13 nt, Human
acgaaauguuauu

SEQ ID NO: 1881956 - RNA, 12 nt, Human
acgaaauguuau

SEQ ID NO: 1881957 - RNA, 15 nt, Human
acgaauauugcugau

SEQ ID NO: 1881958 - RNA, 18 nt, Human
acgaauauugcugauggu

SEQ ID NO: 1881959 - RNA, 13 nt, Human
acgaaacccacuc

SEQ ID NO: 1881960 - RNA, 23 nt, Human
uccaggcugggagagccuuccag

SEQ ID NO: 1881961 - RNA, 13 nt, Human
uccaggcugguuc

SEQ ID NO: 1881962 - RNA, 11 nt, Human
uccaggcuggu

SEQ ID NO: 1881963 - RNA, 22 nt, Human
uccaggcuccuuuagcgcccag

SEQ ID NO: 1881964 - RNA, 12 nt, Human
uccaggcuccuu

SEQ ID NO: 1881965 - RNA, 20 nt, Human
uccaggcugggagagccuuc

SEQ ID NO: 1881966 - RNA, 21 nt, Human
uccaggcugggagagccuucc

SEQ ID NO: 1881967 - RNA, 10 nt, Human
uccaggcucc

SEQ ID NO: 1881968 - RNA, 22 nt, Human
uccaggauuccucuuuucucug

SEQ ID NO: 1881969 - RNA, 18 nt, Human
uccaggauuccucuuuuc

SEQ ID NO: 1881970 - RNA, 15 nt, Human
uccaggauuccucuu

SEQ ID NO: 1881971 - RNA, 14 nt, Human
uccagaauuuccca

SEQ ID NO: 1881972 - RNA, 15 nt, Human
uccagaauuucccaa

SEQ ID NO: 1881973 - RNA, 22 nt, Human
uccagcccugaguuccuagcca

SEQ ID NO: 1881974 - RNA, 20 nt, Human
uccagcccugaguuccuagc

SEQ ID NO: 1881975 - RNA, 20 nt, Human
uccagccugcugccugcuuu

SEQ ID NO: 1881976 - RNA, 13 nt, Human
uccagccugccac

SEQ ID NO: 1881977 - RNA, 11 nt, Human
uccagccuggg

SEQ ID NO: 1881978 - RNA, 21 nt, Human
uccacugugccaugugccagg

SEQ ID NO: 1881979 - RNA, 21 nt, Human
uccagaaugcuguacaucuau

SEQ ID NO: 1881980 - RNA, 18 nt, Human
uccagaaugcuguacauc

SEQ ID NO: 1881981 - RNA, 22 nt, Human
uccacugguucuucuuggucuc

SEQ ID NO: 1881982 - RNA, 18 nt, Human
uccacucucccccacccc

SEQ ID NO: 1881983 - RNA, 16 nt, Human
uccacucucccccacc

SEQ ID NO: 1881984 - RNA, 14 nt, Human
uccacucuccccca

SEQ ID NO: 1881985 - RNA, 13 nt, Human
uccacucuccccc

SEQ ID NO: 1881986 - RNA, 12 nt, Human
uccacucucccc

SEQ ID NO: 1881987 - RNA, 13 nt, Human
accuuuuuuauac

SEQ ID NO: 1881988 - RNA, 16 nt, Human
accuuuuauugacaca

SEQ ID NO: 1881989 - RNA, 15 nt, Human
accuuuuauguagua

SEQ ID NO: 1881990 - RNA, 20 nt, Human
accuuuuauguaguaauuga

SEQ ID NO: 1881991 - RNA, 20 nt, Human
accuuuuauugacacagaaa

SEQ ID NO: 1881992 - RNA, 20 nt, Human
accuugaacuggguacuugu

SEQ ID NO: 1881993 - RNA, 15 nt, Human
accuuucuccuuugu

SEQ ID NO: 1881994 - RNA, 16 nt, Human
accuuucuccuuugua

SEQ ID NO: 1881995 - RNA, 19 nt, Human
accuugaaaacuuuaugcu

SEQ ID NO: 1881996 - RNA, 20 nt, Human
accuugaaaauaagaauaga

SEQ ID NO: 1881997 - RNA, 20 nt, Human
ucauucccuucgacagcauu

SEQ ID NO: 1881998 - RNA, 21 nt, Human
ucauucccuucgacagcauuu

SEQ ID NO: 1881999 - RNA, 23 nt, Human
ucauucccuucgacagcauuuuc

SEQ ID NO: 1882000 - RNA, 22 nt, Human
ucauucccuucgacagcauuuu

SEQ ID NO: 1882001 - RNA, 22 nt, Human
accuuuguuugcaucugaaaau

SEQ ID NO: 1882002 - RNA, 18 nt, Human
accuuuguccccaccgca

SEQ ID NO: 1882003 - RNA, 17 nt, Human
accuuugacaaagguaa

SEQ ID NO: 1882004 - RNA, 18 nt, Human
accuuugacaaagguaaa

SEQ ID NO: 1882005 - RNA, 17 nt, Human
accuuuguccccaccgc

SEQ ID NO: 1882006 - RNA, 23 nt, Human
accuuucuccuuuguacuuugug

SEQ ID NO: 1882007 - RNA, 19 nt, Human
accuuucuccuuuguacuu

SEQ ID NO: 1882008 - RNA, 20 nt, Human
accuuucuccuuuguacuuu

SEQ ID NO: 1882009 - RNA, 24 nt, Human
acgcggcucccggggcagggcagc

SEQ ID NO: 1882010 - RNA, 20 nt, Human
acgcgugcacacaccagagc

SEQ ID NO: 1882011 - RNA, 21 nt, Human
acgcuacccgggaagggggcu

SEQ ID NO: 1882012 - RNA, 20 nt, Human
acgccuguaaucccagcacu

SEQ ID NO: 1882013 - RNA, 21 nt, Human
acgaauauugcugauggugca

SEQ ID NO: 1882014 - RNA, 15 nt, Human
acgccucccacuggg

SEQ ID NO: 1882015 - RNA, 14 nt, Human
acgccucccacugg

SEQ ID NO: 1882016 - RNA, 13 nt, Human
acgcuggaccuug

SEQ ID NO: 1882017 - RNA, 15 nt, Human
acgcucucuacucug

SEQ ID NO: 1882018 - RNA, 18 nt, Human
acgcucucuacucugcuu

SEQ ID NO: 1882019 - RNA, 14 nt, Human
acgcucucuggccu

SEQ ID NO: 1882020 - RNA, 11 nt, Human
acgcucucugg

SEQ ID NO: 1882021 - RNA, 16 nt, Human
acgcuggagugcagug

SEQ ID NO: 1882022 - RNA, 15 nt, Human
acgcuggagugcagu

SEQ ID NO: 1882023 - RNA, 23 nt, Human
acgcuggaccuugaacuggguac

SEQ ID NO: 1882024 - RNA, 20 nt, Human
acgcuggaccuugaacuggg

SEQ ID NO: 1882025 - RNA, 18 nt, Human
acgcuggagugcagugag

SEQ ID NO: 1882026 - RNA, 17 nt, Human
acgcuggagugcaguga

SEQ ID NO: 1882027 - RNA, 23 nt, Human
acggagucccaccuuggcugcag

SEQ ID NO: 1882028 - RNA, 22 nt, Human
acggcuccacuaggacuucaaa

SEQ ID NO: 1882029 - RNA, 18 nt, Human
acggccacaucaaagagg

SEQ ID NO: 1882030 - RNA, 13 nt, Human
acggccacaucaa

SEQ ID NO: 1882031 - RNA, 18 nt, Human
acggcucgauuucuccag

SEQ ID NO: 1882032 - RNA, 19 nt, Human
acggcucgauuucuccagg

SEQ ID NO: 1882033 - RNA, 18 nt, Human
acggcuuuuacuuaaacc

SEQ ID NO: 1882034 - RNA, 11 nt, Human
acggcugggca

SEQ ID NO: 1882035 - RNA, 22 nt, Human
acggcugggcacacgccuccca

SEQ ID NO: 1882036 - RNA, 14 nt, Human
uccaguaucuugaa

SEQ ID NO: 1882037 - RNA, 15 nt, Human
uccaguaucuugaag

SEQ ID NO: 1882038 - RNA, 15 nt, Human
uccaguaaucuaaua

SEQ ID NO: 1882039 - RNA, 19 nt, Human
uccaguaaucuaauauggc

SEQ ID NO: 1882040 - RNA, 12 nt, Human
acggccaggcca

SEQ ID NO: 1882041 - RNA, 18 nt, Human
acggcucacugcagccuc

SEQ ID NO: 1882042 - RNA, 17 nt, Human
acggcucacugcagccu

SEQ ID NO: 1882043 - RNA, 16 nt, Human
acggcucacugcagcc

SEQ ID NO: 1882044 - RNA, 13 nt, Human
acggccaggccag

SEQ ID NO: 1882045 - RNA, 22 nt, Human
uccagugaggcucugcccuugg

SEQ ID NO: 1882046 - RNA, 23 nt, Human
uccagugaggcucugcccuuggu

SEQ ID NO: 1882047 - RNA, 18 nt, Human
uccagugcaacacugaag

SEQ ID NO: 1882048 - RNA, 16 nt, Human
uccagugaggcucugc

SEQ ID NO: 1882049 - RNA, 19 nt, Human
uccagucuccaccaggaac

SEQ ID NO: 1882050 - RNA, 15 nt, Human
uccagugaggcucug

SEQ ID NO: 1882051 - RNA, 18 nt, Human
uccagugagacagcucug

SEQ ID NO: 1882052 - RNA, 16 nt, Human
uccaguaucuugaaga

SEQ ID NO: 1882053 - RNA, 18 nt, Human
uccaguaucuugaagacu

SEQ ID NO: 1882054 - RNA, 15 nt, Human
uccagucuccaccag

SEQ ID NO: 1882055 - RNA, 16 nt, Human
uccagucuccaccagg

SEQ ID NO: 1882056 - RNA, 13 nt, Human
acuaucugcuuuu

SEQ ID NO: 1882057 - RNA, 12 nt, Human
acuaucugcuuu

SEQ ID NO: 1882058 - RNA, 19 nt, Human
acuaucuacucuccucauc

SEQ ID NO: 1882059 - RNA, 17 nt, Human
acuaucuacucuccuca

SEQ ID NO: 1882060 - RNA, 16 nt, Human
acuaucuaaauguuga

SEQ ID NO: 1882061 - RNA, 21 nt, Human
acuaucuaaauguugaaagau

SEQ ID NO: 1882062 - RNA, 15 nt, Human
acuaucuacucuccu

SEQ ID NO: 1882063 - RNA, 16 nt, Human
acuaucuacucuccuc

SEQ ID NO: 1882064 - RNA, 22 nt, Human
acuauagccuaggugacagagu

SEQ ID NO: 1882065 - RNA, 20 nt, Human
acuauagccuaggugacaga

SEQ ID NO: 1882066 - RNA, 15 nt, Human
acuagagcuuucuuu

SEQ ID NO: 1882067 - RNA, 18 nt, Human
acuagagggaccucuccc

SEQ ID NO: 1882068 - RNA, 19 nt, Human
acuagagggaccucuccca

SEQ ID NO: 1882069 - RNA, 23 nt, Human
acuauauuugggccugcuccaga

SEQ ID NO: 1882070 - RNA, 22 nt, Human
acuauauuugggccugcuccag

SEQ ID NO: 1882071 - RNA, 18 nt, Human
acuauagccuaggugaca

SEQ ID NO: 1882072 - RNA, 21 nt, Human
acucaauguuacuaucugcuu

SEQ ID NO: 1882073 - RNA, 16 nt, Human
acucaaguagcauuua

SEQ ID NO: 1882074 - RNA, 21 nt, Human
acucacaaccugaaccuagga

SEQ ID NO: 1882075 - RNA, 16 nt, Human
acucaaugcacugaca

SEQ ID NO: 1882076 - RNA, 15 nt, Human
acucaaguagcauuu

SEQ ID NO: 1882077 - RNA, 14 nt, Human
acucaagcccgcgg

SEQ ID NO: 1882078 - RNA, 17 nt, Human
acucaagauucccagga

SEQ ID NO: 1882079 - RNA, 18 nt, Human
acucaagauucccaggag

SEQ ID NO: 1882080 - RNA, 23 nt, Human
acucaagauucccaggaguucug

SEQ ID NO: 1882081 - RNA, 19 nt, Human
acucaagauucccaggagu

SEQ ID NO: 1882082 - RNA, 14 nt, Human
acuauguugcccag

SEQ ID NO: 1882083 - RNA, 22 nt, Human
acuauggcccuggccuagcaua

SEQ ID NO: 1882084 - RNA, 16 nt, Human
acuauguugcccaggc

SEQ ID NO: 1882085 - RNA, 15 nt, Human
acuauguugcccagg

SEQ ID NO: 1882086 - RNA, 17 nt, Human
acuauguugcccaggca

SEQ ID NO: 1882087 - RNA, 15 nt, Human
acuaugguauuugag

SEQ ID NO: 1882088 - RNA, 16 nt, Human
acuaugguauuugagu

SEQ ID NO: 1882089 - RNA, 15 nt, Human
acucaagauucccag

SEQ ID NO: 1882090 - RNA, 16 nt, Human
acucaagauucccagg

SEQ ID NO: 1882091 - RNA, 23 nt, Human
uccccacccugaaagcccugagc

SEQ ID NO: 1882092 - RNA, 15 nt, Human
uccccaccgcagaca

SEQ ID NO: 1882093 - RNA, 16 nt, Human
uccccaccgcagacag

SEQ ID NO: 1882094 - RNA, 18 nt, Human
uccccaggaggccagccu

SEQ ID NO: 1882095 - RNA, 12 nt, Human
uccccacccuga

SEQ ID NO: 1882096 - RNA, 16 nt, Human
ucccagcuacaccuuu

SEQ ID NO: 1882097 - RNA, 16 nt, Human
ucccagcuaccucaac

SEQ ID NO: 1882098 - RNA, 18 nt, Human
ucccauugucccucugcc

SEQ ID NO: 1882099 - RNA, 19 nt, Human
ucccauugucccucugccc

SEQ ID NO: 1882100 - RNA, 21 nt, Human
ucccauugucccucugcccca

SEQ ID NO: 1882101 - RNA, 19 nt, Human
ucccagcuacuugggaggc

SEQ ID NO: 1882102 - RNA, 17 nt, Human
ucccagcuacuugggag

SEQ ID NO: 1882103 - RNA, 18 nt, Human
ucccagcuacuugggagg

SEQ ID NO: 1882104 - RNA, 16 nt, Human
ucccagcuacuuggga

SEQ ID NO: 1882105 - RNA, 16 nt, Human
ucccccagccccaucc

SEQ ID NO: 1882106 - RNA, 15 nt, Human
acuacugcaccauuu

SEQ ID NO: 1882107 - RNA, 13 nt, Human
ucccccagcccca

SEQ ID NO: 1882108 - RNA, 15 nt, Human
ucccccagccccauc

SEQ ID NO: 1882109 - RNA, 11 nt, Human
ucccccagccc

SEQ ID NO: 1882110 - RNA, 15 nt, Human
uccccaggggaguug

SEQ ID NO: 1882111 - RNA, 20 nt, Human
uccccaggaggccagccuug

SEQ ID NO: 1882112 - RNA, 21 nt, Human
uccccaggaggccagccuuga

SEQ ID NO: 1882113 - RNA, 15 nt, Human
acuaauuuuaaaaug

SEQ ID NO: 1882114 - RNA, 20 nt, Human
acuacaaacaaaauuucuau

SEQ ID NO: 1882115 - RNA, 18 nt, Human
acuacaaacaaaauuucu

SEQ ID NO: 1882116 - RNA, 22 nt, Human
acguuucuaaaggcuaccuuug

SEQ ID NO: 1882117 - RNA, 22 nt, Human
acguuugaagacauugcaccag

SEQ ID NO: 1882118 - RNA, 18 nt, Human
ucccagauacuugggggg

SEQ ID NO: 1882119 - RNA, 21 nt, Human
ucccagauuggcucacacuga

SEQ ID NO: 1882120 - RNA, 20 nt, Human
ucccagauuggcucacacug

SEQ ID NO: 1882121 - RNA, 19 nt, Human
ucccagauuggcucacacu

SEQ ID NO: 1882122 - RNA, 18 nt, Human
ucccagauuggcucacac

SEQ ID NO: 1882123 - RNA, 22 nt, Human
ucccagauuggcucacacugag

SEQ ID NO: 1882124 - RNA, 16 nt, Human
ucccagauacuugggg

SEQ ID NO: 1882125 - RNA, 18 nt, Human
acuacagaaaaaccagag

SEQ ID NO: 1882126 - RNA, 19 nt, Human
uccauccugaggcuccacu

SEQ ID NO: 1882127 - RNA, 16 nt, Human
uccagugucucggagg

SEQ ID NO: 1882128 - RNA, 15 nt, Human
uccauccugaggcuc

SEQ ID NO: 1882129 - RNA, 12 nt, Human
uccauccugagg

SEQ ID NO: 1882130 - RNA, 17 nt, Human
uccaguguccuuagaac

SEQ ID NO: 1882131 - RNA, 18 nt, Human
uccaguguccuuagaaca

SEQ ID NO: 1882132 - RNA, 21 nt, Human
uccaguguccuuagaacauuu

SEQ ID NO: 1882133 - RNA, 20 nt, Human
uccaguguccuuagaacauu

SEQ ID NO: 1882134 - RNA, 18 nt, Human
acguaaagcuagaaauga

SEQ ID NO: 1882135 - RNA, 17 nt, Human
acguaaagcuagaaaug

SEQ ID NO: 1882136 - RNA, 18 nt, Human
acguaaugaaacuuggau

SEQ ID NO: 1882137 - RNA, 13 nt, Human
acguugugcauuu

SEQ ID NO: 1882138 - RNA, 15 nt, Human
acguugugcauuugg

SEQ ID NO: 1882139 - RNA, 14 nt, Human
acguugugcauuug

SEQ ID NO: 1882140 - RNA, 16 nt, Human
acguuucuaaaggcua

SEQ ID NO: 1882141 - RNA, 15 nt, Human
acguuucuaaaggcu

SEQ ID NO: 1882142 - RNA, 19 nt, Human
acguggcugcuucaaggau

SEQ ID NO: 1882143 - RNA, 21 nt, Human
acguggcugcuucaaggaucc

SEQ ID NO: 1882144 - RNA, 18 nt, Human
acguggcugcuucaagga

SEQ ID NO: 1882145 - RNA, 17 nt, Human
acguggcugcuucaagg

SEQ ID NO: 1882146 - RNA, 14 nt, Human
acugagccuuguaa

SEQ ID NO: 1882147 - RNA, 14 nt, Human
acugcaacuucugc

SEQ ID NO: 1882148 - RNA, 16 nt, Human
acugcaacuucugccu

SEQ ID NO: 1882149 - RNA, 21 nt, Human
acugauaaagaugagugagca

SEQ ID NO: 1882150 - RNA, 13 nt, Human
acugauaaagaug

SEQ ID NO: 1882151 - RNA, 14 nt, Human
acugcaccgggcca

SEQ ID NO: 1882152 - RNA, 18 nt, Human
acugcaccauuuaaaaac

SEQ ID NO: 1882153 - RNA, 20 nt, Human
acugcacuauagccuaggug

SEQ ID NO: 1882154 - RNA, 16 nt, Human
acugcaccgggccaca

SEQ ID NO: 1882155 - RNA, 16 nt, Human
acugcaagaaaaugau

SEQ ID NO: 1882156 - RNA, 19 nt, Human
uccugaugcuucuucagag

SEQ ID NO: 1882157 - RNA, 20 nt, Human
uccugaugcuucuucagaga

SEQ ID NO: 1882158 - RNA, 21 nt, Human
uccugaugcuucuucagagac

SEQ ID NO: 1882159 - RNA, 21 nt, Human
acugcacuauagccuagguga

SEQ ID NO: 1882160 - RNA, 14 nt, Human
acugcacuccagcc

SEQ ID NO: 1882161 - RNA, 17 nt, Human
acugcacuccagccugg

SEQ ID NO: 1882162 - RNA, 18 nt, Human
acugcacuccagccuggg

SEQ ID NO: 1882163 - RNA, 19 nt, Human
acugcacuccagccugggu

SEQ ID NO: 1882164 - RNA, 20 nt, Human
acugcacuccagccugggug

SEQ ID NO: 1882165 - RNA, 15 nt, Human
uccuggaaauauuaa

SEQ ID NO: 1882166 - RNA, 18 nt, Human
uccugcuuugggaagccg

SEQ ID NO: 1882167 - RNA, 23 nt, Human
uccuggaagugcuaauuuugaaa

SEQ ID NO: 1882168 - RNA, 22 nt, Human
uccuggaauaucuccgucaacu

SEQ ID NO: 1882169 - RNA, 17 nt, Human
uccugggagugagcugg

SEQ ID NO: 1882170 - RNA, 14 nt, Human
uccugggagugagc

SEQ ID NO: 1882171 - RNA, 12 nt, Human
uccugggaguga

SEQ ID NO: 1882172 - RNA, 15 nt, Human
uccugggagcuuuug

SEQ ID NO: 1882173 - RNA, 13 nt, Human
uccugcugggcag

SEQ ID NO: 1882174 - RNA, 22 nt, Human
uccugcuguaaauuuggcuucu

SEQ ID NO: 1882175 - RNA, 21 nt, Human
uccugcugcaguugccaguca

SEQ ID NO: 1882176 - RNA, 12 nt, Human
uccugcaggcag

SEQ ID NO: 1882177 - RNA, 13 nt, Human
uccugcaggcagc

SEQ ID NO: 1882178 - RNA, 14 nt, Human
uccugcaggcagcc

SEQ ID NO: 1882179 - RNA, 14 nt, Human
acucuuuguaagag

SEQ ID NO: 1882180 - RNA, 13 nt, Human
acucuuuguaaga

SEQ ID NO: 1882181 - RNA, 12 nt, Human
acucuuuugcuu

SEQ ID NO: 1882182 - RNA, 14 nt, Human
acucuuuugcuuua

SEQ ID NO: 1882183 - RNA, 20 nt, Human
acucuuuugcuuuauuccag

SEQ ID NO: 1882184 - RNA, 19 nt, Human
acucuuucuauuguuucuu

SEQ ID NO: 1882185 - RNA, 15 nt, Human
acucuuguuuccuua

SEQ ID NO: 1882186 - RNA, 16 nt, Human
acugaacauuccagag

SEQ ID NO: 1882187 - RNA, 13 nt, Human
acugaacauucca

SEQ ID NO: 1882188 - RNA, 18 nt, Human
acugaacucacuuuccuc

SEQ ID NO: 1882189 - RNA, 22 nt, Human
acugaacaccauugaaggcuua

SEQ ID NO: 1882190 - RNA, 21 nt, Human
acugaacaccauugaaggcuu

SEQ ID NO: 1882191 - RNA, 20 nt, Human
acugaacaccauugaaggcu

SEQ ID NO: 1882192 - RNA, 21 nt, Human
acucuuuugcuuuauuccaga

SEQ ID NO: 1882193 - RNA, 19 nt, Human
acugaacaccauugaaggc

SEQ ID NO: 1882194 - RNA, 22 nt, Human
uccucuuuggucuacacugugc

SEQ ID NO: 1882195 - RNA, 15 nt, Human
uccucuuugcuuugc

SEQ ID NO: 1882196 - RNA, 16 nt, Human
uccucuuugcuuugcu

SEQ ID NO: 1882197 - RNA, 17 nt, Human
uccugaaacaacuugga

SEQ ID NO: 1882198 - RNA, 20 nt, Human
uccucuuugcuuugcuuucu

SEQ ID NO: 1882199 - RNA, 23 nt, Human
uccucuuugcuuugcuuucugcu

SEQ ID NO: 1882200 - RNA, 19 nt, Human
uccucuuuccaucuacccu

SEQ ID NO: 1882201 - RNA, 19 nt, Human
uccucuuuggucuacacug

SEQ ID NO: 1882202 - RNA, 21 nt, Human
uccucuuuggucuacacugug

SEQ ID NO: 1882203 - RNA, 11 nt, Human
uccucccuccc

SEQ ID NO: 1882204 - RNA, 14 nt, Human
uccucccucccucu

SEQ ID NO: 1882205 - RNA, 11 nt, Human
uccucuuucca

SEQ ID NO: 1882206 - RNA, 12 nt, Human
uccucuuuccau

SEQ ID NO: 1882207 - RNA, 17 nt, Human
acugaccugguccacag

SEQ ID NO: 1882208 - RNA, 21 nt, Human
acugaccugguccacagggca

SEQ ID NO: 1882209 - RNA, 22 nt, Human
acugaccugguccacagggcac

SEQ ID NO: 1882210 - RNA, 19 nt, Human
acugaccuugaugagcugu

SEQ ID NO: 1882211 - RNA, 13 nt, Human
acugaccuugaug

SEQ ID NO: 1882212 - RNA, 15 nt, Human
acugacugcagggac

SEQ ID NO: 1882213 - RNA, 12 nt, Human
acugagaaauuu

SEQ ID NO: 1882214 - RNA, 17 nt, Human
acugagaaauuuauaaa

SEQ ID NO: 1882215 - RNA, 21 nt, Human
acugagaaauuuauaaacuuu

SEQ ID NO: 1882216 - RNA, 15 nt, Human
acugagacagcccgg

SEQ ID NO: 1882217 - RNA, 20 nt, Human
acugagaauguaagaacuac

SEQ ID NO: 1882218 - RNA, 19 nt, Human
acugagaauguaagaacua

SEQ ID NO: 1882219 - RNA, 18 nt, Human
acugagacagcccgggcu

SEQ ID NO: 1882220 - RNA, 21 nt, Human
acugagacagcccgggcucug

SEQ ID NO: 1882221 - RNA, 22 nt, Human
acugagacagcccgggcucugc

SEQ ID NO: 1882222 - RNA, 23 nt, Human
acugagacagcccgggcucugcc

SEQ ID NO: 1882223 - RNA, 18 nt, Human
acugagagugaacaaauu

SEQ ID NO: 1882224 - RNA, 20 nt, Human
acugagauccuuccuuuuga

SEQ ID NO: 1882225 - RNA, 14 nt, Human
acucuuaaucaaau

SEQ ID NO: 1882226 - RNA, 19 nt, Human
acucuuagauggauucucc

SEQ ID NO: 1882227 - RNA, 17 nt, Human
acucuuaggaagagaaa

SEQ ID NO: 1882228 - RNA, 14 nt, Human
acucuugaccucag

SEQ ID NO: 1882229 - RNA, 22 nt, Human
acucuuauaucuauauuuuaca

SEQ ID NO: 1882230 - RNA, 18 nt, Human
acucuuauaucuauauuu

SEQ ID NO: 1882231 - RNA, 17 nt, Human
acucuuauaucuauauu

SEQ ID NO: 1882232 - RNA, 16 nt, Human
acucuuauaucuauau

SEQ ID NO: 1882233 - RNA, 19 nt, Human
acucuuaggaagagaaacc

SEQ ID NO: 1882234 - RNA, 20 nt, Human
acucuuaggaagagaaacca

SEQ ID NO: 1882235 - RNA, 16 nt, Human
acucuugaccucaggu

SEQ ID NO: 1882236 - RNA, 15 nt, Human
acucuugaccucagg

SEQ ID NO: 1882237 - RNA, 19 nt, Human
acucuuauaucuauauuuu

SEQ ID NO: 1882238 - RNA, 16 nt, Human
acucuugauuauccau

SEQ ID NO: 1882239 - RNA, 14 nt, Human
acucuuggagccug

SEQ ID NO: 1882240 - RNA, 16 nt, Human
acucuuggagccugca

SEQ ID NO: 1882241 - RNA, 15 nt, Human
acucuuggagccugc

SEQ ID NO: 1882242 - RNA, 23 nt, Human
acucuuggagccugcagagcugc

SEQ ID NO: 1882243 - RNA, 22 nt, Human
acucuuggagccugcagagcug

SEQ ID NO: 1882244 - RNA, 22 nt, Human
uccucauaguaugguggcuggg

SEQ ID NO: 1882245 - RNA, 22 nt, Human
uccucagguggccaugccucag

SEQ ID NO: 1882246 - RNA, 18 nt, Human
uccucagguggccaugcc

SEQ ID NO: 1882247 - RNA, 23 nt, Human
uccucauacccacccccacccaa

SEQ ID NO: 1882248 - RNA, 13 nt, Human
uccucagguggcc

SEQ ID NO: 1882249 - RNA, 16 nt, Human
uccucagguggccaug

SEQ ID NO: 1882250 - RNA, 21 nt, Human
uccucagccuugccagagauc

SEQ ID NO: 1882251 - RNA, 20 nt, Human
uccucagccuugccagagau

SEQ ID NO: 1882252 - RNA, 18 nt, Human
uccucagccuugccagag

SEQ ID NO: 1882253 - RNA, 23 nt, Human
acuccuugaaaacacuguucucu

SEQ ID NO: 1882254 - RNA, 24 nt, Human
acuccuugaaaacacuguucucug

SEQ ID NO: 1882255 - RNA, 14 nt, Human
acucuccuccagag

SEQ ID NO: 1882256 - RNA, 17 nt, Human
acucuccuccagaguca

SEQ ID NO: 1882257 - RNA, 22 nt, Human
acucucccccacccccuccccg

SEQ ID NO: 1882258 - RNA, 20 nt, Human
acucucccccacccccuccc

SEQ ID NO: 1882259 - RNA, 12 nt, Human
acucuccucugc

SEQ ID NO: 1882260 - RNA, 14 nt, Human
acucuccucaucuc

SEQ ID NO: 1882261 - RNA, 15 nt, Human
acucuccucaucucu

SEQ ID NO: 1882262 - RNA, 13 nt, Human
acucuccucugcu

SEQ ID NO: 1882263 - RNA, 14 nt, Human
acucuccucugcug

SEQ ID NO: 1882264 - RNA, 16 nt, Human
acucuccucugcugcu

SEQ ID NO: 1882265 - RNA, 18 nt, Human
acucuccuggaaauauua

SEQ ID NO: 1882266 - RNA, 15 nt, Human
acucuccuugguguc

SEQ ID NO: 1882267 - RNA, 14 nt, Human
acucuggcaaagcu

SEQ ID NO: 1882268 - RNA, 15 nt, Human
acucuggcaaagcuu

SEQ ID NO: 1882269 - RNA, 16 nt, Human
acucuggcaaagcuuu

SEQ ID NO: 1882270 - RNA, 17 nt, Human
acucuggcaaagcuuuu

SEQ ID NO: 1882271 - RNA, 23 nt, Human
acucuggcaaagcuuuuagaaau

SEQ ID NO: 1882272 - RNA, 13 nt, Human
acucuggcagcuc

SEQ ID NO: 1882273 - RNA, 15 nt, Human
acucuggcagcucag

SEQ ID NO: 1882274 - RNA, 16 nt, Human
acucuccuuggugucg

SEQ ID NO: 1882275 - RNA, 23 nt, Human
acucuccuuggugucgggcauga

SEQ ID NO: 1882276 - RNA, 18 nt, Human
acucucugaaccccuccc

SEQ ID NO: 1882277 - RNA, 11 nt, Human
acucugagacu

SEQ ID NO: 1882278 - RNA, 22 nt, Human
acucugagacucgcgacaaugc

SEQ ID NO: 1882279 - RNA, 19 nt, Human
acucucugaaccccucccu

SEQ ID NO: 1882280 - RNA, 21 nt, Human
acucucugaaccccucccucc

SEQ ID NO: 1882281 - RNA, 19 nt, Human
acuccagugagacagcucu

SEQ ID NO: 1882282 - RNA, 13 nt, Human
acucaccccagcc

SEQ ID NO: 1882283 - RNA, 21 nt, Human
acucacaccugaacugaacac

SEQ ID NO: 1882284 - RNA, 16 nt, Human
acucaccccagcccca

SEQ ID NO: 1882285 - RNA, 14 nt, Human
acucaccccagccc

SEQ ID NO: 1882286 - RNA, 15 nt, Human
acucaccccagcccc

SEQ ID NO: 1882287 - RNA, 11 nt, Human
acuccuggccu

SEQ ID NO: 1882288 - RNA, 13 nt, Human
acuccuccuagcc

SEQ ID NO: 1882289 - RNA, 16 nt, Human
ucccugguggcagcuc

SEQ ID NO: 1882290 - RNA, 17 nt, Human
ucccugguggcagcuca

SEQ ID NO: 1882291 - RNA, 18 nt, Human
ucccugguggcagcucac

SEQ ID NO: 1882292 - RNA, 19 nt, Human
ucccugguggcagcucacc

SEQ ID NO: 1882293 - RNA, 20 nt, Human
ucccugguggcagcucaccu

SEQ ID NO: 1882294 - RNA, 21 nt, Human
ucccugguggcagcucaccuc

SEQ ID NO: 1882295 - RNA, 22 nt, Human
acuccugcaggcagccaggcca

SEQ ID NO: 1882296 - RNA, 15 nt, Human
acuccugcaggcagc

SEQ ID NO: 1882297 - RNA, 16 nt, Human
acuccugcaggcagcc

SEQ ID NO: 1882298 - RNA, 17 nt, Human
acuccucaguucuugcc

SEQ ID NO: 1882299 - RNA, 22 nt, Human
acuccucaguucuugccacuuu

SEQ ID NO: 1882300 - RNA, 12 nt, Human
acuccugcaggc

SEQ ID NO: 1882301 - RNA, 14 nt, Human
acuccugcaggcag

SEQ ID NO: 1882302 - RNA, 14 nt, Human
acuccuggccucaa

SEQ ID NO: 1882303 - RNA, 13 nt, Human
acuccuggccuca

SEQ ID NO: 1882304 - RNA, 12 nt, Human
acuccuggccuc

SEQ ID NO: 1882305 - RNA, 13 nt, Human
uccuaggcauuug

SEQ ID NO: 1882306 - RNA, 15 nt, Human
uccuacucuguguca

SEQ ID NO: 1882307 - RNA, 14 nt, Human
uccuacucuguguc

SEQ ID NO: 1882308 - RNA, 13 nt, Human
uccuacucugugu

SEQ ID NO: 1882309 - RNA, 16 nt, Human
ucccuuuuuuuaagua

SEQ ID NO: 1882310 - RNA, 21 nt, Human
ucccuuuuuuuaaguaaggaa

SEQ ID NO: 1882311 - RNA, 16 nt, Human
ucccuuugacgccauc

SEQ ID NO: 1882312 - RNA, 18 nt, Human
ucccuuugacgccauccc

SEQ ID NO: 1882313 - RNA, 22 nt, Human
ucccugguggcagcucaccucu

SEQ ID NO: 1882314 - RNA, 23 nt, Human
ucccugguggcagcucaccucuc

SEQ ID NO: 1882315 - RNA, 14 nt, Human
acuccugcuguaaa

SEQ ID NO: 1882316 - RNA, 19 nt, Human
ucccuuggauuguccccga

SEQ ID NO: 1882317 - RNA, 20 nt, Human
ucccuuggauuguccccgac

SEQ ID NO: 1882318 - RNA, 13 nt, Human
ucccuuuuuuuaa

SEQ ID NO: 1882319 - RNA, 23 nt, Human
ucccuuuuuuggcugcugaaggc

SEQ ID NO: 1882320 - RNA, 20 nt, Human
ucccuuuuuuggcugcugaa

SEQ ID NO: 1882321 - RNA, 22 nt, Human
ucccuuuuuuggcugcugaagg

SEQ ID NO: 1882322 - RNA, 21 nt, Human
ucccuuugacgccaucccagc

SEQ ID NO: 1882323 - RNA, 19 nt, Human
ucccuuugacgccauccca

SEQ ID NO: 1882324 - RNA, 17 nt, Human
ucccuuuuuuggcugcu

SEQ ID NO: 1882325 - RNA, 19 nt, Human
ucccuuuuuuggcugcuga

SEQ ID NO: 1882326 - RNA, 21 nt, Human
agaaauaugcacaauagcagu

SEQ ID NO: 1882327 - RNA, 16 nt, Human
agaaauauggaacuua

SEQ ID NO: 1882328 - RNA, 14 nt, Human
agaaauauggacac

SEQ ID NO: 1882329 - RNA, 17 nt, Human
agaaauauggaacuuac

SEQ ID NO: 1882330 - RNA, 20 nt, Human
agaaauauggaacuuacauu

SEQ ID NO: 1882331 - RNA, 17 nt, Human
agaaauauggacacuua

SEQ ID NO: 1882332 - RNA, 22 nt, Human
agaaauauggaacuuacauugu

SEQ ID NO: 1882333 - RNA, 20 nt, Human
agaaagcccuuaggaagaau

SEQ ID NO: 1882334 - RNA, 22 nt, Human
agaaagcccuuaggaagaauuu

SEQ ID NO: 1882335 - RNA, 14 nt, Human
agaaaugcaaaaau

SEQ ID NO: 1882336 - RNA, 16 nt, Human
agaaaugcaaaaaucu

SEQ ID NO: 1882337 - RNA, 19 nt, Human
ucuccuuuguacuuugugc

SEQ ID NO: 1882338 - RNA, 20 nt, Human
ucuccuuuguacuuugugcu

SEQ ID NO: 1882339 - RNA, 13 nt, Human
ucugaagccucac

SEQ ID NO: 1882340 - RNA, 21 nt, Human
ucugaaggacauugcggacag

SEQ ID NO: 1882341 - RNA, 22 nt, Human
ucugaaggacauugcggacagc

SEQ ID NO: 1882342 - RNA, 21 nt, Human
ucugaagcuuuaccagcugaa

SEQ ID NO: 1882343 - RNA, 10 nt, Human
ucugaauuau

SEQ ID NO: 1882344 - RNA, 15 nt, Human
ucugacacacagcuc

SEQ ID NO: 1882345 - RNA, 14 nt, Human
ucugacacacagcu

SEQ ID NO: 1882346 - RNA, 13 nt, Human
ucugacacacagc

SEQ ID NO: 1882347 - RNA, 15 nt, Human
ucugaauuauuuucu

SEQ ID NO: 1882348 - RNA, 20 nt, Human
ucugcagggccgccagggag

SEQ ID NO: 1882349 - RNA, 13 nt, Human
ucugcaggucccu

SEQ ID NO: 1882350 - RNA, 11 nt, Human
ucugcaggucc

SEQ ID NO: 1882351 - RNA, 12 nt, Human
ucugcagguccc

SEQ ID NO: 1882352 - RNA, 15 nt, Human
agaaauguacagcaa

SEQ ID NO: 1882353 - RNA, 14 nt, Human
agaaauguacagca

SEQ ID NO: 1882354 - RNA, 17 nt, Human
ucugcacuccccugcug

SEQ ID NO: 1882355 - RNA, 16 nt, Human
ucugcacuccccugcu

SEQ ID NO: 1882356 - RNA, 14 nt, Human
ucugcacuccccug

SEQ ID NO: 1882357 - RNA, 15 nt, Human
ucugcacuccccugc

SEQ ID NO: 1882358 - RNA, 17 nt, Human
ucugcagcaauaaagca

SEQ ID NO: 1882359 - RNA, 15 nt, Human
ucugcagauaaacag

SEQ ID NO: 1882360 - RNA, 18 nt, Human
ucugcagauaaacaguag

SEQ ID NO: 1882361 - RNA, 21 nt, Human
ucugaucauccacugugccau

SEQ ID NO: 1882362 - RNA, 22 nt, Human
ucugaguggcuucacuccugcu

SEQ ID NO: 1882363 - RNA, 18 nt, Human
ucugagugaaccuguaua

SEQ ID NO: 1882364 - RNA, 21 nt, Human
ucugaguggcuucacuccugc

SEQ ID NO: 1882365 - RNA, 17 nt, Human
ucugaucauccacugug

SEQ ID NO: 1882366 - RNA, 17 nt, Human
ucugaguggcuucacuc

SEQ ID NO: 1882367 - RNA, 13 nt, Human
ucugagugaaccu

SEQ ID NO: 1882368 - RNA, 22 nt, Human
ucugagacucgcgacaaugcaa

SEQ ID NO: 1882369 - RNA, 21 nt, Human
ucugagacucgcgacaaugca

SEQ ID NO: 1882370 - RNA, 20 nt, Human
ucugagugaaccuguauaag

SEQ ID NO: 1882371 - RNA, 21 nt, Human
agaaauucugucauagaaagu

SEQ ID NO: 1882372 - RNA, 23 nt, Human
agaaauucugucauagaaagugc

SEQ ID NO: 1882373 - RNA, 19 nt, Human
agaacuguguuucaaguuc

SEQ ID NO: 1882374 - RNA, 20 nt, Human
agaacuguguuucaaguuca

SEQ ID NO: 1882375 - RNA, 21 nt, Human
agaacuguguuucaaguucaa

SEQ ID NO: 1882376 - RNA, 22 nt, Human
agaacugccuuuggcagaguuc

SEQ ID NO: 1882377 - RNA, 18 nt, Human
agaagaaauucugucaua

SEQ ID NO: 1882378 - RNA, 22 nt, Human
agaagaaauucugucauagaaa

SEQ ID NO: 1882379 - RNA, 14 nt, Human
agaagaaguguguc

SEQ ID NO: 1882380 - RNA, 12 nt, Human
agaagcccagga

SEQ ID NO: 1882381 - RNA, 16 nt, Human
agaagcccaggaaagg

SEQ ID NO: 1882382 - RNA, 18 nt, Human
agaagcccaggaaaggcu

SEQ ID NO: 1882383 - RNA, 20 nt, Human
agaagcccaggaaaggcucc

SEQ ID NO: 1882384 - RNA, 21 nt, Human
agaagcccaggaaaggcucca

SEQ ID NO: 1882385 - RNA, 22 nt, Human
agaagcccaggaaaggcuccag

SEQ ID NO: 1882386 - RNA, 17 nt, Human
ucugcccacucccugca

SEQ ID NO: 1882387 - RNA, 18 nt, Human
agaagauuuugaaauuuu

SEQ ID NO: 1882388 - RNA, 22 nt, Human
agaagauucuucccauucucca

SEQ ID NO: 1882389 - RNA, 18 nt, Human
agaagccacaggccugag

SEQ ID NO: 1882390 - RNA, 21 nt, Human
agaagcccaauauuauaauuu

SEQ ID NO: 1882391 - RNA, 17 nt, Human
agaagccacaggccuga

SEQ ID NO: 1882392 - RNA, 11 nt, Human
agaagcccaga

SEQ ID NO: 1882393 - RNA, 13 nt, Human
agaagcccagaau

SEQ ID NO: 1882394 - RNA, 12 nt, Human
agaagcccagaa

SEQ ID NO: 1882395 - RNA, 16 nt, Human
agaagccacaggccug

SEQ ID NO: 1882396 - RNA, 13 nt, Human
ucugcuucagccu

SEQ ID NO: 1882397 - RNA, 15 nt, Human
ucugcucauucuaau

SEQ ID NO: 1882398 - RNA, 15 nt, Human
ucugcuucagccucc

SEQ ID NO: 1882399 - RNA, 14 nt, Human
ucugcuucagccuc

SEQ ID NO: 1882400 - RNA, 20 nt, Human
ucugcucacauaucugucau

SEQ ID NO: 1882401 - RNA, 19 nt, Human
ucugcucacauaucuguca

SEQ ID NO: 1882402 - RNA, 20 nt, Human
ucugcgucucugcuuuaaag

SEQ ID NO: 1882403 - RNA, 22 nt, Human
ucugccugcccaggccccugcc

SEQ ID NO: 1882404 - RNA, 21 nt, Human
ucugccugcccaggccccugc

SEQ ID NO: 1882405 - RNA, 23 nt, Human
ucugccgcagcccugcagagggc

SEQ ID NO: 1882406 - RNA, 22 nt, Human
ucugccgcagcccugcagaggg

SEQ ID NO: 1882407 - RNA, 19 nt, Human
ucugcgucucugcuuuaaa

SEQ ID NO: 1882408 - RNA, 16 nt, Human
ucugcgugcagggaca

SEQ ID NO: 1882409 - RNA, 14 nt, Human
ucugccgcagcccu

SEQ ID NO: 1882410 - RNA, 15 nt, Human
ucugccgcagcccug

SEQ ID NO: 1882411 - RNA, 18 nt, Human
ucugcccacucccugcaa

SEQ ID NO: 1882412 - RNA, 21 nt, Human
ucugcccacucccugcaaccu

SEQ ID NO: 1882413 - RNA, 19 nt, Human
ucugcccuccaagaccuuc

SEQ ID NO: 1882414 - RNA, 18 nt, Human
ucugggauaaguaaguuu

SEQ ID NO: 1882415 - RNA, 19 nt, Human
ucugggaguggggaaguga

SEQ ID NO: 1882416 - RNA, 20 nt, Human
agaauucaaacuggggccuc

SEQ ID NO: 1882417 - RNA, 21 nt, Human
agaauuaucuaauuuauaaaa

SEQ ID NO: 1882418 - RNA, 20 nt, Human
agaauuaucuaauuuauaaa

SEQ ID NO: 1882419 - RNA, 18 nt, Human
agaauuaucuaauuuaua

SEQ ID NO: 1882420 - RNA, 15 nt, Human
agaauuaacacauga

SEQ ID NO: 1882421 - RNA, 23 nt, Human
agaauuaacacaugauccugcaa

SEQ ID NO: 1882422 - RNA, 17 nt, Human
agaauuaucuaauuuau

SEQ ID NO: 1882423 - RNA, 15 nt, Human
agaauuaucuaauuu

SEQ ID NO: 1882424 - RNA, 14 nt, Human
agaauuaucuaauu

SEQ ID NO: 1882425 - RNA, 16 nt, Human
agaauguaagaacuac

SEQ ID NO: 1882426 - RNA, 15 nt, Human
agaauguaagaacua

SEQ ID NO: 1882427 - RNA, 13 nt, Human
agaaugucaguau

SEQ ID NO: 1882428 - RNA, 19 nt, Human
agaauauuugguuuuccug

SEQ ID NO: 1882429 - RNA, 16 nt, Human
agaauauuuauuaccu

SEQ ID NO: 1882430 - RNA, 19 nt, Human
agaauauuuauuaccucug

SEQ ID NO: 1882431 - RNA, 22 nt, Human
agaauauuuauuaccucugaua

SEQ ID NO: 1882432 - RNA, 11 nt, Human
agaauauuuau

SEQ ID NO: 1882433 - RNA, 19 nt, Human
agaaucagucuugcagcug

SEQ ID NO: 1882434 - RNA, 12 nt, Human
agaauccaaacu

SEQ ID NO: 1882435 - RNA, 14 nt, Human
agaauccaaacuug

SEQ ID NO: 1882436 - RNA, 16 nt, Human
agaauccaaacuugga

SEQ ID NO: 1882437 - RNA, 21 nt, Human
agaauccaaacuuggauuuuu

SEQ ID NO: 1882438 - RNA, 15 nt, Human
agaaucccaaauuug

SEQ ID NO: 1882439 - RNA, 17 nt, Human
agaaucccaaauuugau

SEQ ID NO: 1882440 - RNA, 18 nt, Human
agaaucccaaauuugauu

SEQ ID NO: 1882441 - RNA, 19 nt, Human
agaaucccaaauuugauug

SEQ ID NO: 1882442 - RNA, 15 nt, Human
agaauggggugcaug

SEQ ID NO: 1882443 - RNA, 15 nt, Human
agaaggcaaaaaugu

SEQ ID NO: 1882444 - RNA, 21 nt, Human
agaaguuucugccgcagcccu

SEQ ID NO: 1882445 - RNA, 22 nt, Human
agaaguuucugccgcagcccug

SEQ ID NO: 1882446 - RNA, 23 nt, Human
agaaguuucugccgcagcccugc

SEQ ID NO: 1882447 - RNA, 17 nt, Human
agaauagccacauuugg

SEQ ID NO: 1882448 - RNA, 20 nt, Human
agaauacuguuaaaggaaaa

SEQ ID NO: 1882449 - RNA, 22 nt, Human
agaauagaaauaaaggauguga

SEQ ID NO: 1882450 - RNA, 12 nt, Human
agaauaaaauuu

SEQ ID NO: 1882451 - RNA, 14 nt, Human
agaauaaaauuuuu

SEQ ID NO: 1882452 - RNA, 17 nt, Human
agaauaaaauuuuuaau

SEQ ID NO: 1882453 - RNA, 12 nt, Human
agaauaauaaau

SEQ ID NO: 1882454 - RNA, 16 nt, Human
agaauaauaaauauuu

SEQ ID NO: 1882455 - RNA, 19 nt, Human
agaauacuguuaaaggaaa

SEQ ID NO: 1882456 - RNA, 17 nt, Human
ucuguuggccaguguga

SEQ ID NO: 1882457 - RNA, 12 nt, Human
ucuguuggccag

SEQ ID NO: 1882458 - RNA, 16 nt, Human
ucuguugcccaggcug

SEQ ID NO: 1882459 - RNA, 22 nt, Human
ucuguucuuuccaaaguacacu

SEQ ID NO: 1882460 - RNA, 16 nt, Human
ucuguugcaagugcaa

SEQ ID NO: 1882461 - RNA, 13 nt, Human
ucuguucuuucca

SEQ ID NO: 1882462 - RNA, 13 nt, Human
ucuguuuagauaa

SEQ ID NO: 1882463 - RNA, 16 nt, Human
ucuguugucaccuuca

SEQ ID NO: 1882464 - RNA, 17 nt, Human
ucuguugucaccuucac

SEQ ID NO: 1882465 - RNA, 18 nt, Human
ucuguugucaccuucacc

SEQ ID NO: 1882466 - RNA, 14 nt, Human
ucuguuuacagugu

SEQ ID NO: 1882467 - RNA, 22 nt, Human
ucugugaaaggaaagagggagg

SEQ ID NO: 1882468 - RNA, 21 nt, Human
ucugggccauucuccacagca

SEQ ID NO: 1882469 - RNA, 22 nt, Human
ucugugagaugcuagaacuccc

SEQ ID NO: 1882470 - RNA, 17 nt, Human
ucugugagaugcuagaa

SEQ ID NO: 1882471 - RNA, 23 nt, Human
ucugugagaugcuagaacucccu

SEQ ID NO: 1882472 - RNA, 21 nt, Human
ucugugagacucgagaacuuu

SEQ ID NO: 1882473 - RNA, 17 nt, Human
ucugugagacucgagaa

SEQ ID NO: 1882474 - RNA, 14 nt, Human
ucugugagaugcua

SEQ ID NO: 1882475 - RNA, 17 nt, Human
ucugugaacgauuuaga

SEQ ID NO: 1882476 - RNA, 21 nt, Human
ucugugaacgauuuagaaaga

SEQ ID NO: 1882477 - RNA, 16 nt, Human
agacacaggcccggcu

SEQ ID NO: 1882478 - RNA, 13 nt, Human
agacacaggauga

SEQ ID NO: 1882479 - RNA, 13 nt, Human
agacacaggcccg

SEQ ID NO: 1882480 - RNA, 12 nt, Human
agacacaggccc

SEQ ID NO: 1882481 - RNA, 21 nt, Human
agaauuugauaugugaacagu

SEQ ID NO: 1882482 - RNA, 22 nt, Human
agaauuugauaugugaacaguu

SEQ ID NO: 1882483 - RNA, 17 nt, Human
agacaccuugacagggc

SEQ ID NO: 1882484 - RNA, 18 nt, Human
agacaccuugacagggca

SEQ ID NO: 1882485 - RNA, 16 nt, Human
agacacauguccaaga

SEQ ID NO: 1882486 - RNA, 20 nt, Human
agacacauguccaagaagcc

SEQ ID NO: 1882487 - RNA, 14 nt, Human
agacacauaugagg

SEQ ID NO: 1882488 - RNA, 21 nt, Human
agacacagucauacugucacu

SEQ ID NO: 1882489 - RNA, 16 nt, Human
agacacauaugagggg

SEQ ID NO: 1882490 - RNA, 19 nt, Human
agacacaucgcacugugga

SEQ ID NO: 1882491 - RNA, 21 nt, Human
ucuauugauaauuuagacauu

SEQ ID NO: 1882492 - RNA, 13 nt, Human
ucuauucucucca

SEQ ID NO: 1882493 - RNA, 23 nt, Human
ucuaugggacucaaugcacugac

SEQ ID NO: 1882494 - RNA, 16 nt, Human
ucuauagacucuagga

SEQ ID NO: 1882495 - RNA, 22 nt, Human
ucuauguuuacaaauggacaua

SEQ ID NO: 1882496 - RNA, 15 nt, Human
ucuauacuugcuuug

SEQ ID NO: 1882497 - RNA, 13 nt, Human
ucuauagacucua

SEQ ID NO: 1882498 - RNA, 14 nt, Human
ucucaccuccugcu

SEQ ID NO: 1882499 - RNA, 15 nt, Human
ucucaccuccugcug

SEQ ID NO: 1882500 - RNA, 16 nt, Human
ucucaccuccugcugg

SEQ ID NO: 1882501 - RNA, 17 nt, Human
ucucaccuccugcuggg

SEQ ID NO: 1882502 - RNA, 19 nt, Human
ucucacuauguugcccagg

SEQ ID NO: 1882503 - RNA, 17 nt, Human
ucucacuauguugccca

SEQ ID NO: 1882504 - RNA, 18 nt, Human
ucuauuuuggauuguaua

SEQ ID NO: 1882505 - RNA, 15 nt, Human
ucuauuuuggauugu

SEQ ID NO: 1882506 - RNA, 15 nt, Human
ucuauuuaaguaaaa

SEQ ID NO: 1882507 - RNA, 13 nt, Human
ucuauuuauaugu

SEQ ID NO: 1882508 - RNA, 18 nt, Human
ucuauuuauauguacaug

SEQ ID NO: 1882509 - RNA, 15 nt, Human
ucuauuuaucuucau

SEQ ID NO: 1882510 - RNA, 19 nt, Human
ucuauuuaucuucauuuga

SEQ ID NO: 1882511 - RNA, 13 nt, Human
ucuauuuauguuu

SEQ ID NO: 1882512 - RNA, 15 nt, Human
ucuauuuauguuugc

SEQ ID NO: 1882513 - RNA, 15 nt, Human
ucuauuuauuuacug

SEQ ID NO: 1882514 - RNA, 22 nt, Human
ucuauuuauuuacugagcuucu

SEQ ID NO: 1882515 - RNA, 18 nt, Human
ucuaguugcuuguaaaau

SEQ ID NO: 1882516 - RNA, 23 nt, Human
ucuaguuguuugauucagacagc

SEQ ID NO: 1882517 - RNA, 21 nt, Human
ucuaguuugauuaaauucuug

SEQ ID NO: 1882518 - RNA, 22 nt, Human
ucuaguuugauuaaauucuugc

SEQ ID NO: 1882519 - RNA, 13 nt, Human
ucuauaaaccgaa

SEQ ID NO: 1882520 - RNA, 13 nt, Human
ucuauaaggccau

SEQ ID NO: 1882521 - RNA, 14 nt, Human
ucuauaaggccaua

SEQ ID NO: 1882522 - RNA, 16 nt, Human
ucuauaaggccauaaa

SEQ ID NO: 1882523 - RNA, 22 nt, Human
ucuauaaggccauaaaacaggu

SEQ ID NO: 1882524 - RNA, 22 nt, Human
ucuaguuguuugauucagacag

SEQ ID NO: 1882525 - RNA, 12 nt, Human
ucuaggaagacu

SEQ ID NO: 1882526 - RNA, 13 nt, Human
ucuagccagagga

SEQ ID NO: 1882527 - RNA, 16 nt, Human
ucuagccaaaugguuu

SEQ ID NO: 1882528 - RNA, 14 nt, Human
ucuagacuaaaaga

SEQ ID NO: 1882529 - RNA, 16 nt, Human
acuucaucccucuggg

SEQ ID NO: 1882530 - RNA, 21 nt, Human
acuucccccaaauuuaaagaa

SEQ ID NO: 1882531 - RNA, 24 nt, Human
acuucauauugcugagagaaauau

SEQ ID NO: 1882532 - RNA, 14 nt, Human
acuucauauugcug

SEQ ID NO: 1882533 - RNA, 22 nt, Human
acuucauauugcugagagaaau

SEQ ID NO: 1882534 - RNA, 13 nt, Human
ucuagauacugua

SEQ ID NO: 1882535 - RNA, 18 nt, Human
ucuagcauggcugccaau

SEQ ID NO: 1882536 - RNA, 23 nt, Human
ucuagagagggaggcaagcccug

SEQ ID NO: 1882537 - RNA, 13 nt, Human
ucuagagagggag

SEQ ID NO: 1882538 - RNA, 20 nt, Human
ucuaauaccucugugugcuc

SEQ ID NO: 1882539 - RNA, 19 nt, Human
ucuaauagaacucaguuuu

SEQ ID NO: 1882540 - RNA, 19 nt, Human
ucuacccagcgagcccugg

SEQ ID NO: 1882541 - RNA, 17 nt, Human
ucuaauaccucugugug

SEQ ID NO: 1882542 - RNA, 16 nt, Human
ucuaauaccucugugu

SEQ ID NO: 1882543 - RNA, 14 nt, Human
ucuaauaccucugu

SEQ ID NO: 1882544 - RNA, 21 nt, Human
ucuacagaggccaugggccuc

SEQ ID NO: 1882545 - RNA, 18 nt, Human
uccugggagugagcuggu

SEQ ID NO: 1882546 - RNA, 16 nt, Human
acuguucucugcccuc

SEQ ID NO: 1882547 - RNA, 17 nt, Human
acuguucucugcccucc

SEQ ID NO: 1882548 - RNA, 18 nt, Human
acuguucccaccugcugg

SEQ ID NO: 1882549 - RNA, 19 nt, Human
acuguucucugcccuccaa

SEQ ID NO: 1882550 - RNA, 18 nt, Human
acuguucucugcccucca

SEQ ID NO: 1882551 - RNA, 21 nt, Human
ucuacccuggcacuauaaugu

SEQ ID NO: 1882552 - RNA, 23 nt, Human
ucuacagguuuggguacaagugg

SEQ ID NO: 1882553 - RNA, 20 nt, Human
ucuacccagcgagcccuggu

SEQ ID NO: 1882554 - RNA, 14 nt, Human
ucuacccaggugcu

SEQ ID NO: 1882555 - RNA, 19 nt, Human
ucuacccuggcacuauaau

SEQ ID NO: 1882556 - RNA, 14 nt, Human
ucuacccuggcacu

SEQ ID NO: 1882557 - RNA, 16 nt, Human
acuuauucucaagaag

SEQ ID NO: 1882558 - RNA, 15 nt, Human
acuuagguguggggg

SEQ ID NO: 1882559 - RNA, 23 nt, Human
acuuaugaccucuuccuuuagga

SEQ ID NO: 1882560 - RNA, 13 nt, Human
acuuaugauuuca

SEQ ID NO: 1882561 - RNA, 16 nt, Human
acuuaugauuucaugu

SEQ ID NO: 1882562 - RNA, 17 nt, Human
acuuaugauuucaugug

SEQ ID NO: 1882563 - RNA, 11 nt, Human
acuuauuaaau

SEQ ID NO: 1882564 - RNA, 22 nt, Human
acuuacuguacaugaaaacaca

SEQ ID NO: 1882565 - RNA, 16 nt, Human
acuuacuguacaugaa

SEQ ID NO: 1882566 - RNA, 21 nt, Human
acuuacuguacaugaaaacac

SEQ ID NO: 1882567 - RNA, 17 nt, Human
acuuacacuuuaugcac

SEQ ID NO: 1882568 - RNA, 20 nt, Human
acuuaaauaaugugaaacug

SEQ ID NO: 1882569 - RNA, 16 nt, Human
acuuacacuuuaugca

SEQ ID NO: 1882570 - RNA, 22 nt, Human
acuuaaucuaaauggaaccacu

SEQ ID NO: 1882571 - RNA, 19 nt, Human
acuuaaucuaaauggaacc

SEQ ID NO: 1882572 - RNA, 17 nt, Human
acuuaaucuaaauggaa

SEQ ID NO: 1882573 - RNA, 13 nt, Human
acuuaagcacacu

SEQ ID NO: 1882574 - RNA, 13 nt, Human
acuuaagcaaaag

SEQ ID NO: 1882575 - RNA, 18 nt, Human
ucucaccuccugcugggc

SEQ ID NO: 1882576 - RNA, 23 nt, Human
ucucacuauguugcccaggcagg

SEQ ID NO: 1882577 - RNA, 22 nt, Human
ucucacuauguugcccaggcag

SEQ ID NO: 1882578 - RNA, 21 nt, Human
ucucacuauguugcccaggca

SEQ ID NO: 1882579 - RNA, 20 nt, Human
ucucacuauguugcccaggc

SEQ ID NO: 1882580 - RNA, 22 nt, Human
acuugcagacucuacagaggcc

SEQ ID NO: 1882581 - RNA, 19 nt, Human
acuugcagacucuacagag

SEQ ID NO: 1882582 - RNA, 23 nt, Human
acuugcagacucuacagaggcca

SEQ ID NO: 1882583 - RNA, 16 nt, Human
acuugcucuugaugcc

SEQ ID NO: 1882584 - RNA, 17 nt, Human
acuugcucuugaugccu

SEQ ID NO: 1882585 - RNA, 18 nt, Human
acuugcucuugaugccug

SEQ ID NO: 1882586 - RNA, 20 nt, Human
acuugcucuugaugccuggc

SEQ ID NO: 1882587 - RNA, 22 nt, Human
acuuguggacacagcucuucuc

SEQ ID NO: 1882588 - RNA, 19 nt, Human
acuuguggacacagcucuu

SEQ ID NO: 1882589 - RNA, 20 nt, Human
acuugucuuuggacccugag

SEQ ID NO: 1882590 - RNA, 18 nt, Human
acuugucuuuggacccug

SEQ ID NO: 1882591 - RNA, 21 nt, Human
acuugucuuuggacccugagg

SEQ ID NO: 1882592 - RNA, 14 nt, Human
acuugcuuuuaaaa

SEQ ID NO: 1882593 - RNA, 18 nt, Human
acuuguauuauguguguu

SEQ ID NO: 1882594 - RNA, 19 nt, Human
acuuguauuauguguguuu

SEQ ID NO: 1882595 - RNA, 12 nt, Human
ucucaggccaaa

SEQ ID NO: 1882596 - RNA, 12 nt, Human
ucucaggccagc

SEQ ID NO: 1882597 - RNA, 13 nt, Human
ucucaggccagcu

SEQ ID NO: 1882598 - RNA, 10 nt, Human
ucucaggcca

SEQ ID NO: 1882599 - RNA, 14 nt, Human
ucucauuugucaca

SEQ ID NO: 1882600 - RNA, 22 nt, Human
ucucauuucaccccucccuuuc

SEQ ID NO: 1882601 - RNA, 19 nt, Human
ucucauuucaccccucccu

SEQ ID NO: 1882602 - RNA, 17 nt, Human
ucucauuucaccccucc

SEQ ID NO: 1882603 - RNA, 16 nt, Human
ucucauuucaccccuc

SEQ ID NO: 1882604 - RNA, 16 nt, Human
ucucauuugucacaca

SEQ ID NO: 1882605 - RNA, 13 nt, Human
ucuccaaaauaaa

SEQ ID NO: 1882606 - RNA, 15 nt, Human
ucuccaagcaggaca

SEQ ID NO: 1882607 - RNA, 16 nt, Human
ucuccaagcaggacau

SEQ ID NO: 1882608 - RNA, 21 nt, Human
ucucaggccagcugcuugggc

SEQ ID NO: 1882609 - RNA, 17 nt, Human
ucucaggccagcugcuu

SEQ ID NO: 1882610 - RNA, 18 nt, Human
ucucaggccagcugcuug

SEQ ID NO: 1882611 - RNA, 18 nt, Human
ucucauguuuucaacugc

SEQ ID NO: 1882612 - RNA, 19 nt, Human
ucucauguuuucaacugcc

SEQ ID NO: 1882613 - RNA, 17 nt, Human
ucucauguuuucaacug

SEQ ID NO: 1882614 - RNA, 17 nt, Human
agaaaaaauauuuuccc

SEQ ID NO: 1882615 - RNA, 14 nt, Human
ucuccuucaccuuu

SEQ ID NO: 1882616 - RNA, 15 nt, Human
ucuccuucaccuuug

SEQ ID NO: 1882617 - RNA, 21 nt, Human
ucuccuuguguuacuaaguuu

SEQ ID NO: 1882618 - RNA, 13 nt, Human
ucuccuuguguua

SEQ ID NO: 1882619 - RNA, 16 nt, Human
ucuccuucaccuuugu

SEQ ID NO: 1882620 - RNA, 18 nt, Human
ucuccuucaccuuugucc

SEQ ID NO: 1882621 - RNA, 23 nt, Human
acuuuuguucuugguuuguaaau

SEQ ID NO: 1882622 - RNA, 15 nt, Human
acuuuuguucuuggu

SEQ ID NO: 1882623 - RNA, 13 nt, Human
acuuuguucugcu

SEQ ID NO: 1882624 - RNA, 11 nt, Human
acuuuuuacaa

SEQ ID NO: 1882625 - RNA, 17 nt, Human
acuuuuuauauuuuaua

SEQ ID NO: 1882626 - RNA, 21 nt, Human
acuuuuuauauuuuauacauu

SEQ ID NO: 1882627 - RNA, 13 nt, Human
acuuuuguucuug

SEQ ID NO: 1882628 - RNA, 12 nt, Human
acuuuuguucuu

SEQ ID NO: 1882629 - RNA, 21 nt, Human
acuuuguuaguuucuccaagc

SEQ ID NO: 1882630 - RNA, 14 nt, Human
acuuuguucuggcu

SEQ ID NO: 1882631 - RNA, 20 nt, Human
acuuuguuaguuucuccaag

SEQ ID NO: 1882632 - RNA, 13 nt, Human
acuuugaccucug

SEQ ID NO: 1882633 - RNA, 12 nt, Human
acuuugaccucu

SEQ ID NO: 1882634 - RNA, 23 nt, Human
ucuccgaccagacaccuugacag

SEQ ID NO: 1882635 - RNA, 17 nt, Human
ucuccgaccagacaccu

SEQ ID NO: 1882636 - RNA, 14 nt, Human
ucuccucaucucua

SEQ ID NO: 1882637 - RNA, 15 nt, Human
ucuccucaucucuaa

SEQ ID NO: 1882638 - RNA, 16 nt, Human
ucuccucauguucugc

SEQ ID NO: 1882639 - RNA, 14 nt, Human
ucuccccagcccag

SEQ ID NO: 1882640 - RNA, 15 nt, Human
ucuccccagcccaga

SEQ ID NO: 1882641 - RNA, 16 nt, Human
ucuccccagcccagag

SEQ ID NO: 1882642 - RNA, 17 nt, Human
ucuccccagcccagaga

SEQ ID NO: 1882643 - RNA, 18 nt, Human
ucuccccagcccagagac

SEQ ID NO: 1882644 - RNA, 19 nt, Human
ucuccccagcccagagaca

SEQ ID NO: 1882645 - RNA, 12 nt, Human
ucuccacccugc

SEQ ID NO: 1882646 - RNA, 14 nt, Human
ucuccacagcaacc

SEQ ID NO: 1882647 - RNA, 19 nt, Human
ucuccacagcaaccccagg

SEQ ID NO: 1882648 - RNA, 16 nt, Human
ucuccaccaggaaccu

SEQ ID NO: 1882649 - RNA, 18 nt, Human
ucuccaccaggaaccucu

SEQ ID NO: 1882650 - RNA, 22 nt, Human
ucuccaccagucauuuuucaga

SEQ ID NO: 1882651 - RNA, 23 nt, Human
ucuccccagcaagugagagcugg

SEQ ID NO: 1882652 - RNA, 18 nt, Human
ucuccaagcaggacaugg

SEQ ID NO: 1882653 - RNA, 19 nt, Human
ucuccaagcaggacaugga

SEQ ID NO: 1882654 - RNA, 20 nt, Human
ucuccaauuuuuuuuuccuu

SEQ ID NO: 1882655 - RNA, 17 nt, Human
ucuccucugcugcuggc

SEQ ID NO: 1882656 - RNA, 18 nt, Human
ucuccucugcugcuggcu

SEQ ID NO: 1882657 - RNA, 15 nt, Human
ucuccuccagaguca

SEQ ID NO: 1882658 - RNA, 18 nt, Human
ucuccucaucucuaacag

SEQ ID NO: 1882659 - RNA, 15 nt, Human
ucuccucugcugcug

SEQ ID NO: 1882660 - RNA, 16 nt, Human
ucuccucugcugcugg

SEQ ID NO: 1882661 - RNA, 12 nt, Human
acuuuaccuuuu

SEQ ID NO: 1882662 - RNA, 14 nt, Human
acuuucugaaauaa

SEQ ID NO: 1882663 - RNA, 20 nt, Human
acuuucugaaauaacauggc

SEQ ID NO: 1882664 - RNA, 21 nt, Human
ugacuagugcugaagcuuauu

SEQ ID NO: 1882665 - RNA, 22 nt, Human
ugacuagugcugaagcuuauua

SEQ ID NO: 1882666 - RNA, 18 nt, Human
ugacuagugcugaagcuu

SEQ ID NO: 1882667 - RNA, 17 nt, Human
ugacuagugcugaagcu

SEQ ID NO: 1882668 - RNA, 15 nt, Human
ugacuagugcugaag

SEQ ID NO: 1882669 - RNA, 14 nt, Human
ugacuagugcugaa

SEQ ID NO: 1882670 - RNA, 12 nt, Human
ugaccuuucaau

SEQ ID NO: 1882671 - RNA, 13 nt, Human
ugaccuuucaaua

SEQ ID NO: 1882672 - RNA, 21 nt, Human
ugacuguuuucucuugagagg

SEQ ID NO: 1882673 - RNA, 19 nt, Human
ugacuauuuuucagaaucu

SEQ ID NO: 1882674 - RNA, 15 nt, Human
ugaccugguccacag

SEQ ID NO: 1882675 - RNA, 20 nt, Human
ugaccugguccacagggcac

SEQ ID NO: 1882676 - RNA, 15 nt, Human
ugaccuuuaagagaa

SEQ ID NO: 1882677 - RNA, 18 nt, Human
ugaccuugaugagcugug

SEQ ID NO: 1882678 - RNA, 19 nt, Human
ugaccuugaugagcugugc

SEQ ID NO: 1882679 - RNA, 22 nt, Human
ugaccuugaugagcugugcaca

SEQ ID NO: 1882680 - RNA, 16 nt, Human
ugaccugccaggcaca

SEQ ID NO: 1882681 - RNA, 19 nt, Human
ugaccugccaggcacacug

SEQ ID NO: 1882682 - RNA, 15 nt, Human
ugacuuaagaagccu

SEQ ID NO: 1882683 - RNA, 20 nt, Human
ugacuuacuguacaugaaaa

SEQ ID NO: 1882684 - RNA, 12 nt, Human
ugacuuacugua

SEQ ID NO: 1882685 - RNA, 15 nt, Human
agauuaauuccuuuc

SEQ ID NO: 1882686 - RNA, 13 nt, Human
agauucauauuua

SEQ ID NO: 1882687 - RNA, 16 nt, Human
agauucauauuuacuu

SEQ ID NO: 1882688 - RNA, 19 nt, Human
agauucauauuuacuucuu

SEQ ID NO: 1882689 - RNA, 16 nt, Human
agauucccaggaguuc

SEQ ID NO: 1882690 - RNA, 13 nt, Human
agauucccaggag

SEQ ID NO: 1882691 - RNA, 14 nt, Human
agauucccaggagu

SEQ ID NO: 1882692 - RNA, 12 nt, Human
agauucccagga

SEQ ID NO: 1882693 - RNA, 15 nt, Human
agauucccaggaguu

SEQ ID NO: 1882694 - RNA, 19 nt, Human
agauuucacucuccuuggu

SEQ ID NO: 1882695 - RNA, 17 nt, Human
agauuucacucuccuug

SEQ ID NO: 1882696 - RNA, 21 nt, Human
agauuucaucugcucuccuuc

SEQ ID NO: 1882697 - RNA, 20 nt, Human
agauuucaucugcucuccuu

SEQ ID NO: 1882698 - RNA, 19 nt, Human
agauuucaucugcucuccu

SEQ ID NO: 1882699 - RNA, 18 nt, Human
agauuucaucugcucucc

SEQ ID NO: 1882700 - RNA, 15 nt, Human
agauuucaucugcuc

SEQ ID NO: 1882701 - RNA, 13 nt, Human
agauuucaucugc

SEQ ID NO: 1882702 - RNA, 23 nt, Human
agauuucaucugcucuccuuccu

SEQ ID NO: 1882703 - RNA, 19 nt, Human
agauuuuaaucaaguugaa

SEQ ID NO: 1882704 - RNA, 14 nt, Human
agauuuuaauuuug

SEQ ID NO: 1882705 - RNA, 17 nt, Human
agauuuuaauuuugaau

SEQ ID NO: 1882706 - RNA, 21 nt, Human
agauuuuaauuuugaauaaau

SEQ ID NO: 1882707 - RNA, 22 nt, Human
ugacagggcacaccgggcacuc

SEQ ID NO: 1882708 - RNA, 15 nt, Human
ugacagcuuugcugc

SEQ ID NO: 1882709 - RNA, 16 nt, Human
ugacagcuuugcugcu

SEQ ID NO: 1882710 - RNA, 17 nt, Human
ugacagcuuugcugcug

SEQ ID NO: 1882711 - RNA, 18 nt, Human
ugacagcuuugcugcuga

SEQ ID NO: 1882712 - RNA, 15 nt, Human
ugacagguuugggac

SEQ ID NO: 1882713 - RNA, 21 nt, Human
ugacagcuuugcugcugaagg

SEQ ID NO: 1882714 - RNA, 20 nt, Human
ugacagcuuugcugcugaag

SEQ ID NO: 1882715 - RNA, 19 nt, Human
ugacaggcaaugcuggcug

SEQ ID NO: 1882716 - RNA, 17 nt, Human
ugacaggcaaugcuggc

SEQ ID NO: 1882717 - RNA, 13 nt, Human
ugacagcuuugcu

SEQ ID NO: 1882718 - RNA, 14 nt, Human
ugacagcuuugcug

SEQ ID NO: 1882719 - RNA, 13 nt, Human
ugacauuucuuug

SEQ ID NO: 1882720 - RNA, 14 nt, Human
ugacauuucuuugu

SEQ ID NO: 1882721 - RNA, 12 nt, Human
ugacauuucuuu

SEQ ID NO: 1882722 - RNA, 15 nt, Human
ugacauucaccugcc

SEQ ID NO: 1882723 - RNA, 18 nt, Human
ugacauucaccugcccca

SEQ ID NO: 1882724 - RNA, 12 nt, Human
ugacauucaccu

SEQ ID NO: 1882725 - RNA, 16 nt, Human
ugacacgaauauugcu

SEQ ID NO: 1882726 - RNA, 22 nt, Human
ugacagagugagacucugucuc

SEQ ID NO: 1882727 - RNA, 15 nt, Human
ugacacuuaaaaaug

SEQ ID NO: 1882728 - RNA, 19 nt, Human
ugacacgaauauugcugau

SEQ ID NO: 1882729 - RNA, 20 nt, Human
ugacaccuuucauaaucuuu

SEQ ID NO: 1882730 - RNA, 23 nt, Human
ugacaccuuucauaaucuuugcu

SEQ ID NO: 1882731 - RNA, 19 nt, Human
agaugcuagaacucccuuu

SEQ ID NO: 1882732 - RNA, 20 nt, Human
agaugcaaugacucaggaca

SEQ ID NO: 1882733 - RNA, 21 nt, Human
agauguagccccucuccugga

SEQ ID NO: 1882734 - RNA, 18 nt, Human
agaugcuggcccagggcc

SEQ ID NO: 1882735 - RNA, 19 nt, Human
agaugcuggcccagggccc

SEQ ID NO: 1882736 - RNA, 14 nt, Human
agaugcuggcccag

SEQ ID NO: 1882737 - RNA, 15 nt, Human
agaugcuggcccagg

SEQ ID NO: 1882738 - RNA, 16 nt, Human
agaugcuggcccaggg

SEQ ID NO: 1882739 - RNA, 17 nt, Human
agaugcuggcccagggc

SEQ ID NO: 1882740 - RNA, 22 nt, Human
agauguagccccucuccuggaa

SEQ ID NO: 1882741 - RNA, 22 nt, Human
agaugcuagaacucccuuucaa

SEQ ID NO: 1882742 - RNA, 21 nt, Human
agaugcuagaacucccuuuca

SEQ ID NO: 1882743 - RNA, 16 nt, Human
agaucguucucugccu

SEQ ID NO: 1882744 - RNA, 18 nt, Human
agaucucuaacuucacca

SEQ ID NO: 1882745 - RNA, 13 nt, Human
agcaagucucuuu

SEQ ID NO: 1882746 - RNA, 14 nt, Human
agcaagucaggguu

SEQ ID NO: 1882747 - RNA, 16 nt, Human
agcaagugagacccug

SEQ ID NO: 1882748 - RNA, 16 nt, Human
agcaagugagagcugg

SEQ ID NO: 1882749 - RNA, 15 nt, Human
agcaagugagagcug

SEQ ID NO: 1882750 - RNA, 15 nt, Human
agcaagucagaauag

SEQ ID NO: 1882751 - RNA, 20 nt, Human
agcaaggguucccucaagag

SEQ ID NO: 1882752 - RNA, 14 nt, Human
agcaaggagauuua

SEQ ID NO: 1882753 - RNA, 19 nt, Human
agcaaggagauuuacaacu

SEQ ID NO: 1882754 - RNA, 17 nt, Human
agcaaggagauuuacaa

SEQ ID NO: 1882755 - RNA, 13 nt, Human
ugagccacugcac

SEQ ID NO: 1882756 - RNA, 12 nt, Human
ugagccacugca

SEQ ID NO: 1882757 - RNA, 21 nt, Human
ugagauuucaucugcucuccu

SEQ ID NO: 1882758 - RNA, 19 nt, Human
ugagauuucaucugcucuc

SEQ ID NO: 1882759 - RNA, 18 nt, Human
ugagauuucaucugcucu

SEQ ID NO: 1882760 - RNA, 14 nt, Human
ugagauuucaucug

SEQ ID NO: 1882761 - RNA, 22 nt, Human
ugagauuucaucugcucuccuu

SEQ ID NO: 1882762 - RNA, 14 nt, Human
ugagccacugcacc

SEQ ID NO: 1882763 - RNA, 18 nt, Human
ugagccagauuucacucu

SEQ ID NO: 1882764 - RNA, 19 nt, Human
ugagccagauuucacucuc

SEQ ID NO: 1882765 - RNA, 20 nt, Human
ugagccagauuucacucucc

SEQ ID NO: 1882766 - RNA, 21 nt, Human
ugagccagauuucacucuccu

SEQ ID NO: 1882767 - RNA, 17 nt, Human
agcaagugagagcuggg

SEQ ID NO: 1882768 - RNA, 21 nt, Human
agcacagcuucauuuccugug

SEQ ID NO: 1882769 - RNA, 18 nt, Human
agcacaugccucucucag

SEQ ID NO: 1882770 - RNA, 16 nt, Human
agcacaugccucucuc

SEQ ID NO: 1882771 - RNA, 19 nt, Human
agcacaugccucucucagg

SEQ ID NO: 1882772 - RNA, 20 nt, Human
agcacaugccucucucaggc

SEQ ID NO: 1882773 - RNA, 21 nt, Human
agcacaugccucucucaggcc

SEQ ID NO: 1882774 - RNA, 22 nt, Human
agcacaugccucucucaggcca

SEQ ID NO: 1882775 - RNA, 16 nt, Human
agcaccaucucuccuc

SEQ ID NO: 1882776 - RNA, 22 nt, Human
agcaccaaaagcuuaccaaggg

SEQ ID NO: 1882777 - RNA, 23 nt, Human
agcacaugccucucucaggccaa

SEQ ID NO: 1882778 - RNA, 15 nt, Human
agcaccguucugugc

SEQ ID NO: 1882779 - RNA, 16 nt, Human
agcaccguucugugca

SEQ ID NO: 1882780 - RNA, 17 nt, Human
agcaccguucugugcac

SEQ ID NO: 1882781 - RNA, 16 nt, Human
agcaccuccugccucg

SEQ ID NO: 1882782 - RNA, 14 nt, Human
agcaccuccugccu

SEQ ID NO: 1882783 - RNA, 13 nt, Human
agcaccuccugcc

SEQ ID NO: 1882784 - RNA, 21 nt, Human
agcaccuacaguguacagucu

SEQ ID NO: 1882785 - RNA, 19 nt, Human
agcaccuacaguguacagu

SEQ ID NO: 1882786 - RNA, 15 nt, Human
agcaccuacagugua

SEQ ID NO: 1882787 - RNA, 14 nt, Human
agcaccuacagugu

SEQ ID NO: 1882788 - RNA, 22 nt, Human
agcaccuacaguguacagucuu

SEQ ID NO: 1882789 - RNA, 18 nt, Human
agcaccguucugugcaca

SEQ ID NO: 1882790 - RNA, 21 nt, Human
ugagacagaguuuucacucuu

SEQ ID NO: 1882791 - RNA, 13 nt, Human
ugagacagcccgg

SEQ ID NO: 1882792 - RNA, 11 nt, Human
ugagacagagu

SEQ ID NO: 1882793 - RNA, 22 nt, Human
ugagacacggagcccagcccuc

SEQ ID NO: 1882794 - RNA, 15 nt, Human
ugagaauguaagaac

SEQ ID NO: 1882795 - RNA, 21 nt, Human
ugagacacggagcccagcccu

SEQ ID NO: 1882796 - RNA, 17 nt, Human
ugagacacggagcccag

SEQ ID NO: 1882797 - RNA, 12 nt, Human
ugagaaucuacc

SEQ ID NO: 1882798 - RNA, 21 nt, Human
ugagaaucuacccccagaucc

SEQ ID NO: 1882799 - RNA, 13 nt, Human
ugagaaucccaaa

SEQ ID NO: 1882800 - RNA, 20 nt, Human
ugagaaucccaaauuugauu

SEQ ID NO: 1882801 - RNA, 21 nt, Human
ugagaaucccaaauuugauug

SEQ ID NO: 1882802 - RNA, 22 nt, Human
ugagaaucccaaauuugauuga

SEQ ID NO: 1882803 - RNA, 19 nt, Human
ugagaagcuuuugaauaaa

SEQ ID NO: 1882804 - RNA, 20 nt, Human
ugagacucugucucaaaaaa

SEQ ID NO: 1882805 - RNA, 20 nt, Human
ugagacucugucucagucca

SEQ ID NO: 1882806 - RNA, 22 nt, Human
ugagacagcccgggcucugccu

SEQ ID NO: 1882807 - RNA, 12 nt, Human
ugagacagcucu

SEQ ID NO: 1882808 - RNA, 17 nt, Human
ugagacagcccgggcuc

SEQ ID NO: 1882809 - RNA, 18 nt, Human
ugagacagcccgggcucu

SEQ ID NO: 1882810 - RNA, 19 nt, Human
ugagacagcccgggcucug

SEQ ID NO: 1882811 - RNA, 20 nt, Human
ugagacagcccgggcucugc

SEQ ID NO: 1882812 - RNA, 22 nt, Human
ugagagaaauauggaacuuaca

SEQ ID NO: 1882813 - RNA, 14 nt, Human
ugagagcugggugu

SEQ ID NO: 1882814 - RNA, 10 nt, Human
ugagaggaaa

SEQ ID NO: 1882815 - RNA, 17 nt, Human
ugagagcugugcaucag

SEQ ID NO: 1882816 - RNA, 11 nt, Human
ugagaggaaau

SEQ ID NO: 1882817 - RNA, 12 nt, Human
ugagaggaaauc

SEQ ID NO: 1882818 - RNA, 13 nt, Human
ugagaggaaauca

SEQ ID NO: 1882819 - RNA, 14 nt, Human
ugagaggaaaucac

SEQ ID NO: 1882820 - RNA, 23 nt, Human
ugagaggacuuuucuuuguggcu

SEQ ID NO: 1882821 - RNA, 17 nt, Human
ugagaggaaaucaccga

SEQ ID NO: 1882822 - RNA, 23 nt, Human
ugagauguagccccucuccugga

SEQ ID NO: 1882823 - RNA, 14 nt, Human
ugagauguguucac

SEQ ID NO: 1882824 - RNA, 14 nt, Human
ugagauuaauuccu

SEQ ID NO: 1882825 - RNA, 16 nt, Human
ugagauuaauuccuuu

SEQ ID NO: 1882826 - RNA, 13 nt, Human
ugagauuucaucu

SEQ ID NO: 1882827 - RNA, 22 nt, Human
ugaagaagcuaaauccuuuacu

SEQ ID NO: 1882828 - RNA, 13 nt, Human
ugaagacagagcu

SEQ ID NO: 1882829 - RNA, 23 nt, Human
ugaagacaaugacuuacuguaca

SEQ ID NO: 1882830 - RNA, 22 nt, Human
ugaagacaaugacuuacuguac

SEQ ID NO: 1882831 - RNA, 11 nt, Human
ugaacuccugg

SEQ ID NO: 1882832 - RNA, 20 nt, Human
ugaacucacuuuccuccuga

SEQ ID NO: 1882833 - RNA, 19 nt, Human
ugaagaaccagucccccca

SEQ ID NO: 1882834 - RNA, 20 nt, Human
ugaagaaccaguccccccac

SEQ ID NO: 1882835 - RNA, 13 nt, Human
ugaagaacaugug

SEQ ID NO: 1882836 - RNA, 14 nt, Human
ugaagaacauguga

SEQ ID NO: 1882837 - RNA, 18 nt, Human
ugaacccgggaggcagag

SEQ ID NO: 1882838 - RNA, 22 nt, Human
ugaacccauauuuguacaccaa

SEQ ID NO: 1882839 - RNA, 22 nt, Human
ugaaccaccacacccagcccac

SEQ ID NO: 1882840 - RNA, 18 nt, Human
ugaacaaauuuacagaga

SEQ ID NO: 1882841 - RNA, 21 nt, Human
ugaaccaccacacccagccca

SEQ ID NO: 1882842 - RNA, 13 nt, Human
ugaacaaauuuac

SEQ ID NO: 1882843 - RNA, 16 nt, Human
agagauugugguuuca

SEQ ID NO: 1882844 - RNA, 17 nt, Human
ugaaauaaaacuggcuu

SEQ ID NO: 1882845 - RNA, 19 nt, Human
ugaaauaaaacuggcuuug

SEQ ID NO: 1882846 - RNA, 22 nt, Human
ugaaauaaaacuggcuuuggcu

SEQ ID NO: 1882847 - RNA, 17 nt, Human
ugaaauaacauggccuu

SEQ ID NO: 1882848 - RNA, 16 nt, Human
ugaaauaacauggccu

SEQ ID NO: 1882849 - RNA, 23 nt, Human
ugaaauaaacgucuuaaauauuc

SEQ ID NO: 1882850 - RNA, 22 nt, Human
ugaaauaaacgucuuaaauauu

SEQ ID NO: 1882851 - RNA, 18 nt, Human
ugaaauaaacgucuuaaa

SEQ ID NO: 1882852 - RNA, 13 nt, Human
ugaaauaaacguc

SEQ ID NO: 1882853 - RNA, 14 nt, Human
ugaaauaagccaga

SEQ ID NO: 1882854 - RNA, 20 nt, Human
ugaaauuuuuauuaaauuau

SEQ ID NO: 1882855 - RNA, 21 nt, Human
ugaaauuuccugggagcuuuu

SEQ ID NO: 1882856 - RNA, 19 nt, Human
ugaaauuuuuauuaaauua

SEQ ID NO: 1882857 - RNA, 15 nt, Human
ugaaauuuccuggga

SEQ ID NO: 1882858 - RNA, 16 nt, Human
ugaacaaagcagccac

SEQ ID NO: 1882859 - RNA, 17 nt, Human
ugaacaaagcagccacg

SEQ ID NO: 1882860 - RNA, 14 nt, Human
ugaacaaagcagcc

SEQ ID NO: 1882861 - RNA, 15 nt, Human
ugaacaaagcagcca

SEQ ID NO: 1882862 - RNA, 20 nt, Human
ugaaauuuuugguuauaaau

SEQ ID NO: 1882863 - RNA, 17 nt, Human
ugaaguacucauacaug

SEQ ID NO: 1882864 - RNA, 12 nt, Human
ugaaguaccacc

SEQ ID NO: 1882865 - RNA, 13 nt, Human
ugaagucacacag

SEQ ID NO: 1882866 - RNA, 12 nt, Human
ugaauaauacag

SEQ ID NO: 1882867 - RNA, 23 nt, Human
ugaauaauguaagacaaauaugu

SEQ ID NO: 1882868 - RNA, 13 nt, Human
ugaauaauacagu

SEQ ID NO: 1882869 - RNA, 18 nt, Human
ugaauauuuaguguucau

SEQ ID NO: 1882870 - RNA, 19 nt, Human
ugaauauuuucauuaaaag

SEQ ID NO: 1882871 - RNA, 21 nt, Human
ugaauauuuucauuaaaagcu

SEQ ID NO: 1882872 - RNA, 22 nt, Human
ugaaguaauaugcacacauuuu

SEQ ID NO: 1882873 - RNA, 21 nt, Human
ugaaguaauaugcacacauuu

SEQ ID NO: 1882874 - RNA, 20 nt, Human
ugaaguaauaugcacacauu

SEQ ID NO: 1882875 - RNA, 16 nt, Human
ugaaguaauaugcaca

SEQ ID NO: 1882876 - RNA, 15 nt, Human
ugaaguaauaugcac

SEQ ID NO: 1882877 - RNA, 13 nt, Human
ugaagcaaacaca

SEQ ID NO: 1882878 - RNA, 14 nt, Human
ugaagcaaacacau

SEQ ID NO: 1882879 - RNA, 15 nt, Human
ugaagcaaacacauu

SEQ ID NO: 1882880 - RNA, 18 nt, Human
ugaagguuucugaaaauu

SEQ ID NO: 1882881 - RNA, 17 nt, Human
ugaagggccagagccag

SEQ ID NO: 1882882 - RNA, 15 nt, Human
ugaagggccagagcc

SEQ ID NO: 1882883 - RNA, 16 nt, Human
ugaagggccagagcca

SEQ ID NO: 1882884 - RNA, 12 nt, Human
ugaagggccaga

SEQ ID NO: 1882885 - RNA, 14 nt, Human
ugaagggccagagc

SEQ ID NO: 1882886 - RNA, 16 nt, Human
ugaagggauaugugaa

SEQ ID NO: 1882887 - RNA, 22 nt, Human
agaguaauccaagcaaauguga

SEQ ID NO: 1882888 - RNA, 20 nt, Human
agaguaauccaagcaaaugu

SEQ ID NO: 1882889 - RNA, 18 nt, Human
agaguaauccaagcaaau

SEQ ID NO: 1882890 - RNA, 20 nt, Human
agagguucaaagauauuuug

SEQ ID NO: 1882891 - RNA, 19 nt, Human
agagguucaaagauauuuu

SEQ ID NO: 1882892 - RNA, 16 nt, Human
agagguucaaagauau

SEQ ID NO: 1882893 - RNA, 15 nt, Human
agagggagugacaga

SEQ ID NO: 1882894 - RNA, 15 nt, Human
agagggagguaagga

SEQ ID NO: 1882895 - RNA, 20 nt, Human
agagggagugacagaggcag

SEQ ID NO: 1882896 - RNA, 13 nt, Human
agagguucaaaga

SEQ ID NO: 1882897 - RNA, 22 nt, Human
agaggcugccucucccaucacu

SEQ ID NO: 1882898 - RNA, 16 nt, Human
agaggcugcagccagg

SEQ ID NO: 1882899 - RNA, 19 nt, Human
agaggcugaggcuggcaca

SEQ ID NO: 1882900 - RNA, 21 nt, Human
agaggcugaggcuggcacagg

SEQ ID NO: 1882901 - RNA, 23 nt, Human
agaggcagccccauucugccugc

SEQ ID NO: 1882902 - RNA, 21 nt, Human
agaggcagggucucacucugu

SEQ ID NO: 1882903 - RNA, 22 nt, Human
agaggcagccccauucugccug

SEQ ID NO: 1882904 - RNA, 21 nt, Human
agaggcagccccauucugccu

SEQ ID NO: 1882905 - RNA, 13 nt, Human
agaggcauuuccc

SEQ ID NO: 1882906 - RNA, 14 nt, Human
agaggcauuucccc

SEQ ID NO: 1882907 - RNA, 21 nt, Human
agaggcccucuggaguggcca

SEQ ID NO: 1882908 - RNA, 24 nt, Human
agaggcccucuggaguggccacua

SEQ ID NO: 1882909 - RNA, 22 nt, Human
agaggcccucuggaguggccac

SEQ ID NO: 1882910 - RNA, 23 nt, Human
agaggcccucuggaguggccacu

SEQ ID NO: 1882911 - RNA, 22 nt, Human
agaggccugccuccagggcugg

SEQ ID NO: 1882912 - RNA, 21 nt, Human
agaggccugccuccagggcug

SEQ ID NO: 1882913 - RNA, 20 nt, Human
agaggccugccuccagggcu

SEQ ID NO: 1882914 - RNA, 19 nt, Human
agacucuacccauauuaca

SEQ ID NO: 1882915 - RNA, 21 nt, Human
agacucuaggacauaaauuag

SEQ ID NO: 1882916 - RNA, 13 nt, Human
agacuccugcagg

SEQ ID NO: 1882917 - RNA, 11 nt, Human
agacuccucag

SEQ ID NO: 1882918 - RNA, 23 nt, Human
agacuccugacugucucccggga

SEQ ID NO: 1882919 - RNA, 17 nt, Human
agacucccauuccugaa

SEQ ID NO: 1882920 - RNA, 19 nt, Human
agacucccauuccugaaga

SEQ ID NO: 1882921 - RNA, 23 nt, Human
agacucccauuccugaagaacca

SEQ ID NO: 1882922 - RNA, 17 nt, Human
agacuccucaguucuug

SEQ ID NO: 1882923 - RNA, 13 nt, Human
agacucugucuaa

SEQ ID NO: 1882924 - RNA, 18 nt, Human
agacucugucuaaaaaac

SEQ ID NO: 1882925 - RNA, 20 nt, Human
agacucugucuaaaaaacaa

SEQ ID NO: 1882926 - RNA, 21 nt, Human
agacucugucuaaaaaacaaa

SEQ ID NO: 1882927 - RNA, 15 nt, Human
ucuuuaaugucacag

SEQ ID NO: 1882928 - RNA, 22 nt, Human
agacaggcaagcaccuccugcc

SEQ ID NO: 1882929 - RNA, 20 nt, Human
agacaggcaagcaccuccug

SEQ ID NO: 1882930 - RNA, 19 nt, Human
ucuuuaaugucacaggcag

SEQ ID NO: 1882931 - RNA, 18 nt, Human
ucuuuaaugucacaggca

SEQ ID NO: 1882932 - RNA, 20 nt, Human
ucuuucccugcuuaaugaaa

SEQ ID NO: 1882933 - RNA, 13 nt, Human
ucuuuaaugcuuu

SEQ ID NO: 1882934 - RNA, 16 nt, Human
ucuuuaaugcuuuuau

SEQ ID NO: 1882935 - RNA, 11 nt, Human
ucuuuaaugcu

SEQ ID NO: 1882936 - RNA, 12 nt, Human
ucuuuccugagg

SEQ ID NO: 1882937 - RNA, 15 nt, Human
ucuuuccuccuucca

SEQ ID NO: 1882938 - RNA, 22 nt, Human
ucuuuccuagauggcagucacu

SEQ ID NO: 1882939 - RNA, 14 nt, Human
ucuuuccuccuucc

SEQ ID NO: 1882940 - RNA, 12 nt, Human
ucuuuccuccuu

SEQ ID NO: 1882941 - RNA, 23 nt, Human
ucuuuccuaaggcugcaagguuu

SEQ ID NO: 1882942 - RNA, 19 nt, Human
ucuuuccuagauggcaguc

SEQ ID NO: 1882943 - RNA, 17 nt, Human
ucuuuccuaaggcugca

SEQ ID NO: 1882944 - RNA, 16 nt, Human
agacuccaccaagccu

SEQ ID NO: 1882945 - RNA, 12 nt, Human
agacuccaccaa

SEQ ID NO: 1882946 - RNA, 17 nt, Human
ucuuuuuuuggcccagg

SEQ ID NO: 1882947 - RNA, 15 nt, Human
ucuuuuuuucuuugg

SEQ ID NO: 1882948 - RNA, 21 nt, Human
ucuuuuuucuaaaguaaaaac

SEQ ID NO: 1882949 - RNA, 22 nt, Human
ucuuuuuucuaaaguaaaaaca

SEQ ID NO: 1882950 - RNA, 14 nt, Human
ucuuuguggcuucc

SEQ ID NO: 1882951 - RNA, 16 nt, Human
ucuuugugaaggccuc

SEQ ID NO: 1882952 - RNA, 11 nt, Human
ucuuugugaag

SEQ ID NO: 1882953 - RNA, 16 nt, Human
ucuuugugcuuuggcu

SEQ ID NO: 1882954 - RNA, 13 nt, Human
ucuuuguggccaa

SEQ ID NO: 1882955 - RNA, 14 nt, Human
ucuuuguggccaag

SEQ ID NO: 1882956 - RNA, 22 nt, Human
ucuuuguggccaaggagcugcu

SEQ ID NO: 1882957 - RNA, 23 nt, Human
ucuuuguggccaaggagcugcua

SEQ ID NO: 1882958 - RNA, 16 nt, Human
ucuuuguaaugaaaac

SEQ ID NO: 1882959 - RNA, 14 nt, Human
ucuuuguacagaca

SEQ ID NO: 1882960 - RNA, 15 nt, Human
ucuuuguacagacaa

SEQ ID NO: 1882961 - RNA, 20 nt, Human
ucuuuguacagacaacaaac

SEQ ID NO: 1882962 - RNA, 15 nt, Human
agagacagaaagcag

SEQ ID NO: 1882963 - RNA, 14 nt, Human
agagacagaaagca

SEQ ID NO: 1882964 - RNA, 20 nt, Human
agacugguuccauggccucu

SEQ ID NO: 1882965 - RNA, 14 nt, Human
agacuguacaaagu

SEQ ID NO: 1882966 - RNA, 17 nt, Human
agacuuuggaaagacuu

SEQ ID NO: 1882967 - RNA, 15 nt, Human
agacuuuggaaagag

SEQ ID NO: 1882968 - RNA, 15 nt, Human
agacuuuuaugauac

SEQ ID NO: 1882969 - RNA, 15 nt, Human
agacuuuuccaaccc

SEQ ID NO: 1882970 - RNA, 12 nt, Human
agacuuuuauga

SEQ ID NO: 1882971 - RNA, 19 nt, Human
agacuuuggaaagaguagg

SEQ ID NO: 1882972 - RNA, 19 nt, Human
agacuuuucuuucagccaa

SEQ ID NO: 1882973 - RNA, 16 nt, Human
agagacacaagccuuc

SEQ ID NO: 1882974 - RNA, 19 nt, Human
agagacacaagccuucggc

SEQ ID NO: 1882975 - RNA, 13 nt, Human
ugaaagaaaauaa

SEQ ID NO: 1882976 - RNA, 18 nt, Human
ugaaacuggauuaaacuu

SEQ ID NO: 1882977 - RNA, 17 nt, Human
ugaaacuggauuaaacu

SEQ ID NO: 1882978 - RNA, 14 nt, Human
ugaaaauuaacaug

SEQ ID NO: 1882979 - RNA, 18 nt, Human
ugaaaauuaacacugcuu

SEQ ID NO: 1882980 - RNA, 16 nt, Human
ugaaaauuaacacugc

SEQ ID NO: 1882981 - RNA, 15 nt, Human
ugaaaauuaacacug

SEQ ID NO: 1882982 - RNA, 14 nt, Human
ugaaaauuaacacu

SEQ ID NO: 1882983 - RNA, 18 nt, Human
ugaaaaugcaacaacaug

SEQ ID NO: 1882984 - RNA, 21 nt, Human
ugaaaaugcaacaacauguau

SEQ ID NO: 1882985 - RNA, 20 nt, Human
ugaaaaugcaacaacaugua

SEQ ID NO: 1882986 - RNA, 23 nt, Human
ugaaaaugcaacaacauguauaa

SEQ ID NO: 1882987 - RNA, 23 nt, Human
ucuuuuuuuuuuuuuaaagacag

SEQ ID NO: 1882988 - RNA, 13 nt, Human
ugaaaacacauuu

SEQ ID NO: 1882989 - RNA, 12 nt, Human
ugaaaacacauu

SEQ ID NO: 1882990 - RNA, 14 nt, Human
ugaaaacacauuuu

SEQ ID NO: 1882991 - RNA, 20 nt, Human
ugaaaacacauuuuucuuag

SEQ ID NO: 1882992 - RNA, 19 nt, Human
ugaaaacacauuuuucuua

SEQ ID NO: 1882993 - RNA, 17 nt, Human
ugaaaacacauuuuucu

SEQ ID NO: 1882994 - RNA, 15 nt, Human
ugaaaacacauuuuu

SEQ ID NO: 1882995 - RNA, 16 nt, Human
ugaaaauaagaauaga

SEQ ID NO: 1882996 - RNA, 15 nt, Human
agagacuccugcagg

SEQ ID NO: 1882997 - RNA, 12 nt, Human
agagacuccugc

SEQ ID NO: 1882998 - RNA, 13 nt, Human
agagacuccugca

SEQ ID NO: 1882999 - RNA, 14 nt, Human
agagacuccugcag

SEQ ID NO: 1883000 - RNA, 18 nt, Human
agagauccaaaagaagcc

SEQ ID NO: 1883001 - RNA, 22 nt, Human
agagaccaucccugaaggcccc

SEQ ID NO: 1883002 - RNA, 23 nt, Human
agagaccaucccugaaggccccg

SEQ ID NO: 1883003 - RNA, 19 nt, Human
agagaccaucccugaaggc

SEQ ID NO: 1883004 - RNA, 21 nt, Human
agagaccaucccugaaggccc

SEQ ID NO: 1883005 - RNA, 18 nt, Human
ugaaagaggaaugaagua

SEQ ID NO: 1883006 - RNA, 18 nt, Human
agagaccaucccugaagg

SEQ ID NO: 1883007 - RNA, 18 nt, Human
ugaaagacuguacaaagu

SEQ ID NO: 1883008 - RNA, 19 nt, Human
ugaaagacuguacaaagua

SEQ ID NO: 1883009 - RNA, 22 nt, Human
ugaaagacuguacaaaguagaa

SEQ ID NO: 1883010 - RNA, 17 nt, Human
ugaaagaggaaugaagu

SEQ ID NO: 1883011 - RNA, 16 nt, Human
ugaaagacuguacaaa

SEQ ID NO: 1883012 - RNA, 22 nt, Human
ugaaagaaaauaccaaggaaca

SEQ ID NO: 1883013 - RNA, 24 nt, Human
uguccuguaguugcguggacucug

SEQ ID NO: 1883014 - RNA, 12 nt, Human
uguccuuagaac

SEQ ID NO: 1883015 - RNA, 18 nt, Human
uguccuuagaacauuuua

SEQ ID NO: 1883016 - RNA, 12 nt, Human
ugucccuuuucc

SEQ ID NO: 1883017 - RNA, 14 nt, Human
ugucccugcacuug

SEQ ID NO: 1883018 - RNA, 14 nt, Human
ugucccucugcccc

SEQ ID NO: 1883019 - RNA, 15 nt, Human
ugucccucugcccca

SEQ ID NO: 1883020 - RNA, 16 nt, Human
ugucccucugccccau

SEQ ID NO: 1883021 - RNA, 21 nt, Human
ugucccuaguaaaaauacaaa

SEQ ID NO: 1883022 - RNA, 17 nt, Human
uguccagcugagcgcca

SEQ ID NO: 1883023 - RNA, 21 nt, Human
uguccagcugagcgccaggau

SEQ ID NO: 1883024 - RNA, 11 nt, Human
uguccagcucc

SEQ ID NO: 1883025 - RNA, 12 nt, Human
uguccagcucca

SEQ ID NO: 1883026 - RNA, 16 nt, Human
uguccagcuccaaccu

SEQ ID NO: 1883027 - RNA, 20 nt, Human
uguccagcuccaaccugcaa

SEQ ID NO: 1883028 - RNA, 23 nt, Human
uguccagcuccaaccugcaaaga

SEQ ID NO: 1883029 - RNA, 16 nt, Human
ugucagccauuccugu

SEQ ID NO: 1883030 - RNA, 20 nt, Human
agucccaccuuggcugcagg

SEQ ID NO: 1883031 - RNA, 23 nt, Human
agucccaccuuggcugcagggag

SEQ ID NO: 1883032 - RNA, 21 nt, Human
agucccaccuuggcugcaggg

SEQ ID NO: 1883033 - RNA, 21 nt, Human
aguccauauuucaauuuccaa

SEQ ID NO: 1883034 - RNA, 14 nt, Human
aguccccuguuugu

SEQ ID NO: 1883035 - RNA, 19 nt, Human
aguccccuguuuguuucug

SEQ ID NO: 1883036 - RNA, 13 nt, Human
aguccccagagaa

SEQ ID NO: 1883037 - RNA, 23 nt, Human
aguccauauuucaauuuccaaga

SEQ ID NO: 1883038 - RNA, 19 nt, Human
agucagggguucccuuuuu

SEQ ID NO: 1883039 - RNA, 21 nt, Human
agucagucauucagauaugau

SEQ ID NO: 1883040 - RNA, 15 nt, Human
agucagucauucaga

SEQ ID NO: 1883041 - RNA, 15 nt, Human
agucaucauucccuu

SEQ ID NO: 1883042 - RNA, 23 nt, Human
agucacauggccuaugcacauau

SEQ ID NO: 1883043 - RNA, 21 nt, Human
agucacagaacaaauguuugu

SEQ ID NO: 1883044 - RNA, 13 nt, Human
agucacagccacc

SEQ ID NO: 1883045 - RNA, 20 nt, Human
agucacauuccaagccucau

SEQ ID NO: 1883046 - RNA, 15 nt, Human
agucacugagacagc

SEQ ID NO: 1883047 - RNA, 16 nt, Human
agucacugagacagcc

SEQ ID NO: 1883048 - RNA, 17 nt, Human
agucacugagacagccc

SEQ ID NO: 1883049 - RNA, 15 nt, Human
ugucagcauagaagu

SEQ ID NO: 1883050 - RNA, 21 nt, Human
aguauuuaauucauguugccu

SEQ ID NO: 1883051 - RNA, 21 nt, Human
aguagcugggacuacaggcac

SEQ ID NO: 1883052 - RNA, 19 nt, Human
aguagcugggacuacaggc

SEQ ID NO: 1883053 - RNA, 22 nt, Human
aguagcugggacuacaggcacc

SEQ ID NO: 1883054 - RNA, 17 nt, Human
aguagcuggauuacagg

SEQ ID NO: 1883055 - RNA, 14 nt, Human
aguauuauaccuuu

SEQ ID NO: 1883056 - RNA, 15 nt, Human
aguauuauaccuuuu

SEQ ID NO: 1883057 - RNA, 15 nt, Human
uguagagccaggguc

SEQ ID NO: 1883058 - RNA, 12 nt, Human
uguagagccagg

SEQ ID NO: 1883059 - RNA, 14 nt, Human
agguuugaguagag

SEQ ID NO: 1883060 - RNA, 23 nt, Human
agguuuggacaaaauggaauacu

SEQ ID NO: 1883061 - RNA, 22 nt, Human
uguauccauccauggggcugau

SEQ ID NO: 1883062 - RNA, 21 nt, Human
agguuugggaccccugguggu

SEQ ID NO: 1883063 - RNA, 17 nt, Human
agguuugguccagccug

SEQ ID NO: 1883064 - RNA, 16 nt, Human
agguuugggaccccug

SEQ ID NO: 1883065 - RNA, 16 nt, Human
uguaucccaugagccu

SEQ ID NO: 1883066 - RNA, 15 nt, Human
uguaucccaugagcc

SEQ ID NO: 1883067 - RNA, 14 nt, Human
uguauguguaagua

SEQ ID NO: 1883068 - RNA, 22 nt, Human
uguaugugggggucuguguguu

SEQ ID NO: 1883069 - RNA, 21 nt, Human
uguaugugggggucugugugu

SEQ ID NO: 1883070 - RNA, 21 nt, Human
uguauuaaguuguuaauaaaa

SEQ ID NO: 1883071 - RNA, 11 nt, Human
uguauuaugug

SEQ ID NO: 1883072 - RNA, 14 nt, Human
ugucaaagugguga

SEQ ID NO: 1883073 - RNA, 15 nt, Human
ugucaaaguggugag

SEQ ID NO: 1883074 - RNA, 16 nt, Human
ugucaaaguggugaga

SEQ ID NO: 1883075 - RNA, 19 nt, Human
ugucaaaguggugagaggc

SEQ ID NO: 1883076 - RNA, 17 nt, Human
ugucaacaugaacaaau

SEQ ID NO: 1883077 - RNA, 14 nt, Human
aguagcugggacua

SEQ ID NO: 1883078 - RNA, 13 nt, Human
aguagcugggacu

SEQ ID NO: 1883079 - RNA, 15 nt, Human
ugucuuggacacugu

SEQ ID NO: 1883080 - RNA, 13 nt, Human
ugucuuggacacu

SEQ ID NO: 1883081 - RNA, 18 nt, Human
ugucuuguguuucuuuag

SEQ ID NO: 1883082 - RNA, 17 nt, Human
ugucuuuaaaugcugcu

SEQ ID NO: 1883083 - RNA, 15 nt, Human
ugugaaccaccacac

SEQ ID NO: 1883084 - RNA, 22 nt, Human
ugugaacaguuguguuugaagc

SEQ ID NO: 1883085 - RNA, 23 nt, Human
ugugaaccaccacacccagccca

SEQ ID NO: 1883086 - RNA, 22 nt, Human
ugugaaccaccacacccagccc

SEQ ID NO: 1883087 - RNA, 17 nt, Human
ugugaaccaccacaccc

SEQ ID NO: 1883088 - RNA, 16 nt, Human
ugugaaccaccacacc

SEQ ID NO: 1883089 - RNA, 21 nt, Human
ugugaacgauuuagaaagaag

SEQ ID NO: 1883090 - RNA, 21 nt, Human
ugucuuuccacuccuccuagc

SEQ ID NO: 1883091 - RNA, 17 nt, Human
ugucuucucccugcaca

SEQ ID NO: 1883092 - RNA, 15 nt, Human
ugucuucauagcaga

SEQ ID NO: 1883093 - RNA, 21 nt, Human
ugucuugcaauggcagccuug

SEQ ID NO: 1883094 - RNA, 20 nt, Human
ugucuugcaauggcagccuu

SEQ ID NO: 1883095 - RNA, 18 nt, Human
ugucuugcaauggcagcc

SEQ ID NO: 1883096 - RNA, 17 nt, Human
ugucuugcaauggcagc

SEQ ID NO: 1883097 - RNA, 15 nt, Human
ugucuugcaauggca

SEQ ID NO: 1883098 - RNA, 23 nt, Human
aguccccuguuuguuucugaaag

SEQ ID NO: 1883099 - RNA, 13 nt, Human
agucccugccaau

SEQ ID NO: 1883100 - RNA, 14 nt, Human
agucccugccaaug

SEQ ID NO: 1883101 - RNA, 16 nt, Human
agucccugccaaugga

SEQ ID NO: 1883102 - RNA, 21 nt, Human
ugucuccuggcgguuccucgu

SEQ ID NO: 1883103 - RNA, 11 nt, Human
ugucuccuggc

SEQ ID NO: 1883104 - RNA, 22 nt, Human
ugucucuggauuauauuaugaa

SEQ ID NO: 1883105 - RNA, 13 nt, Human
ugucucugagagu

SEQ ID NO: 1883106 - RNA, 20 nt, Human
ugucucgugguaggacugua

SEQ ID NO: 1883107 - RNA, 19 nt, Human
ugucucgugguaggacugu

SEQ ID NO: 1883108 - RNA, 18 nt, Human
ugucucgugguaggacug

SEQ ID NO: 1883109 - RNA, 21 nt, Human
ugucucgugguaggacuguag

SEQ ID NO: 1883110 - RNA, 17 nt, Human
ugucucuacuaaaaaua

SEQ ID NO: 1883111 - RNA, 21 nt, Human
ugucucuuuaaugucacaggc

SEQ ID NO: 1883112 - RNA, 22 nt, Human
ugucucuugguccugcugcagu

SEQ ID NO: 1883113 - RNA, 22 nt, Human
ugucucuuuaaugucacaggca

SEQ ID NO: 1883114 - RNA, 13 nt, Human
ugucucuuucaug

SEQ ID NO: 1883115 - RNA, 18 nt, Human
ugucucuugguccugcug

SEQ ID NO: 1883116 - RNA, 19 nt, Human
ugucucuugguccugcugc

SEQ ID NO: 1883117 - RNA, 20 nt, Human
ugucucuugguccugcugca

SEQ ID NO: 1883118 - RNA, 21 nt, Human
ugucucuugguccugcugcag

SEQ ID NO: 1883119 - RNA, 23 nt, Human
ugucucugggcuuggggcuuccu

SEQ ID NO: 1883120 - RNA, 13 nt, Human
ugucucugugaga

SEQ ID NO: 1883121 - RNA, 15 nt, Human
agugagccacuccgg

SEQ ID NO: 1883122 - RNA, 16 nt, Human
agugagccgagauugu

SEQ ID NO: 1883123 - RNA, 15 nt, Human
ugugauggggcccug

SEQ ID NO: 1883124 - RNA, 16 nt, Human
ugugauggggcccugc

SEQ ID NO: 1883125 - RNA, 14 nt, Human
agugagagcugggu

SEQ ID NO: 1883126 - RNA, 17 nt, Human
ugugauggggcccugcc

SEQ ID NO: 1883127 - RNA, 18 nt, Human
ugugauggggcccugccu

SEQ ID NO: 1883128 - RNA, 15 nt, Human
ugugaugugaagcca

SEQ ID NO: 1883129 - RNA, 11 nt, Human
ugugauguguc

SEQ ID NO: 1883130 - RNA, 11 nt, Human
ugugauuuuuu

SEQ ID NO: 1883131 - RNA, 17 nt, Human
agugaaagaaaauaaca

SEQ ID NO: 1883132 - RNA, 14 nt, Human
agugagacagcucu

SEQ ID NO: 1883133 - RNA, 17 nt, Human
agucuuuuguucgcaug

SEQ ID NO: 1883134 - RNA, 13 nt, Human
agugagacucugu

SEQ ID NO: 1883135 - RNA, 21 nt, Human
agugagacccugucucaaaaa

SEQ ID NO: 1883136 - RNA, 17 nt, Human
agugagacccugucuca

SEQ ID NO: 1883137 - RNA, 14 nt, Human
agugaaagcaucac

SEQ ID NO: 1883138 - RNA, 17 nt, Human
agugagacucugucuca

SEQ ID NO: 1883139 - RNA, 16 nt, Human
agugagacucugucuc

SEQ ID NO: 1883140 - RNA, 22 nt, Human
agugagacucugucucaaaaaa

SEQ ID NO: 1883141 - RNA, 19 nt, Human
agucuccaaagucucugga

SEQ ID NO: 1883142 - RNA, 14 nt, Human
ugugagcccagcug

SEQ ID NO: 1883143 - RNA, 15 nt, Human
ugugagcccagcugg

SEQ ID NO: 1883144 - RNA, 14 nt, Human
agucuccaccagga

SEQ ID NO: 1883145 - RNA, 15 nt, Human
agucuccaccaggaa

SEQ ID NO: 1883146 - RNA, 16 nt, Human
agucuccaccaggaac

SEQ ID NO: 1883147 - RNA, 22 nt, Human
ugugagaugcuagaacucccuu

SEQ ID NO: 1883148 - RNA, 10 nt, Human
ugugaagcca

SEQ ID NO: 1883149 - RNA, 20 nt, Human
ugugaagccaauucagacag

SEQ ID NO: 1883150 - RNA, 21 nt, Human
ugugaagccaauucagacagg

SEQ ID NO: 1883151 - RNA, 19 nt, Human
ugugagcacaaagguagcu

SEQ ID NO: 1883152 - RNA, 22 nt, Human
ugugaagcacagaccccuucca

SEQ ID NO: 1883153 - RNA, 13 nt, Human
agucuuuuccaug

SEQ ID NO: 1883154 - RNA, 15 nt, Human
agucuuuuccaugaa

SEQ ID NO: 1883155 - RNA, 22 nt, Human
agucuuuuguucgcauggucac

SEQ ID NO: 1883156 - RNA, 11 nt, Human
agugaaaaagg

SEQ ID NO: 1883157 - RNA, 17 nt, Human
agugaaaaaggaggaag

SEQ ID NO: 1883158 - RNA, 20 nt, Human
agugaaaaaggaggaagaga

SEQ ID NO: 1883159 - RNA, 23 nt, Human
agugaaaaaggaggaagagaaaa

SEQ ID NO: 1883160 - RNA, 16 nt, Human
agucuguuuuguaaag

SEQ ID NO: 1883161 - RNA, 15 nt, Human
agucuguuuuguaaa

SEQ ID NO: 1883162 - RNA, 22 nt, Human
uguacauuagucauucaauaaa

SEQ ID NO: 1883163 - RNA, 14 nt, Human
uguacauuaauuac

SEQ ID NO: 1883164 - RNA, 21 nt, Human
uguacauguguagccugugca

SEQ ID NO: 1883165 - RNA, 20 nt, Human
uguacauguguagccugugc

SEQ ID NO: 1883166 - RNA, 17 nt, Human
uguacauguguagccug

SEQ ID NO: 1883167 - RNA, 20 nt, Human
uguacaugaaaacacauuuu

SEQ ID NO: 1883168 - RNA, 19 nt, Human
uguacaugaaaacacauuu

SEQ ID NO: 1883169 - RNA, 18 nt, Human
uguacaugaaaacacauu

SEQ ID NO: 1883170 - RNA, 17 nt, Human
uguacaugaaaacacau

SEQ ID NO: 1883171 - RNA, 19 nt, Human
uguacuugcucuugaugcc

SEQ ID NO: 1883172 - RNA, 15 nt, Human
uguacuugcucuuga

SEQ ID NO: 1883173 - RNA, 21 nt, Human
uguagaagucacauuccugaa

SEQ ID NO: 1883174 - RNA, 15 nt, Human
uguagaagcauggug

SEQ ID NO: 1883175 - RNA, 15 nt, Human
uguaaggcaaucaug

SEQ ID NO: 1883176 - RNA, 16 nt, Human
uguaauuugugauaca

SEQ ID NO: 1883177 - RNA, 18 nt, Human
uguaaggaaugauuaauu

SEQ ID NO: 1883178 - RNA, 21 nt, Human
uguaauuugugauacaaugcu

SEQ ID NO: 1883179 - RNA, 17 nt, Human
uguaauuugugauacaa

SEQ ID NO: 1883180 - RNA, 16 nt, Human
uguaauuuuauaugaa

SEQ ID NO: 1883181 - RNA, 19 nt, Human
uguacaaaguagaagucuu

SEQ ID NO: 1883182 - RNA, 23 nt, Human
uguacaaaguagaagucuuagau

SEQ ID NO: 1883183 - RNA, 14 nt, Human
uguacaucuauuuu

SEQ ID NO: 1883184 - RNA, 20 nt, Human
aggugugagucaccaagccc

SEQ ID NO: 1883185 - RNA, 14 nt, Human
aggugugagucacc

SEQ ID NO: 1883186 - RNA, 20 nt, Human
aggugugacugaauuucuuu

SEQ ID NO: 1883187 - RNA, 22 nt, Human
aggugugaaccaccacacccag

SEQ ID NO: 1883188 - RNA, 23 nt, Human
aggugugaaccaccacacccagc

SEQ ID NO: 1883189 - RNA, 18 nt, Human
aggugugacugaauuucu

SEQ ID NO: 1883190 - RNA, 13 nt, Human
agguggggcagcu

SEQ ID NO: 1883191 - RNA, 22 nt, Human
aggugcaacaagguccucuguc

SEQ ID NO: 1883192 - RNA, 14 nt, Human
agguggggcagcuu

SEQ ID NO: 1883193 - RNA, 23 nt, Human
agguggggucacucuggcagcuc

SEQ ID NO: 1883194 - RNA, 16 nt, Human
agguggggcagcuuga

SEQ ID NO: 1883195 - RNA, 15 nt, Human
agguguuacuguaau

SEQ ID NO: 1883196 - RNA, 16 nt, Human
agguguuacuguaauu

SEQ ID NO: 1883197 - RNA, 15 nt, Human
agguguugucccuuc

SEQ ID NO: 1883198 - RNA, 16 nt, Human
agguguugucccuucu

SEQ ID NO: 1883199 - RNA, 13 nt, Human
uguaaggaaugau

SEQ ID NO: 1883200 - RNA, 18 nt, Human
uguaagaacuacaaacaa

SEQ ID NO: 1883201 - RNA, 14 nt, Human
uguaaggaaugauu

SEQ ID NO: 1883202 - RNA, 15 nt, Human
uguaaggaaugauua

SEQ ID NO: 1883203 - RNA, 22 nt, Human
uguaagcucuacugaggugcua

SEQ ID NO: 1883204 - RNA, 15 nt, Human
ugguuuucuguucuu

SEQ ID NO: 1883205 - RNA, 13 nt, Human
ugguuuucuguuc

SEQ ID NO: 1883206 - RNA, 23 nt, Human
aggugauccacccaccucagccu

SEQ ID NO: 1883207 - RNA, 21 nt, Human
aggugauccacccaccucagc

SEQ ID NO: 1883208 - RNA, 18 nt, Human
ugguuuuaguugcaacuu

SEQ ID NO: 1883209 - RNA, 12 nt, Human
ugguuuucuguu

SEQ ID NO: 1883210 - RNA, 13 nt, Human
ugguuuuccugua

SEQ ID NO: 1883211 - RNA, 21 nt, Human
ugguuuguaaauuaacuuuua

SEQ ID NO: 1883212 - RNA, 17 nt, Human
ugguuugcaaggaagcc

SEQ ID NO: 1883213 - RNA, 15 nt, Human
ugguuugcaaggaag

SEQ ID NO: 1883214 - RNA, 20 nt, Human
ugguuuuaacaacugugcuu

SEQ ID NO: 1883215 - RNA, 15 nt, Human
ugguuucagaaaugu

SEQ ID NO: 1883216 - RNA, 14 nt, Human
ugguuucagaaaug

SEQ ID NO: 1883217 - RNA, 18 nt, Human
ugguuuaacuucugccug

SEQ ID NO: 1883218 - RNA, 15 nt, Human
ugguuucgaacuccu

SEQ ID NO: 1883219 - RNA, 15 nt, Human
ugguguuuccuggca

SEQ ID NO: 1883220 - RNA, 17 nt, Human
ugguguuuccuggcacu

SEQ ID NO: 1883221 - RNA, 13 nt, Human
ugguuaaugccau

SEQ ID NO: 1883222 - RNA, 16 nt, Human
ugguuaagcuuugaca

SEQ ID NO: 1883223 - RNA, 17 nt, Human
ugguucacucuuggagc

SEQ ID NO: 1883224 - RNA, 23 nt, Human
ugguucaggguuggccccugccc

SEQ ID NO: 1883225 - RNA, 15 nt, Human
ugguuuaauuuaaag

SEQ ID NO: 1883226 - RNA, 22 nt, Human
ugguucaggguuggccccugcc

SEQ ID NO: 1883227 - RNA, 20 nt, Human
ugguucaggguuggccccug

SEQ ID NO: 1883228 - RNA, 22 nt, Human
ugguucacucuuggagccugca

SEQ ID NO: 1883229 - RNA, 21 nt, Human
ugguucacucuuggagccugc

SEQ ID NO: 1883230 - RNA, 20 nt, Human
ugguucacucuuggagccug

SEQ ID NO: 1883231 - RNA, 12 nt, Human
ugguggcagcug

SEQ ID NO: 1883232 - RNA, 22 nt, Human
ugguguucaaaaaacuuguaaa

SEQ ID NO: 1883233 - RNA, 21 nt, Human
ugguguucaaaaaacuuguaa

SEQ ID NO: 1883234 - RNA, 15 nt, Human
ugguggcagagugga

SEQ ID NO: 1883235 - RNA, 12 nt, Human
ugguggcagcuc

SEQ ID NO: 1883236 - RNA, 16 nt, Human
ugguggcagcucaccu

SEQ ID NO: 1883237 - RNA, 19 nt, Human
ugguggcagcucaccucuc

SEQ ID NO: 1883238 - RNA, 20 nt, Human
ugguggcagcucaccucucc

SEQ ID NO: 1883239 - RNA, 23 nt, Human
ugguggcagcucaccucucccuu

SEQ ID NO: 1883240 - RNA, 22 nt, Human
ugguccaugggccauaugaaaa

SEQ ID NO: 1883241 - RNA, 19 nt, Human
ugguccauagagagcaaga

SEQ ID NO: 1883242 - RNA, 13 nt, Human
uggucccacccca

SEQ ID NO: 1883243 - RNA, 12 nt, Human
uggucuguguga

SEQ ID NO: 1883244 - RNA, 22 nt, Human
uggucugugagaugcuagaacu

SEQ ID NO: 1883245 - RNA, 16 nt, Human
uggucuuauuuguaaa

SEQ ID NO: 1883246 - RNA, 18 nt, Human
uggucugacccacugcuu

SEQ ID NO: 1883247 - RNA, 16 nt, Human
uggucugggacucucu

SEQ ID NO: 1883248 - RNA, 20 nt, Human
uggugaacauugcaauagaa

SEQ ID NO: 1883249 - RNA, 15 nt, Human
uggugaacauugcaa

SEQ ID NO: 1883250 - RNA, 19 nt, Human
uggugaacagaacaaaagg

SEQ ID NO: 1883251 - RNA, 21 nt, Human
aggguggugaccucugccuga

SEQ ID NO: 1883252 - RNA, 19 nt, Human
aggguggugaccucugccu

SEQ ID NO: 1883253 - RNA, 18 nt, Human
aggguggugaccucugcc

SEQ ID NO: 1883254 - RNA, 17 nt, Human
aggguggugaccucugc

SEQ ID NO: 1883255 - RNA, 15 nt, Human
aggguugggcuggug

SEQ ID NO: 1883256 - RNA, 17 nt, Human
aggguuggccccugccc

SEQ ID NO: 1883257 - RNA, 14 nt, Human
aggguuggccccug

SEQ ID NO: 1883258 - RNA, 13 nt, Human
aggguuggccccu

SEQ ID NO: 1883259 - RNA, 14 nt, Human
uggugaaaccuccu

SEQ ID NO: 1883260 - RNA, 18 nt, Human
aggguuauugcauuugga

SEQ ID NO: 1883261 - RNA, 15 nt, Human
aggucagugcaaaua

SEQ ID NO: 1883262 - RNA, 21 nt, Human
aggucaaggcugcagugagcc

SEQ ID NO: 1883263 - RNA, 23 nt, Human
aggucauuuuuuuuaagaaaaag

SEQ ID NO: 1883264 - RNA, 22 nt, Human
aggucauuuuuuuuaagaaaaa

SEQ ID NO: 1883265 - RNA, 15 nt, Human
aggucaggaguucga

SEQ ID NO: 1883266 - RNA, 22 nt, Human
aggucauacuaucuacucuccu

SEQ ID NO: 1883267 - RNA, 21 nt, Human
aggucuugaacuccuggccuc

SEQ ID NO: 1883268 - RNA, 20 nt, Human
aggucuugaacuccuggccu

SEQ ID NO: 1883269 - RNA, 22 nt, Human
aggucuugaacuccuggccuca

SEQ ID NO: 1883270 - RNA, 17 nt, Human
agguaugcaaucaaauc

SEQ ID NO: 1883271 - RNA, 20 nt, Human
agguaugaccuucuaggaag

SEQ ID NO: 1883272 - RNA, 23 nt, Human
agguaugaccuucuaggaagcuc

SEQ ID NO: 1883273 - RNA, 22 nt, Human
agguaugaccuucuaggaagcu

SEQ ID NO: 1883274 - RNA, 23 nt, Human
agguagcuuugagguggaagagg

SEQ ID NO: 1883275 - RNA, 20 nt, Human
aggguuuauguuuaggaugu

SEQ ID NO: 1883276 - RNA, 17 nt, Human
aggguugggcugguguc

SEQ ID NO: 1883277 - RNA, 14 nt, Human
aggguuggagcagu

SEQ ID NO: 1883278 - RNA, 20 nt, Human
agguagaccugucuccuggc

SEQ ID NO: 1883279 - RNA, 22 nt, Human
agguagaauuaucuaauuuaua

SEQ ID NO: 1883280 - RNA, 14 nt, Human
ugggaaucaagauu

SEQ ID NO: 1883281 - RNA, 15 nt, Human
ugggaauaccugugg

SEQ ID NO: 1883282 - RNA, 23 nt, Human
ugggaauaagugccaggauggaa

SEQ ID NO: 1883283 - RNA, 22 nt, Human
aggggacccccgcccccugccc

SEQ ID NO: 1883284 - RNA, 15 nt, Human
aggggacccccgccc

SEQ ID NO: 1883285 - RNA, 18 nt, Human
aggggacccccgcccccu

SEQ ID NO: 1883286 - RNA, 19 nt, Human
aggggacccccgcccccug

SEQ ID NO: 1883287 - RNA, 14 nt, Human
aggggacccccgcc

SEQ ID NO: 1883288 - RNA, 16 nt, Human
aggggauagagagaga

SEQ ID NO: 1883289 - RNA, 16 nt, Human
aggggaguugugucug

SEQ ID NO: 1883290 - RNA, 19 nt, Human
aggggagggucagccaggg

SEQ ID NO: 1883291 - RNA, 18 nt, Human
aggggagggucagccagg

SEQ ID NO: 1883292 - RNA, 15 nt, Human
aggggaggccuucca

SEQ ID NO: 1883293 - RNA, 13 nt, Human
agggggcugggac

SEQ ID NO: 1883294 - RNA, 19 nt, Human
aggggucgacuucgggcug

SEQ ID NO: 1883295 - RNA, 21 nt, Human
aggggucgacuucgggcuggc

SEQ ID NO: 1883296 - RNA, 14 nt, Human
aggggggaagauca

SEQ ID NO: 1883297 - RNA, 17 nt, Human
aggggggaagaucaggu

SEQ ID NO: 1883298 - RNA, 16 nt, Human
aggguaucaggugcug

SEQ ID NO: 1883299 - RNA, 18 nt, Human
aggguaucaggugcugcc

SEQ ID NO: 1883300 - RNA, 22 nt, Human
agggucuugguuccagccugcc

SEQ ID NO: 1883301 - RNA, 19 nt, Human
aggguacuaaggaaucuuu

SEQ ID NO: 1883302 - RNA, 13 nt, Human
ugguccacagggc

SEQ ID NO: 1883303 - RNA, 14 nt, Human
ugguccacagggca

SEQ ID NO: 1883304 - RNA, 15 nt, Human
ugguccacagggcac

SEQ ID NO: 1883305 - RNA, 21 nt, Human
ugguccacagggcaccugcca

SEQ ID NO: 1883306 - RNA, 15 nt, Human
ugguccauagagagc

SEQ ID NO: 1883307 - RNA, 16 nt, Human
ugguccauagagagca

SEQ ID NO: 1883308 - RNA, 14 nt, Human
ugguccagccuggu

SEQ ID NO: 1883309 - RNA, 17 nt, Human
ugguaauucuuauucuu

SEQ ID NO: 1883310 - RNA, 19 nt, Human
ugguaaacgcugucccuag

SEQ ID NO: 1883311 - RNA, 23 nt, Human
uggucaccaaaucagcugcuacu

SEQ ID NO: 1883312 - RNA, 21 nt, Human
uggucaccaaaucagcugcua

SEQ ID NO: 1883313 - RNA, 14 nt, Human
ugggugaaggcugg

SEQ ID NO: 1883314 - RNA, 15 nt, Human
ugggugaaggcuggc

SEQ ID NO: 1883315 - RNA, 16 nt, Human
ugggugaaggcuggca

SEQ ID NO: 1883316 - RNA, 14 nt, Human
uggguggaugccug

SEQ ID NO: 1883317 - RNA, 23 nt, Human
uggguggaugccugguggcagcu

SEQ ID NO: 1883318 - RNA, 20 nt, Human
agggugcaguaucaugcccu

SEQ ID NO: 1883319 - RNA, 15 nt, Human
ugggucugugugugu

SEQ ID NO: 1883320 - RNA, 13 nt, Human
ugggucugugugu

SEQ ID NO: 1883321 - RNA, 21 nt, Human
auaaguuucugggaccucagu

SEQ ID NO: 1883322 - RNA, 21 nt, Human
auaauacaccacuacauucug

SEQ ID NO: 1883323 - RNA, 23 nt, Human
auaauacaccacuacauucuguu

SEQ ID NO: 1883324 - RNA, 23 nt, Human
auaaguucuaguugcuuguaaaa

SEQ ID NO: 1883325 - RNA, 22 nt, Human
auaaguuaacuuccaauuuaca

SEQ ID NO: 1883326 - RNA, 22 nt, Human
auaagaaccuuuugagugccuu

SEQ ID NO: 1883327 - RNA, 11 nt, Human
uuaccucugau

SEQ ID NO: 1883328 - RNA, 21 nt, Human
uuaccucugauaccucaaccc

SEQ ID NO: 1883329 - RNA, 23 nt, Human
auaagaaccuuuugagugccuua

SEQ ID NO: 1883330 - RNA, 17 nt, Human
auaaguuaacuuccaau

SEQ ID NO: 1883331 - RNA, 14 nt, Human
auaaugaauacuuu

SEQ ID NO: 1883332 - RNA, 14 nt, Human
auaauucuacuuug

SEQ ID NO: 1883333 - RNA, 19 nt, Human
auaauacaguaucucaggg

SEQ ID NO: 1883334 - RNA, 18 nt, Human
auaaucaucucugucaca

SEQ ID NO: 1883335 - RNA, 23 nt, Human
uuagauggauucuccacucaguu

SEQ ID NO: 1883336 - RNA, 16 nt, Human
uuagauggauucucca

SEQ ID NO: 1883337 - RNA, 17 nt, Human
uuagauggauucuccac

SEQ ID NO: 1883338 - RNA, 12 nt, Human
uuagcagacagg

SEQ ID NO: 1883339 - RNA, 21 nt, Human
uuagcagcagccuuuaaugca

SEQ ID NO: 1883340 - RNA, 19 nt, Human
auaauucugggaagcaaaa

SEQ ID NO: 1883341 - RNA, 15 nt, Human
auaauuguauauaug

SEQ ID NO: 1883342 - RNA, 15 nt, Human
auaaaugucuguuga

SEQ ID NO: 1883343 - RNA, 12 nt, Human
auaaaugucugu

SEQ ID NO: 1883344 - RNA, 12 nt, Human
auaaauaacuuu

SEQ ID NO: 1883345 - RNA, 12 nt, Human
auaaauaaaugu

SEQ ID NO: 1883346 - RNA, 13 nt, Human
auaaauaaaguuu

SEQ ID NO: 1883347 - RNA, 19 nt, Human
auaaauaaaguuuguugaa

SEQ ID NO: 1883348 - RNA, 13 nt, Human
auaaauuauaagu

SEQ ID NO: 1883349 - RNA, 15 nt, Human
auaaauguuaagaaa

SEQ ID NO: 1883350 - RNA, 16 nt, Human
auaaauguuaagaaaa

SEQ ID NO: 1883351 - RNA, 20 nt, Human
auaaccaaagcccaaagugg

SEQ ID NO: 1883352 - RNA, 16 nt, Human
auaaccaaucuacaau

SEQ ID NO: 1883353 - RNA, 20 nt, Human
auaaccaguguuguggauuu

SEQ ID NO: 1883354 - RNA, 20 nt, Human
auaacugcaaagugaaguug

SEQ ID NO: 1883355 - RNA, 13 nt, Human
auaacugcccagc

SEQ ID NO: 1883356 - RNA, 23 nt, Human
auaacugcccagcggacaguggc

SEQ ID NO: 1883357 - RNA, 23 nt, Human
uuaccauuuugggguacccacug

SEQ ID NO: 1883358 - RNA, 16 nt, Human
uuacccacacacagau

SEQ ID NO: 1883359 - RNA, 18 nt, Human
uuacaggaaguacuggag

SEQ ID NO: 1883360 - RNA, 22 nt, Human
uuacaggaaguacuggagaaaa

SEQ ID NO: 1883361 - RNA, 15 nt, Human
uuacaggaaguacug

SEQ ID NO: 1883362 - RNA, 16 nt, Human
uuacaggaaguacugg

SEQ ID NO: 1883363 - RNA, 19 nt, Human
auaacuggaggaauuuucu

SEQ ID NO: 1883364 - RNA, 12 nt, Human
auaaacuaaaga

SEQ ID NO: 1883365 - RNA, 17 nt, Human
auaaacuaaagaaaaau

SEQ ID NO: 1883366 - RNA, 18 nt, Human
auaaacgucuuaaauauu

SEQ ID NO: 1883367 - RNA, 16 nt, Human
auaaacgucuuaaaua

SEQ ID NO: 1883368 - RNA, 15 nt, Human
auaaacgucuuaaau

SEQ ID NO: 1883369 - RNA, 18 nt, Human
auaaacuggcagcucagc

SEQ ID NO: 1883370 - RNA, 15 nt, Human
auaaacuuuaccuuu

SEQ ID NO: 1883371 - RNA, 13 nt, Human
auaaacuuuaccu

SEQ ID NO: 1883372 - RNA, 22 nt, Human
auaaagugcugcggagcaagag

SEQ ID NO: 1883373 - RNA, 23 nt, Human
auaaagugcugcggagcaagagg

SEQ ID NO: 1883374 - RNA, 24 nt, Human
auaaagugcugcggagcaagagga

SEQ ID NO: 1883375 - RNA, 13 nt, Human
auaaauaaaacau

SEQ ID NO: 1883376 - RNA, 23 nt, Human
auaaacacucuugaaaaaugcau

SEQ ID NO: 1883377 - RNA, 18 nt, Human
auaaacacucuugaaaaa

SEQ ID NO: 1883378 - RNA, 22 nt, Human
auaaacauuuguagcauccucu

SEQ ID NO: 1883379 - RNA, 16 nt, Human
auaaaccgaacugaug

SEQ ID NO: 1883380 - RNA, 17 nt, Human
uuauauauguauuuaua

SEQ ID NO: 1883381 - RNA, 14 nt, Human
uuauauauguauuu

SEQ ID NO: 1883382 - RNA, 22 nt, Human
uuauauauauuuuuuucugaaa

SEQ ID NO: 1883383 - RNA, 19 nt, Human
uuauauauauauauauuuc

SEQ ID NO: 1883384 - RNA, 21 nt, Human
uuauauagggaucaaccagcu

SEQ ID NO: 1883385 - RNA, 15 nt, Human
auacaaaagcaugug

SEQ ID NO: 1883386 - RNA, 13 nt, Human
auacaaaagcaug

SEQ ID NO: 1883387 - RNA, 12 nt, Human
auacaaaagcau

SEQ ID NO: 1883388 - RNA, 22 nt, Human
auacaaaaaaaaaaaaaaauua

SEQ ID NO: 1883389 - RNA, 20 nt, Human
auaauuuuuuucaauauuua

SEQ ID NO: 1883390 - RNA, 21 nt, Human
auaauuuuuuucaauauuuau

SEQ ID NO: 1883391 - RNA, 22 nt, Human
auaauuuuuuucaauauuuauu

SEQ ID NO: 1883392 - RNA, 14 nt, Human
uuagcaguaaaaua

SEQ ID NO: 1883393 - RNA, 16 nt, Human
uuagcaguaaaauagc

SEQ ID NO: 1883394 - RNA, 19 nt, Human
uuagcaguaaaauagcuga

SEQ ID NO: 1883395 - RNA, 10 nt, Human
uuagccugga

SEQ ID NO: 1883396 - RNA, 18 nt, Human
uuauacuuuguaaagaca

SEQ ID NO: 1883397 - RNA, 15 nt, Human
uuauagaauauuuau

SEQ ID NO: 1883398 - RNA, 23 nt, Human
uuauagaauauuuauuaccucug

SEQ ID NO: 1883399 - RNA, 21 nt, Human
uuauaccuguguauuuuuuaa

SEQ ID NO: 1883400 - RNA, 16 nt, Human
uuauacucuuucugua

SEQ ID NO: 1883401 - RNA, 14 nt, Human
uuauacuggcaugc

SEQ ID NO: 1883402 - RNA, 16 nt, Human
uuauagccgaaaugau

SEQ ID NO: 1883403 - RNA, 21 nt, Human
auacaguucggugagcuacaa

SEQ ID NO: 1883404 - RNA, 22 nt, Human
auacaggaaaagcugcugacag

SEQ ID NO: 1883405 - RNA, 20 nt, Human
auacaggaaaagcugcugac

SEQ ID NO: 1883406 - RNA, 19 nt, Human
auacaggaaaagcugcuga

SEQ ID NO: 1883407 - RNA, 14 nt, Human
auacaggaaaagcu

SEQ ID NO: 1883408 - RNA, 15 nt, Human
auacaaauuagaaaa

SEQ ID NO: 1883409 - RNA, 17 nt, Human
auacaaauuagaaaaug

SEQ ID NO: 1883410 - RNA, 14 nt, Human
auacaaauuagaaa

SEQ ID NO: 1883411 - RNA, 18 nt, Human
auacaaauuagaaaaugu

SEQ ID NO: 1883412 - RNA, 15 nt, Human
auacaacacaaagag

SEQ ID NO: 1883413 - RNA, 16 nt, Human
auacaacacaaagaga

SEQ ID NO: 1883414 - RNA, 20 nt, Human
auacauaaacaagaccacgu

SEQ ID NO: 1883415 - RNA, 21 nt, Human
auacauaucuuuauuaaucac

SEQ ID NO: 1883416 - RNA, 17 nt, Human
auacauucuguaauaca

SEQ ID NO: 1883417 - RNA, 16 nt, Human
auacauuugauaaagu

SEQ ID NO: 1883418 - RNA, 24 nt, Human
auaccaaauagcuucuguuuuguu

SEQ ID NO: 1883419 - RNA, 16 nt, Human
uuaucaaaacuuucuu

SEQ ID NO: 1883420 - RNA, 15 nt, Human
uuaucaaaacuuucu

SEQ ID NO: 1883421 - RNA, 15 nt, Human
uuaucaacaauagug

SEQ ID NO: 1883422 - RNA, 20 nt, Human
uuaucaagcuaauaaaauau

SEQ ID NO: 1883423 - RNA, 13 nt, Human
uuaucaagcuaau

SEQ ID NO: 1883424 - RNA, 23 nt, Human
uuaucaagaguugugacaacuuc

SEQ ID NO: 1883425 - RNA, 22 nt, Human
uuaucaagaguugugacaacuu

SEQ ID NO: 1883426 - RNA, 14 nt, Human
uuaucaacauuugu

SEQ ID NO: 1883427 - RNA, 23 nt, Human
uuaucagucauaacuaaauaaag

SEQ ID NO: 1883428 - RNA, 21 nt, Human
uuaucagucauaacuaaauaa

SEQ ID NO: 1883429 - RNA, 23 nt, Human
uuaucagucaauauuuuuagaua

SEQ ID NO: 1883430 - RNA, 14 nt, Human
uuaucagucaauau

SEQ ID NO: 1883431 - RNA, 15 nt, Human
uuaucagucaauauu

SEQ ID NO: 1883432 - RNA, 17 nt, Human
uuaucaugugaaaucau

SEQ ID NO: 1883433 - RNA, 18 nt, Human
uuaucaugugaaaucauu

SEQ ID NO: 1883434 - RNA, 20 nt, Human
uuaucaugugaaaucauuca

SEQ ID NO: 1883435 - RNA, 22 nt, Human
uuaucaugugaaaucauucauu

SEQ ID NO: 1883436 - RNA, 19 nt, Human
uuaucauggucucagucau

SEQ ID NO: 1883437 - RNA, 19 nt, Human
auaccagccaguaaauggg

SEQ ID NO: 1883438 - RNA, 21 nt, Human
auacuaaccagcagaaaugcc

SEQ ID NO: 1883439 - RNA, 20 nt, Human
auacuacaguuuguuaguau

SEQ ID NO: 1883440 - RNA, 16 nt, Human
auacuacaguuuguua

SEQ ID NO: 1883441 - RNA, 15 nt, Human
auacuacaguuuguu

SEQ ID NO: 1883442 - RNA, 13 nt, Human
auacuacaguuug

SEQ ID NO: 1883443 - RNA, 14 nt, Human
auacuaccuugaaa

SEQ ID NO: 1883444 - RNA, 15 nt, Human
auacuaccuugaaaa

SEQ ID NO: 1883445 - RNA, 17 nt, Human
auacuaccuugaaaaua

SEQ ID NO: 1883446 - RNA, 16 nt, Human
uguuguaaacauuucu

SEQ ID NO: 1883447 - RNA, 13 nt, Human
uguugucagcuga

SEQ ID NO: 1883448 - RNA, 13 nt, Human
uguugucaccuuc

SEQ ID NO: 1883449 - RNA, 13 nt, Human
uguugggccagga

SEQ ID NO: 1883450 - RNA, 18 nt, Human
uguugggagugaggaugu

SEQ ID NO: 1883451 - RNA, 16 nt, Human
uguugggccaggagcc

SEQ ID NO: 1883452 - RNA, 19 nt, Human
aguucgagaccagccuggc

SEQ ID NO: 1883453 - RNA, 21 nt, Human
aguuauuuuuauuuauuuaaa

SEQ ID NO: 1883454 - RNA, 17 nt, Human
aguuccuagccaccgcc

SEQ ID NO: 1883455 - RNA, 21 nt, Human
aguucgaugggcccaauucuu

SEQ ID NO: 1883456 - RNA, 17 nt, Human
aguucgagaccagccug

SEQ ID NO: 1883457 - RNA, 20 nt, Human
aguuauuauauuuacaaaug

SEQ ID NO: 1883458 - RNA, 17 nt, Human
aguuaucuaaaagaaau

SEQ ID NO: 1883459 - RNA, 20 nt, Human
uguucuuuccaaaguacacu

SEQ ID NO: 1883460 - RNA, 18 nt, Human
uguucuuuccaaaguaca

SEQ ID NO: 1883461 - RNA, 17 nt, Human
aguguuuaacuugucaa

SEQ ID NO: 1883462 - RNA, 17 nt, Human
aguuacccaaauuaaga

SEQ ID NO: 1883463 - RNA, 18 nt, Human
aguuacccaaauuaagag

SEQ ID NO: 1883464 - RNA, 17 nt, Human
aguuagggaauggcaca

SEQ ID NO: 1883465 - RNA, 16 nt, Human
aguuacuagguaacuu

SEQ ID NO: 1883466 - RNA, 18 nt, Human
uguuauuuuuuaauuauu

SEQ ID NO: 1883467 - RNA, 14 nt, Human
uguucaaacauuua

SEQ ID NO: 1883468 - RNA, 19 nt, Human
uguucccauccucuucuuu

SEQ ID NO: 1883469 - RNA, 20 nt, Human
uguucccauguagcccccug

SEQ ID NO: 1883470 - RNA, 20 nt, Human
uguuauguagugugcuuuuu

SEQ ID NO: 1883471 - RNA, 17 nt, Human
aguguacagucuuguau

SEQ ID NO: 1883472 - RNA, 23 nt, Human
aguguacauggaauaacauguaa

SEQ ID NO: 1883473 - RNA, 16 nt, Human
aguguaccauuugccu

SEQ ID NO: 1883474 - RNA, 19 nt, Human
aguguagcauccuaaagau

SEQ ID NO: 1883475 - RNA, 13 nt, Human
uguucugggacac

SEQ ID NO: 1883476 - RNA, 12 nt, Human
uguucugggaca

SEQ ID NO: 1883477 - RNA, 14 nt, Human
uguuccccagagaa

SEQ ID NO: 1883478 - RNA, 13 nt, Human
uguuccccagaga

SEQ ID NO: 1883479 - RNA, 15 nt, Human
uguucugggacacag

SEQ ID NO: 1883480 - RNA, 14 nt, Human
uguucugggacaca

SEQ ID NO: 1883481 - RNA, 16 nt, Human
uguucuuaauucuuag

SEQ ID NO: 1883482 - RNA, 14 nt, Human
uguucuuaauucuu

SEQ ID NO: 1883483 - RNA, 16 nt, Human
uguucuuaagacguga

SEQ ID NO: 1883484 - RNA, 18 nt, Human
uguucuugguuuguaaau

SEQ ID NO: 1883485 - RNA, 17 nt, Human
uguucuugguuuguaaa

SEQ ID NO: 1883486 - RNA, 14 nt, Human
uguucuuuccaaag

SEQ ID NO: 1883487 - RNA, 13 nt, Human
uguucuuuccaaa

SEQ ID NO: 1883488 - RNA, 19 nt, Human
uguucuugguuuguaaauu

SEQ ID NO: 1883489 - RNA, 16 nt, Human
aguggugcgaucuggg

SEQ ID NO: 1883490 - RNA, 21 nt, Human
agugguuccuaauccucuagg

SEQ ID NO: 1883491 - RNA, 19 nt, Human
agugggugaauaauacagu

SEQ ID NO: 1883492 - RNA, 14 nt, Human
agugggucccagau

SEQ ID NO: 1883493 - RNA, 16 nt, Human
aguguacagucuugua

SEQ ID NO: 1883494 - RNA, 15 nt, Human
aguguacagucuugu

SEQ ID NO: 1883495 - RNA, 13 nt, Human
aguguacagucuu

SEQ ID NO: 1883496 - RNA, 21 nt, Human
aguguacauggaauaacaugu

SEQ ID NO: 1883497 - RNA, 22 nt, Human
aguguacauggaauaacaugua

SEQ ID NO: 1883498 - RNA, 13 nt, Human
aguggcagcugcu

SEQ ID NO: 1883499 - RNA, 12 nt, Human
aguggcagcugc

SEQ ID NO: 1883500 - RNA, 20 nt, Human
aguggcagcugcuuuugucu

SEQ ID NO: 1883501 - RNA, 14 nt, Human
aguggcagcugcuu

SEQ ID NO: 1883502 - RNA, 17 nt, Human
aguggcaggacaggaaa

SEQ ID NO: 1883503 - RNA, 13 nt, Human
aguggcaggacag

SEQ ID NO: 1883504 - RNA, 16 nt, Human
aguggcaggacaggaa

SEQ ID NO: 1883505 - RNA, 18 nt, Human
agugggggaucacagccu

SEQ ID NO: 1883506 - RNA, 13 nt, Human
agugggugaauaa

SEQ ID NO: 1883507 - RNA, 18 nt, Human
agugggugaauaauacag

SEQ ID NO: 1883508 - RNA, 19 nt, Human
agugggggaguggccacag

SEQ ID NO: 1883509 - RNA, 20 nt, Human
agugggggaguggccacaga

SEQ ID NO: 1883510 - RNA, 13 nt, Human
aguggcauaaaaa

SEQ ID NO: 1883511 - RNA, 14 nt, Human
aguucuugugccau

SEQ ID NO: 1883512 - RNA, 13 nt, Human
aguucuugugcca

SEQ ID NO: 1883513 - RNA, 12 nt, Human
aguucuugugcc

SEQ ID NO: 1883514 - RNA, 14 nt, Human
aguugauagcacag

SEQ ID NO: 1883515 - RNA, 16 nt, Human
aguucuuugggccaga

SEQ ID NO: 1883516 - RNA, 17 nt, Human
aguucuuugggccagac

SEQ ID NO: 1883517 - RNA, 15 nt, Human
aguucuuugggccag

SEQ ID NO: 1883518 - RNA, 15 nt, Human
aguugauagcacaga

SEQ ID NO: 1883519 - RNA, 19 nt, Human
aguugauagcacagacccu

SEQ ID NO: 1883520 - RNA, 20 nt, Human
aguugauagcacagacccug

SEQ ID NO: 1883521 - RNA, 21 nt, Human
aguugauagcacagacccugc

SEQ ID NO: 1883522 - RNA, 22 nt, Human
aguugauagcacagacccugcc

SEQ ID NO: 1883523 - RNA, 23 nt, Human
aguugauagcacagacccugccc

SEQ ID NO: 1883524 - RNA, 18 nt, Human
aguucuuugggccagaca

SEQ ID NO: 1883525 - RNA, 19 nt, Human
aguucuuugggccagacau

SEQ ID NO: 1883526 - RNA, 13 nt, Human
aguugauucagcu

SEQ ID NO: 1883527 - RNA, 23 nt, Human
aguugaucuggaacccagacuca

SEQ ID NO: 1883528 - RNA, 13 nt, Human
aguugaucuggaa

SEQ ID NO: 1883529 - RNA, 15 nt, Human
aguugaucuggaacc

SEQ ID NO: 1883530 - RNA, 17 nt, Human
aguugaucuggaaccca

SEQ ID NO: 1883531 - RNA, 18 nt, Human
aguugaucuggaacccag

SEQ ID NO: 1883532 - RNA, 19 nt, Human
aguugaucuggaacccaga

SEQ ID NO: 1883533 - RNA, 20 nt, Human
aguugaucuggaacccagac

SEQ ID NO: 1883534 - RNA, 21 nt, Human
aguugaucuggaacccagacu

SEQ ID NO: 1883535 - RNA, 19 nt, Human
aguugcaacuuuguauaaa

SEQ ID NO: 1883536 - RNA, 23 nt, Human
aguugauucagcucugcaagaau

SEQ ID NO: 1883537 - RNA, 14 nt, Human
aguugauucagcuc

SEQ ID NO: 1883538 - RNA, 15 nt, Human
aguugauucagcucu

SEQ ID NO: 1883539 - RNA, 17 nt, Human
aguugauucagcucugc

SEQ ID NO: 1883540 - RNA, 18 nt, Human
aguugauucagcucugca

SEQ ID NO: 1883541 - RNA, 20 nt, Human
uguuugccuucuacuuuuaa

SEQ ID NO: 1883542 - RNA, 15 nt, Human
uguuuggggaugaga

SEQ ID NO: 1883543 - RNA, 19 nt, Human
uguuuggggaugagaaagg

SEQ ID NO: 1883544 - RNA, 22 nt, Human
uguuuuaauuuauacuggcaug

SEQ ID NO: 1883545 - RNA, 14 nt, Human
uguugucagcugaa

SEQ ID NO: 1883546 - RNA, 12 nt, Human
uguugucccuuc

SEQ ID NO: 1883547 - RNA, 13 nt, Human
uguugucccuucu

SEQ ID NO: 1883548 - RNA, 16 nt, Human
uguuugccucugccuc

SEQ ID NO: 1883549 - RNA, 14 nt, Human
uguuugccucugcc

SEQ ID NO: 1883550 - RNA, 15 nt, Human
uguuugcaucugaaa

SEQ ID NO: 1883551 - RNA, 15 nt, Human
uguuuucaguguaca

SEQ ID NO: 1883552 - RNA, 17 nt, Human
uguuuucaguguacaug

SEQ ID NO: 1883553 - RNA, 16 nt, Human
uguuuuccgugaaaac

SEQ ID NO: 1883554 - RNA, 19 nt, Human
uguuuuccgugaaaacgga

SEQ ID NO: 1883555 - RNA, 14 nt, Human
uguuuuccucccuu

SEQ ID NO: 1883556 - RNA, 21 nt, Human
uguuuuccucccuucugcuac

SEQ ID NO: 1883557 - RNA, 22 nt, Human
uguuuuccucccuucugcuacu

SEQ ID NO: 1883558 - RNA, 15 nt, Human
uguuuucucuugaga

SEQ ID NO: 1883559 - RNA, 23 nt, Human
uguuuuccucccuucugcuacug

SEQ ID NO: 1883560 - RNA, 16 nt, Human
aguucucuccuucuuc

SEQ ID NO: 1883561 - RNA, 20 nt, Human
aguucucuucacucaaggau

SEQ ID NO: 1883562 - RNA, 13 nt, Human
aguucucuccuuc

SEQ ID NO: 1883563 - RNA, 12 nt, Human
aguucucuccuu

SEQ ID NO: 1883564 - RNA, 19 nt, Human
aguuuccuuccagcccaga

SEQ ID NO: 1883565 - RNA, 12 nt, Human
aguuuccugaaa

SEQ ID NO: 1883566 - RNA, 15 nt, Human
aguuucguuuucaaa

SEQ ID NO: 1883567 - RNA, 16 nt, Human
aguuucguuuucaaaa

SEQ ID NO: 1883568 - RNA, 21 nt, Human
aguuucuccaagcaggacaug

SEQ ID NO: 1883569 - RNA, 13 nt, Human
aguuucuccaagc

SEQ ID NO: 1883570 - RNA, 15 nt, Human
aguuucuccaagcag

SEQ ID NO: 1883571 - RNA, 16 nt, Human
uuaaauucuugcaaag

SEQ ID NO: 1883572 - RNA, 23 nt, Human
uuaaauucuccaguuuuuuguua

SEQ ID NO: 1883573 - RNA, 13 nt, Human
uuaaauucuugca

SEQ ID NO: 1883574 - RNA, 15 nt, Human
aguuuauuuuaagac

SEQ ID NO: 1883575 - RNA, 15 nt, Human
aguuucaaccaugaa

SEQ ID NO: 1883576 - RNA, 20 nt, Human
aguuuuaucauuuucaaaau

SEQ ID NO: 1883577 - RNA, 14 nt, Human
aguuuuaucauuuu

SEQ ID NO: 1883578 - RNA, 15 nt, Human
aguuuuaucauuuuc

SEQ ID NO: 1883579 - RNA, 22 nt, Human
aguuuucacucuuauugcccac

SEQ ID NO: 1883580 - RNA, 21 nt, Human
aguuuucaagucaaauuaaua

SEQ ID NO: 1883581 - RNA, 22 nt, Human
aguuuucaagucaaauuaauaa

SEQ ID NO: 1883582 - RNA, 17 nt, Human
aguuuucaccucgaauu

SEQ ID NO: 1883583 - RNA, 18 nt, Human
aguuuucccuugaggaaa

SEQ ID NO: 1883584 - RNA, 20 nt, Human
aguuuucccuugaggaaaca

SEQ ID NO: 1883585 - RNA, 22 nt, Human
aguugcauagguuuaauaauuu

SEQ ID NO: 1883586 - RNA, 20 nt, Human
aguugccagucaccccggcc

SEQ ID NO: 1883587 - RNA, 21 nt, Human
uuaaaaaaauugguuggagaa

SEQ ID NO: 1883588 - RNA, 17 nt, Human
uuaaaacaacacucaca

SEQ ID NO: 1883589 - RNA, 20 nt, Human
uuaaaaaugguuuaaauggu

SEQ ID NO: 1883590 - RNA, 18 nt, Human
uuaaaaaguggaaaaaua

SEQ ID NO: 1883591 - RNA, 22 nt, Human
uuaaauaaugugaaacuggauu

SEQ ID NO: 1883592 - RNA, 19 nt, Human
uuaaauaaugugaaacugg

SEQ ID NO: 1883593 - RNA, 21 nt, Human
uuaaauaaugugaaacuggau

SEQ ID NO: 1883594 - RNA, 20 nt, Human
uuaaauaaugugaaacugga

SEQ ID NO: 1883595 - RNA, 13 nt, Human
uuaaauaaaucau

SEQ ID NO: 1883596 - RNA, 15 nt, Human
uuaaauaaaucauaa

SEQ ID NO: 1883597 - RNA, 17 nt, Human
uuaaaccgccaaggcug

SEQ ID NO: 1883598 - RNA, 17 nt, Human
agccagaggacugugau

SEQ ID NO: 1883599 - RNA, 13 nt, Human
agccagaggacug

SEQ ID NO: 1883600 - RNA, 14 nt, Human
agccagaggacugu

SEQ ID NO: 1883601 - RNA, 10 nt, Human
agccagagga

SEQ ID NO: 1883602 - RNA, 11 nt, Human
agccagaggag

SEQ ID NO: 1883603 - RNA, 19 nt, Human
agccacugcaccgggccac

SEQ ID NO: 1883604 - RNA, 18 nt, Human
agccacugcaccgggcca

SEQ ID NO: 1883605 - RNA, 20 nt, Human
agccacugcaccgggccaca

SEQ ID NO: 1883606 - RNA, 16 nt, Human
agccacugcaccgggc

SEQ ID NO: 1883607 - RNA, 15 nt, Human
agccacgguguucug

SEQ ID NO: 1883608 - RNA, 20 nt, Human
ugauuaaccacuucagcuga

SEQ ID NO: 1883609 - RNA, 19 nt, Human
ugauuaaauucuugcaaag

SEQ ID NO: 1883610 - RNA, 15 nt, Human
ugauggugcaaugac

SEQ ID NO: 1883611 - RNA, 13 nt, Human
ugauggugcaaug

SEQ ID NO: 1883612 - RNA, 20 nt, Human
ugauuaaauucuugcaaagu

SEQ ID NO: 1883613 - RNA, 19 nt, Human
ugauuaaccacuucagcug

SEQ ID NO: 1883614 - RNA, 18 nt, Human
ugaugaacucuuaaucaa

SEQ ID NO: 1883615 - RNA, 16 nt, Human
ugauccuggaggccca

SEQ ID NO: 1883616 - RNA, 17 nt, Human
ugauccuggaggcccag

SEQ ID NO: 1883617 - RNA, 18 nt, Human
ugauccuggaggcccagu

SEQ ID NO: 1883618 - RNA, 14 nt, Human
ugaugaccaaaguc

SEQ ID NO: 1883619 - RNA, 14 nt, Human
ugaugacucaagau

SEQ ID NO: 1883620 - RNA, 15 nt, Human
ugaugacucaagauu

SEQ ID NO: 1883621 - RNA, 22 nt, Human
ugaugacucaagauucccagga

SEQ ID NO: 1883622 - RNA, 21 nt, Human
ugauccucccaccucagccuc

SEQ ID NO: 1883623 - RNA, 16 nt, Human
ugauccucccaccuca

SEQ ID NO: 1883624 - RNA, 22 nt, Human
ugauccucccaccucagccucc

SEQ ID NO: 1883625 - RNA, 14 nt, Human
ugauccuggaggcc

SEQ ID NO: 1883626 - RNA, 15 nt, Human
ugauccuggaggccc

SEQ ID NO: 1883627 - RNA, 15 nt, Human
ugauccucccaccuc

SEQ ID NO: 1883628 - RNA, 16 nt, Human
ugauccuaguuccacc

SEQ ID NO: 1883629 - RNA, 16 nt, Human
agcaccugaacaguuu

SEQ ID NO: 1883630 - RNA, 13 nt, Human
ugaugagaggaaa

SEQ ID NO: 1883631 - RNA, 14 nt, Human
ugaugagaggaaau

SEQ ID NO: 1883632 - RNA, 15 nt, Human
ugaugagaggaaauc

SEQ ID NO: 1883633 - RNA, 16 nt, Human
ugaugagaggaaauca

SEQ ID NO: 1883634 - RNA, 23 nt, Human
ugaugcuucuucagagacuccug

SEQ ID NO: 1883635 - RNA, 23 nt, Human
ugaugacucaagauucccaggag

SEQ ID NO: 1883636 - RNA, 14 nt, Human
ugauggggcccugc

SEQ ID NO: 1883637 - RNA, 15 nt, Human
ugauggggcccugcc

SEQ ID NO: 1883638 - RNA, 16 nt, Human
ugauggggcccugccu

SEQ ID NO: 1883639 - RNA, 19 nt, Human
ugauggggcccugccuccu

SEQ ID NO: 1883640 - RNA, 14 nt, Human
ugaugggauuuggu

SEQ ID NO: 1883641 - RNA, 15 nt, Human
ugauuucauuaauac

SEQ ID NO: 1883642 - RNA, 18 nt, Human
ugauuuccguuaaaauac

SEQ ID NO: 1883643 - RNA, 22 nt, Human
ugauuuccguuaaaauaccagc

SEQ ID NO: 1883644 - RNA, 21 nt, Human
ugauuucagcaccuacagugu

SEQ ID NO: 1883645 - RNA, 21 nt, Human
ugauuuaggagaagccaggaa

SEQ ID NO: 1883646 - RNA, 22 nt, Human
ugauuuaggagaagccaggaau

SEQ ID NO: 1883647 - RNA, 16 nt, Human
ugauuuaggagaagcc

SEQ ID NO: 1883648 - RNA, 20 nt, Human
ugauuuaggagaagccagga

SEQ ID NO: 1883649 - RNA, 17 nt, Human
ugauuuggggauauuuu

SEQ ID NO: 1883650 - RNA, 17 nt, Human
ugauuugaagaacaugu

SEQ ID NO: 1883651 - RNA, 19 nt, Human
ugauuugaagaacauguga

SEQ ID NO: 1883652 - RNA, 20 nt, Human
ugauuuggugaccaacuguc

SEQ ID NO: 1883653 - RNA, 13 nt, Human
ugauuuggugacc

SEQ ID NO: 1883654 - RNA, 19 nt, Human
ugauuuggugaccaacugu

SEQ ID NO: 1883655 - RNA, 23 nt, Human
ugauuuccuugaauguggcuuga

SEQ ID NO: 1883656 - RNA, 17 nt, Human
ugauuuccuugaaugug

SEQ ID NO: 1883657 - RNA, 19 nt, Human
ugauuuccuugaauguggc

SEQ ID NO: 1883658 - RNA, 13 nt, Human
ugauuuccuugaa

SEQ ID NO: 1883659 - RNA, 14 nt, Human
ugauuuccuugaau

SEQ ID NO: 1883660 - RNA, 15 nt, Human
ugauuuccuugaaug

SEQ ID NO: 1883661 - RNA, 16 nt, Human
ugauuuccuugaaugu

SEQ ID NO: 1883662 - RNA, 15 nt, Human
agcccagccacggac

SEQ ID NO: 1883663 - RNA, 11 nt, Human
agcccagccac

SEQ ID NO: 1883664 - RNA, 17 nt, Human
agcccagcugggucagg

SEQ ID NO: 1883665 - RNA, 19 nt, Human
agcccagcugggucaggca

SEQ ID NO: 1883666 - RNA, 20 nt, Human
agcccagcugggucaggcag

SEQ ID NO: 1883667 - RNA, 21 nt, Human
agcccagcugggucaggcagg

SEQ ID NO: 1883668 - RNA, 14 nt, Human
agcccaggaaaggc

SEQ ID NO: 1883669 - RNA, 21 nt, Human
ugauucauaaugacuuaagca

SEQ ID NO: 1883670 - RNA, 16 nt, Human
ugauucauaguaacuu

SEQ ID NO: 1883671 - RNA, 18 nt, Human
ugauucauaguaacuucu

SEQ ID NO: 1883672 - RNA, 18 nt, Human
agcccaggaaaggcucca

SEQ ID NO: 1883673 - RNA, 16 nt, Human
ugauucauaaugacuu

SEQ ID NO: 1883674 - RNA, 13 nt, Human
ugauucuccugcc

SEQ ID NO: 1883675 - RNA, 12 nt, Human
ugauuccuuccu

SEQ ID NO: 1883676 - RNA, 23 nt, Human
ugauucccaagcucugcuccucu

SEQ ID NO: 1883677 - RNA, 22 nt, Human
ugauucccaagcucugcuccuc

SEQ ID NO: 1883678 - RNA, 19 nt, Human
ugauucauaguaacuucuu

SEQ ID NO: 1883679 - RNA, 14 nt, Human
ugauuccuuccugu

SEQ ID NO: 1883680 - RNA, 21 nt, Human
agccaguaaaugggggugcau

SEQ ID NO: 1883681 - RNA, 22 nt, Human
agccaguaaaugggggugcauu

SEQ ID NO: 1883682 - RNA, 18 nt, Human
agccaucaaaaugcuuuu

SEQ ID NO: 1883683 - RNA, 13 nt, Human
agccaguaaaugg

SEQ ID NO: 1883684 - RNA, 15 nt, Human
agccagggccugcga

SEQ ID NO: 1883685 - RNA, 14 nt, Human
agccagcucccucu

SEQ ID NO: 1883686 - RNA, 15 nt, Human
agccagcucccucua

SEQ ID NO: 1883687 - RNA, 17 nt, Human
agccagcucccucuauu

SEQ ID NO: 1883688 - RNA, 19 nt, Human
agccagcucccucuauuua

SEQ ID NO: 1883689 - RNA, 22 nt, Human
agccagcgggaauggcagcugc

SEQ ID NO: 1883690 - RNA, 22 nt, Human
agccagcucccucuauuuaugu

SEQ ID NO: 1883691 - RNA, 15 nt, Human
agcccacuucugcca

SEQ ID NO: 1883692 - RNA, 14 nt, Human
agcccacuucugcc

SEQ ID NO: 1883693 - RNA, 13 nt, Human
agcccacuucugc

SEQ ID NO: 1883694 - RNA, 15 nt, Human
agcccacuguccugg

SEQ ID NO: 1883695 - RNA, 17 nt, Human
agcccacuguccugggc

SEQ ID NO: 1883696 - RNA, 18 nt, Human
agcccacuguccugggcc

SEQ ID NO: 1883697 - RNA, 19 nt, Human
agcccacuguccugggccu

SEQ ID NO: 1883698 - RNA, 20 nt, Human
agcccacuguccugggccug

SEQ ID NO: 1883699 - RNA, 22 nt, Human
agcccacuguccugggccugca

SEQ ID NO: 1883700 - RNA, 23 nt, Human
agcccacuguccugggccugcag

SEQ ID NO: 1883701 - RNA, 14 nt, Human
agcccacuguacuu

SEQ ID NO: 1883702 - RNA, 16 nt, Human
agcccacuguacuugc

SEQ ID NO: 1883703 - RNA, 14 nt, Human
agcccacuguccug

SEQ ID NO: 1883704 - RNA, 21 nt, Human
agccaugagaugauacaucca

SEQ ID NO: 1883705 - RNA, 19 nt, Human
ugcagaccccuuggccagc

SEQ ID NO: 1883706 - RNA, 17 nt, Human
ugcagaccccuuggcca

SEQ ID NO: 1883707 - RNA, 14 nt, Human
ugcagacgcccaga

SEQ ID NO: 1883708 - RNA, 22 nt, Human
ugcagacaggcaagcaccuccu

SEQ ID NO: 1883709 - RNA, 15 nt, Human
ugcagaagacaguau

SEQ ID NO: 1883710 - RNA, 14 nt, Human
ugcagaagacagua

SEQ ID NO: 1883711 - RNA, 16 nt, Human
ugcacucuagccuggg

SEQ ID NO: 1883712 - RNA, 19 nt, Human
ugcacuccccugcugggug

SEQ ID NO: 1883713 - RNA, 16 nt, Human
ugcacuccccugcugg

SEQ ID NO: 1883714 - RNA, 17 nt, Human
ugcacuccccugcuggg

SEQ ID NO: 1883715 - RNA, 15 nt, Human
ugcacacauuuuuua

SEQ ID NO: 1883716 - RNA, 13 nt, Human
ugcacacauuuuu

SEQ ID NO: 1883717 - RNA, 12 nt, Human
ugcacacauuuu

SEQ ID NO: 1883718 - RNA, 11 nt, Human
ugcacacauuu

SEQ ID NO: 1883719 - RNA, 17 nt, Human
agccgagaucacgccac

SEQ ID NO: 1883720 - RNA, 21 nt, Human
agccgagauagccaaggccaa

SEQ ID NO: 1883721 - RNA, 20 nt, Human
agccgagauagccaaggcca

SEQ ID NO: 1883722 - RNA, 21 nt, Human
agcccuuagcagggaaacagc

SEQ ID NO: 1883723 - RNA, 23 nt, Human
agcccuguugacacaggucuuuc

SEQ ID NO: 1883724 - RNA, 17 nt, Human
agcccuguugacacagg

SEQ ID NO: 1883725 - RNA, 18 nt, Human
agcccuguugacacaggu

SEQ ID NO: 1883726 - RNA, 20 nt, Human
agcccuguugacacaggucu

SEQ ID NO: 1883727 - RNA, 21 nt, Human
agcccuguugacacaggucuu

SEQ ID NO: 1883728 - RNA, 17 nt, Human
agcccuugcauugcaga

SEQ ID NO: 1883729 - RNA, 16 nt, Human
agcccuuagcagggaa

SEQ ID NO: 1883730 - RNA, 17 nt, Human
ugcagacucuacagagg

SEQ ID NO: 1883731 - RNA, 16 nt, Human
ugcagacucuacagag

SEQ ID NO: 1883732 - RNA, 18 nt, Human
ugcagacucuacagaggc

SEQ ID NO: 1883733 - RNA, 23 nt, Human
agccucugaaaaccaauguucuc

SEQ ID NO: 1883734 - RNA, 13 nt, Human
agccucugcuccc

SEQ ID NO: 1883735 - RNA, 23 nt, Human
ugcagccucaaccuccugggcua

SEQ ID NO: 1883736 - RNA, 22 nt, Human
ugcagccucaaccuccugggcu

SEQ ID NO: 1883737 - RNA, 21 nt, Human
ugcagccucaaccuccugggc

SEQ ID NO: 1883738 - RNA, 20 nt, Human
ugcagccucaaccuccuggg

SEQ ID NO: 1883739 - RNA, 15 nt, Human
agccucugcucccca

SEQ ID NO: 1883740 - RNA, 16 nt, Human
agccucugcuccccag

SEQ ID NO: 1883741 - RNA, 18 nt, Human
agccgagaucacgccacu

SEQ ID NO: 1883742 - RNA, 19 nt, Human
agccucaaccuccugggcu

SEQ ID NO: 1883743 - RNA, 20 nt, Human
agccucaaccuccugggcua

SEQ ID NO: 1883744 - RNA, 17 nt, Human
agccucacaguccuuac

SEQ ID NO: 1883745 - RNA, 18 nt, Human
agccucacaguccuuacc

SEQ ID NO: 1883746 - RNA, 21 nt, Human
ugcaaaccaucauugaaaucu

SEQ ID NO: 1883747 - RNA, 20 nt, Human
ugcaauaaaucugacccagu

SEQ ID NO: 1883748 - RNA, 21 nt, Human
ugcaauaaaucugacccagug

SEQ ID NO: 1883749 - RNA, 23 nt, Human
ugcaauaaaucugacccagugcc

SEQ ID NO: 1883750 - RNA, 22 nt, Human
agccccauucugccugcccagg

SEQ ID NO: 1883751 - RNA, 21 nt, Human
agccccauucugccugcccag

SEQ ID NO: 1883752 - RNA, 18 nt, Human
agccccaaaacucuccuc

SEQ ID NO: 1883753 - RNA, 20 nt, Human
agccccauucugccugccca

SEQ ID NO: 1883754 - RNA, 16 nt, Human
agccccaaaacucucc

SEQ ID NO: 1883755 - RNA, 17 nt, Human
agccccaaaacucuccu

SEQ ID NO: 1883756 - RNA, 21 nt, Human
agcccaggccuccuacagcuu

SEQ ID NO: 1883757 - RNA, 23 nt, Human
agccccauucugccugcccaggc

SEQ ID NO: 1883758 - RNA, 13 nt, Human
agcccccccuucc

SEQ ID NO: 1883759 - RNA, 15 nt, Human
agcccccccuuccac

SEQ ID NO: 1883760 - RNA, 14 nt, Human
agcccccuggccuc

SEQ ID NO: 1883761 - RNA, 15 nt, Human
agcccccuggccucu

SEQ ID NO: 1883762 - RNA, 15 nt, Human
agcccgcggggacau

SEQ ID NO: 1883763 - RNA, 20 nt, Human
agcccgcggggacauuggga

SEQ ID NO: 1883764 - RNA, 16 nt, Human
agcccugguggcagug

SEQ ID NO: 1883765 - RNA, 15 nt, Human
agcccugguggcagu

SEQ ID NO: 1883766 - RNA, 14 nt, Human
agcccugguggcag

SEQ ID NO: 1883767 - RNA, 18 nt, Human
ugcacacaccagagccca

SEQ ID NO: 1883768 - RNA, 17 nt, Human
ugcacacaccagagccc

SEQ ID NO: 1883769 - RNA, 21 nt, Human
ugcacacaccagagcccaccu

SEQ ID NO: 1883770 - RNA, 22 nt, Human
ugcacacaccagagcccaccuu

SEQ ID NO: 1883771 - RNA, 21 nt, Human
agcuccccgcuucugccugca

SEQ ID NO: 1883772 - RNA, 20 nt, Human
agcuccccgcuucugccugc

SEQ ID NO: 1883773 - RNA, 23 nt, Human
agcuccuucuguccuacucugug

SEQ ID NO: 1883774 - RNA, 22 nt, Human
agcuccuucuguccuacucugu

SEQ ID NO: 1883775 - RNA, 19 nt, Human
agcuccagcucaccagccc

SEQ ID NO: 1883776 - RNA, 18 nt, Human
agcuccagcucaccagcc

SEQ ID NO: 1883777 - RNA, 21 nt, Human
agcuccagcucaccagcccca

SEQ ID NO: 1883778 - RNA, 23 nt, Human
agcucugcccauccugccccuga

SEQ ID NO: 1883779 - RNA, 17 nt, Human
agcucuggacagcccca

SEQ ID NO: 1883780 - RNA, 18 nt, Human
agcucuggacagccccac

SEQ ID NO: 1883781 - RNA, 21 nt, Human
agcucuggacagccccacccu

SEQ ID NO: 1883782 - RNA, 16 nt, Human
ugcccuaaugucugua

SEQ ID NO: 1883783 - RNA, 21 nt, Human
ugcccuccagcucuuuccucc

SEQ ID NO: 1883784 - RNA, 16 nt, Human
ugcccuccucucccau

SEQ ID NO: 1883785 - RNA, 12 nt, Human
ugcccuccucuc

SEQ ID NO: 1883786 - RNA, 14 nt, Human
ugcccuccucuccc

SEQ ID NO: 1883787 - RNA, 15 nt, Human
ugcccuccucuccca

SEQ ID NO: 1883788 - RNA, 21 nt, Human
ugcccuccccucucugcaccg

SEQ ID NO: 1883789 - RNA, 14 nt, Human
ugcccuccccucuc

SEQ ID NO: 1883790 - RNA, 17 nt, Human
ugcccuccccucucugc

SEQ ID NO: 1883791 - RNA, 17 nt, Human
agcuccagcucaccagc

SEQ ID NO: 1883792 - RNA, 13 nt, Human
agcuccagcucac

SEQ ID NO: 1883793 - RNA, 15 nt, Human
agcuccacccuggcc

SEQ ID NO: 1883794 - RNA, 17 nt, Human
agcuccacccuggccga

SEQ ID NO: 1883795 - RNA, 14 nt, Human
ugcccugcccaccu

SEQ ID NO: 1883796 - RNA, 17 nt, Human
agcuccaagcucccagg

SEQ ID NO: 1883797 - RNA, 18 nt, Human
agcuccaagcucccaggc

SEQ ID NO: 1883798 - RNA, 19 nt, Human
agcuccaagcucccaggca

SEQ ID NO: 1883799 - RNA, 22 nt, Human
ugccucccaucacccgcuaaga

SEQ ID NO: 1883800 - RNA, 21 nt, Human
ugccucaggaggcaggaccuu

SEQ ID NO: 1883801 - RNA, 16 nt, Human
ugccucaggccucugu

SEQ ID NO: 1883802 - RNA, 18 nt, Human
ugccucaggccucugugc

SEQ ID NO: 1883803 - RNA, 18 nt, Human
ugccucaggaggcaggac

SEQ ID NO: 1883804 - RNA, 17 nt, Human
ugccucagccuccugag

SEQ ID NO: 1883805 - RNA, 15 nt, Human
ugccucagcccugac

SEQ ID NO: 1883806 - RNA, 11 nt, Human
ugccucucugc

SEQ ID NO: 1883807 - RNA, 12 nt, Human
ugccucucugca

SEQ ID NO: 1883808 - RNA, 17 nt, Human
ugccucucucaggccaa

SEQ ID NO: 1883809 - RNA, 19 nt, Human
ugcccuuaccugccaggaa

SEQ ID NO: 1883810 - RNA, 20 nt, Human
ugccgcagcccugcagaggg

SEQ ID NO: 1883811 - RNA, 15 nt, Human
ugccucaccccuugc

SEQ ID NO: 1883812 - RNA, 17 nt, Human
agcucuucuccaggcug

SEQ ID NO: 1883813 - RNA, 16 nt, Human
agcucuucuccaggcu

SEQ ID NO: 1883814 - RNA, 15 nt, Human
agcucuucuccaggc

SEQ ID NO: 1883815 - RNA, 15 nt, Human
ugcccugugggcccc

SEQ ID NO: 1883816 - RNA, 18 nt, Human
ugcccugugggcccccaa

SEQ ID NO: 1883817 - RNA, 22 nt, Human
ugcccuuaccugccaggaagcc

SEQ ID NO: 1883818 - RNA, 12 nt, Human
ugcccugugcaa

SEQ ID NO: 1883819 - RNA, 22 nt, Human
agcugcuuuugucuaugggacu

SEQ ID NO: 1883820 - RNA, 13 nt, Human
agcugccuguuca

SEQ ID NO: 1883821 - RNA, 24 nt, Human
agcugcuuuugucuaugggacuca

SEQ ID NO: 1883822 - RNA, 23 nt, Human
agcugcuuuugucuaugggacuc

SEQ ID NO: 1883823 - RNA, 14 nt, Human
agcugccugugccu

SEQ ID NO: 1883824 - RNA, 19 nt, Human
ugccugcccaggccccugc

SEQ ID NO: 1883825 - RNA, 18 nt, Human
ugccugcccaggccccug

SEQ ID NO: 1883826 - RNA, 17 nt, Human
ugccugcccaggccccu

SEQ ID NO: 1883827 - RNA, 12 nt, Human
ugccucugccuc

SEQ ID NO: 1883828 - RNA, 11 nt, Human
ugccucugccu

SEQ ID NO: 1883829 - RNA, 21 nt, Human
ugccucucugcaggucccuaa

SEQ ID NO: 1883830 - RNA, 16 nt, Human
ugccucugacacacag

SEQ ID NO: 1883831 - RNA, 14 nt, Human
ugccucugacacac

SEQ ID NO: 1883832 - RNA, 15 nt, Human
ugccucucugcaggu

SEQ ID NO: 1883833 - RNA, 23 nt, Human
ugccucucugcaggucccuaaua

SEQ ID NO: 1883834 - RNA, 12 nt, Human
ugcauucuagua

SEQ ID NO: 1883835 - RNA, 20 nt, Human
ugcauuuaaaagauacaguu

SEQ ID NO: 1883836 - RNA, 11 nt, Human
ugcauucuccc

SEQ ID NO: 1883837 - RNA, 21 nt, Human
ugcauucucccuccuucccuu

SEQ ID NO: 1883838 - RNA, 18 nt, Human
ugcauuugaggucuguuc

SEQ ID NO: 1883839 - RNA, 19 nt, Human
ugcauuugaggucuguucu

SEQ ID NO: 1883840 - RNA, 22 nt, Human
agcgcuggccgggaccccgagc

SEQ ID NO: 1883841 - RNA, 20 nt, Human
agcggacaguggcaggacag

SEQ ID NO: 1883842 - RNA, 19 nt, Human
agcggacaucagcugguca

SEQ ID NO: 1883843 - RNA, 14 nt, Human
agcggacaguggca

SEQ ID NO: 1883844 - RNA, 15 nt, Human
agcggacaguggcag

SEQ ID NO: 1883845 - RNA, 16 nt, Human
agcggacaguggcagg

SEQ ID NO: 1883846 - RNA, 17 nt, Human
agcggacaguggcagga

SEQ ID NO: 1883847 - RNA, 16 nt, Human
agcgcuggccgggacc

SEQ ID NO: 1883848 - RNA, 18 nt, Human
agccuuccagggguggga

SEQ ID NO: 1883849 - RNA, 15 nt, Human
agccuugaacuuuga

SEQ ID NO: 1883850 - RNA, 22 nt, Human
agcgauucuucugcuucagccu

SEQ ID NO: 1883851 - RNA, 15 nt, Human
agccuugccagagau

SEQ ID NO: 1883852 - RNA, 17 nt, Human
agccuugccagagaucc

SEQ ID NO: 1883853 - RNA, 19 nt, Human
agccuugccagagauccaa

SEQ ID NO: 1883854 - RNA, 23 nt, Human
agccuugaccauucuccaccugc

SEQ ID NO: 1883855 - RNA, 13 nt, Human
agccuugccagag

SEQ ID NO: 1883856 - RNA, 14 nt, Human
agccuugccagaga

SEQ ID NO: 1883857 - RNA, 22 nt, Human
agccuugaacuuugaccucugc

SEQ ID NO: 1883858 - RNA, 16 nt, Human
agccuugaacuuugac

SEQ ID NO: 1883859 - RNA, 23 nt, Human
agccuugaacuuugaccucugca

SEQ ID NO: 1883860 - RNA, 22 nt, Human
agccuugaccauucuccaccug

SEQ ID NO: 1883861 - RNA, 20 nt, Human
agcggggacagcuccuucug

SEQ ID NO: 1883862 - RNA, 19 nt, Human
agcggggacagcuccuucu

SEQ ID NO: 1883863 - RNA, 23 nt, Human
agcggcuggcagcccaccccuca

SEQ ID NO: 1883864 - RNA, 20 nt, Human
agcgggaauggcagcugcca

SEQ ID NO: 1883865 - RNA, 21 nt, Human
agcggcuggacuuggagguag

SEQ ID NO: 1883866 - RNA, 22 nt, Human
agcggggacagcuccuucuguc

SEQ ID NO: 1883867 - RNA, 17 nt, Human
agcgggagccucccugc

SEQ ID NO: 1883868 - RNA, 13 nt, Human
agcggcuggcagc

SEQ ID NO: 1883869 - RNA, 18 nt, Human
ugccagcuuaucucaggg

SEQ ID NO: 1883870 - RNA, 14 nt, Human
ugccagagauccaa

SEQ ID NO: 1883871 - RNA, 21 nt, Human
ugcauuugaggucuguucuuu

SEQ ID NO: 1883872 - RNA, 20 nt, Human
ugcauuugaggucuguucuu

SEQ ID NO: 1883873 - RNA, 15 nt, Human
ugccagcugcacuga

SEQ ID NO: 1883874 - RNA, 20 nt, Human
ugcccuaaaguguauuuuuu

SEQ ID NO: 1883875 - RNA, 23 nt, Human
ugccccgaacauguuuuucuucu

SEQ ID NO: 1883876 - RNA, 12 nt, Human
ugccccauucuu

SEQ ID NO: 1883877 - RNA, 18 nt, Human
ugccccauucuuuuguaa

SEQ ID NO: 1883878 - RNA, 20 nt, Human
ugccccauccuccagcaggg

SEQ ID NO: 1883879 - RNA, 21 nt, Human
ugccccauccuccagcaggga

SEQ ID NO: 1883880 - RNA, 22 nt, Human
ugcccccgcauccccugccucc

SEQ ID NO: 1883881 - RNA, 18 nt, Human
ugcccccgcauccccugc

SEQ ID NO: 1883882 - RNA, 20 nt, Human
ugcccccgcauccccugccu

SEQ ID NO: 1883883 - RNA, 21 nt, Human
ugcccccgcauccccugccuc

SEQ ID NO: 1883884 - RNA, 18 nt, Human
ugcccaggccccugccac

SEQ ID NO: 1883885 - RNA, 17 nt, Human
ugcccaggccccugcca

SEQ ID NO: 1883886 - RNA, 15 nt, Human
ugcccaggccccugc

SEQ ID NO: 1883887 - RNA, 19 nt, Human
ugcccaacccuucccucac

SEQ ID NO: 1883888 - RNA, 17 nt, Human
ugcccaaagaugcagcc

SEQ ID NO: 1883889 - RNA, 20 nt, Human
ugcccaaagaugcagccggu

SEQ ID NO: 1883890 - RNA, 19 nt, Human
ugcccaaaguuuuauuuuu

SEQ ID NO: 1883891 - RNA, 14 nt, Human
ugccauuuugcauu

SEQ ID NO: 1883892 - RNA, 13 nt, Human
ugcccagccccuu

SEQ ID NO: 1883893 - RNA, 12 nt, Human
ugcccagccccu

SEQ ID NO: 1883894 - RNA, 16 nt, Human
ugcccagccccuucug

SEQ ID NO: 1883895 - RNA, 17 nt, Human
ugcccagccccuucuga

SEQ ID NO: 1883896 - RNA, 17 nt, Human
agcucaggugucccugc

SEQ ID NO: 1883897 - RNA, 15 nt, Human
agcuccaagaauuuc

SEQ ID NO: 1883898 - RNA, 22 nt, Human
agcuccaaccugcaaagaucug

SEQ ID NO: 1883899 - RNA, 15 nt, Human
agcuccaagcuccca

SEQ ID NO: 1883900 - RNA, 18 nt, Human
agcuccaagaauuucuag

SEQ ID NO: 1883901 - RNA, 16 nt, Human
agcuccaagcucccag

SEQ ID NO: 1883902 - RNA, 20 nt, Human
agcucagggccuggcucagg

SEQ ID NO: 1883903 - RNA, 14 nt, Human
agcucagggccugg

SEQ ID NO: 1883904 - RNA, 13 nt, Human
agcucaggaucuc

SEQ ID NO: 1883905 - RNA, 19 nt, Human
agcucagggccuggcucag

SEQ ID NO: 1883906 - RNA, 19 nt, Human
agcuauucaguaauaacuc

SEQ ID NO: 1883907 - RNA, 12 nt, Human
agcucagggccu

SEQ ID NO: 1883908 - RNA, 13 nt, Human
agcucagggccug

SEQ ID NO: 1883909 - RNA, 13 nt, Human
agcgugagccacu

SEQ ID NO: 1883910 - RNA, 21 nt, Human
agcuaggccuggccagaugca

SEQ ID NO: 1883911 - RNA, 17 nt, Human
agcuacccgcagaguuc

SEQ ID NO: 1883912 - RNA, 17 nt, Human
agcuaucguaaaauuaa

SEQ ID NO: 1883913 - RNA, 14 nt, Human
aggacugugaugcc

SEQ ID NO: 1883914 - RNA, 20 nt, Human
aggacugugaugcccugccc

SEQ ID NO: 1883915 - RNA, 21 nt, Human
aggacugugaugcccugcccu

SEQ ID NO: 1883916 - RNA, 20 nt, Human
aggacuuccuguccagcucc

SEQ ID NO: 1883917 - RNA, 19 nt, Human
aggacuuauuuaaacucug

SEQ ID NO: 1883918 - RNA, 21 nt, Human
aggacuuccuguccagcucca

SEQ ID NO: 1883919 - RNA, 18 nt, Human
aggacauugcggacagcc

SEQ ID NO: 1883920 - RNA, 17 nt, Human
aggacauugcggacagc

SEQ ID NO: 1883921 - RNA, 15 nt, Human
aggacauugcggaca

SEQ ID NO: 1883922 - RNA, 23 nt, Human
aggacauugcggacagccacggc

SEQ ID NO: 1883923 - RNA, 19 nt, Human
aggacauugcggacagcca

SEQ ID NO: 1883924 - RNA, 20 nt, Human
aggacugaauuaugaaacuu

SEQ ID NO: 1883925 - RNA, 19 nt, Human
aggacugaauuaugaaacu

SEQ ID NO: 1883926 - RNA, 17 nt, Human
aggacuuucugaagccu

SEQ ID NO: 1883927 - RNA, 11 nt, Human
aggagaaacug

SEQ ID NO: 1883928 - RNA, 23 nt, Human
aggacuuuucuuuguggcuuccu

SEQ ID NO: 1883929 - RNA, 17 nt, Human
aggagauuggaaggaac

SEQ ID NO: 1883930 - RNA, 17 nt, Human
aggagaaacuggaacuc

SEQ ID NO: 1883931 - RNA, 22 nt, Human
aggagccccgaggccuucucug

SEQ ID NO: 1883932 - RNA, 18 nt, Human
aggagcauuuuuuaaaaa

SEQ ID NO: 1883933 - RNA, 18 nt, Human
aggagcccugggaggcuc

SEQ ID NO: 1883934 - RNA, 14 nt, Human
aggagcagccacau

SEQ ID NO: 1883935 - RNA, 19 nt, Human
ugcuugggcuucauccucc

SEQ ID NO: 1883936 - RNA, 15 nt, Human
uggaaauauuaagaa

SEQ ID NO: 1883937 - RNA, 21 nt, Human
uggaaaggagccuaggccagg

SEQ ID NO: 1883938 - RNA, 22 nt, Human
uggaaaggagccuaggccaggu

SEQ ID NO: 1883939 - RNA, 21 nt, Human
ugcuuggaggaaggaaaccca

SEQ ID NO: 1883940 - RNA, 12 nt, Human
ugcuugggcuuc

SEQ ID NO: 1883941 - RNA, 16 nt, Human
ugcuugggcuucaucc

SEQ ID NO: 1883942 - RNA, 19 nt, Human
aggagcccugggaggcucu

SEQ ID NO: 1883943 - RNA, 19 nt, Human
aggauuuugauccaagcug

SEQ ID NO: 1883944 - RNA, 15 nt, Human
aggcaaaaauguaaa

SEQ ID NO: 1883945 - RNA, 19 nt, Human
aggaugcccaaagaugcag

SEQ ID NO: 1883946 - RNA, 20 nt, Human
aggaugaucuaggaagacuu

SEQ ID NO: 1883947 - RNA, 14 nt, Human
aggaugcccaaaga

SEQ ID NO: 1883948 - RNA, 17 nt, Human
aggcaacucaucuuagg

SEQ ID NO: 1883949 - RNA, 13 nt, Human
aggcaaaauugca

SEQ ID NO: 1883950 - RNA, 17 nt, Human
aggcaaaauugcaaauc

SEQ ID NO: 1883951 - RNA, 16 nt, Human
aggcaacauccaaaau

SEQ ID NO: 1883952 - RNA, 23 nt, Human
uggaauugauuugcauugaacac

SEQ ID NO: 1883953 - RNA, 22 nt, Human
uggaauuggguggggggcuuca

SEQ ID NO: 1883954 - RNA, 14 nt, Human
uggacccugaggcc

SEQ ID NO: 1883955 - RNA, 12 nt, Human
uggacccugagg

SEQ ID NO: 1883956 - RNA, 13 nt, Human
uggacccugaggc

SEQ ID NO: 1883957 - RNA, 18 nt, Human
uggacacagcucuucucc

SEQ ID NO: 1883958 - RNA, 16 nt, Human
uggacacagcucuucu

SEQ ID NO: 1883959 - RNA, 15 nt, Human
uggacacagcucuuc

SEQ ID NO: 1883960 - RNA, 14 nt, Human
uggacccagacaca

SEQ ID NO: 1883961 - RNA, 16 nt, Human
aggaugaucuaggaag

SEQ ID NO: 1883962 - RNA, 17 nt, Human
aggaugaucuaggaaga

SEQ ID NO: 1883963 - RNA, 18 nt, Human
aggaucuuuguggccaag

SEQ ID NO: 1883964 - RNA, 20 nt, Human
aggaucuuuguggccaagga

SEQ ID NO: 1883965 - RNA, 13 nt, Human
aggaucuuuugaa

SEQ ID NO: 1883966 - RNA, 13 nt, Human
aggaucuuugugg

SEQ ID NO: 1883967 - RNA, 15 nt, Human
aggaucuuuguggcc

SEQ ID NO: 1883968 - RNA, 16 nt, Human
aggaucuuuguggcca

SEQ ID NO: 1883969 - RNA, 17 nt, Human
aggaucuuuguggccaa

SEQ ID NO: 1883970 - RNA, 17 nt, Human
aggauccugagccagau

SEQ ID NO: 1883971 - RNA, 18 nt, Human
aggauccugagccagauu

SEQ ID NO: 1883972 - RNA, 21 nt, Human
aggaucucuugagccugggag

SEQ ID NO: 1883973 - RNA, 22 nt, Human
aggaucucuugagccugggagg

SEQ ID NO: 1883974 - RNA, 21 nt, Human
aggauacaaaagcaugugaga

SEQ ID NO: 1883975 - RNA, 18 nt, Human
aggauaauuagcaucuca

SEQ ID NO: 1883976 - RNA, 15 nt, Human
aggauccugagccag

SEQ ID NO: 1883977 - RNA, 16 nt, Human
aggauccugagccaga

SEQ ID NO: 1883978 - RNA, 20 nt, Human
uggaaauauuaagaaagacu

SEQ ID NO: 1883979 - RNA, 23 nt, Human
uggaaaugggcagagcagagacc

SEQ ID NO: 1883980 - RNA, 22 nt, Human
uggaaauuaggauguaaaucug

SEQ ID NO: 1883981 - RNA, 18 nt, Human
aggagcugccuuggcuca

SEQ ID NO: 1883982 - RNA, 19 nt, Human
aggagcugccuuggcucag

SEQ ID NO: 1883983 - RNA, 11 nt, Human
aggagcugcua

SEQ ID NO: 1883984 - RNA, 23 nt, Human
aggagcugccuuggcucagacau

SEQ ID NO: 1883985 - RNA, 21 nt, Human
aggagcugccuuggcucagac

SEQ ID NO: 1883986 - RNA, 22 nt, Human
aggagcugccuuggcucagaca

SEQ ID NO: 1883987 - RNA, 14 nt, Human
aggaggcaggaccu

SEQ ID NO: 1883988 - RNA, 13 nt, Human
aggagcugcuaua

SEQ ID NO: 1883989 - RNA, 19 nt, Human
aggagcugcuauagccugg

SEQ ID NO: 1883990 - RNA, 20 nt, Human
aggagcugcuauagccuggg

SEQ ID NO: 1883991 - RNA, 21 nt, Human
aggagcugcuauagccugggg

SEQ ID NO: 1883992 - RNA, 11 nt, Human
aggaauuuaaa

SEQ ID NO: 1883993 - RNA, 23 nt, Human
aggaauugacccacaagaaauga

SEQ ID NO: 1883994 - RNA, 23 nt, Human
aggaauuguguuuauaauuuuaa

SEQ ID NO: 1883995 - RNA, 15 nt, Human
aggaauuucccagga

SEQ ID NO: 1883996 - RNA, 17 nt, Human
aggaauuucccaggacc

SEQ ID NO: 1883997 - RNA, 18 nt, Human
aggaauuucccaggaccc

SEQ ID NO: 1883998 - RNA, 19 nt, Human
aggaauuucccaggacccu

SEQ ID NO: 1883999 - RNA, 20 nt, Human
aggaauuucccaggacccug

SEQ ID NO: 1884000 - RNA, 21 nt, Human
aggaauuucccaggacccuga

SEQ ID NO: 1884001 - RNA, 19 nt, Human
aggaaggaaacccagcucu

SEQ ID NO: 1884002 - RNA, 15 nt, Human
aggaaggagaggaga

SEQ ID NO: 1884003 - RNA, 18 nt, Human
aggaaggaaacccagcuc

SEQ ID NO: 1884004 - RNA, 17 nt, Human
aggaagccagcaggcuc

SEQ ID NO: 1884005 - RNA, 18 nt, Human
aggaagccagcaggcucu

SEQ ID NO: 1884006 - RNA, 14 nt, Human
aggaagccagcagg

SEQ ID NO: 1884007 - RNA, 15 nt, Human
aggaagccagcaggc

SEQ ID NO: 1884008 - RNA, 13 nt, Human
aggaagacuuugg

SEQ ID NO: 1884009 - RNA, 14 nt, Human
aggaagacuuugga

SEQ ID NO: 1884010 - RNA, 23 nt, Human
aggaagcacaugccucucucagg

SEQ ID NO: 1884011 - RNA, 24 nt, Human
aggaagcacaugccucucucaggc

SEQ ID NO: 1884012 - RNA, 16 nt, Human
ugcugagucugaaggc

SEQ ID NO: 1884013 - RNA, 17 nt, Human
ugcugagucugaaggcu

SEQ ID NO: 1884014 - RNA, 18 nt, Human
ugcugagucugaaggcug

SEQ ID NO: 1884015 - RNA, 21 nt, Human
ugcugagucugaaggcugggu

SEQ ID NO: 1884016 - RNA, 22 nt, Human
ugcugagucugaaggcuggguu

SEQ ID NO: 1884017 - RNA, 23 nt, Human
ugcugagucugaaggcuggguuc

SEQ ID NO: 1884018 - RNA, 13 nt, Human
aggaagacuucau

SEQ ID NO: 1884019 - RNA, 19 nt, Human
aggaagacuucaucccucu

SEQ ID NO: 1884020 - RNA, 18 nt, Human
agcugggacuacaggcac

SEQ ID NO: 1884021 - RNA, 16 nt, Human
agcugggacuacaggc

SEQ ID NO: 1884022 - RNA, 19 nt, Human
agcugggacuacaggcacc

SEQ ID NO: 1884023 - RNA, 22 nt, Human
ugcuauuguagagccagagguc

SEQ ID NO: 1884024 - RNA, 16 nt, Human
ugcuccagcuguucag

SEQ ID NO: 1884025 - RNA, 19 nt, Human
ugcuccagcuguucagcug

SEQ ID NO: 1884026 - RNA, 20 nt, Human
ugcuccagcuguucagcugg

SEQ ID NO: 1884027 - RNA, 12 nt, Human
ugcuccagaccu

SEQ ID NO: 1884028 - RNA, 14 nt, Human
ugcuccagaccuga

SEQ ID NO: 1884029 - RNA, 21 nt, Human
ugcuccagaccugauccugga

SEQ ID NO: 1884030 - RNA, 22 nt, Human
ugcugacggccagggagaagcu

SEQ ID NO: 1884031 - RNA, 14 nt, Human
ugcugacggccagg

SEQ ID NO: 1884032 - RNA, 15 nt, Human
ugcugacggccaggg

SEQ ID NO: 1884033 - RNA, 17 nt, Human
ugcugacggccagggag

SEQ ID NO: 1884034 - RNA, 20 nt, Human
ugcugacggccagggagaag

SEQ ID NO: 1884035 - RNA, 15 nt, Human
ugcugagucugaagg

SEQ ID NO: 1884036 - RNA, 14 nt, Human
ugcugagucugaag

SEQ ID NO: 1884037 - RNA, 12 nt, Human
ugcucugcuuca

SEQ ID NO: 1884038 - RNA, 16 nt, Human
ugcucugcuugacaac

SEQ ID NO: 1884039 - RNA, 21 nt, Human
ugcucugcuugacaacaucug

SEQ ID NO: 1884040 - RNA, 18 nt, Human
ugcugacauucaccugcc

SEQ ID NO: 1884041 - RNA, 22 nt, Human
ugcucugcugacagacacaggc

SEQ ID NO: 1884042 - RNA, 21 nt, Human
ugcucugcugacagacacagg

SEQ ID NO: 1884043 - RNA, 13 nt, Human
ugcuuauacacuu

SEQ ID NO: 1884044 - RNA, 17 nt, Human
ugcugugaaauucccaa

SEQ ID NO: 1884045 - RNA, 12 nt, Human
ugcuucaaggau

SEQ ID NO: 1884046 - RNA, 14 nt, Human
ugcuucagccuccc

SEQ ID NO: 1884047 - RNA, 13 nt, Human
ugcuucagccucc

SEQ ID NO: 1884048 - RNA, 16 nt, Human
ugcuucaaggauccug

SEQ ID NO: 1884049 - RNA, 18 nt, Human
ugcuucaaggauccugag

SEQ ID NO: 1884050 - RNA, 19 nt, Human
ugcuucaaggauccugagc

SEQ ID NO: 1884051 - RNA, 19 nt, Human
aggacacuaaccacgcugg

SEQ ID NO: 1884052 - RNA, 23 nt, Human
aggacacuaaccacgcuggaccu

SEQ ID NO: 1884053 - RNA, 14 nt, Human
ugcuucaucccuuu

SEQ ID NO: 1884054 - RNA, 16 nt, Human
ugcuucauacagggau

SEQ ID NO: 1884055 - RNA, 15 nt, Human
ugcuucauacaggga

SEQ ID NO: 1884056 - RNA, 14 nt, Human
ugcuucauacaggg

SEQ ID NO: 1884057 - RNA, 11 nt, Human
ugcuucauaca

SEQ ID NO: 1884058 - RNA, 22 nt, Human
aggacagggaggugaccccagg

SEQ ID NO: 1884059 - RNA, 20 nt, Human
aggacauccccccgccaaaa

SEQ ID NO: 1884060 - RNA, 24 nt, Human
aggacauaaugggguccuggccau

SEQ ID NO: 1884061 - RNA, 20 nt, Human
aggacaugcgguagccagca

SEQ ID NO: 1884062 - RNA, 22 nt, Human
aggacaugcgguagccagcaca

SEQ ID NO: 1884063 - RNA, 18 nt, Human
ugcuggcuguuggcuggg

SEQ ID NO: 1884064 - RNA, 16 nt, Human
ugcuggcugguuagag

SEQ ID NO: 1884065 - RNA, 12 nt, Human
ugcuggcccagg

SEQ ID NO: 1884066 - RNA, 13 nt, Human
ugcuggcccaggg

SEQ ID NO: 1884067 - RNA, 14 nt, Human
ugcuggcccagggc

SEQ ID NO: 1884068 - RNA, 16 nt, Human
ugcuggcccagggccc

SEQ ID NO: 1884069 - RNA, 17 nt, Human
ugcuggcccagggccca

SEQ ID NO: 1884070 - RNA, 18 nt, Human
ugcuggcccagggcccag

SEQ ID NO: 1884071 - RNA, 19 nt, Human
ugcuggcccagggcccaga

SEQ ID NO: 1884072 - RNA, 20 nt, Human
ugcuggcccagggcccagag

SEQ ID NO: 1884073 - RNA, 21 nt, Human
ugcuggcccagggcccagagc

SEQ ID NO: 1884074 - RNA, 22 nt, Human
ugcuggcccagggcccagagcc

SEQ ID NO: 1884075 - RNA, 23 nt, Human
ugcuggcccagggcccagagccc

SEQ ID NO: 1884076 - RNA, 12 nt, Human
ugcugcccugug

SEQ ID NO: 1884077 - RNA, 13 nt, Human
ugcugcccuguga

SEQ ID NO: 1884078 - RNA, 14 nt, Human
ugcugcccugugag

SEQ ID NO: 1884079 - RNA, 20 nt, Human
aggaauuuuauuuuuuucug

SEQ ID NO: 1884080 - RNA, 15 nt, Human
ugcugcccugugagu

SEQ ID NO: 1884081 - RNA, 14 nt, Human
ugcuggagcucugc

SEQ ID NO: 1884082 - RNA, 13 nt, Human
ugcuggagcucug

SEQ ID NO: 1884083 - RNA, 12 nt, Human
ugcuguccucag

SEQ ID NO: 1884084 - RNA, 14 nt, Human
ugcuguccucaggu

SEQ ID NO: 1884085 - RNA, 18 nt, Human
ugcuguccucagguggcc

SEQ ID NO: 1884086 - RNA, 21 nt, Human
ugcuguccucagguggccaug

SEQ ID NO: 1884087 - RNA, 19 nt, Human
ugcuguccucagguggcca

SEQ ID NO: 1884088 - RNA, 15 nt, Human
ugcuguacaucuauu

SEQ ID NO: 1884089 - RNA, 16 nt, Human
ugcuguacaucuauuu

SEQ ID NO: 1884090 - RNA, 17 nt, Human
ugcuguacaucuauuuu

SEQ ID NO: 1884091 - RNA, 21 nt, Human
ugcuguacaucuauuuuggau

SEQ ID NO: 1884092 - RNA, 15 nt, Human
ugcuguagacauuug

SEQ ID NO: 1884093 - RNA, 14 nt, Human
aggccuccuggccc

SEQ ID NO: 1884094 - RNA, 21 nt, Human
aggccucucauuccagaggaa

SEQ ID NO: 1884095 - RNA, 13 nt, Human
aggccucgcagga

SEQ ID NO: 1884096 - RNA, 14 nt, Human
aggccucgcaggaa

SEQ ID NO: 1884097 - RNA, 17 nt, Human
aggccucgcaggaagac

SEQ ID NO: 1884098 - RNA, 19 nt, Human
aggccucuggaaagcaaag

SEQ ID NO: 1884099 - RNA, 15 nt, Human
aggccucugugccgc

SEQ ID NO: 1884100 - RNA, 16 nt, Human
aggccucagccagaga

SEQ ID NO: 1884101 - RNA, 14 nt, Human
aggccucagccaga

SEQ ID NO: 1884102 - RNA, 15 nt, Human
aggccucagccagag

SEQ ID NO: 1884103 - RNA, 14 nt, Human
aggccagaccugca

SEQ ID NO: 1884104 - RNA, 15 nt, Human
aggcccaaagccucg

SEQ ID NO: 1884105 - RNA, 13 nt, Human
aggcccaaagccu

SEQ ID NO: 1884106 - RNA, 12 nt, Human
aggcccaaagcc

SEQ ID NO: 1884107 - RNA, 15 nt, Human
aggcccucugcccac

SEQ ID NO: 1884108 - RNA, 13 nt, Human
aggccucagccag

SEQ ID NO: 1884109 - RNA, 13 nt, Human
aggcccucugccc

SEQ ID NO: 1884110 - RNA, 14 nt, Human
aggcccucugccca

SEQ ID NO: 1884111 - RNA, 17 nt, Human
uggccaggcuggucuca

SEQ ID NO: 1884112 - RNA, 15 nt, Human
uggccaggcuggucu

SEQ ID NO: 1884113 - RNA, 15 nt, Human
uggccaaggagcugc

SEQ ID NO: 1884114 - RNA, 16 nt, Human
uggccaaggagcugcu

SEQ ID NO: 1884115 - RNA, 17 nt, Human
uggccaaggagcugcua

SEQ ID NO: 1884116 - RNA, 18 nt, Human
uggccaaggagcugcuau

SEQ ID NO: 1884117 - RNA, 19 nt, Human
uggccaaggagcugcuaua

SEQ ID NO: 1884118 - RNA, 16 nt, Human
uggccaaguucuuagu

SEQ ID NO: 1884119 - RNA, 12 nt, Human
uggcaugggaau

SEQ ID NO: 1884120 - RNA, 15 nt, Human
uggcaugggaaugaa

SEQ ID NO: 1884121 - RNA, 20 nt, Human
aggccugccuccagggcugg

SEQ ID NO: 1884122 - RNA, 19 nt, Human
aggccugccuccagggcug

SEQ ID NO: 1884123 - RNA, 17 nt, Human
aggccugccuccagggc

SEQ ID NO: 1884124 - RNA, 21 nt, Human
aggccugccuccagggcugga

SEQ ID NO: 1884125 - RNA, 16 nt, Human
uggcaugauccaagca

SEQ ID NO: 1884126 - RNA, 18 nt, Human
uggccuggcacacaucag

SEQ ID NO: 1884127 - RNA, 16 nt, Human
uggccuggcacacauc

SEQ ID NO: 1884128 - RNA, 12 nt, Human
uggccuggcaca

SEQ ID NO: 1884129 - RNA, 14 nt, Human
uggccucugcacuc

SEQ ID NO: 1884130 - RNA, 15 nt, Human
uggccucugcacucc

SEQ ID NO: 1884131 - RNA, 17 nt, Human
uggccucugcacucccc

SEQ ID NO: 1884132 - RNA, 18 nt, Human
uggccucugcacuccccu

SEQ ID NO: 1884133 - RNA, 21 nt, Human
aggccuggccagaugcaccag

SEQ ID NO: 1884134 - RNA, 17 nt, Human
aggccuggccagaugca

SEQ ID NO: 1884135 - RNA, 16 nt, Human
aggccuggccagaugc

SEQ ID NO: 1884136 - RNA, 15 nt, Human
aggccuggccagaug

SEQ ID NO: 1884137 - RNA, 23 nt, Human
aggccuggccagaugcaccagcc

SEQ ID NO: 1884138 - RNA, 22 nt, Human
aggccuggccagaugcaccagc

SEQ ID NO: 1884139 - RNA, 12 nt, Human
uggccuggcccc

SEQ ID NO: 1884140 - RNA, 23 nt, Human
aggccugggggcugggcagagga

SEQ ID NO: 1884141 - RNA, 22 nt, Human
uggccgcaccuaaagcagccag

SEQ ID NO: 1884142 - RNA, 21 nt, Human
uggccgcaccuaaagcagcca

SEQ ID NO: 1884143 - RNA, 17 nt, Human
uggccgaguccaagcug

SEQ ID NO: 1884144 - RNA, 19 nt, Human
uggccgaguccaagcuggg

SEQ ID NO: 1884145 - RNA, 23 nt, Human
uggccgcaccuaaagcagccagc

SEQ ID NO: 1884146 - RNA, 23 nt, Human
uggccgcgccaaauaaugucucu

SEQ ID NO: 1884147 - RNA, 22 nt, Human
uggccgcgccaaauaaugucuc

SEQ ID NO: 1884148 - RNA, 21 nt, Human
uggccgcgccaaauaaugucu

SEQ ID NO: 1884149 - RNA, 15 nt, Human
uggccgggaccccga

SEQ ID NO: 1884150 - RNA, 17 nt, Human
uggccgggaccccgagc

SEQ ID NO: 1884151 - RNA, 23 nt, Human
uggccgggaccccgagccuggcu

SEQ ID NO: 1884152 - RNA, 21 nt, Human
uggccccugcccggcugcgga

SEQ ID NO: 1884153 - RNA, 23 nt, Human
uggccaguggcuggaucugugag

SEQ ID NO: 1884154 - RNA, 16 nt, Human
uggccaguggcuggau

SEQ ID NO: 1884155 - RNA, 15 nt, Human
uggccaguggcugga

SEQ ID NO: 1884156 - RNA, 14 nt, Human
uggccaguggcugg

SEQ ID NO: 1884157 - RNA, 14 nt, Human
uggcacccaagacc

SEQ ID NO: 1884158 - RNA, 21 nt, Human
uggcacaucagcacgauuucu

SEQ ID NO: 1884159 - RNA, 15 nt, Human
uggcacccggccccu

SEQ ID NO: 1884160 - RNA, 16 nt, Human
uggcacccggccccug

SEQ ID NO: 1884161 - RNA, 21 nt, Human
uggcagaguugaagacagagc

SEQ ID NO: 1884162 - RNA, 23 nt, Human
uggcacccaagaccucagggcac

SEQ ID NO: 1884163 - RNA, 22 nt, Human
uggcagaguugaagacagagcu

SEQ ID NO: 1884164 - RNA, 12 nt, Human
uggauguucuga

SEQ ID NO: 1884165 - RNA, 22 nt, Human
uggauuaaacuuaaucuaaaug

SEQ ID NO: 1884166 - RNA, 20 nt, Human
uggcacaucagcacgauuuc

SEQ ID NO: 1884167 - RNA, 18 nt, Human
uggcaccagcagccugga

SEQ ID NO: 1884168 - RNA, 13 nt, Human
uggcagccuuggc

SEQ ID NO: 1884169 - RNA, 17 nt, Human
aggccacacucagcaca

SEQ ID NO: 1884170 - RNA, 18 nt, Human
aggccacacucagcacaa

SEQ ID NO: 1884171 - RNA, 12 nt, Human
aggccagagaca

SEQ ID NO: 1884172 - RNA, 12 nt, Human
aggccagaccug

SEQ ID NO: 1884173 - RNA, 19 nt, Human
uggcagccucccauccagg

SEQ ID NO: 1884174 - RNA, 20 nt, Human
uggcagccucccauccaggg

SEQ ID NO: 1884175 - RNA, 21 nt, Human
uggcagccucccauccagggc

SEQ ID NO: 1884176 - RNA, 22 nt, Human
uggcagccucccauccagggcc

SEQ ID NO: 1884177 - RNA, 20 nt, Human
aggccacaagacccuugugg

SEQ ID NO: 1884178 - RNA, 12 nt, Human
uggcagccccug

SEQ ID NO: 1884179 - RNA, 18 nt, Human
uggacgagaaaacaauaa

SEQ ID NO: 1884180 - RNA, 22 nt, Human
uggaccuuuccugaggaagagg

SEQ ID NO: 1884181 - RNA, 11 nt, Human
uggaccugccc

SEQ ID NO: 1884182 - RNA, 13 nt, Human
aggccaaaaaaau

SEQ ID NO: 1884183 - RNA, 16 nt, Human
aggccaaacucaccug

SEQ ID NO: 1884184 - RNA, 18 nt, Human
aggcauuuguuugaacug

SEQ ID NO: 1884185 - RNA, 20 nt, Human
aggccaaacucaccugcccc

SEQ ID NO: 1884186 - RNA, 14 nt, Human
aggccaaaggaagc

SEQ ID NO: 1884187 - RNA, 15 nt, Human
aggccaaaggaagca

SEQ ID NO: 1884188 - RNA, 23 nt, Human
aggccaaaggaagcacaugccuc

SEQ ID NO: 1884189 - RNA, 20 nt, Human
aggccaaaggaagcacaugc

SEQ ID NO: 1884190 - RNA, 22 nt, Human
aggccaacccaaaauaagcagg

SEQ ID NO: 1884191 - RNA, 14 nt, Human
aggccaagaaacgu

SEQ ID NO: 1884192 - RNA, 17 nt, Human
aggccaagaaacgucuu

SEQ ID NO: 1884193 - RNA, 18 nt, Human
aggccaaggugggaggau

SEQ ID NO: 1884194 - RNA, 19 nt, Human
uggaugccugguggcagcu

SEQ ID NO: 1884195 - RNA, 18 nt, Human
uggaugccugguggcagc

SEQ ID NO: 1884196 - RNA, 20 nt, Human
uggaugccugguggcagcug

SEQ ID NO: 1884197 - RNA, 23 nt, Human
uggaugggggaacucagauccag

SEQ ID NO: 1884198 - RNA, 16 nt, Human
uggaguucaucuugaa

SEQ ID NO: 1884199 - RNA, 17 nt, Human
uggaguucaucuugaau

SEQ ID NO: 1884200 - RNA, 15 nt, Human
uggaugccugguggc

SEQ ID NO: 1884201 - RNA, 20 nt, Human
uggaguucaucuugaauugu

SEQ ID NO: 1884202 - RNA, 14 nt, Human
uggagucauucuca

SEQ ID NO: 1884203 - RNA, 15 nt, Human
uggagucauucucau

SEQ ID NO: 1884204 - RNA, 15 nt, Human
aggccacaagacccu

SEQ ID NO: 1884205 - RNA, 21 nt, Human
aggccaagaaacgucuucuaa

SEQ ID NO: 1884206 - RNA, 12 nt, Human
aggcuggcauga

SEQ ID NO: 1884207 - RNA, 16 nt, Human
aggcuggcacaggaca

SEQ ID NO: 1884208 - RNA, 17 nt, Human
aggcuggcacaggacau

SEQ ID NO: 1884209 - RNA, 18 nt, Human
aggcuggcacaggacaug

SEQ ID NO: 1884210 - RNA, 14 nt, Human
aggcuggcacagga

SEQ ID NO: 1884211 - RNA, 17 nt, Human
aggcuggcgugcagugg

SEQ ID NO: 1884212 - RNA, 13 nt, Human
aggcuggcgugca

SEQ ID NO: 1884213 - RNA, 18 nt, Human
aggcucuggagcccacug

SEQ ID NO: 1884214 - RNA, 19 nt, Human
aggcucuggagcccacugu

SEQ ID NO: 1884215 - RNA, 14 nt, Human
aggcucuggagccc

SEQ ID NO: 1884216 - RNA, 15 nt, Human
aggcucuggagccca

SEQ ID NO: 1884217 - RNA, 13 nt, Human
aggcucuggagcc

SEQ ID NO: 1884218 - RNA, 16 nt, Human
aggcucugcccuuggu

SEQ ID NO: 1884219 - RNA, 14 nt, Human
aggcugcuuagaau

SEQ ID NO: 1884220 - RNA, 14 nt, Human
aggcugcuuuccaa

SEQ ID NO: 1884221 - RNA, 13 nt, Human
aggcugcuuucca

SEQ ID NO: 1884222 - RNA, 22 nt, Human
aggcugcuuagaauccaaacuu

SEQ ID NO: 1884223 - RNA, 21 nt, Human
aggcugcuuuccaaagccaau

SEQ ID NO: 1884224 - RNA, 19 nt, Human
aggcugcuuuccaaagcca

SEQ ID NO: 1884225 - RNA, 18 nt, Human
aggcugcuuuccaaagcc

SEQ ID NO: 1884226 - RNA, 17 nt, Human
aggcugcuuuccaaagc

SEQ ID NO: 1884227 - RNA, 15 nt, Human
aggcugcuuuccaaa

SEQ ID NO: 1884228 - RNA, 19 nt, Human
aggcuccuuuagcgcccag

SEQ ID NO: 1884229 - RNA, 12 nt, Human
aggcucgagcau

SEQ ID NO: 1884230 - RNA, 21 nt, Human
aggcucgagcaugccuggaug

SEQ ID NO: 1884231 - RNA, 20 nt, Human
aggcucucaacaggggagag

SEQ ID NO: 1884232 - RNA, 15 nt, Human
aggcucgagcaugcc

SEQ ID NO: 1884233 - RNA, 17 nt, Human
aggcucgagcaugccug

SEQ ID NO: 1884234 - RNA, 18 nt, Human
aggcucgagcaugccugg

SEQ ID NO: 1884235 - RNA, 19 nt, Human
aggcucgagcaugccugga

SEQ ID NO: 1884236 - RNA, 21 nt, Human
aggcucucaggccagcugcuu

SEQ ID NO: 1884237 - RNA, 11 nt, Human
aggcucugccc

SEQ ID NO: 1884238 - RNA, 12 nt, Human
aggcucugcccu

SEQ ID NO: 1884239 - RNA, 13 nt, Human
aggcucugcccuu

SEQ ID NO: 1884240 - RNA, 14 nt, Human
aggcucugcccuug

SEQ ID NO: 1884241 - RNA, 15 nt, Human
aggcucugcccuugg

SEQ ID NO: 1884242 - RNA, 11 nt, Human
aggcucucagg

SEQ ID NO: 1884243 - RNA, 12 nt, Human
aggcucucaggc

SEQ ID NO: 1884244 - RNA, 14 nt, Human
aggcucucaggcca

SEQ ID NO: 1884245 - RNA, 15 nt, Human
aggcucucaggccag

SEQ ID NO: 1884246 - RNA, 16 nt, Human
aggcucucaggccagc

SEQ ID NO: 1884247 - RNA, 18 nt, Human
aggcucucaggccagcug

SEQ ID NO: 1884248 - RNA, 19 nt, Human
aggcucucaggccagcugc

SEQ ID NO: 1884249 - RNA, 20 nt, Human
aggcucucaggccagcugcu

SEQ ID NO: 1884250 - RNA, 20 nt, Human
aggcuggcgugcaguggugc

SEQ ID NO: 1884251 - RNA, 18 nt, Human
aggcuggcgugcaguggu

SEQ ID NO: 1884252 - RNA, 19 nt, Human
aggcuggcuccagaugcag

SEQ ID NO: 1884253 - RNA, 22 nt, Human
uggcuagagguucaaagauauu

SEQ ID NO: 1884254 - RNA, 14 nt, Human
aggcugggagagcc

SEQ ID NO: 1884255 - RNA, 15 nt, Human
uggcuagucaagcuc

SEQ ID NO: 1884256 - RNA, 22 nt, Human
uggcuauuagagaucaaccccu

SEQ ID NO: 1884257 - RNA, 19 nt, Human
uggcuaugcauuugaaaau

SEQ ID NO: 1884258 - RNA, 16 nt, Human
uggcuaugagggccuu

SEQ ID NO: 1884259 - RNA, 14 nt, Human
uggcuaugcauuug

SEQ ID NO: 1884260 - RNA, 22 nt, Human
uggcuagucaagcuccuccucc

SEQ ID NO: 1884261 - RNA, 23 nt, Human
uggcuagucaagcuccuccuccc

SEQ ID NO: 1884262 - RNA, 17 nt, Human
uggcuagucaagcuccu

SEQ ID NO: 1884263 - RNA, 18 nt, Human
uggcuagucaagcuccuc

SEQ ID NO: 1884264 - RNA, 20 nt, Human
uggcuagucaagcuccuccu

SEQ ID NO: 1884265 - RNA, 21 nt, Human
uggcuagucaagcuccuccuc

SEQ ID NO: 1884266 - RNA, 17 nt, Human
uggcuaugcauuugaaa

SEQ ID NO: 1884267 - RNA, 15 nt, Human
uggcuaugcauuuga

SEQ ID NO: 1884268 - RNA, 18 nt, Human
uggcucaaguccucuuuu

SEQ ID NO: 1884269 - RNA, 19 nt, Human
uggcucuuccaggcuggga

SEQ ID NO: 1884270 - RNA, 20 nt, Human
uggcucuuccaggcugggag

SEQ ID NO: 1884271 - RNA, 21 nt, Human
uggcucuuccaggcugggaga

SEQ ID NO: 1884272 - RNA, 12 nt, Human
uggcugcaaagg

SEQ ID NO: 1884273 - RNA, 22 nt, Human
uggcucuugaacugagcuugga

SEQ ID NO: 1884274 - RNA, 16 nt, Human
uggcucuugaacugag

SEQ ID NO: 1884275 - RNA, 14 nt, Human
uggcugcagggagu

SEQ ID NO: 1884276 - RNA, 13 nt, Human
uggcugcagggag

SEQ ID NO: 1884277 - RNA, 15 nt, Human
uggcugcagggaguc

SEQ ID NO: 1884278 - RNA, 18 nt, Human
uggcugccaaugggagcu

SEQ ID NO: 1884279 - RNA, 20 nt, Human
uggcugccaaugggagcuca

SEQ ID NO: 1884280 - RNA, 20 nt, Human
uggcugcaucccccccaccu

SEQ ID NO: 1884281 - RNA, 11 nt, Human
uggcugcugaa

SEQ ID NO: 1884282 - RNA, 22 nt, Human
uggcugccuugugaaggaauua

SEQ ID NO: 1884283 - RNA, 17 nt, Human
uggcugccucauuuaga

SEQ ID NO: 1884284 - RNA, 17 nt, Human
uggcuuaaaacaacacu

SEQ ID NO: 1884285 - RNA, 15 nt, Human
uggcuguuggcuggg

SEQ ID NO: 1884286 - RNA, 13 nt, Human
uggcuguuggcug

SEQ ID NO: 1884287 - RNA, 14 nt, Human
uggcugugucuccc

SEQ ID NO: 1884288 - RNA, 22 nt, Human
uggcuucacggaagagccuugc

SEQ ID NO: 1884289 - RNA, 23 nt, Human
uggcuucacggaagagccuugcg

SEQ ID NO: 1884290 - RNA, 14 nt, Human
uggcuucacuccug

SEQ ID NO: 1884291 - RNA, 16 nt, Human
uggcuucacuccugcu

SEQ ID NO: 1884292 - RNA, 23 nt, Human
uggcuucacuccugcuguaaauu

SEQ ID NO: 1884293 - RNA, 18 nt, Human
uggcuucacuccugcugu

SEQ ID NO: 1884294 - RNA, 19 nt, Human
uggcuucacuccugcugua

SEQ ID NO: 1884295 - RNA, 22 nt, Human
ugggaacuuauuaaauggaaac

SEQ ID NO: 1884296 - RNA, 19 nt, Human
ugggaaggggacccccgcc

SEQ ID NO: 1884297 - RNA, 15 nt, Human
ugggaagugaagacu

SEQ ID NO: 1884298 - RNA, 22 nt, Human
ugggaaggggacccccgccccc

SEQ ID NO: 1884299 - RNA, 16 nt, Human
ugggaaaggggaaguu

SEQ ID NO: 1884300 - RNA, 16 nt, Human
ugggaaaguauucugu

SEQ ID NO: 1884301 - RNA, 18 nt, Human
uucuucuagguucuaaaa

SEQ ID NO: 1884302 - RNA, 21 nt, Human
uucuucuagguucuaaaaauu

SEQ ID NO: 1884303 - RNA, 22 nt, Human
uucuucuccacuuucuagccag

SEQ ID NO: 1884304 - RNA, 11 nt, Human
uucuucucccu

SEQ ID NO: 1884305 - RNA, 20 nt, Human
uucuugccucuguccccuuc

SEQ ID NO: 1884306 - RNA, 18 nt, Human
uucuugccucuguccccu

SEQ ID NO: 1884307 - RNA, 17 nt, Human
uucuugcauauuuugua

SEQ ID NO: 1884308 - RNA, 14 nt, Human
uucuugcauauuuu

SEQ ID NO: 1884309 - RNA, 20 nt, Human
uucuugcauauuuuguaacu

SEQ ID NO: 1884310 - RNA, 12 nt, Human
uucuuucuggcu

SEQ ID NO: 1884311 - RNA, 20 nt, Human
uucuuucuggcuaugcauuu

SEQ ID NO: 1884312 - RNA, 17 nt, Human
uucuuucuggcuaugca

SEQ ID NO: 1884313 - RNA, 22 nt, Human
uucuuaaccagaucauugugaa

SEQ ID NO: 1884314 - RNA, 23 nt, Human
uucuuaaccagaucauugugaaa

SEQ ID NO: 1884315 - RNA, 18 nt, Human
uucuguuuagauaauaca

SEQ ID NO: 1884316 - RNA, 13 nt, Human
uucuguuuagaua

SEQ ID NO: 1884317 - RNA, 12 nt, Human
uucuguuuaacu

SEQ ID NO: 1884318 - RNA, 16 nt, Human
auccaagcaaauguga

SEQ ID NO: 1884319 - RNA, 16 nt, Human
uucugccugcccaggc

SEQ ID NO: 1884320 - RNA, 15 nt, Human
uucugccugcccagg

SEQ ID NO: 1884321 - RNA, 18 nt, Human
uucugccugccagcugca

SEQ ID NO: 1884322 - RNA, 19 nt, Human
uucugccugccagcugcac

SEQ ID NO: 1884323 - RNA, 15 nt, Human
auccaaagcagacag

SEQ ID NO: 1884324 - RNA, 22 nt, Human
uucugccugccagcugcacuga

SEQ ID NO: 1884325 - RNA, 17 nt, Human
auccagguucagcuugu

SEQ ID NO: 1884326 - RNA, 13 nt, Human
auccaauuggaua

SEQ ID NO: 1884327 - RNA, 15 nt, Human
auccaguaucuugaa

SEQ ID NO: 1884328 - RNA, 14 nt, Human
auccaguaucuuga

SEQ ID NO: 1884329 - RNA, 18 nt, Human
aucccaugagccucagca

SEQ ID NO: 1884330 - RNA, 17 nt, Human
aucccaugagccucagc

SEQ ID NO: 1884331 - RNA, 22 nt, Human
aucccugaaggccccgcccagg

SEQ ID NO: 1884332 - RNA, 17 nt, Human
aucccugaaggccccgc

SEQ ID NO: 1884333 - RNA, 16 nt, Human
aucccaugagccucag

SEQ ID NO: 1884334 - RNA, 12 nt, Human
aucccagcccca

SEQ ID NO: 1884335 - RNA, 11 nt, Human
aucccagcccc

SEQ ID NO: 1884336 - RNA, 19 nt, Human
aucccagcacuuugggagg

SEQ ID NO: 1884337 - RNA, 22 nt, Human
aucccagcacuuugggaggcug

SEQ ID NO: 1884338 - RNA, 20 nt, Human
auccauggggcugauuguau

SEQ ID NO: 1884339 - RNA, 18 nt, Human
uucucccugcacaagcca

SEQ ID NO: 1884340 - RNA, 20 nt, Human
uucucccuccuucccuuccu

SEQ ID NO: 1884341 - RNA, 23 nt, Human
uucuccccugcccccaggacugg

SEQ ID NO: 1884342 - RNA, 22 nt, Human
uucuccccugcccccaggacug

SEQ ID NO: 1884343 - RNA, 21 nt, Human
uucuccccugcccccaggacu

SEQ ID NO: 1884344 - RNA, 19 nt, Human
uucuccccugcccccagga

SEQ ID NO: 1884345 - RNA, 18 nt, Human
uucuccccugcccccagg

SEQ ID NO: 1884346 - RNA, 17 nt, Human
uucuccccugcccccag

SEQ ID NO: 1884347 - RNA, 16 nt, Human
uucuccccugccccca

SEQ ID NO: 1884348 - RNA, 15 nt, Human
uucuccccugccccc

SEQ ID NO: 1884349 - RNA, 12 nt, Human
aucauugaaauc

SEQ ID NO: 1884350 - RNA, 13 nt, Human
aucauugaaaucu

SEQ ID NO: 1884351 - RNA, 13 nt, Human
aucauugugaaau

SEQ ID NO: 1884352 - RNA, 15 nt, Human
aucauugugaaauua

SEQ ID NO: 1884353 - RNA, 19 nt, Human
aucauugugaaauuauuca

SEQ ID NO: 1884354 - RNA, 21 nt, Human
uucucuaguuugauuaaauuc

SEQ ID NO: 1884355 - RNA, 12 nt, Human
uucucucaucuc

SEQ ID NO: 1884356 - RNA, 17 nt, Human
uucucucaucucuuagc

SEQ ID NO: 1884357 - RNA, 13 nt, Human
uucucucaucucu

SEQ ID NO: 1884358 - RNA, 23 nt, Human
uucucucaucucuuagcuccccu

SEQ ID NO: 1884359 - RNA, 20 nt, Human
uucucucaucucuuagcucc

SEQ ID NO: 1884360 - RNA, 18 nt, Human
uucugaagcuuuaccagc

SEQ ID NO: 1884361 - RNA, 12 nt, Human
uucuccuuugua

SEQ ID NO: 1884362 - RNA, 14 nt, Human
uucuccuuuguacu

SEQ ID NO: 1884363 - RNA, 17 nt, Human
uucuccuuuguacuuug

SEQ ID NO: 1884364 - RNA, 19 nt, Human
uucugcagccacuauuguu

SEQ ID NO: 1884365 - RNA, 12 nt, Human
uucugccugcca

SEQ ID NO: 1884366 - RNA, 16 nt, Human
uucugccugccagcug

SEQ ID NO: 1884367 - RNA, 17 nt, Human
uucugccugccagcugc

SEQ ID NO: 1884368 - RNA, 17 nt, Human
uucugcauauguugaau

SEQ ID NO: 1884369 - RNA, 21 nt, Human
uucugcauauguugaauacuu

SEQ ID NO: 1884370 - RNA, 22 nt, Human
uucugcauauguugaauacuuu

SEQ ID NO: 1884371 - RNA, 23 nt, Human
uucugcauauguugaauacuuuu

SEQ ID NO: 1884372 - RNA, 15 nt, Human
uucugcaguaaaucu

SEQ ID NO: 1884373 - RNA, 18 nt, Human
uucugcaguaaaucuuuu

SEQ ID NO: 1884374 - RNA, 22 nt, Human
uucugcaguaaaucuuuuacaa

SEQ ID NO: 1884375 - RNA, 20 nt, Human
aucauauaauaaauguacau

SEQ ID NO: 1884376 - RNA, 16 nt, Human
aucauauaauaaaugu

SEQ ID NO: 1884377 - RNA, 15 nt, Human
aucauaaaacuugau

SEQ ID NO: 1884378 - RNA, 23 nt, Human
aucauccacugugccaugugcca

SEQ ID NO: 1884379 - RNA, 21 nt, Human
aucauccacugugccaugugc

SEQ ID NO: 1884380 - RNA, 16 nt, Human
aucauuaggugugacu

SEQ ID NO: 1884381 - RNA, 19 nt, Human
aucauuagggggaacucua

SEQ ID NO: 1884382 - RNA, 20 nt, Human
aucauuaucagccugugcca

SEQ ID NO: 1884383 - RNA, 19 nt, Human
aucagucugauucccaagc

SEQ ID NO: 1884384 - RNA, 15 nt, Human
aucaguguuggccau

SEQ ID NO: 1884385 - RNA, 15 nt, Human
aucaggugcugccau

SEQ ID NO: 1884386 - RNA, 23 nt, Human
aucacuugaacccgggaggcaga

SEQ ID NO: 1884387 - RNA, 19 nt, Human
aucaggugcugccauccag

SEQ ID NO: 1884388 - RNA, 17 nt, Human
aucaggugcugccaucc

SEQ ID NO: 1884389 - RNA, 21 nt, Human
aucacucugugucugaguggc

SEQ ID NO: 1884390 - RNA, 19 nt, Human
uugagaggcccugggguuc

SEQ ID NO: 1884391 - RNA, 24 nt, Human
uugaccauucuccaccugccaggg

SEQ ID NO: 1884392 - RNA, 21 nt, Human
uugagaaauauggacacuuaa

SEQ ID NO: 1884393 - RNA, 18 nt, Human
uugagaacuuuauuucca

SEQ ID NO: 1884394 - RNA, 15 nt, Human
uugagaagaaaacau

SEQ ID NO: 1884395 - RNA, 18 nt, Human
uugagaagaaaacaucua

SEQ ID NO: 1884396 - RNA, 22 nt, Human
uugagaagaccucaccuagaaa

SEQ ID NO: 1884397 - RNA, 18 nt, Human
uugaccauucuccaccug

SEQ ID NO: 1884398 - RNA, 19 nt, Human
uugaccauucuccaccugc

SEQ ID NO: 1884399 - RNA, 13 nt, Human
uugacaucaacug

SEQ ID NO: 1884400 - RNA, 19 nt, Human
uugacagggcacaccgggc

SEQ ID NO: 1884401 - RNA, 19 nt, Human
uugacacuuaaaaaugguu

SEQ ID NO: 1884402 - RNA, 18 nt, Human
uugacacuggaaugaguu

SEQ ID NO: 1884403 - RNA, 12 nt, Human
uugauaaaguaa

SEQ ID NO: 1884404 - RNA, 18 nt, Human
uugaguaaaauaaauauu

SEQ ID NO: 1884405 - RNA, 12 nt, Human
uugaguaaaaua

SEQ ID NO: 1884406 - RNA, 14 nt, Human
uugaguaaaauaaa

SEQ ID NO: 1884407 - RNA, 15 nt, Human
uugaggucuguucuu

SEQ ID NO: 1884408 - RNA, 16 nt, Human
uugaggucuguucuuu

SEQ ID NO: 1884409 - RNA, 13 nt, Human
aucuaagccugaa

SEQ ID NO: 1884410 - RNA, 17 nt, Human
uugacacuuaaaaaugg

SEQ ID NO: 1884411 - RNA, 22 nt, Human
uugaauauaauauauuugugua

SEQ ID NO: 1884412 - RNA, 20 nt, Human
uugaauauaauauauuugug

SEQ ID NO: 1884413 - RNA, 21 nt, Human
uugaauauaauauauuugugu

SEQ ID NO: 1884414 - RNA, 21 nt, Human
uugaauaaaaacuuugcuaaa

SEQ ID NO: 1884415 - RNA, 12 nt, Human
uugaauacuuuu

SEQ ID NO: 1884416 - RNA, 13 nt, Human
uugaauacuuuuu

SEQ ID NO: 1884417 - RNA, 18 nt, Human
uugaauauaaacacuaua

SEQ ID NO: 1884418 - RNA, 16 nt, Human
uugaauauaaacacua

SEQ ID NO: 1884419 - RNA, 15 nt, Human
uugaauauaaacacu

SEQ ID NO: 1884420 - RNA, 23 nt, Human
uugaaggugcugacggccaggga

SEQ ID NO: 1884421 - RNA, 15 nt, Human
uugaagggccagagc

SEQ ID NO: 1884422 - RNA, 17 nt, Human
uugaagggccagagcca

SEQ ID NO: 1884423 - RNA, 19 nt, Human
uugaagggccagagccagg

SEQ ID NO: 1884424 - RNA, 20 nt, Human
uugaagggccagagccaggg

SEQ ID NO: 1884425 - RNA, 15 nt, Human
aucuaaauguugaaa

SEQ ID NO: 1884426 - RNA, 19 nt, Human
aucuaaaagaaaugucuau

SEQ ID NO: 1884427 - RNA, 19 nt, Human
aucuaaauggaaccacucu

SEQ ID NO: 1884428 - RNA, 15 nt, Human
aucgugacaacacuu

SEQ ID NO: 1884429 - RNA, 14 nt, Human
aucgugacaacacu

SEQ ID NO: 1884430 - RNA, 23 nt, Human
aucguccagggagcauuuuccuc

SEQ ID NO: 1884431 - RNA, 14 nt, Human
aucgucacugcuua

SEQ ID NO: 1884432 - RNA, 18 nt, Human
aucgucacugcuuaacuu

SEQ ID NO: 1884433 - RNA, 12 nt, Human
aucguccaggga

SEQ ID NO: 1884434 - RNA, 13 nt, Human
aucguccagggag

SEQ ID NO: 1884435 - RNA, 21 nt, Human
uucuuuucuggaauguaauca

SEQ ID NO: 1884436 - RNA, 20 nt, Human
uucuuuugccguuauuaaaa

SEQ ID NO: 1884437 - RNA, 18 nt, Human
auccucuguacagagccc

SEQ ID NO: 1884438 - RNA, 20 nt, Human
auccucuguacagagcccac

SEQ ID NO: 1884439 - RNA, 13 nt, Human
auccucuucuuuu

SEQ ID NO: 1884440 - RNA, 18 nt, Human
auccucuucuuuuagcag

SEQ ID NO: 1884441 - RNA, 17 nt, Human
auccucuuugagugaag

SEQ ID NO: 1884442 - RNA, 18 nt, Human
auccugaaauagaggcua

SEQ ID NO: 1884443 - RNA, 20 nt, Human
auccucuucuuuuagcagua

SEQ ID NO: 1884444 - RNA, 11 nt, Human
auccugagcca

SEQ ID NO: 1884445 - RNA, 21 nt, Human
auccugaaauagaggcuaaau

SEQ ID NO: 1884446 - RNA, 12 nt, Human
auccugagccag

SEQ ID NO: 1884447 - RNA, 13 nt, Human
auccugagccaga

SEQ ID NO: 1884448 - RNA, 14 nt, Human
auccugagccagau

SEQ ID NO: 1884449 - RNA, 15 nt, Human
auccugagccagauu

SEQ ID NO: 1884450 - RNA, 17 nt, Human
auccugagccagauuuc

SEQ ID NO: 1884451 - RNA, 21 nt, Human
auccugagccagauuucacuc

SEQ ID NO: 1884452 - RNA, 18 nt, Human
auccugaggcuccacuug

SEQ ID NO: 1884453 - RNA, 16 nt, Human
auccugaggcuccacu

SEQ ID NO: 1884454 - RNA, 13 nt, Human
auccugaggcucc

SEQ ID NO: 1884455 - RNA, 11 nt, Human
auccugaggcu

SEQ ID NO: 1884456 - RNA, 13 nt, Human
auccugccccuga

SEQ ID NO: 1884457 - RNA, 22 nt, Human
auccugaggcuccacuuggucu

SEQ ID NO: 1884458 - RNA, 16 nt, Human
auccugcaauuccacu

SEQ ID NO: 1884459 - RNA, 12 nt, Human
aucguaaaauua

SEQ ID NO: 1884460 - RNA, 13 nt, Human
aucguaaaauuaa

SEQ ID NO: 1884461 - RNA, 14 nt, Human
aucguaaaauuaag

SEQ ID NO: 1884462 - RNA, 17 nt, Human
aucguaaaauuaagaaa

SEQ ID NO: 1884463 - RNA, 20 nt, Human
auccuggcugucgagaaaca

SEQ ID NO: 1884464 - RNA, 21 nt, Human
auccugggggacccaauguag

SEQ ID NO: 1884465 - RNA, 23 nt, Human
auccuggcacccggccccugcug

SEQ ID NO: 1884466 - RNA, 22 nt, Human
auccuggcacccggccccugcu

SEQ ID NO: 1884467 - RNA, 19 nt, Human
auccuggaggcccaguuca

SEQ ID NO: 1884468 - RNA, 20 nt, Human
auccuggaggcccaguucac

SEQ ID NO: 1884469 - RNA, 21 nt, Human
auccuggcacccggccccugc

SEQ ID NO: 1884470 - RNA, 20 nt, Human
auccuggcacccggccccug

SEQ ID NO: 1884471 - RNA, 19 nt, Human
auccuggcacccggccccu

SEQ ID NO: 1884472 - RNA, 17 nt, Human
auccuggcacccggccc

SEQ ID NO: 1884473 - RNA, 21 nt, Human
auccugcuucugauaugcagu

SEQ ID NO: 1884474 - RNA, 19 nt, Human
auccugcuucugauaugca

SEQ ID NO: 1884475 - RNA, 15 nt, Human
auccuggaguucugg

SEQ ID NO: 1884476 - RNA, 14 nt, Human
auccuggaggccca

SEQ ID NO: 1884477 - RNA, 15 nt, Human
auccuggaggcccag

SEQ ID NO: 1884478 - RNA, 16 nt, Human
auccuggaggcccagu

SEQ ID NO: 1884479 - RNA, 17 nt, Human
auccuggaggcccaguu

SEQ ID NO: 1884480 - RNA, 13 nt, Human
auauuuacaaaug

SEQ ID NO: 1884481 - RNA, 14 nt, Human
auauuguacaguuu

SEQ ID NO: 1884482 - RNA, 13 nt, Human
auauuguacaguu

SEQ ID NO: 1884483 - RNA, 14 nt, Human
auauugucuuuuug

SEQ ID NO: 1884484 - RNA, 17 nt, Human
auauugucuuuuuguau

SEQ ID NO: 1884485 - RNA, 13 nt, Human
auauuguuuucag

SEQ ID NO: 1884486 - RNA, 17 nt, Human
auauuguuuucagugua

SEQ ID NO: 1884487 - RNA, 15 nt, Human
auauugauaugcuua

SEQ ID NO: 1884488 - RNA, 18 nt, Human
auauucucacagcuccaa

SEQ ID NO: 1884489 - RNA, 12 nt, Human
auauuguacagu

SEQ ID NO: 1884490 - RNA, 17 nt, Human
auauuguaaaacaggua

SEQ ID NO: 1884491 - RNA, 16 nt, Human
auauuguaaaacaggu

SEQ ID NO: 1884492 - RNA, 22 nt, Human
auauugcugauggugcaaugac

SEQ ID NO: 1884493 - RNA, 17 nt, Human
auauugagucaaauggu

SEQ ID NO: 1884494 - RNA, 19 nt, Human
auauuggguuccauucuca

SEQ ID NO: 1884495 - RNA, 16 nt, Human
auauguucugacauaa

SEQ ID NO: 1884496 - RNA, 14 nt, Human
auauguugaauacu

SEQ ID NO: 1884497 - RNA, 19 nt, Human
uucccaggaguucugcuca

SEQ ID NO: 1884498 - RNA, 22 nt, Human
uuccagucuccaccaggaaccu

SEQ ID NO: 1884499 - RNA, 11 nt, Human
uuccagucucc

SEQ ID NO: 1884500 - RNA, 20 nt, Human
uuccagucuccaccaggaac

SEQ ID NO: 1884501 - RNA, 15 nt, Human
uuccagugaggcucu

SEQ ID NO: 1884502 - RNA, 16 nt, Human
uuccagugaggcucug

SEQ ID NO: 1884503 - RNA, 21 nt, Human
uucccagcuacaccuuucucc

SEQ ID NO: 1884504 - RNA, 11 nt, Human
uucccaggacc

SEQ ID NO: 1884505 - RNA, 12 nt, Human
uucccaggaccc

SEQ ID NO: 1884506 - RNA, 13 nt, Human
uucccaggacccu

SEQ ID NO: 1884507 - RNA, 19 nt, Human
uucccaggacccugaaggg

SEQ ID NO: 1884508 - RNA, 20 nt, Human
uucccaggacccugaagggg

SEQ ID NO: 1884509 - RNA, 20 nt, Human
uucccaggaguucugcucau

SEQ ID NO: 1884510 - RNA, 16 nt, Human
auauuaagaaagacua

SEQ ID NO: 1884511 - RNA, 15 nt, Human
auauuaagaaagacu

SEQ ID NO: 1884512 - RNA, 17 nt, Human
auauuaagaaagacuau

SEQ ID NO: 1884513 - RNA, 22 nt, Human
auauuaagaaagacuaucuaaa

SEQ ID NO: 1884514 - RNA, 17 nt, Human
auauuaccacagacaua

SEQ ID NO: 1884515 - RNA, 22 nt, Human
auauuaaagagaaagcccgcuu

SEQ ID NO: 1884516 - RNA, 15 nt, Human
auauguugaauacuu

SEQ ID NO: 1884517 - RNA, 16 nt, Human
auauguugaauacuuu

SEQ ID NO: 1884518 - RNA, 17 nt, Human
auauguugaauacuuuu

SEQ ID NO: 1884519 - RNA, 18 nt, Human
auauguugaauacuuuuu

SEQ ID NO: 1884520 - RNA, 19 nt, Human
aucaauguuucuucuaggu

SEQ ID NO: 1884521 - RNA, 16 nt, Human
aucaauucauaucuau

SEQ ID NO: 1884522 - RNA, 13 nt, Human
aucaauuuaaaaa

SEQ ID NO: 1884523 - RNA, 23 nt, Human
aucaauguaccuuuuuugguagu

SEQ ID NO: 1884524 - RNA, 17 nt, Human
aucacgccacugcacua

SEQ ID NO: 1884525 - RNA, 15 nt, Human
aucacgccacugcac

SEQ ID NO: 1884526 - RNA, 16 nt, Human
aucacucugugucuga

SEQ ID NO: 1884527 - RNA, 20 nt, Human
aucacucugugucugagugg

SEQ ID NO: 1884528 - RNA, 21 nt, Human
aucaacugcaucaagauguga

SEQ ID NO: 1884529 - RNA, 23 nt, Human
auauuuuuuaaaaaucuauauuu

SEQ ID NO: 1884530 - RNA, 17 nt, Human
auauuuuuuaaaaaucu

SEQ ID NO: 1884531 - RNA, 15 nt, Human
uucccuuuuuuuaag

SEQ ID NO: 1884532 - RNA, 13 nt, Human
uuccccuuuugca

SEQ ID NO: 1884533 - RNA, 16 nt, Human
auauuugguuuuccug

SEQ ID NO: 1884534 - RNA, 21 nt, Human
auauuugaauguaugcuucau

SEQ ID NO: 1884535 - RNA, 12 nt, Human
auauuugcacua

SEQ ID NO: 1884536 - RNA, 20 nt, Human
uuccuggcacugcuuccagu

SEQ ID NO: 1884537 - RNA, 22 nt, Human
uuccuggcacugcuuccaguga

SEQ ID NO: 1884538 - RNA, 22 nt, Human
uuccucuuuuuauuuaguuccu

SEQ ID NO: 1884539 - RNA, 22 nt, Human
uuccucuuugcuuugcuuucug

SEQ ID NO: 1884540 - RNA, 16 nt, Human
uuccucuuuucucugc

SEQ ID NO: 1884541 - RNA, 18 nt, Human
uuccugaaacaacuugga

SEQ ID NO: 1884542 - RNA, 19 nt, Human
uuccuggcacugcuuccag

SEQ ID NO: 1884543 - RNA, 12 nt, Human
uuccugaacagg

SEQ ID NO: 1884544 - RNA, 15 nt, Human
uuccucuuugcuuug

SEQ ID NO: 1884545 - RNA, 16 nt, Human
uuccucuuugcuuugc

SEQ ID NO: 1884546 - RNA, 15 nt, Human
uuccucucuccagau

SEQ ID NO: 1884547 - RNA, 14 nt, Human
uuccucucuccaga

SEQ ID NO: 1884548 - RNA, 21 nt, Human
uuccuaaauauauuuuaagac

SEQ ID NO: 1884549 - RNA, 14 nt, Human
uuccuaaggcugca

SEQ ID NO: 1884550 - RNA, 16 nt, Human
auauggccucaagauc

SEQ ID NO: 1884551 - RNA, 15 nt, Human
auauggccucaagau

SEQ ID NO: 1884552 - RNA, 23 nt, Human
auauggccacaguagucuugaug

SEQ ID NO: 1884553 - RNA, 20 nt, Human
auauguggaguucaucuuga

SEQ ID NO: 1884554 - RNA, 21 nt, Human
auauguggaguucaucuugaa

SEQ ID NO: 1884555 - RNA, 17 nt, Human
auauguagcagaaaggc

SEQ ID NO: 1884556 - RNA, 23 nt, Human
auauguaccuaacgaaguauccu

SEQ ID NO: 1884557 - RNA, 20 nt, Human
auauggggaugcagcauuau

SEQ ID NO: 1884558 - RNA, 16 nt, Human
auauggggaugcagca

SEQ ID NO: 1884559 - RNA, 22 nt, Human
uucaugcuguucaugaaagauu

SEQ ID NO: 1884560 - RNA, 20 nt, Human
uucaugcuguucaugaaaga

SEQ ID NO: 1884561 - RNA, 15 nt, Human
uucauuaaaagcuac

SEQ ID NO: 1884562 - RNA, 22 nt, Human
uuccaauuuacauacucugcuu

SEQ ID NO: 1884563 - RNA, 13 nt, Human
uucauucuugaaa

SEQ ID NO: 1884564 - RNA, 19 nt, Human
uucauucuugaaagcugug

SEQ ID NO: 1884565 - RNA, 16 nt, Human
uucauuaauucuauaa

SEQ ID NO: 1884566 - RNA, 21 nt, Human
uuccacaagagcccaggccuc

SEQ ID NO: 1884567 - RNA, 18 nt, Human
uuccaccaucaagccacc

SEQ ID NO: 1884568 - RNA, 13 nt, Human
uuccaggcuggga

SEQ ID NO: 1884569 - RNA, 15 nt, Human
uuccaggcugggaga

SEQ ID NO: 1884570 - RNA, 17 nt, Human
uuccaggcugggagagc

SEQ ID NO: 1884571 - RNA, 18 nt, Human
uuccagguuuaagcuguu

SEQ ID NO: 1884572 - RNA, 17 nt, Human
uuccagguuuaagcugu

SEQ ID NO: 1884573 - RNA, 19 nt, Human
uuccaguacaccuuucagc

SEQ ID NO: 1884574 - RNA, 13 nt, Human
auauaugcuaagu

SEQ ID NO: 1884575 - RNA, 15 nt, Human
uucaucaaugaauga

SEQ ID NO: 1884576 - RNA, 22 nt, Human
auauauguuuuaagaggcaggg

SEQ ID NO: 1884577 - RNA, 21 nt, Human
auauauguuuuaagaggcagg

SEQ ID NO: 1884578 - RNA, 15 nt, Human
auauauuuuaagacg

SEQ ID NO: 1884579 - RNA, 13 nt, Human
auauauuuuaauu

SEQ ID NO: 1884580 - RNA, 9 nt, Human
auauauuuc

SEQ ID NO: 1884581 - RNA, 21 nt, Human
uucaguaacccccacuggacu

SEQ ID NO: 1884582 - RNA, 14 nt, Human
uucaguaagccgug

SEQ ID NO: 1884583 - RNA, 17 nt, Human
uucagguaacaggcaga

SEQ ID NO: 1884584 - RNA, 20 nt, Human
uucauaucuauuuauuaaau

SEQ ID NO: 1884585 - RNA, 16 nt, Human
uucagugauuacuguc

SEQ ID NO: 1884586 - RNA, 17 nt, Human
uucauaguaacuucuua

SEQ ID NO: 1884587 - RNA, 16 nt, Human
uucagugaaagcauca

SEQ ID NO: 1884588 - RNA, 16 nt, Human
uucagaaauguguuau

SEQ ID NO: 1884589 - RNA, 22 nt, Human
uucagauauaaaagacugacca

SEQ ID NO: 1884590 - RNA, 13 nt, Human
uucagaagaaauu

SEQ ID NO: 1884591 - RNA, 18 nt, Human
uucagauaugauucaaau

SEQ ID NO: 1884592 - RNA, 17 nt, Human
uucagauaugauucaaa

SEQ ID NO: 1884593 - RNA, 16 nt, Human
uucagauaugauucaa

SEQ ID NO: 1884594 - RNA, 19 nt, Human
uucagauaugauucaaaug

SEQ ID NO: 1884595 - RNA, 16 nt, Human
uucagauuugccuuau

SEQ ID NO: 1884596 - RNA, 15 nt, Human
uucagccugccuucu

SEQ ID NO: 1884597 - RNA, 20 nt, Human
uucagccugccuucuuuucu

SEQ ID NO: 1884598 - RNA, 14 nt, Human
uucagccaagaauu

SEQ ID NO: 1884599 - RNA, 16 nt, Human
uucagguaacaggcag

SEQ ID NO: 1884600 - RNA, 15 nt, Human
uucagguaacaggca

SEQ ID NO: 1884601 - RNA, 22 nt, Human
uucaggguuggccccugcccgg

SEQ ID NO: 1884602 - RNA, 19 nt, Human
uucaggguuggccccugcc

SEQ ID NO: 1884603 - RNA, 17 nt, Human
uucaggguuggccccug

SEQ ID NO: 1884604 - RNA, 16 nt, Human
uucaggguuggccccu

SEQ ID NO: 1884605 - RNA, 14 nt, Human
uucaggguuggccc

SEQ ID NO: 1884606 - RNA, 16 nt, Human
auggaaccaggcuugg

SEQ ID NO: 1884607 - RNA, 17 nt, Human
auggaaccaggcuugga

SEQ ID NO: 1884608 - RNA, 21 nt, Human
auggaaguacuauaauuuacc

SEQ ID NO: 1884609 - RNA, 18 nt, Human
auggaacacucugagacu

SEQ ID NO: 1884610 - RNA, 17 nt, Human
auggaacacucugagac

SEQ ID NO: 1884611 - RNA, 14 nt, Human
auggaauaacaugu

SEQ ID NO: 1884612 - RNA, 15 nt, Human
auggaauaacaugua

SEQ ID NO: 1884613 - RNA, 22 nt, Human
augcuggcuguuggcugggggc

SEQ ID NO: 1884614 - RNA, 23 nt, Human
augcuguacaucuauuuuggauu

SEQ ID NO: 1884615 - RNA, 19 nt, Human
augcugugcccuaaagugu

SEQ ID NO: 1884616 - RNA, 13 nt, Human
augcugugaaauu

SEQ ID NO: 1884617 - RNA, 17 nt, Human
augcuuagauguuccag

SEQ ID NO: 1884618 - RNA, 19 nt, Human
uuuccagguuuaagcuguu

SEQ ID NO: 1884619 - RNA, 20 nt, Human
uuucauaguuggggucauag

SEQ ID NO: 1884620 - RNA, 12 nt, Human
uuucauaaucuu

SEQ ID NO: 1884621 - RNA, 14 nt, Human
uuucauaaucuuug

SEQ ID NO: 1884622 - RNA, 20 nt, Human
uuucccagcuacaccuuucu

SEQ ID NO: 1884623 - RNA, 11 nt, Human
uuucccaggac

SEQ ID NO: 1884624 - RNA, 14 nt, Human
uuucccaggacccu

SEQ ID NO: 1884625 - RNA, 16 nt, Human
uuucccaggacccuga

SEQ ID NO: 1884626 - RNA, 18 nt, Human
uuucccaggacccugaag

SEQ ID NO: 1884627 - RNA, 15 nt, Human
uuuccagucuccacc

SEQ ID NO: 1884628 - RNA, 20 nt, Human
uuuccagucuccaccaggaa

SEQ ID NO: 1884629 - RNA, 21 nt, Human
uuuccagucuccaccaggaac

SEQ ID NO: 1884630 - RNA, 24 nt, Human
uuucacucuuauugcccacgcugg

SEQ ID NO: 1884631 - RNA, 15 nt, Human
uuucacucuccuugg

SEQ ID NO: 1884632 - RNA, 15 nt, Human
uuucaguuuucagga

SEQ ID NO: 1884633 - RNA, 12 nt, Human
uuucauaaagca

SEQ ID NO: 1884634 - RNA, 17 nt, Human
uuuauuuuuuucugaau

SEQ ID NO: 1884635 - RNA, 14 nt, Human
uuucacucuccuug

SEQ ID NO: 1884636 - RNA, 22 nt, Human
uuucaccccucccuuucucccc

SEQ ID NO: 1884637 - RNA, 20 nt, Human
uuucaccccucccuuucucc

SEQ ID NO: 1884638 - RNA, 18 nt, Human
uuucaccccucccuuucu

SEQ ID NO: 1884639 - RNA, 17 nt, Human
uuucaccccucccuuuc

SEQ ID NO: 1884640 - RNA, 15 nt, Human
uuucaccccucccuu

SEQ ID NO: 1884641 - RNA, 14 nt, Human
uuucaccccucccu

SEQ ID NO: 1884642 - RNA, 13 nt, Human
uuucaccccuccc

SEQ ID NO: 1884643 - RNA, 13 nt, Human
uuuauauauguau

SEQ ID NO: 1884644 - RNA, 17 nt, Human
uuuauaugaagauaagu

SEQ ID NO: 1884645 - RNA, 19 nt, Human
uuuauaugaagauaagugu

SEQ ID NO: 1884646 - RNA, 14 nt, Human
uuuauguacaggau

SEQ ID NO: 1884647 - RNA, 19 nt, Human
uuuauguaguaauugacau

SEQ ID NO: 1884648 - RNA, 19 nt, Human
uuuauuaaauguagaaagu

SEQ ID NO: 1884649 - RNA, 15 nt, Human
uuuauuaaauacaaa

SEQ ID NO: 1884650 - RNA, 21 nt, Human
uuuauuaaauacaaaacuucc

SEQ ID NO: 1884651 - RNA, 19 nt, Human
uuuauuaaaugcccagccc

SEQ ID NO: 1884652 - RNA, 14 nt, Human
uuuaugugaaacau

SEQ ID NO: 1884653 - RNA, 15 nt, Human
uuuaugugaaacaug

SEQ ID NO: 1884654 - RNA, 13 nt, Human
uuuagauaauaca

SEQ ID NO: 1884655 - RNA, 18 nt, Human
uuuagaguugauacuaca

SEQ ID NO: 1884656 - RNA, 15 nt, Human
uuuagauaauacacc

SEQ ID NO: 1884657 - RNA, 18 nt, Human
augcuacacacugcaugu

SEQ ID NO: 1884658 - RNA, 17 nt, Human
augcuacacacugcaug

SEQ ID NO: 1884659 - RNA, 20 nt, Human
uuuaccuuuuuuauacauaa

SEQ ID NO: 1884660 - RNA, 19 nt, Human
uuuaccuuuuuuauacaua

SEQ ID NO: 1884661 - RNA, 14 nt, Human
uuuaccuuuuuuau

SEQ ID NO: 1884662 - RNA, 18 nt, Human
uuuacuaauagacaauuu

SEQ ID NO: 1884663 - RNA, 17 nt, Human
uuuacuaauagacaauu

SEQ ID NO: 1884664 - RNA, 14 nt, Human
uuuacuaauagaca

SEQ ID NO: 1884665 - RNA, 21 nt, Human
uuuaccuuuuuuauacauaaa

SEQ ID NO: 1884666 - RNA, 13 nt, Human
uuuacgcuuugau

SEQ ID NO: 1884667 - RNA, 18 nt, Human
uuuacgcuuugauucaua

SEQ ID NO: 1884668 - RNA, 13 nt, Human
uuuacggacaccc

SEQ ID NO: 1884669 - RNA, 17 nt, Human
uuuacggacacccccuc

SEQ ID NO: 1884670 - RNA, 13 nt, Human
augcuaagugaaa

SEQ ID NO: 1884671 - RNA, 13 nt, Human
augccucagcccu

SEQ ID NO: 1884672 - RNA, 14 nt, Human
augccguuacuuuu

SEQ ID NO: 1884673 - RNA, 20 nt, Human
augccguuacuuuucauauu

SEQ ID NO: 1884674 - RNA, 22 nt, Human
augccguuacuuuucauauuug

SEQ ID NO: 1884675 - RNA, 17 nt, Human
uuuaaagaaaaguuuug

SEQ ID NO: 1884676 - RNA, 15 nt, Human
uuuaaagaaaaguuu

SEQ ID NO: 1884677 - RNA, 13 nt, Human
uuuaaagaaaagu

SEQ ID NO: 1884678 - RNA, 21 nt, Human
uuuaaagaaaaguuuuguaaa

SEQ ID NO: 1884679 - RNA, 17 nt, Human
uuuaaaggcccuaucug

SEQ ID NO: 1884680 - RNA, 16 nt, Human
uuuaaagcuuccauug

SEQ ID NO: 1884681 - RNA, 15 nt, Human
uuuccuuccagccca

SEQ ID NO: 1884682 - RNA, 16 nt, Human
uuuccuuccagcccag

SEQ ID NO: 1884683 - RNA, 23 nt, Human
uuuccuucauucaacccaccugc

SEQ ID NO: 1884684 - RNA, 18 nt, Human
uuuccuucagugccuuau

SEQ ID NO: 1884685 - RNA, 21 nt, Human
uuuccuucagugccuuaugga

SEQ ID NO: 1884686 - RNA, 22 nt, Human
uuuccuucagugccuuauggaa

SEQ ID NO: 1884687 - RNA, 21 nt, Human
uuuccuucauucaacccaccu

SEQ ID NO: 1884688 - RNA, 12 nt, Human
uuuccugugucu

SEQ ID NO: 1884689 - RNA, 17 nt, Human
augggccuccugugugu

SEQ ID NO: 1884690 - RNA, 19 nt, Human
uuuccuuaaauuaucuaaa

SEQ ID NO: 1884691 - RNA, 11 nt, Human
uuuccuucagu

SEQ ID NO: 1884692 - RNA, 13 nt, Human
uuuccuuaaucca

SEQ ID NO: 1884693 - RNA, 16 nt, Human
uuuccuuaauccagcu

SEQ ID NO: 1884694 - RNA, 12 nt, Human
uuuccuucagug

SEQ ID NO: 1884695 - RNA, 15 nt, Human
uuuccuucagugccu

SEQ ID NO: 1884696 - RNA, 19 nt, Human
uuuccuuucauuuacugug

SEQ ID NO: 1884697 - RNA, 18 nt, Human
uuucgcaggauucuuccu

SEQ ID NO: 1884698 - RNA, 22 nt, Human
uuucgcaggauucuuccucccu

SEQ ID NO: 1884699 - RNA, 22 nt, Human
uuucgauucguuaagagagcaa

SEQ ID NO: 1884700 - RNA, 13 nt, Human
uuucguucaguua

SEQ ID NO: 1884701 - RNA, 15 nt, Human
uuucuaaacagagau

SEQ ID NO: 1884702 - RNA, 15 nt, Human
augggccuccugugu

SEQ ID NO: 1884703 - RNA, 15 nt, Human
augggcagagcagag

SEQ ID NO: 1884704 - RNA, 18 nt, Human
augggcacaaagggccca

SEQ ID NO: 1884705 - RNA, 20 nt, Human
augggcacaaagggcccaga

SEQ ID NO: 1884706 - RNA, 13 nt, Human
augggcagagcag

SEQ ID NO: 1884707 - RNA, 14 nt, Human
augggcagagcaga

SEQ ID NO: 1884708 - RNA, 21 nt, Human
augggcaacccccagccugcu

SEQ ID NO: 1884709 - RNA, 19 nt, Human
augggcaacccccagccug

SEQ ID NO: 1884710 - RNA, 23 nt, Human
augggagcugaggccacacucag

SEQ ID NO: 1884711 - RNA, 18 nt, Human
augggcaacccccagccu

SEQ ID NO: 1884712 - RNA, 13 nt, Human
augggagcucaug

SEQ ID NO: 1884713 - RNA, 22 nt, Human
augggaccuauaacugcccagc

SEQ ID NO: 1884714 - RNA, 15 nt, Human
augggaccuauaacu

SEQ ID NO: 1884715 - RNA, 21 nt, Human
auggacccaauauuuaccaga

SEQ ID NO: 1884716 - RNA, 18 nt, Human
auggaauugauuugcauu

SEQ ID NO: 1884717 - RNA, 19 nt, Human
auggaauugauuugcauug

SEQ ID NO: 1884718 - RNA, 19 nt, Human
auggacaugaucuucuuua

SEQ ID NO: 1884719 - RNA, 18 nt, Human
auggccucuucagaucuc

SEQ ID NO: 1884720 - RNA, 18 nt, Human
uuucuggaauguaaucaa

SEQ ID NO: 1884721 - RNA, 15 nt, Human
uuucuuuaaaaaaca

SEQ ID NO: 1884722 - RNA, 15 nt, Human
uuucugcucagcuuc

SEQ ID NO: 1884723 - RNA, 18 nt, Human
uuucugcucagcuucucc

SEQ ID NO: 1884724 - RNA, 19 nt, Human
uuucugcucagcuucuccu

SEQ ID NO: 1884725 - RNA, 19 nt, Human
uuucugcuggaaacagacu

SEQ ID NO: 1884726 - RNA, 22 nt, Human
uuucuuuucuggaauguaauca

SEQ ID NO: 1884727 - RNA, 16 nt, Human
uuucuuucacaaaaaa

SEQ ID NO: 1884728 - RNA, 13 nt, Human
uuucuuuguggcu

SEQ ID NO: 1884729 - RNA, 21 nt, Human
uuucuuuaguuuuugugaagu

SEQ ID NO: 1884730 - RNA, 13 nt, Human
uuucuuuaaugcu

SEQ ID NO: 1884731 - RNA, 18 nt, Human
uuucuuuaaugcuuuuau

SEQ ID NO: 1884732 - RNA, 15 nt, Human
uuucuuucacaaaaa

SEQ ID NO: 1884733 - RNA, 17 nt, Human
uuugaaacacuuugcau

SEQ ID NO: 1884734 - RNA, 19 nt, Human
uuugaaacacuuugcauaa

SEQ ID NO: 1884735 - RNA, 20 nt, Human
uuugaaagccccagaaauca

SEQ ID NO: 1884736 - RNA, 14 nt, Human
auggggcccugccu

SEQ ID NO: 1884737 - RNA, 13 nt, Human
auggggcccugcc

SEQ ID NO: 1884738 - RNA, 23 nt, Human
augggcuggguucuacccaggug

SEQ ID NO: 1884739 - RNA, 15 nt, Human
uuucuccagggucag

SEQ ID NO: 1884740 - RNA, 23 nt, Human
uuucuccauauuagauuuaccca

SEQ ID NO: 1884741 - RNA, 14 nt, Human
uuucugccgcagcc

SEQ ID NO: 1884742 - RNA, 16 nt, Human
uuucugccgcagcccu

SEQ ID NO: 1884743 - RNA, 17 nt, Human
uuucugcauauguugaa

SEQ ID NO: 1884744 - RNA, 13 nt, Human
uuucugcauaugu

SEQ ID NO: 1884745 - RNA, 16 nt, Human
uuucucaaagaaauuu

SEQ ID NO: 1884746 - RNA, 15 nt, Human
uuucucaaagaaauu

SEQ ID NO: 1884747 - RNA, 14 nt, Human
uuucucaaagaaau

SEQ ID NO: 1884748 - RNA, 21 nt, Human
uuucuaugacacaugcaaggu

SEQ ID NO: 1884749 - RNA, 15 nt, Human
uuucuaugacacaug

SEQ ID NO: 1884750 - RNA, 22 nt, Human
uuucuauuaaauuaaauuuugu

SEQ ID NO: 1884751 - RNA, 22 nt, Human
uuucuaggacugaauuaugaaa

SEQ ID NO: 1884752 - RNA, 17 nt, Human
uuucuaggacugaauua

SEQ ID NO: 1884753 - RNA, 21 nt, Human
uuucuaggacugaauuaugaa

SEQ ID NO: 1884754 - RNA, 16 nt, Human
uuucuaaacagagaug

SEQ ID NO: 1884755 - RNA, 18 nt, Human
augagaugccugaagcca

SEQ ID NO: 1884756 - RNA, 24 nt, Human
augagaugauacauccaaagcaga

SEQ ID NO: 1884757 - RNA, 23 nt, Human
augagaugauacauccaaagcag

SEQ ID NO: 1884758 - RNA, 16 nt, Human
augagaggaaaucacc

SEQ ID NO: 1884759 - RNA, 14 nt, Human
augagaggaaauca

SEQ ID NO: 1884760 - RNA, 15 nt, Human
augagaggaaaucac

SEQ ID NO: 1884761 - RNA, 12 nt, Human
augagaggaaau

SEQ ID NO: 1884762 - RNA, 13 nt, Human
augagaggaaauc

SEQ ID NO: 1884763 - RNA, 16 nt, Human
augagccucagcaucc

SEQ ID NO: 1884764 - RNA, 15 nt, Human
augagccucagcauc

SEQ ID NO: 1884765 - RNA, 12 nt, Human
augagccucagc

SEQ ID NO: 1884766 - RNA, 21 nt, Human
augagccaccgcgcccagccu

SEQ ID NO: 1884767 - RNA, 18 nt, Human
augagccaccgcgcccag

SEQ ID NO: 1884768 - RNA, 22 nt, Human
augagcaucaggccaggcccuc

SEQ ID NO: 1884769 - RNA, 15 nt, Human
augagcaucaggcca

SEQ ID NO: 1884770 - RNA, 17 nt, Human
augagauuaauuccuuu

SEQ ID NO: 1884771 - RNA, 16 nt, Human
augagcaucaggccag

SEQ ID NO: 1884772 - RNA, 17 nt, Human
augagcaucaggccagg

SEQ ID NO: 1884773 - RNA, 18 nt, Human
augagcaucaggccaggc

SEQ ID NO: 1884774 - RNA, 19 nt, Human
augagcaucaggccaggcc

SEQ ID NO: 1884775 - RNA, 20 nt, Human
augagcaucaggccaggccc

SEQ ID NO: 1884776 - RNA, 21 nt, Human
augagcaucaggccaggcccu

SEQ ID NO: 1884777 - RNA, 13 nt, Human
uugugaaauuauu

SEQ ID NO: 1884778 - RNA, 19 nt, Human
uugucccggauuuuuguua

SEQ ID NO: 1884779 - RNA, 15 nt, Human
uugucccucugcccc

SEQ ID NO: 1884780 - RNA, 16 nt, Human
uugucccucugcccca

SEQ ID NO: 1884781 - RNA, 18 nt, Human
uugucccugaagagaagg

SEQ ID NO: 1884782 - RNA, 17 nt, Human
uugucccucugccccau

SEQ ID NO: 1884783 - RNA, 17 nt, Human
uugucaccuucaccucc

SEQ ID NO: 1884784 - RNA, 18 nt, Human
uugucacacacuuuggcu

SEQ ID NO: 1884785 - RNA, 15 nt, Human
augauaaaacacaaa

SEQ ID NO: 1884786 - RNA, 17 nt, Human
augaguggcuuuaauga

SEQ ID NO: 1884787 - RNA, 13 nt, Human
augaguuuuuccc

SEQ ID NO: 1884788 - RNA, 18 nt, Human
augagccucagcauccug

SEQ ID NO: 1884789 - RNA, 17 nt, Human
augagccucagcauccu

SEQ ID NO: 1884790 - RNA, 19 nt, Human
augcaccuugugucuguac

SEQ ID NO: 1884791 - RNA, 18 nt, Human
augcaccuugugucugua

SEQ ID NO: 1884792 - RNA, 16 nt, Human
augcaccuugugucug

SEQ ID NO: 1884793 - RNA, 15 nt, Human
augcaccuugugucu

SEQ ID NO: 1884794 - RNA, 19 nt, Human
augcaccuggaauauauaa

SEQ ID NO: 1884795 - RNA, 22 nt, Human
augcaaggucauuuuuuuuaag

SEQ ID NO: 1884796 - RNA, 13 nt, Human
augcaagggacug

SEQ ID NO: 1884797 - RNA, 18 nt, Human
augcaagggacugugugu

SEQ ID NO: 1884798 - RNA, 14 nt, Human
augcaccuggaaua

SEQ ID NO: 1884799 - RNA, 16 nt, Human
augcaccuggaauaua

SEQ ID NO: 1884800 - RNA, 22 nt, Human
augcaaacuuuauuuuguguuu

SEQ ID NO: 1884801 - RNA, 16 nt, Human
augcaaggucauuuuu

SEQ ID NO: 1884802 - RNA, 14 nt, Human
augcaaggucauuu

SEQ ID NO: 1884803 - RNA, 15 nt, Human
augaucuucuuuaua

SEQ ID NO: 1884804 - RNA, 18 nt, Human
augaucuucuuuauaauu

SEQ ID NO: 1884805 - RNA, 16 nt, Human
augcaaaccaucauug

SEQ ID NO: 1884806 - RNA, 18 nt, Human
augcaaaccaucauugaa

SEQ ID NO: 1884807 - RNA, 19 nt, Human
augcaaaccaucauugaaa

SEQ ID NO: 1884808 - RNA, 20 nt, Human
augcaaaccaucauugaaau

SEQ ID NO: 1884809 - RNA, 21 nt, Human
augcaaaccaucauugaaauc

SEQ ID NO: 1884810 - RNA, 22 nt, Human
augcaaaccaucauugaaaucu

SEQ ID NO: 1884811 - RNA, 15 nt, Human
augaucacggcucac

SEQ ID NO: 1884812 - RNA, 19 nt, Human
augaucacggcucacugca

SEQ ID NO: 1884813 - RNA, 18 nt, Human
augaucacggcucacugc

SEQ ID NO: 1884814 - RNA, 23 nt, Human
augaucacggcucacugcagccu

SEQ ID NO: 1884815 - RNA, 16 nt, Human
augauccuaggcauuu

SEQ ID NO: 1884816 - RNA, 14 nt, Human
augaucuucuuuau

SEQ ID NO: 1884817 - RNA, 14 nt, Human
augaucugaaaaau

SEQ ID NO: 1884818 - RNA, 17 nt, Human
uugugaagguggaaaua

SEQ ID NO: 1884819 - RNA, 18 nt, Human
uugugaagguggaaauaa

SEQ ID NO: 1884820 - RNA, 22 nt, Human
uugugaaggccucgcaggaaga

SEQ ID NO: 1884821 - RNA, 19 nt, Human
uugugugugcucugcuuca

SEQ ID NO: 1884822 - RNA, 16 nt, Human
uugugugugggagugu

SEQ ID NO: 1884823 - RNA, 15 nt, Human
uuguuccccuccucc

SEQ ID NO: 1884824 - RNA, 14 nt, Human
uuguuccccuccuc

SEQ ID NO: 1884825 - RNA, 13 nt, Human
uuguuccccuccu

SEQ ID NO: 1884826 - RNA, 13 nt, Human
uugugugugggag

SEQ ID NO: 1884827 - RNA, 10 nt, Human
uugugugugg

SEQ ID NO: 1884828 - RNA, 16 nt, Human
uuguucgggugugcaa

SEQ ID NO: 1884829 - RNA, 17 nt, Human
uuguucgggugugcaau

SEQ ID NO: 1884830 - RNA, 23 nt, Human
uuguuccccuccuccacucuccc

SEQ ID NO: 1884831 - RNA, 20 nt, Human
uuguuccccuccuccacucu

SEQ ID NO: 1884832 - RNA, 19 nt, Human
uuguuccccuccuccacuc

SEQ ID NO: 1884833 - RNA, 18 nt, Human
uuguuccccuccuccacu

SEQ ID NO: 1884834 - RNA, 16 nt, Human
uuguuccccuccucca

SEQ ID NO: 1884835 - RNA, 16 nt, Human
aucuuuucacaaauaa

SEQ ID NO: 1884836 - RNA, 15 nt, Human
aucuuuucacaaaua

SEQ ID NO: 1884837 - RNA, 14 nt, Human
aucuuuucacaaau

SEQ ID NO: 1884838 - RNA, 13 nt, Human
aucuuuucacaaa

SEQ ID NO: 1884839 - RNA, 20 nt, Human
augaaagacuguacaaagua

SEQ ID NO: 1884840 - RNA, 17 nt, Human
aucuuuucacaaauaaa

SEQ ID NO: 1884841 - RNA, 14 nt, Human
augaaaugagguca

SEQ ID NO: 1884842 - RNA, 22 nt, Human
uuggcgcugccccuggcagccc

SEQ ID NO: 1884843 - RNA, 13 nt, Human
aucuuucugcaga

SEQ ID NO: 1884844 - RNA, 17 nt, Human
aucuuugugaaggccuc

SEQ ID NO: 1884845 - RNA, 13 nt, Human
aucuuugugaagg

SEQ ID NO: 1884846 - RNA, 13 nt, Human
aucuuuguggcca

SEQ ID NO: 1884847 - RNA, 14 nt, Human
aucuuuguggccaa

SEQ ID NO: 1884848 - RNA, 15 nt, Human
aucuuuguggccaag

SEQ ID NO: 1884849 - RNA, 22 nt, Human
aucuuuuacaacugccucgaaa

SEQ ID NO: 1884850 - RNA, 16 nt, Human
aucuuuguggccaagg

SEQ ID NO: 1884851 - RNA, 19 nt, Human
aucuuuguggccaaggagc

SEQ ID NO: 1884852 - RNA, 23 nt, Human
aucuuuguggccaaggagcugcu

SEQ ID NO: 1884853 - RNA, 14 nt, Human
uuggcugcagggag

SEQ ID NO: 1884854 - RNA, 23 nt, Human
uuggcuauuagagaucaaccccu

SEQ ID NO: 1884855 - RNA, 11 nt, Human
uuggcugcuga

SEQ ID NO: 1884856 - RNA, 15 nt, Human
uuggcugcugaaggc

SEQ ID NO: 1884857 - RNA, 22 nt, Human
uuggcuaggaccccuccaugug

SEQ ID NO: 1884858 - RNA, 22 nt, Human
uuggcuagagguucaaagauau

SEQ ID NO: 1884859 - RNA, 21 nt, Human
uuggcuagagguucaaagaua

SEQ ID NO: 1884860 - RNA, 18 nt, Human
uuggaaagaguaggaaga

SEQ ID NO: 1884861 - RNA, 23 nt, Human
uuggaaagaguaggaagacuuug

SEQ ID NO: 1884862 - RNA, 19 nt, Human
uuggccugaucagaccacg

SEQ ID NO: 1884863 - RNA, 17 nt, Human
uuggacggcugggcaca

SEQ ID NO: 1884864 - RNA, 19 nt, Human
aucuaauaccucugugugc

SEQ ID NO: 1884865 - RNA, 17 nt, Human
aucuaauaccucugugu

SEQ ID NO: 1884866 - RNA, 15 nt, Human
aucuaauaccucugu

SEQ ID NO: 1884867 - RNA, 20 nt, Human
uugcuaagugaggaugaaaa

SEQ ID NO: 1884868 - RNA, 15 nt, Human
uugcuaucuauugau

SEQ ID NO: 1884869 - RNA, 20 nt, Human
uugcuaugagcuggggaugu

SEQ ID NO: 1884870 - RNA, 19 nt, Human
uugcugaauacagaggcaa

SEQ ID NO: 1884871 - RNA, 23 nt, Human
uugcugaaggcuaaauucacagc

SEQ ID NO: 1884872 - RNA, 17 nt, Human
uugcugauggugcaaug

SEQ ID NO: 1884873 - RNA, 18 nt, Human
uugcugauggugcaauga

SEQ ID NO: 1884874 - RNA, 19 nt, Human
uugcugauggugcaaugac

SEQ ID NO: 1884875 - RNA, 14 nt, Human
uugcugagccucug

SEQ ID NO: 1884876 - RNA, 15 nt, Human
uugcugagccucugc

SEQ ID NO: 1884877 - RNA, 22 nt, Human
uugcugagccucugcuccccag

SEQ ID NO: 1884878 - RNA, 13 nt, Human
uugcuuguucucu

SEQ ID NO: 1884879 - RNA, 17 nt, Human
uuggaaagaguaggaag

SEQ ID NO: 1884880 - RNA, 16 nt, Human
uugcuuuuaaaaucca

SEQ ID NO: 1884881 - RNA, 20 nt, Human
augacacgaauauugcugau

SEQ ID NO: 1884882 - RNA, 19 nt, Human
augacacgaauauugcuga

SEQ ID NO: 1884883 - RNA, 23 nt, Human
augacaaaaucaucuuugugaag

SEQ ID NO: 1884884 - RNA, 17 nt, Human
augacaacuacagaaaa

SEQ ID NO: 1884885 - RNA, 13 nt, Human
uuguaaugaaaac

SEQ ID NO: 1884886 - RNA, 20 nt, Human
uuguaaggaaugauuaauua

SEQ ID NO: 1884887 - RNA, 22 nt, Human
uugggguacccacugcucuggu

SEQ ID NO: 1884888 - RNA, 17 nt, Human
uuggggucuggcagccu

SEQ ID NO: 1884889 - RNA, 19 nt, Human
uugguuaggcauuguggga

SEQ ID NO: 1884890 - RNA, 14 nt, Human
uugguucauuaauu

SEQ ID NO: 1884891 - RNA, 20 nt, Human
uugguucauuaauucuauaa

SEQ ID NO: 1884892 - RNA, 17 nt, Human
uugguuuuguuccccuc

SEQ ID NO: 1884893 - RNA, 14 nt, Human
uugguuuuguuccc

SEQ ID NO: 1884894 - RNA, 22 nt, Human
uuguaagcaugcacaaauucug

SEQ ID NO: 1884895 - RNA, 14 nt, Human
uuguaaggaaugau

SEQ ID NO: 1884896 - RNA, 18 nt, Human
uuguaaaaaaaaaaaaca

SEQ ID NO: 1884897 - RNA, 18 nt, Human
uugguuuuguuccccucc

SEQ ID NO: 1884898 - RNA, 13 nt, Human
augaaccacaucu

SEQ ID NO: 1884899 - RNA, 20 nt, Human
augaaccacaucuugcucug

SEQ ID NO: 1884900 - RNA, 17 nt, Human
uugggguacccacugcu

SEQ ID NO: 1884901 - RNA, 19 nt, Human
uuggggaagaacgaagcca

SEQ ID NO: 1884902 - RNA, 13 nt, Human
uugggccagacau

SEQ ID NO: 1884903 - RNA, 14 nt, Human
uugggccagacaug

SEQ ID NO: 1884904 - RNA, 20 nt, Human
uugggccugcuccagaccug

SEQ ID NO: 1884905 - RNA, 19 nt, Human
auuuuaauuauuauucuuc

SEQ ID NO: 1884906 - RNA, 13 nt, Human
auuuuaauuauua

SEQ ID NO: 1884907 - RNA, 23 nt, Human
auuuuaauuauuauucuucauaa

SEQ ID NO: 1884908 - RNA, 12 nt, Human
auuuuaauucau

SEQ ID NO: 1884909 - RNA, 24 nt, Human
auuuuaauucaucccaacugucuu

SEQ ID NO: 1884910 - RNA, 15 nt, Human
auuuuaauucaguug

SEQ ID NO: 1884911 - RNA, 17 nt, Human
auuuuacauaaauuuag

SEQ ID NO: 1884912 - RNA, 16 nt, Human
auuuuacauaaauuua

SEQ ID NO: 1884913 - RNA, 16 nt, Human
auuuuacuuuuuccug

SEQ ID NO: 1884914 - RNA, 17 nt, Human
auuuuacuuuuuccugg

SEQ ID NO: 1884915 - RNA, 17 nt, Human
auuuuaccuuugacaaa

SEQ ID NO: 1884916 - RNA, 23 nt, Human
auuugugaagguggaaauaaacu

SEQ ID NO: 1884917 - RNA, 14 nt, Human
auuugugauacaau

SEQ ID NO: 1884918 - RNA, 22 nt, Human
auuuucaguuauuauauuuaca

SEQ ID NO: 1884919 - RNA, 13 nt, Human
auuuucauuuguu

SEQ ID NO: 1884920 - RNA, 15 nt, Human
auuuucauuaaaagc

SEQ ID NO: 1884921 - RNA, 15 nt, Human
auuuuccucugcuuu

SEQ ID NO: 1884922 - RNA, 19 nt, Human
auuuuccucugcuuugaaa

SEQ ID NO: 1884923 - RNA, 21 nt, Human
auuuuauuuuuuucugaauua

SEQ ID NO: 1884924 - RNA, 21 nt, Human
auuuucaccuguuuuuaagcu

SEQ ID NO: 1884925 - RNA, 20 nt, Human
auuuucacacaauacaauaa

SEQ ID NO: 1884926 - RNA, 23 nt, Human
auugugaucagaccauaauguua

SEQ ID NO: 1884927 - RNA, 15 nt, Human
auugugauguguccu

SEQ ID NO: 1884928 - RNA, 14 nt, Human
auugugaugugucc

SEQ ID NO: 1884929 - RNA, 13 nt, Human
auugugauguguc

SEQ ID NO: 1884930 - RNA, 17 nt, Human
auuguccccgacccuug

SEQ ID NO: 1884931 - RNA, 19 nt, Human
auuguccccgacccuugcc

SEQ ID NO: 1884932 - RNA, 20 nt, Human
auuguccccgacccuugccg

SEQ ID NO: 1884933 - RNA, 13 nt, Human
auuguauucagag

SEQ ID NO: 1884934 - RNA, 15 nt, Human
auuguauuuguuucu

SEQ ID NO: 1884935 - RNA, 12 nt, Human
auugguguugac

SEQ ID NO: 1884936 - RNA, 18 nt, Human
auugugucucuugguccu

SEQ ID NO: 1884937 - RNA, 14 nt, Human
auugugucucuugg

SEQ ID NO: 1884938 - RNA, 17 nt, Human
auucuccuuguguuacu

SEQ ID NO: 1884939 - RNA, 23 nt, Human
auucuccuucagcccucaccccu

SEQ ID NO: 1884940 - RNA, 17 nt, Human
auucugcaguaaaucuu

SEQ ID NO: 1884941 - RNA, 18 nt, Human
auucugcaguaaaucuuu

SEQ ID NO: 1884942 - RNA, 20 nt, Human
auucugcaguaaaucuuuua

SEQ ID NO: 1884943 - RNA, 21 nt, Human
auucugcaguaaaucuuuuac

SEQ ID NO: 1884944 - RNA, 23 nt, Human
auucugcaguaaaucuuuuacaa

SEQ ID NO: 1884945 - RNA, 12 nt, Human
auucuggaguca

SEQ ID NO: 1884946 - RNA, 24 nt, Human
auucugucucuggauuauauuaug

SEQ ID NO: 1884947 - RNA, 17 nt, Human
auucugucauagaaagu

SEQ ID NO: 1884948 - RNA, 18 nt, Human
auucugucauagaaagug

SEQ ID NO: 1884949 - RNA, 15 nt, Human
auucuuaaaaaaaga

SEQ ID NO: 1884950 - RNA, 22 nt, Human
auucuuccucccucccucuuuc

SEQ ID NO: 1884951 - RNA, 13 nt, Human
auucuucuccacu

SEQ ID NO: 1884952 - RNA, 13 nt, Human
auucuuuuguaau

SEQ ID NO: 1884953 - RNA, 16 nt, Human
auucuuuuguaauuua

SEQ ID NO: 1884954 - RNA, 17 nt, Human
auucuuuuguaauuuaa

SEQ ID NO: 1884955 - RNA, 13 nt, Human
auucuuauuuaau

SEQ ID NO: 1884956 - RNA, 18 nt, Human
auucuuauucaaagaaau

SEQ ID NO: 1884957 - RNA, 14 nt, Human
auucuuauuuaaug

SEQ ID NO: 1884958 - RNA, 18 nt, Human
auucuuauuuaaugaaag

SEQ ID NO: 1884959 - RNA, 16 nt, Human
auucuuauuuuuuaaa

SEQ ID NO: 1884960 - RNA, 18 nt, Human
auugacccacaagaaaug

SEQ ID NO: 1884961 - RNA, 20 nt, Human
auuggguggggggcuucaua

SEQ ID NO: 1884962 - RNA, 22 nt, Human
auuggguggggggcuucauaca

SEQ ID NO: 1884963 - RNA, 18 nt, Human
auugggugggcaggaaaa

SEQ ID NO: 1884964 - RNA, 21 nt, Human
auuggguggggggcuucauac

SEQ ID NO: 1884965 - RNA, 15 nt, Human
auuggggucccucua

SEQ ID NO: 1884966 - RNA, 16 nt, Human
auugggccccugccag

SEQ ID NO: 1884967 - RNA, 15 nt, Human
auugggccccugcca

SEQ ID NO: 1884968 - RNA, 18 nt, Human
auuucauuucaacuguuu

SEQ ID NO: 1884969 - RNA, 16 nt, Human
auuucaaaaugcuuuu

SEQ ID NO: 1884970 - RNA, 13 nt, Human
auuucaaaaugcu

SEQ ID NO: 1884971 - RNA, 14 nt, Human
auuucaaaaugcuu

SEQ ID NO: 1884972 - RNA, 15 nt, Human
auuucaaaaugcuuu

SEQ ID NO: 1884973 - RNA, 21 nt, Human
auuucaaaaugcuuuuuauua

SEQ ID NO: 1884974 - RNA, 19 nt, Human
auuucauuuuuacccuuac

SEQ ID NO: 1884975 - RNA, 21 nt, Human
auuucauuuuguaacaaauga

SEQ ID NO: 1884976 - RNA, 17 nt, Human
auuuccagccaaagccu

SEQ ID NO: 1884977 - RNA, 23 nt, Human
auuucauuuuguaacaaaugaac

SEQ ID NO: 1884978 - RNA, 23 nt, Human
auuucccccaccccauuucucuc

SEQ ID NO: 1884979 - RNA, 21 nt, Human
auuucccccaccccauuucuc

SEQ ID NO: 1884980 - RNA, 13 nt, Human
auuuccagucucc

SEQ ID NO: 1884981 - RNA, 17 nt, Human
auuuccagucuccacca

SEQ ID NO: 1884982 - RNA, 14 nt, Human
auuugaaaauuuug

SEQ ID NO: 1884983 - RNA, 15 nt, Human
auuugaaaauuuuga

SEQ ID NO: 1884984 - RNA, 16 nt, Human
auuugaagaacaugug

SEQ ID NO: 1884985 - RNA, 16 nt, Human
auuuccguuaaaauac

SEQ ID NO: 1884986 - RNA, 15 nt, Human
auuuccguuaaaaua

SEQ ID NO: 1884987 - RNA, 16 nt, Human
auuuccccuuuugcau

SEQ ID NO: 1884988 - RNA, 15 nt, Human
auuuccccuuuugca

SEQ ID NO: 1884989 - RNA, 13 nt, Human
auuuauucugcuc

SEQ ID NO: 1884990 - RNA, 18 nt, Human
auuuauucaauuccucug

SEQ ID NO: 1884991 - RNA, 19 nt, Human
auuuauucaauuccucugg

SEQ ID NO: 1884992 - RNA, 14 nt, Human
auuuauuuauuauu

SEQ ID NO: 1884993 - RNA, 13 nt, Human
auuuauuuacaga

SEQ ID NO: 1884994 - RNA, 23 nt, Human
auuuauuuacagaugaauguauu

SEQ ID NO: 1884995 - RNA, 24 nt, Human
auuuauuuacugagcuucucugug

SEQ ID NO: 1884996 - RNA, 13 nt, Human
auuuauuuauuau

SEQ ID NO: 1884997 - RNA, 15 nt, Human
auuuauuaauugcuu

SEQ ID NO: 1884998 - RNA, 11 nt, Human
auuuauuauuu

SEQ ID NO: 1884999 - RNA, 13 nt, Human
auuuauuauuuau

SEQ ID NO: 1885000 - RNA, 19 nt, Human
auuuauuauuuauuuauua

SEQ ID NO: 1885001 - RNA, 14 nt, Human
auuuauuauuuuca

SEQ ID NO: 1885002 - RNA, 21 nt, Human
auuuauuauuuucaccuguuu

SEQ ID NO: 1885003 - RNA, 17 nt, Human
auuuauaaaaauaaaaa

SEQ ID NO: 1885004 - RNA, 22 nt, Human
auuuauaaaaauaaaaaacacu

SEQ ID NO: 1885005 - RNA, 16 nt, Human
auuuauaaaaaggugu

SEQ ID NO: 1885006 - RNA, 13 nt, Human
auuuaguguucau

SEQ ID NO: 1885007 - RNA, 20 nt, Human
auuuaguaucuuuuuauuca

SEQ ID NO: 1885008 - RNA, 18 nt, Human
auuuaguauuuuguuuca

SEQ ID NO: 1885009 - RNA, 16 nt, Human
auuuagagaggaaaag

SEQ ID NO: 1885010 - RNA, 13 nt, Human
auuuagauaugca

SEQ ID NO: 1885011 - RNA, 12 nt, Human
auuuaacagaaa

SEQ ID NO: 1885012 - RNA, 14 nt, Human
auuuaacagaaaug

SEQ ID NO: 1885013 - RNA, 14 nt, Human
auuuaaaaaaauca

SEQ ID NO: 1885014 - RNA, 22 nt, Human
auuuaaaaacaggcagcucaua

SEQ ID NO: 1885015 - RNA, 18 nt, Human
auuuaaaaauauuuuugg

SEQ ID NO: 1885016 - RNA, 14 nt, Human
auuuaaaaauauuu

SEQ ID NO: 1885017 - RNA, 17 nt, Human
auuuacuucuuauacau

SEQ ID NO: 1885018 - RNA, 12 nt, Human
auuuacuguuuu

SEQ ID NO: 1885019 - RNA, 15 nt, Human
auuuacugugucuuu

SEQ ID NO: 1885020 - RNA, 14 nt, Human
auuuacuucuuaua

SEQ ID NO: 1885021 - RNA, 16 nt, Human
auuuacuucuuauaca

SEQ ID NO: 1885022 - RNA, 15 nt, Human
auuuagaaauauaau

SEQ ID NO: 1885023 - RNA, 22 nt, Human
auuuagaaagaagcccaauauu

SEQ ID NO: 1885024 - RNA, 14 nt, Human
auuuauucugcuca

SEQ ID NO: 1885025 - RNA, 18 nt, Human
auucuaaaugaauguuua

SEQ ID NO: 1885026 - RNA, 17 nt, Human
auucuaaaugaauguuu

SEQ ID NO: 1885027 - RNA, 15 nt, Human
auucuaaaugaaugu

SEQ ID NO: 1885028 - RNA, 15 nt, Human
auucuauaaggccau

SEQ ID NO: 1885029 - RNA, 20 nt, Human
auucuauuuauauguacaug

SEQ ID NO: 1885030 - RNA, 19 nt, Human
auucuccaccugccaggga

SEQ ID NO: 1885031 - RNA, 20 nt, Human
auucuccaccugccagggac

SEQ ID NO: 1885032 - RNA, 22 nt, Human
auucuauuuauauguacaugag

SEQ ID NO: 1885033 - RNA, 13 nt, Human
auucuccugccuc

SEQ ID NO: 1885034 - RNA, 14 nt, Human
auucuccugccuca

SEQ ID NO: 1885035 - RNA, 11 nt, Human
auucuccugcc

SEQ ID NO: 1885036 - RNA, 21 nt, Human
auucuccaccugccagggaca

SEQ ID NO: 1885037 - RNA, 14 nt, Human
auucuccauuuguu

SEQ ID NO: 1885038 - RNA, 16 nt, Human
auucuccauuuguuau

SEQ ID NO: 1885039 - RNA, 18 nt, Human
auucuccauuuguuaucu

SEQ ID NO: 1885040 - RNA, 19 nt, Human
auucuccauuuguuaucug

SEQ ID NO: 1885041 - RNA, 17 nt, Human
auucuccugccucagcc

SEQ ID NO: 1885042 - RNA, 15 nt, Human
auucuccugccucag

SEQ ID NO: 1885043 - RNA, 19 nt, Human
auucuccugccucagccuc

SEQ ID NO: 1885044 - RNA, 20 nt, Human
auucuccugccucagccucc

SEQ ID NO: 1885045 - RNA, 18 nt, Human
auucuccugccucagccu

SEQ ID NO: 1885046 - RNA, 15 nt, Human
auucuccuucagccc

SEQ ID NO: 1885047 - RNA, 14 nt, Human
auucuccuucagcc

SEQ ID NO: 1885048 - RNA, 13 nt, Human
auucuccuucagc

SEQ ID NO: 1885049 - RNA, 16 nt, Human
auucuccuuguguuac

SEQ ID NO: 1885050 - RNA, 22 nt, Human
auucuccuucagcccucacccc

SEQ ID NO: 1885051 - RNA, 18 nt, Human
auucuccuucagcccuca

SEQ ID NO: 1885052 - RNA, 17 nt, Human
auucuccuucagcccuc

SEQ ID NO: 1885053 - RNA, 16 nt, Human
auucuccuucagcccu

SEQ ID NO: 1885054 - RNA, 15 nt, Human
auucccaagcucugc

SEQ ID NO: 1885055 - RNA, 14 nt, Human
auucccaagcucug

SEQ ID NO: 1885056 - RNA, 16 nt, Human
auucccaagcucugcu

SEQ ID NO: 1885057 - RNA, 16 nt, Human
auuccaacacugauuu

SEQ ID NO: 1885058 - RNA, 15 nt, Human
auucaguaauaacuc

SEQ ID NO: 1885059 - RNA, 19 nt, Human
auucaguaauaacucuacc

SEQ ID NO: 1885060 - RNA, 20 nt, Human
auucaggaagcucagggccu

SEQ ID NO: 1885061 - RNA, 18 nt, Human
auucagauaugauucaaa

SEQ ID NO: 1885062 - RNA, 17 nt, Human
auucaggaagcucaggg

SEQ ID NO: 1885063 - RNA, 19 nt, Human
auucaggaagcucagggcc

SEQ ID NO: 1885064 - RNA, 17 nt, Human
auucagaguugaugguu

SEQ ID NO: 1885065 - RNA, 14 nt, Human
auucaggaagcuca

SEQ ID NO: 1885066 - RNA, 13 nt, Human
auucagacaggca

SEQ ID NO: 1885067 - RNA, 14 nt, Human
auucagacaggcaa

SEQ ID NO: 1885068 - RNA, 12 nt, Human
auugaaaucuuu

SEQ ID NO: 1885069 - RNA, 20 nt, Human
auucagauaugauucaaaug

SEQ ID NO: 1885070 - RNA, 12 nt, Human
auguuguuauuu

SEQ ID NO: 1885071 - RNA, 17 nt, Human
auguuguuauuuaaaga

SEQ ID NO: 1885072 - RNA, 15 nt, Human
auguuguuauuuaaa

SEQ ID NO: 1885073 - RNA, 14 nt, Human
auguuguuauuuaa

SEQ ID NO: 1885074 - RNA, 13 nt, Human
auguuguuauuua

SEQ ID NO: 1885075 - RNA, 17 nt, Human
auguuuaguaaucauau

SEQ ID NO: 1885076 - RNA, 23 nt, Human
auuaaaacacaacaucuuuuucu

SEQ ID NO: 1885077 - RNA, 22 nt, Human
auuaaaaaucucaaauuucuaa

SEQ ID NO: 1885078 - RNA, 20 nt, Human
auuaaaaaucucaaauuucu

SEQ ID NO: 1885079 - RNA, 19 nt, Human
auuaaaaaucucaaauuuc

SEQ ID NO: 1885080 - RNA, 15 nt, Human
auuaaaaaucucaaa

SEQ ID NO: 1885081 - RNA, 11 nt, Human
auuaaaaccac

SEQ ID NO: 1885082 - RNA, 23 nt, Human
auuaaacucuucacaaaaucugu

SEQ ID NO: 1885083 - RNA, 14 nt, Human
uuuucaguuuucag

SEQ ID NO: 1885084 - RNA, 12 nt, Human
uuuucaguuuuc

SEQ ID NO: 1885085 - RNA, 11 nt, Human
uuuuauuuuau

SEQ ID NO: 1885086 - RNA, 20 nt, Human
uuuuaggccaaaaaaaugua

SEQ ID NO: 1885087 - RNA, 17 nt, Human
uuuuagggagcuggucu

SEQ ID NO: 1885088 - RNA, 13 nt, Human
uuuuauuaugcau

SEQ ID NO: 1885089 - RNA, 20 nt, Human
uuuucauuuaggugaggaag

SEQ ID NO: 1885090 - RNA, 16 nt, Human
uuuucauauuugcacu

SEQ ID NO: 1885091 - RNA, 18 nt, Human
uuuucauugaacagcaaa

SEQ ID NO: 1885092 - RNA, 21 nt, Human
auguuaaacuuacuuaguguu

SEQ ID NO: 1885093 - RNA, 17 nt, Human
auguucagaagaaauuc

SEQ ID NO: 1885094 - RNA, 16 nt, Human
auguucagaagaaauu

SEQ ID NO: 1885095 - RNA, 15 nt, Human
auguugcauagaaua

SEQ ID NO: 1885096 - RNA, 12 nt, Human
auguugcccagg

SEQ ID NO: 1885097 - RNA, 17 nt, Human
auguugcccaggcaggu

SEQ ID NO: 1885098 - RNA, 17 nt, Human
auguugcauagaauaaa

SEQ ID NO: 1885099 - RNA, 18 nt, Human
auguugcauagaauaaaa

SEQ ID NO: 1885100 - RNA, 18 nt, Human
auguucaucaaugaauga

SEQ ID NO: 1885101 - RNA, 20 nt, Human
auguugcccaggcaggucuu

SEQ ID NO: 1885102 - RNA, 20 nt, Human
auguugcccuguugcugccu

SEQ ID NO: 1885103 - RNA, 22 nt, Human
augugccagguuuuuggucuga

SEQ ID NO: 1885104 - RNA, 13 nt, Human
augugcuacaggg

SEQ ID NO: 1885105 - RNA, 15 nt, Human
augugcuacaggggc

SEQ ID NO: 1885106 - RNA, 19 nt, Human
augugcuacaggggccaga

SEQ ID NO: 1885107 - RNA, 21 nt, Human
augugcuacaggggccagaag

SEQ ID NO: 1885108 - RNA, 14 nt, Human
uuuuaauaaacacu

SEQ ID NO: 1885109 - RNA, 20 nt, Human
auggggcccugccuccuuug

SEQ ID NO: 1885110 - RNA, 10 nt, Human
augugugugu

SEQ ID NO: 1885111 - RNA, 23 nt, Human
auguguguuuuaaaaugagaaau

SEQ ID NO: 1885112 - RNA, 18 nt, Human
auguguguguguugugug

SEQ ID NO: 1885113 - RNA, 24 nt, Human
auguggaguucaucuugaauugua

SEQ ID NO: 1885114 - RNA, 18 nt, Human
auguggcaaggaaaaaca

SEQ ID NO: 1885115 - RNA, 17 nt, Human
auguggauuuuuuccua

SEQ ID NO: 1885116 - RNA, 20 nt, Human
auguggaguucaucuugaau

SEQ ID NO: 1885117 - RNA, 13 nt, Human
auguggaagugug

SEQ ID NO: 1885118 - RNA, 16 nt, Human
auguggaagugugggu

SEQ ID NO: 1885119 - RNA, 15 nt, Human
auguggaaguguggg

SEQ ID NO: 1885120 - RNA, 23 nt, Human
augugcuacaggggccagaagau

SEQ ID NO: 1885121 - RNA, 23 nt, Human
auguggaagugugggucugugug

SEQ ID NO: 1885122 - RNA, 22 nt, Human
auguggaagugugggucugugu

SEQ ID NO: 1885123 - RNA, 23 nt, Human
auuagucauucaauaaauuguaa

SEQ ID NO: 1885124 - RNA, 20 nt, Human
auuacccccuccuucagaca

SEQ ID NO: 1885125 - RNA, 21 nt, Human
auuacccccuccuucagacac

SEQ ID NO: 1885126 - RNA, 19 nt, Human
uuuuugugaaaagcuccau

SEQ ID NO: 1885127 - RNA, 20 nt, Human
uuuuuguagagccagggucu

SEQ ID NO: 1885128 - RNA, 19 nt, Human
uuuuuguagagccaggguc

SEQ ID NO: 1885129 - RNA, 15 nt, Human
uuuuuguguauuugu

SEQ ID NO: 1885130 - RNA, 22 nt, Human
uuuuuauggcuuuugugcauua

SEQ ID NO: 1885131 - RNA, 21 nt, Human
uuuuuauggcuuuugugcauu

SEQ ID NO: 1885132 - RNA, 20 nt, Human
uuuuuauggcuuuugugcau

SEQ ID NO: 1885133 - RNA, 23 nt, Human
uuuuuauugaaucuauuuaagua

SEQ ID NO: 1885134 - RNA, 20 nt, Human
auuaaguuguuaauaaaagu

SEQ ID NO: 1885135 - RNA, 19 nt, Human
auuaaguuguuaauaaaag

SEQ ID NO: 1885136 - RNA, 14 nt, Human
auuaaguacuaugu

SEQ ID NO: 1885137 - RNA, 14 nt, Human
auuaaguuguuaau

SEQ ID NO: 1885138 - RNA, 16 nt, Human
auuaaguacuauguau

SEQ ID NO: 1885139 - RNA, 12 nt, Human
auuaauaaucuu

SEQ ID NO: 1885140 - RNA, 13 nt, Human
auuaauaaucuua

SEQ ID NO: 1885141 - RNA, 16 nt, Human
auuaauaaucuuauua

SEQ ID NO: 1885142 - RNA, 20 nt, Human
auuaauacaaugaugcuauu

SEQ ID NO: 1885143 - RNA, 21 nt, Human
auuacaguggggaaugaagau

SEQ ID NO: 1885144 - RNA, 13 nt, Human
auuacccccuccu

SEQ ID NO: 1885145 - RNA, 18 nt, Human
auuacccccuccuucaga

SEQ ID NO: 1885146 - RNA, 19 nt, Human
auuacccccuccuucagac

SEQ ID NO: 1885147 - RNA, 15 nt, Human
uuuugccauuaaacu

SEQ ID NO: 1885148 - RNA, 23 nt, Human
uuuugccauguuggccaggcugg

SEQ ID NO: 1885149 - RNA, 20 nt, Human
uuuugcaucucacaaacaua

SEQ ID NO: 1885150 - RNA, 15 nt, Human
uuuugcauaauuuca

SEQ ID NO: 1885151 - RNA, 13 nt, Human
uuuugaucuucaa

SEQ ID NO: 1885152 - RNA, 18 nt, Human
uuuugaucuucaacaaau

SEQ ID NO: 1885153 - RNA, 12 nt, Human
uuuugauuaugu

SEQ ID NO: 1885154 - RNA, 19 nt, Human
uuuugaucuucaacaaauu

SEQ ID NO: 1885155 - RNA, 13 nt, Human
auuaaagacagag

SEQ ID NO: 1885156 - RNA, 17 nt, Human
uuuugauccaagcuggu

SEQ ID NO: 1885157 - RNA, 17 nt, Human
uuuugagugccuuacac

SEQ ID NO: 1885158 - RNA, 14 nt, Human
uuuugagcaugggu

SEQ ID NO: 1885159 - RNA, 22 nt, Human
uuuuuagacagagucucacugu

SEQ ID NO: 1885160 - RNA, 22 nt, Human
uuuuuacguuugaagacauugc

SEQ ID NO: 1885161 - RNA, 11 nt, Human
uuuuuacuaau

SEQ ID NO: 1885162 - RNA, 12 nt, Human
uuuuuaucaugu

SEQ ID NO: 1885163 - RNA, 20 nt, Human
uuuuuaucgucacugcuuaa

SEQ ID NO: 1885164 - RNA, 12 nt, Human
uuuuuauggcuu

SEQ ID NO: 1885165 - RNA, 23 nt, Human
uuuuuauacauaaacaagaccac

SEQ ID NO: 1885166 - RNA, 15 nt, Human
uuuuguuccacaagu

SEQ ID NO: 1885167 - RNA, 21 nt, Human
uuuuguuccacaaguuaaaua

SEQ ID NO: 1885168 - RNA, 19 nt, Human
uuuuguuucauauugaugu

SEQ ID NO: 1885169 - RNA, 12 nt, Human
uuuuguuucaua

SEQ ID NO: 1885170 - RNA, 14 nt, Human
uuuugcuguagaag

SEQ ID NO: 1885171 - RNA, 13 nt, Human
uuuugcuguagaa

SEQ ID NO: 1885172 - RNA, 12 nt, Human
uuuugcuguaua

SEQ ID NO: 1885173 - RNA, 13 nt, Human
uuuugcuguauau

SEQ ID NO: 1885174 - RNA, 20 nt, Human
uuuugugcauuaucuagaua

SEQ ID NO: 1885175 - RNA, 17 nt, Human
uuuugugcauuaucuag

SEQ ID NO: 1885176 - RNA, 23 nt, Human
uuuugugcauuaucuagauacug

SEQ ID NO: 1885177 - RNA, 18 nt, Human
uuuuguuaucagucaaua

SEQ ID NO: 1885178 - RNA, 22 nt, Human
cacauaugcaccuugugucugu

SEQ ID NO: 1885179 - RNA, 21 nt, Human
cacauaugcaccuugugucug

SEQ ID NO: 1885180 - RNA, 20 nt, Human
cacauaugcaccuugugucu

SEQ ID NO: 1885181 - RNA, 19 nt, Human
cacauaugcaccuuguguc

SEQ ID NO: 1885182 - RNA, 18 nt, Human
cacauaugcaccuugugu

SEQ ID NO: 1885183 - RNA, 13 nt, Human
cacauaugagggg

SEQ ID NO: 1885184 - RNA, 19 nt, Human
cacauacccucuucaugga

SEQ ID NO: 1885185 - RNA, 22 nt, Human
cacauacccucuucauggaugg

SEQ ID NO: 1885186 - RNA, 22 nt, Human
cacagcuucauuuccugugucu

SEQ ID NO: 1885187 - RNA, 21 nt, Human
cacagcuucauuuccuguguc

SEQ ID NO: 1885188 - RNA, 22 nt, Human
cacagcugggguggggaccuca

SEQ ID NO: 1885189 - RNA, 23 nt, Human
cacagcugggguggggaccucag

SEQ ID NO: 1885190 - RNA, 15 nt, Human
cacaggcagguccag

SEQ ID NO: 1885191 - RNA, 14 nt, Human
cacaggcaggucca

SEQ ID NO: 1885192 - RNA, 11 nt, Human
cacaggcaggu

SEQ ID NO: 1885193 - RNA, 14 nt, Human
cacaguucucuccu

SEQ ID NO: 1885194 - RNA, 15 nt, Human
cacaguucucuccuu

SEQ ID NO: 1885195 - RNA, 18 nt, Human
cacaguucuuugggccag

SEQ ID NO: 1885196 - RNA, 19 nt, Human
cacaguucuuugggccaga

SEQ ID NO: 1885197 - RNA, 20 nt, Human
cacaguucuuugggccagac

SEQ ID NO: 1885198 - RNA, 13 nt, Human
cacagugugaaua

SEQ ID NO: 1885199 - RNA, 22 nt, Human
cacagugugaauaaagugcugc

SEQ ID NO: 1885200 - RNA, 21 nt, Human
cacagugagucgaggacaggg

SEQ ID NO: 1885201 - RNA, 22 nt, Human
cacagugagucgaggacaggga

SEQ ID NO: 1885202 - RNA, 19 nt, Human
cacagugaucaaguuauuu

SEQ ID NO: 1885203 - RNA, 13 nt, Human
cacaguccuuacc

SEQ ID NO: 1885204 - RNA, 15 nt, Human
cacaguccuuaccag

SEQ ID NO: 1885205 - RNA, 21 nt, Human
cacaguccuuaccagcagagc

SEQ ID NO: 1885206 - RNA, 22 nt, Human
cacaguccuuaccagcagagca

SEQ ID NO: 1885207 - RNA, 21 nt, Human
cacaguucuuugggccagaca

SEQ ID NO: 1885208 - RNA, 19 nt, Human
caauguuacuaucugcuuu

SEQ ID NO: 1885209 - RNA, 15 nt, Human
caaugugauaaaacc

SEQ ID NO: 1885210 - RNA, 17 nt, Human
caaugugauaaaacccc

SEQ ID NO: 1885211 - RNA, 23 nt, Human
caauucucauuugucacacacuu

SEQ ID NO: 1885212 - RNA, 16 nt, Human
caauuacaggaaguac

SEQ ID NO: 1885213 - RNA, 17 nt, Human
caaugcacuuuguucug

SEQ ID NO: 1885214 - RNA, 21 nt, Human
caaugacuaauucuugcauau

SEQ ID NO: 1885215 - RNA, 22 nt, Human
caaugcacuuuguucuggcucu

SEQ ID NO: 1885216 - RNA, 19 nt, Human
caaugggagcugaggccac

SEQ ID NO: 1885217 - RNA, 23 nt, Human
caaugggagcugaggccacacuc

SEQ ID NO: 1885218 - RNA, 20 nt, Human
caaugcacuuuguucuggcu

SEQ ID NO: 1885219 - RNA, 21 nt, Human
caaugcacuuuguucuggcuc

SEQ ID NO: 1885220 - RNA, 21 nt, Human
caaugggagcugaggccacac

SEQ ID NO: 1885221 - RNA, 23 nt, Human
caauguagucagaauuagcugcu

SEQ ID NO: 1885222 - RNA, 22 nt, Human
caauguacuaggauacugcugc

SEQ ID NO: 1885223 - RNA, 21 nt, Human
caauguacuaggauacugcug

SEQ ID NO: 1885224 - RNA, 19 nt, Human
caauguagaggggaaaaga

SEQ ID NO: 1885225 - RNA, 12 nt, Human
caauaggaaaaa

SEQ ID NO: 1885226 - RNA, 13 nt, Human
caauaggaaaaac

SEQ ID NO: 1885227 - RNA, 16 nt, Human
caauaauugcagaacu

SEQ ID NO: 1885228 - RNA, 17 nt, Human
caauauucgcuguguca

SEQ ID NO: 1885229 - RNA, 13 nt, Human
caauauagcaaga

SEQ ID NO: 1885230 - RNA, 12 nt, Human
caauauagcaag

SEQ ID NO: 1885231 - RNA, 16 nt, Human
caauauugacuuuguc

SEQ ID NO: 1885232 - RNA, 14 nt, Human
caauauuguacagu

SEQ ID NO: 1885233 - RNA, 17 nt, Human
caauauugacuuugucu

SEQ ID NO: 1885234 - RNA, 14 nt, Human
caauauugacuuug

SEQ ID NO: 1885235 - RNA, 23 nt, Human
caaugaccuuucaauaggaaaaa

SEQ ID NO: 1885236 - RNA, 18 nt, Human
caaugacuuacuguacau

SEQ ID NO: 1885237 - RNA, 17 nt, Human
caaugacuuacuguaca

SEQ ID NO: 1885238 - RNA, 21 nt, Human
caaugaccuuucaauaggaaa

SEQ ID NO: 1885239 - RNA, 14 nt, Human
caaugacuaauucu

SEQ ID NO: 1885240 - RNA, 15 nt, Human
caaugacuuacugua

SEQ ID NO: 1885241 - RNA, 14 nt, Human
caauguucucucuu

SEQ ID NO: 1885242 - RNA, 14 nt, Human
caauaggaaaaacu

SEQ ID NO: 1885243 - RNA, 15 nt, Human
caaggagggcacagg

SEQ ID NO: 1885244 - RNA, 19 nt, Human
caaggagggugagugcaag

SEQ ID NO: 1885245 - RNA, 22 nt, Human
caaggagcugcuauagccuggg

SEQ ID NO: 1885246 - RNA, 20 nt, Human
caaggagggcacaggugucu

SEQ ID NO: 1885247 - RNA, 20 nt, Human
caaggagggugagugcaagg

SEQ ID NO: 1885248 - RNA, 17 nt, Human
caaggcugauuaaacca

SEQ ID NO: 1885249 - RNA, 11 nt, Human
caaggagcugc

SEQ ID NO: 1885250 - RNA, 13 nt, Human
caaggagcugcua

SEQ ID NO: 1885251 - RNA, 14 nt, Human
caaggacuuccugu

SEQ ID NO: 1885252 - RNA, 19 nt, Human
caaggacuuccuguccagc

SEQ ID NO: 1885253 - RNA, 21 nt, Human
caaggacuuccuguccagcuc

SEQ ID NO: 1885254 - RNA, 22 nt, Human
caaggacuuccuguccagcucc

SEQ ID NO: 1885255 - RNA, 23 nt, Human
caaggacuuccuguccagcucca

SEQ ID NO: 1885256 - RNA, 19 nt, Human
caagcuggucccacucagu

SEQ ID NO: 1885257 - RNA, 17 nt, Human
caagcuggucccacuca

SEQ ID NO: 1885258 - RNA, 22 nt, Human
caagccaccaacauacucccau

SEQ ID NO: 1885259 - RNA, 14 nt, Human
caagccagcuggag

SEQ ID NO: 1885260 - RNA, 22 nt, Human
caagccagcgggaauggcagcu

SEQ ID NO: 1885261 - RNA, 18 nt, Human
caagcaggacauggacaa

SEQ ID NO: 1885262 - RNA, 14 nt, Human
caagcaggacaugg

SEQ ID NO: 1885263 - RNA, 22 nt, Human
caagcgauucuucugcuucagc

SEQ ID NO: 1885264 - RNA, 20 nt, Human
caagcgauucuucugcuuca

SEQ ID NO: 1885265 - RNA, 12 nt, Human
caagccugguca

SEQ ID NO: 1885266 - RNA, 19 nt, Human
caagcgauucuucugcuuc

SEQ ID NO: 1885267 - RNA, 21 nt, Human
caagccugaccacgcuuucua

SEQ ID NO: 1885268 - RNA, 17 nt, Human
caagugagagcugggug

SEQ ID NO: 1885269 - RNA, 15 nt, Human
caagugagagcuggg

SEQ ID NO: 1885270 - RNA, 14 nt, Human
caagugagagcugg

SEQ ID NO: 1885271 - RNA, 21 nt, Human
caaguccucuuuucugagagg

SEQ ID NO: 1885272 - RNA, 18 nt, Human
caagugagagcugggugu

SEQ ID NO: 1885273 - RNA, 18 nt, Human
caaguggacucagggcag

SEQ ID NO: 1885274 - RNA, 23 nt, Human
caaguggacucagggcagcgcca

SEQ ID NO: 1885275 - RNA, 12 nt, Human
caaguggaccuu

SEQ ID NO: 1885276 - RNA, 21 nt, Human
caaguggaccuuaggccuucc

SEQ ID NO: 1885277 - RNA, 22 nt, Human
caaguggaccuuaggccuuccu

SEQ ID NO: 1885278 - RNA, 15 nt, Human
caaguggacucaggg

SEQ ID NO: 1885279 - RNA, 16 nt, Human
caaguggacucagggc

SEQ ID NO: 1885280 - RNA, 23 nt, Human
caaguggaccuuaggccuuccuc

SEQ ID NO: 1885281 - RNA, 14 nt, Human
caaguuaaauaaau

SEQ ID NO: 1885282 - RNA, 14 nt, Human
caaguccucuuuuc

SEQ ID NO: 1885283 - RNA, 20 nt, Human
caagguccucugucagucac

SEQ ID NO: 1885284 - RNA, 21 nt, Human
caagguccucugucagucaca

SEQ ID NO: 1885285 - RNA, 22 nt, Human
caagguccucugucagucacag

SEQ ID NO: 1885286 - RNA, 20 nt, Human
caaggucauuuuuuuuaaga

SEQ ID NO: 1885287 - RNA, 14 nt, Human
caaggucauuuuuu

SEQ ID NO: 1885288 - RNA, 18 nt, Human
caaggggcccaaauucuu

SEQ ID NO: 1885289 - RNA, 17 nt, Human
caaggggcccaaauucu

SEQ ID NO: 1885290 - RNA, 12 nt, Human
caaggcugcagu

SEQ ID NO: 1885291 - RNA, 15 nt, Human
caaggcugcagugag

SEQ ID NO: 1885292 - RNA, 23 nt, Human
caaggcugucaauuacaggaagu

SEQ ID NO: 1885293 - RNA, 17 nt, Human
caagcaccuccugccuc

SEQ ID NO: 1885294 - RNA, 16 nt, Human
caagcaccuccugccu

SEQ ID NO: 1885295 - RNA, 15 nt, Human
caagcaccuccugcc

SEQ ID NO: 1885296 - RNA, 23 nt, Human
caagacucugucuaaaaaacaaa

SEQ ID NO: 1885297 - RNA, 16 nt, Human
caagagcccaggccuc

SEQ ID NO: 1885298 - RNA, 16 nt, Human
caagaggcugcagcca

SEQ ID NO: 1885299 - RNA, 19 nt, Human
caagacgcugugcugcccu

SEQ ID NO: 1885300 - RNA, 18 nt, Human
caagacgcugugcugccc

SEQ ID NO: 1885301 - RNA, 23 nt, Human
caagacgcugugcugcccugccc

SEQ ID NO: 1885302 - RNA, 22 nt, Human
caagacucugucuaaaaaacaa

SEQ ID NO: 1885303 - RNA, 15 nt, Human
caagacucugucuca

SEQ ID NO: 1885304 - RNA, 14 nt, Human
caagagcccaggcc

SEQ ID NO: 1885305 - RNA, 15 nt, Human
caagagcccaggccu

SEQ ID NO: 1885306 - RNA, 18 nt, Human
caagacucuuuggacacu

SEQ ID NO: 1885307 - RNA, 20 nt, Human
caagaacuuuccaggaaggc

SEQ ID NO: 1885308 - RNA, 14 nt, Human
caagaccuucuccu

SEQ ID NO: 1885309 - RNA, 16 nt, Human
caagaccuucuccuuc

SEQ ID NO: 1885310 - RNA, 17 nt, Human
caagaccuucuccuuca

SEQ ID NO: 1885311 - RNA, 18 nt, Human
caagaccuucuccuucac

SEQ ID NO: 1885312 - RNA, 16 nt, Human
caagacgcugugcugc

SEQ ID NO: 1885313 - RNA, 17 nt, Human
caagacgcugugcugcc

SEQ ID NO: 1885314 - RNA, 22 nt, Human
caacacucacauuuauucugcu

SEQ ID NO: 1885315 - RNA, 18 nt, Human
caacacucauugaccuga

SEQ ID NO: 1885316 - RNA, 20 nt, Human
caacacucauugaccugagg

SEQ ID NO: 1885317 - RNA, 22 nt, Human
caacacucauugaccugaggcc

SEQ ID NO: 1885318 - RNA, 22 nt, Human
caaccccuucgcuccugugucu

SEQ ID NO: 1885319 - RNA, 21 nt, Human
caacacugauuuccccuuuug

SEQ ID NO: 1885320 - RNA, 23 nt, Human
caacacugauuuccccuuuugca

SEQ ID NO: 1885321 - RNA, 20 nt, Human
caacacugggaaacagaggc

SEQ ID NO: 1885322 - RNA, 13 nt, Human
caacgucugugcc

SEQ ID NO: 1885323 - RNA, 14 nt, Human
caacgucugugcca

SEQ ID NO: 1885324 - RNA, 14 nt, Human
caaccuccugggcu

SEQ ID NO: 1885325 - RNA, 15 nt, Human
caaccuccugggcua

SEQ ID NO: 1885326 - RNA, 22 nt, Human
auuuugguaaaauacuucuuga

SEQ ID NO: 1885327 - RNA, 23 nt, Human
auuuugggguacccacugcucug

SEQ ID NO: 1885328 - RNA, 22 nt, Human
auuuugggguacccacugcucu

SEQ ID NO: 1885329 - RNA, 16 nt, Human
caaaaaaugcuugcuu

SEQ ID NO: 1885330 - RNA, 23 nt, Human
auuuugguuuuguuccccuccuc

SEQ ID NO: 1885331 - RNA, 22 nt, Human
auuuugguuuuguuccccuccu

SEQ ID NO: 1885332 - RNA, 21 nt, Human
auuuugguuuuguuccccucc

SEQ ID NO: 1885333 - RNA, 17 nt, Human
auuuugguuuuguuccc

SEQ ID NO: 1885334 - RNA, 16 nt, Human
auuuugguuuuguucc

SEQ ID NO: 1885335 - RNA, 18 nt, Human
auuuugguccaaguugug

SEQ ID NO: 1885336 - RNA, 14 nt, Human
auuuuggugagaaa

SEQ ID NO: 1885337 - RNA, 15 nt, Human
auuuuggugagaaau

SEQ ID NO: 1885338 - RNA, 16 nt, Human
auuuuggugagaaaug

SEQ ID NO: 1885339 - RNA, 21 nt, Human
auuuuggugagaaaugggacu

SEQ ID NO: 1885340 - RNA, 21 nt, Human
auuuugggguacccacugcuc

SEQ ID NO: 1885341 - RNA, 22 nt, Human
auuuuggagaguuuccugaaac

SEQ ID NO: 1885342 - RNA, 21 nt, Human
auuuuggagaguuuccugaaa

SEQ ID NO: 1885343 - RNA, 20 nt, Human
auuuuggagaguuuccugaa

SEQ ID NO: 1885344 - RNA, 20 nt, Human
caaaaacauggccuuugcuu

SEQ ID NO: 1885345 - RNA, 13 nt, Human
caaaaaggcagga

SEQ ID NO: 1885346 - RNA, 21 nt, Human
caaaaacccagcaacagaaaa

SEQ ID NO: 1885347 - RNA, 22 nt, Human
caaaacugccucaggaggcagg

SEQ ID NO: 1885348 - RNA, 22 nt, Human
caaaacucuccucugcugcugg

SEQ ID NO: 1885349 - RNA, 20 nt, Human
caaaacucuccucugcugcu

SEQ ID NO: 1885350 - RNA, 21 nt, Human
caaaacucuccucugcugcug

SEQ ID NO: 1885351 - RNA, 17 nt, Human
caaaauaaaaaugaggu

SEQ ID NO: 1885352 - RNA, 23 nt, Human
caaaacuucagacauagaauuaa

SEQ ID NO: 1885353 - RNA, 18 nt, Human
caaaacagaggcacuuaa

SEQ ID NO: 1885354 - RNA, 13 nt, Human
caaaacccagacc

SEQ ID NO: 1885355 - RNA, 15 nt, Human
caaaacccagaccug

SEQ ID NO: 1885356 - RNA, 18 nt, Human
caaaacaaaaauuaggua

SEQ ID NO: 1885357 - RNA, 22 nt, Human
caaaacaaaaauuagguauuuu

SEQ ID NO: 1885358 - RNA, 23 nt, Human
caaaacaaaaauuagguauuuug

SEQ ID NO: 1885359 - RNA, 13 nt, Human
caaaacaaaacaa

SEQ ID NO: 1885360 - RNA, 17 nt, Human
caaaacaaaaauuaggu

SEQ ID NO: 1885361 - RNA, 16 nt, Human
caaaaauucucaguuc

SEQ ID NO: 1885362 - RNA, 11 nt, Human
caaaaauuagg

SEQ ID NO: 1885363 - RNA, 16 nt, Human
caaaaauuagguauuu

SEQ ID NO: 1885364 - RNA, 18 nt, Human
caaaaauuagguauuuug

SEQ ID NO: 1885365 - RNA, 15 nt, Human
caaaaauuagccggg

SEQ ID NO: 1885366 - RNA, 17 nt, Human
caaaaauuagccgggca

SEQ ID NO: 1885367 - RNA, 14 nt, Human
caaaaauauuuaua

SEQ ID NO: 1885368 - RNA, 22 nt, Human
caaaaauauuuauaaaacuucu

SEQ ID NO: 1885369 - RNA, 17 nt, Human
caaauuaucaagcuaau

SEQ ID NO: 1885370 - RNA, 16 nt, Human
caaauuaucaagcuaa

SEQ ID NO: 1885371 - RNA, 21 nt, Human
caaauuaucaagcuaauaaaa

SEQ ID NO: 1885372 - RNA, 20 nt, Human
caaauuaucaagcuaauaaa

SEQ ID NO: 1885373 - RNA, 18 nt, Human
caaauuaucaagcuaaua

SEQ ID NO: 1885374 - RNA, 14 nt, Human
caaaugucuauaaa

SEQ ID NO: 1885375 - RNA, 15 nt, Human
caaaugucuauaaac

SEQ ID NO: 1885376 - RNA, 23 nt, Human
caaaugguuuaacuucugccugu

SEQ ID NO: 1885377 - RNA, 11 nt, Human
caaauuucuaa

SEQ ID NO: 1885378 - RNA, 14 nt, Human
caaauuucuaaauc

SEQ ID NO: 1885379 - RNA, 12 nt, Human
caaauuucuaaa

SEQ ID NO: 1885380 - RNA, 21 nt, Human
caaauuguaagcaugcacaaa

SEQ ID NO: 1885381 - RNA, 19 nt, Human
caaaggguaucaggugcug

SEQ ID NO: 1885382 - RNA, 19 nt, Human
caaagugcugggauuacag

SEQ ID NO: 1885383 - RNA, 23 nt, Human
caaagugcugggauuacaggugu

SEQ ID NO: 1885384 - RNA, 20 nt, Human
caaagugcugggauuacagg

SEQ ID NO: 1885385 - RNA, 22 nt, Human
caaagggggaggcuaaagccca

SEQ ID NO: 1885386 - RNA, 20 nt, Human
caaauacgugggcauucaaa

SEQ ID NO: 1885387 - RNA, 22 nt, Human
caaauacgugggcauucaaaug

SEQ ID NO: 1885388 - RNA, 21 nt, Human
caaauacgugggcauucaaau

SEQ ID NO: 1885389 - RNA, 23 nt, Human
caaauacucauuuuaggaaaaaa

SEQ ID NO: 1885390 - RNA, 14 nt, Human
caaauacucuuagg

SEQ ID NO: 1885391 - RNA, 14 nt, Human
caaauggggccaga

SEQ ID NO: 1885392 - RNA, 15 nt, Human
caaauggggccagau

SEQ ID NO: 1885393 - RNA, 16 nt, Human
caaauggggccagauc

SEQ ID NO: 1885394 - RNA, 17 nt, Human
caaauggggccagaucc

SEQ ID NO: 1885395 - RNA, 18 nt, Human
caaauggggccagaucca

SEQ ID NO: 1885396 - RNA, 19 nt, Human
caaauggggccagauccag

SEQ ID NO: 1885397 - RNA, 20 nt, Human
caaauggggccagauccagc

SEQ ID NO: 1885398 - RNA, 23 nt, Human
caaauggggccagauccagccug

SEQ ID NO: 1885399 - RNA, 13 nt, Human
caaaugguaggca

SEQ ID NO: 1885400 - RNA, 15 nt, Human
caaaugguaggcauu

SEQ ID NO: 1885401 - RNA, 20 nt, Human
caaaugguaggcauuuccua

SEQ ID NO: 1885402 - RNA, 15 nt, Human
caaaauguaggguua

SEQ ID NO: 1885403 - RNA, 18 nt, Human
caaaauggauaaaaucug

SEQ ID NO: 1885404 - RNA, 23 nt, Human
caaaauggauaaaaucugauaug

SEQ ID NO: 1885405 - RNA, 14 nt, Human
caaaauaaaacuuu

SEQ ID NO: 1885406 - RNA, 12 nt, Human
caaaauaaaacu

SEQ ID NO: 1885407 - RNA, 18 nt, Human
caaaaugcucuagugccu

SEQ ID NO: 1885408 - RNA, 18 nt, Human
caaaaugcuuuuuauuuc

SEQ ID NO: 1885409 - RNA, 20 nt, Human
caaaaugcuuuuuauuucug

SEQ ID NO: 1885410 - RNA, 23 nt, Human
caaaaugcuuuuuauuucugcau

SEQ ID NO: 1885411 - RNA, 15 nt, Human
caaaauggauaaaau

SEQ ID NO: 1885412 - RNA, 16 nt, Human
caaaauuguuacaaau

SEQ ID NO: 1885413 - RNA, 16 nt, Human
caaaauugcaaaucuu

SEQ ID NO: 1885414 - RNA, 17 nt, Human
caaaauugcaaaucuug

SEQ ID NO: 1885415 - RNA, 15 nt, Human
caaacacauacagga

SEQ ID NO: 1885416 - RNA, 23 nt, Human
caaacacauuaagccuuccacac

SEQ ID NO: 1885417 - RNA, 22 nt, Human
caaaauugcaaaucuugaaauu

SEQ ID NO: 1885418 - RNA, 14 nt, Human
caaacccuucagug

SEQ ID NO: 1885419 - RNA, 20 nt, Human
caaacccuucagugccaaaa

SEQ ID NO: 1885420 - RNA, 13 nt, Human
caaacacauuaag

SEQ ID NO: 1885421 - RNA, 14 nt, Human
caaacgccuccccu

SEQ ID NO: 1885422 - RNA, 17 nt, Human
caaacgccuccccugcc

SEQ ID NO: 1885423 - RNA, 15 nt, Human
caaagcuaggccugg

SEQ ID NO: 1885424 - RNA, 20 nt, Human
caaagcgaauuuuaaaagau

SEQ ID NO: 1885425 - RNA, 19 nt, Human
caaagcuaggccuggccag

SEQ ID NO: 1885426 - RNA, 14 nt, Human
caaagcuaggccug

SEQ ID NO: 1885427 - RNA, 13 nt, Human
caaagcuaggccu

SEQ ID NO: 1885428 - RNA, 12 nt, Human
caaaggaagcac

SEQ ID NO: 1885429 - RNA, 13 nt, Human
caaaggaagcaca

SEQ ID NO: 1885430 - RNA, 18 nt, Human
caaaggguaucaggugcu

SEQ ID NO: 1885431 - RNA, 16 nt, Human
caaaggguaucaggug

SEQ ID NO: 1885432 - RNA, 22 nt, Human
caaaggccagaccugcagacgc

SEQ ID NO: 1885433 - RNA, 14 nt, Human
caaaggaagcacau

SEQ ID NO: 1885434 - RNA, 18 nt, Human
caaaggccagaccugcag

SEQ ID NO: 1885435 - RNA, 19 nt, Human
caaaggccagaccugcaga

SEQ ID NO: 1885436 - RNA, 20 nt, Human
caaaggccagaccugcagac

SEQ ID NO: 1885437 - RNA, 21 nt, Human
caaaggccagaccugcagacg

SEQ ID NO: 1885438 - RNA, 17 nt, Human
caaacucaccugccccu

SEQ ID NO: 1885439 - RNA, 20 nt, Human
caaacuaggggacaaagcaa

SEQ ID NO: 1885440 - RNA, 22 nt, Human
caaacuaggggacaaagcaaaa

SEQ ID NO: 1885441 - RNA, 21 nt, Human
caaacuggggccuccagaacu

SEQ ID NO: 1885442 - RNA, 12 nt, Human
caaacuguaaau

SEQ ID NO: 1885443 - RNA, 16 nt, Human
caaacuggggccucca

SEQ ID NO: 1885444 - RNA, 19 nt, Human
caaacuggggccuccagaa

SEQ ID NO: 1885445 - RNA, 21 nt, Human
caaacuguaaauaaaaagaaa

SEQ ID NO: 1885446 - RNA, 14 nt, Human
caaacuguaaauaa

SEQ ID NO: 1885447 - RNA, 20 nt, Human
caaacuguaaauaaaaagaa

SEQ ID NO: 1885448 - RNA, 17 nt, Human
caaagccuccuccagcc

SEQ ID NO: 1885449 - RNA, 18 nt, Human
caaagccuccuccagccg

SEQ ID NO: 1885450 - RNA, 19 nt, Human
caaagcgaauuuuaaaaga

SEQ ID NO: 1885451 - RNA, 14 nt, Human
caaagcgaauuuua

SEQ ID NO: 1885452 - RNA, 22 nt, Human
caaagccaaagcuaggccuggc

SEQ ID NO: 1885453 - RNA, 15 nt, Human
cacuggaugcagaaa

SEQ ID NO: 1885454 - RNA, 17 nt, Human
cacuggacugaccuggu

SEQ ID NO: 1885455 - RNA, 16 nt, Human
cacuggacugaccugg

SEQ ID NO: 1885456 - RNA, 19 nt, Human
cacuggacuccggcccucc

SEQ ID NO: 1885457 - RNA, 15 nt, Human
cacuggacuccggcc

SEQ ID NO: 1885458 - RNA, 16 nt, Human
cacuggacuccggccc

SEQ ID NO: 1885459 - RNA, 21 nt, Human
cacugcuuuuggucuguguga

SEQ ID NO: 1885460 - RNA, 17 nt, Human
cacuggaacacuaauga

SEQ ID NO: 1885461 - RNA, 20 nt, Human
cacugcuuuuggucugugug

SEQ ID NO: 1885462 - RNA, 22 nt, Human
cacugcuuccagugaggcucug

SEQ ID NO: 1885463 - RNA, 18 nt, Human
cacugcuuccagugaggc

SEQ ID NO: 1885464 - RNA, 19 nt, Human
cacugcuuccagugaggcu

SEQ ID NO: 1885465 - RNA, 20 nt, Human
cacugcuuccagugaggcuc

SEQ ID NO: 1885466 - RNA, 21 nt, Human
cacugcuuccagugaggcucu

SEQ ID NO: 1885467 - RNA, 13 nt, Human
cacugcuuaacuu

SEQ ID NO: 1885468 - RNA, 14 nt, Human
cacugcuuccagug

SEQ ID NO: 1885469 - RNA, 15 nt, Human
cacugcuuccaguga

SEQ ID NO: 1885470 - RNA, 16 nt, Human
cacugcuuccagugag

SEQ ID NO: 1885471 - RNA, 12 nt, Human
cacugcucuggu

SEQ ID NO: 1885472 - RNA, 18 nt, Human
cacugcuaagaauauuug

SEQ ID NO: 1885473 - RNA, 18 nt, Human
cacugcacuauagccuag

SEQ ID NO: 1885474 - RNA, 19 nt, Human
cacugcaccgggccacaga

SEQ ID NO: 1885475 - RNA, 18 nt, Human
cacugcaccgggccacag

SEQ ID NO: 1885476 - RNA, 16 nt, Human
cacugcaccgggccac

SEQ ID NO: 1885477 - RNA, 15 nt, Human
cacugcaccgggcca

SEQ ID NO: 1885478 - RNA, 14 nt, Human
cacugcaccgggcc

SEQ ID NO: 1885479 - RNA, 14 nt, Human
cacugccucucaca

SEQ ID NO: 1885480 - RNA, 15 nt, Human
cacugccucucacag

SEQ ID NO: 1885481 - RNA, 17 nt, Human
cacugccucucacagcu

SEQ ID NO: 1885482 - RNA, 16 nt, Human
cacugccucucacagc

SEQ ID NO: 1885483 - RNA, 17 nt, Human
cacugcccauggacagg

SEQ ID NO: 1885484 - RNA, 18 nt, Human
cacugcccauggacaggc

SEQ ID NO: 1885485 - RNA, 16 nt, Human
cacugacugcagggac

SEQ ID NO: 1885486 - RNA, 18 nt, Human
cacugagaauguaagaac

SEQ ID NO: 1885487 - RNA, 16 nt, Human
cacugagaauguaaga

SEQ ID NO: 1885488 - RNA, 12 nt, Human
cacugagacagc

SEQ ID NO: 1885489 - RNA, 13 nt, Human
cacugagacagcc

SEQ ID NO: 1885490 - RNA, 14 nt, Human
cacugagacagccc

SEQ ID NO: 1885491 - RNA, 17 nt, Human
cacugagacagcccggg

SEQ ID NO: 1885492 - RNA, 19 nt, Human
cacugagacagcccgggcu

SEQ ID NO: 1885493 - RNA, 22 nt, Human
cacugagacagcccgggcucug

SEQ ID NO: 1885494 - RNA, 13 nt, Human
cacugaccagaac

SEQ ID NO: 1885495 - RNA, 14 nt, Human
cacugaccagaacu

SEQ ID NO: 1885496 - RNA, 15 nt, Human
cacugaccagaacua

SEQ ID NO: 1885497 - RNA, 23 nt, Human
cacugacauuguuggccaaagcc

SEQ ID NO: 1885498 - RNA, 19 nt, Human
cacucugucgcccagucug

SEQ ID NO: 1885499 - RNA, 16 nt, Human
cacucugucgcccagu

SEQ ID NO: 1885500 - RNA, 15 nt, Human
cacucugucgcccag

SEQ ID NO: 1885501 - RNA, 16 nt, Human
cacucugggcuccaga

SEQ ID NO: 1885502 - RNA, 17 nt, Human
cacucugggcuccagag

SEQ ID NO: 1885503 - RNA, 23 nt, Human
cacucuggcagcucagagagggu

SEQ ID NO: 1885504 - RNA, 14 nt, Human
cacucugggcucca

SEQ ID NO: 1885505 - RNA, 15 nt, Human
cacucugggcuccag

SEQ ID NO: 1885506 - RNA, 20 nt, Human
cacucuggcagcucagagag

SEQ ID NO: 1885507 - RNA, 21 nt, Human
cacucuggcagcucagagagg

SEQ ID NO: 1885508 - RNA, 15 nt, Human
cacucuggcagcuca

SEQ ID NO: 1885509 - RNA, 16 nt, Human
cacucuggcagcucag

SEQ ID NO: 1885510 - RNA, 17 nt, Human
cacucuggcagcucaga

SEQ ID NO: 1885511 - RNA, 19 nt, Human
cacucuggcagcucagaga

SEQ ID NO: 1885512 - RNA, 23 nt, Human
cacugagacagcccgggcucugc

SEQ ID NO: 1885513 - RNA, 20 nt, Human
cacugagaauguaagaacua

SEQ ID NO: 1885514 - RNA, 19 nt, Human
cacugagaauguaagaacu

SEQ ID NO: 1885515 - RNA, 21 nt, Human
cacugagaauguaagaacuac

SEQ ID NO: 1885516 - RNA, 17 nt, Human
cacugagaucuguuuga

SEQ ID NO: 1885517 - RNA, 17 nt, Human
cacugaggaagaacggg

SEQ ID NO: 1885518 - RNA, 15 nt, Human
cacugaggaagaacg

SEQ ID NO: 1885519 - RNA, 14 nt, Human
cacugaggaagaac

SEQ ID NO: 1885520 - RNA, 13 nt, Human
cacugaggaagaa

SEQ ID NO: 1885521 - RNA, 24 nt, Human
cacugaugggcaacccccagccug

SEQ ID NO: 1885522 - RNA, 18 nt, Human
cacugaugggcaaccccc

SEQ ID NO: 1885523 - RNA, 14 nt, Human
cacugaugggcaac

SEQ ID NO: 1885524 - RNA, 16 nt, Human
cacugaugcuuagaug

SEQ ID NO: 1885525 - RNA, 19 nt, Human
cacugaugcugccccucau

SEQ ID NO: 1885526 - RNA, 15 nt, Human
cacugaugcuuagau

SEQ ID NO: 1885527 - RNA, 12 nt, Human
cacugaugcugc

SEQ ID NO: 1885528 - RNA, 17 nt, Human
cacugaugcugccccuc

SEQ ID NO: 1885529 - RNA, 16 nt, Human
cacugauccagcccug

SEQ ID NO: 1885530 - RNA, 15 nt, Human
cacugauccagcccu

SEQ ID NO: 1885531 - RNA, 14 nt, Human
cacugauccagccc

SEQ ID NO: 1885532 - RNA, 13 nt, Human
cacugcaaccucc

SEQ ID NO: 1885533 - RNA, 23 nt, Human
cacugauuuccccuuuugcauuc

SEQ ID NO: 1885534 - RNA, 15 nt, Human
cacugauuuccccuu

SEQ ID NO: 1885535 - RNA, 16 nt, Human
cacugcaaccuccgcc

SEQ ID NO: 1885536 - RNA, 14 nt, Human
cacugcaaccuccg

SEQ ID NO: 1885537 - RNA, 23 nt, Human
cacugcaaccuccgccucuuggg

SEQ ID NO: 1885538 - RNA, 17 nt, Human
cacugcaacuucugccu

SEQ ID NO: 1885539 - RNA, 16 nt, Human
cacugcaacuucugcc

SEQ ID NO: 1885540 - RNA, 20 nt, Human
cacuguacaagguaccccuu

SEQ ID NO: 1885541 - RNA, 19 nt, Human
cacuguacuugcucuugau

SEQ ID NO: 1885542 - RNA, 15 nt, Human
cacuguacuugcucu

SEQ ID NO: 1885543 - RNA, 18 nt, Human
cacuguacuugcucuuga

SEQ ID NO: 1885544 - RNA, 17 nt, Human
cacuggccccugagauc

SEQ ID NO: 1885545 - RNA, 16 nt, Human
cacugugagcucccag

SEQ ID NO: 1885546 - RNA, 17 nt, Human
cacugugagcucccagg

SEQ ID NO: 1885547 - RNA, 23 nt, Human
cacugugacccccagcuccggcc

SEQ ID NO: 1885548 - RNA, 17 nt, Human
cacugugaccuugagaa

SEQ ID NO: 1885549 - RNA, 14 nt, Human
cacugugccaugug

SEQ ID NO: 1885550 - RNA, 17 nt, Human
cacugugaaggacccuu

SEQ ID NO: 1885551 - RNA, 15 nt, Human
cacugugaaggaccc

SEQ ID NO: 1885552 - RNA, 14 nt, Human
cacugugaccccca

SEQ ID NO: 1885553 - RNA, 15 nt, Human
cacugugacccccag

SEQ ID NO: 1885554 - RNA, 19 nt, Human
cacugugacccccagcucc

SEQ ID NO: 1885555 - RNA, 20 nt, Human
cacugugacccccagcuccg

SEQ ID NO: 1885556 - RNA, 22 nt, Human
cacugugacccccagcuccggc

SEQ ID NO: 1885557 - RNA, 13 nt, Human
cacugugaagaga

SEQ ID NO: 1885558 - RNA, 13 nt, Human
cacugucuuuccu

SEQ ID NO: 1885559 - RNA, 13 nt, Human
cacugugaaggac

SEQ ID NO: 1885560 - RNA, 14 nt, Human
cacugugaaggacc

SEQ ID NO: 1885561 - RNA, 14 nt, Human
cacugucuugaaga

SEQ ID NO: 1885562 - RNA, 14 nt, Human
cacuguccuccaag

SEQ ID NO: 1885563 - RNA, 17 nt, Human
cacuguccuccaagcca

SEQ ID NO: 1885564 - RNA, 18 nt, Human
cacuguccuccaagccag

SEQ ID NO: 1885565 - RNA, 15 nt, Human
cacuguccugggccu

SEQ ID NO: 1885566 - RNA, 18 nt, Human
cacuguccugggccugca

SEQ ID NO: 1885567 - RNA, 15 nt, Human
cacuguuaucaaaac

SEQ ID NO: 1885568 - RNA, 15 nt, Human
cacugugugcuauuu

SEQ ID NO: 1885569 - RNA, 13 nt, Human
cacuguucucugc

SEQ ID NO: 1885570 - RNA, 14 nt, Human
cacuguucucugcc

SEQ ID NO: 1885571 - RNA, 15 nt, Human
cacuguucucugccc

SEQ ID NO: 1885572 - RNA, 16 nt, Human
cacuguucucugcccu

SEQ ID NO: 1885573 - RNA, 17 nt, Human
cacuguucucugcccuc

SEQ ID NO: 1885574 - RNA, 19 nt, Human
cacuguucucugcccucca

SEQ ID NO: 1885575 - RNA, 21 nt, Human
cacuguucucugcccuccaag

SEQ ID NO: 1885576 - RNA, 22 nt, Human
cacuguucucugcccuccaaga

SEQ ID NO: 1885577 - RNA, 22 nt, Human
cacugugagcucccaggugcag

SEQ ID NO: 1885578 - RNA, 18 nt, Human
cacugugccaugugccag

SEQ ID NO: 1885579 - RNA, 16 nt, Human
cacugugccaugugcc

SEQ ID NO: 1885580 - RNA, 15 nt, Human
cacugugccaugugc

SEQ ID NO: 1885581 - RNA, 13 nt, Human
cacugugcugagu

SEQ ID NO: 1885582 - RNA, 15 nt, Human
cacugugcugagucu

SEQ ID NO: 1885583 - RNA, 17 nt, Human
cacugugcugagucuga

SEQ ID NO: 1885584 - RNA, 20 nt, Human
cacugugcugagucugaagg

SEQ ID NO: 1885585 - RNA, 21 nt, Human
cacugugcugagucugaaggc

SEQ ID NO: 1885586 - RNA, 22 nt, Human
cacugugcugagucugaaggcu

SEQ ID NO: 1885587 - RNA, 14 nt, Human
cacuucacccugga

SEQ ID NO: 1885588 - RNA, 17 nt, Human
cacuucacgcuuucagc

SEQ ID NO: 1885589 - RNA, 18 nt, Human
cacuucaggucaggaguu

SEQ ID NO: 1885590 - RNA, 22 nt, Human
cacuucauucuugaaagcugug

SEQ ID NO: 1885591 - RNA, 12 nt, Human
cacuucagcuga

SEQ ID NO: 1885592 - RNA, 21 nt, Human
cacuucagcugacuuuucugu

SEQ ID NO: 1885593 - RNA, 21 nt, Human
cacuucgggaggucgaggcag

SEQ ID NO: 1885594 - RNA, 23 nt, Human
cacuucgggaggucgaggcagga

SEQ ID NO: 1885595 - RNA, 22 nt, Human
cacuucugccauauucuguugg

SEQ ID NO: 1885596 - RNA, 13 nt, Human
cacuucucuuccu

SEQ ID NO: 1885597 - RNA, 16 nt, Human
cacuucccuacaugga

SEQ ID NO: 1885598 - RNA, 22 nt, Human
cacuugcagacucuacagaggc

SEQ ID NO: 1885599 - RNA, 19 nt, Human
cacuugcagacucuacaga

SEQ ID NO: 1885600 - RNA, 18 nt, Human
cacuugcagacucuacag

SEQ ID NO: 1885601 - RNA, 14 nt, Human
cacuugcagacucu

SEQ ID NO: 1885602 - RNA, 24 nt, Human
cacuugcagacucuacagaggcca

SEQ ID NO: 1885603 - RNA, 22 nt, Human
cacuugccgcgucgcccuccca

SEQ ID NO: 1885604 - RNA, 19 nt, Human
cacuuucuagccagaggag

SEQ ID NO: 1885605 - RNA, 20 nt, Human
cacuuucuagccagaggaga

SEQ ID NO: 1885606 - RNA, 15 nt, Human
cacuuggucugugag

SEQ ID NO: 1885607 - RNA, 13 nt, Human
cacuugcagacuc

SEQ ID NO: 1885608 - RNA, 22 nt, Human
cacuugaggucaggaguuccua

SEQ ID NO: 1885609 - RNA, 18 nt, Human
cacuugaggucaggaguu

SEQ ID NO: 1885610 - RNA, 13 nt, Human
cacuugaguccag

SEQ ID NO: 1885611 - RNA, 19 nt, Human
cacuugacaucaacugcau

SEQ ID NO: 1885612 - RNA, 17 nt, Human
cacuugagaauuacccu

SEQ ID NO: 1885613 - RNA, 20 nt, Human
cacuugagaauuacccuuuu

SEQ ID NO: 1885614 - RNA, 16 nt, Human
cacuugacaucaacug

SEQ ID NO: 1885615 - RNA, 23 nt, Human
cacuugaacccgggaggcagagg

SEQ ID NO: 1885616 - RNA, 21 nt, Human
cacuugaacccgggaggcaga

SEQ ID NO: 1885617 - RNA, 20 nt, Human
cacuugaacccgggaggcag

SEQ ID NO: 1885618 - RNA, 19 nt, Human
cacuucuggguggggcagu

SEQ ID NO: 1885619 - RNA, 18 nt, Human
cacuucuggguggggcag

SEQ ID NO: 1885620 - RNA, 19 nt, Human
cacgcagccaggacaccgg

SEQ ID NO: 1885621 - RNA, 16 nt, Human
cacgcagccaggacac

SEQ ID NO: 1885622 - RNA, 15 nt, Human
cacgcagccaggaca

SEQ ID NO: 1885623 - RNA, 13 nt, Human
cacgcagccagga

SEQ ID NO: 1885624 - RNA, 21 nt, Human
cacgcagccaggacaccgggc

SEQ ID NO: 1885625 - RNA, 12 nt, Human
cacgcaggagca

SEQ ID NO: 1885626 - RNA, 19 nt, Human
cacgcaggagcacacccag

SEQ ID NO: 1885627 - RNA, 20 nt, Human
cacgcaggagcacacccagc

SEQ ID NO: 1885628 - RNA, 13 nt, Human
cacgccacugcac

SEQ ID NO: 1885629 - RNA, 15 nt, Human
cacgccacugcacua

SEQ ID NO: 1885630 - RNA, 19 nt, Human
cacgccagauucuuuccug

SEQ ID NO: 1885631 - RNA, 20 nt, Human
cacgccagauucuuuccuga

SEQ ID NO: 1885632 - RNA, 22 nt, Human
cacgccagauucuuuccugagg

SEQ ID NO: 1885633 - RNA, 23 nt, Human
cacgccagauucuuuccugaggc

SEQ ID NO: 1885634 - RNA, 13 nt, Human
cacgcccccacug

SEQ ID NO: 1885635 - RNA, 15 nt, Human
cacgcccccacuggu

SEQ ID NO: 1885636 - RNA, 17 nt, Human
cacgcccccacugguga

SEQ ID NO: 1885637 - RNA, 18 nt, Human
cacgcccccacuggugac

SEQ ID NO: 1885638 - RNA, 21 nt, Human
cacgcacaugcgaccccgagg

SEQ ID NO: 1885639 - RNA, 12 nt, Human
cacgcaccugcc

SEQ ID NO: 1885640 - RNA, 15 nt, Human
cacgcaccugccuca

SEQ ID NO: 1885641 - RNA, 17 nt, Human
cacgcacuucgggaggu

SEQ ID NO: 1885642 - RNA, 16 nt, Human
cacgcaccugccucag

SEQ ID NO: 1885643 - RNA, 16 nt, Human
cacgauuucuguuuag

SEQ ID NO: 1885644 - RNA, 14 nt, Human
cacgauuucuguuu

SEQ ID NO: 1885645 - RNA, 12 nt, Human
cacgauuucugu

SEQ ID NO: 1885646 - RNA, 17 nt, Human
cacgaaauguuauuuuu

SEQ ID NO: 1885647 - RNA, 22 nt, Human
caccuugaagaaccucucacuu

SEQ ID NO: 1885648 - RNA, 18 nt, Human
caccuugacagggcacac

SEQ ID NO: 1885649 - RNA, 16 nt, Human
caccuugacagggcac

SEQ ID NO: 1885650 - RNA, 15 nt, Human
caccuugacagggca

SEQ ID NO: 1885651 - RNA, 13 nt, Human
caccuugacaggg

SEQ ID NO: 1885652 - RNA, 17 nt, Human
cacgacugcccggcagg

SEQ ID NO: 1885653 - RNA, 16 nt, Human
cacgacugcccggcag

SEQ ID NO: 1885654 - RNA, 16 nt, Human
cacgaauauugcugau

SEQ ID NO: 1885655 - RNA, 19 nt, Human
cacgaauauugcugauggu

SEQ ID NO: 1885656 - RNA, 22 nt, Human
cacgaauauugcugauggugca

SEQ ID NO: 1885657 - RNA, 23 nt, Human
caccuucaguaacccccacugga

SEQ ID NO: 1885658 - RNA, 15 nt, Human
caccuuauauuuacg

SEQ ID NO: 1885659 - RNA, 10 nt, Human
caccuucacc

SEQ ID NO: 1885660 - RNA, 21 nt, Human
caccuuagacagucccugcca

SEQ ID NO: 1885661 - RNA, 23 nt, Human
caccuuagacagucccugccaau

SEQ ID NO: 1885662 - RNA, 14 nt, Human
caccuuagacaguc

SEQ ID NO: 1885663 - RNA, 16 nt, Human
caccuuagacaguccc

SEQ ID NO: 1885664 - RNA, 18 nt, Human
caccuuagacagucccug

SEQ ID NO: 1885665 - RNA, 19 nt, Human
caccuuagacagucccugc

SEQ ID NO: 1885666 - RNA, 19 nt, Human
caccuguuuuuaagcuguu

SEQ ID NO: 1885667 - RNA, 20 nt, Human
caccuguuuuuaagcuguuu

SEQ ID NO: 1885668 - RNA, 22 nt, Human
cacgggcagccuggcucccagg

SEQ ID NO: 1885669 - RNA, 18 nt, Human
cacgggcagccuggcucc

SEQ ID NO: 1885670 - RNA, 15 nt, Human
cacgggcagccuggc

SEQ ID NO: 1885671 - RNA, 14 nt, Human
cacgggcagccugg

SEQ ID NO: 1885672 - RNA, 12 nt, Human
cacgggcagccu

SEQ ID NO: 1885673 - RNA, 20 nt, Human
cacggcucacugcagccuca

SEQ ID NO: 1885674 - RNA, 19 nt, Human
cacggcucacugcagccuc

SEQ ID NO: 1885675 - RNA, 17 nt, Human
cacggcucacugcagcc

SEQ ID NO: 1885676 - RNA, 16 nt, Human
cacggcucacugcagc

SEQ ID NO: 1885677 - RNA, 17 nt, Human
cacgcuggaccuugaac

SEQ ID NO: 1885678 - RNA, 20 nt, Human
cacgcuggaccuugaacugg

SEQ ID NO: 1885679 - RNA, 21 nt, Human
cacgcgugcacacaccagagc

SEQ ID NO: 1885680 - RNA, 16 nt, Human
cacgcgugcacacacc

SEQ ID NO: 1885681 - RNA, 15 nt, Human
cacgcgugcacacac

SEQ ID NO: 1885682 - RNA, 23 nt, Human
cacgccuguaaucccagcaauuu

SEQ ID NO: 1885683 - RNA, 23 nt, Human
cacgcgugcacacaccagagccc

SEQ ID NO: 1885684 - RNA, 19 nt, Human
cacgccuguaauccuagca

SEQ ID NO: 1885685 - RNA, 20 nt, Human
cacgccuguaauccuagcac

SEQ ID NO: 1885686 - RNA, 22 nt, Human
cacgccucccacugggguccag

SEQ ID NO: 1885687 - RNA, 17 nt, Human
cacgccucccacugggg

SEQ ID NO: 1885688 - RNA, 18 nt, Human
cacgccucccacuggggu

SEQ ID NO: 1885689 - RNA, 13 nt, Human
cacgccucccacu

SEQ ID NO: 1885690 - RNA, 14 nt, Human
cacgccucccacug

SEQ ID NO: 1885691 - RNA, 15 nt, Human
cacgccucccacugg

SEQ ID NO: 1885692 - RNA, 16 nt, Human
cacgccucccacuggg

SEQ ID NO: 1885693 - RNA, 16 nt, Human
cacguguccuguaguu

SEQ ID NO: 1885694 - RNA, 15 nt, Human
cacguguccuguagu

SEQ ID NO: 1885695 - RNA, 19 nt, Human
cacguguggccuguucuuc

SEQ ID NO: 1885696 - RNA, 16 nt, Human
cacgugguccuaaucu

SEQ ID NO: 1885697 - RNA, 19 nt, Human
cacgugguccuaaucuucu

SEQ ID NO: 1885698 - RNA, 22 nt, Human
cacguucuuacuaguuucccuu

SEQ ID NO: 1885699 - RNA, 13 nt, Human
cacuaaacaaaga

SEQ ID NO: 1885700 - RNA, 15 nt, Human
cacguuuuguuuugu

SEQ ID NO: 1885701 - RNA, 18 nt, Human
cacguuuuguuuugugcc

SEQ ID NO: 1885702 - RNA, 23 nt, Human
cacguuucuaaaggcuaccuuug

SEQ ID NO: 1885703 - RNA, 14 nt, Human
cacguuucuaaagg

SEQ ID NO: 1885704 - RNA, 12 nt, Human
cacguuucuaaa

SEQ ID NO: 1885705 - RNA, 14 nt, Human
cacguacacacaca

SEQ ID NO: 1885706 - RNA, 19 nt, Human
cacguaaugaaacuuggau

SEQ ID NO: 1885707 - RNA, 16 nt, Human
cacguaaugaaacuug

SEQ ID NO: 1885708 - RNA, 19 nt, Human
cacguacacacacauacac

SEQ ID NO: 1885709 - RNA, 18 nt, Human
cacguacacacacauaca

SEQ ID NO: 1885710 - RNA, 20 nt, Human
cacucucccccacccccucc

SEQ ID NO: 1885711 - RNA, 18 nt, Human
cacucucccccacccccu

SEQ ID NO: 1885712 - RNA, 16 nt, Human
cacucucccccacccc

SEQ ID NO: 1885713 - RNA, 16 nt, Human
cacucgcauugacaca

SEQ ID NO: 1885714 - RNA, 13 nt, Human
cacuccugcugua

SEQ ID NO: 1885715 - RNA, 12 nt, Human
cacucuggcagc

SEQ ID NO: 1885716 - RNA, 13 nt, Human
cacucuggcagcu

SEQ ID NO: 1885717 - RNA, 14 nt, Human
cacucuggcagcuc

SEQ ID NO: 1885718 - RNA, 12 nt, Human
cacucuccuugg

SEQ ID NO: 1885719 - RNA, 12 nt, Human
cacucugagacu

SEQ ID NO: 1885720 - RNA, 23 nt, Human
cacucugagacucgcgacaaugc

SEQ ID NO: 1885721 - RNA, 14 nt, Human
cacuccuucacaga

SEQ ID NO: 1885722 - RNA, 21 nt, Human
cacuccuucacagaugggugc

SEQ ID NO: 1885723 - RNA, 11 nt, Human
cacuccugcug

SEQ ID NO: 1885724 - RNA, 12 nt, Human
cacuccugcugu

SEQ ID NO: 1885725 - RNA, 16 nt, Human
cacuccugcuguaaau

SEQ ID NO: 1885726 - RNA, 18 nt, Human
cacuccuccuagccaccc

SEQ ID NO: 1885727 - RNA, 13 nt, Human
cacuccuccuagc

SEQ ID NO: 1885728 - RNA, 17 nt, Human
cacucccugcaaccuga

SEQ ID NO: 1885729 - RNA, 16 nt, Human
cacucaguccauagca

SEQ ID NO: 1885730 - RNA, 16 nt, Human
cacucaggucuguuuu

SEQ ID NO: 1885731 - RNA, 22 nt, Human
cacucagcucuuggcuccacug

SEQ ID NO: 1885732 - RNA, 15 nt, Human
cacucauugaccuga

SEQ ID NO: 1885733 - RNA, 16 nt, Human
cacucauccccucacu

SEQ ID NO: 1885734 - RNA, 18 nt, Human
cacucauugaccugaggc

SEQ ID NO: 1885735 - RNA, 19 nt, Human
cacucauugaccugaggcc

SEQ ID NO: 1885736 - RNA, 20 nt, Human
cacucauugaccugaggccc

SEQ ID NO: 1885737 - RNA, 22 nt, Human
cacucauugaccugaggcccuu

SEQ ID NO: 1885738 - RNA, 12 nt, Human
cacucccugcaa

SEQ ID NO: 1885739 - RNA, 13 nt, Human
cacucccugcaac

SEQ ID NO: 1885740 - RNA, 16 nt, Human
cacucccugcaaccug

SEQ ID NO: 1885741 - RNA, 18 nt, Human
cacuaaccacgcuggacc

SEQ ID NO: 1885742 - RNA, 18 nt, Human
cacuaaggugugcucuga

SEQ ID NO: 1885743 - RNA, 12 nt, Human
cacuaaggggcc

SEQ ID NO: 1885744 - RNA, 13 nt, Human
cacuaaggggccc

SEQ ID NO: 1885745 - RNA, 23 nt, Human
cacuaaggggcccggccagccau

SEQ ID NO: 1885746 - RNA, 17 nt, Human
cacuaaggugugcucug

SEQ ID NO: 1885747 - RNA, 13 nt, Human
cacuaagcagagg

SEQ ID NO: 1885748 - RNA, 14 nt, Human
cacuaagcagagga

SEQ ID NO: 1885749 - RNA, 15 nt, Human
cacuaagcagaggag

SEQ ID NO: 1885750 - RNA, 16 nt, Human
cacuaagcagaggagg

SEQ ID NO: 1885751 - RNA, 17 nt, Human
cacuaagcagaggaggg

SEQ ID NO: 1885752 - RNA, 18 nt, Human
cacuaagcagaggagggg

SEQ ID NO: 1885753 - RNA, 20 nt, Human
cacuaagcagaggaggggcc

SEQ ID NO: 1885754 - RNA, 21 nt, Human
cacuaagcagaggaggggccg

SEQ ID NO: 1885755 - RNA, 16 nt, Human
cacuaaccacgcugga

SEQ ID NO: 1885756 - RNA, 15 nt, Human
cacuaaccacgcugg

SEQ ID NO: 1885757 - RNA, 14 nt, Human
cacuaaccacgcug

SEQ ID NO: 1885758 - RNA, 16 nt, Human
cacuaacaugauuugg

SEQ ID NO: 1885759 - RNA, 21 nt, Human
cacuaaauugacacuuaaaaa

SEQ ID NO: 1885760 - RNA, 21 nt, Human
cacuauagccuaggugacaga

SEQ ID NO: 1885761 - RNA, 14 nt, Human
cacuauagccuagg

SEQ ID NO: 1885762 - RNA, 18 nt, Human
cacuauaauguaagcucu

SEQ ID NO: 1885763 - RNA, 14 nt, Human
cacuauaauguaag

SEQ ID NO: 1885764 - RNA, 19 nt, Human
cacuauguugcccaggcag

SEQ ID NO: 1885765 - RNA, 18 nt, Human
cacuauguugcccaggca

SEQ ID NO: 1885766 - RNA, 17 nt, Human
cacuauguugcccaggc

SEQ ID NO: 1885767 - RNA, 16 nt, Human
cacuauguugcccagg

SEQ ID NO: 1885768 - RNA, 15 nt, Human
cacuauguugcccag

SEQ ID NO: 1885769 - RNA, 17 nt, Human
cacuaugguauuugagu

SEQ ID NO: 1885770 - RNA, 21 nt, Human
cacuauguugcccaggcaggu

SEQ ID NO: 1885771 - RNA, 20 nt, Human
cacuauguugcccaggcagg

SEQ ID NO: 1885772 - RNA, 15 nt, Human
cacucaaaagcuggg

SEQ ID NO: 1885773 - RNA, 17 nt, Human
cacucaaaagcugggca

SEQ ID NO: 1885774 - RNA, 18 nt, Human
cacucaaaagcugggcag

SEQ ID NO: 1885775 - RNA, 19 nt, Human
cacucaaaagcugggcagg

SEQ ID NO: 1885776 - RNA, 20 nt, Human
cacucaaaagcugggcaggu

SEQ ID NO: 1885777 - RNA, 12 nt, Human
cacucaaaggcc

SEQ ID NO: 1885778 - RNA, 15 nt, Human
cacucaaaggccaga

SEQ ID NO: 1885779 - RNA, 20 nt, Human
cacucaaaggccagaccugc

SEQ ID NO: 1885780 - RNA, 22 nt, Human
cacucaaaggccagaccugcag

SEQ ID NO: 1885781 - RNA, 23 nt, Human
cacucaaaggccagaccugcaga

SEQ ID NO: 1885782 - RNA, 17 nt, Human
cacucagaagacacuga

SEQ ID NO: 1885783 - RNA, 16 nt, Human
cacucagaagacacug

SEQ ID NO: 1885784 - RNA, 12 nt, Human
cacucagaagac

SEQ ID NO: 1885785 - RNA, 20 nt, Human
cacucacauuuauucugcuc

SEQ ID NO: 1885786 - RNA, 19 nt, Human
cacucacauuuauucugcu

SEQ ID NO: 1885787 - RNA, 19 nt, Human
cacucagaagacacugaug

SEQ ID NO: 1885788 - RNA, 18 nt, Human
cacucagaagacacugau

SEQ ID NO: 1885789 - RNA, 22 nt, Human
cacucagaagacacugaugggc

SEQ ID NO: 1885790 - RNA, 22 nt, Human
cacucagcacaaggccaucugg

SEQ ID NO: 1885791 - RNA, 13 nt, Human
cacucagcacaag

SEQ ID NO: 1885792 - RNA, 15 nt, Human
cacucagcacaaggc

SEQ ID NO: 1885793 - RNA, 12 nt, Human
cacucagcacaa

SEQ ID NO: 1885794 - RNA, 22 nt, Human
caccccugccucccgcccccuu

SEQ ID NO: 1885795 - RNA, 18 nt, Human
caccccucccuuucuccc

SEQ ID NO: 1885796 - RNA, 15 nt, Human
caccccucccuuucu

SEQ ID NO: 1885797 - RNA, 13 nt, Human
cacauauugauuu

SEQ ID NO: 1885798 - RNA, 20 nt, Human
caccccucaacaccucugca

SEQ ID NO: 1885799 - RNA, 12 nt, Human
caccccuggggg

SEQ ID NO: 1885800 - RNA, 14 nt, Human
caccccugggggcu

SEQ ID NO: 1885801 - RNA, 18 nt, Human
caccccugggggcucuca

SEQ ID NO: 1885802 - RNA, 18 nt, Human
caccccugguucucaucu

SEQ ID NO: 1885803 - RNA, 17 nt, Human
caccccugguucucauc

SEQ ID NO: 1885804 - RNA, 21 nt, Human
cacccggccccugcugguuca

SEQ ID NO: 1885805 - RNA, 18 nt, Human
cacccggccccugcuggu

SEQ ID NO: 1885806 - RNA, 17 nt, Human
cacccggccccugcugg

SEQ ID NO: 1885807 - RNA, 16 nt, Human
cacccggccccugcug

SEQ ID NO: 1885808 - RNA, 14 nt, Human
cacccggccccugc

SEQ ID NO: 1885809 - RNA, 13 nt, Human
cacccggccccug

SEQ ID NO: 1885810 - RNA, 12 nt, Human
cacccggccccu

SEQ ID NO: 1885811 - RNA, 19 nt, Human
cacccgcuaagagggaggg

SEQ ID NO: 1885812 - RNA, 18 nt, Human
cacccucaaccucuucug

SEQ ID NO: 1885813 - RNA, 22 nt, Human
caccgaaaacguggcugcuuca

SEQ ID NO: 1885814 - RNA, 14 nt, Human
caccgaaaaacuaa

SEQ ID NO: 1885815 - RNA, 19 nt, Human
caccgaaaacguggcugcu

SEQ ID NO: 1885816 - RNA, 21 nt, Human
caccgaaaacguggcugcuuc

SEQ ID NO: 1885817 - RNA, 15 nt, Human
caccgaaaacguggc

SEQ ID NO: 1885818 - RNA, 18 nt, Human
caccgaaaacguggcugc

SEQ ID NO: 1885819 - RNA, 12 nt, Human
caccgcagacag

SEQ ID NO: 1885820 - RNA, 13 nt, Human
caccgcagacagg

SEQ ID NO: 1885821 - RNA, 14 nt, Human
caccgcagacagga

SEQ ID NO: 1885822 - RNA, 15 nt, Human
caccgcagacaggac

SEQ ID NO: 1885823 - RNA, 17 nt, Human
caccgcagacaggacca

SEQ ID NO: 1885824 - RNA, 18 nt, Human
caccgcagacaggaccag

SEQ ID NO: 1885825 - RNA, 11 nt, Human
cacccugugau

SEQ ID NO: 1885826 - RNA, 12 nt, Human
cacccugugaug

SEQ ID NO: 1885827 - RNA, 15 nt, Human
cacccugugaugggg

SEQ ID NO: 1885828 - RNA, 18 nt, Human
cacccugugauggggccc

SEQ ID NO: 1885829 - RNA, 20 nt, Human
cacccugugauggggcccug

SEQ ID NO: 1885830 - RNA, 21 nt, Human
cacccugugauggggcccugc

SEQ ID NO: 1885831 - RNA, 22 nt, Human
cacccugugauggggcccugcc

SEQ ID NO: 1885832 - RNA, 23 nt, Human
cacccugugauggggcccugccu

SEQ ID NO: 1885833 - RNA, 20 nt, Human
cacauauugauuuccguuaa

SEQ ID NO: 1885834 - RNA, 15 nt, Human
caccugccacccugg

SEQ ID NO: 1885835 - RNA, 20 nt, Human
caccugccacccugggccug

SEQ ID NO: 1885836 - RNA, 23 nt, Human
caccugccacccugggccuggca

SEQ ID NO: 1885837 - RNA, 23 nt, Human
caccugcggugcuaucuccccca

SEQ ID NO: 1885838 - RNA, 20 nt, Human
caccuggaauauauaaccag

SEQ ID NO: 1885839 - RNA, 15 nt, Human
caccugcuggaguga

SEQ ID NO: 1885840 - RNA, 15 nt, Human
caccugaagacucau

SEQ ID NO: 1885841 - RNA, 14 nt, Human
caccugaagacuca

SEQ ID NO: 1885842 - RNA, 23 nt, Human
caccugaagacucauucuucugu

SEQ ID NO: 1885843 - RNA, 19 nt, Human
caccugaacugaacaccau

SEQ ID NO: 1885844 - RNA, 17 nt, Human
caccugaacugaacacc

SEQ ID NO: 1885845 - RNA, 13 nt, Human
caccugaacugaa

SEQ ID NO: 1885846 - RNA, 15 nt, Human
caccucucucacucc

SEQ ID NO: 1885847 - RNA, 17 nt, Human
caccucucucacuccuu

SEQ ID NO: 1885848 - RNA, 18 nt, Human
caccucucucacuccuug

SEQ ID NO: 1885849 - RNA, 19 nt, Human
caccucucucacuccuuga

SEQ ID NO: 1885850 - RNA, 18 nt, Human
caccucugcacaagcugc

SEQ ID NO: 1885851 - RNA, 19 nt, Human
caccucugcacaagcugca

SEQ ID NO: 1885852 - RNA, 22 nt, Human
caccucugcuacucaaguagca

SEQ ID NO: 1885853 - RNA, 23 nt, Human
caccuggccucugcacuccccug

SEQ ID NO: 1885854 - RNA, 17 nt, Human
caccuggccucugcacu

SEQ ID NO: 1885855 - RNA, 18 nt, Human
caccuggccucugcacuc

SEQ ID NO: 1885856 - RNA, 19 nt, Human
caccuggccucugcacucc

SEQ ID NO: 1885857 - RNA, 20 nt, Human
caccuggccucugcacuccc

SEQ ID NO: 1885858 - RNA, 12 nt, Human
caccuggccucu

SEQ ID NO: 1885859 - RNA, 13 nt, Human
caccuggccucug

SEQ ID NO: 1885860 - RNA, 14 nt, Human
caccuggccucugc

SEQ ID NO: 1885861 - RNA, 15 nt, Human
caccuggccucugca

SEQ ID NO: 1885862 - RNA, 21 nt, Human
caccuguaaucccagcuacuu

SEQ ID NO: 1885863 - RNA, 16 nt, Human
caccuguaaucccagc

SEQ ID NO: 1885864 - RNA, 18 nt, Human
caccuguaaucccagcac

SEQ ID NO: 1885865 - RNA, 14 nt, Human
caccgggcagggcc

SEQ ID NO: 1885866 - RNA, 13 nt, Human
caccgggcagggc

SEQ ID NO: 1885867 - RNA, 18 nt, Human
caccgggccacagagaaa

SEQ ID NO: 1885868 - RNA, 15 nt, Human
caccgggccacagag

SEQ ID NO: 1885869 - RNA, 22 nt, Human
caccgggcacucagaagacacu

SEQ ID NO: 1885870 - RNA, 15 nt, Human
caccgggcacucaga

SEQ ID NO: 1885871 - RNA, 14 nt, Human
caccguacugugga

SEQ ID NO: 1885872 - RNA, 15 nt, Human
caccgugggcaggga

SEQ ID NO: 1885873 - RNA, 14 nt, Human
caccggcuggccug

SEQ ID NO: 1885874 - RNA, 15 nt, Human
caccggcuggccugg

SEQ ID NO: 1885875 - RNA, 16 nt, Human
caccggcuggccuggc

SEQ ID NO: 1885876 - RNA, 14 nt, Human
caccgggcacucag

SEQ ID NO: 1885877 - RNA, 20 nt, Human
caccggcuggccuggccccu

SEQ ID NO: 1885878 - RNA, 17 nt, Human
caccggcuggccuggcc

SEQ ID NO: 1885879 - RNA, 18 nt, Human
caccggcuggccuggccc

SEQ ID NO: 1885880 - RNA, 21 nt, Human
caccgcagacaggaccaggga

SEQ ID NO: 1885881 - RNA, 17 nt, Human
caccgccuccuacagcc

SEQ ID NO: 1885882 - RNA, 10 nt, Human
caccucccug

SEQ ID NO: 1885883 - RNA, 11 nt, Human
caccuccugcc

SEQ ID NO: 1885884 - RNA, 13 nt, Human
caccuccugccuc

SEQ ID NO: 1885885 - RNA, 14 nt, Human
caccuccugcuggg

SEQ ID NO: 1885886 - RNA, 15 nt, Human
caccuccugcugggc

SEQ ID NO: 1885887 - RNA, 14 nt, Human
caccuccugccucg

SEQ ID NO: 1885888 - RNA, 12 nt, Human
caccucccugcc

SEQ ID NO: 1885889 - RNA, 13 nt, Human
caccucccugccu

SEQ ID NO: 1885890 - RNA, 14 nt, Human
caccucccugccuc

SEQ ID NO: 1885891 - RNA, 15 nt, Human
caccucccugccucc

SEQ ID NO: 1885892 - RNA, 17 nt, Human
caccucccugccuccag

SEQ ID NO: 1885893 - RNA, 17 nt, Human
caccuccugcugggcag

SEQ ID NO: 1885894 - RNA, 20 nt, Human
caccucgaauuuuguuuucu

SEQ ID NO: 1885895 - RNA, 23 nt, Human
caccuccuuucaagguaacugua

SEQ ID NO: 1885896 - RNA, 15 nt, Human
caccucgaauuuugu

SEQ ID NO: 1885897 - RNA, 13 nt, Human
caccucucccuug

SEQ ID NO: 1885898 - RNA, 19 nt, Human
caccucucccugacccugu

SEQ ID NO: 1885899 - RNA, 14 nt, Human
caccucucccuugg

SEQ ID NO: 1885900 - RNA, 17 nt, Human
caccucucccuuggauu

SEQ ID NO: 1885901 - RNA, 16 nt, Human
cacgccagauucuuuc

SEQ ID NO: 1885902 - RNA, 21 nt, Human
cagaggagcugggagccgggc

SEQ ID NO: 1885903 - RNA, 20 nt, Human
cagaggagcugggagccggg

SEQ ID NO: 1885904 - RNA, 18 nt, Human
cagaggagggcagcagaa

SEQ ID NO: 1885905 - RNA, 14 nt, Human
cagaggagggcagc

SEQ ID NO: 1885906 - RNA, 21 nt, Human
cagaggacugugaugcccugc

SEQ ID NO: 1885907 - RNA, 20 nt, Human
cagaggagagaggacccccu

SEQ ID NO: 1885908 - RNA, 11 nt, Human
cagaggcagcc

SEQ ID NO: 1885909 - RNA, 22 nt, Human
cagaggagggcagcagaagggg

SEQ ID NO: 1885910 - RNA, 13 nt, Human
cagaggaggggcc

SEQ ID NO: 1885911 - RNA, 14 nt, Human
cagaggaggggccg

SEQ ID NO: 1885912 - RNA, 19 nt, Human
cagaggaggggccgcugcc

SEQ ID NO: 1885913 - RNA, 20 nt, Human
cagaggaggggccgcugcca

SEQ ID NO: 1885914 - RNA, 14 nt, Human
cagaggacugugau

SEQ ID NO: 1885915 - RNA, 13 nt, Human
cagaggagagagg

SEQ ID NO: 1885916 - RNA, 15 nt, Human
cagaggagagaggac

SEQ ID NO: 1885917 - RNA, 19 nt, Human
cagaggagagaggaccccc

SEQ ID NO: 1885918 - RNA, 22 nt, Human
cagaggacaguauuugugggga

SEQ ID NO: 1885919 - RNA, 13 nt, Human
cagagccugcagu

SEQ ID NO: 1885920 - RNA, 13 nt, Human
cagaggaaggaga

SEQ ID NO: 1885921 - RNA, 12 nt, Human
cagagccugcag

SEQ ID NO: 1885922 - RNA, 23 nt, Human
cagagcccacgcccccacuggug

SEQ ID NO: 1885923 - RNA, 11 nt, Human
cagagcccagc

SEQ ID NO: 1885924 - RNA, 13 nt, Human
cagagcccagcuc

SEQ ID NO: 1885925 - RNA, 14 nt, Human
cagagcccagcucc

SEQ ID NO: 1885926 - RNA, 17 nt, Human
cagagcccacgccccca

SEQ ID NO: 1885927 - RNA, 19 nt, Human
cagagcccacgcccccacu

SEQ ID NO: 1885928 - RNA, 20 nt, Human
cagagcccacgcccccacug

SEQ ID NO: 1885929 - RNA, 21 nt, Human
cagagcccacgcccccacugg

SEQ ID NO: 1885930 - RNA, 20 nt, Human
cagagcccaccuuggcucaa

SEQ ID NO: 1885931 - RNA, 16 nt, Human
cagagcccacgccccc

SEQ ID NO: 1885932 - RNA, 19 nt, Human
cagagcccaccuuggcuca

SEQ ID NO: 1885933 - RNA, 17 nt, Human
cagagcccaccuuggcu

SEQ ID NO: 1885934 - RNA, 15 nt, Human
cagagcccaccuugg

SEQ ID NO: 1885935 - RNA, 23 nt, Human
cagagccaggggggugaggagcu

SEQ ID NO: 1885936 - RNA, 22 nt, Human
cagagcagugggccuggccagc

SEQ ID NO: 1885937 - RNA, 21 nt, Human
cagagcagugggccuggccag

SEQ ID NO: 1885938 - RNA, 20 nt, Human
cagagcagugggccuggcca

SEQ ID NO: 1885939 - RNA, 17 nt, Human
cagagcagugggccugg

SEQ ID NO: 1885940 - RNA, 15 nt, Human
cagagcagugggccu

SEQ ID NO: 1885941 - RNA, 23 nt, Human
cagagcaccuuagacagucccug

SEQ ID NO: 1885942 - RNA, 11 nt, Human
cagagcagaga

SEQ ID NO: 1885943 - RNA, 12 nt, Human
cagagcagagac

SEQ ID NO: 1885944 - RNA, 18 nt, Human
cagagcaccuuagacagu

SEQ ID NO: 1885945 - RNA, 19 nt, Human
cagagcaccuuagacaguc

SEQ ID NO: 1885946 - RNA, 21 nt, Human
cagagcaccuuagacaguccc

SEQ ID NO: 1885947 - RNA, 22 nt, Human
cagagcaccuuagacagucccu

SEQ ID NO: 1885948 - RNA, 13 nt, Human
cagagcagagacc

SEQ ID NO: 1885949 - RNA, 14 nt, Human
cagagcagagacca

SEQ ID NO: 1885950 - RNA, 15 nt, Human
cagagcagagaccau

SEQ ID NO: 1885951 - RNA, 17 nt, Human
cagagcagagaccaucc

SEQ ID NO: 1885952 - RNA, 18 nt, Human
cagagcagagaccauccc

SEQ ID NO: 1885953 - RNA, 19 nt, Human
cagagcagagaccaucccu

SEQ ID NO: 1885954 - RNA, 21 nt, Human
cagagcagagaccaucccuga

SEQ ID NO: 1885955 - RNA, 13 nt, Human
cagagacaaggag

SEQ ID NO: 1885956 - RNA, 14 nt, Human
cagagacacaagcc

SEQ ID NO: 1885957 - RNA, 15 nt, Human
cagagacacaagccu

SEQ ID NO: 1885958 - RNA, 20 nt, Human
cagagacaaggagggcacag

SEQ ID NO: 1885959 - RNA, 16 nt, Human
cagagacaaggagggc

SEQ ID NO: 1885960 - RNA, 16 nt, Human
cagagacacaagccuu

SEQ ID NO: 1885961 - RNA, 17 nt, Human
cagagacacaagccuuc

SEQ ID NO: 1885962 - RNA, 13 nt, Human
cagagaccauccc

SEQ ID NO: 1885963 - RNA, 14 nt, Human
cagagaccaucccu

SEQ ID NO: 1885964 - RNA, 16 nt, Human
cagagaccaucccuga

SEQ ID NO: 1885965 - RNA, 15 nt, Human
cagagacauacuuga

SEQ ID NO: 1885966 - RNA, 16 nt, Human
cagagacauacuugaa

SEQ ID NO: 1885967 - RNA, 17 nt, Human
cagagacauacuugaag

SEQ ID NO: 1885968 - RNA, 19 nt, Human
cagagacauacuugaaggg

SEQ ID NO: 1885969 - RNA, 20 nt, Human
cagagacauacuugaagggc

SEQ ID NO: 1885970 - RNA, 21 nt, Human
cagagacauacuugaagggcc

SEQ ID NO: 1885971 - RNA, 23 nt, Human
cagagacauacuugaagggccag

SEQ ID NO: 1885972 - RNA, 19 nt, Human
cagagaagcucucgggcua

SEQ ID NO: 1885973 - RNA, 21 nt, Human
cagagaagcuauaaauuccuc

SEQ ID NO: 1885974 - RNA, 23 nt, Human
cagagaagcuauaaauuccucuu

SEQ ID NO: 1885975 - RNA, 19 nt, Human
cagagaaaggggagcccac

SEQ ID NO: 1885976 - RNA, 21 nt, Human
cagagaaugaaagggcccaga

SEQ ID NO: 1885977 - RNA, 20 nt, Human
cagagaaugaaagggcccag

SEQ ID NO: 1885978 - RNA, 15 nt, Human
cagagaauucucuua

SEQ ID NO: 1885979 - RNA, 19 nt, Human
cagagaaugaaagggccca

SEQ ID NO: 1885980 - RNA, 22 nt, Human
cagagauaguggggagacuucu

SEQ ID NO: 1885981 - RNA, 19 nt, Human
cagagauccaaaagaagcc

SEQ ID NO: 1885982 - RNA, 20 nt, Human
cagagauccaaaagaagccc

SEQ ID NO: 1885983 - RNA, 21 nt, Human
cagagauccaaaagaagcccc

SEQ ID NO: 1885984 - RNA, 23 nt, Human
cagagauccaaaagaagccccca

SEQ ID NO: 1885985 - RNA, 16 nt, Human
cagagcaccuuagaca

SEQ ID NO: 1885986 - RNA, 14 nt, Human
cagagcaagugaga

SEQ ID NO: 1885987 - RNA, 20 nt, Human
cagagcaagugagacccugu

SEQ ID NO: 1885988 - RNA, 20 nt, Human
cagagcaagacucugucuca

SEQ ID NO: 1885989 - RNA, 21 nt, Human
cagagaccaucccugaaggcc

SEQ ID NO: 1885990 - RNA, 14 nt, Human
cagagaccauugca

SEQ ID NO: 1885991 - RNA, 17 nt, Human
cagagaccaucccugaa

SEQ ID NO: 1885992 - RNA, 18 nt, Human
cagagaccaucccugaag

SEQ ID NO: 1885993 - RNA, 19 nt, Human
cagagaccaucccugaagg

SEQ ID NO: 1885994 - RNA, 20 nt, Human
cagagaccaucccugaaggc

SEQ ID NO: 1885995 - RNA, 13 nt, Human
cagagacuccugc

SEQ ID NO: 1885996 - RNA, 14 nt, Human
cagagacuccugca

SEQ ID NO: 1885997 - RNA, 15 nt, Human
cagagacuccugcag

SEQ ID NO: 1885998 - RNA, 16 nt, Human
cagagacuccugcagg

SEQ ID NO: 1885999 - RNA, 17 nt, Human
cagagacuccugcaggc

SEQ ID NO: 1886000 - RNA, 18 nt, Human
cagagacuccugcaggca

SEQ ID NO: 1886001 - RNA, 19 nt, Human
cagagacuccugcaggcag

SEQ ID NO: 1886002 - RNA, 16 nt, Human
cagaugcaccagcccu

SEQ ID NO: 1886003 - RNA, 14 nt, Human
cagaugcaccagcc

SEQ ID NO: 1886004 - RNA, 13 nt, Human
cagaugcaccagc

SEQ ID NO: 1886005 - RNA, 14 nt, Human
cagaugcaaugacu

SEQ ID NO: 1886006 - RNA, 22 nt, Human
cagaugcaccagcccuuagcag

SEQ ID NO: 1886007 - RNA, 17 nt, Human
cagaugcaccagcccuu

SEQ ID NO: 1886008 - RNA, 13 nt, Human
cagaugcagggca

SEQ ID NO: 1886009 - RNA, 14 nt, Human
cagaugcagggcag

SEQ ID NO: 1886010 - RNA, 15 nt, Human
cagaugaauguauuu

SEQ ID NO: 1886011 - RNA, 19 nt, Human
cagaugaauguauuuauuu

SEQ ID NO: 1886012 - RNA, 23 nt, Human
cagaugaauguauuuauuuggga

SEQ ID NO: 1886013 - RNA, 22 nt, Human
cagauacaggaaaagcugcuga

SEQ ID NO: 1886014 - RNA, 21 nt, Human
cagauacaggaaaagcugcug

SEQ ID NO: 1886015 - RNA, 20 nt, Human
cagauacaggaaaagcugcu

SEQ ID NO: 1886016 - RNA, 20 nt, Human
cagaucucuaacuucaccau

SEQ ID NO: 1886017 - RNA, 24 nt, Human
cagaucugacaugauuccuuccug

SEQ ID NO: 1886018 - RNA, 14 nt, Human
cagaucuggaaccu

SEQ ID NO: 1886019 - RNA, 15 nt, Human
cagaucuggaaccuc

SEQ ID NO: 1886020 - RNA, 18 nt, Human
cagaucuggaaccucagc

SEQ ID NO: 1886021 - RNA, 19 nt, Human
cagaucuggaaccucagcc

SEQ ID NO: 1886022 - RNA, 20 nt, Human
cagaucuggaaccucagccu

SEQ ID NO: 1886023 - RNA, 21 nt, Human
cagaucuggaaccucagccug

SEQ ID NO: 1886024 - RNA, 22 nt, Human
cagaucuggaaccucagccugg

SEQ ID NO: 1886025 - RNA, 23 nt, Human
cagaucuggaaccucagccuggc

SEQ ID NO: 1886026 - RNA, 22 nt, Human
cagaucugacaugauuccuucc

SEQ ID NO: 1886027 - RNA, 23 nt, Human
cagaucugacaugauuccuuccu

SEQ ID NO: 1886028 - RNA, 19 nt, Human
cagaguuguuacauuuuua

SEQ ID NO: 1886029 - RNA, 18 nt, Human
cagaguuguuacauuuuu

SEQ ID NO: 1886030 - RNA, 15 nt, Human
cagaguuguuacauu

SEQ ID NO: 1886031 - RNA, 14 nt, Human
cagauaaacaguag

SEQ ID NO: 1886032 - RNA, 22 nt, Human
cagauaaagguucaugcaaacu

SEQ ID NO: 1886033 - RNA, 23 nt, Human
cagauaaauaguuuaugauucca

SEQ ID NO: 1886034 - RNA, 22 nt, Human
cagaguugaagacagagcuaca

SEQ ID NO: 1886035 - RNA, 14 nt, Human
cagaguuguuacau

SEQ ID NO: 1886036 - RNA, 17 nt, Human
cagaguugaagacagag

SEQ ID NO: 1886037 - RNA, 18 nt, Human
cagaguugaagacagagc

SEQ ID NO: 1886038 - RNA, 19 nt, Human
cagaguugaagacagagcu

SEQ ID NO: 1886039 - RNA, 20 nt, Human
cagaguugaagacagagcua

SEQ ID NO: 1886040 - RNA, 14 nt, Human
cagaguugaagaca

SEQ ID NO: 1886041 - RNA, 15 nt, Human
cagaguugaagacag

SEQ ID NO: 1886042 - RNA, 16 nt, Human
cagaguugaagacaga

SEQ ID NO: 1886043 - RNA, 20 nt, Human
cagagugagacucugucuca

SEQ ID NO: 1886044 - RNA, 19 nt, Human
cagagugagacucugucuc

SEQ ID NO: 1886045 - RNA, 18 nt, Human
cagagugcaagccccugc

SEQ ID NO: 1886046 - RNA, 23 nt, Human
cagagugcaagccccugcuccag

SEQ ID NO: 1886047 - RNA, 20 nt, Human
cagagugcaagccccugcuc

SEQ ID NO: 1886048 - RNA, 18 nt, Human
cagagugagacucugucu

SEQ ID NO: 1886049 - RNA, 17 nt, Human
cagagugagacucuguc

SEQ ID NO: 1886050 - RNA, 16 nt, Human
cagagugagacucugu

SEQ ID NO: 1886051 - RNA, 23 nt, Human
cagagucucacuguugcccaggc

SEQ ID NO: 1886052 - RNA, 22 nt, Human
cagagucucacuguugcccagg

SEQ ID NO: 1886053 - RNA, 23 nt, Human
cagagucucgcucuguugcccag

SEQ ID NO: 1886054 - RNA, 23 nt, Human
cagagggagugacagaggcagcc

SEQ ID NO: 1886055 - RNA, 22 nt, Human
cagagggagugacagaggcagc

SEQ ID NO: 1886056 - RNA, 21 nt, Human
cagagggagugacagaggcag

SEQ ID NO: 1886057 - RNA, 20 nt, Human
cagagggagugacagaggca

SEQ ID NO: 1886058 - RNA, 15 nt, Human
cagagggccugcaag

SEQ ID NO: 1886059 - RNA, 19 nt, Human
cagagggccugcaagggag

SEQ ID NO: 1886060 - RNA, 21 nt, Human
cagagucucacuguugcccag

SEQ ID NO: 1886061 - RNA, 20 nt, Human
cagagucucacuguugccca

SEQ ID NO: 1886062 - RNA, 19 nt, Human
cagagucucacuguugccc

SEQ ID NO: 1886063 - RNA, 17 nt, Human
cagagucucacuguugc

SEQ ID NO: 1886064 - RNA, 13 nt, Human
cagagucucacug

SEQ ID NO: 1886065 - RNA, 22 nt, Human
cagaggcagccccauucugccu

SEQ ID NO: 1886066 - RNA, 20 nt, Human
cagaggcagccccauucugc

SEQ ID NO: 1886067 - RNA, 19 nt, Human
cagaggcagccccauucug

SEQ ID NO: 1886068 - RNA, 18 nt, Human
cagaggcagccccauucu

SEQ ID NO: 1886069 - RNA, 15 nt, Human
cagaggcagccccau

SEQ ID NO: 1886070 - RNA, 14 nt, Human
cagaggcagcccca

SEQ ID NO: 1886071 - RNA, 13 nt, Human
cagaggcagcccc

SEQ ID NO: 1886072 - RNA, 12 nt, Human
cagaggcagccc

SEQ ID NO: 1886073 - RNA, 21 nt, Human
cagaggccaugggccuccugu

SEQ ID NO: 1886074 - RNA, 20 nt, Human
cagaggccaugggccuccug

SEQ ID NO: 1886075 - RNA, 16 nt, Human
cagaggccaugggccu

SEQ ID NO: 1886076 - RNA, 19 nt, Human
cagaggccaugggccuccu

SEQ ID NO: 1886077 - RNA, 23 nt, Human
cagaggcagccccauucugccug

SEQ ID NO: 1886078 - RNA, 19 nt, Human
cagagggagugacagaggc

SEQ ID NO: 1886079 - RNA, 18 nt, Human
cagagggagugacagagg

SEQ ID NO: 1886080 - RNA, 16 nt, Human
cagagggagugacaga

SEQ ID NO: 1886081 - RNA, 14 nt, Human
cagagggagugaca

SEQ ID NO: 1886082 - RNA, 23 nt, Human
cagaggcugccucucccaucacu

SEQ ID NO: 1886083 - RNA, 23 nt, Human
cagaggcgcaugaauuugugaag

SEQ ID NO: 1886084 - RNA, 17 nt, Human
cagaggcgcacugugac

SEQ ID NO: 1886085 - RNA, 13 nt, Human
cagaggcugccuc

SEQ ID NO: 1886086 - RNA, 18 nt, Human
cagaggcgcacugugacc

SEQ ID NO: 1886087 - RNA, 13 nt, Human
cagaggccccagc

SEQ ID NO: 1886088 - RNA, 14 nt, Human
cagaggccccagcc

SEQ ID NO: 1886089 - RNA, 16 nt, Human
cagaggccccagccuc

SEQ ID NO: 1886090 - RNA, 17 nt, Human
cagaggccccagccucc

SEQ ID NO: 1886091 - RNA, 13 nt, Human
cagaaacaggacc

SEQ ID NO: 1886092 - RNA, 18 nt, Human
cagaaagcagaacaguga

SEQ ID NO: 1886093 - RNA, 19 nt, Human
cagaaacuguucccaccug

SEQ ID NO: 1886094 - RNA, 19 nt, Human
cagaaagcagaacagugau

SEQ ID NO: 1886095 - RNA, 23 nt, Human
cagaacagugauuaccagggacu

SEQ ID NO: 1886096 - RNA, 21 nt, Human
cagaaaagaaaguucaugcuu

SEQ ID NO: 1886097 - RNA, 22 nt, Human
cagaaaaguugaauuuuacaug

SEQ ID NO: 1886098 - RNA, 20 nt, Human
cagaaaaguugaauuuuaca

SEQ ID NO: 1886099 - RNA, 17 nt, Human
cagaaaaguugaauuuu

SEQ ID NO: 1886100 - RNA, 16 nt, Human
cagaaaauggaagaca

SEQ ID NO: 1886101 - RNA, 20 nt, Human
cagaaaauggaagacagcuc

SEQ ID NO: 1886102 - RNA, 21 nt, Human
cagaaaauggaagacagcucu

SEQ ID NO: 1886103 - RNA, 22 nt, Human
cagaaaauggaagacagcucuu

SEQ ID NO: 1886104 - RNA, 23 nt, Human
cagaaaauggaagacagcucuua

SEQ ID NO: 1886105 - RNA, 14 nt, Human
cagaaaauguugag

SEQ ID NO: 1886106 - RNA, 18 nt, Human
cagaaaauguugagaauc

SEQ ID NO: 1886107 - RNA, 23 nt, Human
cagaaaauguugagaaucccaaa

SEQ ID NO: 1886108 - RNA, 14 nt, Human
cacuuuuguucuug

SEQ ID NO: 1886109 - RNA, 22 nt, Human
cacuuuuguucuugguuuguaa

SEQ ID NO: 1886110 - RNA, 20 nt, Human
cacuuugucgcccaggcugg

SEQ ID NO: 1886111 - RNA, 23 nt, Human
cacuuuuuuuuuuaaucuccacc

SEQ ID NO: 1886112 - RNA, 13 nt, Human
cagaaaaaccaga

SEQ ID NO: 1886113 - RNA, 12 nt, Human
cacuuugcauaa

SEQ ID NO: 1886114 - RNA, 20 nt, Human
cacuuuggauuucaucagac

SEQ ID NO: 1886115 - RNA, 22 nt, Human
cacuuucuagccagaggagaga

SEQ ID NO: 1886116 - RNA, 22 nt, Human
cacuuucucaugauuuacagag

SEQ ID NO: 1886117 - RNA, 16 nt, Human
cacuuugggaggccaa

SEQ ID NO: 1886118 - RNA, 23 nt, Human
cacuuugggaggccaaggagggc

SEQ ID NO: 1886119 - RNA, 12 nt, Human
cacuuugggagg

SEQ ID NO: 1886120 - RNA, 13 nt, Human
cacuuugggaggc

SEQ ID NO: 1886121 - RNA, 13 nt, Human
cacuuuguucugg

SEQ ID NO: 1886122 - RNA, 14 nt, Human
cacuuuguucuggc

SEQ ID NO: 1886123 - RNA, 16 nt, Human
cacuuuguucuggcuc

SEQ ID NO: 1886124 - RNA, 23 nt, Human
cacuuuguucuggcucuuccagg

SEQ ID NO: 1886125 - RNA, 19 nt, Human
cagaagggagcuagccaga

SEQ ID NO: 1886126 - RNA, 20 nt, Human
cagaagggagcuagccagag

SEQ ID NO: 1886127 - RNA, 21 nt, Human
cagaagggagcuagccagagg

SEQ ID NO: 1886128 - RNA, 21 nt, Human
cagaaggggguggugucucca

SEQ ID NO: 1886129 - RNA, 20 nt, Human
cagaaggggguggugucucc

SEQ ID NO: 1886130 - RNA, 19 nt, Human
cagaaggggguggugucuc

SEQ ID NO: 1886131 - RNA, 14 nt, Human
cagaaggggguggu

SEQ ID NO: 1886132 - RNA, 17 nt, Human
cagaaucucaaauaacu

SEQ ID NO: 1886133 - RNA, 18 nt, Human
cagaaucucaaauaacua

SEQ ID NO: 1886134 - RNA, 22 nt, Human
cagaaggagacaggcagagcug

SEQ ID NO: 1886135 - RNA, 13 nt, Human
cagaaggagacag

SEQ ID NO: 1886136 - RNA, 17 nt, Human
cagaaggagacaggcag

SEQ ID NO: 1886137 - RNA, 18 nt, Human
cagaaggagacaggcaga

SEQ ID NO: 1886138 - RNA, 16 nt, Human
cagaagcuucugccca

SEQ ID NO: 1886139 - RNA, 19 nt, Human
cagaaggaagacuucaucc

SEQ ID NO: 1886140 - RNA, 16 nt, Human
cagaaggaagacuuca

SEQ ID NO: 1886141 - RNA, 12 nt, Human
cagaagcuucca

SEQ ID NO: 1886142 - RNA, 17 nt, Human
cagaaggaagacuucau

SEQ ID NO: 1886143 - RNA, 18 nt, Human
cagaaggaagacuucauc

SEQ ID NO: 1886144 - RNA, 18 nt, Human
cagaagccugaugcugac

SEQ ID NO: 1886145 - RNA, 17 nt, Human
cagaagcuaagcugcag

SEQ ID NO: 1886146 - RNA, 23 nt, Human
cagaaccccuggcuccaggccag

SEQ ID NO: 1886147 - RNA, 19 nt, Human
cagaacuaaacucauuuau

SEQ ID NO: 1886148 - RNA, 20 nt, Human
cagaacuaaacucauuuaua

SEQ ID NO: 1886149 - RNA, 17 nt, Human
cagaacuaaacucauuu

SEQ ID NO: 1886150 - RNA, 18 nt, Human
cagaacuaaacucauuua

SEQ ID NO: 1886151 - RNA, 20 nt, Human
cagaacucaaauggggccag

SEQ ID NO: 1886152 - RNA, 21 nt, Human
cagaacucaaauggggccaga

SEQ ID NO: 1886153 - RNA, 22 nt, Human
cagaacucaaauggggccagau

SEQ ID NO: 1886154 - RNA, 15 nt, Human
cagaacucacugggg

SEQ ID NO: 1886155 - RNA, 18 nt, Human
cagaacucacuggggccu

SEQ ID NO: 1886156 - RNA, 21 nt, Human
cagaagacacugaugggcaac

SEQ ID NO: 1886157 - RNA, 20 nt, Human
cagaagauagcuucacccca

SEQ ID NO: 1886158 - RNA, 14 nt, Human
cagaagaaggcagc

SEQ ID NO: 1886159 - RNA, 15 nt, Human
cagaagaacccuggc

SEQ ID NO: 1886160 - RNA, 15 nt, Human
cagaagaaggcagca

SEQ ID NO: 1886161 - RNA, 14 nt, Human
cagaagcagcucuu

SEQ ID NO: 1886162 - RNA, 13 nt, Human
cagaagcagcucu

SEQ ID NO: 1886163 - RNA, 18 nt, Human
cagaagaugaacagacug

SEQ ID NO: 1886164 - RNA, 15 nt, Human
cagaagaugaacaga

SEQ ID NO: 1886165 - RNA, 20 nt, Human
cagaagcaacccaaauguuc

SEQ ID NO: 1886166 - RNA, 19 nt, Human
cagaagcaacccaaauguu

SEQ ID NO: 1886167 - RNA, 14 nt, Human
cagaagcccagaau

SEQ ID NO: 1886168 - RNA, 12 nt, Human
cagaagcccaga

SEQ ID NO: 1886169 - RNA, 11 nt, Human
cagaagcccag

SEQ ID NO: 1886170 - RNA, 16 nt, Human
cagaccauaauguuac

SEQ ID NO: 1886171 - RNA, 13 nt, Human
cagaccagcucuu

SEQ ID NO: 1886172 - RNA, 13 nt, Human
cagaccacggcuc

SEQ ID NO: 1886173 - RNA, 14 nt, Human
cagaccacaaaacu

SEQ ID NO: 1886174 - RNA, 20 nt, Human
cagaccacaaaacuuuucua

SEQ ID NO: 1886175 - RNA, 14 nt, Human
cagacauuggcacc

SEQ ID NO: 1886176 - RNA, 15 nt, Human
cagacccccuggaga

SEQ ID NO: 1886177 - RNA, 22 nt, Human
cagaccuaggauuucaugauuu

SEQ ID NO: 1886178 - RNA, 15 nt, Human
cagaccuaaugcucc

SEQ ID NO: 1886179 - RNA, 16 nt, Human
cagaccuaaugcuccu

SEQ ID NO: 1886180 - RNA, 17 nt, Human
cagaccuaaugcuccuu

SEQ ID NO: 1886181 - RNA, 18 nt, Human
cagaccuaaugcuccuug

SEQ ID NO: 1886182 - RNA, 16 nt, Human
cagaccccuuggccag

SEQ ID NO: 1886183 - RNA, 22 nt, Human
cagacccugcccugugggcccc

SEQ ID NO: 1886184 - RNA, 15 nt, Human
cagacccugcccugu

SEQ ID NO: 1886185 - RNA, 16 nt, Human
cagacccugcccugug

SEQ ID NO: 1886186 - RNA, 17 nt, Human
cagacccugcccugugg

SEQ ID NO: 1886187 - RNA, 21 nt, Human
cagacccugcccugugggccc

SEQ ID NO: 1886188 - RNA, 15 nt, Human
cagaccccuuggcca

SEQ ID NO: 1886189 - RNA, 13 nt, Human
cagaccccuuggc

SEQ ID NO: 1886190 - RNA, 14 nt, Human
cagacccggcugcg

SEQ ID NO: 1886191 - RNA, 12 nt, Human
cagacccggcug

SEQ ID NO: 1886192 - RNA, 16 nt, Human
cagacccggcugcgug

SEQ ID NO: 1886193 - RNA, 12 nt, Human
cagacccugccc

SEQ ID NO: 1886194 - RNA, 13 nt, Human
cagacccugcccu

SEQ ID NO: 1886195 - RNA, 14 nt, Human
cagacccugcccug

SEQ ID NO: 1886196 - RNA, 23 nt, Human
cagagaaaguacuucuccacccu

SEQ ID NO: 1886197 - RNA, 19 nt, Human
cagagaaaguacuucucca

SEQ ID NO: 1886198 - RNA, 18 nt, Human
cagagaaaggggagccca

SEQ ID NO: 1886199 - RNA, 17 nt, Human
cagagaaagcgcagaug

SEQ ID NO: 1886200 - RNA, 13 nt, Human
cagagaaagcgca

SEQ ID NO: 1886201 - RNA, 15 nt, Human
cagagaaagcgcaga

SEQ ID NO: 1886202 - RNA, 16 nt, Human
cagagaaagcgcagau

SEQ ID NO: 1886203 - RNA, 15 nt, Human
cagacuuccuugaga

SEQ ID NO: 1886204 - RNA, 24 nt, Human
cagacuuccuugagacacggagcc

SEQ ID NO: 1886205 - RNA, 14 nt, Human
cagacucagacauu

SEQ ID NO: 1886206 - RNA, 20 nt, Human
cagacucacaaccugaaccu

SEQ ID NO: 1886207 - RNA, 21 nt, Human
cagacucacaaccugaaccua

SEQ ID NO: 1886208 - RNA, 14 nt, Human
cagacucccauucc

SEQ ID NO: 1886209 - RNA, 16 nt, Human
cagacucauauuacug

SEQ ID NO: 1886210 - RNA, 17 nt, Human
cagacucccauuccuga

SEQ ID NO: 1886211 - RNA, 18 nt, Human
cagacucccauuccugaa

SEQ ID NO: 1886212 - RNA, 14 nt, Human
cagacgcccagauu

SEQ ID NO: 1886213 - RNA, 20 nt, Human
cagaccuuuuaacuccucaa

SEQ ID NO: 1886214 - RNA, 19 nt, Human
cagaccuguuagcagacag

SEQ ID NO: 1886215 - RNA, 20 nt, Human
cagaccuguuagcagacagg

SEQ ID NO: 1886216 - RNA, 13 nt, Human
cagaccugauccu

SEQ ID NO: 1886217 - RNA, 14 nt, Human
cagaccugauccug

SEQ ID NO: 1886218 - RNA, 17 nt, Human
cagaccugauccuggag

SEQ ID NO: 1886219 - RNA, 20 nt, Human
cagaccugauccuggaggcc

SEQ ID NO: 1886220 - RNA, 22 nt, Human
cagaccugauccuggaggccca

SEQ ID NO: 1886221 - RNA, 23 nt, Human
cagaccugauccuggaggcccag

SEQ ID NO: 1886222 - RNA, 20 nt, Human
cagaccugcagacgcccaga

SEQ ID NO: 1886223 - RNA, 22 nt, Human
cagacucaaaugcucagaccag

SEQ ID NO: 1886224 - RNA, 23 nt, Human
cagacucaaaugcucagaccagc

SEQ ID NO: 1886225 - RNA, 19 nt, Human
cagacucacaaccugaacc

SEQ ID NO: 1886226 - RNA, 22 nt, Human
cagacaccuugacagggcacac

SEQ ID NO: 1886227 - RNA, 20 nt, Human
cagacaccuugacagggcac

SEQ ID NO: 1886228 - RNA, 19 nt, Human
cagacaccuugacagggca

SEQ ID NO: 1886229 - RNA, 14 nt, Human
cagacacccucaac

SEQ ID NO: 1886230 - RNA, 15 nt, Human
cagacacccucaacc

SEQ ID NO: 1886231 - RNA, 21 nt, Human
cagacacccucaaccucuucu

SEQ ID NO: 1886232 - RNA, 20 nt, Human
cagacaguuaagagaaauga

SEQ ID NO: 1886233 - RNA, 19 nt, Human
cagacauacuaaccagcag

SEQ ID NO: 1886234 - RNA, 19 nt, Human
cagacauagaauuaacaca

SEQ ID NO: 1886235 - RNA, 17 nt, Human
cagacauagaauuaaca

SEQ ID NO: 1886236 - RNA, 18 nt, Human
cagacaugccacaaggac

SEQ ID NO: 1886237 - RNA, 12 nt, Human
cagacauguuuu

SEQ ID NO: 1886238 - RNA, 18 nt, Human
cagacauguuuuccguga

SEQ ID NO: 1886239 - RNA, 22 nt, Human
cagacauguuuuccgugaaaac

SEQ ID NO: 1886240 - RNA, 23 nt, Human
cagacacaggcccggcuccaggc

SEQ ID NO: 1886241 - RNA, 22 nt, Human
cagacacaggcccggcuccagg

SEQ ID NO: 1886242 - RNA, 21 nt, Human
cagacacaggcccggcuccag

SEQ ID NO: 1886243 - RNA, 18 nt, Human
cagacacaggcccggcuc

SEQ ID NO: 1886244 - RNA, 17 nt, Human
cagacacaggcccggcu

SEQ ID NO: 1886245 - RNA, 15 nt, Human
cagacacaggcccgg

SEQ ID NO: 1886246 - RNA, 14 nt, Human
cagacacaggcccg

SEQ ID NO: 1886247 - RNA, 13 nt, Human
cagacacaggccc

SEQ ID NO: 1886248 - RNA, 14 nt, Human
cagacacaugucca

SEQ ID NO: 1886249 - RNA, 14 nt, Human
cagacacaggcccu

SEQ ID NO: 1886250 - RNA, 15 nt, Human
cagacacaggcccuc

SEQ ID NO: 1886251 - RNA, 18 nt, Human
cagacacaggcccucccu

SEQ ID NO: 1886252 - RNA, 17 nt, Human
cagacacauguccaaga

SEQ ID NO: 1886253 - RNA, 21 nt, Human
cagacacauguccaagaagcc

SEQ ID NO: 1886254 - RNA, 22 nt, Human
cagacacauguccaagaagccc

SEQ ID NO: 1886255 - RNA, 23 nt, Human
cagacacauguccaagaagccca

SEQ ID NO: 1886256 - RNA, 12 nt, Human
cagacacccagg

SEQ ID NO: 1886257 - RNA, 13 nt, Human
cagacacccagga

SEQ ID NO: 1886258 - RNA, 14 nt, Human
cagacacccaggac

SEQ ID NO: 1886259 - RNA, 15 nt, Human
cagacacccaggacu

SEQ ID NO: 1886260 - RNA, 17 nt, Human
cagacacccaggacuua

SEQ ID NO: 1886261 - RNA, 22 nt, Human
cagacaaagcgugguggacaug

SEQ ID NO: 1886262 - RNA, 20 nt, Human
cagacaacaaaccuguuucu

SEQ ID NO: 1886263 - RNA, 24 nt, Human
cagaauuucccaaagcagugcaug

SEQ ID NO: 1886264 - RNA, 19 nt, Human
cagaauuuggguucugccu

SEQ ID NO: 1886265 - RNA, 12 nt, Human
cagacaaagcgu

SEQ ID NO: 1886266 - RNA, 17 nt, Human
cagaauuucccaaagca

SEQ ID NO: 1886267 - RNA, 18 nt, Human
cagaauuucccaaagcag

SEQ ID NO: 1886268 - RNA, 19 nt, Human
cagaauuucccaaagcagu

SEQ ID NO: 1886269 - RNA, 20 nt, Human
cagaauuucccaaagcagug

SEQ ID NO: 1886270 - RNA, 18 nt, Human
cagaaugcugcaggacuu

SEQ ID NO: 1886271 - RNA, 15 nt, Human
cagaaugaggcugcu

SEQ ID NO: 1886272 - RNA, 14 nt, Human
cagaaugaggcugc

SEQ ID NO: 1886273 - RNA, 18 nt, Human
cagaauggggugcaugaa

SEQ ID NO: 1886274 - RNA, 21 nt, Human
cagaaugcuguacaucuauuu

SEQ ID NO: 1886275 - RNA, 11 nt, Human
cagaaugcugu

SEQ ID NO: 1886276 - RNA, 16 nt, Human
cagaaugcuguacauc

SEQ ID NO: 1886277 - RNA, 17 nt, Human
cagaaugcuguacaucu

SEQ ID NO: 1886278 - RNA, 18 nt, Human
cagaaugcuguacaucua

SEQ ID NO: 1886279 - RNA, 14 nt, Human
cagaauuucccaaa

SEQ ID NO: 1886280 - RNA, 23 nt, Human
cagaauuggauacauacaccagc

SEQ ID NO: 1886281 - RNA, 11 nt, Human
cagaauucuca

SEQ ID NO: 1886282 - RNA, 18 nt, Human
cagaauucucuaguuuga

SEQ ID NO: 1886283 - RNA, 15 nt, Human
cagaauucucuaguu

SEQ ID NO: 1886284 - RNA, 16 nt, Human
cagacaacaaaccugu

SEQ ID NO: 1886285 - RNA, 14 nt, Human
cagcaagucucuuu

SEQ ID NO: 1886286 - RNA, 15 nt, Human
cagcaagucaggguu

SEQ ID NO: 1886287 - RNA, 12 nt, Human
cagcaagugaga

SEQ ID NO: 1886288 - RNA, 17 nt, Human
cagcaagugagagcugg

SEQ ID NO: 1886289 - RNA, 16 nt, Human
cagcaagugagagcug

SEQ ID NO: 1886290 - RNA, 15 nt, Human
cagcaagugagagcu

SEQ ID NO: 1886291 - RNA, 14 nt, Human
cagcaagugagagc

SEQ ID NO: 1886292 - RNA, 17 nt, Human
cagcaaggagauuuaca

SEQ ID NO: 1886293 - RNA, 18 nt, Human
cagcaaggagauuuacaa

SEQ ID NO: 1886294 - RNA, 21 nt, Human
cagcaagugagagcugggugu

SEQ ID NO: 1886295 - RNA, 19 nt, Human
cagcaagugagagcugggu

SEQ ID NO: 1886296 - RNA, 21 nt, Human
cagcaauaaagcagcguuucu

SEQ ID NO: 1886297 - RNA, 13 nt, Human
cagcaauaaagca

SEQ ID NO: 1886298 - RNA, 22 nt, Human
cagcaauaaagcagcguuucua

SEQ ID NO: 1886299 - RNA, 13 nt, Human
cagcacaaggcca

SEQ ID NO: 1886300 - RNA, 16 nt, Human
cagcacaaggccaucu

SEQ ID NO: 1886301 - RNA, 13 nt, Human
cagcacacagggc

SEQ ID NO: 1886302 - RNA, 14 nt, Human
cagcacacagggca

SEQ ID NO: 1886303 - RNA, 15 nt, Human
cagcacacagggcag

SEQ ID NO: 1886304 - RNA, 11 nt, Human
cagcagacuga

SEQ ID NO: 1886305 - RNA, 18 nt, Human
cagcagacugaucaggac

SEQ ID NO: 1886306 - RNA, 11 nt, Human
cagcagagcac

SEQ ID NO: 1886307 - RNA, 13 nt, Human
cagcagagcaccu

SEQ ID NO: 1886308 - RNA, 22 nt, Human
cagcagaaaugccuuacccuca

SEQ ID NO: 1886309 - RNA, 19 nt, Human
cagcagaaaugccuuaccc

SEQ ID NO: 1886310 - RNA, 17 nt, Human
cagcagaaggggguggu

SEQ ID NO: 1886311 - RNA, 13 nt, Human
cagcagaaggggg

SEQ ID NO: 1886312 - RNA, 17 nt, Human
cagcagaaaugccuuac

SEQ ID NO: 1886313 - RNA, 15 nt, Human
cagcagaaaugccuu

SEQ ID NO: 1886314 - RNA, 15 nt, Human
cagcacuuugggagg

SEQ ID NO: 1886315 - RNA, 16 nt, Human
cagcacuuugggaggc

SEQ ID NO: 1886316 - RNA, 18 nt, Human
cagcacuuguccagcuga

SEQ ID NO: 1886317 - RNA, 19 nt, Human
cagcacuuguccagcugag

SEQ ID NO: 1886318 - RNA, 13 nt, Human
cagcacuuauuua

SEQ ID NO: 1886319 - RNA, 15 nt, Human
cagcacuuguccagc

SEQ ID NO: 1886320 - RNA, 17 nt, Human
cagcacuuguccagcug

SEQ ID NO: 1886321 - RNA, 19 nt, Human
cagauuuugcuguauauuu

SEQ ID NO: 1886322 - RNA, 23 nt, Human
cagauuuugcuguauauuuguga

SEQ ID NO: 1886323 - RNA, 20 nt, Human
cagauuuuuuuuggacuguu

SEQ ID NO: 1886324 - RNA, 16 nt, Human
cagauuuugcuguaua

SEQ ID NO: 1886325 - RNA, 17 nt, Human
cagauuuugcuguauau

SEQ ID NO: 1886326 - RNA, 14 nt, Human
cagauucuuuccug

SEQ ID NO: 1886327 - RNA, 15 nt, Human
cagauuuuaauuuug

SEQ ID NO: 1886328 - RNA, 23 nt, Human
cagauuuuaauuuugaauaaaua

SEQ ID NO: 1886329 - RNA, 18 nt, Human
cagcaaaagaugcuucuc

SEQ ID NO: 1886330 - RNA, 13 nt, Human
cagcaaccccagg

SEQ ID NO: 1886331 - RNA, 16 nt, Human
cagcaaccccaggcug

SEQ ID NO: 1886332 - RNA, 17 nt, Human
cagcaaccccaggcuga

SEQ ID NO: 1886333 - RNA, 12 nt, Human
cagcaaccccag

SEQ ID NO: 1886334 - RNA, 14 nt, Human
cagcaacagaaaaa

SEQ ID NO: 1886335 - RNA, 17 nt, Human
cagcaacagaaaaaugg

SEQ ID NO: 1886336 - RNA, 13 nt, Human
cagcaacagaaaa

SEQ ID NO: 1886337 - RNA, 23 nt, Human
cagaugggugcuuggaggaagga

SEQ ID NO: 1886338 - RNA, 14 nt, Human
cagauguuuccaga

SEQ ID NO: 1886339 - RNA, 15 nt, Human
cagauguuuccagac

SEQ ID NO: 1886340 - RNA, 16 nt, Human
cagauguuuccagacu

SEQ ID NO: 1886341 - RNA, 19 nt, Human
cagauuaugagacacagga

SEQ ID NO: 1886342 - RNA, 21 nt, Human
cagauuaugagacacaggaug

SEQ ID NO: 1886343 - RNA, 18 nt, Human
cagauguuuccagacuuc

SEQ ID NO: 1886344 - RNA, 23 nt, Human
cagauguuuccagacuuccuuga

SEQ ID NO: 1886345 - RNA, 17 nt, Human
cagaugcagggcaguca

SEQ ID NO: 1886346 - RNA, 18 nt, Human
cagaugggugcuuggagg

SEQ ID NO: 1886347 - RNA, 14 nt, Human
cagauggaaaggag

SEQ ID NO: 1886348 - RNA, 16 nt, Human
cagauggaaaggagcc

SEQ ID NO: 1886349 - RNA, 15 nt, Human
cagcccagccacgga

SEQ ID NO: 1886350 - RNA, 13 nt, Human
cagcccagagaca

SEQ ID NO: 1886351 - RNA, 21 nt, Human
cagcccagagacauacuugaa

SEQ ID NO: 1886352 - RNA, 22 nt, Human
cagcccagagacauacuugaag

SEQ ID NO: 1886353 - RNA, 18 nt, Human
cagcccacuucugccaua

SEQ ID NO: 1886354 - RNA, 11 nt, Human
cagcccagaga

SEQ ID NO: 1886355 - RNA, 12 nt, Human
cagcccagagac

SEQ ID NO: 1886356 - RNA, 22 nt, Human
cagccccaaaacucuccucugc

SEQ ID NO: 1886357 - RNA, 20 nt, Human
cagccccaaaacucuccucu

SEQ ID NO: 1886358 - RNA, 21 nt, Human
cagccccaaaacucuccucug

SEQ ID NO: 1886359 - RNA, 15 nt, Human
cagcccacuucugcc

SEQ ID NO: 1886360 - RNA, 16 nt, Human
cagcccaccuggcuuu

SEQ ID NO: 1886361 - RNA, 15 nt, Human
cagcccaccccucaa

SEQ ID NO: 1886362 - RNA, 16 nt, Human
cagccaucaaaaugcu

SEQ ID NO: 1886363 - RNA, 17 nt, Human
cagccaucaaaaugcuu

SEQ ID NO: 1886364 - RNA, 17 nt, Human
cagccaugucugcauuu

SEQ ID NO: 1886365 - RNA, 17 nt, Human
cagcccaaagaaggaaa

SEQ ID NO: 1886366 - RNA, 23 nt, Human
cagcccaaaccaccagaagccca

SEQ ID NO: 1886367 - RNA, 21 nt, Human
cagcccaaaccaccagaagcc

SEQ ID NO: 1886368 - RNA, 20 nt, Human
cagcccaaaccaccagaagc

SEQ ID NO: 1886369 - RNA, 19 nt, Human
cagcccaaaccaccagaag

SEQ ID NO: 1886370 - RNA, 16 nt, Human
cagcccaaaccaccag

SEQ ID NO: 1886371 - RNA, 20 nt, Human
cagccacggacgcuggcucc

SEQ ID NO: 1886372 - RNA, 18 nt, Human
cagccacgaggugcaaca

SEQ ID NO: 1886373 - RNA, 21 nt, Human
cagccaccgaagccgccugug

SEQ ID NO: 1886374 - RNA, 19 nt, Human
cagccacauuccugaugcu

SEQ ID NO: 1886375 - RNA, 15 nt, Human
cagccacauuccuga

SEQ ID NO: 1886376 - RNA, 17 nt, Human
cagccacauuccugaug

SEQ ID NO: 1886377 - RNA, 14 nt, Human
cagccacauuccug

SEQ ID NO: 1886378 - RNA, 22 nt, Human
cagccacggccaggccagaggg

SEQ ID NO: 1886379 - RNA, 21 nt, Human
cagccacggccaggccagagg

SEQ ID NO: 1886380 - RNA, 19 nt, Human
cagccacggccaggccaga

SEQ ID NO: 1886381 - RNA, 18 nt, Human
cagccacggccaggccag

SEQ ID NO: 1886382 - RNA, 17 nt, Human
cagccacggccaggcca

SEQ ID NO: 1886383 - RNA, 16 nt, Human
cagccacggccaggcc

SEQ ID NO: 1886384 - RNA, 15 nt, Human
cagccacggccaggc

SEQ ID NO: 1886385 - RNA, 14 nt, Human
cagccacggccagg

SEQ ID NO: 1886386 - RNA, 23 nt, Human
cagccacggccaggccagaggga

SEQ ID NO: 1886387 - RNA, 22 nt, Human
cagccaguaaaugggggugcau

SEQ ID NO: 1886388 - RNA, 13 nt, Human
cagccaguaaaug

SEQ ID NO: 1886389 - RNA, 13 nt, Human
cagccaucaaaau

SEQ ID NO: 1886390 - RNA, 20 nt, Human
cagcauccuggcacccggcc

SEQ ID NO: 1886391 - RNA, 19 nt, Human
cagcauccuggcacccggc

SEQ ID NO: 1886392 - RNA, 21 nt, Human
cagcauccuggcacccggccc

SEQ ID NO: 1886393 - RNA, 21 nt, Human
cagcaucuuaccuucauaugc

SEQ ID NO: 1886394 - RNA, 17 nt, Human
cagcauugauauuugug

SEQ ID NO: 1886395 - RNA, 18 nt, Human
cagcauugauauuugugc

SEQ ID NO: 1886396 - RNA, 19 nt, Human
cagcauugauauuugugca

SEQ ID NO: 1886397 - RNA, 20 nt, Human
cagcauugauauuugugcau

SEQ ID NO: 1886398 - RNA, 15 nt, Human
cagccaaagccuccu

SEQ ID NO: 1886399 - RNA, 16 nt, Human
cagccaaagccuccuc

SEQ ID NO: 1886400 - RNA, 23 nt, Human
cagcauuuuccucugcuuugaaa

SEQ ID NO: 1886401 - RNA, 21 nt, Human
cagcauugauauuugugcauu

SEQ ID NO: 1886402 - RNA, 22 nt, Human
cagcauugauauuugugcauuu

SEQ ID NO: 1886403 - RNA, 13 nt, Human
cagcauuuuccuc

SEQ ID NO: 1886404 - RNA, 15 nt, Human
cagcauuuuccucug

SEQ ID NO: 1886405 - RNA, 18 nt, Human
cagccaaagccuccucca

SEQ ID NO: 1886406 - RNA, 21 nt, Human
cagccaaagccuccuccagcc

SEQ ID NO: 1886407 - RNA, 19 nt, Human
cagccaacacgcaccugcc

SEQ ID NO: 1886408 - RNA, 20 nt, Human
cagccaacacgcaccugccu

SEQ ID NO: 1886409 - RNA, 22 nt, Human
cagccaacacgcaccugccuca

SEQ ID NO: 1886410 - RNA, 23 nt, Human
cagccaacacgcaccugccucag

SEQ ID NO: 1886411 - RNA, 18 nt, Human
cagccaacuauggccugu

SEQ ID NO: 1886412 - RNA, 12 nt, Human
cagcaggcucuc

SEQ ID NO: 1886413 - RNA, 14 nt, Human
cagcaggcucucag

SEQ ID NO: 1886414 - RNA, 15 nt, Human
cagcaggcucucagg

SEQ ID NO: 1886415 - RNA, 19 nt, Human
cagcagccuggacccugug

SEQ ID NO: 1886416 - RNA, 22 nt, Human
cagcagccuggacccuguggau

SEQ ID NO: 1886417 - RNA, 17 nt, Human
cagcagcgccuuuccca

SEQ ID NO: 1886418 - RNA, 20 nt, Human
cagcagccuggggcuggccu

SEQ ID NO: 1886419 - RNA, 21 nt, Human
cagcagccuggggcuggccuc

SEQ ID NO: 1886420 - RNA, 17 nt, Human
cagcagccuuuaaugca

SEQ ID NO: 1886421 - RNA, 12 nt, Human
cagcagccugga

SEQ ID NO: 1886422 - RNA, 14 nt, Human
cagcagccuggacc

SEQ ID NO: 1886423 - RNA, 15 nt, Human
cagcagccuggaccc

SEQ ID NO: 1886424 - RNA, 18 nt, Human
cagcagccuggacccugu

SEQ ID NO: 1886425 - RNA, 17 nt, Human
cagcauccuggcacccg

SEQ ID NO: 1886426 - RNA, 16 nt, Human
cagcauccuggcaccc

SEQ ID NO: 1886427 - RNA, 15 nt, Human
cagcauccuggcacc

SEQ ID NO: 1886428 - RNA, 14 nt, Human
cagcauccuggcac

SEQ ID NO: 1886429 - RNA, 20 nt, Human
cagcagggagggcuucugcc

SEQ ID NO: 1886430 - RNA, 22 nt, Human
cagcagggaaaaugcagcaggg

SEQ ID NO: 1886431 - RNA, 23 nt, Human
cagcagggaaaaugcagcaggga

SEQ ID NO: 1886432 - RNA, 15 nt, Human
cagcagggaugcccu

SEQ ID NO: 1886433 - RNA, 24 nt, Human
cagcagggaaaaugcagcagggau

SEQ ID NO: 1886434 - RNA, 16 nt, Human
cagcagggaugcccug

SEQ ID NO: 1886435 - RNA, 18 nt, Human
cagcagggaugcccugga

SEQ ID NO: 1886436 - RNA, 21 nt, Human
cagcagggaugcccuggaggu

SEQ ID NO: 1886437 - RNA, 22 nt, Human
cagcagggaugcccuggaggug

SEQ ID NO: 1886438 - RNA, 16 nt, Human
cagcaggcucucaggc

SEQ ID NO: 1886439 - RNA, 17 nt, Human
cagcaggcucucaggcc

SEQ ID NO: 1886440 - RNA, 18 nt, Human
cagcaggcucucaggcca

SEQ ID NO: 1886441 - RNA, 19 nt, Human
cagcaggcucucaggccag

SEQ ID NO: 1886442 - RNA, 20 nt, Human
cagcaggcucucaggccagc

SEQ ID NO: 1886443 - RNA, 22 nt, Human
cagcaggcucucaggccagcug

SEQ ID NO: 1886444 - RNA, 18 nt, Human
cagcagggagggcuucug

SEQ ID NO: 1886445 - RNA, 14 nt, Human
cagcucaccagccc

SEQ ID NO: 1886446 - RNA, 18 nt, Human
cagccgucaccccugccu

SEQ ID NO: 1886447 - RNA, 21 nt, Human
cagccguguaaccauggaccc

SEQ ID NO: 1886448 - RNA, 21 nt, Human
cagcccuccccauggagccag

SEQ ID NO: 1886449 - RNA, 21 nt, Human
cagcccugaguuccuagccac

SEQ ID NO: 1886450 - RNA, 19 nt, Human
cagcccugaguuccuagcc

SEQ ID NO: 1886451 - RNA, 18 nt, Human
cagcccugaguuccuagc

SEQ ID NO: 1886452 - RNA, 13 nt, Human
cagcccugacccu

SEQ ID NO: 1886453 - RNA, 16 nt, Human
cagcccugacccugug

SEQ ID NO: 1886454 - RNA, 18 nt, Human
cagcccugcagagggcac

SEQ ID NO: 1886455 - RNA, 20 nt, Human
cagcccugcagagggcacag

SEQ ID NO: 1886456 - RNA, 13 nt, Human
cagcccugcagag

SEQ ID NO: 1886457 - RNA, 14 nt, Human
cagcccugcagagg

SEQ ID NO: 1886458 - RNA, 15 nt, Human
cagcccugcagaggg

SEQ ID NO: 1886459 - RNA, 16 nt, Human
cagcccugcagagggc

SEQ ID NO: 1886460 - RNA, 18 nt, Human
cagccucaaccuccuggg

SEQ ID NO: 1886461 - RNA, 17 nt, Human
cagccucaaccuccugg

SEQ ID NO: 1886462 - RNA, 21 nt, Human
cagccucaaccuccugggcua

SEQ ID NO: 1886463 - RNA, 20 nt, Human
cagccucaaccuccugggcu

SEQ ID NO: 1886464 - RNA, 19 nt, Human
cagccucaaccuccugggc

SEQ ID NO: 1886465 - RNA, 14 nt, Human
cagccucacagucc

SEQ ID NO: 1886466 - RNA, 15 nt, Human
cagccucacaguccu

SEQ ID NO: 1886467 - RNA, 20 nt, Human
cagccucacaguccuuacca

SEQ ID NO: 1886468 - RNA, 22 nt, Human
cagccucccgaauagcugggac

SEQ ID NO: 1886469 - RNA, 21 nt, Human
cagccucccgaauagcuggga

SEQ ID NO: 1886470 - RNA, 20 nt, Human
cagccucccgaauagcuggg

SEQ ID NO: 1886471 - RNA, 23 nt, Human
cagccucccauccagggccccca

SEQ ID NO: 1886472 - RNA, 16 nt, Human
cagccucccauccagg

SEQ ID NO: 1886473 - RNA, 18 nt, Human
cagccucccauccagggc

SEQ ID NO: 1886474 - RNA, 19 nt, Human
cagccucccauccagggcc

SEQ ID NO: 1886475 - RNA, 20 nt, Human
cagccucccauccagggccc

SEQ ID NO: 1886476 - RNA, 14 nt, Human
cagccucccaucca

SEQ ID NO: 1886477 - RNA, 23 nt, Human
cagccucccaaagugcugggauu

SEQ ID NO: 1886478 - RNA, 21 nt, Human
cagccucccaaagugcuggga

SEQ ID NO: 1886479 - RNA, 20 nt, Human
cagccucccaaagugcuggg

SEQ ID NO: 1886480 - RNA, 19 nt, Human
cagccucccaaagugcugg

SEQ ID NO: 1886481 - RNA, 14 nt, Human
cagccccauucugc

SEQ ID NO: 1886482 - RNA, 13 nt, Human
cagccccauucug

SEQ ID NO: 1886483 - RNA, 16 nt, Human
cagccccauccucugu

SEQ ID NO: 1886484 - RNA, 22 nt, Human
cagccccauccucuguacagag

SEQ ID NO: 1886485 - RNA, 22 nt, Human
cagccccaucccaaacccuuca

SEQ ID NO: 1886486 - RNA, 12 nt, Human
cagccccauccu

SEQ ID NO: 1886487 - RNA, 13 nt, Human
cagccccauccuc

SEQ ID NO: 1886488 - RNA, 14 nt, Human
cagccccauccucu

SEQ ID NO: 1886489 - RNA, 18 nt, Human
cagccccauucugccugc

SEQ ID NO: 1886490 - RNA, 23 nt, Human
cagccccuggaugcagccucaca

SEQ ID NO: 1886491 - RNA, 17 nt, Human
cagccccauucugccug

SEQ ID NO: 1886492 - RNA, 16 nt, Human
cagccccauucugccu

SEQ ID NO: 1886493 - RNA, 20 nt, Human
cagccccuguucuggcagag

SEQ ID NO: 1886494 - RNA, 13 nt, Human
cagccccuggccc

SEQ ID NO: 1886495 - RNA, 21 nt, Human
cagccccuggccccaggaccu

SEQ ID NO: 1886496 - RNA, 21 nt, Human
cagccccuguucuggcagagu

SEQ ID NO: 1886497 - RNA, 18 nt, Human
cagccccagugcccacag

SEQ ID NO: 1886498 - RNA, 17 nt, Human
cagccccagugcccaca

SEQ ID NO: 1886499 - RNA, 11 nt, Human
cagccccaucc

SEQ ID NO: 1886500 - RNA, 21 nt, Human
cagccccaucccaaacccuuc

SEQ ID NO: 1886501 - RNA, 16 nt, Human
cagccccagugcccac

SEQ ID NO: 1886502 - RNA, 15 nt, Human
cagccccagugccca

SEQ ID NO: 1886503 - RNA, 14 nt, Human
cagccccagugccc

SEQ ID NO: 1886504 - RNA, 13 nt, Human
cagccccagugcc

SEQ ID NO: 1886505 - RNA, 18 nt, Human
cagcccucauuggcucuu

SEQ ID NO: 1886506 - RNA, 20 nt, Human
cagcccuccccauggagcca

SEQ ID NO: 1886507 - RNA, 18 nt, Human
cagcccucaccccugguu

SEQ ID NO: 1886508 - RNA, 15 nt, Human
cagcccucaccccug

SEQ ID NO: 1886509 - RNA, 14 nt, Human
cagcccucaccccu

SEQ ID NO: 1886510 - RNA, 13 nt, Human
cagcccucacccc

SEQ ID NO: 1886511 - RNA, 21 nt, Human
cagcccgggcucugccuccca

SEQ ID NO: 1886512 - RNA, 22 nt, Human
cagcccgggcucugccucccau

SEQ ID NO: 1886513 - RNA, 17 nt, Human
cagcccgggcucugccu

SEQ ID NO: 1886514 - RNA, 18 nt, Human
cagcccgggcucugccuc

SEQ ID NO: 1886515 - RNA, 19 nt, Human
cagcccgggcucugccucc

SEQ ID NO: 1886516 - RNA, 20 nt, Human
cagcccgggcucugccuccc

SEQ ID NO: 1886517 - RNA, 24 nt, Human
cagccccuucugacccaugcugcc

SEQ ID NO: 1886518 - RNA, 18 nt, Human
cagccccuugagaaaccu

SEQ ID NO: 1886519 - RNA, 17 nt, Human
cagccccuugagaaacc

SEQ ID NO: 1886520 - RNA, 22 nt, Human
cagccccuucugacccaugcug

SEQ ID NO: 1886521 - RNA, 23 nt, Human
cagccccuucugacccaugcugc

SEQ ID NO: 1886522 - RNA, 16 nt, Human
cagccccuucugaccc

SEQ ID NO: 1886523 - RNA, 17 nt, Human
cagccccuucugaccca

SEQ ID NO: 1886524 - RNA, 19 nt, Human
cagccccuucugacccaug

SEQ ID NO: 1886525 - RNA, 21 nt, Human
cagccccuucugacccaugcu

SEQ ID NO: 1886526 - RNA, 13 nt, Human
cagcccgggcucu

SEQ ID NO: 1886527 - RNA, 14 nt, Human
cagcccgggcucug

SEQ ID NO: 1886528 - RNA, 15 nt, Human
cagcccgggcucugc

SEQ ID NO: 1886529 - RNA, 16 nt, Human
cagcccgggcucugcc

SEQ ID NO: 1886530 - RNA, 22 nt, Human
cagccuggccacgcagccagga

SEQ ID NO: 1886531 - RNA, 21 nt, Human
cagccuggccacgcagccagg

SEQ ID NO: 1886532 - RNA, 20 nt, Human
cagccuggccacgcagccag

SEQ ID NO: 1886533 - RNA, 19 nt, Human
cagccuggccacgcagcca

SEQ ID NO: 1886534 - RNA, 13 nt, Human
cagccuggccaga

SEQ ID NO: 1886535 - RNA, 14 nt, Human
cagccuggccagac

SEQ ID NO: 1886536 - RNA, 15 nt, Human
cagccuggccagaca

SEQ ID NO: 1886537 - RNA, 17 nt, Human
cagccuggccagacaca

SEQ ID NO: 1886538 - RNA, 18 nt, Human
cagccuggccagacacag

SEQ ID NO: 1886539 - RNA, 20 nt, Human
cagccuggccagacacaggc

SEQ ID NO: 1886540 - RNA, 21 nt, Human
cagccuggcucccaggacacg

SEQ ID NO: 1886541 - RNA, 19 nt, Human
cagccuggcucccaggaca

SEQ ID NO: 1886542 - RNA, 13 nt, Human
cagccuggcuccc

SEQ ID NO: 1886543 - RNA, 12 nt, Human
cagccuggcucc

SEQ ID NO: 1886544 - RNA, 20 nt, Human
cagccuggcucccaggacac

SEQ ID NO: 1886545 - RNA, 18 nt, Human
cagccuggccacgcagcc

SEQ ID NO: 1886546 - RNA, 17 nt, Human
cagccuggccacgcagc

SEQ ID NO: 1886547 - RNA, 15 nt, Human
cagccuggacccugu

SEQ ID NO: 1886548 - RNA, 19 nt, Human
cagccuggacccuguggau

SEQ ID NO: 1886549 - RNA, 23 nt, Human
cagccucccgaguagcugggacu

SEQ ID NO: 1886550 - RNA, 22 nt, Human
cagccucccgaguagcugggac

SEQ ID NO: 1886551 - RNA, 21 nt, Human
cagccucccgaguagcuggga

SEQ ID NO: 1886552 - RNA, 20 nt, Human
cagccucccgaguagcuggg

SEQ ID NO: 1886553 - RNA, 19 nt, Human
cagccucccgaguagcugg

SEQ ID NO: 1886554 - RNA, 23 nt, Human
cagccucccgaauagcugggacu

SEQ ID NO: 1886555 - RNA, 20 nt, Human
cagccuccugaguagcugga

SEQ ID NO: 1886556 - RNA, 20 nt, Human
cagccugcuccagcuguuca

SEQ ID NO: 1886557 - RNA, 12 nt, Human
cagccucccuga

SEQ ID NO: 1886558 - RNA, 14 nt, Human
cagccucccugaag

SEQ ID NO: 1886559 - RNA, 16 nt, Human
cagccucccugaagcc

SEQ ID NO: 1886560 - RNA, 17 nt, Human
cagccucccugaagccu

SEQ ID NO: 1886561 - RNA, 18 nt, Human
cagccucccugaagccuu

SEQ ID NO: 1886562 - RNA, 22 nt, Human
cagccuugaccauucuccaccu

SEQ ID NO: 1886563 - RNA, 23 nt, Human
cagccuugaccauucuccaccug

SEQ ID NO: 1886564 - RNA, 24 nt, Human
cagccuugaccauucuccaccugc

SEQ ID NO: 1886565 - RNA, 13 nt, Human
cagccuugccaga

SEQ ID NO: 1886566 - RNA, 14 nt, Human
cagccuugccagag

SEQ ID NO: 1886567 - RNA, 15 nt, Human
cagccuugccagaga

SEQ ID NO: 1886568 - RNA, 16 nt, Human
cagccuugccagagau

SEQ ID NO: 1886569 - RNA, 23 nt, Human
cagccugugucuuuaaaugcugc

SEQ ID NO: 1886570 - RNA, 14 nt, Human
cagccugugucuuu

SEQ ID NO: 1886571 - RNA, 17 nt, Human
cagccuugaccauucuc

SEQ ID NO: 1886572 - RNA, 20 nt, Human
cagccuugaccauucuccac

SEQ ID NO: 1886573 - RNA, 21 nt, Human
cagccuugaccauucuccacc

SEQ ID NO: 1886574 - RNA, 16 nt, Human
cagccugggcaaugug

SEQ ID NO: 1886575 - RNA, 19 nt, Human
cagccugggcaaugugaua

SEQ ID NO: 1886576 - RNA, 17 nt, Human
cagccuggggcuggccu

SEQ ID NO: 1886577 - RNA, 18 nt, Human
cagccuggggcuggccuc

SEQ ID NO: 1886578 - RNA, 21 nt, Human
cagccuggggcuggccuccca

SEQ ID NO: 1886579 - RNA, 15 nt, Human
cagccuggggucugg

SEQ ID NO: 1886580 - RNA, 19 nt, Human
cagccuggggucuggaguu

SEQ ID NO: 1886581 - RNA, 20 nt, Human
cagccuggucaacaugguga

SEQ ID NO: 1886582 - RNA, 19 nt, Human
cagccugguuuagccugga

SEQ ID NO: 1886583 - RNA, 16 nt, Human
cagcuaaugggacacu

SEQ ID NO: 1886584 - RNA, 15 nt, Human
cagcuaaugggacac

SEQ ID NO: 1886585 - RNA, 20 nt, Human
cagcuaacauggaaguacua

SEQ ID NO: 1886586 - RNA, 12 nt, Human
cagcgccaggcu

SEQ ID NO: 1886587 - RNA, 13 nt, Human
cagcuaagaaccu

SEQ ID NO: 1886588 - RNA, 12 nt, Human
cagcuaagaaaa

SEQ ID NO: 1886589 - RNA, 23 nt, Human
cagcuaagaaaagauuuuaauca

SEQ ID NO: 1886590 - RNA, 23 nt, Human
cagcuaagaaccuggaacuuggg

SEQ ID NO: 1886591 - RNA, 14 nt, Human
cagcuaagaaccug

SEQ ID NO: 1886592 - RNA, 16 nt, Human
cagcuaagaaccugga

SEQ ID NO: 1886593 - RNA, 18 nt, Human
cagcuaagaaccuggaac

SEQ ID NO: 1886594 - RNA, 19 nt, Human
cagcuaagaaccuggaacu

SEQ ID NO: 1886595 - RNA, 19 nt, Human
cagcuacuugggaggcuga

SEQ ID NO: 1886596 - RNA, 18 nt, Human
cagcuacaccuuucuccu

SEQ ID NO: 1886597 - RNA, 21 nt, Human
cagcuaccucaaccaaugcca

SEQ ID NO: 1886598 - RNA, 20 nt, Human
cagcgagcccugguggcagu

SEQ ID NO: 1886599 - RNA, 19 nt, Human
cagcgagcccugguggcag

SEQ ID NO: 1886600 - RNA, 17 nt, Human
cagcgagcccugguggc

SEQ ID NO: 1886601 - RNA, 16 nt, Human
cagcgagcccuggugg

SEQ ID NO: 1886602 - RNA, 13 nt, Human
cagcgagcccugg

SEQ ID NO: 1886603 - RNA, 13 nt, Human
cagcgaaugacaa

SEQ ID NO: 1886604 - RNA, 21 nt, Human
cagcgagcccugguggcagug

SEQ ID NO: 1886605 - RNA, 19 nt, Human
cagcuaacauggaaguacu

SEQ ID NO: 1886606 - RNA, 18 nt, Human
cagcuaacauggaaguac

SEQ ID NO: 1886607 - RNA, 19 nt, Human
cagcucaccagccccagug

SEQ ID NO: 1886608 - RNA, 17 nt, Human
cagcucaccagccccag

SEQ ID NO: 1886609 - RNA, 16 nt, Human
cagcucaccagcccca

SEQ ID NO: 1886610 - RNA, 15 nt, Human
cagcucaccagcccc

SEQ ID NO: 1886611 - RNA, 13 nt, Human
cagcucaccagcc

SEQ ID NO: 1886612 - RNA, 18 nt, Human
cagcuauugauauaaaua

SEQ ID NO: 1886613 - RNA, 13 nt, Human
cagcuauuuuuau

SEQ ID NO: 1886614 - RNA, 15 nt, Human
cagcuacuugggagg

SEQ ID NO: 1886615 - RNA, 16 nt, Human
cagcuacuugggaggc

SEQ ID NO: 1886616 - RNA, 21 nt, Human
cagcucaccagccccagugcc

SEQ ID NO: 1886617 - RNA, 20 nt, Human
cagcucaccagccccagugc

SEQ ID NO: 1886618 - RNA, 22 nt, Human
cagcucaccagccccagugccc

SEQ ID NO: 1886619 - RNA, 13 nt, Human
cagcucaccucuc

SEQ ID NO: 1886620 - RNA, 15 nt, Human
cagcucaccucuccc

SEQ ID NO: 1886621 - RNA, 16 nt, Human
cagcucaccucucccu

SEQ ID NO: 1886622 - RNA, 17 nt, Human
cagcucaccucucccuu

SEQ ID NO: 1886623 - RNA, 12 nt, Human
cagcucagagag

SEQ ID NO: 1886624 - RNA, 19 nt, Human
cagcucaccucucccuugg

SEQ ID NO: 1886625 - RNA, 20 nt, Human
cagcucaccucucccuugga

SEQ ID NO: 1886626 - RNA, 13 nt, Human
cagcucagcuucc

SEQ ID NO: 1886627 - RNA, 14 nt, Human
cagcucagcuuccc

SEQ ID NO: 1886628 - RNA, 12 nt, Human
cagcucaggaca

SEQ ID NO: 1886629 - RNA, 10 nt, Human
cagcucagga

SEQ ID NO: 1886630 - RNA, 13 nt, Human
cagcucaggacag

SEQ ID NO: 1886631 - RNA, 16 nt, Human
cagcucaggacagaug

SEQ ID NO: 1886632 - RNA, 18 nt, Human
cagcucaggacagaugcc

SEQ ID NO: 1886633 - RNA, 19 nt, Human
cagcucaggacagaugcca

SEQ ID NO: 1886634 - RNA, 22 nt, Human
cagcucaggacagaugccacac

SEQ ID NO: 1886635 - RNA, 11 nt, Human
cagcucaggau

SEQ ID NO: 1886636 - RNA, 13 nt, Human
cagcucaggaucu

SEQ ID NO: 1886637 - RNA, 13 nt, Human
cagcucagagagg

SEQ ID NO: 1886638 - RNA, 17 nt, Human
cagcucagagagggugg

SEQ ID NO: 1886639 - RNA, 19 nt, Human
cagcucagagaggguggga

SEQ ID NO: 1886640 - RNA, 20 nt, Human
cagcucagagagggugggag

SEQ ID NO: 1886641 - RNA, 23 nt, Human
cagcuccuucuguccuacucugu

SEQ ID NO: 1886642 - RNA, 21 nt, Human
cagcuccuucuguccuacucu

SEQ ID NO: 1886643 - RNA, 17 nt, Human
cagcuccuucuguccua

SEQ ID NO: 1886644 - RNA, 16 nt, Human
cagcuccuucuguccu

SEQ ID NO: 1886645 - RNA, 14 nt, Human
cagcucauaagagc

SEQ ID NO: 1886646 - RNA, 16 nt, Human
cagcucauaagagcca

SEQ ID NO: 1886647 - RNA, 14 nt, Human
cagcuccaaccugc

SEQ ID NO: 1886648 - RNA, 15 nt, Human
cagcucugcaagaau

SEQ ID NO: 1886649 - RNA, 16 nt, Human
cagcucugcaagaauu

SEQ ID NO: 1886650 - RNA, 21 nt, Human
cagcucugcaagaauugaagc

SEQ ID NO: 1886651 - RNA, 20 nt, Human
cagcucugcauacucauuag

SEQ ID NO: 1886652 - RNA, 17 nt, Human
cagcucuggacagcccc

SEQ ID NO: 1886653 - RNA, 18 nt, Human
cagcucuggacagcccca

SEQ ID NO: 1886654 - RNA, 21 nt, Human
cagcucuggacagccccaccc

SEQ ID NO: 1886655 - RNA, 23 nt, Human
cagcucuggacagccccacccug

SEQ ID NO: 1886656 - RNA, 12 nt, Human
cagcucuccccu

SEQ ID NO: 1886657 - RNA, 23 nt, Human
cagcucuucuccaggcuguaucc

SEQ ID NO: 1886658 - RNA, 19 nt, Human
cagcucuucuccaggcugu

SEQ ID NO: 1886659 - RNA, 18 nt, Human
cagcucuucuccaggcug

SEQ ID NO: 1886660 - RNA, 17 nt, Human
cagcucuucuccaggcu

SEQ ID NO: 1886661 - RNA, 16 nt, Human
cagcucuucuccaggc

SEQ ID NO: 1886662 - RNA, 15 nt, Human
cagcucuucuccagg

SEQ ID NO: 1886663 - RNA, 14 nt, Human
cagcucuucuccag

SEQ ID NO: 1886664 - RNA, 13 nt, Human
cagcucuucucca

SEQ ID NO: 1886665 - RNA, 23 nt, Human
cagcucuguccugggagugagcu

SEQ ID NO: 1886666 - RNA, 22 nt, Human
cagcucugggccauucuccaca

SEQ ID NO: 1886667 - RNA, 23 nt, Human
cagcucugggccauucuccacag

SEQ ID NO: 1886668 - RNA, 10 nt, Human
cagcucuuau

SEQ ID NO: 1886669 - RNA, 21 nt, Human
cagcucuuauauugccauuuc

SEQ ID NO: 1886670 - RNA, 18 nt, Human
cagcucuguccugggagu

SEQ ID NO: 1886671 - RNA, 17 nt, Human
cagcucuguccugggag

SEQ ID NO: 1886672 - RNA, 16 nt, Human
cagcucuguccuggga

SEQ ID NO: 1886673 - RNA, 14 nt, Human
cagcucuguccugg

SEQ ID NO: 1886674 - RNA, 13 nt, Human
cagcucuguccug

SEQ ID NO: 1886675 - RNA, 12 nt, Human
cagcucuguccu

SEQ ID NO: 1886676 - RNA, 22 nt, Human
cagcucugguccauagagagca

SEQ ID NO: 1886677 - RNA, 23 nt, Human
cagcucugguccauagagagcaa

SEQ ID NO: 1886678 - RNA, 10 nt, Human
cagcucuggu

SEQ ID NO: 1886679 - RNA, 13 nt, Human
cagcucuggucca

SEQ ID NO: 1886680 - RNA, 12 nt, Human
cagcucugggcc

SEQ ID NO: 1886681 - RNA, 19 nt, Human
cagcucugggccauucucc

SEQ ID NO: 1886682 - RNA, 16 nt, Human
cagcucugguccauag

SEQ ID NO: 1886683 - RNA, 17 nt, Human
cagcucugguccauaga

SEQ ID NO: 1886684 - RNA, 18 nt, Human
cagcucugguccauagag

SEQ ID NO: 1886685 - RNA, 21 nt, Human
cagcucugguccauagagagc

SEQ ID NO: 1886686 - RNA, 22 nt, Human
cagcugcuuuugucuaugggac

SEQ ID NO: 1886687 - RNA, 23 nt, Human
cagcugcuuuugucuaugggacu

SEQ ID NO: 1886688 - RNA, 18 nt, Human
cagcuggagaaauauggu

SEQ ID NO: 1886689 - RNA, 18 nt, Human
cagcuggggccaggcugg

SEQ ID NO: 1886690 - RNA, 19 nt, Human
cagcuggggccaggcuggg

SEQ ID NO: 1886691 - RNA, 20 nt, Human
cagcuggggccaggcugggu

SEQ ID NO: 1886692 - RNA, 21 nt, Human
cagcuggggccaggcuggguc

SEQ ID NO: 1886693 - RNA, 22 nt, Human
cagcuggggccaggcugggucg

SEQ ID NO: 1886694 - RNA, 21 nt, Human
cagcugggguggggaccucag

SEQ ID NO: 1886695 - RNA, 22 nt, Human
cagcugggguggggaccucagg

SEQ ID NO: 1886696 - RNA, 23 nt, Human
cagcugggguggggaccucaggc

SEQ ID NO: 1886697 - RNA, 14 nt, Human
cagcugggucaggc

SEQ ID NO: 1886698 - RNA, 15 nt, Human
cagcugggucaggca

SEQ ID NO: 1886699 - RNA, 16 nt, Human
cagcugggucaggcag

SEQ ID NO: 1886700 - RNA, 18 nt, Human
cagcugggucaggcaggg

SEQ ID NO: 1886701 - RNA, 20 nt, Human
cagcugggucaggcagggug

SEQ ID NO: 1886702 - RNA, 18 nt, Human
cagcugguugagguuuca

SEQ ID NO: 1886703 - RNA, 19 nt, Human
cagcuggugguaucugagu

SEQ ID NO: 1886704 - RNA, 24 nt, Human
cagcugcgguccacccaggagccc

SEQ ID NO: 1886705 - RNA, 23 nt, Human
cagcugcgguccacccaggagcc

SEQ ID NO: 1886706 - RNA, 22 nt, Human
cagcugcgguccacccaggagc

SEQ ID NO: 1886707 - RNA, 21 nt, Human
cagcugcgguccacccaggag

SEQ ID NO: 1886708 - RNA, 20 nt, Human
cagcugcgguccacccagga

SEQ ID NO: 1886709 - RNA, 19 nt, Human
cagcugcgguccacccagg

SEQ ID NO: 1886710 - RNA, 15 nt, Human
cagcugccugggauc

SEQ ID NO: 1886711 - RNA, 18 nt, Human
cagcugcgguccacccag

SEQ ID NO: 1886712 - RNA, 18 nt, Human
cagcugccugggaucccu

SEQ ID NO: 1886713 - RNA, 23 nt, Human
cagcugccugggaucccucaucc

SEQ ID NO: 1886714 - RNA, 16 nt, Human
cagcucuuggcuccac

SEQ ID NO: 1886715 - RNA, 17 nt, Human
cagcucuuggcuccacu

SEQ ID NO: 1886716 - RNA, 18 nt, Human
cagcucuuggcuccacug

SEQ ID NO: 1886717 - RNA, 13 nt, Human
cagcucuuuccuc

SEQ ID NO: 1886718 - RNA, 14 nt, Human
cagcucuuuccucc

SEQ ID NO: 1886719 - RNA, 16 nt, Human
cagcucuuuccuccuu

SEQ ID NO: 1886720 - RNA, 17 nt, Human
cagcucuuuccuccuuc

SEQ ID NO: 1886721 - RNA, 18 nt, Human
cagcucuuuccuccuucc

SEQ ID NO: 1886722 - RNA, 19 nt, Human
cagcucuuuccuccuucca

SEQ ID NO: 1886723 - RNA, 21 nt, Human
cagcucuuuccuccuuccaug

SEQ ID NO: 1886724 - RNA, 22 nt, Human
cagcucuuuccuccuuccaugg

SEQ ID NO: 1886725 - RNA, 19 nt, Human
cagcugaaauaugcuggcu

SEQ ID NO: 1886726 - RNA, 21 nt, Human
cagcugaaauaugcuggcugg

SEQ ID NO: 1886727 - RNA, 22 nt, Human
cagcugaaauaugcuggcugga

SEQ ID NO: 1886728 - RNA, 16 nt, Human
cagcugaauuaucuau

SEQ ID NO: 1886729 - RNA, 13 nt, Human
cagcugcuugggc

SEQ ID NO: 1886730 - RNA, 14 nt, Human
cagcugcuugggcu

SEQ ID NO: 1886731 - RNA, 15 nt, Human
cagcugcuugggcuu

SEQ ID NO: 1886732 - RNA, 16 nt, Human
cagcugcuugggcuuc

SEQ ID NO: 1886733 - RNA, 18 nt, Human
cagcugcuugggcuucau

SEQ ID NO: 1886734 - RNA, 19 nt, Human
cagcugcuugggcuucauc

SEQ ID NO: 1886735 - RNA, 21 nt, Human
cagcugcuugggcuucauccu

SEQ ID NO: 1886736 - RNA, 22 nt, Human
cagcugcuugggcuucauccuc

SEQ ID NO: 1886737 - RNA, 17 nt, Human
cagcugcuacuacuccu

SEQ ID NO: 1886738 - RNA, 12 nt, Human
cagcugcuccua

SEQ ID NO: 1886739 - RNA, 18 nt, Human
cagcugcuccuagaggga

SEQ ID NO: 1886740 - RNA, 19 nt, Human
cagcugcuccuagagggag

SEQ ID NO: 1886741 - RNA, 23 nt, Human
cagcugcuccuagagggaggggc

SEQ ID NO: 1886742 - RNA, 20 nt, Human
cagcuuguaaauagcucagg

SEQ ID NO: 1886743 - RNA, 19 nt, Human
cagcuuguaaauagcucag

SEQ ID NO: 1886744 - RNA, 18 nt, Human
cagcuuguaaauagcuca

SEQ ID NO: 1886745 - RNA, 22 nt, Human
cagcuuguaaauagcucaggug

SEQ ID NO: 1886746 - RNA, 21 nt, Human
cagcuuguaaauagcucaggu

SEQ ID NO: 1886747 - RNA, 17 nt, Human
cagcuuguuauuuauaa

SEQ ID NO: 1886748 - RNA, 23 nt, Human
cagcuuuccucaaaacuucagac

SEQ ID NO: 1886749 - RNA, 12 nt, Human
cagcuuuguuug

SEQ ID NO: 1886750 - RNA, 21 nt, Human
cagcuuuguuuguugucagcu

SEQ ID NO: 1886751 - RNA, 22 nt, Human
cagcuuuguuuguugucagcug

SEQ ID NO: 1886752 - RNA, 23 nt, Human
cagcuuuguuuguugucagcuga

SEQ ID NO: 1886753 - RNA, 16 nt, Human
cagcuuugaucccuga

SEQ ID NO: 1886754 - RNA, 17 nt, Human
cagcuuugaucccugac

SEQ ID NO: 1886755 - RNA, 20 nt, Human
cagcuuugaucccugacauc

SEQ ID NO: 1886756 - RNA, 13 nt, Human
cagcuuugcugcu

SEQ ID NO: 1886757 - RNA, 12 nt, Human
cagcuuugcugc

SEQ ID NO: 1886758 - RNA, 14 nt, Human
cagcuuugcugcug

SEQ ID NO: 1886759 - RNA, 17 nt, Human
caggaaaaacccgucaa

SEQ ID NO: 1886760 - RNA, 21 nt, Human
cagcuucauuuccugugucuu

SEQ ID NO: 1886761 - RNA, 20 nt, Human
cagcuucauuuccugugucu

SEQ ID NO: 1886762 - RNA, 18 nt, Human
cagcuucucauccugcag

SEQ ID NO: 1886763 - RNA, 20 nt, Human
cagcuucucauccugcaggc

SEQ ID NO: 1886764 - RNA, 19 nt, Human
cagcuucucauccugcagg

SEQ ID NO: 1886765 - RNA, 21 nt, Human
cagcuucucauccugcaggca

SEQ ID NO: 1886766 - RNA, 15 nt, Human
cagcuucuccugugu

SEQ ID NO: 1886767 - RNA, 16 nt, Human
cagcuucuccugugug

SEQ ID NO: 1886768 - RNA, 15 nt, Human
cagcuugaggguugg

SEQ ID NO: 1886769 - RNA, 14 nt, Human
cagcuugaggguug

SEQ ID NO: 1886770 - RNA, 18 nt, Human
cagcuugaccgugaggcc

SEQ ID NO: 1886771 - RNA, 19 nt, Human
cagcuugaccgugaggcca

SEQ ID NO: 1886772 - RNA, 20 nt, Human
cagcuugaccgugaggccag

SEQ ID NO: 1886773 - RNA, 21 nt, Human
cagcuugaccgugaggccaga

SEQ ID NO: 1886774 - RNA, 21 nt, Human
cagcuugaggguugggcuggu

SEQ ID NO: 1886775 - RNA, 20 nt, Human
cagcuugaggguugggcugg

SEQ ID NO: 1886776 - RNA, 19 nt, Human
cagcuugaggguugggcug

SEQ ID NO: 1886777 - RNA, 18 nt, Human
cagcuugaggguugggcu

SEQ ID NO: 1886778 - RNA, 19 nt, Human
cagcuugaucaaaggcaca

SEQ ID NO: 1886779 - RNA, 23 nt, Human
cagcuugaucaaaggcacacagc

SEQ ID NO: 1886780 - RNA, 22 nt, Human
caggaagacccaacacauggga

SEQ ID NO: 1886781 - RNA, 19 nt, Human
caggaagacccaacacaug

SEQ ID NO: 1886782 - RNA, 16 nt, Human
caggaaccacaccaca

SEQ ID NO: 1886783 - RNA, 19 nt, Human
caggaaccacaccacaucu

SEQ ID NO: 1886784 - RNA, 22 nt, Human
caggaagccagcaggcucucag

SEQ ID NO: 1886785 - RNA, 19 nt, Human
caggaagccagcaggcucu

SEQ ID NO: 1886786 - RNA, 21 nt, Human
caggaagccagcaggcucuca

SEQ ID NO: 1886787 - RNA, 14 nt, Human
caggaagccagcag

SEQ ID NO: 1886788 - RNA, 16 nt, Human
caggaagccagcaggc

SEQ ID NO: 1886789 - RNA, 17 nt, Human
caggaagccagcaggcu

SEQ ID NO: 1886790 - RNA, 18 nt, Human
caggaagccagcaggcuc

SEQ ID NO: 1886791 - RNA, 23 nt, Human
caggaagcucagggccuggcuca

SEQ ID NO: 1886792 - RNA, 20 nt, Human
caggaagcucagggccuggc

SEQ ID NO: 1886793 - RNA, 21 nt, Human
caggaagcucagggccuggcu

SEQ ID NO: 1886794 - RNA, 13 nt, Human
caggaagcucagg

SEQ ID NO: 1886795 - RNA, 14 nt, Human
caggaagcucaggg

SEQ ID NO: 1886796 - RNA, 15 nt, Human
caggaagcucagggc

SEQ ID NO: 1886797 - RNA, 16 nt, Human
caggaagcucagggcc

SEQ ID NO: 1886798 - RNA, 17 nt, Human
caggaagcucagggccu

SEQ ID NO: 1886799 - RNA, 18 nt, Human
caggaagcucagggccug

SEQ ID NO: 1886800 - RNA, 19 nt, Human
caggaagcucagggccugg

SEQ ID NO: 1886801 - RNA, 17 nt, Human
caggaccuguggccaag

SEQ ID NO: 1886802 - RNA, 20 nt, Human
caggaccuucgggcugugcc

SEQ ID NO: 1886803 - RNA, 22 nt, Human
caggaccuucgggcugugcccg

SEQ ID NO: 1886804 - RNA, 21 nt, Human
caggaccuucgggcugugccc

SEQ ID NO: 1886805 - RNA, 14 nt, Human
caggaccuggcugc

SEQ ID NO: 1886806 - RNA, 16 nt, Human
caggaccuggcugcca

SEQ ID NO: 1886807 - RNA, 17 nt, Human
caggaccuggcugccau

SEQ ID NO: 1886808 - RNA, 18 nt, Human
caggaccuggcugccaua

SEQ ID NO: 1886809 - RNA, 13 nt, Human
caggacacaguca

SEQ ID NO: 1886810 - RNA, 15 nt, Human
caggacacagucaga

SEQ ID NO: 1886811 - RNA, 16 nt, Human
caggaauguguggccu

SEQ ID NO: 1886812 - RNA, 17 nt, Human
caggaauguguggccug

SEQ ID NO: 1886813 - RNA, 19 nt, Human
caggaauguguggccugca

SEQ ID NO: 1886814 - RNA, 21 nt, Human
caggaauguguggccugcaca

SEQ ID NO: 1886815 - RNA, 23 nt, Human
caggaauguguggccugcacagu

SEQ ID NO: 1886816 - RNA, 16 nt, Human
caggaauuucccagga

SEQ ID NO: 1886817 - RNA, 17 nt, Human
caggaauuucccaggac

SEQ ID NO: 1886818 - RNA, 18 nt, Human
caggaauuucccaggacc

SEQ ID NO: 1886819 - RNA, 19 nt, Human
caggaauuucccaggaccc

SEQ ID NO: 1886820 - RNA, 20 nt, Human
caggaauuucccaggacccu

SEQ ID NO: 1886821 - RNA, 21 nt, Human
caggaauuucccaggacccug

SEQ ID NO: 1886822 - RNA, 16 nt, Human
caggaaguagaggagg

SEQ ID NO: 1886823 - RNA, 17 nt, Human
caggaaguacuggagaa

SEQ ID NO: 1886824 - RNA, 18 nt, Human
caggaaguacuggagaaa

SEQ ID NO: 1886825 - RNA, 20 nt, Human
caggaaguacuggagaaaau

SEQ ID NO: 1886826 - RNA, 15 nt, Human
caggaaguagaggag

SEQ ID NO: 1886827 - RNA, 12 nt, Human
caggaaguacug

SEQ ID NO: 1886828 - RNA, 14 nt, Human
caggaaguacugga

SEQ ID NO: 1886829 - RNA, 16 nt, Human
caggaaguacuggaga

SEQ ID NO: 1886830 - RNA, 15 nt, Human
caggaaggcuaaagg

SEQ ID NO: 1886831 - RNA, 22 nt, Human
caggaagcucagggccuggcuc

SEQ ID NO: 1886832 - RNA, 15 nt, Human
cagucauaacuaaau

SEQ ID NO: 1886833 - RNA, 19 nt, Human
caguauuacuucugcuaca

SEQ ID NO: 1886834 - RNA, 18 nt, Human
caguauuacuucugcuac

SEQ ID NO: 1886835 - RNA, 17 nt, Human
cagucagauuuccaguc

SEQ ID NO: 1886836 - RNA, 20 nt, Human
cagucagauuuccagucucc

SEQ ID NO: 1886837 - RNA, 23 nt, Human
cagucagauuuccagucuccacc

SEQ ID NO: 1886838 - RNA, 16 nt, Human
caguauuacuucugcu

SEQ ID NO: 1886839 - RNA, 12 nt, Human
caguauguggaa

SEQ ID NO: 1886840 - RNA, 16 nt, Human
caguccauagcagaga

SEQ ID NO: 1886841 - RNA, 14 nt, Human
caguccauugaaag

SEQ ID NO: 1886842 - RNA, 13 nt, Human
caguccaugaaga

SEQ ID NO: 1886843 - RNA, 21 nt, Human
cagucauuuuucagaccuuuu

SEQ ID NO: 1886844 - RNA, 20 nt, Human
cagucauucagauaugauuc

SEQ ID NO: 1886845 - RNA, 13 nt, Human
cagucauuggcug

SEQ ID NO: 1886846 - RNA, 17 nt, Human
cagucauuggcugucuc

SEQ ID NO: 1886847 - RNA, 21 nt, Human
cagucauuggcugucuccuag

SEQ ID NO: 1886848 - RNA, 20 nt, Human
cagucauuuuucagaccuuu

SEQ ID NO: 1886849 - RNA, 17 nt, Human
cagucauucagauauga

SEQ ID NO: 1886850 - RNA, 13 nt, Human
caguaucucaggg

SEQ ID NO: 1886851 - RNA, 20 nt, Human
caguaucaugcccugugcaa

SEQ ID NO: 1886852 - RNA, 17 nt, Human
caguaucaugcccugug

SEQ ID NO: 1886853 - RNA, 19 nt, Human
caguaucaugcccugugca

SEQ ID NO: 1886854 - RNA, 13 nt, Human
caguaucaugccc

SEQ ID NO: 1886855 - RNA, 16 nt, Human
caguaucaugcccugu

SEQ ID NO: 1886856 - RNA, 14 nt, Human
caguaucacugucu

SEQ ID NO: 1886857 - RNA, 22 nt, Human
caguaucacugucuuuccuaga

SEQ ID NO: 1886858 - RNA, 15 nt, Human
caguaucucagggcc

SEQ ID NO: 1886859 - RNA, 12 nt, Human
caguaucuugaa

SEQ ID NO: 1886860 - RNA, 18 nt, Human
caguaucuugaagacuuu

SEQ ID NO: 1886861 - RNA, 21 nt, Human
caguaucuugaagacuuuucu

SEQ ID NO: 1886862 - RNA, 12 nt, Human
caguauggcagc

SEQ ID NO: 1886863 - RNA, 12 nt, Human
caguagugauag

SEQ ID NO: 1886864 - RNA, 23 nt, Human
caguagucuugaugaccaaaguc

SEQ ID NO: 1886865 - RNA, 14 nt, Human
caguauaaacaaag

SEQ ID NO: 1886866 - RNA, 19 nt, Human
caguauaaacaaaguuacu

SEQ ID NO: 1886867 - RNA, 20 nt, Human
caguacuuuggaggccccua

SEQ ID NO: 1886868 - RNA, 16 nt, Human
caguacuuuggaggcc

SEQ ID NO: 1886869 - RNA, 19 nt, Human
caguacuuuggaggccccu

SEQ ID NO: 1886870 - RNA, 18 nt, Human
caguagcaguagaugcau

SEQ ID NO: 1886871 - RNA, 14 nt, Human
caguccccccaccc

SEQ ID NO: 1886872 - RNA, 20 nt, Human
caguccccccacccucauuc

SEQ ID NO: 1886873 - RNA, 17 nt, Human
cagucccugccaaugga

SEQ ID NO: 1886874 - RNA, 12 nt, Human
caguccucccau

SEQ ID NO: 1886875 - RNA, 13 nt, Human
caguccucccauc

SEQ ID NO: 1886876 - RNA, 14 nt, Human
caguccucccaucu

SEQ ID NO: 1886877 - RNA, 15 nt, Human
caguccucccaucuc

SEQ ID NO: 1886878 - RNA, 12 nt, Human
cagucccugcca

SEQ ID NO: 1886879 - RNA, 23 nt, Human
cagucccugaggcagguccccag

SEQ ID NO: 1886880 - RNA, 20 nt, Human
cagucccugaggcagguccc

SEQ ID NO: 1886881 - RNA, 14 nt, Human
cagucccugaggca

SEQ ID NO: 1886882 - RNA, 13 nt, Human
cagucccugccaa

SEQ ID NO: 1886883 - RNA, 14 nt, Human
cagucccugccaau

SEQ ID NO: 1886884 - RNA, 15 nt, Human
cagucccugccaaug

SEQ ID NO: 1886885 - RNA, 16 nt, Human
cagucccugccaaugg

SEQ ID NO: 1886886 - RNA, 13 nt, Human
cagugagccacuc

SEQ ID NO: 1886887 - RNA, 17 nt, Human
cagugagcagagaucac

SEQ ID NO: 1886888 - RNA, 24 nt, Human
cagugagccgagauugcaccacug

SEQ ID NO: 1886889 - RNA, 12 nt, Human
cagugaggcucu

SEQ ID NO: 1886890 - RNA, 13 nt, Human
cagugaggcucug

SEQ ID NO: 1886891 - RNA, 14 nt, Human
cagugaggcucugc

SEQ ID NO: 1886892 - RNA, 15 nt, Human
cagugaggcucugcc

SEQ ID NO: 1886893 - RNA, 16 nt, Human
cagugaggcucugccc

SEQ ID NO: 1886894 - RNA, 18 nt, Human
cagugagucgaggacagg

SEQ ID NO: 1886895 - RNA, 17 nt, Human
cagugagucgaggacag

SEQ ID NO: 1886896 - RNA, 21 nt, Human
cagugaggcucugcccuuggu

SEQ ID NO: 1886897 - RNA, 21 nt, Human
cagugagggagggcugucauc

SEQ ID NO: 1886898 - RNA, 17 nt, Human
cagugaggcucugcccu

SEQ ID NO: 1886899 - RNA, 18 nt, Human
cagugaggcucugcccuu

SEQ ID NO: 1886900 - RNA, 19 nt, Human
cagugaggcucugcccuug

SEQ ID NO: 1886901 - RNA, 20 nt, Human
cagugaggcucugcccuugg

SEQ ID NO: 1886902 - RNA, 15 nt, Human
cagugagacagcucu

SEQ ID NO: 1886903 - RNA, 14 nt, Human
cagugaaagcauca

SEQ ID NO: 1886904 - RNA, 13 nt, Human
cagugaaagcauc

SEQ ID NO: 1886905 - RNA, 20 nt, Human
cagugaaagaaaauaacaau

SEQ ID NO: 1886906 - RNA, 16 nt, Human
cagugaaagaaaauaa

SEQ ID NO: 1886907 - RNA, 17 nt, Human
cagucuuguauuaaguu

SEQ ID NO: 1886908 - RNA, 16 nt, Human
cagucuuggcucacug

SEQ ID NO: 1886909 - RNA, 18 nt, Human
cagucuugacgaguguga

SEQ ID NO: 1886910 - RNA, 22 nt, Human
cagucuuuaaucugagaggcca

SEQ ID NO: 1886911 - RNA, 19 nt, Human
cagucuggaaugcaguggu

SEQ ID NO: 1886912 - RNA, 12 nt, Human
caguccuuccac

SEQ ID NO: 1886913 - RNA, 23 nt, Human
cagucuuauagcaagacuguuag

SEQ ID NO: 1886914 - RNA, 16 nt, Human
caguccucccaucuca

SEQ ID NO: 1886915 - RNA, 17 nt, Human
caguccucccaucucac

SEQ ID NO: 1886916 - RNA, 15 nt, Human
caguccuuaccagca

SEQ ID NO: 1886917 - RNA, 18 nt, Human
caguccuuaccagcagag

SEQ ID NO: 1886918 - RNA, 19 nt, Human
caguccuuaccagcagagc

SEQ ID NO: 1886919 - RNA, 20 nt, Human
caguccuuaccagcagagca

SEQ ID NO: 1886920 - RNA, 21 nt, Human
caguccuuaccagcagagcac

SEQ ID NO: 1886921 - RNA, 18 nt, Human
cagucuggaaugcagugg

SEQ ID NO: 1886922 - RNA, 18 nt, Human
cagugauuaccagggacu

SEQ ID NO: 1886923 - RNA, 17 nt, Human
cagugauuaccagggac

SEQ ID NO: 1886924 - RNA, 12 nt, Human
cagugcccccac

SEQ ID NO: 1886925 - RNA, 15 nt, Human
cagugcccccacuga

SEQ ID NO: 1886926 - RNA, 17 nt, Human
cagugcccccacugacc

SEQ ID NO: 1886927 - RNA, 20 nt, Human
cagugcccccacugaccaga

SEQ ID NO: 1886928 - RNA, 21 nt, Human
cagugcccccacugaccagaa

SEQ ID NO: 1886929 - RNA, 22 nt, Human
cagugcccccacugaccagaac

SEQ ID NO: 1886930 - RNA, 23 nt, Human
cagugcccccacugaccagaacu

SEQ ID NO: 1886931 - RNA, 23 nt, Human
cagugagucgaggacagggaggu

SEQ ID NO: 1886932 - RNA, 22 nt, Human
cagugagucgaggacagggagg

SEQ ID NO: 1886933 - RNA, 20 nt, Human
cagugagucgaggacaggga

SEQ ID NO: 1886934 - RNA, 19 nt, Human
cagugagucgaggacaggg

SEQ ID NO: 1886935 - RNA, 15 nt, Human
cagugccgagaagga

SEQ ID NO: 1886936 - RNA, 18 nt, Human
cagugccgagaaggaagc

SEQ ID NO: 1886937 - RNA, 11 nt, Human
cagugccuuau

SEQ ID NO: 1886938 - RNA, 13 nt, Human
cagugccuuaugg

SEQ ID NO: 1886939 - RNA, 15 nt, Human
cagugccuuauggaa

SEQ ID NO: 1886940 - RNA, 16 nt, Human
cagugccuuauggaac

SEQ ID NO: 1886941 - RNA, 17 nt, Human
cagugccuuauggaaca

SEQ ID NO: 1886942 - RNA, 18 nt, Human
cagugccuuauggaacac

SEQ ID NO: 1886943 - RNA, 19 nt, Human
cagugccuuauggaacacu

SEQ ID NO: 1886944 - RNA, 20 nt, Human
cagugccuuauggaacacuc

SEQ ID NO: 1886945 - RNA, 21 nt, Human
cagugccuuauggaacacucu

SEQ ID NO: 1886946 - RNA, 22 nt, Human
cagugccuuauggaacacucug

SEQ ID NO: 1886947 - RNA, 13 nt, Human
cagugcuccagcc

SEQ ID NO: 1886948 - RNA, 23 nt, Human
cagugccuuauggaacacucuga

SEQ ID NO: 1886949 - RNA, 16 nt, Human
caggugaaacccaguc

SEQ ID NO: 1886950 - RNA, 14 nt, Human
caggucuuuccuaa

SEQ ID NO: 1886951 - RNA, 19 nt, Human
caggucuuuccuaaggcug

SEQ ID NO: 1886952 - RNA, 21 nt, Human
caggucuuuccuaaggcugca

SEQ ID NO: 1886953 - RNA, 20 nt, Human
caggucuucaucgaaucuac

SEQ ID NO: 1886954 - RNA, 13 nt, Human
caggucuuuccua

SEQ ID NO: 1886955 - RNA, 14 nt, Human
caggugaauuguuu

SEQ ID NO: 1886956 - RNA, 21 nt, Human
caggugagaagcagaggaagg

SEQ ID NO: 1886957 - RNA, 13 nt, Human
caggugagaagca

SEQ ID NO: 1886958 - RNA, 20 nt, Human
caggugagaagcagaggaag

SEQ ID NO: 1886959 - RNA, 19 nt, Human
cagguggccaugccucagc

SEQ ID NO: 1886960 - RNA, 13 nt, Human
cagguggccaugc

SEQ ID NO: 1886961 - RNA, 15 nt, Human
cagguggccaugccu

SEQ ID NO: 1886962 - RNA, 23 nt, Human
caggucuugaacuccuggccuca

SEQ ID NO: 1886963 - RNA, 22 nt, Human
caggucuugaacuccuggccuc

SEQ ID NO: 1886964 - RNA, 21 nt, Human
caggucuugaacuccuggccu

SEQ ID NO: 1886965 - RNA, 20 nt, Human
caggucuugaacuccuggcc

SEQ ID NO: 1886966 - RNA, 19 nt, Human
caggucuugaacuccuggc

SEQ ID NO: 1886967 - RNA, 18 nt, Human
caggucuugaacuccugg

SEQ ID NO: 1886968 - RNA, 19 nt, Human
caggucccuaauaaagcug

SEQ ID NO: 1886969 - RNA, 20 nt, Human
caggucccuaauaaagcugu

SEQ ID NO: 1886970 - RNA, 21 nt, Human
caggucccuaauaaagcugug

SEQ ID NO: 1886971 - RNA, 22 nt, Human
caggucccuaauaaagcugugu

SEQ ID NO: 1886972 - RNA, 11 nt, Human
caggucccuaa

SEQ ID NO: 1886973 - RNA, 12 nt, Human
caggucccuaau

SEQ ID NO: 1886974 - RNA, 13 nt, Human
caggucccuaaua

SEQ ID NO: 1886975 - RNA, 14 nt, Human
caggucccuaauaa

SEQ ID NO: 1886976 - RNA, 15 nt, Human
caggucccuaauaaa

SEQ ID NO: 1886977 - RNA, 16 nt, Human
caggucccuaauaaag

SEQ ID NO: 1886978 - RNA, 17 nt, Human
caggucccuaauaaagc

SEQ ID NO: 1886979 - RNA, 18 nt, Human
caggucccuaauaaagcu

SEQ ID NO: 1886980 - RNA, 20 nt, Human
caggucaggaguucgagacc

SEQ ID NO: 1886981 - RNA, 18 nt, Human
cagguauuuuauaauucu

SEQ ID NO: 1886982 - RNA, 23 nt, Human
cagguauuuuauaauucugggaa

SEQ ID NO: 1886983 - RNA, 19 nt, Human
cagguauuuuauaauucug

SEQ ID NO: 1886984 - RNA, 12 nt, Human
cagguccccaga

SEQ ID NO: 1886985 - RNA, 18 nt, Human
cagguccccagcuuuggc

SEQ ID NO: 1886986 - RNA, 13 nt, Human
cagguccccagac

SEQ ID NO: 1886987 - RNA, 21 nt, Human
cagguaacaggcagauacagg

SEQ ID NO: 1886988 - RNA, 20 nt, Human
cagguaacaggcagauacag

SEQ ID NO: 1886989 - RNA, 20 nt, Human
cagguaugaccuucuaggaa

SEQ ID NO: 1886990 - RNA, 19 nt, Human
cagguagaacacaagguca

SEQ ID NO: 1886991 - RNA, 20 nt, Human
cagguagaauuaucuaauuu

SEQ ID NO: 1886992 - RNA, 23 nt, Human
cagguagaauuaucuaauuuaua

SEQ ID NO: 1886993 - RNA, 22 nt, Human
cagguagaauuaucuaauuuau

SEQ ID NO: 1886994 - RNA, 18 nt, Human
cagguagaccugucuccu

SEQ ID NO: 1886995 - RNA, 19 nt, Human
cagguagaccugucuccug

SEQ ID NO: 1886996 - RNA, 21 nt, Human
cagguagaccugucuccuggc

SEQ ID NO: 1886997 - RNA, 18 nt, Human
cagggucagaaacaggac

SEQ ID NO: 1886998 - RNA, 19 nt, Human
cagggucagaaacaggacc

SEQ ID NO: 1886999 - RNA, 12 nt, Human
cagggucccugg

SEQ ID NO: 1887000 - RNA, 14 nt, Human
cagggucccuggug

SEQ ID NO: 1887001 - RNA, 15 nt, Human
cagggucccuggugg

SEQ ID NO: 1887002 - RNA, 18 nt, Human
cagggucccugguggcag

SEQ ID NO: 1887003 - RNA, 19 nt, Human
cagggucccugguggcagc

SEQ ID NO: 1887004 - RNA, 22 nt, Human
cagggucccugguggcagcuca

SEQ ID NO: 1887005 - RNA, 10 nt, Human
cagggucaga

SEQ ID NO: 1887006 - RNA, 16 nt, Human
cagggucagaaacagg

SEQ ID NO: 1887007 - RNA, 21 nt, Human
caggguauuccagagugggga

SEQ ID NO: 1887008 - RNA, 20 nt, Human
caggguauuccagagugggg

SEQ ID NO: 1887009 - RNA, 22 nt, Human
cagggguggcugccucauuuag

SEQ ID NO: 1887010 - RNA, 15 nt, Human
cagggucucacucug

SEQ ID NO: 1887011 - RNA, 23 nt, Human
cagggucucacuauguugcccag

SEQ ID NO: 1887012 - RNA, 22 nt, Human
cagggucucacuauguugccca

SEQ ID NO: 1887013 - RNA, 21 nt, Human
cagggucucacuauguugccc

SEQ ID NO: 1887014 - RNA, 23 nt, Human
cagggucccugguggcagcucac

SEQ ID NO: 1887015 - RNA, 18 nt, Human
caggguccuguagcccua

SEQ ID NO: 1887016 - RNA, 17 nt, Human
cagguaacaggcagaua

SEQ ID NO: 1887017 - RNA, 16 nt, Human
cagguaacaggcagau

SEQ ID NO: 1887018 - RNA, 15 nt, Human
cagguaacaggcaga

SEQ ID NO: 1887019 - RNA, 14 nt, Human
cagguaacaggcag

SEQ ID NO: 1887020 - RNA, 16 nt, Human
cagggucucacucugu

SEQ ID NO: 1887021 - RNA, 16 nt, Human
caggguuuugccaugu

SEQ ID NO: 1887022 - RNA, 14 nt, Human
caggggugggacac

SEQ ID NO: 1887023 - RNA, 15 nt, Human
caggggugggacacc

SEQ ID NO: 1887024 - RNA, 20 nt, Human
caggggugggacacccugug

SEQ ID NO: 1887025 - RNA, 21 nt, Human
caggggugggacacccuguga

SEQ ID NO: 1887026 - RNA, 18 nt, Human
caggugucugcccccucu

SEQ ID NO: 1887027 - RNA, 16 nt, Human
caggugugagucacca

SEQ ID NO: 1887028 - RNA, 21 nt, Human
caggugugagucaccaagccc

SEQ ID NO: 1887029 - RNA, 20 nt, Human
caggugugagucaccaagcc

SEQ ID NO: 1887030 - RNA, 23 nt, Human
caggugugaaccaccacacccag

SEQ ID NO: 1887031 - RNA, 22 nt, Human
caggugugaaccaccacaccca

SEQ ID NO: 1887032 - RNA, 19 nt, Human
caggugugaaccaccacac

SEQ ID NO: 1887033 - RNA, 16 nt, Human
caggugugaaccacca

SEQ ID NO: 1887034 - RNA, 23 nt, Human
caggugugagucaccaagcccag

SEQ ID NO: 1887035 - RNA, 22 nt, Human
caggugugagucaccaagccca

SEQ ID NO: 1887036 - RNA, 22 nt, Human
cagguguuacuguaauuccuca

SEQ ID NO: 1887037 - RNA, 12 nt, Human
cagguguucuuc

SEQ ID NO: 1887038 - RNA, 12 nt, Human
caggugugaacc

SEQ ID NO: 1887039 - RNA, 19 nt, Human
caggugucccugcacuugc

SEQ ID NO: 1887040 - RNA, 18 nt, Human
caggugucccugcacuug

SEQ ID NO: 1887041 - RNA, 16 nt, Human
caggugucccugcacu

SEQ ID NO: 1887042 - RNA, 15 nt, Human
caggugucccugcac

SEQ ID NO: 1887043 - RNA, 14 nt, Human
caguaacuaaagcu

SEQ ID NO: 1887044 - RNA, 21 nt, Human
caguaaaugggggugcauuug

SEQ ID NO: 1887045 - RNA, 22 nt, Human
caguaaaugggggugcauuuga

SEQ ID NO: 1887046 - RNA, 13 nt, Human
cagguucagcuug

SEQ ID NO: 1887047 - RNA, 14 nt, Human
cagguucccaagcu

SEQ ID NO: 1887048 - RNA, 15 nt, Human
cagguucccaagcuc

SEQ ID NO: 1887049 - RNA, 17 nt, Human
cagguucccaagcucag

SEQ ID NO: 1887050 - RNA, 12 nt, Human
cagguucagcuu

SEQ ID NO: 1887051 - RNA, 21 nt, Human
caguaauugguccgaucuuug

SEQ ID NO: 1887052 - RNA, 12 nt, Human
caguaauaacuc

SEQ ID NO: 1887053 - RNA, 13 nt, Human
caguaauaacucu

SEQ ID NO: 1887054 - RNA, 14 nt, Human
caggugucccugca

SEQ ID NO: 1887055 - RNA, 11 nt, Human
caggugucccu

SEQ ID NO: 1887056 - RNA, 20 nt, Human
caggugguuauggagagggu

SEQ ID NO: 1887057 - RNA, 18 nt, Human
caggugguuauggagagg

SEQ ID NO: 1887058 - RNA, 23 nt, Human
cagguggggucacucuggcagcu

SEQ ID NO: 1887059 - RNA, 19 nt, Human
cagguggggucacucuggc

SEQ ID NO: 1887060 - RNA, 20 nt, Human
cagguggggucacucuggca

SEQ ID NO: 1887061 - RNA, 21 nt, Human
cagguggggucacucuggcag

SEQ ID NO: 1887062 - RNA, 22 nt, Human
cagguggggucacucuggcagc

SEQ ID NO: 1887063 - RNA, 17 nt, Human
cagguggggcagcuuga

SEQ ID NO: 1887064 - RNA, 18 nt, Human
cagguggggucacucugg

SEQ ID NO: 1887065 - RNA, 16 nt, Human
cagguggggcagcuug

SEQ ID NO: 1887066 - RNA, 15 nt, Human
cagguggggcagcuu

SEQ ID NO: 1887067 - RNA, 14 nt, Human
cagguggggcagcu

SEQ ID NO: 1887068 - RNA, 13 nt, Human
cagguggggcagc

SEQ ID NO: 1887069 - RNA, 23 nt, Human
caggaguucaauaaaugucuguu

SEQ ID NO: 1887070 - RNA, 21 nt, Human
caggaguucgagaccagccug

SEQ ID NO: 1887071 - RNA, 21 nt, Human
caggaguucaauaaaugucug

SEQ ID NO: 1887072 - RNA, 17 nt, Human
caggaguggguugauuu

SEQ ID NO: 1887073 - RNA, 16 nt, Human
caggaguucugcucau

SEQ ID NO: 1887074 - RNA, 20 nt, Human
caggaguucugcucauucua

SEQ ID NO: 1887075 - RNA, 22 nt, Human
caggaguucugcucauucuaau

SEQ ID NO: 1887076 - RNA, 23 nt, Human
caggaguucgagaccagccuggc

SEQ ID NO: 1887077 - RNA, 14 nt, Human
caggaguucugcuc

SEQ ID NO: 1887078 - RNA, 15 nt, Human
caggaguucugcuca

SEQ ID NO: 1887079 - RNA, 19 nt, Human
caggaguuucguuuucaaa

SEQ ID NO: 1887080 - RNA, 21 nt, Human
caggaguuugagaccaaccug

SEQ ID NO: 1887081 - RNA, 22 nt, Human
caggaguuugagaccaaccugg

SEQ ID NO: 1887082 - RNA, 23 nt, Human
caggaguuugagaccaaccuggg

SEQ ID NO: 1887083 - RNA, 21 nt, Human
caggagcacacccagccccca

SEQ ID NO: 1887084 - RNA, 15 nt, Human
caggagcacacccag

SEQ ID NO: 1887085 - RNA, 16 nt, Human
caggagcacacccagc

SEQ ID NO: 1887086 - RNA, 19 nt, Human
caggagcacacccagcccc

SEQ ID NO: 1887087 - RNA, 20 nt, Human
caggagauggaaguugcagu

SEQ ID NO: 1887088 - RNA, 16 nt, Human
caggagacccacaggu

SEQ ID NO: 1887089 - RNA, 15 nt, Human
caggacuuaaaauga

SEQ ID NO: 1887090 - RNA, 20 nt, Human
caggagaacucauguuauuu

SEQ ID NO: 1887091 - RNA, 17 nt, Human
caggacgugggcugggc

SEQ ID NO: 1887092 - RNA, 16 nt, Human
caggacgugggcuggg

SEQ ID NO: 1887093 - RNA, 20 nt, Human
caggacuauauuugggccug

SEQ ID NO: 1887094 - RNA, 13 nt, Human
caggacugggcca

SEQ ID NO: 1887095 - RNA, 12 nt, Human
caggacugggcc

SEQ ID NO: 1887096 - RNA, 16 nt, Human
caggacugggccacuu

SEQ ID NO: 1887097 - RNA, 15 nt, Human
caggacugggccacu

SEQ ID NO: 1887098 - RNA, 20 nt, Human
caggacugggccacuucugg

SEQ ID NO: 1887099 - RNA, 12 nt, Human
caggagugagca

SEQ ID NO: 1887100 - RNA, 21 nt, Human
caggagucccugccaucaugu

SEQ ID NO: 1887101 - RNA, 15 nt, Human
caggagucccugcca

SEQ ID NO: 1887102 - RNA, 14 nt, Human
caggagucccugcc

SEQ ID NO: 1887103 - RNA, 20 nt, Human
caggagccuccugcccuuac

SEQ ID NO: 1887104 - RNA, 14 nt, Human
caggagccuccugc

SEQ ID NO: 1887105 - RNA, 17 nt, Human
caggagccuccugcccu

SEQ ID NO: 1887106 - RNA, 21 nt, Human
caggagcccugggaggcucug

SEQ ID NO: 1887107 - RNA, 18 nt, Human
caggagccccgaggccuu

SEQ ID NO: 1887108 - RNA, 16 nt, Human
caggagccccgaggcc

SEQ ID NO: 1887109 - RNA, 15 nt, Human
caggagccccgaggc

SEQ ID NO: 1887110 - RNA, 12 nt, Human
caggagcagcca

SEQ ID NO: 1887111 - RNA, 13 nt, Human
caggagcagccac

SEQ ID NO: 1887112 - RNA, 14 nt, Human
caggagcagccaca

SEQ ID NO: 1887113 - RNA, 19 nt, Human
caggagcagccacauuccu

SEQ ID NO: 1887114 - RNA, 22 nt, Human
caggagccccgaggccuucucu

SEQ ID NO: 1887115 - RNA, 20 nt, Human
caggagccccgaggccuucu

SEQ ID NO: 1887116 - RNA, 23 nt, Human
caggagccccgaggccuucucug

SEQ ID NO: 1887117 - RNA, 11 nt, Human
caggagcccug

SEQ ID NO: 1887118 - RNA, 14 nt, Human
caggagcccuggga

SEQ ID NO: 1887119 - RNA, 16 nt, Human
caggagcccugggagg

SEQ ID NO: 1887120 - RNA, 18 nt, Human
caggagcccugggaggcu

SEQ ID NO: 1887121 - RNA, 19 nt, Human
caggagcccugggaggcuc

SEQ ID NO: 1887122 - RNA, 23 nt, Human
caggcccaaauuaucaagcuaau

SEQ ID NO: 1887123 - RNA, 15 nt, Human
caggccccaggaaag

SEQ ID NO: 1887124 - RNA, 18 nt, Human
caggccccaggcagggcc

SEQ ID NO: 1887125 - RNA, 13 nt, Human
caggccccugcca

SEQ ID NO: 1887126 - RNA, 21 nt, Human
caggcccccagaaccccuggc

SEQ ID NO: 1887127 - RNA, 18 nt, Human
caggccaaacucaccugc

SEQ ID NO: 1887128 - RNA, 23 nt, Human
caggccaaacucaccugccccuc

SEQ ID NO: 1887129 - RNA, 17 nt, Human
caggccaagaaacgucu

SEQ ID NO: 1887130 - RNA, 13 nt, Human
caggccacaagac

SEQ ID NO: 1887131 - RNA, 17 nt, Human
caggccacaagacccuu

SEQ ID NO: 1887132 - RNA, 18 nt, Human
caggccacaagacccuug

SEQ ID NO: 1887133 - RNA, 21 nt, Human
caggccagggggccagucccu

SEQ ID NO: 1887134 - RNA, 20 nt, Human
caggccacaagacccuugug

SEQ ID NO: 1887135 - RNA, 21 nt, Human
caggccaggcccucugcccac

SEQ ID NO: 1887136 - RNA, 22 nt, Human
caggccaggcccucugcccacu

SEQ ID NO: 1887137 - RNA, 20 nt, Human
caggccccugccacccuggg

SEQ ID NO: 1887138 - RNA, 19 nt, Human
caggccccugccacccugg

SEQ ID NO: 1887139 - RNA, 17 nt, Human
caggccccugccacccu

SEQ ID NO: 1887140 - RNA, 15 nt, Human
caggccccugccacc

SEQ ID NO: 1887141 - RNA, 15 nt, Human
caggcccggcuccag

SEQ ID NO: 1887142 - RNA, 14 nt, Human
caggcccggcucca

SEQ ID NO: 1887143 - RNA, 13 nt, Human
caggcccggcucc

SEQ ID NO: 1887144 - RNA, 21 nt, Human
caggccccgugaggcaauggg

SEQ ID NO: 1887145 - RNA, 17 nt, Human
caggcaguuggccagag

SEQ ID NO: 1887146 - RNA, 15 nt, Human
caggcagggugcagu

SEQ ID NO: 1887147 - RNA, 12 nt, Human
caggcauccucc

SEQ ID NO: 1887148 - RNA, 17 nt, Human
caggcaugguggcccac

SEQ ID NO: 1887149 - RNA, 23 nt, Human
caggcaggucuugaacuccuggc

SEQ ID NO: 1887150 - RNA, 15 nt, Human
caggcaggugggaug

SEQ ID NO: 1887151 - RNA, 22 nt, Human
caggcaggucuugaacuccugg

SEQ ID NO: 1887152 - RNA, 13 nt, Human
caggcaggucuug

SEQ ID NO: 1887153 - RNA, 12 nt, Human
caggcaggucuu

SEQ ID NO: 1887154 - RNA, 19 nt, Human
caggcagguccaggguuug

SEQ ID NO: 1887155 - RNA, 15 nt, Human
caggcagguccaggg

SEQ ID NO: 1887156 - RNA, 14 nt, Human
caggcagguccagg

SEQ ID NO: 1887157 - RNA, 20 nt, Human
caggcauguucucugaggac

SEQ ID NO: 1887158 - RNA, 19 nt, Human
caggcauguucucugagga

SEQ ID NO: 1887159 - RNA, 18 nt, Human
caggcauguucucugagg

SEQ ID NO: 1887160 - RNA, 15 nt, Human
caggcauguucucug

SEQ ID NO: 1887161 - RNA, 13 nt, Human
caggcauucccca

SEQ ID NO: 1887162 - RNA, 15 nt, Human
caggcauuccccagg

SEQ ID NO: 1887163 - RNA, 16 nt, Human
caggcauuccccagga

SEQ ID NO: 1887164 - RNA, 17 nt, Human
caggcauuccccaggag

SEQ ID NO: 1887165 - RNA, 24 nt, Human
caggcauuccccaggaggccagcc

SEQ ID NO: 1887166 - RNA, 22 nt, Human
caggcauuccccaggaggccag

SEQ ID NO: 1887167 - RNA, 23 nt, Human
caggcauuccccaggaggccagc

SEQ ID NO: 1887168 - RNA, 18 nt, Human
caggcauuccccaggagg

SEQ ID NO: 1887169 - RNA, 19 nt, Human
caggcauuccccaggaggc

SEQ ID NO: 1887170 - RNA, 20 nt, Human
caggcauuccccaggaggcc

SEQ ID NO: 1887171 - RNA, 21 nt, Human
caggcauuccccaggaggcca

SEQ ID NO: 1887172 - RNA, 20 nt, Human
caggauucuuccucccuccc

SEQ ID NO: 1887173 - RNA, 21 nt, Human
caggcaagcaccuccugccuc

SEQ ID NO: 1887174 - RNA, 16 nt, Human
caggcaagcaccuccu

SEQ ID NO: 1887175 - RNA, 15 nt, Human
caggcaagcaccucc

SEQ ID NO: 1887176 - RNA, 14 nt, Human
caggcaagcaccuc

SEQ ID NO: 1887177 - RNA, 14 nt, Human
caggcagccaggcc

SEQ ID NO: 1887178 - RNA, 15 nt, Human
caggcagccaggcca

SEQ ID NO: 1887179 - RNA, 13 nt, Human
caggcagguccag

SEQ ID NO: 1887180 - RNA, 20 nt, Human
caggcagggccaacccuucu

SEQ ID NO: 1887181 - RNA, 22 nt, Human
caggcagggccaacccuucucc

SEQ ID NO: 1887182 - RNA, 22 nt, Human
caggcagcuuuuucucucccac

SEQ ID NO: 1887183 - RNA, 19 nt, Human
caggcagcuuuuucucucc

SEQ ID NO: 1887184 - RNA, 21 nt, Human
caggcagcucauaagagccac

SEQ ID NO: 1887185 - RNA, 22 nt, Human
caggcagcucauaagagccaca

SEQ ID NO: 1887186 - RNA, 23 nt, Human
caggcagcucauaagagccacag

SEQ ID NO: 1887187 - RNA, 16 nt, Human
caggcagccaggccac

SEQ ID NO: 1887188 - RNA, 17 nt, Human
caggcagccaggccaca

SEQ ID NO: 1887189 - RNA, 14 nt, Human
caggaucagucuga

SEQ ID NO: 1887190 - RNA, 13 nt, Human
caggaucagucug

SEQ ID NO: 1887191 - RNA, 21 nt, Human
caggauauucucacagcucca

SEQ ID NO: 1887192 - RNA, 18 nt, Human
caggaugaugacuaugga

SEQ ID NO: 1887193 - RNA, 20 nt, Human
caggaugaugacuauggaaa

SEQ ID NO: 1887194 - RNA, 18 nt, Human
caggaucucuuagcauuu

SEQ ID NO: 1887195 - RNA, 23 nt, Human
caggaucucuuagcauuuuaauu

SEQ ID NO: 1887196 - RNA, 14 nt, Human
caggaugaagcauu

SEQ ID NO: 1887197 - RNA, 15 nt, Human
caggaugaagcauuu

SEQ ID NO: 1887198 - RNA, 22 nt, Human
caggaugaugacuauggaaaga

SEQ ID NO: 1887199 - RNA, 23 nt, Human
caggauggccgggcgcgguggcu

SEQ ID NO: 1887200 - RNA, 15 nt, Human
caggaugcuuugguu

SEQ ID NO: 1887201 - RNA, 15 nt, Human
caggaugguaauucu

SEQ ID NO: 1887202 - RNA, 16 nt, Human
caggauuccucuuuuc

SEQ ID NO: 1887203 - RNA, 17 nt, Human
caggauuccucuuuucu

SEQ ID NO: 1887204 - RNA, 20 nt, Human
caggauuccucuuuucucug

SEQ ID NO: 1887205 - RNA, 22 nt, Human
caggauuccucuuuucucugcc

SEQ ID NO: 1887206 - RNA, 17 nt, Human
caggauucuuccucccu

SEQ ID NO: 1887207 - RNA, 18 nt, Human
caggauucuuccucccuc

SEQ ID NO: 1887208 - RNA, 14 nt, Human
caggaugguaauuc

SEQ ID NO: 1887209 - RNA, 21 nt, Human
caggcuuuuuuccagacucua

SEQ ID NO: 1887210 - RNA, 15 nt, Human
cagggaaaagcagcu

SEQ ID NO: 1887211 - RNA, 23 nt, Human
caggcuuuuuuaucaugugaaau

SEQ ID NO: 1887212 - RNA, 18 nt, Human
caggcuugccugcaggca

SEQ ID NO: 1887213 - RNA, 17 nt, Human
caggcuugccugcaggc

SEQ ID NO: 1887214 - RNA, 16 nt, Human
caggcuugccugcagg

SEQ ID NO: 1887215 - RNA, 15 nt, Human
caggcuugccugcag

SEQ ID NO: 1887216 - RNA, 22 nt, Human
caggcuuagucacugagacagc

SEQ ID NO: 1887217 - RNA, 23 nt, Human
caggcuuagucacugagacagcc

SEQ ID NO: 1887218 - RNA, 21 nt, Human
caggcuguaucccaugagccu

SEQ ID NO: 1887219 - RNA, 20 nt, Human
caggcuguaucccaugagcc

SEQ ID NO: 1887220 - RNA, 14 nt, Human
caggcuguauccca

SEQ ID NO: 1887221 - RNA, 19 nt, Human
caggcuggucucaaacucu

SEQ ID NO: 1887222 - RNA, 12 nt, Human
caggcuggucuc

SEQ ID NO: 1887223 - RNA, 23 nt, Human
caggcuggucucaaacuccugac

SEQ ID NO: 1887224 - RNA, 23 nt, Human
caggcuguaucccaugagccuca

SEQ ID NO: 1887225 - RNA, 22 nt, Human
caggcuguaucccaugagccuc

SEQ ID NO: 1887226 - RNA, 16 nt, Human
caggcuuagucacuga

SEQ ID NO: 1887227 - RNA, 17 nt, Human
caggcuuagucacugag

SEQ ID NO: 1887228 - RNA, 20 nt, Human
caggcuuagucacugagaca

SEQ ID NO: 1887229 - RNA, 21 nt, Human
caggcuuagucacugagacag

SEQ ID NO: 1887230 - RNA, 23 nt, Human
caggcugggcuucaguggcagcu

SEQ ID NO: 1887231 - RNA, 21 nt, Human
caggcugggucgcccuggacu

SEQ ID NO: 1887232 - RNA, 23 nt, Human
caggcugggucgcccuggacugu

SEQ ID NO: 1887233 - RNA, 22 nt, Human
caggcugaccacagcacagcca

SEQ ID NO: 1887234 - RNA, 15 nt, Human
caggcugaccacagc

SEQ ID NO: 1887235 - RNA, 17 nt, Human
caggcugaccacagcac

SEQ ID NO: 1887236 - RNA, 20 nt, Human
caggcugaccacagcacagc

SEQ ID NO: 1887237 - RNA, 21 nt, Human
caggcugaccacagcacagcc

SEQ ID NO: 1887238 - RNA, 18 nt, Human
caggcugaagcagguucc

SEQ ID NO: 1887239 - RNA, 14 nt, Human
caggcugaccacag

SEQ ID NO: 1887240 - RNA, 20 nt, Human
caggcuccuuuagcgcccag

SEQ ID NO: 1887241 - RNA, 19 nt, Human
caggcuccuuuagcgccca

SEQ ID NO: 1887242 - RNA, 14 nt, Human
caggcuccuuuagc

SEQ ID NO: 1887243 - RNA, 14 nt, Human
caggccgcccugcg

SEQ ID NO: 1887244 - RNA, 21 nt, Human
caggcuccuuuagcgcccagu

SEQ ID NO: 1887245 - RNA, 20 nt, Human
caggcucgggcuccccagcc

SEQ ID NO: 1887246 - RNA, 12 nt, Human
caggcucucagg

SEQ ID NO: 1887247 - RNA, 13 nt, Human
caggcucucaggc

SEQ ID NO: 1887248 - RNA, 14 nt, Human
caggcucucaggcc

SEQ ID NO: 1887249 - RNA, 15 nt, Human
caggcucucaggcca

SEQ ID NO: 1887250 - RNA, 16 nt, Human
caggcucucaggccag

SEQ ID NO: 1887251 - RNA, 21 nt, Human
caggcucucaggccagcugcu

SEQ ID NO: 1887252 - RNA, 23 nt, Human
caggcucucaggccagcugcuug

SEQ ID NO: 1887253 - RNA, 13 nt, Human
caggcucucaaca

SEQ ID NO: 1887254 - RNA, 14 nt, Human
caggcucucaacag

SEQ ID NO: 1887255 - RNA, 17 nt, Human
caggcucucaggccagc

SEQ ID NO: 1887256 - RNA, 18 nt, Human
caggcucucaggccagcu

SEQ ID NO: 1887257 - RNA, 19 nt, Human
caggcucucaggccagcug

SEQ ID NO: 1887258 - RNA, 20 nt, Human
caggcucucaggccagcugc

SEQ ID NO: 1887259 - RNA, 19 nt, Human
caggcccggcuccaggcuc

SEQ ID NO: 1887260 - RNA, 18 nt, Human
caggcccggcuccaggcu

SEQ ID NO: 1887261 - RNA, 16 nt, Human
caggcccggcuccagg

SEQ ID NO: 1887262 - RNA, 17 nt, Human
caggcccggcuccaggc

SEQ ID NO: 1887263 - RNA, 21 nt, Human
caggcccggcuccaggcuccu

SEQ ID NO: 1887264 - RNA, 20 nt, Human
caggcccggcuccaggcucc

SEQ ID NO: 1887265 - RNA, 22 nt, Human
caggcccggcuccaggcuccuu

SEQ ID NO: 1887266 - RNA, 13 nt, Human
caggcccucugcc

SEQ ID NO: 1887267 - RNA, 22 nt, Human
caggcccucccuguuccccaga

SEQ ID NO: 1887268 - RNA, 23 nt, Human
caggcccucccuguuccccagag

SEQ ID NO: 1887269 - RNA, 14 nt, Human
caggcccucugccc

SEQ ID NO: 1887270 - RNA, 15 nt, Human
caggcccucugccca

SEQ ID NO: 1887271 - RNA, 16 nt, Human
caggcccucugcccac

SEQ ID NO: 1887272 - RNA, 17 nt, Human
caggcccucugcccacu

SEQ ID NO: 1887273 - RNA, 19 nt, Human
caggcccucugcccacucc

SEQ ID NO: 1887274 - RNA, 20 nt, Human
caggcccucugcccacuccc

SEQ ID NO: 1887275 - RNA, 21 nt, Human
caggcccucugcccacucccu

SEQ ID NO: 1887276 - RNA, 22 nt, Human
caggcccucugcccacucccug

SEQ ID NO: 1887277 - RNA, 20 nt, Human
cagggcagccgucaccccug

SEQ ID NO: 1887278 - RNA, 13 nt, Human
cagggcagcgcca

SEQ ID NO: 1887279 - RNA, 14 nt, Human
cagggcagcgccag

SEQ ID NO: 1887280 - RNA, 15 nt, Human
cagggcagcgccagg

SEQ ID NO: 1887281 - RNA, 16 nt, Human
cagggcagcgccaggc

SEQ ID NO: 1887282 - RNA, 17 nt, Human
cagggcagcgccaggcu

SEQ ID NO: 1887283 - RNA, 18 nt, Human
cagggcagcgccaggcug

SEQ ID NO: 1887284 - RNA, 19 nt, Human
cagggcagcgccaggcuga

SEQ ID NO: 1887285 - RNA, 22 nt, Human
cagggcagcgccaggcugacca

SEQ ID NO: 1887286 - RNA, 15 nt, Human
cagggcaccugccac

SEQ ID NO: 1887287 - RNA, 21 nt, Human
cagggcacaccgggcacucag

SEQ ID NO: 1887288 - RNA, 19 nt, Human
cagggcacaccgggcacuc

SEQ ID NO: 1887289 - RNA, 17 nt, Human
cagggcacaccgggcac

SEQ ID NO: 1887290 - RNA, 15 nt, Human
cagggcacaccgggc

SEQ ID NO: 1887291 - RNA, 23 nt, Human
cagggcacaccgggcacucagaa

SEQ ID NO: 1887292 - RNA, 22 nt, Human
cagggcacaccgggcacucaga

SEQ ID NO: 1887293 - RNA, 15 nt, Human
cagggcacaggccau

SEQ ID NO: 1887294 - RNA, 18 nt, Human
cagggcacaggccaugga

SEQ ID NO: 1887295 - RNA, 14 nt, Human
cagggcacaccggg

SEQ ID NO: 1887296 - RNA, 18 nt, Human
cagggcaaugaugaauga

SEQ ID NO: 1887297 - RNA, 12 nt, Human
cagggagaagcu

SEQ ID NO: 1887298 - RNA, 13 nt, Human
cagggagaagcuc

SEQ ID NO: 1887299 - RNA, 18 nt, Human
cagggauuguuucuguuu

SEQ ID NO: 1887300 - RNA, 23 nt, Human
cagggacagaggggguggccucc

SEQ ID NO: 1887301 - RNA, 19 nt, Human
cagggacagaggccccagc

SEQ ID NO: 1887302 - RNA, 21 nt, Human
cagggacagaggccccagccu

SEQ ID NO: 1887303 - RNA, 23 nt, Human
cagggacagaggccccagccucc

SEQ ID NO: 1887304 - RNA, 20 nt, Human
cagggacugaaaaccucucc

SEQ ID NO: 1887305 - RNA, 21 nt, Human
cagggacugaaaaccucuccu

SEQ ID NO: 1887306 - RNA, 23 nt, Human
cagggacugaaaaccucuccuca

SEQ ID NO: 1887307 - RNA, 19 nt, Human
cagggacgaagaagagcca

SEQ ID NO: 1887308 - RNA, 22 nt, Human
cagggacgaagaagagccacag

SEQ ID NO: 1887309 - RNA, 23 nt, Human
cagggacgaagaagagccacagu

SEQ ID NO: 1887310 - RNA, 23 nt, Human
cagggccgcccgggcccagagga

SEQ ID NO: 1887311 - RNA, 22 nt, Human
cagggccgcccgggcccagagg

SEQ ID NO: 1887312 - RNA, 21 nt, Human
cagggccgcccgggcccagag

SEQ ID NO: 1887313 - RNA, 20 nt, Human
cagggccgcccgggcccaga

SEQ ID NO: 1887314 - RNA, 14 nt, Human
cagggccgccaggg

SEQ ID NO: 1887315 - RNA, 16 nt, Human
cagggccgccagggag

SEQ ID NO: 1887316 - RNA, 19 nt, Human
cagggccgcccgggcccag

SEQ ID NO: 1887317 - RNA, 22 nt, Human
cagggccgccagggagaccugg

SEQ ID NO: 1887318 - RNA, 13 nt, Human
cagggccugcgag

SEQ ID NO: 1887319 - RNA, 15 nt, Human
cagggcccccaucuc

SEQ ID NO: 1887320 - RNA, 16 nt, Human
cagggcccccaucuca

SEQ ID NO: 1887321 - RNA, 21 nt, Human
cagggcccccaucucaugccc

SEQ ID NO: 1887322 - RNA, 12 nt, Human
cagggcccagag

SEQ ID NO: 1887323 - RNA, 13 nt, Human
cagggcccagagc

SEQ ID NO: 1887324 - RNA, 14 nt, Human
cagggcccagagcc

SEQ ID NO: 1887325 - RNA, 15 nt, Human
cagggcccagagccc

SEQ ID NO: 1887326 - RNA, 16 nt, Human
cagggcccagagccca

SEQ ID NO: 1887327 - RNA, 18 nt, Human
cagggcccagagcccagc

SEQ ID NO: 1887328 - RNA, 19 nt, Human
cagggcccagagcccagcu

SEQ ID NO: 1887329 - RNA, 21 nt, Human
cagggcccagagcccagcucc

SEQ ID NO: 1887330 - RNA, 22 nt, Human
cagggcccagagcccagcucca

SEQ ID NO: 1887331 - RNA, 13 nt, Human
cagggccaacccu

SEQ ID NO: 1887332 - RNA, 21 nt, Human
cagggcagucauuggcugucu

SEQ ID NO: 1887333 - RNA, 18 nt, Human
cagggccaacccuucucc

SEQ ID NO: 1887334 - RNA, 19 nt, Human
caggggaggguagagcgga

SEQ ID NO: 1887335 - RNA, 18 nt, Human
caggggagggucagccag

SEQ ID NO: 1887336 - RNA, 20 nt, Human
caggggauuucaccacucaa

SEQ ID NO: 1887337 - RNA, 14 nt, Human
caggggcaggagga

SEQ ID NO: 1887338 - RNA, 19 nt, Human
caggggagggucagccagg

SEQ ID NO: 1887339 - RNA, 20 nt, Human
caggggagggucagccaggg

SEQ ID NO: 1887340 - RNA, 22 nt, Human
caggggagggucagccagggcc

SEQ ID NO: 1887341 - RNA, 14 nt, Human
caggggccagaaga

SEQ ID NO: 1887342 - RNA, 16 nt, Human
cagggccuggcucagg

SEQ ID NO: 1887343 - RNA, 19 nt, Human
cagggccuggcucaggugg

SEQ ID NO: 1887344 - RNA, 13 nt, Human
cagggccuggcuc

SEQ ID NO: 1887345 - RNA, 14 nt, Human
cagggccuggcuca

SEQ ID NO: 1887346 - RNA, 15 nt, Human
cagggccuggcucag

SEQ ID NO: 1887347 - RNA, 22 nt, Human
cagggggccagucccugaggca

SEQ ID NO: 1887348 - RNA, 15 nt, Human
caggggggugaggag

SEQ ID NO: 1887349 - RNA, 18 nt, Human
caggggggugaggagcug

SEQ ID NO: 1887350 - RNA, 19 nt, Human
caggggggugaggagcugg

SEQ ID NO: 1887351 - RNA, 17 nt, Human
cagggacacgggcagcc

SEQ ID NO: 1887352 - RNA, 21 nt, Human
cagggacacgggcagccuggc

SEQ ID NO: 1887353 - RNA, 15 nt, Human
cagggacacgggcag

SEQ ID NO: 1887354 - RNA, 16 nt, Human
cagggacacgggcagc

SEQ ID NO: 1887355 - RNA, 13 nt, Human
cagggacaaagag

SEQ ID NO: 1887356 - RNA, 17 nt, Human
cagggacaaagaggccu

SEQ ID NO: 1887357 - RNA, 18 nt, Human
cagggacaaagaggccuu

SEQ ID NO: 1887358 - RNA, 23 nt, Human
cagggacaaagaggccuuuaacc

SEQ ID NO: 1887359 - RNA, 13 nt, Human
cagggacagaggg

SEQ ID NO: 1887360 - RNA, 14 nt, Human
cagggacagaggcc

SEQ ID NO: 1887361 - RNA, 16 nt, Human
cagggacagaggcccc

SEQ ID NO: 1887362 - RNA, 18 nt, Human
cagggacagaggccccag

SEQ ID NO: 1887363 - RNA, 14 nt, Human
cagggacagagggg

SEQ ID NO: 1887364 - RNA, 20 nt, Human
cagggacagaggggguggcc

SEQ ID NO: 1887365 - RNA, 22 nt, Human
cagggaaacagcuaaugggaca

SEQ ID NO: 1887366 - RNA, 16 nt, Human
cagggaaacagcuaau

SEQ ID NO: 1887367 - RNA, 17 nt, Human
cagggaaaagcagcucu

SEQ ID NO: 1887368 - RNA, 19 nt, Human
cagggaaaagcagcucucc

SEQ ID NO: 1887369 - RNA, 20 nt, Human
cagggaaaagcagcucuccc

SEQ ID NO: 1887370 - RNA, 21 nt, Human
cagggaaaagcagcucucccc

SEQ ID NO: 1887371 - RNA, 20 nt, Human
cagggaaaaugcagcaggga

SEQ ID NO: 1887372 - RNA, 22 nt, Human
caucuucuuuuugaaaucagca

SEQ ID NO: 1887373 - RNA, 16 nt, Human
caucuugaauuguaag

SEQ ID NO: 1887374 - RNA, 21 nt, Human
caucuugaauuguaaggaaug

SEQ ID NO: 1887375 - RNA, 17 nt, Human
caucuugcucugcugac

SEQ ID NO: 1887376 - RNA, 16 nt, Human
caucuugcucugcuga

SEQ ID NO: 1887377 - RNA, 19 nt, Human
caucuugcucugcugacag

SEQ ID NO: 1887378 - RNA, 15 nt, Human
caucucuccuccuuu

SEQ ID NO: 1887379 - RNA, 22 nt, Human
caucucuaacagcucaggaucu

SEQ ID NO: 1887380 - RNA, 23 nt, Human
caucucuaacagcucaggaucuc

SEQ ID NO: 1887381 - RNA, 12 nt, Human
caucucugcuug

SEQ ID NO: 1887382 - RNA, 13 nt, Human
caucucugcuuga

SEQ ID NO: 1887383 - RNA, 20 nt, Human
caucucugcuugagucaggu

SEQ ID NO: 1887384 - RNA, 21 nt, Human
caucucugcuugagucagguu

SEQ ID NO: 1887385 - RNA, 14 nt, Human
caucucucuuuaau

SEQ ID NO: 1887386 - RNA, 16 nt, Human
caucucucugcccaac

SEQ ID NO: 1887387 - RNA, 18 nt, Human
caucucucugcccaaccc

SEQ ID NO: 1887388 - RNA, 13 nt, Human
caucucucugccc

SEQ ID NO: 1887389 - RNA, 15 nt, Human
caucucucugcccaa

SEQ ID NO: 1887390 - RNA, 14 nt, Human
caucugaccagcag

SEQ ID NO: 1887391 - RNA, 15 nt, Human
caucugaccagcagc

SEQ ID NO: 1887392 - RNA, 17 nt, Human
caucugaccagcagcgc

SEQ ID NO: 1887393 - RNA, 19 nt, Human
caucugaccagcagcgccu

SEQ ID NO: 1887394 - RNA, 21 nt, Human
caucugaccagcagcgccuuu

SEQ ID NO: 1887395 - RNA, 16 nt, Human
caucucuacaaaaagc

SEQ ID NO: 1887396 - RNA, 16 nt, Human
caucucuaacagcuca

SEQ ID NO: 1887397 - RNA, 18 nt, Human
caucucuaacagcucagg

SEQ ID NO: 1887398 - RNA, 19 nt, Human
caucucuaacagcucagga

SEQ ID NO: 1887399 - RNA, 20 nt, Human
caucucuaacagcucaggau

SEQ ID NO: 1887400 - RNA, 21 nt, Human
caucucuaacagcucaggauc

SEQ ID NO: 1887401 - RNA, 20 nt, Human
caugauccaagcaagacuga

SEQ ID NO: 1887402 - RNA, 21 nt, Human
caugaguuggggucuggcagc

SEQ ID NO: 1887403 - RNA, 23 nt, Human
caugaguuggggucuggcagccu

SEQ ID NO: 1887404 - RNA, 19 nt, Human
caugaguuggcugggaaua

SEQ ID NO: 1887405 - RNA, 15 nt, Human
caugcacucagcucu

SEQ ID NO: 1887406 - RNA, 16 nt, Human
caugcacucagcucuu

SEQ ID NO: 1887407 - RNA, 21 nt, Human
caugaugacaacuacagaaaa

SEQ ID NO: 1887408 - RNA, 23 nt, Human
caugaguccccuguuuguuucug

SEQ ID NO: 1887409 - RNA, 14 nt, Human
caugaguccccugu

SEQ ID NO: 1887410 - RNA, 15 nt, Human
caugaguccccuguu

SEQ ID NO: 1887411 - RNA, 13 nt, Human
caugaguccccug

SEQ ID NO: 1887412 - RNA, 19 nt, Human
caugagguacugagaguga

SEQ ID NO: 1887413 - RNA, 16 nt, Human
caugagguacugagag

SEQ ID NO: 1887414 - RNA, 23 nt, Human
caugaggaacaaggcaaggcugu

SEQ ID NO: 1887415 - RNA, 23 nt, Human
caugagccucagcauccuggcac

SEQ ID NO: 1887416 - RNA, 22 nt, Human
caugagccucagcauccuggca

SEQ ID NO: 1887417 - RNA, 16 nt, Human
caugaggaacaaggca

SEQ ID NO: 1887418 - RNA, 17 nt, Human
caugaggaacaaggcaa

SEQ ID NO: 1887419 - RNA, 20 nt, Human
caugaggaacaaggcaaggc

SEQ ID NO: 1887420 - RNA, 21 nt, Human
caugaggaacaaggcaaggcu

SEQ ID NO: 1887421 - RNA, 17 nt, Human
caugagaccacuguuau

SEQ ID NO: 1887422 - RNA, 19 nt, Human
caugagaccacuguuauca

SEQ ID NO: 1887423 - RNA, 18 nt, Human
caugagauaauaugcaga

SEQ ID NO: 1887424 - RNA, 13 nt, Human
caugagcaucagg

SEQ ID NO: 1887425 - RNA, 22 nt, Human
caugagaugauacauccaaagc

SEQ ID NO: 1887426 - RNA, 16 nt, Human
caugagaacaaacaga

SEQ ID NO: 1887427 - RNA, 19 nt, Human
caugaagauguagaggaga

SEQ ID NO: 1887428 - RNA, 21 nt, Human
caugaagaggaugcugugaaa

SEQ ID NO: 1887429 - RNA, 18 nt, Human
caugaagauguagaggag

SEQ ID NO: 1887430 - RNA, 18 nt, Human
caugaagaggaugcugug

SEQ ID NO: 1887431 - RNA, 21 nt, Human
caugagccucagcauccuggc

SEQ ID NO: 1887432 - RNA, 20 nt, Human
caugagccucagcauccugg

SEQ ID NO: 1887433 - RNA, 19 nt, Human
caugagccucagcauccug

SEQ ID NO: 1887434 - RNA, 18 nt, Human
caugagccucagcauccu

SEQ ID NO: 1887435 - RNA, 17 nt, Human
caugagccucagcaucc

SEQ ID NO: 1887436 - RNA, 15 nt, Human
caugagccucagcau

SEQ ID NO: 1887437 - RNA, 12 nt, Human
caugagccucag

SEQ ID NO: 1887438 - RNA, 15 nt, Human
caugagcaucaggcc

SEQ ID NO: 1887439 - RNA, 16 nt, Human
caugagcaucaggcca

SEQ ID NO: 1887440 - RNA, 17 nt, Human
caugagcaucaggccag

SEQ ID NO: 1887441 - RNA, 18 nt, Human
caugagcaucaggccagg

SEQ ID NO: 1887442 - RNA, 20 nt, Human
caugagcaucaggccaggcc

SEQ ID NO: 1887443 - RNA, 21 nt, Human
caugagcaucaggccaggccc

SEQ ID NO: 1887444 - RNA, 22 nt, Human
caugagcaucaggccaggcccu

SEQ ID NO: 1887445 - RNA, 23 nt, Human
caugagcaucaggccaggcccuc

SEQ ID NO: 1887446 - RNA, 12 nt, Human
caugaagacaga

SEQ ID NO: 1887447 - RNA, 21 nt, Human
caugaaaacacauuuuucuua

SEQ ID NO: 1887448 - RNA, 19 nt, Human
caugaaaacacauuuuucu

SEQ ID NO: 1887449 - RNA, 22 nt, Human
caugaaaaugcaacaacaugua

SEQ ID NO: 1887450 - RNA, 15 nt, Human
caugaaaaugcaaca

SEQ ID NO: 1887451 - RNA, 13 nt, Human
caugaaaaugcaa

SEQ ID NO: 1887452 - RNA, 14 nt, Human
caugaaagauucaa

SEQ ID NO: 1887453 - RNA, 17 nt, Human
caugaaaacacauuuuu

SEQ ID NO: 1887454 - RNA, 16 nt, Human
caugaaaacacauuuu

SEQ ID NO: 1887455 - RNA, 15 nt, Human
caugaaaacacauuu

SEQ ID NO: 1887456 - RNA, 14 nt, Human
caugaaaacacauu

SEQ ID NO: 1887457 - RNA, 13 nt, Human
caugaaaacacau

SEQ ID NO: 1887458 - RNA, 16 nt, Human
caucuuuucuugccuc

SEQ ID NO: 1887459 - RNA, 14 nt, Human
caucuuuucuugcc

SEQ ID NO: 1887460 - RNA, 22 nt, Human
caucuuugugaaggccucgcag

SEQ ID NO: 1887461 - RNA, 21 nt, Human
caucuuuucuugccucugucc

SEQ ID NO: 1887462 - RNA, 22 nt, Human
caucuuuacaaaacuacaugag

SEQ ID NO: 1887463 - RNA, 14 nt, Human
caucuuucuuugga

SEQ ID NO: 1887464 - RNA, 13 nt, Human
caucuuugugaag

SEQ ID NO: 1887465 - RNA, 14 nt, Human
caucuuugugaagg

SEQ ID NO: 1887466 - RNA, 13 nt, Human
cauagucacaugg

SEQ ID NO: 1887467 - RNA, 22 nt, Human
cauaguaccauuuauacaaauu

SEQ ID NO: 1887468 - RNA, 17 nt, Human
cauaguaugguggcugg

SEQ ID NO: 1887469 - RNA, 16 nt, Human
cauaguaugguggcug

SEQ ID NO: 1887470 - RNA, 18 nt, Human
cauaguaccaaucauuuu

SEQ ID NO: 1887471 - RNA, 16 nt, Human
cauaguaccaaucauu

SEQ ID NO: 1887472 - RNA, 23 nt, Human
cauaguaacuucuuauggaauug

SEQ ID NO: 1887473 - RNA, 24 nt, Human
cauaguaacuucuuauggaauuga

SEQ ID NO: 1887474 - RNA, 21 nt, Human
cauaguaacuucuuauggaau

SEQ ID NO: 1887475 - RNA, 22 nt, Human
cauaguaacuucuuauggaauu

SEQ ID NO: 1887476 - RNA, 22 nt, Human
cauaguaccaaucauuuuaauu

SEQ ID NO: 1887477 - RNA, 16 nt, Human
cauaguaccauuuaua

SEQ ID NO: 1887478 - RNA, 19 nt, Human
cauaguaccauuuauacaa

SEQ ID NO: 1887479 - RNA, 20 nt, Human
cauaguaccauuuauacaaa

SEQ ID NO: 1887480 - RNA, 15 nt, Human
cauaguaugguggcu

SEQ ID NO: 1887481 - RNA, 19 nt, Human
cagugcuugauugcgugga

SEQ ID NO: 1887482 - RNA, 16 nt, Human
cauauaagugauugcu

SEQ ID NO: 1887483 - RNA, 23 nt, Human
cauauaagauucauauuuacuuc

SEQ ID NO: 1887484 - RNA, 18 nt, Human
cauauauuggguuccauu

SEQ ID NO: 1887485 - RNA, 22 nt, Human
cauauauuggguuccauucuca

SEQ ID NO: 1887486 - RNA, 22 nt, Human
cauauucuguuggccaguguga

SEQ ID NO: 1887487 - RNA, 17 nt, Human
cauauugauuuccguua

SEQ ID NO: 1887488 - RNA, 17 nt, Human
cauaucuuuauuaauca

SEQ ID NO: 1887489 - RNA, 14 nt, Human
cauaucuuuauuaa

SEQ ID NO: 1887490 - RNA, 15 nt, Human
cauaucuuuauuaau

SEQ ID NO: 1887491 - RNA, 16 nt, Human
cauaucuuuauuaauc

SEQ ID NO: 1887492 - RNA, 21 nt, Human
cauauugauuuccguuaaaau

SEQ ID NO: 1887493 - RNA, 19 nt, Human
cauauuguaaaacagguag

SEQ ID NO: 1887494 - RNA, 17 nt, Human
cauauuguaaaacaggu

SEQ ID NO: 1887495 - RNA, 16 nt, Human
cauauuguaaaacagg

SEQ ID NO: 1887496 - RNA, 13 nt, Human
cauauuguaaaac

SEQ ID NO: 1887497 - RNA, 23 nt, Human
cauauugcugagagaaauaugga

SEQ ID NO: 1887498 - RNA, 16 nt, Human
cauauugcugagagaa

SEQ ID NO: 1887499 - RNA, 17 nt, Human
cauauugcugagagaaa

SEQ ID NO: 1887500 - RNA, 21 nt, Human
cauauugcugagagaaauaug

SEQ ID NO: 1887501 - RNA, 13 nt, Human
cauauuguuacug

SEQ ID NO: 1887502 - RNA, 19 nt, Human
cauauuguuacugguacca

SEQ ID NO: 1887503 - RNA, 13 nt, Human
cauauuugcacua

SEQ ID NO: 1887504 - RNA, 14 nt, Human
cauauuugcacuaa

SEQ ID NO: 1887505 - RNA, 14 nt, Human
caucaacaucuugg

SEQ ID NO: 1887506 - RNA, 23 nt, Human
cauccagucucccaacuuguauu

SEQ ID NO: 1887507 - RNA, 17 nt, Human
cauccagguucagcuug

SEQ ID NO: 1887508 - RNA, 23 nt, Human
cauccacugugccaugugccagg

SEQ ID NO: 1887509 - RNA, 17 nt, Human
cauccacugugccaugu

SEQ ID NO: 1887510 - RNA, 14 nt, Human
cauccacugugcca

SEQ ID NO: 1887511 - RNA, 12 nt, Human
caucauucccuu

SEQ ID NO: 1887512 - RNA, 15 nt, Human
caucccucuggggcu

SEQ ID NO: 1887513 - RNA, 13 nt, Human
caucccuccuggg

SEQ ID NO: 1887514 - RNA, 20 nt, Human
caucaccaacgucugugcca

SEQ ID NO: 1887515 - RNA, 12 nt, Human
caucacccgcua

SEQ ID NO: 1887516 - RNA, 15 nt, Human
caucaugucuggcua

SEQ ID NO: 1887517 - RNA, 14 nt, Human
caucaugucuggcu

SEQ ID NO: 1887518 - RNA, 21 nt, Human
caucauguuuacagaggacag

SEQ ID NO: 1887519 - RNA, 19 nt, Human
caucauguuuacagaggac

SEQ ID NO: 1887520 - RNA, 13 nt, Human
caucauguuuaca

SEQ ID NO: 1887521 - RNA, 13 nt, Human
caucaugucuggc

SEQ ID NO: 1887522 - RNA, 16 nt, Human
caucauccuaagcuau

SEQ ID NO: 1887523 - RNA, 17 nt, Human
caucaugaccagcaaau

SEQ ID NO: 1887524 - RNA, 17 nt, Human
caugucuuguacaugug

SEQ ID NO: 1887525 - RNA, 15 nt, Human
caugucuuguacaug

SEQ ID NO: 1887526 - RNA, 14 nt, Human
caugucuuguacau

SEQ ID NO: 1887527 - RNA, 13 nt, Human
caugucuuguaca

SEQ ID NO: 1887528 - RNA, 12 nt, Human
caugucuggcua

SEQ ID NO: 1887529 - RNA, 14 nt, Human
caugucugcauuuc

SEQ ID NO: 1887530 - RNA, 15 nt, Human
caugucugcauuucg

SEQ ID NO: 1887531 - RNA, 23 nt, Human
caugucugcauuucgguggcuag

SEQ ID NO: 1887532 - RNA, 15 nt, Human
caugugaugagagga

SEQ ID NO: 1887533 - RNA, 16 nt, Human
caugugaugagaggaa

SEQ ID NO: 1887534 - RNA, 17 nt, Human
caugugaugagaggaaa

SEQ ID NO: 1887535 - RNA, 18 nt, Human
caugugaugagaggaaau

SEQ ID NO: 1887536 - RNA, 20 nt, Human
caugugaugagaggaaauca

SEQ ID NO: 1887537 - RNA, 21 nt, Human
caugugaugagaggaaaucac

SEQ ID NO: 1887538 - RNA, 18 nt, Human
cauguguagccugugcau

SEQ ID NO: 1887539 - RNA, 16 nt, Human
cauguguagccugugc

SEQ ID NO: 1887540 - RNA, 14 nt, Human
cauguguagccugu

SEQ ID NO: 1887541 - RNA, 17 nt, Human
caugugcuacaggggcc

SEQ ID NO: 1887542 - RNA, 20 nt, Human
caugugcuacaggggccaga

SEQ ID NO: 1887543 - RNA, 22 nt, Human
caugugcuacaggggccagaag

SEQ ID NO: 1887544 - RNA, 14 nt, Human
caugugcacaugca

SEQ ID NO: 1887545 - RNA, 22 nt, Human
caugugccagguuuuuggucug

SEQ ID NO: 1887546 - RNA, 14 nt, Human
cauguguuccaagg

SEQ ID NO: 1887547 - RNA, 22 nt, Human
cauguacugagccuuguaauuc

SEQ ID NO: 1887548 - RNA, 19 nt, Human
cauguacugagccuuguaa

SEQ ID NO: 1887549 - RNA, 23 nt, Human
cauguacugagccuuguaauucu

SEQ ID NO: 1887550 - RNA, 20 nt, Human
cauguacaugaagaagcuaa

SEQ ID NO: 1887551 - RNA, 21 nt, Human
cauguaaagcaguauuaaaau

SEQ ID NO: 1887552 - RNA, 20 nt, Human
cauguaaagcaguauuaaaa

SEQ ID NO: 1887553 - RNA, 19 nt, Human
cauguacccuaaggucauu

SEQ ID NO: 1887554 - RNA, 23 nt, Human
cauggucggaaaacaugcuacac

SEQ ID NO: 1887555 - RNA, 14 nt, Human
cauggucacacacu

SEQ ID NO: 1887556 - RNA, 15 nt, Human
cauggucacacacug

SEQ ID NO: 1887557 - RNA, 19 nt, Human
cauggugcuuguuaaugcu

SEQ ID NO: 1887558 - RNA, 19 nt, Human
cauggucggaaaacaugcu

SEQ ID NO: 1887559 - RNA, 17 nt, Human
cauggucggaaaacaug

SEQ ID NO: 1887560 - RNA, 14 nt, Human
cauguuugugauug

SEQ ID NO: 1887561 - RNA, 12 nt, Human
cauguuugugau

SEQ ID NO: 1887562 - RNA, 19 nt, Human
cauguuuuucuucucccuc

SEQ ID NO: 1887563 - RNA, 20 nt, Human
cauguuuuucuucucccuca

SEQ ID NO: 1887564 - RNA, 22 nt, Human
cauuaaaaaaaaaaaaaaaagu

SEQ ID NO: 1887565 - RNA, 22 nt, Human
caugcagccuaaggcuguauga

SEQ ID NO: 1887566 - RNA, 22 nt, Human
caugcacugugaaggacccuug

SEQ ID NO: 1887567 - RNA, 10 nt, Human
caugcacugu

SEQ ID NO: 1887568 - RNA, 13 nt, Human
caugcacugugaa

SEQ ID NO: 1887569 - RNA, 14 nt, Human
caugcacugugaag

SEQ ID NO: 1887570 - RNA, 16 nt, Human
caugcacugugaagga

SEQ ID NO: 1887571 - RNA, 17 nt, Human
caugcacugugaaggac

SEQ ID NO: 1887572 - RNA, 18 nt, Human
caugcacugugaaggacc

SEQ ID NO: 1887573 - RNA, 20 nt, Human
caugcacugugaaggacccu

SEQ ID NO: 1887574 - RNA, 17 nt, Human
caugcugucccuuacgu

SEQ ID NO: 1887575 - RNA, 15 nt, Human
caugcuguucaugaa

SEQ ID NO: 1887576 - RNA, 13 nt, Human
caugcugucccuu

SEQ ID NO: 1887577 - RNA, 15 nt, Human
caugcugucccuuac

SEQ ID NO: 1887578 - RNA, 17 nt, Human
caugcgggcuuccuccu

SEQ ID NO: 1887579 - RNA, 22 nt, Human
cauggacuucugccagcauaau

SEQ ID NO: 1887580 - RNA, 14 nt, Human
cauggagccagcuc

SEQ ID NO: 1887581 - RNA, 15 nt, Human
cauggacuuccacug

SEQ ID NO: 1887582 - RNA, 17 nt, Human
cauggagccagcucccu

SEQ ID NO: 1887583 - RNA, 18 nt, Human
caugcuguucaugaaaga

SEQ ID NO: 1887584 - RNA, 16 nt, Human
caugcuguucaugaaa

SEQ ID NO: 1887585 - RNA, 18 nt, Human
caugggccuccugugugu

SEQ ID NO: 1887586 - RNA, 19 nt, Human
caugggcacaaagggccca

SEQ ID NO: 1887587 - RNA, 21 nt, Human
caugggcacaaagggcccaga

SEQ ID NO: 1887588 - RNA, 23 nt, Human
caugggacagggaggacgcucuc

SEQ ID NO: 1887589 - RNA, 18 nt, Human
caugggaccuauaacugc

SEQ ID NO: 1887590 - RNA, 22 nt, Human
caugggaccuauaacugcccag

SEQ ID NO: 1887591 - RNA, 16 nt, Human
cauggucacacacuga

SEQ ID NO: 1887592 - RNA, 15 nt, Human
cauuuacuguggcuu

SEQ ID NO: 1887593 - RNA, 14 nt, Human
cauuuacuguggcu

SEQ ID NO: 1887594 - RNA, 13 nt, Human
cauuuacuguggc

SEQ ID NO: 1887595 - RNA, 12 nt, Human
cauuuacugugg

SEQ ID NO: 1887596 - RNA, 18 nt, Human
cauuucuuugugcuuugg

SEQ ID NO: 1887597 - RNA, 19 nt, Human
cauuugaaaauuuugaugu

SEQ ID NO: 1887598 - RNA, 17 nt, Human
cauuugaaaauuuugau

SEQ ID NO: 1887599 - RNA, 22 nt, Human
cauuuacccuucuuuucugacu

SEQ ID NO: 1887600 - RNA, 23 nt, Human
cauuuacaacccgguucacucuu

SEQ ID NO: 1887601 - RNA, 15 nt, Human
cauuuaccuuuuuga

SEQ ID NO: 1887602 - RNA, 14 nt, Human
cauuuacaacccgg

SEQ ID NO: 1887603 - RNA, 15 nt, Human
cauuuaaaaaaaauc

SEQ ID NO: 1887604 - RNA, 16 nt, Human
cauuguucaauuagaa

SEQ ID NO: 1887605 - RNA, 15 nt, Human
cauugugggaagggg

SEQ ID NO: 1887606 - RNA, 13 nt, Human
cauugugggaagg

SEQ ID NO: 1887607 - RNA, 14 nt, Human
cauugaccugaggc

SEQ ID NO: 1887608 - RNA, 15 nt, Human
cauugaccugaggcc

SEQ ID NO: 1887609 - RNA, 17 nt, Human
cauugaccugaggcccu

SEQ ID NO: 1887610 - RNA, 18 nt, Human
cauugaccugaggcccuu

SEQ ID NO: 1887611 - RNA, 16 nt, Human
cauugauauuugugca

SEQ ID NO: 1887612 - RNA, 19 nt, Human
cauugauauuugugcauuu

SEQ ID NO: 1887613 - RNA, 22 nt, Human
cauugauauuugugcauuuucu

SEQ ID NO: 1887614 - RNA, 23 nt, Human
cauugauauuugugcauuuucua

SEQ ID NO: 1887615 - RNA, 12 nt, Human
cauugaugcuga

SEQ ID NO: 1887616 - RNA, 17 nt, Human
cauugaauuauaaaagc

SEQ ID NO: 1887617 - RNA, 14 nt, Human
cauugaaggcuuaa

SEQ ID NO: 1887618 - RNA, 13 nt, Human
cauugaaggcuua

SEQ ID NO: 1887619 - RNA, 22 nt, Human
cauugaacacaaacuguaaaua

SEQ ID NO: 1887620 - RNA, 14 nt, Human
cauugaacagcaaa

SEQ ID NO: 1887621 - RNA, 15 nt, Human
cauugaacagcaaag

SEQ ID NO: 1887622 - RNA, 19 nt, Human
cauucuuuuguaauuuaaa

SEQ ID NO: 1887623 - RNA, 21 nt, Human
cauuuuuaagugcugcauuua

SEQ ID NO: 1887624 - RNA, 11 nt, Human
cauuuucaucu

SEQ ID NO: 1887625 - RNA, 14 nt, Human
cauuuuccucugcu

SEQ ID NO: 1887626 - RNA, 15 nt, Human
cauuuuccucugcuu

SEQ ID NO: 1887627 - RNA, 17 nt, Human
cauuuuccucugcuuug

SEQ ID NO: 1887628 - RNA, 20 nt, Human
cauuuuccucugcuuugaaa

SEQ ID NO: 1887629 - RNA, 17 nt, Human
cauuuuuaguagagaca

SEQ ID NO: 1887630 - RNA, 12 nt, Human
cauuuuuacugu

SEQ ID NO: 1887631 - RNA, 22 nt, Human
ccaaaaugcucuagugccuucu

SEQ ID NO: 1887632 - RNA, 17 nt, Human
ccaaaccaccagaagcc

SEQ ID NO: 1887633 - RNA, 16 nt, Human
ccaaacccuucagugc

SEQ ID NO: 1887634 - RNA, 22 nt, Human
cauuuuacuuuuuccuggcuca

SEQ ID NO: 1887635 - RNA, 20 nt, Human
cauuuuacuuuuuccuggcu

SEQ ID NO: 1887636 - RNA, 17 nt, Human
cauuuuacuuuuuccug

SEQ ID NO: 1887637 - RNA, 20 nt, Human
cauuuuacccacacacagau

SEQ ID NO: 1887638 - RNA, 22 nt, Human
cauuuuauuuuauuaugcauga

SEQ ID NO: 1887639 - RNA, 23 nt, Human
cauuuuauuuuauuaugcaugaa

SEQ ID NO: 1887640 - RNA, 23 nt, Human
cauuuuaccuuugacaaagguaa

SEQ ID NO: 1887641 - RNA, 16 nt, Human
cauucaggagcuuccu

SEQ ID NO: 1887642 - RNA, 18 nt, Human
cauucaguauauaaaaua

SEQ ID NO: 1887643 - RNA, 19 nt, Human
cauucagugauuacuguca

SEQ ID NO: 1887644 - RNA, 20 nt, Human
cauucagugauuacugucaa

SEQ ID NO: 1887645 - RNA, 21 nt, Human
cauucagugauuacugucaag

SEQ ID NO: 1887646 - RNA, 21 nt, Human
cauucagauaugauucaaaug

SEQ ID NO: 1887647 - RNA, 15 nt, Human
cauucaccugcccca

SEQ ID NO: 1887648 - RNA, 16 nt, Human
cauucaccugccccaa

SEQ ID NO: 1887649 - RNA, 19 nt, Human
cauucaccugccccaacuc

SEQ ID NO: 1887650 - RNA, 19 nt, Human
cauucauuuucuggguguu

SEQ ID NO: 1887651 - RNA, 20 nt, Human
cauucauuuagcuaaacgga

SEQ ID NO: 1887652 - RNA, 13 nt, Human
cauuccagaggaa

SEQ ID NO: 1887653 - RNA, 13 nt, Human
cauuccccaggag

SEQ ID NO: 1887654 - RNA, 15 nt, Human
cauuccccaggaggc

SEQ ID NO: 1887655 - RNA, 17 nt, Human
cauuccccaggaggcca

SEQ ID NO: 1887656 - RNA, 14 nt, Human
cauuccaagccuga

SEQ ID NO: 1887657 - RNA, 14 nt, Human
cauuccagaggaag

SEQ ID NO: 1887658 - RNA, 20 nt, Human
cauucccuucgacagcauuu

SEQ ID NO: 1887659 - RNA, 20 nt, Human
cauuccccaggaggccagcc

SEQ ID NO: 1887660 - RNA, 18 nt, Human
cauuccccaggaggccag

SEQ ID NO: 1887661 - RNA, 19 nt, Human
cauuccccaggaggccagc

SEQ ID NO: 1887662 - RNA, 23 nt, Human
cauucacaguucuuugggccaga

SEQ ID NO: 1887663 - RNA, 13 nt, Human
cauucaccugccc

SEQ ID NO: 1887664 - RNA, 22 nt, Human
cauucacaguucuuugggccag

SEQ ID NO: 1887665 - RNA, 20 nt, Human
cauucaaauguauuacagug

SEQ ID NO: 1887666 - RNA, 12 nt, Human
cauucaacaaga

SEQ ID NO: 1887667 - RNA, 16 nt, Human
cauuaagccuuccaca

SEQ ID NO: 1887668 - RNA, 21 nt, Human
cauuacagggcacaggccaug

SEQ ID NO: 1887669 - RNA, 22 nt, Human
cauuacagggcacaggccaugg

SEQ ID NO: 1887670 - RNA, 13 nt, Human
cauucuggaauaa

SEQ ID NO: 1887671 - RNA, 17 nt, Human
cauucuguuaaucauua

SEQ ID NO: 1887672 - RNA, 13 nt, Human
cauucuuaaaaaa

SEQ ID NO: 1887673 - RNA, 20 nt, Human
cauucugccugcccaggccc

SEQ ID NO: 1887674 - RNA, 19 nt, Human
cauucugccugcccaggcc

SEQ ID NO: 1887675 - RNA, 18 nt, Human
cauucugccugcccaggc

SEQ ID NO: 1887676 - RNA, 17 nt, Human
cauucugccugcccagg

SEQ ID NO: 1887677 - RNA, 16 nt, Human
cauucugccugcccag

SEQ ID NO: 1887678 - RNA, 15 nt, Human
cauucugccugccca

SEQ ID NO: 1887679 - RNA, 13 nt, Human
cauucugccugcc

SEQ ID NO: 1887680 - RNA, 12 nt, Human
cauucugccugc

SEQ ID NO: 1887681 - RNA, 23 nt, Human
cauuccugaugcuucuucagaga

SEQ ID NO: 1887682 - RNA, 14 nt, Human
cauuccugaugcuu

SEQ ID NO: 1887683 - RNA, 16 nt, Human
cauuccugaugcuucu

SEQ ID NO: 1887684 - RNA, 19 nt, Human
cauuccugaugcuucuuca

SEQ ID NO: 1887685 - RNA, 22 nt, Human
cauuccugaugcuucuucagag

SEQ ID NO: 1887686 - RNA, 14 nt, Human
cauuccugaacagg

SEQ ID NO: 1887687 - RNA, 13 nt, Human
cauuccugaagaa

SEQ ID NO: 1887688 - RNA, 16 nt, Human
cauuccugaagaacca

SEQ ID NO: 1887689 - RNA, 17 nt, Human
cauuccugaagaaccag

SEQ ID NO: 1887690 - RNA, 20 nt, Human
cauuccugaagaaccagucc

SEQ ID NO: 1887691 - RNA, 21 nt, Human
cauuccugaagaaccaguccc

SEQ ID NO: 1887692 - RNA, 23 nt, Human
cauucuucuguacgucugacagg

SEQ ID NO: 1887693 - RNA, 17 nt, Human
cauucuugaaagcugug

SEQ ID NO: 1887694 - RNA, 12 nt, Human
cauucuuuugua

SEQ ID NO: 1887695 - RNA, 14 nt, Human
cauucuuuuguaau

SEQ ID NO: 1887696 - RNA, 15 nt, Human
cauucuuuuguaauu

SEQ ID NO: 1887697 - RNA, 16 nt, Human
cauucuuuuguaauuu

SEQ ID NO: 1887698 - RNA, 18 nt, Human
cauucuuuuguaauuuaa

SEQ ID NO: 1887699 - RNA, 17 nt, Human
cauucuuucugauaacu

SEQ ID NO: 1887700 - RNA, 23 nt, Human
ccagggagaccuggacacaggcc

SEQ ID NO: 1887701 - RNA, 21 nt, Human
ccagggagaccuggacacagg

SEQ ID NO: 1887702 - RNA, 22 nt, Human
ccagggagaccuggacacaggc

SEQ ID NO: 1887703 - RNA, 18 nt, Human
ccagggagaccuggacac

SEQ ID NO: 1887704 - RNA, 19 nt, Human
ccagggagcauuuuccucc

SEQ ID NO: 1887705 - RNA, 20 nt, Human
ccagggagcauuuuccucca

SEQ ID NO: 1887706 - RNA, 21 nt, Human
ccagggagcauuuuccuccau

SEQ ID NO: 1887707 - RNA, 20 nt, Human
ccaggcuuagucacugagac

SEQ ID NO: 1887708 - RNA, 14 nt, Human
ccagggacagaggg

SEQ ID NO: 1887709 - RNA, 15 nt, Human
ccagggacagagggg

SEQ ID NO: 1887710 - RNA, 21 nt, Human
ccagggacagaggggguggcc

SEQ ID NO: 1887711 - RNA, 22 nt, Human
ccagggacagaggggguggccu

SEQ ID NO: 1887712 - RNA, 19 nt, Human
ccaggugcacaagcuccaa

SEQ ID NO: 1887713 - RNA, 20 nt, Human
ccaggugcacaagcuccaag

SEQ ID NO: 1887714 - RNA, 18 nt, Human
ccaggugcacaagcucca

SEQ ID NO: 1887715 - RNA, 19 nt, Human
ccagggcuggacugaggcc

SEQ ID NO: 1887716 - RNA, 18 nt, Human
ccagggcuggacugaggc

SEQ ID NO: 1887717 - RNA, 17 nt, Human
ccagggcuggacugagg

SEQ ID NO: 1887718 - RNA, 16 nt, Human
ccagggcuggacugag

SEQ ID NO: 1887719 - RNA, 13 nt, Human
ccagggcuggacu

SEQ ID NO: 1887720 - RNA, 19 nt, Human
ccagggcccagagcccagc

SEQ ID NO: 1887721 - RNA, 21 nt, Human
ccagggcccagagcccagcuc

SEQ ID NO: 1887722 - RNA, 22 nt, Human
ccagggcccagagcccagcucc

SEQ ID NO: 1887723 - RNA, 23 nt, Human
ccagggcccagagcccagcucca

SEQ ID NO: 1887724 - RNA, 18 nt, Human
ccagggagccuuugguuc

SEQ ID NO: 1887725 - RNA, 14 nt, Human
ccagggagccuuug

SEQ ID NO: 1887726 - RNA, 12 nt, Human
ccagggagccuu

SEQ ID NO: 1887727 - RNA, 13 nt, Human
ccagggagccuuu

SEQ ID NO: 1887728 - RNA, 13 nt, Human
ccagggcccagag

SEQ ID NO: 1887729 - RNA, 14 nt, Human
ccagggcccagagc

SEQ ID NO: 1887730 - RNA, 15 nt, Human
ccagggcccagagcc

SEQ ID NO: 1887731 - RNA, 16 nt, Human
ccagggcccagagccc

SEQ ID NO: 1887732 - RNA, 17 nt, Human
ccagggcccagagccca

SEQ ID NO: 1887733 - RNA, 18 nt, Human
ccagggcccagagcccag

SEQ ID NO: 1887734 - RNA, 20 nt, Human
ccagucuggaaugcaguggu

SEQ ID NO: 1887735 - RNA, 19 nt, Human
ccagucuggaaugcagugg

SEQ ID NO: 1887736 - RNA, 18 nt, Human
ccagucuggaaugcagug

SEQ ID NO: 1887737 - RNA, 20 nt, Human
ccagucuccaccaggaaccu

SEQ ID NO: 1887738 - RNA, 21 nt, Human
ccagucuccaccaggaaccuc

SEQ ID NO: 1887739 - RNA, 23 nt, Human
ccagucuccaccaggaaccucuu

SEQ ID NO: 1887740 - RNA, 16 nt, Human
ccagucuccaccagga

SEQ ID NO: 1887741 - RNA, 18 nt, Human
ccagucuccaccaggaac

SEQ ID NO: 1887742 - RNA, 19 nt, Human
ccagucuccaccaggaacc

SEQ ID NO: 1887743 - RNA, 17 nt, Human
ccagguuuuuggucuga

SEQ ID NO: 1887744 - RNA, 20 nt, Human
ccaguaaaaaaaaaaaaugg

SEQ ID NO: 1887745 - RNA, 24 nt, Human
ccaggugcacaagcuccaagcucc

SEQ ID NO: 1887746 - RNA, 24 nt, Human
ccaggcuguaucccaugagccuca

SEQ ID NO: 1887747 - RNA, 17 nt, Human
ccaggcuuagucacuga

SEQ ID NO: 1887748 - RNA, 18 nt, Human
ccaggcgcaggggcucac

SEQ ID NO: 1887749 - RNA, 22 nt, Human
ccaggcccucugcccacucccu

SEQ ID NO: 1887750 - RNA, 23 nt, Human
ccaggcccucugcccacucccug

SEQ ID NO: 1887751 - RNA, 20 nt, Human
ccaggcccucugcccacucc

SEQ ID NO: 1887752 - RNA, 21 nt, Human
ccaggcccucugcccacuccc

SEQ ID NO: 1887753 - RNA, 19 nt, Human
ccaggccagggggccaguc

SEQ ID NO: 1887754 - RNA, 20 nt, Human
ccaggagccccgaggccuuc

SEQ ID NO: 1887755 - RNA, 12 nt, Human
ccaggagccucc

SEQ ID NO: 1887756 - RNA, 19 nt, Human
ccaggagccccgaggccuu

SEQ ID NO: 1887757 - RNA, 16 nt, Human
ccaggagccccgaggc

SEQ ID NO: 1887758 - RNA, 18 nt, Human
ccaggcauuccccaggag

SEQ ID NO: 1887759 - RNA, 19 nt, Human
ccaggcauuccccaggagg

SEQ ID NO: 1887760 - RNA, 21 nt, Human
ccaggcauuccccaggaggcc

SEQ ID NO: 1887761 - RNA, 15 nt, Human
ccaggccagcugccu

SEQ ID NO: 1887762 - RNA, 13 nt, Human
ccagccucccuga

SEQ ID NO: 1887763 - RNA, 15 nt, Human
ccagccucccugaag

SEQ ID NO: 1887764 - RNA, 17 nt, Human
ccagccucccugaagcc

SEQ ID NO: 1887765 - RNA, 21 nt, Human
ccagccucccugaagccuuug

SEQ ID NO: 1887766 - RNA, 15 nt, Human
ccauagucacauggc

SEQ ID NO: 1887767 - RNA, 23 nt, Human
ccauauucuguuggccaguguga

SEQ ID NO: 1887768 - RNA, 15 nt, Human
ccauaguaccauuua

SEQ ID NO: 1887769 - RNA, 19 nt, Human
ccauaguaccauuuauaca

SEQ ID NO: 1887770 - RNA, 22 nt, Human
ccaguguuguggauuuaacaga

SEQ ID NO: 1887771 - RNA, 16 nt, Human
ccaguguccuuagaac

SEQ ID NO: 1887772 - RNA, 16 nt, Human
ccagugaggcucugcc

SEQ ID NO: 1887773 - RNA, 14 nt, Human
ccagugaggcucug

SEQ ID NO: 1887774 - RNA, 15 nt, Human
ccagugaggcucugc

SEQ ID NO: 1887775 - RNA, 22 nt, Human
ccagugguuccuaauccucuag

SEQ ID NO: 1887776 - RNA, 20 nt, Human
ccagugccgagaaggaagcc

SEQ ID NO: 1887777 - RNA, 14 nt, Human
ccagugcccccacu

SEQ ID NO: 1887778 - RNA, 16 nt, Human
ccagugcccccacuga

SEQ ID NO: 1887779 - RNA, 18 nt, Human
ccagugcccccacugacc

SEQ ID NO: 1887780 - RNA, 13 nt, Human
ccaucuacccucc

SEQ ID NO: 1887781 - RNA, 13 nt, Human
cccaaagggugug

SEQ ID NO: 1887782 - RNA, 20 nt, Human
cccaaagugguauagaaaug

SEQ ID NO: 1887783 - RNA, 16 nt, Human
cccaaagugcugggau

SEQ ID NO: 1887784 - RNA, 21 nt, Human
cccaaagugguauagaaaugc

SEQ ID NO: 1887785 - RNA, 23 nt, Human
cccaaauggaaaugggcagagca

SEQ ID NO: 1887786 - RNA, 14 nt, Human
cccaaaugagccau

SEQ ID NO: 1887787 - RNA, 18 nt, Human
cccaaauggaaaugggca

SEQ ID NO: 1887788 - RNA, 22 nt, Human
cccaaauggaaaugggcagagc

SEQ ID NO: 1887789 - RNA, 13 nt, Human
cccaagggaucug

SEQ ID NO: 1887790 - RNA, 23 nt, Human
cccaaucccagcuaccucaacca

SEQ ID NO: 1887791 - RNA, 17 nt, Human
cccaaucccuuuauuac

SEQ ID NO: 1887792 - RNA, 21 nt, Human
cccaaucccuuuauuaccccc

SEQ ID NO: 1887793 - RNA, 17 nt, Human
cccaacccuucccucac

SEQ ID NO: 1887794 - RNA, 19 nt, Human
ccauucuccaccugccagg

SEQ ID NO: 1887795 - RNA, 20 nt, Human
ccauucuccaccugccaggg

SEQ ID NO: 1887796 - RNA, 13 nt, Human
ccauucuccauuu

SEQ ID NO: 1887797 - RNA, 17 nt, Human
ccauucuccauuuguua

SEQ ID NO: 1887798 - RNA, 14 nt, Human
ccauuuguguuuau

SEQ ID NO: 1887799 - RNA, 14 nt, Human
ccauuuguuaucug

SEQ ID NO: 1887800 - RNA, 15 nt, Human
cccaaagugcuggga

SEQ ID NO: 1887801 - RNA, 13 nt, Human
cccaaagugcugg

SEQ ID NO: 1887802 - RNA, 20 nt, Human
cccaaaacucuccucugcug

SEQ ID NO: 1887803 - RNA, 21 nt, Human
cccaaaacaccggguuccagc

SEQ ID NO: 1887804 - RNA, 16 nt, Human
cccaaaacucuccucu

SEQ ID NO: 1887805 - RNA, 18 nt, Human
cccaaaacucuccucugc

SEQ ID NO: 1887806 - RNA, 18 nt, Human
ccauucuccaccugccag

SEQ ID NO: 1887807 - RNA, 21 nt, Human
ccauguuuguggcuauuaaaa

SEQ ID NO: 1887808 - RNA, 20 nt, Human
ccauucagugauuacuguca

SEQ ID NO: 1887809 - RNA, 17 nt, Human
ccauguugugccucccu

SEQ ID NO: 1887810 - RNA, 20 nt, Human
ccauguugugccucccuggu

SEQ ID NO: 1887811 - RNA, 22 nt, Human
ccauguugugccucccugguga

SEQ ID NO: 1887812 - RNA, 16 nt, Human
ccauguuggccaggcu

SEQ ID NO: 1887813 - RNA, 17 nt, Human
ccauguuggccaggcug

SEQ ID NO: 1887814 - RNA, 19 nt, Human
ccaugggacagggaggacg

SEQ ID NO: 1887815 - RNA, 16 nt, Human
ccaugggacagggagg

SEQ ID NO: 1887816 - RNA, 13 nt, Human
ccauccuccagca

SEQ ID NO: 1887817 - RNA, 14 nt, Human
ccauccuccagcag

SEQ ID NO: 1887818 - RNA, 15 nt, Human
ccauccuccagcagg

SEQ ID NO: 1887819 - RNA, 16 nt, Human
ccauccuccagcaggg

SEQ ID NO: 1887820 - RNA, 17 nt, Human
ccauccuccagcaggga

SEQ ID NO: 1887821 - RNA, 18 nt, Human
ccauauuguaaaacaggu

SEQ ID NO: 1887822 - RNA, 14 nt, Human
ccauauuguaaaac

SEQ ID NO: 1887823 - RNA, 21 nt, Human
ccagccacggacgcuggcucc

SEQ ID NO: 1887824 - RNA, 17 nt, Human
ccagccaggccccaggc

SEQ ID NO: 1887825 - RNA, 15 nt, Human
ccagccaaagccucc

SEQ ID NO: 1887826 - RNA, 14 nt, Human
ccagcauuccuuuu

SEQ ID NO: 1887827 - RNA, 13 nt, Human
ccagcauuccuuu

SEQ ID NO: 1887828 - RNA, 18 nt, Human
ccagccaaagccuccucc

SEQ ID NO: 1887829 - RNA, 19 nt, Human
ccagccaaagccuccucca

SEQ ID NO: 1887830 - RNA, 23 nt, Human
ccagcauaauacuugcuuuggaa

SEQ ID NO: 1887831 - RNA, 15 nt, Human
ccagcaguuuucaag

SEQ ID NO: 1887832 - RNA, 22 nt, Human
ccagcaguuuucaagucaaauu

SEQ ID NO: 1887833 - RNA, 15 nt, Human
ccagcaggugcugac

SEQ ID NO: 1887834 - RNA, 22 nt, Human
ccagcacugaggaagaacgggg

SEQ ID NO: 1887835 - RNA, 17 nt, Human
ccagcacugaggaagaa

SEQ ID NO: 1887836 - RNA, 15 nt, Human
ccagcacugaggaag

SEQ ID NO: 1887837 - RNA, 14 nt, Human
ccagcacugaggaa

SEQ ID NO: 1887838 - RNA, 13 nt, Human
ccagcacugagga

SEQ ID NO: 1887839 - RNA, 12 nt, Human
ccagcacugagg

SEQ ID NO: 1887840 - RNA, 18 nt, Human
ccagcaggugcugacuuc

SEQ ID NO: 1887841 - RNA, 21 nt, Human
ccagcagucaauuaacaauaa

SEQ ID NO: 1887842 - RNA, 15 nt, Human
ccagccccagugccc

SEQ ID NO: 1887843 - RNA, 13 nt, Human
ccagccccagugc

SEQ ID NO: 1887844 - RNA, 23 nt, Human
ccagccccaaaacucuccucugc

SEQ ID NO: 1887845 - RNA, 17 nt, Human
ccagcccuuagcaggga

SEQ ID NO: 1887846 - RNA, 16 nt, Human
ccagcccuuagcaggg

SEQ ID NO: 1887847 - RNA, 16 nt, Human
ccagccccagugccca

SEQ ID NO: 1887848 - RNA, 14 nt, Human
ccagcccuccccau

SEQ ID NO: 1887849 - RNA, 20 nt, Human
ccagcccuccccauggagcc

SEQ ID NO: 1887850 - RNA, 21 nt, Human
ccagcccuccccauggagcca

SEQ ID NO: 1887851 - RNA, 19 nt, Human
ccagccucaucucuuuguu

SEQ ID NO: 1887852 - RNA, 14 nt, Human
ccagccgccaugcu

SEQ ID NO: 1887853 - RNA, 23 nt, Human
ccagccgagauagccaaggccaa

SEQ ID NO: 1887854 - RNA, 18 nt, Human
ccagccgccaugcuccug

SEQ ID NO: 1887855 - RNA, 19 nt, Human
ccagccgccaugcuccugg

SEQ ID NO: 1887856 - RNA, 15 nt, Human
ccagcaagugagagc

SEQ ID NO: 1887857 - RNA, 14 nt, Human
ccagauuucacucu

SEQ ID NO: 1887858 - RNA, 22 nt, Human
ccagcaagugagagcugggugu

SEQ ID NO: 1887859 - RNA, 21 nt, Human
ccagcaagugagagcugggug

SEQ ID NO: 1887860 - RNA, 20 nt, Human
ccagcaagugagagcugggu

SEQ ID NO: 1887861 - RNA, 16 nt, Human
ccagcaagugagagcu

SEQ ID NO: 1887862 - RNA, 22 nt, Human
ccagaggagcugggagccgggc

SEQ ID NO: 1887863 - RNA, 21 nt, Human
ccagaggagcugggagccggg

SEQ ID NO: 1887864 - RNA, 20 nt, Human
ccagaggagcugggagccgg

SEQ ID NO: 1887865 - RNA, 22 nt, Human
ccagaggagggcagcagaaggg

SEQ ID NO: 1887866 - RNA, 12 nt, Human
ccagaggagggc

SEQ ID NO: 1887867 - RNA, 22 nt, Human
ccagaggcaccucaagaagaag

SEQ ID NO: 1887868 - RNA, 18 nt, Human
ccagaggcagcuucuuug

SEQ ID NO: 1887869 - RNA, 19 nt, Human
ccagaggcagcuucuuugc

SEQ ID NO: 1887870 - RNA, 20 nt, Human
ccagaggacugugaugcccu

SEQ ID NO: 1887871 - RNA, 22 nt, Human
ccagaggacugugaugcccugc

SEQ ID NO: 1887872 - RNA, 22 nt, Human
ccagaggagagaggacccccug

SEQ ID NO: 1887873 - RNA, 21 nt, Human
ccagaggagagaggacccccu

SEQ ID NO: 1887874 - RNA, 21 nt, Human
ccagagggagugacagaggca

SEQ ID NO: 1887875 - RNA, 20 nt, Human
ccagagggagugacagaggc

SEQ ID NO: 1887876 - RNA, 19 nt, Human
ccagagggagugacagagg

SEQ ID NO: 1887877 - RNA, 18 nt, Human
ccagagggagugacagag

SEQ ID NO: 1887878 - RNA, 17 nt, Human
ccagagggagugacaga

SEQ ID NO: 1887879 - RNA, 16 nt, Human
ccagagggagugacag

SEQ ID NO: 1887880 - RNA, 14 nt, Human
ccagagcugccacc

SEQ ID NO: 1887881 - RNA, 15 nt, Human
ccagagcugccaccu

SEQ ID NO: 1887882 - RNA, 16 nt, Human
ccagagcugccaccug

SEQ ID NO: 1887883 - RNA, 19 nt, Human
ccagagcugccaccugccu

SEQ ID NO: 1887884 - RNA, 11 nt, Human
ccagagcugcc

SEQ ID NO: 1887885 - RNA, 20 nt, Human
ccagagcuacccgcagaguu

SEQ ID NO: 1887886 - RNA, 21 nt, Human
ccagagcuacccgcagaguuc

SEQ ID NO: 1887887 - RNA, 12 nt, Human
ccagagcugcca

SEQ ID NO: 1887888 - RNA, 13 nt, Human
ccagagcugccac

SEQ ID NO: 1887889 - RNA, 20 nt, Human
ccagagauccaaaagaagcc

SEQ ID NO: 1887890 - RNA, 17 nt, Human
ccacuguacuugcucuu

SEQ ID NO: 1887891 - RNA, 18 nt, Human
ccacuguacuugcucuug

SEQ ID NO: 1887892 - RNA, 19 nt, Human
ccacuguacuugcucuuga

SEQ ID NO: 1887893 - RNA, 19 nt, Human
ccagacaccuugacagggc

SEQ ID NO: 1887894 - RNA, 17 nt, Human
ccagacaccuugacagg

SEQ ID NO: 1887895 - RNA, 20 nt, Human
ccacuguacuugcucuugau

SEQ ID NO: 1887896 - RNA, 14 nt, Human
ccagacacccagga

SEQ ID NO: 1887897 - RNA, 15 nt, Human
ccagacacccaggac

SEQ ID NO: 1887898 - RNA, 16 nt, Human
ccagacacccaggacu

SEQ ID NO: 1887899 - RNA, 14 nt, Human
ccagagaggguggu

SEQ ID NO: 1887900 - RNA, 18 nt, Human
ccagacccccuggagacu

SEQ ID NO: 1887901 - RNA, 23 nt, Human
ccagagaggguggugaccucugc

SEQ ID NO: 1887902 - RNA, 21 nt, Human
ccagagaggguggugaccucu

SEQ ID NO: 1887903 - RNA, 20 nt, Human
ccagacaccuugacagggca

SEQ ID NO: 1887904 - RNA, 16 nt, Human
ccagacccccuggaga

SEQ ID NO: 1887905 - RNA, 12 nt, Human
ccagacccccug

SEQ ID NO: 1887906 - RNA, 23 nt, Human
ccagagggagugacagaggcagc

SEQ ID NO: 1887907 - RNA, 22 nt, Human
ccagagggagugacagaggcag

SEQ ID NO: 1887908 - RNA, 13 nt, Human
ccagagggccugc

SEQ ID NO: 1887909 - RNA, 15 nt, Human
ccagagggccugcaa

SEQ ID NO: 1887910 - RNA, 16 nt, Human
ccagagggccugcaag

SEQ ID NO: 1887911 - RNA, 14 nt, Human
ccagaugcagggca

SEQ ID NO: 1887912 - RNA, 15 nt, Human
ccagaugcagggcag

SEQ ID NO: 1887913 - RNA, 18 nt, Human
ccagaugcagggcaguca

SEQ ID NO: 1887914 - RNA, 18 nt, Human
ccagauucuuuccugagg

SEQ ID NO: 1887915 - RNA, 17 nt, Human
ccagauguuuccagacu

SEQ ID NO: 1887916 - RNA, 23 nt, Human
ccagauguuuccagacuuccuug

SEQ ID NO: 1887917 - RNA, 19 nt, Human
ccagauucuuuccugaggc

SEQ ID NO: 1887918 - RNA, 20 nt, Human
ccagauucuuuccugaggcu

SEQ ID NO: 1887919 - RNA, 21 nt, Human
ccagauucuuuccugaggcug

SEQ ID NO: 1887920 - RNA, 22 nt, Human
ccagauucuuuccugaggcugg

SEQ ID NO: 1887921 - RNA, 20 nt, Human
ccagauugcaacaggcuggg

SEQ ID NO: 1887922 - RNA, 19 nt, Human
ccagauugcaacaggcugg

SEQ ID NO: 1887923 - RNA, 23 nt, Human
ccagauucuuuccugaggcuggg

SEQ ID NO: 1887924 - RNA, 21 nt, Human
ccagauugcaacaggcugggc

SEQ ID NO: 1887925 - RNA, 13 nt, Human
ccagauuuaugca

SEQ ID NO: 1887926 - RNA, 22 nt, Human
ccagauuuaugcauauuauuuu

SEQ ID NO: 1887927 - RNA, 12 nt, Human
ccagauuucacu

SEQ ID NO: 1887928 - RNA, 14 nt, Human
ccacaccugccucu

SEQ ID NO: 1887929 - RNA, 14 nt, Human
ccacacccagccca

SEQ ID NO: 1887930 - RNA, 13 nt, Human
ccacacccagccc

SEQ ID NO: 1887931 - RNA, 12 nt, Human
ccacacccagcc

SEQ ID NO: 1887932 - RNA, 20 nt, Human
ccaaaccaccagaagcccag

SEQ ID NO: 1887933 - RNA, 23 nt, Human
ccacaucuugcucugcugacaga

SEQ ID NO: 1887934 - RNA, 22 nt, Human
ccacaucuugcucugcugacag

SEQ ID NO: 1887935 - RNA, 16 nt, Human
ccacaucuugcucugc

SEQ ID NO: 1887936 - RNA, 14 nt, Human
ccaccaacauacuc

SEQ ID NO: 1887937 - RNA, 18 nt, Human
ccaccaacauacucccau

SEQ ID NO: 1887938 - RNA, 14 nt, Human
ccacaucuugcucu

SEQ ID NO: 1887939 - RNA, 14 nt, Human
ccacaucaaagagg

SEQ ID NO: 1887940 - RNA, 20 nt, Human
ccacauacaacacaaagaga

SEQ ID NO: 1887941 - RNA, 13 nt, Human
ccacacuggacuc

SEQ ID NO: 1887942 - RNA, 14 nt, Human
ccacacuggacucc

SEQ ID NO: 1887943 - RNA, 19 nt, Human
ccacacugauccagcccug

SEQ ID NO: 1887944 - RNA, 22 nt, Human
ccacacugauccagcccugagu

SEQ ID NO: 1887945 - RNA, 13 nt, Human
ccacccaccucag

SEQ ID NO: 1887946 - RNA, 22 nt, Human
ccacccaagggccuggccugag

SEQ ID NO: 1887947 - RNA, 20 nt, Human
ccacccaagggccuggccug

SEQ ID NO: 1887948 - RNA, 21 nt, Human
ccacccaagggccuggccuga

SEQ ID NO: 1887949 - RNA, 15 nt, Human
ccacccaccucagcc

SEQ ID NO: 1887950 - RNA, 14 nt, Human
ccacccaccucagc

SEQ ID NO: 1887951 - RNA, 16 nt, Human
ccacccaccucagccu

SEQ ID NO: 1887952 - RNA, 17 nt, Human
ccacccaccucccugcc

SEQ ID NO: 1887953 - RNA, 19 nt, Human
ccacccaccucccugccuc

SEQ ID NO: 1887954 - RNA, 16 nt, Human
ccaccacacccagccc

SEQ ID NO: 1887955 - RNA, 14 nt, Human
ccaccacacccagc

SEQ ID NO: 1887956 - RNA, 20 nt, Human
ccaccaacauacucccaucu

SEQ ID NO: 1887957 - RNA, 22 nt, Human
ccaccaagccuggucagcccaa

SEQ ID NO: 1887958 - RNA, 16 nt, Human
ccacccaagggccugg

SEQ ID NO: 1887959 - RNA, 17 nt, Human
ccacccaagggccuggc

SEQ ID NO: 1887960 - RNA, 19 nt, Human
ccacccaagggccuggccu

SEQ ID NO: 1887961 - RNA, 17 nt, Human
ccacggacgcuggcucc

SEQ ID NO: 1887962 - RNA, 17 nt, Human
ccaccuggccucugcac

SEQ ID NO: 1887963 - RNA, 14 nt, Human
ccaccuggccucug

SEQ ID NO: 1887964 - RNA, 22 nt, Human
ccaccugcggugcuaucucccc

SEQ ID NO: 1887965 - RNA, 15 nt, Human
ccaccuggccucugc

SEQ ID NO: 1887966 - RNA, 16 nt, Human
ccaccuggccucugca

SEQ ID NO: 1887967 - RNA, 15 nt, Human
ccacggccaggccag

SEQ ID NO: 1887968 - RNA, 14 nt, Human
ccacggccaggcca

SEQ ID NO: 1887969 - RNA, 13 nt, Human
ccacggccaggcc

SEQ ID NO: 1887970 - RNA, 12 nt, Human
ccacggccaggc

SEQ ID NO: 1887971 - RNA, 17 nt, Human
ccaccugccuguugggc

SEQ ID NO: 1887972 - RNA, 20 nt, Human
ccaccugccuguugggccag

SEQ ID NO: 1887973 - RNA, 12 nt, Human
ccaccugccagg

SEQ ID NO: 1887974 - RNA, 16 nt, Human
ccaccugccagggaca

SEQ ID NO: 1887975 - RNA, 17 nt, Human
ccaccucccacaaagga

SEQ ID NO: 1887976 - RNA, 14 nt, Human
ccacccaggagccc

SEQ ID NO: 1887977 - RNA, 12 nt, Human
ccacccaggagc

SEQ ID NO: 1887978 - RNA, 15 nt, Human
ccaccucagccuccc

SEQ ID NO: 1887979 - RNA, 14 nt, Human
ccaccucagccucc

SEQ ID NO: 1887980 - RNA, 13 nt, Human
ccaccucagccuc

SEQ ID NO: 1887981 - RNA, 12 nt, Human
ccaccucagccu

SEQ ID NO: 1887982 - RNA, 18 nt, Human
ccacccugaaagcccuga

SEQ ID NO: 1887983 - RNA, 16 nt, Human
ccacccugaaagcccu

SEQ ID NO: 1887984 - RNA, 17 nt, Human
ccacccugaaagcccug

SEQ ID NO: 1887985 - RNA, 19 nt, Human
ccaccccucaacaccucug

SEQ ID NO: 1887986 - RNA, 15 nt, Human
ccacccuccacucuc

SEQ ID NO: 1887987 - RNA, 18 nt, Human
ccacuggacugaccuggu

SEQ ID NO: 1887988 - RNA, 16 nt, Human
ccacugcgaccacaag

SEQ ID NO: 1887989 - RNA, 23 nt, Human
ccacugcacuccagccuggguga

SEQ ID NO: 1887990 - RNA, 15 nt, Human
ccacucccugcaacc

SEQ ID NO: 1887991 - RNA, 19 nt, Human
ccacugcacuccagccugg

SEQ ID NO: 1887992 - RNA, 20 nt, Human
ccacugcacuccagccuggg

SEQ ID NO: 1887993 - RNA, 22 nt, Human
ccacuacggaauaguuggcuag

SEQ ID NO: 1887994 - RNA, 18 nt, Human
ccacuacauucuguuaau

SEQ ID NO: 1887995 - RNA, 23 nt, Human
ccacuacggaauaguuggcuagg

SEQ ID NO: 1887996 - RNA, 21 nt, Human
ccacuaagaauucaaacuggg

SEQ ID NO: 1887997 - RNA, 13 nt, Human
ccacuaagcagag

SEQ ID NO: 1887998 - RNA, 14 nt, Human
ccacuaagcagagg

SEQ ID NO: 1887999 - RNA, 16 nt, Human
ccacuaagcagaggag

SEQ ID NO: 1888000 - RNA, 19 nt, Human
ccacucaaaggccagaccu

SEQ ID NO: 1888001 - RNA, 12 nt, Human
ccacucccugca

SEQ ID NO: 1888002 - RNA, 13 nt, Human
ccacucccugcaa

SEQ ID NO: 1888003 - RNA, 13 nt, Human
ccacguuucuaaa

SEQ ID NO: 1888004 - RNA, 18 nt, Human
ccacuaagcagaggaggg

SEQ ID NO: 1888005 - RNA, 13 nt, Human
ccuggacacaggc

SEQ ID NO: 1888006 - RNA, 16 nt, Human
ccuggacacaggccug

SEQ ID NO: 1888007 - RNA, 20 nt, Human
ccuggacacaggccugcucu

SEQ ID NO: 1888008 - RNA, 18 nt, Human
ccuggaauauauaaccag

SEQ ID NO: 1888009 - RNA, 23 nt, Human
ccuggcacccggccccugcuggu

SEQ ID NO: 1888010 - RNA, 22 nt, Human
ccuggcacuauaauguaagcuc

SEQ ID NO: 1888011 - RNA, 22 nt, Human
ccuggcacccggccccugcugg

SEQ ID NO: 1888012 - RNA, 12 nt, Human
ccuggcagcccc

SEQ ID NO: 1888013 - RNA, 13 nt, Human
ccuggcagccccu

SEQ ID NO: 1888014 - RNA, 14 nt, Human
ccuggcagcucagc

SEQ ID NO: 1888015 - RNA, 12 nt, Human
ccuggcagcucu

SEQ ID NO: 1888016 - RNA, 13 nt, Human
ccuggcagcucug

SEQ ID NO: 1888017 - RNA, 14 nt, Human
ccuggcagcucugg

SEQ ID NO: 1888018 - RNA, 15 nt, Human
ccuggcagcucugga

SEQ ID NO: 1888019 - RNA, 17 nt, Human
ccuggcagcucuggaca

SEQ ID NO: 1888020 - RNA, 19 nt, Human
ccuggcagcucuggacagc

SEQ ID NO: 1888021 - RNA, 20 nt, Human
ccuggcagcucuggacagcc

SEQ ID NO: 1888022 - RNA, 21 nt, Human
ccuggcagcucuggacagccc

SEQ ID NO: 1888023 - RNA, 23 nt, Human
ccuggcagcucuggacagcccca

SEQ ID NO: 1888024 - RNA, 15 nt, Human
ccuggccagaugcac

SEQ ID NO: 1888025 - RNA, 20 nt, Human
ccuggcuccaaacccucgag

SEQ ID NO: 1888026 - RNA, 12 nt, Human
ccuggccagaca

SEQ ID NO: 1888027 - RNA, 13 nt, Human
ccuggccagacac

SEQ ID NO: 1888028 - RNA, 14 nt, Human
ccuggccagacaca

SEQ ID NO: 1888029 - RNA, 15 nt, Human
ccuggccagacacag

SEQ ID NO: 1888030 - RNA, 16 nt, Human
ccuggccagacacagg

SEQ ID NO: 1888031 - RNA, 18 nt, Human
ccuggccagacacaggcc

SEQ ID NO: 1888032 - RNA, 19 nt, Human
ccuggccagacacaggccc

SEQ ID NO: 1888033 - RNA, 23 nt, Human
ccuggccagacacaggcccuccc

SEQ ID NO: 1888034 - RNA, 18 nt, Human
ccuggcugcagccugcgc

SEQ ID NO: 1888035 - RNA, 22 nt, Human
ccuggcuccaaacccucgaggc

SEQ ID NO: 1888036 - RNA, 15 nt, Human
ccuggcuccaggcca

SEQ ID NO: 1888037 - RNA, 17 nt, Human
ccuggcuccaggccagg

SEQ ID NO: 1888038 - RNA, 16 nt, Human
ccuggcuccaggccag

SEQ ID NO: 1888039 - RNA, 17 nt, Human
ccugguccacagggcac

SEQ ID NO: 1888040 - RNA, 14 nt, Human
ccuggucagcccaa

SEQ ID NO: 1888041 - RNA, 12 nt, Human
ccuggucagccc

SEQ ID NO: 1888042 - RNA, 21 nt, Human
ccuggugagagggccgggcag

SEQ ID NO: 1888043 - RNA, 19 nt, Human
ccugguaggagugugugau

SEQ ID NO: 1888044 - RNA, 15 nt, Human
ccugguacucaagcc

SEQ ID NO: 1888045 - RNA, 16 nt, Human
ccugguacucaagccc

SEQ ID NO: 1888046 - RNA, 19 nt, Human
ccugguacucaagcccgcg

SEQ ID NO: 1888047 - RNA, 20 nt, Human
ccuggcugggacguggcuca

SEQ ID NO: 1888048 - RNA, 21 nt, Human
ccuggcugggacguggcucag

SEQ ID NO: 1888049 - RNA, 22 nt, Human
ccuggcugggacguggcucagc

SEQ ID NO: 1888050 - RNA, 24 nt, Human
ccuggcugggacguggcucagcca

SEQ ID NO: 1888051 - RNA, 22 nt, Human
ccugcgcccaguccuuccaccu

SEQ ID NO: 1888052 - RNA, 16 nt, Human
ccugcggugcuaucuc

SEQ ID NO: 1888053 - RNA, 17 nt, Human
ccugcggugcuaucucc

SEQ ID NO: 1888054 - RNA, 23 nt, Human
ccugcgggugaacaaagcagcca

SEQ ID NO: 1888055 - RNA, 24 nt, Human
ccugcgggugaacaaagcagccac

SEQ ID NO: 1888056 - RNA, 23 nt, Human
ccugcgguagaugggagggaggc

SEQ ID NO: 1888057 - RNA, 19 nt, Human
ccugcgagggcagcgggag

SEQ ID NO: 1888058 - RNA, 20 nt, Human
ccugcgccaccgcccagaga

SEQ ID NO: 1888059 - RNA, 13 nt, Human
ccugcgagggcag

SEQ ID NO: 1888060 - RNA, 18 nt, Human
ccugcgcccaguccuucc

SEQ ID NO: 1888061 - RNA, 20 nt, Human
ccugcgcccaguccuuccac

SEQ ID NO: 1888062 - RNA, 22 nt, Human
ccugccccucaacucuccucca

SEQ ID NO: 1888063 - RNA, 22 nt, Human
ccugcccccaggacugggccac

SEQ ID NO: 1888064 - RNA, 20 nt, Human
ccugcccccaggacugggcc

SEQ ID NO: 1888065 - RNA, 19 nt, Human
ccugcccccaggacugggc

SEQ ID NO: 1888066 - RNA, 18 nt, Human
ccugcccccaggacuggg

SEQ ID NO: 1888067 - RNA, 17 nt, Human
ccugcccccaggacugg

SEQ ID NO: 1888068 - RNA, 16 nt, Human
ccugcccccaggacug

SEQ ID NO: 1888069 - RNA, 11 nt, Human
ccugccucagc

SEQ ID NO: 1888070 - RNA, 23 nt, Human
ccugccuguugggccaggagccu

SEQ ID NO: 1888071 - RNA, 18 nt, Human
ccugccugguccucacac

SEQ ID NO: 1888072 - RNA, 14 nt, Human
ccugcuucaaauau

SEQ ID NO: 1888073 - RNA, 13 nt, Human
ccuggaacuuggg

SEQ ID NO: 1888074 - RNA, 16 nt, Human
ccuggaacuuggggag

SEQ ID NO: 1888075 - RNA, 17 nt, Human
ccuggaacuuggggagu

SEQ ID NO: 1888076 - RNA, 22 nt, Human
ccugcucuccgaccagacaccu

SEQ ID NO: 1888077 - RNA, 21 nt, Human
ccugcucuccgaccagacacc

SEQ ID NO: 1888078 - RNA, 11 nt, Human
ccugcuccaga

SEQ ID NO: 1888079 - RNA, 12 nt, Human
ccugcuccagac

SEQ ID NO: 1888080 - RNA, 13 nt, Human
ccugcuccagacc

SEQ ID NO: 1888081 - RNA, 14 nt, Human
ccugcuccagaccu

SEQ ID NO: 1888082 - RNA, 15 nt, Human
ccugcuccagaccug

SEQ ID NO: 1888083 - RNA, 22 nt, Human
ccugcggugcuaucucccccag

SEQ ID NO: 1888084 - RNA, 23 nt, Human
ccugacaacacucauugaccuga

SEQ ID NO: 1888085 - RNA, 13 nt, Human
ccugagcaacucu

SEQ ID NO: 1888086 - RNA, 14 nt, Human
ccugagcaacucuu

SEQ ID NO: 1888087 - RNA, 15 nt, Human
ccugagcaacucuug

SEQ ID NO: 1888088 - RNA, 18 nt, Human
ccugagcaacucuugauu

SEQ ID NO: 1888089 - RNA, 23 nt, Human
ccugagcaacucuugauuaucca

SEQ ID NO: 1888090 - RNA, 16 nt, Human
ccugagcuuucugcua

SEQ ID NO: 1888091 - RNA, 19 nt, Human
ccugaggaagagggacugu

SEQ ID NO: 1888092 - RNA, 21 nt, Human
ccugaggcccagagggccugc

SEQ ID NO: 1888093 - RNA, 12 nt, Human
ccugagccagau

SEQ ID NO: 1888094 - RNA, 14 nt, Human
ccugagcuuucugc

SEQ ID NO: 1888095 - RNA, 11 nt, Human
ccugagcccca

SEQ ID NO: 1888096 - RNA, 15 nt, Human
ccugaggcagguccc

SEQ ID NO: 1888097 - RNA, 22 nt, Human
ccugcaaccugauugugucucu

SEQ ID NO: 1888098 - RNA, 21 nt, Human
ccugcaaccugauugugucuc

SEQ ID NO: 1888099 - RNA, 17 nt, Human
ccugauugugucucuug

SEQ ID NO: 1888100 - RNA, 19 nt, Human
ccugauugugucucuuggu

SEQ ID NO: 1888101 - RNA, 11 nt, Human
ccugaggcccu

SEQ ID NO: 1888102 - RNA, 12 nt, Human
ccugaggcccuu

SEQ ID NO: 1888103 - RNA, 19 nt, Human
ccugaugcuucuucagaga

SEQ ID NO: 1888104 - RNA, 20 nt, Human
ccugaugcuucuucagagac

SEQ ID NO: 1888105 - RNA, 21 nt, Human
ccugaugcuucuucagagacu

SEQ ID NO: 1888106 - RNA, 22 nt, Human
ccugaugcuucuucagagacuc

SEQ ID NO: 1888107 - RNA, 14 nt, Human
ccugaggcccuucu

SEQ ID NO: 1888108 - RNA, 15 nt, Human
ccugauugugucucu

SEQ ID NO: 1888109 - RNA, 16 nt, Human
ccugcaggccaggcca

SEQ ID NO: 1888110 - RNA, 19 nt, Human
ccugcacucuuuaagggag

SEQ ID NO: 1888111 - RNA, 12 nt, Human
ccugcaggccag

SEQ ID NO: 1888112 - RNA, 18 nt, Human
ccugcaggccaggccagc

SEQ ID NO: 1888113 - RNA, 14 nt, Human
ccugcaagaacaag

SEQ ID NO: 1888114 - RNA, 13 nt, Human
ccugccaggaagc

SEQ ID NO: 1888115 - RNA, 14 nt, Human
ccugccaggaagcc

SEQ ID NO: 1888116 - RNA, 15 nt, Human
ccugccaggaagcca

SEQ ID NO: 1888117 - RNA, 17 nt, Human
ccugccaggaagccagc

SEQ ID NO: 1888118 - RNA, 12 nt, Human
ccugccagcugc

SEQ ID NO: 1888119 - RNA, 13 nt, Human
ccugccagcugca

SEQ ID NO: 1888120 - RNA, 14 nt, Human
ccugccagcugcac

SEQ ID NO: 1888121 - RNA, 16 nt, Human
ccugccagcugcacug

SEQ ID NO: 1888122 - RNA, 17 nt, Human
ccugccagcugcacuga

SEQ ID NO: 1888123 - RNA, 18 nt, Human
ccugccagcugcacugau

SEQ ID NO: 1888124 - RNA, 23 nt, Human
ccugccagcugcacugaugcugc

SEQ ID NO: 1888125 - RNA, 14 nt, Human
ccugccacucaggc

SEQ ID NO: 1888126 - RNA, 14 nt, Human
ccugccagaccccc

SEQ ID NO: 1888127 - RNA, 23 nt, Human
ccugccacucaggcccaaagccu

SEQ ID NO: 1888128 - RNA, 22 nt, Human
ccugccacucaggcccaaagcc

SEQ ID NO: 1888129 - RNA, 19 nt, Human
ccugcaucugaccagcagc

SEQ ID NO: 1888130 - RNA, 18 nt, Human
ccugcaucugaccagcag

SEQ ID NO: 1888131 - RNA, 16 nt, Human
ccugccagggacagag

SEQ ID NO: 1888132 - RNA, 15 nt, Human
ccugcccccaggacu

SEQ ID NO: 1888133 - RNA, 14 nt, Human
ccugcccccaggac

SEQ ID NO: 1888134 - RNA, 12 nt, Human
ccugcccccagg

SEQ ID NO: 1888135 - RNA, 12 nt, Human
ccugccagggac

SEQ ID NO: 1888136 - RNA, 13 nt, Human
ccugccagggaca

SEQ ID NO: 1888137 - RNA, 14 nt, Human
ccugccagggacag

SEQ ID NO: 1888138 - RNA, 15 nt, Human
ccugccagggacaga

SEQ ID NO: 1888139 - RNA, 23 nt, Human
ccugccaggaagccagcaggcuc

SEQ ID NO: 1888140 - RNA, 16 nt, Human
ccugccaggcauggug

SEQ ID NO: 1888141 - RNA, 11 nt, Human
ccugccaggga

SEQ ID NO: 1888142 - RNA, 18 nt, Human
ccugccaggaagccagca

SEQ ID NO: 1888143 - RNA, 19 nt, Human
ccugccaggaagccagcag

SEQ ID NO: 1888144 - RNA, 21 nt, Human
ccugccaggaagccagcaggc

SEQ ID NO: 1888145 - RNA, 22 nt, Human
ccugccaggaagccagcaggcu

SEQ ID NO: 1888146 - RNA, 18 nt, Human
ccuugaagaaccucucac

SEQ ID NO: 1888147 - RNA, 17 nt, Human
ccuugaagaaccucuca

SEQ ID NO: 1888148 - RNA, 13 nt, Human
ccuugaacuagga

SEQ ID NO: 1888149 - RNA, 21 nt, Human
ccuugaaaauaagaauagaaa

SEQ ID NO: 1888150 - RNA, 20 nt, Human
ccuugaaaacuuuaugcuaa

SEQ ID NO: 1888151 - RNA, 13 nt, Human
ccuugacucuuuc

SEQ ID NO: 1888152 - RNA, 22 nt, Human
ccuugaccauucuccaccugcc

SEQ ID NO: 1888153 - RNA, 23 nt, Human
ccuugaccauucuccaccugcca

SEQ ID NO: 1888154 - RNA, 20 nt, Human
ccuugaguugauucagcucu

SEQ ID NO: 1888155 - RNA, 14 nt, Human
ccuucgggcugugc

SEQ ID NO: 1888156 - RNA, 15 nt, Human
ccuucggcgccuuaa

SEQ ID NO: 1888157 - RNA, 14 nt, Human
ccuucuaggaagcu

SEQ ID NO: 1888158 - RNA, 16 nt, Human
ccuucgacagcauuuu

SEQ ID NO: 1888159 - RNA, 15 nt, Human
ccuucuccuucaccu

SEQ ID NO: 1888160 - RNA, 19 nt, Human
ccuucuccuucaccuuugu

SEQ ID NO: 1888161 - RNA, 20 nt, Human
ccuucuaggguuauugcauu

SEQ ID NO: 1888162 - RNA, 14 nt, Human
ccuucucucaucuc

SEQ ID NO: 1888163 - RNA, 16 nt, Human
ccuuugacgccauccc

SEQ ID NO: 1888164 - RNA, 20 nt, Human
ccuuucuccccugcccccag

SEQ ID NO: 1888165 - RNA, 19 nt, Human
ccuuucuccccugccccca

SEQ ID NO: 1888166 - RNA, 17 nt, Human
ccuuugacgccauccca

SEQ ID NO: 1888167 - RNA, 18 nt, Human
ccuuugacgccaucccag

SEQ ID NO: 1888168 - RNA, 18 nt, Human
ccuuucuccccugccccc

SEQ ID NO: 1888169 - RNA, 15 nt, Human
ccuuucuccccugcc

SEQ ID NO: 1888170 - RNA, 21 nt, Human
ccuuguuccuagaguagagug

SEQ ID NO: 1888171 - RNA, 19 nt, Human
ccuuguuuacacauacccu

SEQ ID NO: 1888172 - RNA, 21 nt, Human
ccuuggcuuuuacugaagccu

SEQ ID NO: 1888173 - RNA, 23 nt, Human
ccuugauuguucgggugugcaau

SEQ ID NO: 1888174 - RNA, 22 nt, Human
ccuuggugucgggcaugacacg

SEQ ID NO: 1888175 - RNA, 21 nt, Human
ccuugguuaggcauuguggga

SEQ ID NO: 1888176 - RNA, 22 nt, Human
ccuugguuaggcauugugggaa

SEQ ID NO: 1888177 - RNA, 17 nt, Human
ccuugggcccucugguu

SEQ ID NO: 1888178 - RNA, 15 nt, Human
ccuuccucucuccag

SEQ ID NO: 1888179 - RNA, 17 nt, Human
ccuuccucucuccagau

SEQ ID NO: 1888180 - RNA, 22 nt, Human
ccuucauuuggcauuccccacu

SEQ ID NO: 1888181 - RNA, 18 nt, Human
ccuucagcccucaccccu

SEQ ID NO: 1888182 - RNA, 17 nt, Human
ccuuccaagagccugag

SEQ ID NO: 1888183 - RNA, 16 nt, Human
ccuuccaagagccuga

SEQ ID NO: 1888184 - RNA, 15 nt, Human
ccuuccaagagccug

SEQ ID NO: 1888185 - RNA, 20 nt, Human
ccuucggccuccauccugag

SEQ ID NO: 1888186 - RNA, 19 nt, Human
ccuucggccuccauccuga

SEQ ID NO: 1888187 - RNA, 14 nt, Human
ccuucggccuccau

SEQ ID NO: 1888188 - RNA, 15 nt, Human
ccuucgacagcauuu

SEQ ID NO: 1888189 - RNA, 17 nt, Human
ccuuccuuguagccuuu

SEQ ID NO: 1888190 - RNA, 18 nt, Human
ccuuccuuguagccuuuu

SEQ ID NO: 1888191 - RNA, 10 nt, Human
ccuucagaca

SEQ ID NO: 1888192 - RNA, 11 nt, Human
ccuucagacac

SEQ ID NO: 1888193 - RNA, 21 nt, Human
ccuucaccuuuguccccaccg

SEQ ID NO: 1888194 - RNA, 14 nt, Human
ccuuagacaguccc

SEQ ID NO: 1888195 - RNA, 17 nt, Human
ccuucacagaugggugc

SEQ ID NO: 1888196 - RNA, 19 nt, Human
ccuucaccuuuguccccac

SEQ ID NO: 1888197 - RNA, 20 nt, Human
ccuucaccuuuguccccacc

SEQ ID NO: 1888198 - RNA, 11 nt, Human
ccuucagugcc

SEQ ID NO: 1888199 - RNA, 15 nt, Human
ccuucagcccucacc

SEQ ID NO: 1888200 - RNA, 14 nt, Human
ccuucagcccucac

SEQ ID NO: 1888201 - RNA, 19 nt, Human
ccuucauuuggcauucccc

SEQ ID NO: 1888202 - RNA, 14 nt, Human
ccuucagugccaaa

SEQ ID NO: 1888203 - RNA, 12 nt, Human
ccuucagccuga

SEQ ID NO: 1888204 - RNA, 13 nt, Human
ccuucagcccuca

SEQ ID NO: 1888205 - RNA, 17 nt, Human
ccuucagacacccucaa

SEQ ID NO: 1888206 - RNA, 20 nt, Human
ccuucagacacccucaaccu

SEQ ID NO: 1888207 - RNA, 23 nt, Human
ccuguugggccaggagccuccug

SEQ ID NO: 1888208 - RNA, 12 nt, Human
ccuguuuaagag

SEQ ID NO: 1888209 - RNA, 15 nt, Human
ccuguuuaagagaca

SEQ ID NO: 1888210 - RNA, 14 nt, Human
ccuguuuguuucug

SEQ ID NO: 1888211 - RNA, 18 nt, Human
ccuguuuguuucugaaag

SEQ ID NO: 1888212 - RNA, 16 nt, Human
ccuguuucugcagcca

SEQ ID NO: 1888213 - RNA, 21 nt, Human
ccugugucuugcaauggcagc

SEQ ID NO: 1888214 - RNA, 19 nt, Human
ccugugucuugcaauggca

SEQ ID NO: 1888215 - RNA, 17 nt, Human
ccugugucuugcaaugg

SEQ ID NO: 1888216 - RNA, 22 nt, Human
ccugugucuuuaaaugcugcuu

SEQ ID NO: 1888217 - RNA, 14 nt, Human
ccugugugauugac

SEQ ID NO: 1888218 - RNA, 22 nt, Human
ccugugucuugcaauggcagcc

SEQ ID NO: 1888219 - RNA, 18 nt, Human
ccugugugauugacagcu

SEQ ID NO: 1888220 - RNA, 19 nt, Human
ccugugugauugacagcuu

SEQ ID NO: 1888221 - RNA, 22 nt, Human
ccugugugauugacagcuuugc

SEQ ID NO: 1888222 - RNA, 21 nt, Human
ccugugugugcgccuacagga

SEQ ID NO: 1888223 - RNA, 20 nt, Human
ccugugugugcgccuacagg

SEQ ID NO: 1888224 - RNA, 21 nt, Human
ccuguguguccaaaacugccu

SEQ ID NO: 1888225 - RNA, 20 nt, Human
ccuguguguccaaaacugcc

SEQ ID NO: 1888226 - RNA, 17 nt, Human
ccuuaaagaguguggca

SEQ ID NO: 1888227 - RNA, 14 nt, Human
ccuguuuuuuuucu

SEQ ID NO: 1888228 - RNA, 17 nt, Human
ccuguuuuuuuucuuuu

SEQ ID NO: 1888229 - RNA, 17 nt, Human
ccuguuuuuaagcuguu

SEQ ID NO: 1888230 - RNA, 19 nt, Human
ccuguuuuuaagcuguuuc

SEQ ID NO: 1888231 - RNA, 18 nt, Human
ccuguuuuuaagcuguuu

SEQ ID NO: 1888232 - RNA, 14 nt, Human
ccuuacacaauggu

SEQ ID NO: 1888233 - RNA, 20 nt, Human
ccuuacacaaugguuuucuu

SEQ ID NO: 1888234 - RNA, 13 nt, Human
ccuuaccagcaga

SEQ ID NO: 1888235 - RNA, 15 nt, Human
ccuuacccucauguu

SEQ ID NO: 1888236 - RNA, 20 nt, Human
ccuuaccagcagagcaccuu

SEQ ID NO: 1888237 - RNA, 18 nt, Human
ccuuagaagucacacagu

SEQ ID NO: 1888238 - RNA, 14 nt, Human
ccuuagaaguggaa

SEQ ID NO: 1888239 - RNA, 17 nt, Human
ccuuagaagucacacag

SEQ ID NO: 1888240 - RNA, 19 nt, Human
ccuuacccucauguucuua

SEQ ID NO: 1888241 - RNA, 19 nt, Human
ccuuaccugccaggaagcc

SEQ ID NO: 1888242 - RNA, 12 nt, Human
ccuucagugccu

SEQ ID NO: 1888243 - RNA, 16 nt, Human
cgccagggagaccugg

SEQ ID NO: 1888244 - RNA, 21 nt, Human
cgccaggcugaccacagcaca

SEQ ID NO: 1888245 - RNA, 23 nt, Human
cgccaggcugaccacagcacagc

SEQ ID NO: 1888246 - RNA, 22 nt, Human
cgccaggggaaaaucagccugc

SEQ ID NO: 1888247 - RNA, 21 nt, Human
cgccaggauggaacacggcca

SEQ ID NO: 1888248 - RNA, 23 nt, Human
cgccaggauggaacacggccaca

SEQ ID NO: 1888249 - RNA, 16 nt, Human
cgccaggcugaccaca

SEQ ID NO: 1888250 - RNA, 17 nt, Human
cgccaggcugaccacag

SEQ ID NO: 1888251 - RNA, 20 nt, Human
cgccaggcugaccacagcac

SEQ ID NO: 1888252 - RNA, 19 nt, Human
cgccagauucuuuccugag

SEQ ID NO: 1888253 - RNA, 20 nt, Human
cgccagauucuuuccugagg

SEQ ID NO: 1888254 - RNA, 21 nt, Human
cgccagauucuuuccugaggc

SEQ ID NO: 1888255 - RNA, 14 nt, Human
cgcagccaggacac

SEQ ID NO: 1888256 - RNA, 13 nt, Human
cgcagccaggaca

SEQ ID NO: 1888257 - RNA, 12 nt, Human
cgcagccaggac

SEQ ID NO: 1888258 - RNA, 15 nt, Human
cgcagccaggacacc

SEQ ID NO: 1888259 - RNA, 14 nt, Human
cgcagcccugcaga

SEQ ID NO: 1888260 - RNA, 15 nt, Human
cgcagacaggaccag

SEQ ID NO: 1888261 - RNA, 16 nt, Human
cgcagacaggaccagg

SEQ ID NO: 1888262 - RNA, 16 nt, Human
cgagcccugguggcag

SEQ ID NO: 1888263 - RNA, 15 nt, Human
cgagcccugguggca

SEQ ID NO: 1888264 - RNA, 18 nt, Human
cgagcaugccuggauggg

SEQ ID NO: 1888265 - RNA, 18 nt, Human
cgagcccugguggcagug

SEQ ID NO: 1888266 - RNA, 20 nt, Human
cgauuucuguuuagauaaua

SEQ ID NO: 1888267 - RNA, 15 nt, Human
cgauucauauugaau

SEQ ID NO: 1888268 - RNA, 18 nt, Human
cgcaaaccacacuggacu

SEQ ID NO: 1888269 - RNA, 15 nt, Human
cgcaaaccacacugg

SEQ ID NO: 1888270 - RNA, 16 nt, Human
cgcaaaccacacugga

SEQ ID NO: 1888271 - RNA, 17 nt, Human
cgccaugcuccuggccc

SEQ ID NO: 1888272 - RNA, 13 nt, Human
cgaacuggcgccu

SEQ ID NO: 1888273 - RNA, 15 nt, Human
cgaagaagagccaca

SEQ ID NO: 1888274 - RNA, 16 nt, Human
cgaagaagagccacag

SEQ ID NO: 1888275 - RNA, 17 nt, Human
cgaagaagagccacagu

SEQ ID NO: 1888276 - RNA, 18 nt, Human
cgaagaagagccacagug

SEQ ID NO: 1888277 - RNA, 14 nt, Human
cgaauacaaaauug

SEQ ID NO: 1888278 - RNA, 14 nt, Human
cgaacuggcugcaa

SEQ ID NO: 1888279 - RNA, 12 nt, Human
cgaacuggcugc

SEQ ID NO: 1888280 - RNA, 19 nt, Human
cgaaagggacuuggaagcu

SEQ ID NO: 1888281 - RNA, 20 nt, Human
cgaaaggaugaaagugacca

SEQ ID NO: 1888282 - RNA, 22 nt, Human
cgaaagggacuuggaagcuccg

SEQ ID NO: 1888283 - RNA, 21 nt, Human
cgaaagaacaguccauugaaa

SEQ ID NO: 1888284 - RNA, 12 nt, Human
cgaaagaacagu

SEQ ID NO: 1888285 - RNA, 22 nt, Human
ccuuugacgccaucccagcccc

SEQ ID NO: 1888286 - RNA, 20 nt, Human
ccuuugacgccaucccagcc

SEQ ID NO: 1888287 - RNA, 21 nt, Human
ccuuugacgccaucccagccc

SEQ ID NO: 1888288 - RNA, 22 nt, Human
ccuuuuauguaguaauugacau

SEQ ID NO: 1888289 - RNA, 15 nt, Human
ccuuuuauugacaca

SEQ ID NO: 1888290 - RNA, 13 nt, Human
ccuuuuauuucuu

SEQ ID NO: 1888291 - RNA, 18 nt, Human
ccuuuuauuucuucacca

SEQ ID NO: 1888292 - RNA, 18 nt, Human
ccuuuuuuuccaucuuua

SEQ ID NO: 1888293 - RNA, 15 nt, Human
cgaaaacguggcugc

SEQ ID NO: 1888294 - RNA, 13 nt, Human
cgaaaaccaggcc

SEQ ID NO: 1888295 - RNA, 22 nt, Human
cgaaaaccaggccuuaucucca

SEQ ID NO: 1888296 - RNA, 18 nt, Human
cgaaaacguggcugcuuc

SEQ ID NO: 1888297 - RNA, 19 nt, Human
cgaaaacguggcugcuuca

SEQ ID NO: 1888298 - RNA, 20 nt, Human
cgaaaacguggcugcuucaa

SEQ ID NO: 1888299 - RNA, 17 nt, Human
cgaaacacagaaaccuu

SEQ ID NO: 1888300 - RNA, 18 nt, Human
cgaaaccugggauucagg

SEQ ID NO: 1888301 - RNA, 17 nt, Human
cgagaaacagccugugu

SEQ ID NO: 1888302 - RNA, 17 nt, Human
cgagaacuuucauuuuu

SEQ ID NO: 1888303 - RNA, 16 nt, Human
cgagaacuuucauuuu

SEQ ID NO: 1888304 - RNA, 20 nt, Human
cgagaaauaaaguuugcuua

SEQ ID NO: 1888305 - RNA, 14 nt, Human
cgaauagcugggac

SEQ ID NO: 1888306 - RNA, 13 nt, Human
cgaauagcuggga

SEQ ID NO: 1888307 - RNA, 17 nt, Human
cgagaucacgccacugc

SEQ ID NO: 1888308 - RNA, 18 nt, Human
cgagauagccaaggccaa

SEQ ID NO: 1888309 - RNA, 13 nt, Human
cgagaccagccug

SEQ ID NO: 1888310 - RNA, 14 nt, Human
cgagaccagccugg

SEQ ID NO: 1888311 - RNA, 15 nt, Human
cgagaccagccuggc

SEQ ID NO: 1888312 - RNA, 16 nt, Human
cgagaccagccuggcc

SEQ ID NO: 1888313 - RNA, 20 nt, Human
cgagauugcaccacugcacu

SEQ ID NO: 1888314 - RNA, 20 nt, Human
cgagaucacgccacugcacu

SEQ ID NO: 1888315 - RNA, 18 nt, Human
cgagaucacgccacugca

SEQ ID NO: 1888316 - RNA, 14 nt, Human
cgagcaugccugga

SEQ ID NO: 1888317 - RNA, 13 nt, Human
cgagcaugccugg

SEQ ID NO: 1888318 - RNA, 16 nt, Human
cgagcaugccuggaug

SEQ ID NO: 1888319 - RNA, 17 nt, Human
cgagcaugccuggaugg

SEQ ID NO: 1888320 - RNA, 20 nt, Human
cgagcaggcuucuucccccc

SEQ ID NO: 1888321 - RNA, 19 nt, Human
cccacaugugacacauaug

SEQ ID NO: 1888322 - RNA, 21 nt, Human
cccacaggagguggucuggga

SEQ ID NO: 1888323 - RNA, 16 nt, Human
cccacaggaggugguc

SEQ ID NO: 1888324 - RNA, 19 nt, Human
cccacagcgcuggccggga

SEQ ID NO: 1888325 - RNA, 13 nt, Human
cccacacacagau

SEQ ID NO: 1888326 - RNA, 15 nt, Human
cccacaaaggcaaag

SEQ ID NO: 1888327 - RNA, 13 nt, Human
cccacaaguggug

SEQ ID NO: 1888328 - RNA, 20 nt, Human
cccacaagaaaugaaagcag

SEQ ID NO: 1888329 - RNA, 14 nt, Human
cccacaaguggugg

SEQ ID NO: 1888330 - RNA, 16 nt, Human
cccacaagugguggua

SEQ ID NO: 1888331 - RNA, 20 nt, Human
cccacaaguggugguaaccc

SEQ ID NO: 1888332 - RNA, 22 nt, Human
cccacaaguggugguaacccug

SEQ ID NO: 1888333 - RNA, 23 nt, Human
cccacaaguggugguaacccugg

SEQ ID NO: 1888334 - RNA, 16 nt, Human
cccaaugcacuuuguu

SEQ ID NO: 1888335 - RNA, 20 nt, Human
cccaaugcacuuuguucugg

SEQ ID NO: 1888336 - RNA, 13 nt, Human
cccacaagaaaug

SEQ ID NO: 1888337 - RNA, 17 nt, Human
cccaccuggccucugca

SEQ ID NO: 1888338 - RNA, 19 nt, Human
cccaccuggccucugcacu

SEQ ID NO: 1888339 - RNA, 21 nt, Human
cccaccuggccucugcacucc

SEQ ID NO: 1888340 - RNA, 20 nt, Human
cccacgacugcccggcaggg

SEQ ID NO: 1888341 - RNA, 21 nt, Human
cccacgacugcccggcagggu

SEQ ID NO: 1888342 - RNA, 16 nt, Human
cccaccuggccucugc

SEQ ID NO: 1888343 - RNA, 12 nt, Human
cccacuucugcc

SEQ ID NO: 1888344 - RNA, 23 nt, Human
cccacuugagaauuacccuuuug

SEQ ID NO: 1888345 - RNA, 21 nt, Human
cccacgcuggagugcagugag

SEQ ID NO: 1888346 - RNA, 20 nt, Human
cccacgcuggagugcaguga

SEQ ID NO: 1888347 - RNA, 19 nt, Human
cccacgcuggagugcagug

SEQ ID NO: 1888348 - RNA, 18 nt, Human
cccaccaucaugucuggc

SEQ ID NO: 1888349 - RNA, 19 nt, Human
cccaccgcagacaggacca

SEQ ID NO: 1888350 - RNA, 20 nt, Human
cccaccgcagacaggaccag

SEQ ID NO: 1888351 - RNA, 17 nt, Human
cccaccacacccucccu

SEQ ID NO: 1888352 - RNA, 17 nt, Human
cccaccucagccucccg

SEQ ID NO: 1888353 - RNA, 12 nt, Human
cccaccucccug

SEQ ID NO: 1888354 - RNA, 22 nt, Human
cccaccucucucacuccuugaa

SEQ ID NO: 1888355 - RNA, 15 nt, Human
cccaccucccugccu

SEQ ID NO: 1888356 - RNA, 16 nt, Human
cccaccucccugccuc

SEQ ID NO: 1888357 - RNA, 14 nt, Human
cccaccucccugcc

SEQ ID NO: 1888358 - RNA, 17 nt, Human
cccaccucccugccucc

SEQ ID NO: 1888359 - RNA, 23 nt, Human
cccgagucauucguucuguggag

SEQ ID NO: 1888360 - RNA, 13 nt, Human
cccgggcagggcu

SEQ ID NO: 1888361 - RNA, 12 nt, Human
cccgggcagggc

SEQ ID NO: 1888362 - RNA, 22 nt, Human
cccgggcagggcucccacagag

SEQ ID NO: 1888363 - RNA, 21 nt, Human
cccgggcagggcucccacaga

SEQ ID NO: 1888364 - RNA, 12 nt, Human
cccgggcccaga

SEQ ID NO: 1888365 - RNA, 14 nt, Human
cccgggcccagagg

SEQ ID NO: 1888366 - RNA, 13 nt, Human
cccgggcccagag

SEQ ID NO: 1888367 - RNA, 16 nt, Human
cccgggcccagaggag

SEQ ID NO: 1888368 - RNA, 12 nt, Human
cccgggcucugc

SEQ ID NO: 1888369 - RNA, 14 nt, Human
cccgggcucugccu

SEQ ID NO: 1888370 - RNA, 15 nt, Human
cccgggcucugccuc

SEQ ID NO: 1888371 - RNA, 22 nt, Human
cccgaguagcugggacuacagg

SEQ ID NO: 1888372 - RNA, 21 nt, Human
cccgagucauucguucugugg

SEQ ID NO: 1888373 - RNA, 16 nt, Human
cccgcccccugcccuc

SEQ ID NO: 1888374 - RNA, 17 nt, Human
cccgcccccugcccucc

SEQ ID NO: 1888375 - RNA, 18 nt, Human
cccgccgccugguacuca

SEQ ID NO: 1888376 - RNA, 19 nt, Human
cccgcugucagccauuccu

SEQ ID NO: 1888377 - RNA, 20 nt, Human
cccgcugucagccauuccug

SEQ ID NO: 1888378 - RNA, 21 nt, Human
cccgaguagcugggacuacag

SEQ ID NO: 1888379 - RNA, 18 nt, Human
cccgaguagcugggacua

SEQ ID NO: 1888380 - RNA, 17 nt, Human
cccgaguagcugggacu

SEQ ID NO: 1888381 - RNA, 16 nt, Human
cccgaguagcugggac

SEQ ID NO: 1888382 - RNA, 15 nt, Human
cccgaguagcuggga

SEQ ID NO: 1888383 - RNA, 14 nt, Human
cccgaguagcuggg

SEQ ID NO: 1888384 - RNA, 13 nt, Human
cccgaguagcugg

SEQ ID NO: 1888385 - RNA, 21 nt, Human
cccgaggccuucucugaagga

SEQ ID NO: 1888386 - RNA, 15 nt, Human
cccagagggccugca

SEQ ID NO: 1888387 - RNA, 14 nt, Human
cccagagggccugc

SEQ ID NO: 1888388 - RNA, 18 nt, Human
cccggggcagggcagccg

SEQ ID NO: 1888389 - RNA, 21 nt, Human
cccggggugcccacaggccgc

SEQ ID NO: 1888390 - RNA, 16 nt, Human
cccgggcucugccucc

SEQ ID NO: 1888391 - RNA, 22 nt, Human
cccggggaaaggcaagguccgg

SEQ ID NO: 1888392 - RNA, 17 nt, Human
cccgucgacguagaacc

SEQ ID NO: 1888393 - RNA, 15 nt, Human
cccgugggguuccuc

SEQ ID NO: 1888394 - RNA, 23 nt, Human
cccuacuauucaguggcgagaaa

SEQ ID NO: 1888395 - RNA, 20 nt, Human
cccuacaguugaaaaacagc

SEQ ID NO: 1888396 - RNA, 16 nt, Human
cccugcacaagccagg

SEQ ID NO: 1888397 - RNA, 12 nt, Human
cccugcacuugc

SEQ ID NO: 1888398 - RNA, 19 nt, Human
cccugcacuugcagacucu

SEQ ID NO: 1888399 - RNA, 22 nt, Human
cccugcacuugcagacucuaca

SEQ ID NO: 1888400 - RNA, 16 nt, Human
cccucuggggcuguuc

SEQ ID NO: 1888401 - RNA, 18 nt, Human
cccucugguuugccggug

SEQ ID NO: 1888402 - RNA, 15 nt, Human
cccugaaagcccuga

SEQ ID NO: 1888403 - RNA, 13 nt, Human
cccugaggcccag

SEQ ID NO: 1888404 - RNA, 16 nt, Human
cccugaaagcccugag

SEQ ID NO: 1888405 - RNA, 14 nt, Human
cccugaggcccaga

SEQ ID NO: 1888406 - RNA, 15 nt, Human
cccugaggcccagag

SEQ ID NO: 1888407 - RNA, 16 nt, Human
cccugaggcccagagg

SEQ ID NO: 1888408 - RNA, 17 nt, Human
cccugaggcccagaggg

SEQ ID NO: 1888409 - RNA, 18 nt, Human
cccugaggcccagagggc

SEQ ID NO: 1888410 - RNA, 19 nt, Human
cccugaggcccagagggcc

SEQ ID NO: 1888411 - RNA, 20 nt, Human
cccugaggcccagagggccu

SEQ ID NO: 1888412 - RNA, 23 nt, Human
cccugaggcccagagggccugca

SEQ ID NO: 1888413 - RNA, 18 nt, Human
cccucuggaguggccacu

SEQ ID NO: 1888414 - RNA, 21 nt, Human
cccucuggaguggccacuaag

SEQ ID NO: 1888415 - RNA, 22 nt, Human
cccucuggaguggccacuaagc

SEQ ID NO: 1888416 - RNA, 12 nt, Human
cccucuggggcu

SEQ ID NO: 1888417 - RNA, 20 nt, Human
cccucccccccaugcacugu

SEQ ID NO: 1888418 - RNA, 15 nt, Human
cccucccccccaugc

SEQ ID NO: 1888419 - RNA, 18 nt, Human
cccucccccccaugcacu

SEQ ID NO: 1888420 - RNA, 14 nt, Human
cccuccccauggag

SEQ ID NO: 1888421 - RNA, 23 nt, Human
cccuccacucuccucuuccaggc

SEQ ID NO: 1888422 - RNA, 13 nt, Human
cccuccaccugcu

SEQ ID NO: 1888423 - RNA, 15 nt, Human
cccuaguaaaaauac

SEQ ID NO: 1888424 - RNA, 22 nt, Human
cccugcuggguguggcgcagca

SEQ ID NO: 1888425 - RNA, 18 nt, Human
cccugcccaccuggccuc

SEQ ID NO: 1888426 - RNA, 16 nt, Human
cccugcuggguguggc

SEQ ID NO: 1888427 - RNA, 21 nt, Human
cccugcuggguguggcgcagc

SEQ ID NO: 1888428 - RNA, 13 nt, Human
cccugcccaccug

SEQ ID NO: 1888429 - RNA, 21 nt, Human
cccugccagacccccuggaga

SEQ ID NO: 1888430 - RNA, 13 nt, Human
cccugccagaccc

SEQ ID NO: 1888431 - RNA, 14 nt, Human
cccugcccaccugg

SEQ ID NO: 1888432 - RNA, 17 nt, Human
cccugcccaccuggccu

SEQ ID NO: 1888433 - RNA, 15 nt, Human
cccuggacugugugc

SEQ ID NO: 1888434 - RNA, 24 nt, Human
cccugggaggcgggcgcacugccu

SEQ ID NO: 1888435 - RNA, 15 nt, Human
cccugguggcagcuc

SEQ ID NO: 1888436 - RNA, 16 nt, Human
cccugguggcagcuca

SEQ ID NO: 1888437 - RNA, 17 nt, Human
cccugguggcagcucac

SEQ ID NO: 1888438 - RNA, 21 nt, Human
ccuaugcacauauggacucug

SEQ ID NO: 1888439 - RNA, 20 nt, Human
ccuaugcacauauggacucu

SEQ ID NO: 1888440 - RNA, 14 nt, Human
ccuaugcacauaug

SEQ ID NO: 1888441 - RNA, 19 nt, Human
ccucagucuggcccuuccu

SEQ ID NO: 1888442 - RNA, 11 nt, Human
ccucagugcca

SEQ ID NO: 1888443 - RNA, 20 nt, Human
ccucagucuggcccuuccuu

SEQ ID NO: 1888444 - RNA, 22 nt, Human
ccucauaguaugguggcugggu

SEQ ID NO: 1888445 - RNA, 21 nt, Human
ccucauaguaugguggcuggg

SEQ ID NO: 1888446 - RNA, 13 nt, Human
ccucaucaccaac

SEQ ID NO: 1888447 - RNA, 14 nt, Human
ccucaucaccaacg

SEQ ID NO: 1888448 - RNA, 20 nt, Human
ccucauaguaugguggcugg

SEQ ID NO: 1888449 - RNA, 13 nt, Human
ccucauacccacc

SEQ ID NO: 1888450 - RNA, 21 nt, Human
ccucaucuccccaucauuggu

SEQ ID NO: 1888451 - RNA, 17 nt, Human
ccucaucucucugccca

SEQ ID NO: 1888452 - RNA, 19 nt, Human
ccucaucucucugcccaac

SEQ ID NO: 1888453 - RNA, 13 nt, Human
ccucauccucaua

SEQ ID NO: 1888454 - RNA, 20 nt, Human
ccucauccucauacccaccc

SEQ ID NO: 1888455 - RNA, 20 nt, Human
ccucaucucucugcccaacc

SEQ ID NO: 1888456 - RNA, 16 nt, Human
ccucccaaagugcugg

SEQ ID NO: 1888457 - RNA, 16 nt, Human
ccuccccauggagcca

SEQ ID NO: 1888458 - RNA, 15 nt, Human
ccucccaaagugcug

SEQ ID NO: 1888459 - RNA, 23 nt, Human
ccuccaugugggcuaguugggcu

SEQ ID NO: 1888460 - RNA, 14 nt, Human
ccuccauccugagg

SEQ ID NO: 1888461 - RNA, 22 nt, Human
ccuccaggugcacaagcuccaa

SEQ ID NO: 1888462 - RNA, 22 nt, Human
ccuccagggcuggacugaggcc

SEQ ID NO: 1888463 - RNA, 19 nt, Human
ccuccaggugcacaagcuc

SEQ ID NO: 1888464 - RNA, 21 nt, Human
ccuccaggugcacaagcucca

SEQ ID NO: 1888465 - RNA, 21 nt, Human
ccuccagggcuggacugaggc

SEQ ID NO: 1888466 - RNA, 20 nt, Human
ccuccagggcuggacugagg

SEQ ID NO: 1888467 - RNA, 18 nt, Human
ccuccagggcuggacuga

SEQ ID NO: 1888468 - RNA, 17 nt, Human
ccuccagggcuggacug

SEQ ID NO: 1888469 - RNA, 16 nt, Human
ccuccagggcuggacu

SEQ ID NO: 1888470 - RNA, 13 nt, Human
ccuccagggcugg

SEQ ID NO: 1888471 - RNA, 12 nt, Human
ccuccagggcug

SEQ ID NO: 1888472 - RNA, 13 nt, Human
ccuccagcaggga

SEQ ID NO: 1888473 - RNA, 21 nt, Human
ccucccgaguagcugggacua

SEQ ID NO: 1888474 - RNA, 20 nt, Human
ccucccgaguagcugggacu

SEQ ID NO: 1888475 - RNA, 19 nt, Human
ccucccgaguagcugggac

SEQ ID NO: 1888476 - RNA, 12 nt, Human
ccucccugccuc

SEQ ID NO: 1888477 - RNA, 15 nt, Human
ccucccugccucagg

SEQ ID NO: 1888478 - RNA, 14 nt, Human
ccucccugccucca

SEQ ID NO: 1888479 - RNA, 15 nt, Human
ccucccugccuccag

SEQ ID NO: 1888480 - RNA, 14 nt, Human
ccuccucagaucuu

SEQ ID NO: 1888481 - RNA, 10 nt, Human
ccucccuccc

SEQ ID NO: 1888482 - RNA, 13 nt, Human
ccuccugcugggc

SEQ ID NO: 1888483 - RNA, 14 nt, Human
ccuccugggcuaag

SEQ ID NO: 1888484 - RNA, 23 nt, Human
ccuccugccucgaacuggcugca

SEQ ID NO: 1888485 - RNA, 18 nt, Human
ccucgguguggagaagcg

SEQ ID NO: 1888486 - RNA, 15 nt, Human
ccucguucucccugg

SEQ ID NO: 1888487 - RNA, 16 nt, Human
ccucguucucccuggg

SEQ ID NO: 1888488 - RNA, 17 nt, Human
ccucguucucccuggga

SEQ ID NO: 1888489 - RNA, 18 nt, Human
ccucguucucccugggag

SEQ ID NO: 1888490 - RNA, 20 nt, Human
ccucguucucccugggaggc

SEQ ID NO: 1888491 - RNA, 16 nt, Human
ccucggugccuuccuc

SEQ ID NO: 1888492 - RNA, 14 nt, Human
ccucgguguggaga

SEQ ID NO: 1888493 - RNA, 15 nt, Human
ccuccuucagacacc

SEQ ID NO: 1888494 - RNA, 22 nt, Human
ccuccuucagacacccucaacc

SEQ ID NO: 1888495 - RNA, 14 nt, Human
ccuccuucagacac

SEQ ID NO: 1888496 - RNA, 16 nt, Human
ccucuaggaggucucu

SEQ ID NO: 1888497 - RNA, 17 nt, Human
ccucuauuuauguuugc

SEQ ID NO: 1888498 - RNA, 21 nt, Human
ccucuauuuauguuugcacuu

SEQ ID NO: 1888499 - RNA, 18 nt, Human
ccucucauuccagaggaa

SEQ ID NO: 1888500 - RNA, 17 nt, Human
ccucccgaauagcuggg

SEQ ID NO: 1888501 - RNA, 19 nt, Human
ccgcaccuaaagcagccag

SEQ ID NO: 1888502 - RNA, 17 nt, Human
ccgcaccuaaagcagcc

SEQ ID NO: 1888503 - RNA, 19 nt, Human
ccgcacugggcuuggggac

SEQ ID NO: 1888504 - RNA, 14 nt, Human
ccgcacugggcuug

SEQ ID NO: 1888505 - RNA, 22 nt, Human
ccgcgccaaauaaugucucugu

SEQ ID NO: 1888506 - RNA, 22 nt, Human
ccgccugguacucaagcccgcg

SEQ ID NO: 1888507 - RNA, 21 nt, Human
ccgcuaagagggagggagggc

SEQ ID NO: 1888508 - RNA, 17 nt, Human
ccgcgucgcccucccag

SEQ ID NO: 1888509 - RNA, 20 nt, Human
ccgcggggacauugggaagg

SEQ ID NO: 1888510 - RNA, 19 nt, Human
ccgcgucgcccucccaggc

SEQ ID NO: 1888511 - RNA, 22 nt, Human
ccgcgugaucaaagccacacuc

SEQ ID NO: 1888512 - RNA, 23 nt, Human
ccgcuaagagggagggagggcuc

SEQ ID NO: 1888513 - RNA, 17 nt, Human
ccgaguagcugggacua

SEQ ID NO: 1888514 - RNA, 20 nt, Human
ccgaguagcugggacuacag

SEQ ID NO: 1888515 - RNA, 19 nt, Human
ccgagucauucguucugug

SEQ ID NO: 1888516 - RNA, 20 nt, Human
ccgagucauucguucugugg

SEQ ID NO: 1888517 - RNA, 12 nt, Human
ccgaguccaagc

SEQ ID NO: 1888518 - RNA, 15 nt, Human
ccgcaaaccacacug

SEQ ID NO: 1888519 - RNA, 16 nt, Human
ccgcaaaccacacugg

SEQ ID NO: 1888520 - RNA, 21 nt, Human
ccgcaaaccacacuggacucc

SEQ ID NO: 1888521 - RNA, 13 nt, Human
ccgaguccaagcu

SEQ ID NO: 1888522 - RNA, 14 nt, Human
ccgaggccuucucu

SEQ ID NO: 1888523 - RNA, 20 nt, Human
cccugguggcagcucaccuc

SEQ ID NO: 1888524 - RNA, 16 nt, Human
cccugguucucaucuu

SEQ ID NO: 1888525 - RNA, 15 nt, Human
cccugguucucaucu

SEQ ID NO: 1888526 - RNA, 17 nt, Human
cccugguucucaucuuu

SEQ ID NO: 1888527 - RNA, 18 nt, Human
ccgggaccccgagccugg

SEQ ID NO: 1888528 - RNA, 20 nt, Human
ccgggcgcgguggcucacgc

SEQ ID NO: 1888529 - RNA, 16 nt, Human
ccgggcguggugguga

SEQ ID NO: 1888530 - RNA, 22 nt, Human
ccgggcucugccucccaucacc

SEQ ID NO: 1888531 - RNA, 15 nt, Human
ccggguuccagcacc

SEQ ID NO: 1888532 - RNA, 12 nt, Human
ccggguuccagc

SEQ ID NO: 1888533 - RNA, 15 nt, Human
ccggggaaaggcaag

SEQ ID NO: 1888534 - RNA, 16 nt, Human
ccgugcucgccccagc

SEQ ID NO: 1888535 - RNA, 17 nt, Human
ccgugcucgccccagca

SEQ ID NO: 1888536 - RNA, 14 nt, Human
ccgugcugacagcu

SEQ ID NO: 1888537 - RNA, 16 nt, Human
ccgugcugacagcugc

SEQ ID NO: 1888538 - RNA, 17 nt, Human
ccgugcugacagcugcu

SEQ ID NO: 1888539 - RNA, 18 nt, Human
ccgugcugacagcugcuc

SEQ ID NO: 1888540 - RNA, 19 nt, Human
ccgugcugacagcugcucc

SEQ ID NO: 1888541 - RNA, 21 nt, Human
ccgugcugacagcugcuccua

SEQ ID NO: 1888542 - RNA, 20 nt, Human
ccgugcugacagcugcuccu

SEQ ID NO: 1888543 - RNA, 12 nt, Human
ccgcuuucuacc

SEQ ID NO: 1888544 - RNA, 23 nt, Human
ccgcugccacccaccucccugcc

SEQ ID NO: 1888545 - RNA, 24 nt, Human
ccgcugccacccaccucccugccu

SEQ ID NO: 1888546 - RNA, 15 nt, Human
ccgcugccacccacc

SEQ ID NO: 1888547 - RNA, 16 nt, Human
ccgcugccacccaccu

SEQ ID NO: 1888548 - RNA, 17 nt, Human
ccgcugccacccaccuc

SEQ ID NO: 1888549 - RNA, 20 nt, Human
ccgcugccacccaccucccu

SEQ ID NO: 1888550 - RNA, 11 nt, Human
ccgcugccacc

SEQ ID NO: 1888551 - RNA, 12 nt, Human
ccgcugccaccc

SEQ ID NO: 1888552 - RNA, 14 nt, Human
ccgcugccacccac

SEQ ID NO: 1888553 - RNA, 15 nt, Human
ccggcuggccuggcc

SEQ ID NO: 1888554 - RNA, 19 nt, Human
ccgcuuucuacccagcgag

SEQ ID NO: 1888555 - RNA, 17 nt, Human
ccggcuggccuggcccc

SEQ ID NO: 1888556 - RNA, 18 nt, Human
ccggcuggccuggccccu

SEQ ID NO: 1888557 - RNA, 20 nt, Human
ccgggaagggggcugggaca

SEQ ID NO: 1888558 - RNA, 17 nt, Human
ccgggaccccgagccug

SEQ ID NO: 1888559 - RNA, 18 nt, Human
ccuauauuguuuucagug

SEQ ID NO: 1888560 - RNA, 22 nt, Human
ccuauauuguuuucaguguaca

SEQ ID NO: 1888561 - RNA, 16 nt, Human
ccuauaacugcccagc

SEQ ID NO: 1888562 - RNA, 13 nt, Human
ccuaguuccacca

SEQ ID NO: 1888563 - RNA, 21 nt, Human
ccuaguuccaccaucaagcca

SEQ ID NO: 1888564 - RNA, 23 nt, Human
ccuaguuccaccaucaagccacc

SEQ ID NO: 1888565 - RNA, 15 nt, Human
ccuaaaauucagugg

SEQ ID NO: 1888566 - RNA, 16 nt, Human
ccuaaauauauuuuaa

SEQ ID NO: 1888567 - RNA, 18 nt, Human
ccuaaauauauuuuaaga

SEQ ID NO: 1888568 - RNA, 17 nt, Human
ccuaaaagcacacucau

SEQ ID NO: 1888569 - RNA, 18 nt, Human
ccuaaaagcacacucauc

SEQ ID NO: 1888570 - RNA, 22 nt, Human
ccuaaaagugggcuugauucug

SEQ ID NO: 1888571 - RNA, 20 nt, Human
cuguaguugcguggacucug

SEQ ID NO: 1888572 - RNA, 20 nt, Human
cuguacgucugacaggcaau

SEQ ID NO: 1888573 - RNA, 19 nt, Human
cuguacgucugacaggcaa

SEQ ID NO: 1888574 - RNA, 14 nt, Human
cuguacaucuauuu

SEQ ID NO: 1888575 - RNA, 18 nt, Human
cuguacgucugacaggca

SEQ ID NO: 1888576 - RNA, 16 nt, Human
cuguacgucugacagg

SEQ ID NO: 1888577 - RNA, 15 nt, Human
cuguacgucugacag

SEQ ID NO: 1888578 - RNA, 14 nt, Human
cuguacgucugaca

SEQ ID NO: 1888579 - RNA, 21 nt, Human
cuguacaugaaaacacauuuu

SEQ ID NO: 1888580 - RNA, 20 nt, Human
cuguacaugaaaacacauuu

SEQ ID NO: 1888581 - RNA, 17 nt, Human
cuguacaugaaaacaca

SEQ ID NO: 1888582 - RNA, 16 nt, Human
cuguaauuguguguga

SEQ ID NO: 1888583 - RNA, 20 nt, Human
cuguauuuuguuuuugucuu

SEQ ID NO: 1888584 - RNA, 20 nt, Human
cuguauuuugaaaaugcuuu

SEQ ID NO: 1888585 - RNA, 15 nt, Human
cugucaauuacagga

SEQ ID NO: 1888586 - RNA, 16 nt, Human
cugucaauuacaggaa

SEQ ID NO: 1888587 - RNA, 13 nt, Human
cugucaauuacag

SEQ ID NO: 1888588 - RNA, 20 nt, Human
cuguaucccaugagccucag

SEQ ID NO: 1888589 - RNA, 22 nt, Human
cuguaucccaugagccucagca

SEQ ID NO: 1888590 - RNA, 21 nt, Human
cuguaucccaugagccucagc

SEQ ID NO: 1888591 - RNA, 16 nt, Human
cugguuaggauggcag

SEQ ID NO: 1888592 - RNA, 18 nt, Human
cugguuaggauggcagga

SEQ ID NO: 1888593 - RNA, 19 nt, Human
cugguuaggauggcaggac

SEQ ID NO: 1888594 - RNA, 18 nt, Human
cuguaaucccagcaauuu

SEQ ID NO: 1888595 - RNA, 17 nt, Human
cuguaaucccagcacuu

SEQ ID NO: 1888596 - RNA, 19 nt, Human
cuguaauccuagcacuuug

SEQ ID NO: 1888597 - RNA, 20 nt, Human
cuguaaucccagcacuuugg

SEQ ID NO: 1888598 - RNA, 22 nt, Human
cugguuagagguucccuuugac

SEQ ID NO: 1888599 - RNA, 21 nt, Human
cugguuagagguucccuuuga

SEQ ID NO: 1888600 - RNA, 15 nt, Human
cuguaauuugugaua

SEQ ID NO: 1888601 - RNA, 14 nt, Human
cuguaauuugugau

SEQ ID NO: 1888602 - RNA, 14 nt, Human
cuguacagagccca

SEQ ID NO: 1888603 - RNA, 15 nt, Human
cuguacagagcccac

SEQ ID NO: 1888604 - RNA, 18 nt, Human
cuguacagagcccacgcc

SEQ ID NO: 1888605 - RNA, 22 nt, Human
cuguacagagcccacgccccca

SEQ ID NO: 1888606 - RNA, 18 nt, Human
cugguggcagugggagcu

SEQ ID NO: 1888607 - RNA, 14 nt, Human
cugguggcaguggg

SEQ ID NO: 1888608 - RNA, 15 nt, Human
cugguggcagcugcg

SEQ ID NO: 1888609 - RNA, 20 nt, Human
cugguggcagcucaccucuc

SEQ ID NO: 1888610 - RNA, 17 nt, Human
cugguggcagcucaccu

SEQ ID NO: 1888611 - RNA, 18 nt, Human
cugguggcagcucaccuc

SEQ ID NO: 1888612 - RNA, 23 nt, Human
cuggugguucacucuuggagccu

SEQ ID NO: 1888613 - RNA, 21 nt, Human
cuggugguucacucuuggagc

SEQ ID NO: 1888614 - RNA, 20 nt, Human
cuggugguucacucuuggag

SEQ ID NO: 1888615 - RNA, 12 nt, Human
cuggugguucac

SEQ ID NO: 1888616 - RNA, 15 nt, Human
cuggugguugcuguu

SEQ ID NO: 1888617 - RNA, 20 nt, Human
cuggugguugcuguuuuccu

SEQ ID NO: 1888618 - RNA, 18 nt, Human
cugggccuggcagcucag

SEQ ID NO: 1888619 - RNA, 20 nt, Human
cugggccuggcagcucagcu

SEQ ID NO: 1888620 - RNA, 13 nt, Human
cugggccugcaga

SEQ ID NO: 1888621 - RNA, 14 nt, Human
cugggcuccuccag

SEQ ID NO: 1888622 - RNA, 15 nt, Human
cugggcuccuccagg

SEQ ID NO: 1888623 - RNA, 17 nt, Human
cugggcuccuccagggu

SEQ ID NO: 1888624 - RNA, 21 nt, Human
cugggauuacaagcgugagcc

SEQ ID NO: 1888625 - RNA, 19 nt, Human
cugggauguuucugucaca

SEQ ID NO: 1888626 - RNA, 14 nt, Human
cugggauguuucug

SEQ ID NO: 1888627 - RNA, 23 nt, Human
cugcucauucuaaugauggccca

SEQ ID NO: 1888628 - RNA, 19 nt, Human
cugggccccugccucucug

SEQ ID NO: 1888629 - RNA, 20 nt, Human
cugggccccugccucucugc

SEQ ID NO: 1888630 - RNA, 23 nt, Human
cugggccccugccucucugcagg

SEQ ID NO: 1888631 - RNA, 13 nt, Human
cugggucgcccug

SEQ ID NO: 1888632 - RNA, 17 nt, Human
cugggggugggccaggc

SEQ ID NO: 1888633 - RNA, 13 nt, Human
cuggggugggguc

SEQ ID NO: 1888634 - RNA, 14 nt, Human
cuggggugggguca

SEQ ID NO: 1888635 - RNA, 20 nt, Human
cugggguggggucaugcccu

SEQ ID NO: 1888636 - RNA, 15 nt, Human
cugggucgcccugga

SEQ ID NO: 1888637 - RNA, 16 nt, Human
cugggucgcccuggac

SEQ ID NO: 1888638 - RNA, 15 nt, Human
cugguaaucuugcuc

SEQ ID NO: 1888639 - RNA, 15 nt, Human
cugggcuucaguggc

SEQ ID NO: 1888640 - RNA, 22 nt, Human
cugggcuuggggaccagagcug

SEQ ID NO: 1888641 - RNA, 18 nt, Human
cugggcuugucuguagau

SEQ ID NO: 1888642 - RNA, 18 nt, Human
cugggggcugggcagagg

SEQ ID NO: 1888643 - RNA, 14 nt, Human
cugggggcugggca

SEQ ID NO: 1888644 - RNA, 14 nt, Human
cugggggugggcca

SEQ ID NO: 1888645 - RNA, 15 nt, Human
cugggggugggccag

SEQ ID NO: 1888646 - RNA, 16 nt, Human
cugggggugggccagg

SEQ ID NO: 1888647 - RNA, 16 nt, Human
cugggggccucuucug

SEQ ID NO: 1888648 - RNA, 19 nt, Human
cugggcuuggggcuuccua

SEQ ID NO: 1888649 - RNA, 20 nt, Human
cugggcuuggggcuuccuaa

SEQ ID NO: 1888650 - RNA, 22 nt, Human
cuguggcuucuuaaucuuuuca

SEQ ID NO: 1888651 - RNA, 11 nt, Human
cugugggaaau

SEQ ID NO: 1888652 - RNA, 13 nt, Human
cugugggaaauua

SEQ ID NO: 1888653 - RNA, 21 nt, Human
cuguggguuucuaaagcugcc

SEQ ID NO: 1888654 - RNA, 23 nt, Human
cuguggggugugcacaucucugc

SEQ ID NO: 1888655 - RNA, 22 nt, Human
cuguggguuucuaaagcugcca

SEQ ID NO: 1888656 - RNA, 14 nt, Human
cuguggaucaaauc

SEQ ID NO: 1888657 - RNA, 24 nt, Human
cuguggaucaaauccagccugcug

SEQ ID NO: 1888658 - RNA, 18 nt, Human
cugugugugcgccuacag

SEQ ID NO: 1888659 - RNA, 14 nt, Human
cuguguguguguau

SEQ ID NO: 1888660 - RNA, 16 nt, Human
cuguguguguguaugu

SEQ ID NO: 1888661 - RNA, 15 nt, Human
cuguguguguguaug

SEQ ID NO: 1888662 - RNA, 20 nt, Human
cuguguguuuaugugugugu

SEQ ID NO: 1888663 - RNA, 18 nt, Human
cuguguguuuaugugugu

SEQ ID NO: 1888664 - RNA, 20 nt, Human
cuguguguguguaugugggg

SEQ ID NO: 1888665 - RNA, 18 nt, Human
cuguguguguguaugugg

SEQ ID NO: 1888666 - RNA, 21 nt, Human
cuguguguguguauguggggg

SEQ ID NO: 1888667 - RNA, 19 nt, Human
cugugucuuuaaaugcugc

SEQ ID NO: 1888668 - RNA, 20 nt, Human
cugugucuuuaaaugcugcu

SEQ ID NO: 1888669 - RNA, 21 nt, Human
cugugucuuuaaaugcugcuu

SEQ ID NO: 1888670 - RNA, 20 nt, Human
cugugucuuuuuucacuaca

SEQ ID NO: 1888671 - RNA, 20 nt, Human
cugugucuuugguuugugcu

SEQ ID NO: 1888672 - RNA, 14 nt, Human
cugugugcucagga

SEQ ID NO: 1888673 - RNA, 21 nt, Human
cugugugauugacagcuuugc

SEQ ID NO: 1888674 - RNA, 23 nt, Human
cugugugauugacagcuuugcug

SEQ ID NO: 1888675 - RNA, 22 nt, Human
cugugugauugacagcuuugcu

SEQ ID NO: 1888676 - RNA, 22 nt, Human
cuguguguccaaaacugccuca

SEQ ID NO: 1888677 - RNA, 21 nt, Human
cuguguguccaaaacugccuc

SEQ ID NO: 1888678 - RNA, 19 nt, Human
cuguguguccaaaacugcc

SEQ ID NO: 1888679 - RNA, 15 nt, Human
cuguguguccaaaac

SEQ ID NO: 1888680 - RNA, 14 nt, Human
cugugaugcccugc

SEQ ID NO: 1888681 - RNA, 15 nt, Human
cugugauggggcccu

SEQ ID NO: 1888682 - RNA, 23 nt, Human
cugugauggggcccugccuccuu

SEQ ID NO: 1888683 - RNA, 16 nt, Human
cugugauugugccuac

SEQ ID NO: 1888684 - RNA, 16 nt, Human
cugugauggggcccug

SEQ ID NO: 1888685 - RNA, 21 nt, Human
cugugauggggcccugccucc

SEQ ID NO: 1888686 - RNA, 20 nt, Human
cugugagcucccaggugcag

SEQ ID NO: 1888687 - RNA, 16 nt, Human
cugugaacgauuuaga

SEQ ID NO: 1888688 - RNA, 17 nt, Human
cugugagcccagcuggg

SEQ ID NO: 1888689 - RNA, 15 nt, Human
cugugagcccagcug

SEQ ID NO: 1888690 - RNA, 22 nt, Human
cugugaaauucccaacaaacau

SEQ ID NO: 1888691 - RNA, 16 nt, Human
cugugaaaggaaagag

SEQ ID NO: 1888692 - RNA, 22 nt, Human
cugugaaaggaaagagggaggu

SEQ ID NO: 1888693 - RNA, 14 nt, Human
cugugaaauuccca

SEQ ID NO: 1888694 - RNA, 15 nt, Human
cugugccaugugcca

SEQ ID NO: 1888695 - RNA, 22 nt, Human
cugugccauuuuguauuuuacu

SEQ ID NO: 1888696 - RNA, 23 nt, Human
cugugcccacccuccacucuccu

SEQ ID NO: 1888697 - RNA, 17 nt, Human
cugugcccacccuccac

SEQ ID NO: 1888698 - RNA, 19 nt, Human
cugugcccuaaaguguauu

SEQ ID NO: 1888699 - RNA, 14 nt, Human
cugugccaugugcc

SEQ ID NO: 1888700 - RNA, 15 nt, Human
cugugcacgguggac

SEQ ID NO: 1888701 - RNA, 14 nt, Human
cugugcacugccca

SEQ ID NO: 1888702 - RNA, 22 nt, Human
cugugauugggcguagaagugg

SEQ ID NO: 1888703 - RNA, 21 nt, Human
cugugcaaccucuuggccuga

SEQ ID NO: 1888704 - RNA, 23 nt, Human
cugucuucucccugcacaagcca

SEQ ID NO: 1888705 - RNA, 19 nt, Human
cugucuucauagcagauuu

SEQ ID NO: 1888706 - RNA, 22 nt, Human
cugucuucauagcagauuuuaa

SEQ ID NO: 1888707 - RNA, 18 nt, Human
cugucuucaguaagccgu

SEQ ID NO: 1888708 - RNA, 21 nt, Human
cugucuuuuuucuaaaguaaa

SEQ ID NO: 1888709 - RNA, 15 nt, Human
cugugaaaggaaaga

SEQ ID NO: 1888710 - RNA, 20 nt, Human
cugucuuuccuagauggcag

SEQ ID NO: 1888711 - RNA, 11 nt, Human
cugucuuuccu

SEQ ID NO: 1888712 - RNA, 13 nt, Human
cugucuuuccuag

SEQ ID NO: 1888713 - RNA, 14 nt, Human
cugucuuuccuaga

SEQ ID NO: 1888714 - RNA, 22 nt, Human
cugucauuugagcagggcucag

SEQ ID NO: 1888715 - RNA, 21 nt, Human
cugucauuugagcagggcuca

SEQ ID NO: 1888716 - RNA, 18 nt, Human
cugucaauuacaggaagu

SEQ ID NO: 1888717 - RNA, 23 nt, Human
cugucauuugagcagggcucagc

SEQ ID NO: 1888718 - RNA, 14 nt, Human
cugucugccagggc

SEQ ID NO: 1888719 - RNA, 14 nt, Human
cugucuguguuuuu

SEQ ID NO: 1888720 - RNA, 18 nt, Human
cuuccuauaugcacuuau

SEQ ID NO: 1888721 - RNA, 18 nt, Human
cuuccuguccagcuccaa

SEQ ID NO: 1888722 - RNA, 18 nt, Human
cuuccccaacacgcagga

SEQ ID NO: 1888723 - RNA, 22 nt, Human
cuuccccaccccaguuuuuguu

SEQ ID NO: 1888724 - RNA, 14 nt, Human
cuucccauucucca

SEQ ID NO: 1888725 - RNA, 13 nt, Human
cuucccauucucc

SEQ ID NO: 1888726 - RNA, 16 nt, Human
cuuccacaagagccca

SEQ ID NO: 1888727 - RNA, 20 nt, Human
cuuccacuuuuuuuuguaug

SEQ ID NO: 1888728 - RNA, 21 nt, Human
cuuccacuuuuuuuuguaugu

SEQ ID NO: 1888729 - RNA, 18 nt, Human
cuuccccaucuucuaaac

SEQ ID NO: 1888730 - RNA, 16 nt, Human
cuucucacugccaugc

SEQ ID NO: 1888731 - RNA, 21 nt, Human
cuucucacugccaugccagcu

SEQ ID NO: 1888732 - RNA, 17 nt, Human
cuucucauuucaccccu

SEQ ID NO: 1888733 - RNA, 15 nt, Human
cuucucauuucaccc

SEQ ID NO: 1888734 - RNA, 14 nt, Human
cuucucauuucacc

SEQ ID NO: 1888735 - RNA, 17 nt, Human
cuucucauccugcaggc

SEQ ID NO: 1888736 - RNA, 16 nt, Human
cuucucauccugcagg

SEQ ID NO: 1888737 - RNA, 15 nt, Human
cuucucauccugcag

SEQ ID NO: 1888738 - RNA, 19 nt, Human
cuucgggaggucgaggcag

SEQ ID NO: 1888739 - RNA, 20 nt, Human
cuucggccuccauccugagg

SEQ ID NO: 1888740 - RNA, 16 nt, Human
cuucgggcugugcccg

SEQ ID NO: 1888741 - RNA, 17 nt, Human
cuucgcuccugugucuu

SEQ ID NO: 1888742 - RNA, 23 nt, Human
cuuccuguguguccaaaacugcc

SEQ ID NO: 1888743 - RNA, 15 nt, Human
cuuccugugugucca

SEQ ID NO: 1888744 - RNA, 17 nt, Human
cuuccuuaugcuucuuu

SEQ ID NO: 1888745 - RNA, 15 nt, Human
cuuccuuaugcuucu

SEQ ID NO: 1888746 - RNA, 14 nt, Human
cuuccuguucugaa

SEQ ID NO: 1888747 - RNA, 13 nt, Human
cuuccuuggcuuu

SEQ ID NO: 1888748 - RNA, 17 nt, Human
cuuccuuguagccuuuu

SEQ ID NO: 1888749 - RNA, 20 nt, Human
cuuccuuguagccuuuugac

SEQ ID NO: 1888750 - RNA, 21 nt, Human
cuuccuuguagccuuuugacu

SEQ ID NO: 1888751 - RNA, 22 nt, Human
cuucaguaacccccacuggacu

SEQ ID NO: 1888752 - RNA, 20 nt, Human
cuucaguaacccccacugga

SEQ ID NO: 1888753 - RNA, 15 nt, Human
cuucaguaagccgug

SEQ ID NO: 1888754 - RNA, 14 nt, Human
cuucagugccaaaa

SEQ ID NO: 1888755 - RNA, 23 nt, Human
cuucauggaugggggaacucaga

SEQ ID NO: 1888756 - RNA, 13 nt, Human
cuuccacaagagc

SEQ ID NO: 1888757 - RNA, 14 nt, Human
cuuccacaagagcc

SEQ ID NO: 1888758 - RNA, 15 nt, Human
cuuccacaagagccc

SEQ ID NO: 1888759 - RNA, 14 nt, Human
cuucagccucccga

SEQ ID NO: 1888760 - RNA, 15 nt, Human
cuucagccugaaaga

SEQ ID NO: 1888761 - RNA, 20 nt, Human
cuucagccucccgaguagcu

SEQ ID NO: 1888762 - RNA, 16 nt, Human
cuucagccucccgagu

SEQ ID NO: 1888763 - RNA, 14 nt, Human
cuucaguaagccgu

SEQ ID NO: 1888764 - RNA, 15 nt, Human
cuucagcugacuuuu

SEQ ID NO: 1888765 - RNA, 19 nt, Human
cuucagcugacuuuucugu

SEQ ID NO: 1888766 - RNA, 23 nt, Human
cuucacauauugauuuccguuaa

SEQ ID NO: 1888767 - RNA, 14 nt, Human
cuucacauauugau

SEQ ID NO: 1888768 - RNA, 21 nt, Human
cuucaaggauccugagccaga

SEQ ID NO: 1888769 - RNA, 22 nt, Human
cuucaaggauccugagccagau

SEQ ID NO: 1888770 - RNA, 23 nt, Human
cuucaaggauccugagccagauu

SEQ ID NO: 1888771 - RNA, 14 nt, Human
cuucacaaagccca

SEQ ID NO: 1888772 - RNA, 15 nt, Human
cuucacaaagcccaa

SEQ ID NO: 1888773 - RNA, 17 nt, Human
cuucacaaagcccaagg

SEQ ID NO: 1888774 - RNA, 23 nt, Human
cuucacaaagcccaagggaucug

SEQ ID NO: 1888775 - RNA, 13 nt, Human
cuucacacacaga

SEQ ID NO: 1888776 - RNA, 15 nt, Human
cuucaaauauuuccc

SEQ ID NO: 1888777 - RNA, 21 nt, Human
cuuagucacugagacagcccg

SEQ ID NO: 1888778 - RNA, 20 nt, Human
cuuagucacugagacagccc

SEQ ID NO: 1888779 - RNA, 22 nt, Human
cuuagucacugagacagcccgg

SEQ ID NO: 1888780 - RNA, 17 nt, Human
cuucaaggauccugagc

SEQ ID NO: 1888781 - RNA, 18 nt, Human
cuucaaggauccugagcc

SEQ ID NO: 1888782 - RNA, 19 nt, Human
cuucaaggauccugagcca

SEQ ID NO: 1888783 - RNA, 20 nt, Human
cuucaaggauccugagccag

SEQ ID NO: 1888784 - RNA, 19 nt, Human
cuuaccugggcauucuugu

SEQ ID NO: 1888785 - RNA, 20 nt, Human
cuuaccugccaggaagccag

SEQ ID NO: 1888786 - RNA, 20 nt, Human
cuuagaagucacacaguauu

SEQ ID NO: 1888787 - RNA, 17 nt, Human
cuuagaagucacacagu

SEQ ID NO: 1888788 - RNA, 16 nt, Human
cuuagaaguggaagua

SEQ ID NO: 1888789 - RNA, 13 nt, Human
cuuacuguacaug

SEQ ID NO: 1888790 - RNA, 20 nt, Human
cuuagaaaaaccaccaccau

SEQ ID NO: 1888791 - RNA, 23 nt, Human
cuuagguuggcaaaaaggcagga

SEQ ID NO: 1888792 - RNA, 21 nt, Human
cuuagguuggcaaaaaggcag

SEQ ID NO: 1888793 - RNA, 22 nt, Human
cuuagagacaguugggugagaa

SEQ ID NO: 1888794 - RNA, 12 nt, Human
cuuagaauccaa

SEQ ID NO: 1888795 - RNA, 16 nt, Human
cuuagaauccaaacuu

SEQ ID NO: 1888796 - RNA, 17 nt, Human
cuuagaauccaaacuug

SEQ ID NO: 1888797 - RNA, 19 nt, Human
cuuagaauuaguggcacuu

SEQ ID NO: 1888798 - RNA, 20 nt, Human
cuuaaucuuuucacaaauaa

SEQ ID NO: 1888799 - RNA, 19 nt, Human
cuuaaucuuuucacaaaua

SEQ ID NO: 1888800 - RNA, 18 nt, Human
cuuaaucuuuucacaaau

SEQ ID NO: 1888801 - RNA, 17 nt, Human
cuuaaucuuuucacaaa

SEQ ID NO: 1888802 - RNA, 21 nt, Human
cuuaaucuuuucacaaauaaa

SEQ ID NO: 1888803 - RNA, 20 nt, Human
cuuaauucuuagcucauucu

SEQ ID NO: 1888804 - RNA, 17 nt, Human
cuuaaccagaucauugu

SEQ ID NO: 1888805 - RNA, 12 nt, Human
cuuaaaaauggu

SEQ ID NO: 1888806 - RNA, 16 nt, Human
cuuaauacuaccuuga

SEQ ID NO: 1888807 - RNA, 18 nt, Human
cuuaauacuaccuugaaa

SEQ ID NO: 1888808 - RNA, 17 nt, Human
cuguuugcuaagugagg

SEQ ID NO: 1888809 - RNA, 19 nt, Human
cuguuugcuaagugaggau

SEQ ID NO: 1888810 - RNA, 18 nt, Human
cuguuuagauaauacacc

SEQ ID NO: 1888811 - RNA, 17 nt, Human
cuguuuagcagcagccu

SEQ ID NO: 1888812 - RNA, 20 nt, Human
cuguuuagcagcagccuuua

SEQ ID NO: 1888813 - RNA, 17 nt, Human
cuguuucaaacuuuacu

SEQ ID NO: 1888814 - RNA, 15 nt, Human
cuguuucaaacuuua

SEQ ID NO: 1888815 - RNA, 17 nt, Human
cuguugcccaggcuggc

SEQ ID NO: 1888816 - RNA, 18 nt, Human
cuguugcccaggcuggcg

SEQ ID NO: 1888817 - RNA, 17 nt, Human
cuguuuagauaauacac

SEQ ID NO: 1888818 - RNA, 14 nt, Human
cuguuuagauaaua

SEQ ID NO: 1888819 - RNA, 13 nt, Human
cuguuuucccuga

SEQ ID NO: 1888820 - RNA, 12 nt, Human
cuguuuuccucc

SEQ ID NO: 1888821 - RNA, 14 nt, Human
cuguuuuccucccu

SEQ ID NO: 1888822 - RNA, 15 nt, Human
cuguuuuccucccuu

SEQ ID NO: 1888823 - RNA, 16 nt, Human
cuguuuuccucccuuc

SEQ ID NO: 1888824 - RNA, 17 nt, Human
cuguuuuccucccuucu

SEQ ID NO: 1888825 - RNA, 19 nt, Human
cuguuuuccucccuucugc

SEQ ID NO: 1888826 - RNA, 20 nt, Human
cuguuuuccucccuucugcu

SEQ ID NO: 1888827 - RNA, 21 nt, Human
cuguuuuccucccuucugcua

SEQ ID NO: 1888828 - RNA, 23 nt, Human
cuguuuuccucccuucugcuacu

SEQ ID NO: 1888829 - RNA, 16 nt, Human
cuuaaaaaguggaaaa

SEQ ID NO: 1888830 - RNA, 17 nt, Human
cuuaaaaaguggaaaaa

SEQ ID NO: 1888831 - RNA, 15 nt, Human
cuguuuuuaagcugu

SEQ ID NO: 1888832 - RNA, 16 nt, Human
cuguuuuuaagcuguu

SEQ ID NO: 1888833 - RNA, 17 nt, Human
cuguuuuuaagcuguuu

SEQ ID NO: 1888834 - RNA, 18 nt, Human
cuguuuuuaagcuguuuc

SEQ ID NO: 1888835 - RNA, 19 nt, Human
cuguuuuuaagcuguuucc

SEQ ID NO: 1888836 - RNA, 23 nt, Human
cuguuuuuaagcuguuuccauag

SEQ ID NO: 1888837 - RNA, 16 nt, Human
cuguuaauaguucagg

SEQ ID NO: 1888838 - RNA, 18 nt, Human
cuguucuuaagacgugau

SEQ ID NO: 1888839 - RNA, 21 nt, Human
cuguucuuucuggcuaugcau

SEQ ID NO: 1888840 - RNA, 14 nt, Human
cuguucuuucuggc

SEQ ID NO: 1888841 - RNA, 13 nt, Human
cuguucuuucugg

SEQ ID NO: 1888842 - RNA, 21 nt, Human
cuguucuuuccaaaguacacu

SEQ ID NO: 1888843 - RNA, 19 nt, Human
cuguucuuuccaaaguaca

SEQ ID NO: 1888844 - RNA, 16 nt, Human
cuguucuuuccaaagu

SEQ ID NO: 1888845 - RNA, 15 nt, Human
cuguucuuuccaaag

SEQ ID NO: 1888846 - RNA, 16 nt, Human
cuguugcccaggcugg

SEQ ID NO: 1888847 - RNA, 15 nt, Human
cuguugcccaggcug

SEQ ID NO: 1888848 - RNA, 14 nt, Human
cuguugcccaggcu

SEQ ID NO: 1888849 - RNA, 13 nt, Human
cuguugcccaggc

SEQ ID NO: 1888850 - RNA, 12 nt, Human
cuguugcccagg

SEQ ID NO: 1888851 - RNA, 23 nt, Human
cuguucuuucuggcuaugcauuu

SEQ ID NO: 1888852 - RNA, 17 nt, Human
cuguugacacaggucuu

SEQ ID NO: 1888853 - RNA, 22 nt, Human
cuguugacacaggucuuuccua

SEQ ID NO: 1888854 - RNA, 15 nt, Human
cuguugagcuguuuu

SEQ ID NO: 1888855 - RNA, 20 nt, Human
cuguugagcuguuuucccug

SEQ ID NO: 1888856 - RNA, 21 nt, Human
cuguugacacaggucuuuccu

SEQ ID NO: 1888857 - RNA, 18 nt, Human
cuuucauuuacuguggcu

SEQ ID NO: 1888858 - RNA, 17 nt, Human
cuuucagugaaagcauc

SEQ ID NO: 1888859 - RNA, 15 nt, Human
cuuucagugaaagca

SEQ ID NO: 1888860 - RNA, 17 nt, Human
cuuucauaaucuuugcu

SEQ ID NO: 1888861 - RNA, 18 nt, Human
cuuucauaaucuuugcuu

SEQ ID NO: 1888862 - RNA, 20 nt, Human
cuuuccaaagccaaugugaa

SEQ ID NO: 1888863 - RNA, 22 nt, Human
cuuucauuuuuuuccaggcugg

SEQ ID NO: 1888864 - RNA, 20 nt, Human
cuuucauuuuuuuccaggcu

SEQ ID NO: 1888865 - RNA, 15 nt, Human
cuuucauuuuuuucc

SEQ ID NO: 1888866 - RNA, 19 nt, Human
cuuucauuuuuuuccaggc

SEQ ID NO: 1888867 - RNA, 16 nt, Human
cuuucauuuuuuucca

SEQ ID NO: 1888868 - RNA, 18 nt, Human
cuuuccaaaugcccagcu

SEQ ID NO: 1888869 - RNA, 19 nt, Human
cuuuccaaaugcccagcuu

SEQ ID NO: 1888870 - RNA, 22 nt, Human
cuuuccaaaugcccagcuuaaa

SEQ ID NO: 1888871 - RNA, 16 nt, Human
cuuucccaacucuagc

SEQ ID NO: 1888872 - RNA, 21 nt, Human
cuuuauuuucuauaauuuaaa

SEQ ID NO: 1888873 - RNA, 12 nt, Human
cuuuauuuccaa

SEQ ID NO: 1888874 - RNA, 23 nt, Human
cuuuauuccagaaugcuguacau

SEQ ID NO: 1888875 - RNA, 21 nt, Human
cuuuauugaaaaaauaaaaaa

SEQ ID NO: 1888876 - RNA, 17 nt, Human
cuuuauuaaauguagaa

SEQ ID NO: 1888877 - RNA, 20 nt, Human
cuuuauuaaucacuauuguu

SEQ ID NO: 1888878 - RNA, 14 nt, Human
cuuuauuacccccu

SEQ ID NO: 1888879 - RNA, 21 nt, Human
cuuuauuaaauacaaaacuuc

SEQ ID NO: 1888880 - RNA, 20 nt, Human
cuuuauuccagaaugcugua

SEQ ID NO: 1888881 - RNA, 21 nt, Human
cuuuauucaauaaaaaaaaga

SEQ ID NO: 1888882 - RNA, 20 nt, Human
cuuuauuacccccuccuuca

SEQ ID NO: 1888883 - RNA, 22 nt, Human
cuuuauuacccccuccuucaga

SEQ ID NO: 1888884 - RNA, 15 nt, Human
cuuuauuaaucacua

SEQ ID NO: 1888885 - RNA, 15 nt, Human
cuuuaguuuuuguga

SEQ ID NO: 1888886 - RNA, 13 nt, Human
cuuuaguuuuugu

SEQ ID NO: 1888887 - RNA, 20 nt, Human
cuuuagaaagguuuugagca

SEQ ID NO: 1888888 - RNA, 19 nt, Human
cuuuagaaagguuuugagc

SEQ ID NO: 1888889 - RNA, 20 nt, Human
cuuguguguuuauugucaaa

SEQ ID NO: 1888890 - RNA, 15 nt, Human
cuuguggcuuugcaa

SEQ ID NO: 1888891 - RNA, 12 nt, Human
cuuguaaauaaa

SEQ ID NO: 1888892 - RNA, 15 nt, Human
cuuguaaauaaagcc

SEQ ID NO: 1888893 - RNA, 16 nt, Human
cuuguaaauaaagccc

SEQ ID NO: 1888894 - RNA, 17 nt, Human
cuuguaaauaaagcccu

SEQ ID NO: 1888895 - RNA, 19 nt, Human
cuuguaaauaaagcccugg

SEQ ID NO: 1888896 - RNA, 23 nt, Human
cuuguuggauuuuugucuugugu

SEQ ID NO: 1888897 - RNA, 21 nt, Human
cuuguuggauuuuugucuugu

SEQ ID NO: 1888898 - RNA, 21 nt, Human
cuuguguuucuuuaguuuuug

SEQ ID NO: 1888899 - RNA, 21 nt, Human
cuuguguguuuauugucaaag

SEQ ID NO: 1888900 - RNA, 22 nt, Human
cuuggaaccguaggacccaagc

SEQ ID NO: 1888901 - RNA, 13 nt, Human
cuuggaagcuccg

SEQ ID NO: 1888902 - RNA, 13 nt, Human
cuuggaggaagga

SEQ ID NO: 1888903 - RNA, 16 nt, Human
cuuggaaaugggagac

SEQ ID NO: 1888904 - RNA, 21 nt, Human
cuuggaaacuggaugagguca

SEQ ID NO: 1888905 - RNA, 17 nt, Human
cuugcucugcugacaga

SEQ ID NO: 1888906 - RNA, 16 nt, Human
cuugcucugcugacag

SEQ ID NO: 1888907 - RNA, 20 nt, Human
cuugcuucaaccccaugaga

SEQ ID NO: 1888908 - RNA, 11 nt, Human
cuugccagaga

SEQ ID NO: 1888909 - RNA, 12 nt, Human
cuugccagagau

SEQ ID NO: 1888910 - RNA, 16 nt, Human
cuugccagagauccaa

SEQ ID NO: 1888911 - RNA, 23 nt, Human
cuugccagagauccaaaagaagc

SEQ ID NO: 1888912 - RNA, 18 nt, Human
cuucucauuucaccccuc

SEQ ID NO: 1888913 - RNA, 21 nt, Human
cuucuccacccugcucuccga

SEQ ID NO: 1888914 - RNA, 18 nt, Human
cuucuccacccugcucuc

SEQ ID NO: 1888915 - RNA, 17 nt, Human
cuucuccacccugcucu

SEQ ID NO: 1888916 - RNA, 14 nt, Human
cuugcucugcugac

SEQ ID NO: 1888917 - RNA, 13 nt, Human
cuugcucugcuga

SEQ ID NO: 1888918 - RNA, 19 nt, Human
cuuguaaaggaauuuaaaa

SEQ ID NO: 1888919 - RNA, 16 nt, Human
cuuggggggcugaggu

SEQ ID NO: 1888920 - RNA, 22 nt, Human
cuuggggggcugaggugggagg

SEQ ID NO: 1888921 - RNA, 22 nt, Human
cuuggggaccagagcugccacc

SEQ ID NO: 1888922 - RNA, 15 nt, Human
cuuggggggcugagg

SEQ ID NO: 1888923 - RNA, 19 nt, Human
cuuggggaguuaagaccug

SEQ ID NO: 1888924 - RNA, 20 nt, Human
cuuggggaguuaagaccugg

SEQ ID NO: 1888925 - RNA, 21 nt, Human
cuuggggaguuaagaccuggc

SEQ ID NO: 1888926 - RNA, 13 nt, Human
cuugggcuucauc

SEQ ID NO: 1888927 - RNA, 14 nt, Human
cuugggccacugug

SEQ ID NO: 1888928 - RNA, 20 nt, Human
cuuggggaccagagcugcca

SEQ ID NO: 1888929 - RNA, 21 nt, Human
cuuggggaccagagcugccac

SEQ ID NO: 1888930 - RNA, 22 nt, Human
cuugggcuucauccuccucaga

SEQ ID NO: 1888931 - RNA, 20 nt, Human
cuuggggacaggggcaggag

SEQ ID NO: 1888932 - RNA, 17 nt, Human
cuuggcugcagggaguc

SEQ ID NO: 1888933 - RNA, 14 nt, Human
cuuggcugcaggga

SEQ ID NO: 1888934 - RNA, 20 nt, Human
cuuggcuuuuacugaagccu

SEQ ID NO: 1888935 - RNA, 16 nt, Human
cuuggcugcagggagu

SEQ ID NO: 1888936 - RNA, 15 nt, Human
cuuggaggugucugu

SEQ ID NO: 1888937 - RNA, 17 nt, Human
cuuggagguagcuuuga

SEQ ID NO: 1888938 - RNA, 22 nt, Human
cuuggaggaaggaaacccagcu

SEQ ID NO: 1888939 - RNA, 23 nt, Human
cuuggagggcaugaagacagaua

SEQ ID NO: 1888940 - RNA, 12 nt, Human
cuuggagggcau

SEQ ID NO: 1888941 - RNA, 19 nt, Human
cuuuucuggaauguaauca

SEQ ID NO: 1888942 - RNA, 18 nt, Human
cuuuucuggaauguaauc

SEQ ID NO: 1888943 - RNA, 18 nt, Human
cuuuucuguccgagcuuu

SEQ ID NO: 1888944 - RNA, 23 nt, Human
cuuuucuguccgagcuuugaaaa

SEQ ID NO: 1888945 - RNA, 16 nt, Human
cuuuucuuucagccaa

SEQ ID NO: 1888946 - RNA, 18 nt, Human
cuuuucuugcaugaggcu

SEQ ID NO: 1888947 - RNA, 23 nt, Human
cuuuucuugcaugaggcuagugu

SEQ ID NO: 1888948 - RNA, 12 nt, Human
cuuuucucugcc

SEQ ID NO: 1888949 - RNA, 20 nt, Human
cuuuucauaaccuagccuua

SEQ ID NO: 1888950 - RNA, 20 nt, Human
cuuuuacugaagccuuucuu

SEQ ID NO: 1888951 - RNA, 22 nt, Human
cuuuucauaaccuagccuuaga

SEQ ID NO: 1888952 - RNA, 18 nt, Human
cuuuucauauuugcacua

SEQ ID NO: 1888953 - RNA, 17 nt, Human
cuuuucauauuugcacu

SEQ ID NO: 1888954 - RNA, 18 nt, Human
cuuuguuuguugucagcu

SEQ ID NO: 1888955 - RNA, 20 nt, Human
cuuuguuuguugucagcuga

SEQ ID NO: 1888956 - RNA, 14 nt, Human
cuuuguucugcugu

SEQ ID NO: 1888957 - RNA, 20 nt, Human
cuuuguucugcuguucucua

SEQ ID NO: 1888958 - RNA, 20 nt, Human
cuuuuacguccaucucuugu

SEQ ID NO: 1888959 - RNA, 18 nt, Human
cuuuguucuaaagaugga

SEQ ID NO: 1888960 - RNA, 14 nt, Human
cuuuguucuggcuc

SEQ ID NO: 1888961 - RNA, 15 nt, Human
cuuuguucuggcucu

SEQ ID NO: 1888962 - RNA, 15 nt, Human
cuuuguucagccugc

SEQ ID NO: 1888963 - RNA, 19 nt, Human
cuuugugauuuuuguaauu

SEQ ID NO: 1888964 - RNA, 18 nt, Human
cuuugugauuuuuguaau

SEQ ID NO: 1888965 - RNA, 17 nt, Human
cuuugugauuuuuguaa

SEQ ID NO: 1888966 - RNA, 13 nt, Human
cuuugggaggcca

SEQ ID NO: 1888967 - RNA, 18 nt, Human
cuuuguccccaccgcaga

SEQ ID NO: 1888968 - RNA, 12 nt, Human
cuuuggcuuuuu

SEQ ID NO: 1888969 - RNA, 22 nt, Human
cuuuguccccaccgcagacagg

SEQ ID NO: 1888970 - RNA, 14 nt, Human
cuuugugauuuuug

SEQ ID NO: 1888971 - RNA, 16 nt, Human
cuuucccaucuuccaa

SEQ ID NO: 1888972 - RNA, 11 nt, Human
cuuugcugcug

SEQ ID NO: 1888973 - RNA, 19 nt, Human
cuuugcugcugaaggcuca

SEQ ID NO: 1888974 - RNA, 19 nt, Human
cuuuggacccugaggccca

SEQ ID NO: 1888975 - RNA, 17 nt, Human
cuuuggacccugaggcc

SEQ ID NO: 1888976 - RNA, 18 nt, Human
cuuuggacccugaggccc

SEQ ID NO: 1888977 - RNA, 18 nt, Human
cuuuggacagaagcagcu

SEQ ID NO: 1888978 - RNA, 19 nt, Human
cuuuggacagaagcagcuc

SEQ ID NO: 1888979 - RNA, 20 nt, Human
cuuuggacagaagcagcucu

SEQ ID NO: 1888980 - RNA, 21 nt, Human
cuuuggacagaagcagcucuu

SEQ ID NO: 1888981 - RNA, 15 nt, Human
cuuuggacccugagg

SEQ ID NO: 1888982 - RNA, 16 nt, Human
cuuuggacccugaggc

SEQ ID NO: 1888983 - RNA, 20 nt, Human
gaaaaucuuauaauuuaaaa

SEQ ID NO: 1888984 - RNA, 14 nt, Human
gaaacacagaaacc

SEQ ID NO: 1888985 - RNA, 18 nt, Human
gaaacagcuaaugggaca

SEQ ID NO: 1888986 - RNA, 16 nt, Human
gaaacagccugugucu

SEQ ID NO: 1888987 - RNA, 17 nt, Human
gaaacagccugugucuu

SEQ ID NO: 1888988 - RNA, 16 nt, Human
gaaacacuuugcauaa

SEQ ID NO: 1888989 - RNA, 12 nt, Human
gaaacagaggcu

SEQ ID NO: 1888990 - RNA, 19 nt, Human
gaaaauaacgauaaaagac

SEQ ID NO: 1888991 - RNA, 17 nt, Human
gaaaagcugcugacagu

SEQ ID NO: 1888992 - RNA, 13 nt, Human
gaaaagcugcuga

SEQ ID NO: 1888993 - RNA, 18 nt, Human
gaaaauaagaauagaaau

SEQ ID NO: 1888994 - RNA, 19 nt, Human
gaaaaucuuauaauuuaaa

SEQ ID NO: 1888995 - RNA, 16 nt, Human
gaaaaucagccugcuc

SEQ ID NO: 1888996 - RNA, 18 nt, Human
gaaaaucagccugcucca

SEQ ID NO: 1888997 - RNA, 14 nt, Human
gaaaaucagccugc

SEQ ID NO: 1888998 - RNA, 22 nt, Human
gaaaacaauaacgauaaaagac

SEQ ID NO: 1888999 - RNA, 13 nt, Human
gaaaacacauuuu

SEQ ID NO: 1889000 - RNA, 14 nt, Human
gaaaacacauuuuu

SEQ ID NO: 1889001 - RNA, 12 nt, Human
gaaaacaugcua

SEQ ID NO: 1889002 - RNA, 15 nt, Human
gaaaacaugcuacac

SEQ ID NO: 1889003 - RNA, 14 nt, Human
gaaaacaugcuaca

SEQ ID NO: 1889004 - RNA, 19 nt, Human
gaaaacguggcugcuucaa

SEQ ID NO: 1889005 - RNA, 18 nt, Human
gaaaacguggcugcuuca

SEQ ID NO: 1889006 - RNA, 15 nt, Human
gaaaacguggcugcu

SEQ ID NO: 1889007 - RNA, 16 nt, Human
gaaaacguggcugcuu

SEQ ID NO: 1889008 - RNA, 15 nt, Human
cuuuuuucacuacau

SEQ ID NO: 1889009 - RNA, 18 nt, Human
cuuuugacuuucauugga

SEQ ID NO: 1889010 - RNA, 14 nt, Human
cuuuuuucuaaagu

SEQ ID NO: 1889011 - RNA, 20 nt, Human
cuuuuuucucugauacagaa

SEQ ID NO: 1889012 - RNA, 18 nt, Human
cuuuuuuccuuaauccag

SEQ ID NO: 1889013 - RNA, 16 nt, Human
cuuuugagcauuuaga

SEQ ID NO: 1889014 - RNA, 21 nt, Human
cuuuugagugccuuacacaau

SEQ ID NO: 1889015 - RNA, 17 nt, Human
gaaaaaggaugcacaga

SEQ ID NO: 1889016 - RNA, 23 nt, Human
gaaaaaggaugcacagaguuguu

SEQ ID NO: 1889017 - RNA, 14 nt, Human
cuuuuuuggcugcu

SEQ ID NO: 1889018 - RNA, 15 nt, Human
cuuuuuuggcugcug

SEQ ID NO: 1889019 - RNA, 22 nt, Human
cuuuuuucucugauacagaaaa

SEQ ID NO: 1889020 - RNA, 16 nt, Human
cuuuuuucuuuuuccu

SEQ ID NO: 1889021 - RNA, 24 nt, Human
gaaggcacuaaaaagagcuguccu

SEQ ID NO: 1889022 - RNA, 17 nt, Human
gaaggcagcagguggca

SEQ ID NO: 1889023 - RNA, 16 nt, Human
gaaggccccgcccagg

SEQ ID NO: 1889024 - RNA, 14 nt, Human
gaaggccccgccca

SEQ ID NO: 1889025 - RNA, 15 nt, Human
gaaggccccgcccag

SEQ ID NO: 1889026 - RNA, 15 nt, Human
gaaggagacaggcag

SEQ ID NO: 1889027 - RNA, 16 nt, Human
gaaggagacaggcaga

SEQ ID NO: 1889028 - RNA, 18 nt, Human
gaaggagacaggcagagc

SEQ ID NO: 1889029 - RNA, 20 nt, Human
gaaggaaaaggcagggagcg

SEQ ID NO: 1889030 - RNA, 14 nt, Human
gaaggaaacccagc

SEQ ID NO: 1889031 - RNA, 17 nt, Human
gaaggaaacccagcucu

SEQ ID NO: 1889032 - RNA, 18 nt, Human
gaaggaaacccagcucug

SEQ ID NO: 1889033 - RNA, 15 nt, Human
gaaggcaaagcacga

SEQ ID NO: 1889034 - RNA, 21 nt, Human
gaaggauacaaaagcauguga

SEQ ID NO: 1889035 - RNA, 19 nt, Human
gaaggauacaaaagcaugu

SEQ ID NO: 1889036 - RNA, 12 nt, Human
gaaggauacaaa

SEQ ID NO: 1889037 - RNA, 21 nt, Human
gaagacucauucuucuguacg

SEQ ID NO: 1889038 - RNA, 19 nt, Human
gaagacucauucuucugua

SEQ ID NO: 1889039 - RNA, 14 nt, Human
gaagaagcucucuc

SEQ ID NO: 1889040 - RNA, 22 nt, Human
gaagccacgguguucugugaua

SEQ ID NO: 1889041 - RNA, 15 nt, Human
gaagccagcaggcuc

SEQ ID NO: 1889042 - RNA, 16 nt, Human
gaagccagcaggcucu

SEQ ID NO: 1889043 - RNA, 23 nt, Human
gaagccagcaggcucucaggcca

SEQ ID NO: 1889044 - RNA, 19 nt, Human
gaagccaggaauuucccag

SEQ ID NO: 1889045 - RNA, 21 nt, Human
gaagccaggaauuucccagga

SEQ ID NO: 1889046 - RNA, 23 nt, Human
gaagccaggaauuucccaggacc

SEQ ID NO: 1889047 - RNA, 24 nt, Human
gaagccaggaauuucccaggaccc

SEQ ID NO: 1889048 - RNA, 15 nt, Human
gaagccaucuuucuu

SEQ ID NO: 1889049 - RNA, 12 nt, Human
gaagcccagaau

SEQ ID NO: 1889050 - RNA, 10 nt, Human
gaagcccaga

SEQ ID NO: 1889051 - RNA, 18 nt, Human
gaagcuuuuaugugaaac

SEQ ID NO: 1889052 - RNA, 18 nt, Human
gaaggaaaaggcagggag

SEQ ID NO: 1889053 - RNA, 12 nt, Human
gaagcuuuacca

SEQ ID NO: 1889054 - RNA, 18 nt, Human
gaagcuuuaccagcugaa

SEQ ID NO: 1889055 - RNA, 20 nt, Human
gaagcccaggaaaggcucca

SEQ ID NO: 1889056 - RNA, 21 nt, Human
gaagcccaggaaaggcuccag

SEQ ID NO: 1889057 - RNA, 22 nt, Human
gaagcccaggaaaggcuccagg

SEQ ID NO: 1889058 - RNA, 23 nt, Human
gaagcccaggaaaggcuccagga

SEQ ID NO: 1889059 - RNA, 20 nt, Human
gaagccgugcucgccccagc

SEQ ID NO: 1889060 - RNA, 14 nt, Human
gaauacuuuauaaa

SEQ ID NO: 1889061 - RNA, 11 nt, Human
gaauaauaaau

SEQ ID NO: 1889062 - RNA, 23 nt, Human
gaauagaaauaaaggaugugauu

SEQ ID NO: 1889063 - RNA, 20 nt, Human
gaauacuuuuuacaauuaaa

SEQ ID NO: 1889064 - RNA, 14 nt, Human
gaauacuuuuuaca

SEQ ID NO: 1889065 - RNA, 18 nt, Human
gaauacuguuaaaggaaa

SEQ ID NO: 1889066 - RNA, 20 nt, Human
gaauacuguuaaaggaaaaa

SEQ ID NO: 1889067 - RNA, 20 nt, Human
gaauaauccuaaacauauga

SEQ ID NO: 1889068 - RNA, 20 nt, Human
gaauaagugccaggauggaa

SEQ ID NO: 1889069 - RNA, 14 nt, Human
gaauaacauguaau

SEQ ID NO: 1889070 - RNA, 22 nt, Human
gaauaaauaaauguaucuuauu

SEQ ID NO: 1889071 - RNA, 12 nt, Human
gaauaaaauuuu

SEQ ID NO: 1889072 - RNA, 12 nt, Human
gaaguuucugcc

SEQ ID NO: 1889073 - RNA, 18 nt, Human
gaaguuuaauugacuuau

SEQ ID NO: 1889074 - RNA, 16 nt, Human
gaaucucaaauaacua

SEQ ID NO: 1889075 - RNA, 18 nt, Human
gaaucuauuuaucuucau

SEQ ID NO: 1889076 - RNA, 19 nt, Human
gaaucuauuuaucuucauu

SEQ ID NO: 1889077 - RNA, 16 nt, Human
gaaucuggagaccagg

SEQ ID NO: 1889078 - RNA, 18 nt, Human
gaaucuggagaccaggga

SEQ ID NO: 1889079 - RNA, 22 nt, Human
gaaucuggagaccagggagccu

SEQ ID NO: 1889080 - RNA, 13 nt, Human
gaaucuauuuaag

SEQ ID NO: 1889081 - RNA, 15 nt, Human
gaaucuauuuaagua

SEQ ID NO: 1889082 - RNA, 16 nt, Human
gaaucuauuuaaguaa

SEQ ID NO: 1889083 - RNA, 20 nt, Human
gaaucuauuuaucuucauuu

SEQ ID NO: 1889084 - RNA, 19 nt, Human
gaaugaaagggcccagaga

SEQ ID NO: 1889085 - RNA, 14 nt, Human
gaaugccuccugca

SEQ ID NO: 1889086 - RNA, 14 nt, Human
gaaugaaagggccc

SEQ ID NO: 1889087 - RNA, 14 nt, Human
gaauagcugggacu

SEQ ID NO: 1889088 - RNA, 15 nt, Human
gaauagccacauuug

SEQ ID NO: 1889089 - RNA, 18 nt, Human
gaauagccacauuuggaa

SEQ ID NO: 1889090 - RNA, 23 nt, Human
gaauagccacauuuggaauacuu

SEQ ID NO: 1889091 - RNA, 15 nt, Human
gaauagcugggacua

SEQ ID NO: 1889092 - RNA, 12 nt, Human
gaauccaaacuu

SEQ ID NO: 1889093 - RNA, 13 nt, Human
gaauccaaacuug

SEQ ID NO: 1889094 - RNA, 13 nt, Human
gaaucagaacuca

SEQ ID NO: 1889095 - RNA, 22 nt, Human
gaaauguuauuuuuuaauuauu

SEQ ID NO: 1889096 - RNA, 21 nt, Human
gaaauguuauuuuuuaauuau

SEQ ID NO: 1889097 - RNA, 22 nt, Human
gaaauuaagaaggcaaaaaugu

SEQ ID NO: 1889098 - RNA, 17 nt, Human
gaaauuaagaaggcaaa

SEQ ID NO: 1889099 - RNA, 18 nt, Human
gaaauuaagaaggcaaaa

SEQ ID NO: 1889100 - RNA, 23 nt, Human
gaaaugcugguuuuucaguuuuc

SEQ ID NO: 1889101 - RNA, 14 nt, Human
gaaaugggcagagc

SEQ ID NO: 1889102 - RNA, 20 nt, Human
gaaaugggcagagcagagac

SEQ ID NO: 1889103 - RNA, 19 nt, Human
gaaaugggacuuaacuccu

SEQ ID NO: 1889104 - RNA, 17 nt, Human
gaaaugggacuuaacuc

SEQ ID NO: 1889105 - RNA, 21 nt, Human
gaaauugacacaaguggaccu

SEQ ID NO: 1889106 - RNA, 17 nt, Human
gaaauuuguuauaauga

SEQ ID NO: 1889107 - RNA, 17 nt, Human
gaaauaugcacaauagc

SEQ ID NO: 1889108 - RNA, 18 nt, Human
gaaauaugcacaauagca

SEQ ID NO: 1889109 - RNA, 21 nt, Human
gaaauaucugaaaauguaugu

SEQ ID NO: 1889110 - RNA, 13 nt, Human
gaaauauaauuga

SEQ ID NO: 1889111 - RNA, 17 nt, Human
gaaauauacacacagca

SEQ ID NO: 1889112 - RNA, 15 nt, Human
gaaauauacacacag

SEQ ID NO: 1889113 - RNA, 18 nt, Human
gaaauacugcaagaaaau

SEQ ID NO: 1889114 - RNA, 20 nt, Human
gaaacagccugugucuuuaa

SEQ ID NO: 1889115 - RNA, 17 nt, Human
gaaauaaaguuugcuua

SEQ ID NO: 1889116 - RNA, 15 nt, Human
gaaccguaggaccca

SEQ ID NO: 1889117 - RNA, 17 nt, Human
gaaccaccacacccagc

SEQ ID NO: 1889118 - RNA, 16 nt, Human
gaaccaccacacccag

SEQ ID NO: 1889119 - RNA, 17 nt, Human
gaaccugacguagcugc

SEQ ID NO: 1889120 - RNA, 19 nt, Human
gaaccguuuugaagcuacu

SEQ ID NO: 1889121 - RNA, 17 nt, Human
gaaccguuuugaagcua

SEQ ID NO: 1889122 - RNA, 18 nt, Human
gaaccguuuugaagcuac

SEQ ID NO: 1889123 - RNA, 21 nt, Human
gaaccacaucuugcucugcug

SEQ ID NO: 1889124 - RNA, 16 nt, Human
gaacagacuggaagca

SEQ ID NO: 1889125 - RNA, 15 nt, Human
gaacagacuggaagc

SEQ ID NO: 1889126 - RNA, 13 nt, Human
gaacagaagaaaa

SEQ ID NO: 1889127 - RNA, 14 nt, Human
gaacagaagaaaau

SEQ ID NO: 1889128 - RNA, 18 nt, Human
gaaccuucuggccuccca

SEQ ID NO: 1889129 - RNA, 21 nt, Human
gaaccuucuggccucccacag

SEQ ID NO: 1889130 - RNA, 22 nt, Human
gaacggggcucuucucauuuca

SEQ ID NO: 1889131 - RNA, 19 nt, Human
gaacggggcucuucucauu

SEQ ID NO: 1889132 - RNA, 16 nt, Human
gaaccuggaacuuggg

SEQ ID NO: 1889133 - RNA, 22 nt, Human
gaacuagcauauaauucuauau

SEQ ID NO: 1889134 - RNA, 13 nt, Human
gaacuauuagagc

SEQ ID NO: 1889135 - RNA, 15 nt, Human
gaacucaacuuugac

SEQ ID NO: 1889136 - RNA, 14 nt, Human
gaacucccuuucaa

SEQ ID NO: 1889137 - RNA, 16 nt, Human
gaacucaaauggggcc

SEQ ID NO: 1889138 - RNA, 19 nt, Human
gaacucaaauggggccaga

SEQ ID NO: 1889139 - RNA, 20 nt, Human
gaacucaaauggggccagau

SEQ ID NO: 1889140 - RNA, 22 nt, Human
gaacucaaauggggccagaucc

SEQ ID NO: 1889141 - RNA, 23 nt, Human
gaacucaaauggggccagaucca

SEQ ID NO: 1889142 - RNA, 22 nt, Human
gaacuggguacuuguggacaca

SEQ ID NO: 1889143 - RNA, 15 nt, Human
gaacucccuuucaac

SEQ ID NO: 1889144 - RNA, 23 nt, Human
gaacuuccagguguuacuguaau

SEQ ID NO: 1889145 - RNA, 17 nt, Human
gaacuuacauuguucaa

SEQ ID NO: 1889146 - RNA, 23 nt, Human
gaagaaaauggaaccaggcuugg

SEQ ID NO: 1889147 - RNA, 22 nt, Human
gaagaaaacaucuauucucucc

SEQ ID NO: 1889148 - RNA, 14 nt, Human
gaagaaaacaucua

SEQ ID NO: 1889149 - RNA, 22 nt, Human
gaagaacuguguuucaaguuca

SEQ ID NO: 1889150 - RNA, 14 nt, Human
gaagaagagccaca

SEQ ID NO: 1889151 - RNA, 15 nt, Human
gaagaagagccacag

SEQ ID NO: 1889152 - RNA, 21 nt, Human
gaacuuguaaaggaauuuaaa

SEQ ID NO: 1889153 - RNA, 23 nt, Human
gaacuugguucccauuugcuccu

SEQ ID NO: 1889154 - RNA, 13 nt, Human
gaacuuggcgcug

SEQ ID NO: 1889155 - RNA, 15 nt, Human
gaacuuggcgcugcc

SEQ ID NO: 1889156 - RNA, 16 nt, Human
gaacuuggcgcugccc

SEQ ID NO: 1889157 - RNA, 20 nt, Human
cugagggagcuccaacucag

SEQ ID NO: 1889158 - RNA, 13 nt, Human
cugaggcugggcu

SEQ ID NO: 1889159 - RNA, 17 nt, Human
cugaggcuggcacagga

SEQ ID NO: 1889160 - RNA, 18 nt, Human
cugaggcuggcacaggac

SEQ ID NO: 1889161 - RNA, 19 nt, Human
cugaggcuggcacaggaca

SEQ ID NO: 1889162 - RNA, 20 nt, Human
cugaggcuggcacaggacau

SEQ ID NO: 1889163 - RNA, 11 nt, Human
cugaggcuggc

SEQ ID NO: 1889164 - RNA, 13 nt, Human
cugaggcuggcac

SEQ ID NO: 1889165 - RNA, 15 nt, Human
cugaggcugggcucc

SEQ ID NO: 1889166 - RNA, 16 nt, Human
cugaggcugggcuccc

SEQ ID NO: 1889167 - RNA, 17 nt, Human
cugaggcugggcucccu

SEQ ID NO: 1889168 - RNA, 22 nt, Human
cugaggcugggcucccuuccca

SEQ ID NO: 1889169 - RNA, 24 nt, Human
cugaggcccuucucuccagccccu

SEQ ID NO: 1889170 - RNA, 13 nt, Human
cugagccccuguc

SEQ ID NO: 1889171 - RNA, 15 nt, Human
cugagccccugucua

SEQ ID NO: 1889172 - RNA, 16 nt, Human
cugagccccugucuag

SEQ ID NO: 1889173 - RNA, 22 nt, Human
cugagccccugucuagagaggg

SEQ ID NO: 1889174 - RNA, 23 nt, Human
cugagccccugucuagagaggga

SEQ ID NO: 1889175 - RNA, 12 nt, Human
cugagccccugu

SEQ ID NO: 1889176 - RNA, 21 nt, Human
cugaggcuccacuuggucugu

SEQ ID NO: 1889177 - RNA, 15 nt, Human
cugaggcuccacuug

SEQ ID NO: 1889178 - RNA, 22 nt, Human
cugaggccugagcgcuccugcc

SEQ ID NO: 1889179 - RNA, 18 nt, Human
cugaggccugagcgcucc

SEQ ID NO: 1889180 - RNA, 17 nt, Human
cugaggccugagcgcuc

SEQ ID NO: 1889181 - RNA, 18 nt, Human
cugaucaggaccuccaag

SEQ ID NO: 1889182 - RNA, 17 nt, Human
cugaucagaccacggcu

SEQ ID NO: 1889183 - RNA, 20 nt, Human
cugauccuaguuccaccauc

SEQ ID NO: 1889184 - RNA, 21 nt, Human
cugauccuaguuccaccauca

SEQ ID NO: 1889185 - RNA, 14 nt, Human
cugauggugcaaug

SEQ ID NO: 1889186 - RNA, 12 nt, Human
cugauccuggag

SEQ ID NO: 1889187 - RNA, 15 nt, Human
cugauccuggaggcc

SEQ ID NO: 1889188 - RNA, 17 nt, Human
cugauccuggaggccca

SEQ ID NO: 1889189 - RNA, 15 nt, Human
cugauggugcaauga

SEQ ID NO: 1889190 - RNA, 16 nt, Human
cugauggugcaaugac

SEQ ID NO: 1889191 - RNA, 22 nt, Human
cugauacagaaaaguugaauuu

SEQ ID NO: 1889192 - RNA, 14 nt, Human
cugauaagcuucaa

SEQ ID NO: 1889193 - RNA, 18 nt, Human
cugagucugaaggcuggg

SEQ ID NO: 1889194 - RNA, 19 nt, Human
cugagucugaaggcugggu

SEQ ID NO: 1889195 - RNA, 15 nt, Human
cugagugaaccugua

SEQ ID NO: 1889196 - RNA, 21 nt, Human
cugagugaaaaaucuguggaa

SEQ ID NO: 1889197 - RNA, 13 nt, Human
cugagugaaccug

SEQ ID NO: 1889198 - RNA, 17 nt, Human
cugagugaaccuguaua

SEQ ID NO: 1889199 - RNA, 13 nt, Human
cugagugaaaaau

SEQ ID NO: 1889200 - RNA, 14 nt, Human
cugagugaaaaauc

SEQ ID NO: 1889201 - RNA, 18 nt, Human
cugaguuccuagccaccg

SEQ ID NO: 1889202 - RNA, 17 nt, Human
cugaguuccuagccacc

SEQ ID NO: 1889203 - RNA, 16 nt, Human
cugaguuccuagccac

SEQ ID NO: 1889204 - RNA, 15 nt, Human
cugaguuccuagcca

SEQ ID NO: 1889205 - RNA, 23 nt, Human
cugauaacuagauggugcugaga

SEQ ID NO: 1889206 - RNA, 24 nt, Human
cugauaacuagauggugcugagaa

SEQ ID NO: 1889207 - RNA, 18 nt, Human
cugauaacuagauggugc

SEQ ID NO: 1889208 - RNA, 19 nt, Human
cugauaacuagauggugcu

SEQ ID NO: 1889209 - RNA, 20 nt, Human
cugauaacuagauggugcug

SEQ ID NO: 1889210 - RNA, 21 nt, Human
cugauaacuagauggugcuga

SEQ ID NO: 1889211 - RNA, 21 nt, Human
cugaguugguguugacaugug

SEQ ID NO: 1889212 - RNA, 20 nt, Human
cugaguuguugagucuguuu

SEQ ID NO: 1889213 - RNA, 20 nt, Human
cugaguugacuugacagaac

SEQ ID NO: 1889214 - RNA, 16 nt, Human
cugcacaugucuugua

SEQ ID NO: 1889215 - RNA, 14 nt, Human
cugcacaugucuug

SEQ ID NO: 1889216 - RNA, 23 nt, Human
cugcacaugucuuguacaugugu

SEQ ID NO: 1889217 - RNA, 21 nt, Human
cugcacaugucuuguacaugu

SEQ ID NO: 1889218 - RNA, 23 nt, Human
cugcacaugaaucccacccacau

SEQ ID NO: 1889219 - RNA, 22 nt, Human
cugcacaugaaucccacccaca

SEQ ID NO: 1889220 - RNA, 18 nt, Human
cugcaauaaggggagagu

SEQ ID NO: 1889221 - RNA, 22 nt, Human
cugcacaagcugcacccucagg

SEQ ID NO: 1889222 - RNA, 12 nt, Human
cugcaccgggcc

SEQ ID NO: 1889223 - RNA, 23 nt, Human
cugcaccggcuggccuggccccu

SEQ ID NO: 1889224 - RNA, 15 nt, Human
cugcacuccccugcu

SEQ ID NO: 1889225 - RNA, 13 nt, Human
cugcacccucagg

SEQ ID NO: 1889226 - RNA, 14 nt, Human
cugcacccucaggc

SEQ ID NO: 1889227 - RNA, 16 nt, Human
cugcacccucaggcag

SEQ ID NO: 1889228 - RNA, 22 nt, Human
cugcaccggcuggccuggcccc

SEQ ID NO: 1889229 - RNA, 18 nt, Human
cugcacuugcagacucua

SEQ ID NO: 1889230 - RNA, 15 nt, Human
cugcacugaugcugc

SEQ ID NO: 1889231 - RNA, 17 nt, Human
cugcacugaugcugccc

SEQ ID NO: 1889232 - RNA, 18 nt, Human
cugcacugaugcugcccc

SEQ ID NO: 1889233 - RNA, 19 nt, Human
cugcacugaugcugccccu

SEQ ID NO: 1889234 - RNA, 16 nt, Human
cugcacuccccugcug

SEQ ID NO: 1889235 - RNA, 17 nt, Human
cugcacuccccugcugg

SEQ ID NO: 1889236 - RNA, 18 nt, Human
cugcacuccccugcuggg

SEQ ID NO: 1889237 - RNA, 20 nt, Human
cugcacucuagccuggguga

SEQ ID NO: 1889238 - RNA, 21 nt, Human
cugauugugucucuugguccu

SEQ ID NO: 1889239 - RNA, 16 nt, Human
cugauuuaggagaagc

SEQ ID NO: 1889240 - RNA, 17 nt, Human
cugauuuaggagaagcc

SEQ ID NO: 1889241 - RNA, 18 nt, Human
cugauuuaggagaagcca

SEQ ID NO: 1889242 - RNA, 20 nt, Human
cugauuuaggagaagccagg

SEQ ID NO: 1889243 - RNA, 22 nt, Human
cugauuuaggagaagccaggaa

SEQ ID NO: 1889244 - RNA, 21 nt, Human
cugauuuaggagaagccagga

SEQ ID NO: 1889245 - RNA, 16 nt, Human
cugauuuagauaugca

SEQ ID NO: 1889246 - RNA, 18 nt, Human
cugauuuccccuuuugca

SEQ ID NO: 1889247 - RNA, 19 nt, Human
cugauuuccccuuuugcau

SEQ ID NO: 1889248 - RNA, 13 nt, Human
cugauuuccccuu

SEQ ID NO: 1889249 - RNA, 15 nt, Human
cugauuuccccuuuu

SEQ ID NO: 1889250 - RNA, 17 nt, Human
cugauugugucucuugg

SEQ ID NO: 1889251 - RNA, 13 nt, Human
cugauuguauuua

SEQ ID NO: 1889252 - RNA, 18 nt, Human
cugauccuggaggcccag

SEQ ID NO: 1889253 - RNA, 17 nt, Human
cugauggugcaaugacc

SEQ ID NO: 1889254 - RNA, 19 nt, Human
cugauggugcaaugaccuu

SEQ ID NO: 1889255 - RNA, 20 nt, Human
cugauggugcaaugaccuuu

SEQ ID NO: 1889256 - RNA, 21 nt, Human
cugauggugcaaugaccuuuc

SEQ ID NO: 1889257 - RNA, 22 nt, Human
cugcaaagaucuguccucagcc

SEQ ID NO: 1889258 - RNA, 23 nt, Human
cugcaaagaucuguccucagccu

SEQ ID NO: 1889259 - RNA, 23 nt, Human
cugauuuuuuuuuccuucagugc

SEQ ID NO: 1889260 - RNA, 15 nt, Human
cugcaaaaauauuua

SEQ ID NO: 1889261 - RNA, 17 nt, Human
cugcaaaaauauuuaua

SEQ ID NO: 1889262 - RNA, 20 nt, Human
cugcaaaaauauuuauaaaa

SEQ ID NO: 1889263 - RNA, 21 nt, Human
cugcaaaaauauuuauaaaac

SEQ ID NO: 1889264 - RNA, 21 nt, Human
cugauuuuuuuuuccuucagu

SEQ ID NO: 1889265 - RNA, 22 nt, Human
cugauuuuuuuuuccuucagug

SEQ ID NO: 1889266 - RNA, 16 nt, Human
cugauuuuuuuuuccu

SEQ ID NO: 1889267 - RNA, 18 nt, Human
cugauuuuuuuuuccuuc

SEQ ID NO: 1889268 - RNA, 19 nt, Human
cugauuuuuuuuuccuuca

SEQ ID NO: 1889269 - RNA, 20 nt, Human
cugauuuuuuuuuccuucag

SEQ ID NO: 1889270 - RNA, 21 nt, Human
cugccacugacugcagggaca

SEQ ID NO: 1889271 - RNA, 20 nt, Human
cugccacugacugcagggac

SEQ ID NO: 1889272 - RNA, 19 nt, Human
cugccacugacugcaggga

SEQ ID NO: 1889273 - RNA, 11 nt, Human
cugccaggcau

SEQ ID NO: 1889274 - RNA, 13 nt, Human
cugccaggcaugg

SEQ ID NO: 1889275 - RNA, 23 nt, Human
cugccacucaggcccaaagccuc

SEQ ID NO: 1889276 - RNA, 16 nt, Human
cugccacucaggccca

SEQ ID NO: 1889277 - RNA, 23 nt, Human
cugccaucucaccuccugcuggg

SEQ ID NO: 1889278 - RNA, 21 nt, Human
cugccaucucaccuccugcug

SEQ ID NO: 1889279 - RNA, 14 nt, Human
cugccaugccagcu

SEQ ID NO: 1889280 - RNA, 15 nt, Human
cugccaugccagcuu

SEQ ID NO: 1889281 - RNA, 13 nt, Human
cugcccaccuggc

SEQ ID NO: 1889282 - RNA, 14 nt, Human
cugcccaccuggcc

SEQ ID NO: 1889283 - RNA, 15 nt, Human
cugcccaccuggccu

SEQ ID NO: 1889284 - RNA, 18 nt, Human
cugcccacucccugcaac

SEQ ID NO: 1889285 - RNA, 20 nt, Human
cugcccauggacaggcuggc

SEQ ID NO: 1889286 - RNA, 16 nt, Human
cugcccauggacaggc

SEQ ID NO: 1889287 - RNA, 18 nt, Human
cugcccauggacaggcug

SEQ ID NO: 1889288 - RNA, 22 nt, Human
cugcccagcggacaguggcagg

SEQ ID NO: 1889289 - RNA, 17 nt, Human
cugcccaccuggccucu

SEQ ID NO: 1889290 - RNA, 18 nt, Human
cugcccaccuggccucug

SEQ ID NO: 1889291 - RNA, 19 nt, Human
cugcccaccuggccucugc

SEQ ID NO: 1889292 - RNA, 20 nt, Human
cugcccaccuggccucugca

SEQ ID NO: 1889293 - RNA, 22 nt, Human
cugcccaccuggccucugcacu

SEQ ID NO: 1889294 - RNA, 14 nt, Human
cugcccacucccug

SEQ ID NO: 1889295 - RNA, 15 nt, Human
cugcccacucccugc

SEQ ID NO: 1889296 - RNA, 16 nt, Human
cugcccacucccugca

SEQ ID NO: 1889297 - RNA, 23 nt, Human
cugcacuugcagacucuacagag

SEQ ID NO: 1889298 - RNA, 19 nt, Human
cugcaguugccagucaccc

SEQ ID NO: 1889299 - RNA, 17 nt, Human
cugcaguugccagucac

SEQ ID NO: 1889300 - RNA, 21 nt, Human
cugcaguugccagucaccccg

SEQ ID NO: 1889301 - RNA, 22 nt, Human
cugcaguugccagucaccccgg

SEQ ID NO: 1889302 - RNA, 22 nt, Human
cugcaucguuucaucuuccaac

SEQ ID NO: 1889303 - RNA, 22 nt, Human
cugcaucugaccagcagcgccu

SEQ ID NO: 1889304 - RNA, 16 nt, Human
cugcaucugaccagca

SEQ ID NO: 1889305 - RNA, 17 nt, Human
cugcaucugaccagcag

SEQ ID NO: 1889306 - RNA, 18 nt, Human
cugcaucugaccagcagc

SEQ ID NO: 1889307 - RNA, 19 nt, Human
cugcaucugaccagcagcg

SEQ ID NO: 1889308 - RNA, 20 nt, Human
cugcaucugaccagcagcgc

SEQ ID NO: 1889309 - RNA, 21 nt, Human
cugcaucugaccagcagcgcc

SEQ ID NO: 1889310 - RNA, 16 nt, Human
cugcaucguuucaucu

SEQ ID NO: 1889311 - RNA, 18 nt, Human
cugcaugcgggcuuccuc

SEQ ID NO: 1889312 - RNA, 22 nt, Human
cugcaugcgggcuuccuccugg

SEQ ID NO: 1889313 - RNA, 12 nt, Human
cugcaugcugcu

SEQ ID NO: 1889314 - RNA, 13 nt, Human
cugcaugcugcug

SEQ ID NO: 1889315 - RNA, 15 nt, Human
cugcaugcugcugga

SEQ ID NO: 1889316 - RNA, 18 nt, Human
cugcaugcugcuggacag

SEQ ID NO: 1889317 - RNA, 22 nt, Human
cugcaugcugcuggacaguauc

SEQ ID NO: 1889318 - RNA, 18 nt, Human
cugccaaugggagcucau

SEQ ID NO: 1889319 - RNA, 19 nt, Human
cugccaaugggagcucaug

SEQ ID NO: 1889320 - RNA, 18 nt, Human
cugcgguccacccaggag

SEQ ID NO: 1889321 - RNA, 22 nt, Human
cugcgggcuggguguggucucc

SEQ ID NO: 1889322 - RNA, 20 nt, Human
cugcgguccacccaggagcc

SEQ ID NO: 1889323 - RNA, 19 nt, Human
cugcgguccacccaggagc

SEQ ID NO: 1889324 - RNA, 20 nt, Human
cugcgugcagggacaaagag

SEQ ID NO: 1889325 - RNA, 16 nt, Human
cugcggagcaagagga

SEQ ID NO: 1889326 - RNA, 17 nt, Human
cugcggagcaagaggag

SEQ ID NO: 1889327 - RNA, 18 nt, Human
cugccuuuggcagaguuc

SEQ ID NO: 1889328 - RNA, 22 nt, Human
cugccugcccaggccccugcca

SEQ ID NO: 1889329 - RNA, 21 nt, Human
cugccugcccaggccccugcc

SEQ ID NO: 1889330 - RNA, 13 nt, Human
cugccuccaggaa

SEQ ID NO: 1889331 - RNA, 21 nt, Human
cugccucugacacacagcucu

SEQ ID NO: 1889332 - RNA, 18 nt, Human
cugccucugacacacagc

SEQ ID NO: 1889333 - RNA, 17 nt, Human
cugccucugacacacag

SEQ ID NO: 1889334 - RNA, 19 nt, Human
cugccucucugcagguccc

SEQ ID NO: 1889335 - RNA, 18 nt, Human
cugccuggacuagaggga

SEQ ID NO: 1889336 - RNA, 12 nt, Human
cugccccaacuc

SEQ ID NO: 1889337 - RNA, 12 nt, Human
cugccgcagccc

SEQ ID NO: 1889338 - RNA, 13 nt, Human
cugccgcagcccu

SEQ ID NO: 1889339 - RNA, 15 nt, Human
cugccgcagagcugg

SEQ ID NO: 1889340 - RNA, 14 nt, Human
cugccgcagagcug

SEQ ID NO: 1889341 - RNA, 13 nt, Human
cugccgcagagcu

SEQ ID NO: 1889342 - RNA, 23 nt, Human
cugccgcagcccugcagagggca

SEQ ID NO: 1889343 - RNA, 18 nt, Human
cugccgcagagcuggccg

SEQ ID NO: 1889344 - RNA, 16 nt, Human
cugccgcagagcuggc

SEQ ID NO: 1889345 - RNA, 19 nt, Human
cugccgcagcccugcagag

SEQ ID NO: 1889346 - RNA, 20 nt, Human
cugccgcagcccugcagagg

SEQ ID NO: 1889347 - RNA, 21 nt, Human
cugccgcagcccugcagaggg

SEQ ID NO: 1889348 - RNA, 22 nt, Human
cugccgcagcccugcagagggc

SEQ ID NO: 1889349 - RNA, 19 nt, Human
cugccucagccucccaaag

SEQ ID NO: 1889350 - RNA, 18 nt, Human
cugccucagccucccaag

SEQ ID NO: 1889351 - RNA, 10 nt, Human
cugccucagg

SEQ ID NO: 1889352 - RNA, 15 nt, Human
cugccucagccuccc

SEQ ID NO: 1889353 - RNA, 15 nt, Human
cugccucucugcagg

SEQ ID NO: 1889354 - RNA, 16 nt, Human
cugccucucugcaggu

SEQ ID NO: 1889355 - RNA, 17 nt, Human
cugccucucugcagguc

SEQ ID NO: 1889356 - RNA, 18 nt, Human
cugccucucugcaggucc

SEQ ID NO: 1889357 - RNA, 14 nt, Human
cugccuccagggcu

SEQ ID NO: 1889358 - RNA, 23 nt, Human
cugccuccagggcuggacugagg

SEQ ID NO: 1889359 - RNA, 22 nt, Human
cugccuccagggcuggacugag

SEQ ID NO: 1889360 - RNA, 20 nt, Human
cugccuccagggcuggacug

SEQ ID NO: 1889361 - RNA, 19 nt, Human
cugccuccagggcuggacu

SEQ ID NO: 1889362 - RNA, 18 nt, Human
cugccuccagggcuggac

SEQ ID NO: 1889363 - RNA, 17 nt, Human
cugccuccagggcugga

SEQ ID NO: 1889364 - RNA, 16 nt, Human
cugccuccagggcugg

SEQ ID NO: 1889365 - RNA, 15 nt, Human
cugccuccagggcug

SEQ ID NO: 1889366 - RNA, 13 nt, Human
cucugugugcucc

SEQ ID NO: 1889367 - RNA, 21 nt, Human
cucugugucugaguggcuuca

SEQ ID NO: 1889368 - RNA, 20 nt, Human
cucuguugcccaggcuggag

SEQ ID NO: 1889369 - RNA, 22 nt, Human
cucuguugcccaggcuggagug

SEQ ID NO: 1889370 - RNA, 14 nt, Human
cucugugucugagu

SEQ ID NO: 1889371 - RNA, 20 nt, Human
cucugugucugaguggcuuc

SEQ ID NO: 1889372 - RNA, 13 nt, Human
cucuguuuaugcu

SEQ ID NO: 1889373 - RNA, 15 nt, Human
cucuguuuaugcuuu

SEQ ID NO: 1889374 - RNA, 23 nt, Human
cucugugucagguggggcagcuu

SEQ ID NO: 1889375 - RNA, 22 nt, Human
cucugugucagguggggcagcu

SEQ ID NO: 1889376 - RNA, 21 nt, Human
cucugugucagguggggcagc

SEQ ID NO: 1889377 - RNA, 20 nt, Human
cucugugucagguggggcag

SEQ ID NO: 1889378 - RNA, 23 nt, Human
cucugugaacgauuuagaaagaa

SEQ ID NO: 1889379 - RNA, 18 nt, Human
cucugugaacgauuuaga

SEQ ID NO: 1889380 - RNA, 21 nt, Human
cucugugaacgauuuagaaag

SEQ ID NO: 1889381 - RNA, 13 nt, Human
cucuucuccaggc

SEQ ID NO: 1889382 - RNA, 15 nt, Human
cucuucuccaggcug

SEQ ID NO: 1889383 - RNA, 19 nt, Human
cucuucucauuucaccccu

SEQ ID NO: 1889384 - RNA, 15 nt, Human
cucuucucauuucac

SEQ ID NO: 1889385 - RNA, 12 nt, Human
cucuucucauuu

SEQ ID NO: 1889386 - RNA, 11 nt, Human
cucuucucauu

SEQ ID NO: 1889387 - RNA, 14 nt, Human
cucuucucagccac

SEQ ID NO: 1889388 - RNA, 15 nt, Human
cucuucucagccacu

SEQ ID NO: 1889389 - RNA, 20 nt, Human
cucugccucugacacacagc

SEQ ID NO: 1889390 - RNA, 19 nt, Human
cucugccucugacacacag

SEQ ID NO: 1889391 - RNA, 21 nt, Human
cucugccucccaucacccgcu

SEQ ID NO: 1889392 - RNA, 10 nt, Human
cucugccuga

SEQ ID NO: 1889393 - RNA, 19 nt, Human
cucuggauuauauuaugaa

SEQ ID NO: 1889394 - RNA, 20 nt, Human
cucuggauuauauuaugaag

SEQ ID NO: 1889395 - RNA, 23 nt, Human
cucuggcagcucagagagggugg

SEQ ID NO: 1889396 - RNA, 22 nt, Human
cucuggccuucggccuccaucc

SEQ ID NO: 1889397 - RNA, 21 nt, Human
cucuggccuucggccuccauc

SEQ ID NO: 1889398 - RNA, 22 nt, Human
cucuguccugggagugagcugg

SEQ ID NO: 1889399 - RNA, 15 nt, Human
cucuguccugggagu

SEQ ID NO: 1889400 - RNA, 14 nt, Human
cucuguccugggag

SEQ ID NO: 1889401 - RNA, 20 nt, Human
cucugggccauucuccacag

SEQ ID NO: 1889402 - RNA, 13 nt, Human
cucugucgcccag

SEQ ID NO: 1889403 - RNA, 17 nt, Human
cucugucgcccagucug

SEQ ID NO: 1889404 - RNA, 19 nt, Human
cucugucgcccagucugga

SEQ ID NO: 1889405 - RNA, 18 nt, Human
cucugucgcccagucugg

SEQ ID NO: 1889406 - RNA, 15 nt, Human
cucugcauucuagua

SEQ ID NO: 1889407 - RNA, 14 nt, Human
cucugcauucuagu

SEQ ID NO: 1889408 - RNA, 21 nt, Human
cucugcaggucccuaauaaag

SEQ ID NO: 1889409 - RNA, 22 nt, Human
cucugcaggucccuaauaaagc

SEQ ID NO: 1889410 - RNA, 18 nt, Human
cucugcaggucccuaaua

SEQ ID NO: 1889411 - RNA, 12 nt, Human
cucugaguguga

SEQ ID NO: 1889412 - RNA, 15 nt, Human
cucugauacagaaaa

SEQ ID NO: 1889413 - RNA, 13 nt, Human
cucugcacaagcu

SEQ ID NO: 1889414 - RNA, 19 nt, Human
cucugcaggucccuaauaa

SEQ ID NO: 1889415 - RNA, 20 nt, Human
cucugcaggucccuaauaaa

SEQ ID NO: 1889416 - RNA, 14 nt, Human
cucugcacaagcug

SEQ ID NO: 1889417 - RNA, 15 nt, Human
cucugcacaagcugc

SEQ ID NO: 1889418 - RNA, 18 nt, Human
cucugcccacucccugca

SEQ ID NO: 1889419 - RNA, 20 nt, Human
cucugcccacucccugcaac

SEQ ID NO: 1889420 - RNA, 17 nt, Human
cucugccccauccucca

SEQ ID NO: 1889421 - RNA, 21 nt, Human
cucugccccauccuccagcag

SEQ ID NO: 1889422 - RNA, 22 nt, Human
cucugccccauccuccagcagg

SEQ ID NO: 1889423 - RNA, 24 nt, Human
cucugccccauccuccagcaggga

SEQ ID NO: 1889424 - RNA, 14 nt, Human
cucugcccaacccu

SEQ ID NO: 1889425 - RNA, 20 nt, Human
cucugcccaacccuucccuc

SEQ ID NO: 1889426 - RNA, 15 nt, Human
cucugccccauccuc

SEQ ID NO: 1889427 - RNA, 13 nt, Human
cucugcccacucc

SEQ ID NO: 1889428 - RNA, 15 nt, Human
cucugcccacucccu

SEQ ID NO: 1889429 - RNA, 16 nt, Human
cucugcccacucccug

SEQ ID NO: 1889430 - RNA, 17 nt, Human
cucugcccacucccugc

SEQ ID NO: 1889431 - RNA, 13 nt, Human
cucugccucccau

SEQ ID NO: 1889432 - RNA, 14 nt, Human
cucugccucccauc

SEQ ID NO: 1889433 - RNA, 16 nt, Human
cucugccucccaucac

SEQ ID NO: 1889434 - RNA, 17 nt, Human
cucugccucccaucacc

SEQ ID NO: 1889435 - RNA, 22 nt, Human
cucugaaggacauugcggacag

SEQ ID NO: 1889436 - RNA, 19 nt, Human
cucugaauuugagauacaa

SEQ ID NO: 1889437 - RNA, 19 nt, Human
cucugaaggguaauuauau

SEQ ID NO: 1889438 - RNA, 19 nt, Human
cucugacacacagcucugu

SEQ ID NO: 1889439 - RNA, 23 nt, Human
cucugacagaagaaccccagggu

SEQ ID NO: 1889440 - RNA, 18 nt, Human
cucugacacacagcucug

SEQ ID NO: 1889441 - RNA, 17 nt, Human
cucugacacacagcucu

SEQ ID NO: 1889442 - RNA, 16 nt, Human
cucugacacacagcuc

SEQ ID NO: 1889443 - RNA, 15 nt, Human
cucugacacacagcu

SEQ ID NO: 1889444 - RNA, 14 nt, Human
cucugacacacagc

SEQ ID NO: 1889445 - RNA, 21 nt, Human
cucugagacucgcgacaaugc

SEQ ID NO: 1889446 - RNA, 14 nt, Human
cucugaggacacua

SEQ ID NO: 1889447 - RNA, 12 nt, Human
cucugaggacac

SEQ ID NO: 1889448 - RNA, 16 nt, Human
cucugaggacacuaac

SEQ ID NO: 1889449 - RNA, 23 nt, Human
cucugagacucgcgacaaugcaa

SEQ ID NO: 1889450 - RNA, 13 nt, Human
cucugaggaagcu

SEQ ID NO: 1889451 - RNA, 12 nt, Human
cucuuuguaaga

SEQ ID NO: 1889452 - RNA, 20 nt, Human
cucuuuguucuaaagaugga

SEQ ID NO: 1889453 - RNA, 14 nt, Human
cucuuuucaaaaca

SEQ ID NO: 1889454 - RNA, 23 nt, Human
cugaaagggacgcuacccgggaa

SEQ ID NO: 1889455 - RNA, 19 nt, Human
cugaaagugaaaguccaga

SEQ ID NO: 1889456 - RNA, 23 nt, Human
cugaaagugaaaguccagaaacu

SEQ ID NO: 1889457 - RNA, 16 nt, Human
cucuucuccaggcugu

SEQ ID NO: 1889458 - RNA, 22 nt, Human
cucuuuggucuacacugugcug

SEQ ID NO: 1889459 - RNA, 23 nt, Human
cucuuuggucuacacugugcuga

SEQ ID NO: 1889460 - RNA, 15 nt, Human
cugaacauuccagag

SEQ ID NO: 1889461 - RNA, 19 nt, Human
cugaacaauaggcuguucc

SEQ ID NO: 1889462 - RNA, 21 nt, Human
cugaacaauaggcuguuccca

SEQ ID NO: 1889463 - RNA, 14 nt, Human
cugaagaaccaguc

SEQ ID NO: 1889464 - RNA, 15 nt, Human
cugaagaaccagucc

SEQ ID NO: 1889465 - RNA, 22 nt, Human
cugaagaaccaguccccccacc

SEQ ID NO: 1889466 - RNA, 16 nt, Human
cugaaccccucccucc

SEQ ID NO: 1889467 - RNA, 20 nt, Human
cugaaauaaacgucuuaaau

SEQ ID NO: 1889468 - RNA, 19 nt, Human
cugaaugguuuucaaaaua

SEQ ID NO: 1889469 - RNA, 20 nt, Human
cugaaugguuuucaaaauaa

SEQ ID NO: 1889470 - RNA, 12 nt, Human
cugaauuauuuu

SEQ ID NO: 1889471 - RNA, 12 nt, Human
cugaauuucuuu

SEQ ID NO: 1889472 - RNA, 15 nt, Human
cugaauuaugaaacu

SEQ ID NO: 1889473 - RNA, 14 nt, Human
cugaauuaugaaac

SEQ ID NO: 1889474 - RNA, 13 nt, Human
cugaauuaugaaa

SEQ ID NO: 1889475 - RNA, 23 nt, Human
cugaauuaucuauacauaucuuu

SEQ ID NO: 1889476 - RNA, 17 nt, Human
cugaagucacacaguga

SEQ ID NO: 1889477 - RNA, 19 nt, Human
cugaagucacacagugagu

SEQ ID NO: 1889478 - RNA, 18 nt, Human
cugaagucacacagugag

SEQ ID NO: 1889479 - RNA, 21 nt, Human
cugaagucacacagugagucg

SEQ ID NO: 1889480 - RNA, 17 nt, Human
cugaaguucagcugcau

SEQ ID NO: 1889481 - RNA, 19 nt, Human
cugaaguucagccacccug

SEQ ID NO: 1889482 - RNA, 22 nt, Human
cugaagucccagauacuugggg

SEQ ID NO: 1889483 - RNA, 17 nt, Human
cugaagucuuuguacag

SEQ ID NO: 1889484 - RNA, 20 nt, Human
cugaagucuuuguacagaca

SEQ ID NO: 1889485 - RNA, 15 nt, Human
cugagccagauuuca

SEQ ID NO: 1889486 - RNA, 13 nt, Human
cugagccagauuu

SEQ ID NO: 1889487 - RNA, 14 nt, Human
cugagccagauuuc

SEQ ID NO: 1889488 - RNA, 12 nt, Human
cugagcaggugu

SEQ ID NO: 1889489 - RNA, 21 nt, Human
cugagauuucaucugcucucc

SEQ ID NO: 1889490 - RNA, 20 nt, Human
cugagauuucaucugcucuc

SEQ ID NO: 1889491 - RNA, 19 nt, Human
cugagauuucaucugcucu

SEQ ID NO: 1889492 - RNA, 18 nt, Human
cugagauuucaucugcuc

SEQ ID NO: 1889493 - RNA, 16 nt, Human
cugagauuucaucugc

SEQ ID NO: 1889494 - RNA, 15 nt, Human
cugagauuucaucug

SEQ ID NO: 1889495 - RNA, 14 nt, Human
cugagauuucaucu

SEQ ID NO: 1889496 - RNA, 22 nt, Human
cugagauuucaucugcucuccu

SEQ ID NO: 1889497 - RNA, 20 nt, Human
cugagcaacucuugauuauc

SEQ ID NO: 1889498 - RNA, 20 nt, Human
cugagacagcccgggcucug

SEQ ID NO: 1889499 - RNA, 19 nt, Human
cugagacagcccgggcucu

SEQ ID NO: 1889500 - RNA, 21 nt, Human
cugagacagcccgggcucugc

SEQ ID NO: 1889501 - RNA, 22 nt, Human
cugagacagcccgggcucugcc

SEQ ID NO: 1889502 - RNA, 20 nt, Human
cugacugucucccgggacua

SEQ ID NO: 1889503 - RNA, 18 nt, Human
cugacagacacaggcccg

SEQ ID NO: 1889504 - RNA, 17 nt, Human
cugacagacacaggccc

SEQ ID NO: 1889505 - RNA, 20 nt, Human
cugaccagcagcgccuuucc

SEQ ID NO: 1889506 - RNA, 21 nt, Human
cugaccagcagcgccuuuccc

SEQ ID NO: 1889507 - RNA, 22 nt, Human
cugaccagcagcgccuuuccca

SEQ ID NO: 1889508 - RNA, 16 nt, Human
cugacagacacaggcc

SEQ ID NO: 1889509 - RNA, 14 nt, Human
cugaauuucuuuug

SEQ ID NO: 1889510 - RNA, 16 nt, Human
cugaauuaugaaacuu

SEQ ID NO: 1889511 - RNA, 15 nt, Human
cugacggccagggag

SEQ ID NO: 1889512 - RNA, 19 nt, Human
cugacggccagggagaagc

SEQ ID NO: 1889513 - RNA, 20 nt, Human
cugacggccagggagaagcu

SEQ ID NO: 1889514 - RNA, 21 nt, Human
cugacggccagggagaagcuc

SEQ ID NO: 1889515 - RNA, 18 nt, Human
cugacguagcugcaaagg

SEQ ID NO: 1889516 - RNA, 23 nt, Human
cugacguagcugcaaaggacaga

SEQ ID NO: 1889517 - RNA, 22 nt, Human
cugacguagcugcaaaggacag

SEQ ID NO: 1889518 - RNA, 22 nt, Human
cuccuuggugccuggccuggca

SEQ ID NO: 1889519 - RNA, 19 nt, Human
cuccuuggugccuggccug

SEQ ID NO: 1889520 - RNA, 15 nt, Human
cuccuuggugccugg

SEQ ID NO: 1889521 - RNA, 19 nt, Human
cucgagaacuuucauuuuu

SEQ ID NO: 1889522 - RNA, 13 nt, Human
cucgagcaugccu

SEQ ID NO: 1889523 - RNA, 15 nt, Human
cucgagcaugccugg

SEQ ID NO: 1889524 - RNA, 16 nt, Human
cucgagcaugccugga

SEQ ID NO: 1889525 - RNA, 19 nt, Human
cucgagcaugccuggaugg

SEQ ID NO: 1889526 - RNA, 14 nt, Human
cuccuuggugccug

SEQ ID NO: 1889527 - RNA, 23 nt, Human
cuccuuggugucgggcaugacac

SEQ ID NO: 1889528 - RNA, 15 nt, Human
cuccuuccugugugu

SEQ ID NO: 1889529 - RNA, 20 nt, Human
cuccuuccuggagcccagag

SEQ ID NO: 1889530 - RNA, 13 nt, Human
cuccuuccugugu

SEQ ID NO: 1889531 - RNA, 23 nt, Human
cuccuuccuggagcccagaggag

SEQ ID NO: 1889532 - RNA, 20 nt, Human
cucgcccugcgguagauggg

SEQ ID NO: 1889533 - RNA, 13 nt, Human
cucgcaggaagac

SEQ ID NO: 1889534 - RNA, 22 nt, Human
cucgagcaugccuggauggggc

SEQ ID NO: 1889535 - RNA, 14 nt, Human
cucgauuucuccag

SEQ ID NO: 1889536 - RNA, 17 nt, Human
cucgauucauauugaau

SEQ ID NO: 1889537 - RNA, 12 nt, Human
cucgcaggaaga

SEQ ID NO: 1889538 - RNA, 21 nt, Human
cuccugccucgaacuggcugc

SEQ ID NO: 1889539 - RNA, 20 nt, Human
cuccugccucgaacuggcug

SEQ ID NO: 1889540 - RNA, 18 nt, Human
cuccugccucgaacuggc

SEQ ID NO: 1889541 - RNA, 21 nt, Human
cuccugccucagccuccugag

SEQ ID NO: 1889542 - RNA, 22 nt, Human
cuccugccucgaacuggcugca

SEQ ID NO: 1889543 - RNA, 15 nt, Human
cuccucuccccagca

SEQ ID NO: 1889544 - RNA, 13 nt, Human
cuccucuccccag

SEQ ID NO: 1889545 - RNA, 17 nt, Human
cuccugccgcagagcug

SEQ ID NO: 1889546 - RNA, 16 nt, Human
cuccugccgcagagcu

SEQ ID NO: 1889547 - RNA, 14 nt, Human
cuccucuccccagc

SEQ ID NO: 1889548 - RNA, 18 nt, Human
cuccugccgcagagcugg

SEQ ID NO: 1889549 - RNA, 23 nt, Human
cuccucucccauugucccucugc

SEQ ID NO: 1889550 - RNA, 11 nt, Human
cuccugccuca

SEQ ID NO: 1889551 - RNA, 12 nt, Human
cuccugccucag

SEQ ID NO: 1889552 - RNA, 16 nt, Human
cuccugccucagccuc

SEQ ID NO: 1889553 - RNA, 17 nt, Human
cuccugccucagccucc

SEQ ID NO: 1889554 - RNA, 24 nt, Human
cuccugugugugcgccuacaggag

SEQ ID NO: 1889555 - RNA, 23 nt, Human
cuccugugugugcgccuacagga

SEQ ID NO: 1889556 - RNA, 21 nt, Human
cuccugugugugcgccuacag

SEQ ID NO: 1889557 - RNA, 13 nt, Human
cuccugcugggca

SEQ ID NO: 1889558 - RNA, 14 nt, Human
cuccugcuguaaau

SEQ ID NO: 1889559 - RNA, 14 nt, Human
cuccuggaaauauu

SEQ ID NO: 1889560 - RNA, 23 nt, Human
cuccugcuguaaauuuggcuucu

SEQ ID NO: 1889561 - RNA, 20 nt, Human
cuccuuagaaguggaaguag

SEQ ID NO: 1889562 - RNA, 17 nt, Human
cuccuuagaaguggaag

SEQ ID NO: 1889563 - RNA, 13 nt, Human
cuccuuagaagug

SEQ ID NO: 1889564 - RNA, 14 nt, Human
cuccuucccuuccu

SEQ ID NO: 1889565 - RNA, 15 nt, Human
cucccggggcagggc

SEQ ID NO: 1889566 - RNA, 18 nt, Human
cucccggggcagggcagc

SEQ ID NO: 1889567 - RNA, 17 nt, Human
cucccggggcagggcag

SEQ ID NO: 1889568 - RNA, 16 nt, Human
cucccggggcagggca

SEQ ID NO: 1889569 - RNA, 20 nt, Human
cucccgaguagcugggacua

SEQ ID NO: 1889570 - RNA, 19 nt, Human
cucccgaguagcugggacu

SEQ ID NO: 1889571 - RNA, 22 nt, Human
cucccugcaucugaccagcagc

SEQ ID NO: 1889572 - RNA, 23 nt, Human
cucccugcaucugaccagcagcg

SEQ ID NO: 1889573 - RNA, 15 nt, Human
cucccugccuccagg

SEQ ID NO: 1889574 - RNA, 16 nt, Human
cucccugccuccagga

SEQ ID NO: 1889575 - RNA, 18 nt, Human
cucccugccucaggccuc

SEQ ID NO: 1889576 - RNA, 14 nt, Human
cucccugccuccag

SEQ ID NO: 1889577 - RNA, 23 nt, Human
cuccccagcaagugagagcuggg

SEQ ID NO: 1889578 - RNA, 22 nt, Human
cuccccagcaagugagagcugg

SEQ ID NO: 1889579 - RNA, 13 nt, Human
cuccauccugagg

SEQ ID NO: 1889580 - RNA, 14 nt, Human
cuccauccugaggc

SEQ ID NO: 1889581 - RNA, 15 nt, Human
cuccccugcccccag

SEQ ID NO: 1889582 - RNA, 14 nt, Human
cuccccugccccca

SEQ ID NO: 1889583 - RNA, 13 nt, Human
cuccccugccccc

SEQ ID NO: 1889584 - RNA, 23 nt, Human
cuccccugcccccaggacugggc

SEQ ID NO: 1889585 - RNA, 22 nt, Human
cuccccugcccccaggacuggg

SEQ ID NO: 1889586 - RNA, 21 nt, Human
cuccccugcccccaggacugg

SEQ ID NO: 1889587 - RNA, 20 nt, Human
cuccccugcccccaggacug

SEQ ID NO: 1889588 - RNA, 19 nt, Human
cuccccugcccccaggacu

SEQ ID NO: 1889589 - RNA, 18 nt, Human
cuccccugcccccaggac

SEQ ID NO: 1889590 - RNA, 17 nt, Human
cuccccugcccccagga

SEQ ID NO: 1889591 - RNA, 16 nt, Human
cuccccugcccccagg

SEQ ID NO: 1889592 - RNA, 12 nt, Human
cucccuuucaac

SEQ ID NO: 1889593 - RNA, 16 nt, Human
cucccuguuccccaga

SEQ ID NO: 1889594 - RNA, 17 nt, Human
cucccuguuccccagag

SEQ ID NO: 1889595 - RNA, 18 nt, Human
cucccuguuccccagaga

SEQ ID NO: 1889596 - RNA, 19 nt, Human
cucccuguuccccagagaa

SEQ ID NO: 1889597 - RNA, 18 nt, Human
cuccucagaucuucugug

SEQ ID NO: 1889598 - RNA, 12 nt, Human
cuccuccuagcc

SEQ ID NO: 1889599 - RNA, 15 nt, Human
cuccuccucccugca

SEQ ID NO: 1889600 - RNA, 13 nt, Human
cuccuccucccug

SEQ ID NO: 1889601 - RNA, 14 nt, Human
cuccuccucccugc

SEQ ID NO: 1889602 - RNA, 21 nt, Human
cuccucucccauugucccucu

SEQ ID NO: 1889603 - RNA, 15 nt, Human
cuccuccagccgcca

SEQ ID NO: 1889604 - RNA, 17 nt, Human
cuccuccacucuccccc

SEQ ID NO: 1889605 - RNA, 13 nt, Human
cuccuccagaguc

SEQ ID NO: 1889606 - RNA, 15 nt, Human
cuccuccagagucag

SEQ ID NO: 1889607 - RNA, 15 nt, Human
cuccucaguucuugc

SEQ ID NO: 1889608 - RNA, 18 nt, Human
cucauuugucacacacuu

SEQ ID NO: 1889609 - RNA, 16 nt, Human
cuccaaaauaaaacuu

SEQ ID NO: 1889610 - RNA, 15 nt, Human
cuccaaaauaaaacu

SEQ ID NO: 1889611 - RNA, 18 nt, Human
cuccaaaauaaaacuuuu

SEQ ID NO: 1889612 - RNA, 17 nt, Human
cucauuugucacacacu

SEQ ID NO: 1889613 - RNA, 13 nt, Human
cucauuaaaaaaa

SEQ ID NO: 1889614 - RNA, 18 nt, Human
cucauguuuucaacugcc

SEQ ID NO: 1889615 - RNA, 20 nt, Human
cucauguuuucaacugccaa

SEQ ID NO: 1889616 - RNA, 16 nt, Human
cucauguuuucaacug

SEQ ID NO: 1889617 - RNA, 17 nt, Human
cucauguuuucaacugc

SEQ ID NO: 1889618 - RNA, 22 nt, Human
cucaucucuuagcuccccucca

SEQ ID NO: 1889619 - RNA, 20 nt, Human
cucaucucuuagcuccccuc

SEQ ID NO: 1889620 - RNA, 21 nt, Human
cuccaaugcuguuaucccugc

SEQ ID NO: 1889621 - RNA, 23 nt, Human
cuccaaguccacaguggaaccag

SEQ ID NO: 1889622 - RNA, 18 nt, Human
cuccaauuuuuuuuuccu

SEQ ID NO: 1889623 - RNA, 19 nt, Human
cuccaauuuuuuuuuccuu

SEQ ID NO: 1889624 - RNA, 20 nt, Human
cuccacaccauucaggucuu

SEQ ID NO: 1889625 - RNA, 18 nt, Human
cuccacaccauucagguc

SEQ ID NO: 1889626 - RNA, 13 nt, Human
cuccacccugcuc

SEQ ID NO: 1889627 - RNA, 23 nt, Human
cuccaccaagccuggucagccca

SEQ ID NO: 1889628 - RNA, 15 nt, Human
cuccacccugcucuc

SEQ ID NO: 1889629 - RNA, 14 nt, Human
cuccacccuggccg

SEQ ID NO: 1889630 - RNA, 15 nt, Human
cuccacccuggccga

SEQ ID NO: 1889631 - RNA, 12 nt, Human
cuccauccugag

SEQ ID NO: 1889632 - RNA, 18 nt, Human
cuccaggagcagccacau

SEQ ID NO: 1889633 - RNA, 23 nt, Human
cuccaggagcagccacauuccug

SEQ ID NO: 1889634 - RNA, 11 nt, Human
cuccaggagca

SEQ ID NO: 1889635 - RNA, 13 nt, Human
cuccaggagcagc

SEQ ID NO: 1889636 - RNA, 12 nt, Human
cuccaggaacca

SEQ ID NO: 1889637 - RNA, 18 nt, Human
cuccaggaaccacaccac

SEQ ID NO: 1889638 - RNA, 14 nt, Human
cuccaggagcagcc

SEQ ID NO: 1889639 - RNA, 15 nt, Human
cuccaggagcagcca

SEQ ID NO: 1889640 - RNA, 16 nt, Human
cuccaggagcagccac

SEQ ID NO: 1889641 - RNA, 17 nt, Human
cuccaggagcagccaca

SEQ ID NO: 1889642 - RNA, 14 nt, Human
cuccagcucaccag

SEQ ID NO: 1889643 - RNA, 12 nt, Human
cuccagccuggg

SEQ ID NO: 1889644 - RNA, 20 nt, Human
cuccagccccuggaugcagc

SEQ ID NO: 1889645 - RNA, 16 nt, Human
cuccagccccuggaug

SEQ ID NO: 1889646 - RNA, 17 nt, Human
cuccagccccuggaugc

SEQ ID NO: 1889647 - RNA, 15 nt, Human
cuccagccccuggau

SEQ ID NO: 1889648 - RNA, 13 nt, Human
cuccaccugcucu

SEQ ID NO: 1889649 - RNA, 14 nt, Human
cuccaccugccagg

SEQ ID NO: 1889650 - RNA, 12 nt, Human
cuccaccugcca

SEQ ID NO: 1889651 - RNA, 13 nt, Human
cuccaccugccag

SEQ ID NO: 1889652 - RNA, 15 nt, Human
cucagggucccuggu

SEQ ID NO: 1889653 - RNA, 16 nt, Human
cucagggucccuggug

SEQ ID NO: 1889654 - RNA, 17 nt, Human
cucagggucccuggugg

SEQ ID NO: 1889655 - RNA, 18 nt, Human
cucagggucccugguggc

SEQ ID NO: 1889656 - RNA, 16 nt, Human
cucaggugagaagcag

SEQ ID NO: 1889657 - RNA, 19 nt, Human
cucaggugagaagcagagg

SEQ ID NO: 1889658 - RNA, 20 nt, Human
cucaggugagaagcagagga

SEQ ID NO: 1889659 - RNA, 16 nt, Human
cucagggccuggcuca

SEQ ID NO: 1889660 - RNA, 15 nt, Human
cucagggccuggucg

SEQ ID NO: 1889661 - RNA, 14 nt, Human
cucagggccuggcu

SEQ ID NO: 1889662 - RNA, 15 nt, Human
cucagggccuggcuc

SEQ ID NO: 1889663 - RNA, 13 nt, Human
cucagggccuggc

SEQ ID NO: 1889664 - RNA, 10 nt, Human
cucagggcag

SEQ ID NO: 1889665 - RNA, 18 nt, Human
cucagcauccuggcaccc

SEQ ID NO: 1889666 - RNA, 12 nt, Human
cucagccagaga

SEQ ID NO: 1889667 - RNA, 11 nt, Human
cucagccagca

SEQ ID NO: 1889668 - RNA, 13 nt, Human
cucagccagcacu

SEQ ID NO: 1889669 - RNA, 14 nt, Human
cucagccagagaag

SEQ ID NO: 1889670 - RNA, 18 nt, Human
cucaggaguuugagacca

SEQ ID NO: 1889671 - RNA, 23 nt, Human
cucaggaguuugagaccaaccug

SEQ ID NO: 1889672 - RNA, 13 nt, Human
cucaggaucucuu

SEQ ID NO: 1889673 - RNA, 15 nt, Human
cucauccucauaccc

SEQ ID NO: 1889674 - RNA, 19 nt, Human
cucaucucuuagcuccccu

SEQ ID NO: 1889675 - RNA, 17 nt, Human
cucaucucuuagcuccc

SEQ ID NO: 1889676 - RNA, 16 nt, Human
cucaucucucugccca

SEQ ID NO: 1889677 - RNA, 17 nt, Human
cucaucucucugcccaa

SEQ ID NO: 1889678 - RNA, 20 nt, Human
cucaucucuaacagcucagg

SEQ ID NO: 1889679 - RNA, 22 nt, Human
cucaucucuaacagcucaggau

SEQ ID NO: 1889680 - RNA, 23 nt, Human
cucaucucuaacagcucaggauc

SEQ ID NO: 1889681 - RNA, 24 nt, Human
cucaucucuaacagcucaggaucu

SEQ ID NO: 1889682 - RNA, 23 nt, Human
cucauaguaugguggcuggguug

SEQ ID NO: 1889683 - RNA, 21 nt, Human
cucaucaccaacgucugugcc

SEQ ID NO: 1889684 - RNA, 22 nt, Human
cucaucaccaacgucugugcca

SEQ ID NO: 1889685 - RNA, 19 nt, Human
cucaggugauccacccacc

SEQ ID NO: 1889686 - RNA, 18 nt, Human
cucaggugauccacccac

SEQ ID NO: 1889687 - RNA, 20 nt, Human
cucaggugauccacccaccu

SEQ ID NO: 1889688 - RNA, 16 nt, Human
cucauacccaccccca

SEQ ID NO: 1889689 - RNA, 18 nt, Human
cucauacccacccccacc

SEQ ID NO: 1889690 - RNA, 19 nt, Human
cucauacccacccccaccc

SEQ ID NO: 1889691 - RNA, 21 nt, Human
cucauacccacccccacccaa

SEQ ID NO: 1889692 - RNA, 21 nt, Human
cucauaguaugguggcugggu

SEQ ID NO: 1889693 - RNA, 22 nt, Human
cucauacucaccucaccccacu

SEQ ID NO: 1889694 - RNA, 14 nt, Human
cucauacucaccuc

SEQ ID NO: 1889695 - RNA, 15 nt, Human
cucauacccaccccc

SEQ ID NO: 1889696 - RNA, 22 nt, Human
cuaugcacauauggacucugca

SEQ ID NO: 1889697 - RNA, 13 nt, Human
cuaugcauggugc

SEQ ID NO: 1889698 - RNA, 19 nt, Human
cuaugcauggugccccagg

SEQ ID NO: 1889699 - RNA, 20 nt, Human
cuaugcauggugccccagga

SEQ ID NO: 1889700 - RNA, 21 nt, Human
cuaugcauggugccccaggac

SEQ ID NO: 1889701 - RNA, 22 nt, Human
cuaugcauggugccccaggacc

SEQ ID NO: 1889702 - RNA, 23 nt, Human
cuaugcauggugccccaggacca

SEQ ID NO: 1889703 - RNA, 18 nt, Human
cuaugcacauauggacuc

SEQ ID NO: 1889704 - RNA, 13 nt, Human
cuaugcacauaug

SEQ ID NO: 1889705 - RNA, 21 nt, Human
cuaugcacauauggacucugc

SEQ ID NO: 1889706 - RNA, 20 nt, Human
cuaugcacauauggacucug

SEQ ID NO: 1889707 - RNA, 17 nt, Human
cuaugagggccuugagu

SEQ ID NO: 1889708 - RNA, 15 nt, Human
cuaugagggccuuga

SEQ ID NO: 1889709 - RNA, 13 nt, Human
cuaugagggccuu

SEQ ID NO: 1889710 - RNA, 16 nt, Human
cuaugagcuaaauguc

SEQ ID NO: 1889711 - RNA, 17 nt, Human
cuaucuguuuacagugu

SEQ ID NO: 1889712 - RNA, 16 nt, Human
cuaucuguuuacagug

SEQ ID NO: 1889713 - RNA, 13 nt, Human
cuauggccugugg

SEQ ID NO: 1889714 - RNA, 15 nt, Human
cuauuagagaagaga

SEQ ID NO: 1889715 - RNA, 23 nt, Human
cuaugggacucaaugcacugaca

SEQ ID NO: 1889716 - RNA, 22 nt, Human
cuaugggacucaaugcacugac

SEQ ID NO: 1889717 - RNA, 18 nt, Human
cuaugggacucaaugcac

SEQ ID NO: 1889718 - RNA, 17 nt, Human
cuauagccuaggugaca

SEQ ID NO: 1889719 - RNA, 13 nt, Human
cuauauuguacac

SEQ ID NO: 1889720 - RNA, 15 nt, Human
cuauauuguacacac

SEQ ID NO: 1889721 - RNA, 14 nt, Human
cuauauuguacaca

SEQ ID NO: 1889722 - RNA, 17 nt, Human
cuauauuuuacauaaau

SEQ ID NO: 1889723 - RNA, 12 nt, Human
cuauauuugggc

SEQ ID NO: 1889724 - RNA, 22 nt, Human
cuauauuugggccugcuccaga

SEQ ID NO: 1889725 - RNA, 16 nt, Human
cuauaauguaagcucu

SEQ ID NO: 1889726 - RNA, 21 nt, Human
cuauaauguaagcucuacuga

SEQ ID NO: 1889727 - RNA, 22 nt, Human
cuauaauuuaccugaagucuuu

SEQ ID NO: 1889728 - RNA, 12 nt, Human
cuauagacucua

SEQ ID NO: 1889729 - RNA, 14 nt, Human
cuauacauaucuuu

SEQ ID NO: 1889730 - RNA, 15 nt, Human
cuauacauaucuuua

SEQ ID NO: 1889731 - RNA, 17 nt, Human
cuauacauaucuuuauu

SEQ ID NO: 1889732 - RNA, 20 nt, Human
cuauacauaucuuuauuaau

SEQ ID NO: 1889733 - RNA, 22 nt, Human
cuauacauaucuuuauuaauca

SEQ ID NO: 1889734 - RNA, 13 nt, Human
cuagguucuaaaa

SEQ ID NO: 1889735 - RNA, 16 nt, Human
cuaguaaaaauacaaa

SEQ ID NO: 1889736 - RNA, 15 nt, Human
cuagucaagcuccuc

SEQ ID NO: 1889737 - RNA, 16 nt, Human
cuagucaagcuccucc

SEQ ID NO: 1889738 - RNA, 19 nt, Human
cuagucaagcuccuccucc

SEQ ID NO: 1889739 - RNA, 22 nt, Human
cuagucaagcuccuccucccug

SEQ ID NO: 1889740 - RNA, 23 nt, Human
cuagucaagcuccuccucccugc

SEQ ID NO: 1889741 - RNA, 18 nt, Human
cgccagggagaccuggac

SEQ ID NO: 1889742 - RNA, 17 nt, Human
cgccaucccagccccaa

SEQ ID NO: 1889743 - RNA, 22 nt, Human
cgcccaguuggguggaugccug

SEQ ID NO: 1889744 - RNA, 20 nt, Human
cgccaucccagccccaauga

SEQ ID NO: 1889745 - RNA, 15 nt, Human
cgccaugcuccuggc

SEQ ID NO: 1889746 - RNA, 23 nt, Human
cgcccaguuggguggaugccugg

SEQ ID NO: 1889747 - RNA, 22 nt, Human
cuagguaaauuacaguuccuag

SEQ ID NO: 1889748 - RNA, 24 nt, Human
cuaggugacagagugagacucugu

SEQ ID NO: 1889749 - RNA, 18 nt, Human
cuaggugacagagugaga

SEQ ID NO: 1889750 - RNA, 14 nt, Human
cuaggugacagagu

SEQ ID NO: 1889751 - RNA, 19 nt, Human
cucaagaagaagaggggca

SEQ ID NO: 1889752 - RNA, 20 nt, Human
cucaagaagaagaggggcau

SEQ ID NO: 1889753 - RNA, 22 nt, Human
cucaagaaauaaaaggaagcca

SEQ ID NO: 1889754 - RNA, 23 nt, Human
cucaagaaauaaaaggaagccaa

SEQ ID NO: 1889755 - RNA, 21 nt, Human
cucaagaaauaaaaggaagcc

SEQ ID NO: 1889756 - RNA, 14 nt, Human
cucaagacuuccag

SEQ ID NO: 1889757 - RNA, 21 nt, Human
cucaaguccucuuuucugaga

SEQ ID NO: 1889758 - RNA, 16 nt, Human
cucaagacuuccagag

SEQ ID NO: 1889759 - RNA, 17 nt, Human
cucaagugauucuccug

SEQ ID NO: 1889760 - RNA, 22 nt, Human
cucacacaugagcaucaggcca

SEQ ID NO: 1889761 - RNA, 24 nt, Human
cucacacaugagcaucaggccagg

SEQ ID NO: 1889762 - RNA, 23 nt, Human
cucacaccaggcuugccugcagg

SEQ ID NO: 1889763 - RNA, 15 nt, Human
cucacaguccuuacc

SEQ ID NO: 1889764 - RNA, 15 nt, Human
cucacagcugaguug

SEQ ID NO: 1889765 - RNA, 13 nt, Human
cucacagcugagu

SEQ ID NO: 1889766 - RNA, 14 nt, Human
cucaccacccacuu

SEQ ID NO: 1889767 - RNA, 22 nt, Human
cucacauuuauucugcucacau

SEQ ID NO: 1889768 - RNA, 19 nt, Human
cucacauuuauucugcuca

SEQ ID NO: 1889769 - RNA, 15 nt, Human
cucacauuuauucug

SEQ ID NO: 1889770 - RNA, 17 nt, Human
cucacaguccuuaccag

SEQ ID NO: 1889771 - RNA, 19 nt, Human
cucacaguccuuaccagca

SEQ ID NO: 1889772 - RNA, 22 nt, Human
cucacaguccuuaccagcagag

SEQ ID NO: 1889773 - RNA, 23 nt, Human
cucacaguccuuaccagcagagc

SEQ ID NO: 1889774 - RNA, 15 nt, Human
cucaccagccccagu

SEQ ID NO: 1889775 - RNA, 14 nt, Human
cucaccagccccag

SEQ ID NO: 1889776 - RNA, 13 nt, Human
cucaccagcccca

SEQ ID NO: 1889777 - RNA, 18 nt, Human
cucaccagccccagugcc

SEQ ID NO: 1889778 - RNA, 17 nt, Human
cucaccagccccagugc

SEQ ID NO: 1889779 - RNA, 17 nt, Human
cucaaccuccugggcua

SEQ ID NO: 1889780 - RNA, 15 nt, Human
cucaaccuccugggc

SEQ ID NO: 1889781 - RNA, 13 nt, Human
cucaaccuccugg

SEQ ID NO: 1889782 - RNA, 21 nt, Human
cucaacaccucugcacaagcu

SEQ ID NO: 1889783 - RNA, 19 nt, Human
cucaaaugcucagaccagc

SEQ ID NO: 1889784 - RNA, 22 nt, Human
cucaaaugcucagaccagcucu

SEQ ID NO: 1889785 - RNA, 23 nt, Human
cucaaauacgugggcauucaaau

SEQ ID NO: 1889786 - RNA, 16 nt, Human
cucaaaugcucagacc

SEQ ID NO: 1889787 - RNA, 17 nt, Human
cuauuuauauguacaug

SEQ ID NO: 1889788 - RNA, 14 nt, Human
cuauuuaucuucau

SEQ ID NO: 1889789 - RNA, 14 nt, Human
cuauuguagagcca

SEQ ID NO: 1889790 - RNA, 17 nt, Human
cuauuccuguaaugaaa

SEQ ID NO: 1889791 - RNA, 14 nt, Human
cucacucaccuuca

SEQ ID NO: 1889792 - RNA, 23 nt, Human
cucacuauguugcccaggcaggu

SEQ ID NO: 1889793 - RNA, 22 nt, Human
cucacuauguugcccaggcagg

SEQ ID NO: 1889794 - RNA, 21 nt, Human
cucacuauguugcccaggcag

SEQ ID NO: 1889795 - RNA, 20 nt, Human
cucacuauguugcccaggca

SEQ ID NO: 1889796 - RNA, 19 nt, Human
cucacuauguugcccaggc

SEQ ID NO: 1889797 - RNA, 15 nt, Human
cucaccccagcccca

SEQ ID NO: 1889798 - RNA, 14 nt, Human
cucacugcagccuc

SEQ ID NO: 1889799 - RNA, 13 nt, Human
cucacugcagccu

SEQ ID NO: 1889800 - RNA, 12 nt, Human
cucacugcagcc

SEQ ID NO: 1889801 - RNA, 21 nt, Human
cucacucugucgcccagucug

SEQ ID NO: 1889802 - RNA, 13 nt, Human
cucacucugucgc

SEQ ID NO: 1889803 - RNA, 22 nt, Human
cucacucugucgcccagucugg

SEQ ID NO: 1889804 - RNA, 12 nt, Human
cucacucugucg

SEQ ID NO: 1889805 - RNA, 11 nt, Human
cucacucuguc

SEQ ID NO: 1889806 - RNA, 13 nt, Human
cucacuccuugaa

SEQ ID NO: 1889807 - RNA, 17 nt, Human
cucagcauccuggcacc

SEQ ID NO: 1889808 - RNA, 16 nt, Human
cucagcauccuggcac

SEQ ID NO: 1889809 - RNA, 15 nt, Human
cucagaucuucugug

SEQ ID NO: 1889810 - RNA, 14 nt, Human
cucagcacaaggcc

SEQ ID NO: 1889811 - RNA, 20 nt, Human
cucagcacaaggccaucugg

SEQ ID NO: 1889812 - RNA, 20 nt, Human
cucacuguugcccaggcugg

SEQ ID NO: 1889813 - RNA, 19 nt, Human
cucacugccaugccagcuu

SEQ ID NO: 1889814 - RNA, 22 nt, Human
cucacugccaugccagcuuauc

SEQ ID NO: 1889815 - RNA, 22 nt, Human
cucacuguugcccaggcuggcg

SEQ ID NO: 1889816 - RNA, 21 nt, Human
cucacuguugcccaggcuggc

SEQ ID NO: 1889817 - RNA, 18 nt, Human
cucagagagggugggagu

SEQ ID NO: 1889818 - RNA, 13 nt, Human
cucagagugcaag

SEQ ID NO: 1889819 - RNA, 14 nt, Human
cucagagagggugg

SEQ ID NO: 1889820 - RNA, 20 nt, Human
cucagauccagggacagagg

SEQ ID NO: 1889821 - RNA, 22 nt, Human
cucagauccagggacagaggcc

SEQ ID NO: 1889822 - RNA, 15 nt, Human
cucagauccagggac

SEQ ID NO: 1889823 - RNA, 16 nt, Human
cucagauccagggaca

SEQ ID NO: 1889824 - RNA, 17 nt, Human
cucagauccagggacag

SEQ ID NO: 1889825 - RNA, 18 nt, Human
cucagauccagggacaga

SEQ ID NO: 1889826 - RNA, 17 nt, Human
cucagaucaguguacca

SEQ ID NO: 1889827 - RNA, 21 nt, Human
cucagaucaguguaccauuug

SEQ ID NO: 1889828 - RNA, 10 nt, Human
cucagaucca

SEQ ID NO: 1889829 - RNA, 13 nt, Human
cucagauccaggg

SEQ ID NO: 1889830 - RNA, 14 nt, Human
cucagauccaggga

SEQ ID NO: 1889831 - RNA, 22 nt, Human
gagggacgcggcucccggggca

SEQ ID NO: 1889832 - RNA, 17 nt, Human
gagggaccucucccagg

SEQ ID NO: 1889833 - RNA, 18 nt, Human
gagggaccucucccaggg

SEQ ID NO: 1889834 - RNA, 13 nt, Human
gagggaccucucc

SEQ ID NO: 1889835 - RNA, 14 nt, Human
gagggaccucuccc

SEQ ID NO: 1889836 - RNA, 15 nt, Human
gagggaccucuccca

SEQ ID NO: 1889837 - RNA, 14 nt, Human
gagggagggagggc

SEQ ID NO: 1889838 - RNA, 17 nt, Human
gagggaggcaagcccug

SEQ ID NO: 1889839 - RNA, 15 nt, Human
gagggagggagggcu

SEQ ID NO: 1889840 - RNA, 15 nt, Human
gagggagggcuccag

SEQ ID NO: 1889841 - RNA, 19 nt, Human
gagggaacggaaauaaagg

SEQ ID NO: 1889842 - RNA, 20 nt, Human
gaggcuuuggauuugacauu

SEQ ID NO: 1889843 - RNA, 14 nt, Human
gaggcuuuggauuu

SEQ ID NO: 1889844 - RNA, 16 nt, Human
gaggcuuuggauuuga

SEQ ID NO: 1889845 - RNA, 16 nt, Human
gagggagugacagagg

SEQ ID NO: 1889846 - RNA, 16 nt, Human
gagggagggcuccaga

SEQ ID NO: 1889847 - RNA, 14 nt, Human
gagggagugacaga

SEQ ID NO: 1889848 - RNA, 13 nt, Human
gagggagugacag

SEQ ID NO: 1889849 - RNA, 14 nt, Human
gagggagguaagga

SEQ ID NO: 1889850 - RNA, 23 nt, Human
gagggcacagaaaauggaagaca

SEQ ID NO: 1889851 - RNA, 14 nt, Human
gagggcacagaaaa

SEQ ID NO: 1889852 - RNA, 22 nt, Human
gagggcacagaaaauggaagac

SEQ ID NO: 1889853 - RNA, 22 nt, Human
gaggggccucuuaugggcuggg

SEQ ID NO: 1889854 - RNA, 22 nt, Human
gagggcagcagaaggggguggu

SEQ ID NO: 1889855 - RNA, 21 nt, Human
gagggcagcagaagggggugg

SEQ ID NO: 1889856 - RNA, 19 nt, Human
gagggcagcagaagggggu

SEQ ID NO: 1889857 - RNA, 15 nt, Human
gaggccagugagcca

SEQ ID NO: 1889858 - RNA, 19 nt, Human
gaggcccccaucuccuuaa

SEQ ID NO: 1889859 - RNA, 22 nt, Human
gaggccccuauguaguccgugc

SEQ ID NO: 1889860 - RNA, 24 nt, Human
gaggccccuauguaguccgugcug

SEQ ID NO: 1889861 - RNA, 20 nt, Human
gaggccccugucucagggug

SEQ ID NO: 1889862 - RNA, 17 nt, Human
gaggcccucuggagugg

SEQ ID NO: 1889863 - RNA, 19 nt, Human
gaggcccucuggaguggcc

SEQ ID NO: 1889864 - RNA, 24 nt, Human
gaggcccuucucuccagccccugg

SEQ ID NO: 1889865 - RNA, 14 nt, Human
gaggcccuucucuc

SEQ ID NO: 1889866 - RNA, 23 nt, Human
gaggcccuucucuccagccccug

SEQ ID NO: 1889867 - RNA, 20 nt, Human
gaggccugccuccagggcug

SEQ ID NO: 1889868 - RNA, 19 nt, Human
gaggccugccuccagggcu

SEQ ID NO: 1889869 - RNA, 22 nt, Human
gaggccugccuccagggcugga

SEQ ID NO: 1889870 - RNA, 21 nt, Human
gaggccugccuccagggcugg

SEQ ID NO: 1889871 - RNA, 20 nt, Human
gaggccugagcgcuccugcc

SEQ ID NO: 1889872 - RNA, 14 nt, Human
gaggccuucucuga

SEQ ID NO: 1889873 - RNA, 19 nt, Human
gaggcggaucuuuggacag

SEQ ID NO: 1889874 - RNA, 20 nt, Human
gaggcggccccggccggggu

SEQ ID NO: 1889875 - RNA, 11 nt, Human
gaggccuucca

SEQ ID NO: 1889876 - RNA, 13 nt, Human
gaggcugggcucc

SEQ ID NO: 1889877 - RNA, 14 nt, Human
gaggcugggcuccc

SEQ ID NO: 1889878 - RNA, 19 nt, Human
gaggcggguggaucacuug

SEQ ID NO: 1889879 - RNA, 23 nt, Human
gaggcuaaauuacucaggaagaa

SEQ ID NO: 1889880 - RNA, 15 nt, Human
gaggcugggcucccu

SEQ ID NO: 1889881 - RNA, 19 nt, Human
gaggagcugggagccgggc

SEQ ID NO: 1889882 - RNA, 18 nt, Human
gaggagcucaggacacua

SEQ ID NO: 1889883 - RNA, 23 nt, Human
gaggacagggaggugaccccagg

SEQ ID NO: 1889884 - RNA, 22 nt, Human
gaggacagggaggugaccccag

SEQ ID NO: 1889885 - RNA, 13 nt, Human
gaggacagggagg

SEQ ID NO: 1889886 - RNA, 15 nt, Human
gaggaauccagaccc

SEQ ID NO: 1889887 - RNA, 14 nt, Human
gaggaauccagacc

SEQ ID NO: 1889888 - RNA, 22 nt, Human
gaggaaggaaacccagcucugg

SEQ ID NO: 1889889 - RNA, 13 nt, Human
gaggccagccuug

SEQ ID NO: 1889890 - RNA, 12 nt, Human
gaggccagccuu

SEQ ID NO: 1889891 - RNA, 22 nt, Human
gaggcagccccauucugccugc

SEQ ID NO: 1889892 - RNA, 23 nt, Human
gaggcagccccauucugccugcc

SEQ ID NO: 1889893 - RNA, 13 nt, Human
gaggcagccccau

SEQ ID NO: 1889894 - RNA, 23 nt, Human
gaggaguuugggguaugggagag

SEQ ID NO: 1889895 - RNA, 18 nt, Human
gaggaggggccgcugcca

SEQ ID NO: 1889896 - RNA, 16 nt, Human
gaggaggggccgcugc

SEQ ID NO: 1889897 - RNA, 17 nt, Human
gaggaggggccgcugcc

SEQ ID NO: 1889898 - RNA, 19 nt, Human
gaggagguaaugaauuaaa

SEQ ID NO: 1889899 - RNA, 16 nt, Human
gaggauugcuugagcu

SEQ ID NO: 1889900 - RNA, 20 nt, Human
gaggauguucugggacacag

SEQ ID NO: 1889901 - RNA, 17 nt, Human
gaggauguucugggaca

SEQ ID NO: 1889902 - RNA, 12 nt, Human
gaggauguucug

SEQ ID NO: 1889903 - RNA, 15 nt, Human
gaggaugucugggcc

SEQ ID NO: 1889904 - RNA, 17 nt, Human
gagccuggugcugcugc

SEQ ID NO: 1889905 - RNA, 16 nt, Human
gagccuggugcugcug

SEQ ID NO: 1889906 - RNA, 13 nt, Human
gagccugggaggu

SEQ ID NO: 1889907 - RNA, 21 nt, Human
gagccugggaggucaaggcug

SEQ ID NO: 1889908 - RNA, 15 nt, Human
gagccuggcaagaau

SEQ ID NO: 1889909 - RNA, 10 nt, Human
gagccuggca

SEQ ID NO: 1889910 - RNA, 13 nt, Human
gagcuacaaaugc

SEQ ID NO: 1889911 - RNA, 12 nt, Human
gagcuacaaaug

SEQ ID NO: 1889912 - RNA, 19 nt, Human
gagcggugcuguccucagg

SEQ ID NO: 1889913 - RNA, 20 nt, Human
gagccuccugcccuuaccug

SEQ ID NO: 1889914 - RNA, 22 nt, Human
gagccuccugcccuuaccugcc

SEQ ID NO: 1889915 - RNA, 12 nt, Human
gagccugcagag

SEQ ID NO: 1889916 - RNA, 15 nt, Human
gagccugcagagcug

SEQ ID NO: 1889917 - RNA, 17 nt, Human
gagcccugguggcagug

SEQ ID NO: 1889918 - RNA, 19 nt, Human
gagccucagcauccuggca

SEQ ID NO: 1889919 - RNA, 16 nt, Human
gagcccugguggcagu

SEQ ID NO: 1889920 - RNA, 15 nt, Human
gagcccugguggcag

SEQ ID NO: 1889921 - RNA, 21 nt, Human
gagccucagcauccuggcacc

SEQ ID NO: 1889922 - RNA, 20 nt, Human
gagccucagcauccuggcac

SEQ ID NO: 1889923 - RNA, 14 nt, Human
gagccuccugcccu

SEQ ID NO: 1889924 - RNA, 19 nt, Human
gagcuuccuguccucccag

SEQ ID NO: 1889925 - RNA, 10 nt, Human
gagcuucucu

SEQ ID NO: 1889926 - RNA, 14 nt, Human
gagcuucucuguga

SEQ ID NO: 1889927 - RNA, 16 nt, Human
gagcuucucugugaac

SEQ ID NO: 1889928 - RNA, 13 nt, Human
gagcugccaccug

SEQ ID NO: 1889929 - RNA, 15 nt, Human
gagcugccaccugcc

SEQ ID NO: 1889930 - RNA, 16 nt, Human
gagcugccaccugccu

SEQ ID NO: 1889931 - RNA, 19 nt, Human
gagcugcaggggcauggga

SEQ ID NO: 1889932 - RNA, 18 nt, Human
gagcuccaacucagaagg

SEQ ID NO: 1889933 - RNA, 19 nt, Human
gagcuccaacucagaaggg

SEQ ID NO: 1889934 - RNA, 22 nt, Human
gagcucccaggugcagccagag

SEQ ID NO: 1889935 - RNA, 14 nt, Human
gagcuacaaaugca

SEQ ID NO: 1889936 - RNA, 23 nt, Human
gagcuacacaggggaaaagagga

SEQ ID NO: 1889937 - RNA, 18 nt, Human
gagcuacccgcagaguuc

SEQ ID NO: 1889938 - RNA, 14 nt, Human
gagcucaggacacu

SEQ ID NO: 1889939 - RNA, 17 nt, Human
gagcucaggacacuaau

SEQ ID NO: 1889940 - RNA, 13 nt, Human
gagcacacccagc

SEQ ID NO: 1889941 - RNA, 15 nt, Human
gagcacacccagccc

SEQ ID NO: 1889942 - RNA, 16 nt, Human
gagcacacccagcccc

SEQ ID NO: 1889943 - RNA, 19 nt, Human
gagcaccuuagacaguccc

SEQ ID NO: 1889944 - RNA, 17 nt, Human
gagcaccuuagacaguc

SEQ ID NO: 1889945 - RNA, 21 nt, Human
gagcaagacgcugugcugccc

SEQ ID NO: 1889946 - RNA, 18 nt, Human
gagcaagacgcugugcug

SEQ ID NO: 1889947 - RNA, 22 nt, Human
gagcaagacgcugugcugcccu

SEQ ID NO: 1889948 - RNA, 23 nt, Human
gagcaagacgcugugcugcccug

SEQ ID NO: 1889949 - RNA, 19 nt, Human
gagcaaaaucgaugcagug

SEQ ID NO: 1889950 - RNA, 20 nt, Human
gagaucaaccccuucgcucc

SEQ ID NO: 1889951 - RNA, 14 nt, Human
gaaugcuguacauc

SEQ ID NO: 1889952 - RNA, 15 nt, Human
gaaugcuguacaucu

SEQ ID NO: 1889953 - RNA, 17 nt, Human
gaaugcuguacaucuau

SEQ ID NO: 1889954 - RNA, 20 nt, Human
gaaugcuguacaucuauuuu

SEQ ID NO: 1889955 - RNA, 13 nt, Human
gaaugcuguacau

SEQ ID NO: 1889956 - RNA, 21 nt, Human
gaaugcugcaggacuugagaa

SEQ ID NO: 1889957 - RNA, 13 nt, Human
gagaucagccugg

SEQ ID NO: 1889958 - RNA, 14 nt, Human
gagaucagccuggg

SEQ ID NO: 1889959 - RNA, 16 nt, Human
gagaucagccugggca

SEQ ID NO: 1889960 - RNA, 15 nt, Human
gagccacuccggccc

SEQ ID NO: 1889961 - RNA, 13 nt, Human
gagccacugcacc

SEQ ID NO: 1889962 - RNA, 18 nt, Human
gagccaccgcgcccagcc

SEQ ID NO: 1889963 - RNA, 18 nt, Human
gagcaggcggugggcacc

SEQ ID NO: 1889964 - RNA, 22 nt, Human
gagcaggcggugggcacccacc

SEQ ID NO: 1889965 - RNA, 18 nt, Human
gagcagccacauuccuga

SEQ ID NO: 1889966 - RNA, 13 nt, Human
gagcccaggccuc

SEQ ID NO: 1889967 - RNA, 14 nt, Human
gagcccaggccucc

SEQ ID NO: 1889968 - RNA, 12 nt, Human
gagcccacgccc

SEQ ID NO: 1889969 - RNA, 15 nt, Human
gagcccacgccccca

SEQ ID NO: 1889970 - RNA, 16 nt, Human
gagcccacgcccccac

SEQ ID NO: 1889971 - RNA, 12 nt, Human
gagcccaggccu

SEQ ID NO: 1889972 - RNA, 22 nt, Human
gagccacugcaccgggccacag

SEQ ID NO: 1889973 - RNA, 11 nt, Human
gagcccacgcc

SEQ ID NO: 1889974 - RNA, 17 nt, Human
gagccaugggcacaaag

SEQ ID NO: 1889975 - RNA, 18 nt, Human
gagccaugggcacaaagg

SEQ ID NO: 1889976 - RNA, 15 nt, Human
gaguucuugugccau

SEQ ID NO: 1889977 - RNA, 13 nt, Human
gaguuccuagcca

SEQ ID NO: 1889978 - RNA, 21 nt, Human
gaguugaaaaucuuauaauuu

SEQ ID NO: 1889979 - RNA, 14 nt, Human
gaguugaagacaga

SEQ ID NO: 1889980 - RNA, 17 nt, Human
gagugugccugaagucc

SEQ ID NO: 1889981 - RNA, 21 nt, Human
gaguuagaauaauaaauauuu

SEQ ID NO: 1889982 - RNA, 22 nt, Human
gaguuagaauaauaaauauuua

SEQ ID NO: 1889983 - RNA, 16 nt, Human
gaguuagaauaauaaa

SEQ ID NO: 1889984 - RNA, 23 nt, Human
gaguucaucuugaauuguaagga

SEQ ID NO: 1889985 - RNA, 18 nt, Human
gaguuaucuaaaagaaau

SEQ ID NO: 1889986 - RNA, 16 nt, Human
gaguuaucuaaaagaa

SEQ ID NO: 1889987 - RNA, 23 nt, Human
gagugaacaaauuuacagagaca

SEQ ID NO: 1889988 - RNA, 22 nt, Human
gagugaacaaauuuacagagac

SEQ ID NO: 1889989 - RNA, 11 nt, Human
gaguggccacu

SEQ ID NO: 1889990 - RNA, 19 nt, Human
gagugaacaaauuuacaga

SEQ ID NO: 1889991 - RNA, 12 nt, Human
gagugggcccaa

SEQ ID NO: 1889992 - RNA, 23 nt, Human
gagugggggaucacagccucuga

SEQ ID NO: 1889993 - RNA, 15 nt, Human
gaguggcuucacucc

SEQ ID NO: 1889994 - RNA, 19 nt, Human
gaguggcuucacuccugcu

SEQ ID NO: 1889995 - RNA, 20 nt, Human
gaguggcuucacuccugcug

SEQ ID NO: 1889996 - RNA, 17 nt, Human
gauagcacagacccugc

SEQ ID NO: 1889997 - RNA, 18 nt, Human
gauagcacagacccugcc

SEQ ID NO: 1889998 - RNA, 18 nt, Human
gauacaaugcugugcccu

SEQ ID NO: 1889999 - RNA, 13 nt, Human
gauacaaugcugu

SEQ ID NO: 1890000 - RNA, 21 nt, Human
gauagacacauaugaggggga

SEQ ID NO: 1890001 - RNA, 20 nt, Human
gauagacacauaugaggggg

SEQ ID NO: 1890002 - RNA, 22 nt, Human
gaguuuuucccagcuacaccuu

SEQ ID NO: 1890003 - RNA, 22 nt, Human
gaucaaccccuucgcuccugug

SEQ ID NO: 1890004 - RNA, 21 nt, Human
gaucaaccccuucgcuccugu

SEQ ID NO: 1890005 - RNA, 19 nt, Human
gauauauuuaaaaauauuu

SEQ ID NO: 1890006 - RNA, 15 nt, Human
gauauauuuaaaaau

SEQ ID NO: 1890007 - RNA, 23 nt, Human
gauauaugcucugcauguuacau

SEQ ID NO: 1890008 - RNA, 17 nt, Human
gauauacucuagaugaa

SEQ ID NO: 1890009 - RNA, 17 nt, Human
gauauaaguguguguuu

SEQ ID NO: 1890010 - RNA, 21 nt, Human
gauauaaguguguguuuuuca

SEQ ID NO: 1890011 - RNA, 13 nt, Human
gauagccaaggcc

SEQ ID NO: 1890012 - RNA, 14 nt, Human
gauagccaaggcca

SEQ ID NO: 1890013 - RNA, 12 nt, Human
gauagccaaggc

SEQ ID NO: 1890014 - RNA, 19 nt, Human
gauagcacagacccugccc

SEQ ID NO: 1890015 - RNA, 20 nt, Human
gauagcacagacccugcccu

SEQ ID NO: 1890016 - RNA, 14 nt, Human
gaguagcugggacu

SEQ ID NO: 1890017 - RNA, 12 nt, Human
gaguagcuggga

SEQ ID NO: 1890018 - RNA, 19 nt, Human
gagucaaaacuacaaauca

SEQ ID NO: 1890019 - RNA, 19 nt, Human
gagucaaaugguaggcauu

SEQ ID NO: 1890020 - RNA, 14 nt, Human
gaguccccuguuug

SEQ ID NO: 1890021 - RNA, 23 nt, Human
gaguccccuguuuguuucugaaa

SEQ ID NO: 1890022 - RNA, 14 nt, Human
gagucccugccauc

SEQ ID NO: 1890023 - RNA, 12 nt, Human
gaguccccuguu

SEQ ID NO: 1890024 - RNA, 17 nt, Human
gagucgaggacagggag

SEQ ID NO: 1890025 - RNA, 21 nt, Human
gagucucacuguugcccaggc

SEQ ID NO: 1890026 - RNA, 20 nt, Human
gagucucacuguugcccagg

SEQ ID NO: 1890027 - RNA, 19 nt, Human
gagucucacuguugcccag

SEQ ID NO: 1890028 - RNA, 23 nt, Human
gagucucacuguugcccaggcug

SEQ ID NO: 1890029 - RNA, 22 nt, Human
gagucucacuguugcccaggcu

SEQ ID NO: 1890030 - RNA, 21 nt, Human
gagucugaaggcuggguucug

SEQ ID NO: 1890031 - RNA, 16 nt, Human
gaguacguugugcauu

SEQ ID NO: 1890032 - RNA, 22 nt, Human
gaguaaaauaaauauugucuuu

SEQ ID NO: 1890033 - RNA, 19 nt, Human
gagguuuuaaaaaaauccc

SEQ ID NO: 1890034 - RNA, 19 nt, Human
gagguucaaagauauuuug

SEQ ID NO: 1890035 - RNA, 14 nt, Human
gagguucccuuuga

SEQ ID NO: 1890036 - RNA, 22 nt, Human
gagguuuguuuagaagaagugu

SEQ ID NO: 1890037 - RNA, 20 nt, Human
gaguacguugugcauuuggu

SEQ ID NO: 1890038 - RNA, 15 nt, Human
gaguacuacaguccu

SEQ ID NO: 1890039 - RNA, 18 nt, Human
gaguacguugugcauuug

SEQ ID NO: 1890040 - RNA, 17 nt, Human
gaguacguugugcauuu

SEQ ID NO: 1890041 - RNA, 12 nt, Human
gaguagcuggau

SEQ ID NO: 1890042 - RNA, 23 nt, Human
gaguaaaauaaauauugucuuuu

SEQ ID NO: 1890043 - RNA, 18 nt, Human
gaguacuacaguccuccc

SEQ ID NO: 1890044 - RNA, 19 nt, Human
gaguacuacaguccuccca

SEQ ID NO: 1890045 - RNA, 22 nt, Human
gaggggggaggugggauccucc

SEQ ID NO: 1890046 - RNA, 15 nt, Human
gaggggguggccucc

SEQ ID NO: 1890047 - RNA, 15 nt, Human
gaggggggagguggg

SEQ ID NO: 1890048 - RNA, 21 nt, Human
gaggugggauccuccaggugc

SEQ ID NO: 1890049 - RNA, 22 nt, Human
gaggugggauccuccaggugca

SEQ ID NO: 1890050 - RNA, 18 nt, Human
gaggugggauccuccagg

SEQ ID NO: 1890051 - RNA, 13 nt, Human
gaugcccugcccu

SEQ ID NO: 1890052 - RNA, 12 nt, Human
gaugcccuggag

SEQ ID NO: 1890053 - RNA, 15 nt, Human
gaugcccuggaggug

SEQ ID NO: 1890054 - RNA, 18 nt, Human
gaugcccuggagguggcu

SEQ ID NO: 1890055 - RNA, 19 nt, Human
gaugcccuggagguggcug

SEQ ID NO: 1890056 - RNA, 21 nt, Human
gaugccuggcgggguggggug

SEQ ID NO: 1890057 - RNA, 14 nt, Human
gaugcuauuugcaa

SEQ ID NO: 1890058 - RNA, 13 nt, Human
gaugcuauuugca

SEQ ID NO: 1890059 - RNA, 20 nt, Human
gauggcaggacgugggcugg

SEQ ID NO: 1890060 - RNA, 21 nt, Human
gauggcacuuauaaccaaagc

SEQ ID NO: 1890061 - RNA, 22 nt, Human
gauggcaacagaucuggaaccu

SEQ ID NO: 1890062 - RNA, 15 nt, Human
gauggcaacagaucu

SEQ ID NO: 1890063 - RNA, 16 nt, Human
gauggcaacagaucug

SEQ ID NO: 1890064 - RNA, 17 nt, Human
gauggcaacagaucugg

SEQ ID NO: 1890065 - RNA, 21 nt, Human
gauggcaacagaucuggaacc

SEQ ID NO: 1890066 - RNA, 22 nt, Human
gaugggcaacccccagccugcu

SEQ ID NO: 1890067 - RNA, 23 nt, Human
gaugggacuagagcuuucuuuca

SEQ ID NO: 1890068 - RNA, 22 nt, Human
gaugagaaagguugaagcacca

SEQ ID NO: 1890069 - RNA, 11 nt, Human
gaugagaaagg

SEQ ID NO: 1890070 - RNA, 14 nt, Human
gaugacuauggaaa

SEQ ID NO: 1890071 - RNA, 13 nt, Human
gaugacucaagau

SEQ ID NO: 1890072 - RNA, 14 nt, Human
gaugacucaagauu

SEQ ID NO: 1890073 - RNA, 16 nt, Human
gaugacucaagauucc

SEQ ID NO: 1890074 - RNA, 21 nt, Human
gaugacucaagauucccagga

SEQ ID NO: 1890075 - RNA, 22 nt, Human
gaugacucaagauucccaggag

SEQ ID NO: 1890076 - RNA, 23 nt, Human
gaugacucaagauucccaggagu

SEQ ID NO: 1890077 - RNA, 17 nt, Human
gaugcaauguagagggg

SEQ ID NO: 1890078 - RNA, 13 nt, Human
gaugcauggagau

SEQ ID NO: 1890079 - RNA, 20 nt, Human
gaugcauggagauagcccca

SEQ ID NO: 1890080 - RNA, 16 nt, Human
gaucuuugcagacagg

SEQ ID NO: 1890081 - RNA, 15 nt, Human
gaugaaaaaauaaca

SEQ ID NO: 1890082 - RNA, 15 nt, Human
gaucuuuuguuccca

SEQ ID NO: 1890083 - RNA, 18 nt, Human
gaucuuuuguucccaucc

SEQ ID NO: 1890084 - RNA, 24 nt, Human
gaucuuuuguucccauccucuucu

SEQ ID NO: 1890085 - RNA, 17 nt, Human
gaucgaaccguuuugaa

SEQ ID NO: 1890086 - RNA, 20 nt, Human
gaucuguuuugaaggcaaaa

SEQ ID NO: 1890087 - RNA, 15 nt, Human
gaucuucaacaaauu

SEQ ID NO: 1890088 - RNA, 13 nt, Human
gaucuucaacaaa

SEQ ID NO: 1890089 - RNA, 16 nt, Human
gaucuucaacaaauug

SEQ ID NO: 1890090 - RNA, 21 nt, Human
gauccucccaccucagccucc

SEQ ID NO: 1890091 - RNA, 20 nt, Human
gauccucccaccucagccuc

SEQ ID NO: 1890092 - RNA, 19 nt, Human
gauccucccaccucagccu

SEQ ID NO: 1890093 - RNA, 12 nt, Human
gauccuccaggu

SEQ ID NO: 1890094 - RNA, 13 nt, Human
gauccugagccag

SEQ ID NO: 1890095 - RNA, 14 nt, Human
gauccugagccaga

SEQ ID NO: 1890096 - RNA, 15 nt, Human
gauccugagccagau

SEQ ID NO: 1890097 - RNA, 19 nt, Human
gauccugagccagauuuca

SEQ ID NO: 1890098 - RNA, 14 nt, Human
gaucacgccacugc

SEQ ID NO: 1890099 - RNA, 13 nt, Human
gaucacgccacug

SEQ ID NO: 1890100 - RNA, 23 nt, Human
gaucaaccccuucgcuccugugu

SEQ ID NO: 1890101 - RNA, 15 nt, Human
gaucacgccacugca

SEQ ID NO: 1890102 - RNA, 18 nt, Human
gauccuaguuccaccauc

SEQ ID NO: 1890103 - RNA, 11 nt, Human
gauccuccagg

SEQ ID NO: 1890104 - RNA, 13 nt, Human
gauugugccccug

SEQ ID NO: 1890105 - RNA, 20 nt, Human
gauuguccccgacccuugcc

SEQ ID NO: 1890106 - RNA, 15 nt, Human
gauuguccccgaccc

SEQ ID NO: 1890107 - RNA, 23 nt, Human
gauugacgggacuguugguauug

SEQ ID NO: 1890108 - RNA, 17 nt, Human
gauugacagcuuugcug

SEQ ID NO: 1890109 - RNA, 19 nt, Human
gauugacagcuuugcugcu

SEQ ID NO: 1890110 - RNA, 16 nt, Human
gauugacagcuuugcu

SEQ ID NO: 1890111 - RNA, 22 nt, Human
gauucccaagcucugcuccucu

SEQ ID NO: 1890112 - RNA, 16 nt, Human
gauucacuucacgcuu

SEQ ID NO: 1890113 - RNA, 12 nt, Human
gauucagacagc

SEQ ID NO: 1890114 - RNA, 21 nt, Human
gauuccccuaaccucauuccc

SEQ ID NO: 1890115 - RNA, 19 nt, Human
gauucccaggaguucugcu

SEQ ID NO: 1890116 - RNA, 12 nt, Human
gauucccaggag

SEQ ID NO: 1890117 - RNA, 13 nt, Human
gauucccaggagu

SEQ ID NO: 1890118 - RNA, 21 nt, Human
gauucccaggaguucugcuca

SEQ ID NO: 1890119 - RNA, 15 nt, Human
gauuccugagccagu

SEQ ID NO: 1890120 - RNA, 16 nt, Human
gauguucugggacaca

SEQ ID NO: 1890121 - RNA, 14 nt, Human
gauguucugggaca

SEQ ID NO: 1890122 - RNA, 21 nt, Human
gauguguccugauaagcugag

SEQ ID NO: 1890123 - RNA, 23 nt, Human
gauguggaaaagccaagaggcug

SEQ ID NO: 1890124 - RNA, 21 nt, Human
gauguggaaaagccaagaggc

SEQ ID NO: 1890125 - RNA, 23 nt, Human
gauggugcaaugaccuuucaaua

SEQ ID NO: 1890126 - RNA, 16 nt, Human
gauggugcugagaagc

SEQ ID NO: 1890127 - RNA, 17 nt, Human
gauggugcugagaagcu

SEQ ID NO: 1890128 - RNA, 12 nt, Human
gauggugcugag

SEQ ID NO: 1890129 - RNA, 14 nt, Human
gauggugcugagaa

SEQ ID NO: 1890130 - RNA, 20 nt, Human
gauggugcaaugaccuuuca

SEQ ID NO: 1890131 - RNA, 16 nt, Human
gaugggcccaauucuu

SEQ ID NO: 1890132 - RNA, 19 nt, Human
gauucaacagguuuuccug

SEQ ID NO: 1890133 - RNA, 22 nt, Human
gauuaagaucucagugguuaag

SEQ ID NO: 1890134 - RNA, 18 nt, Human
gauuaaccacuucagcug

SEQ ID NO: 1890135 - RNA, 19 nt, Human
gauuaaccacuucagcuga

SEQ ID NO: 1890136 - RNA, 21 nt, Human
gauuaaccacuucagcugacu

SEQ ID NO: 1890137 - RNA, 19 nt, Human
gauuaaauucuugcaaagu

SEQ ID NO: 1890138 - RNA, 12 nt, Human
gauuaaauucuu

SEQ ID NO: 1890139 - RNA, 15 nt, Human
gauguuuuccaugag

SEQ ID NO: 1890140 - RNA, 23 nt, Human
gauguuuuccaugaguccccugu

SEQ ID NO: 1890141 - RNA, 14 nt, Human
gauguuuuccauga

SEQ ID NO: 1890142 - RNA, 21 nt, Human
gauguucuuucacccuuuucu

SEQ ID NO: 1890143 - RNA, 19 nt, Human
gauguugaaaaaguucugc

SEQ ID NO: 1890144 - RNA, 17 nt, Human
gcaggacgugggcuggg

SEQ ID NO: 1890145 - RNA, 21 nt, Human
gcaggaccuucgggcugugcc

SEQ ID NO: 1890146 - RNA, 15 nt, Human
gcagcucagcuuccc

SEQ ID NO: 1890147 - RNA, 18 nt, Human
gcaggaaauggcugugga

SEQ ID NO: 1890148 - RNA, 20 nt, Human
gcagcucauaagagccacag

SEQ ID NO: 1890149 - RNA, 18 nt, Human
gcagcucagagagggugg

SEQ ID NO: 1890150 - RNA, 19 nt, Human
gcagcucagagaggguggg

SEQ ID NO: 1890151 - RNA, 16 nt, Human
gcagcucaccucuccc

SEQ ID NO: 1890152 - RNA, 17 nt, Human
gcagcucaccucucccu

SEQ ID NO: 1890153 - RNA, 20 nt, Human
gcagcucaccucucccuugg

SEQ ID NO: 1890154 - RNA, 21 nt, Human
gcagcucaccucucccuugga

SEQ ID NO: 1890155 - RNA, 14 nt, Human
gcagcucagagagg

SEQ ID NO: 1890156 - RNA, 15 nt, Human
gcagccucacagucc

SEQ ID NO: 1890157 - RNA, 17 nt, Human
gcagccucacaguccuu

SEQ ID NO: 1890158 - RNA, 19 nt, Human
gcagccucacaguccuuac

SEQ ID NO: 1890159 - RNA, 18 nt, Human
gcagccucccauccaggg

SEQ ID NO: 1890160 - RNA, 20 nt, Human
gcagccucccauccagggcc

SEQ ID NO: 1890161 - RNA, 21 nt, Human
gcagccucccauccagggccc

SEQ ID NO: 1890162 - RNA, 20 nt, Human
gcagcagggagggcuucugc

SEQ ID NO: 1890163 - RNA, 18 nt, Human
gcagcagggagggcuucu

SEQ ID NO: 1890164 - RNA, 19 nt, Human
gcagcagggagggcuucug

SEQ ID NO: 1890165 - RNA, 18 nt, Human
gcagacugaucaggaccu

SEQ ID NO: 1890166 - RNA, 17 nt, Human
gcagagaagcucucggg

SEQ ID NO: 1890167 - RNA, 22 nt, Human
gcagagaccaucccugaaggcc

SEQ ID NO: 1890168 - RNA, 19 nt, Human
gcagaggggcagauggaaa

SEQ ID NO: 1890169 - RNA, 20 nt, Human
gcagagaccaucccugaagg

SEQ ID NO: 1890170 - RNA, 21 nt, Human
gcagagaccaucccugaaggc

SEQ ID NO: 1890171 - RNA, 16 nt, Human
gcacuugcagacucua

SEQ ID NO: 1890172 - RNA, 14 nt, Human
gcacuugcagacuc

SEQ ID NO: 1890173 - RNA, 22 nt, Human
gcacuucgggaggucgaggcag

SEQ ID NO: 1890174 - RNA, 22 nt, Human
gcagacucuacagaggccaugg

SEQ ID NO: 1890175 - RNA, 19 nt, Human
gcagacucuacagaggcca

SEQ ID NO: 1890176 - RNA, 18 nt, Human
gcagacucuacagaggcc

SEQ ID NO: 1890177 - RNA, 17 nt, Human
gcagacucuacagaggc

SEQ ID NO: 1890178 - RNA, 18 nt, Human
gcagauggagaccccuug

SEQ ID NO: 1890179 - RNA, 20 nt, Human
gcagauguaaaguuauucuu

SEQ ID NO: 1890180 - RNA, 22 nt, Human
gcagauguaaaguuauucuuga

SEQ ID NO: 1890181 - RNA, 22 nt, Human
gcagcagaaggggguggugucu

SEQ ID NO: 1890182 - RNA, 15 nt, Human
gcagcagaagggggu

SEQ ID NO: 1890183 - RNA, 18 nt, Human
gcagagguugcagugagc

SEQ ID NO: 1890184 - RNA, 23 nt, Human
gcagagguugcagugagccgaga

SEQ ID NO: 1890185 - RNA, 15 nt, Human
gcagauccaggacua

SEQ ID NO: 1890186 - RNA, 14 nt, Human
gcagauccaggacu

SEQ ID NO: 1890187 - RNA, 19 nt, Human
gcacuguuuuauuuuaauu

SEQ ID NO: 1890188 - RNA, 14 nt, Human
gcacugggcuuggg

SEQ ID NO: 1890189 - RNA, 12 nt, Human
gcacugggcuug

SEQ ID NO: 1890190 - RNA, 22 nt, Human
gcacuauaauguaagcucuacu

SEQ ID NO: 1890191 - RNA, 12 nt, Human
gcacuacauuca

SEQ ID NO: 1890192 - RNA, 16 nt, Human
gcacuacauucauuua

SEQ ID NO: 1890193 - RNA, 20 nt, Human
gcacuauaauguaagcucua

SEQ ID NO: 1890194 - RNA, 14 nt, Human
gcacuauaauguaa

SEQ ID NO: 1890195 - RNA, 15 nt, Human
gcacuauaauguaag

SEQ ID NO: 1890196 - RNA, 12 nt, Human
gcacugcuucca

SEQ ID NO: 1890197 - RNA, 13 nt, Human
gcacugcuuccag

SEQ ID NO: 1890198 - RNA, 14 nt, Human
gcacugcuuccagu

SEQ ID NO: 1890199 - RNA, 15 nt, Human
gcacugcuuccagug

SEQ ID NO: 1890200 - RNA, 20 nt, Human
gcacuaaggugugcucugau

SEQ ID NO: 1890201 - RNA, 14 nt, Human
gcacgugugugcac

SEQ ID NO: 1890202 - RNA, 16 nt, Human
gcacccucaggcaggu

SEQ ID NO: 1890203 - RNA, 19 nt, Human
gcacccucaggcagguggg

SEQ ID NO: 1890204 - RNA, 21 nt, Human
gcacagcuucauuuccugugu

SEQ ID NO: 1890205 - RNA, 23 nt, Human
gcacagcuucauuuccugugucu

SEQ ID NO: 1890206 - RNA, 14 nt, Human
gcacaggacaugcg

SEQ ID NO: 1890207 - RNA, 20 nt, Human
gauugugucucuugguccug

SEQ ID NO: 1890208 - RNA, 22 nt, Human
gcacagcagccuggggcuggcc

SEQ ID NO: 1890209 - RNA, 22 nt, Human
gcacagccaacacgcaccugcc

SEQ ID NO: 1890210 - RNA, 15 nt, Human
gcacagcagccuggg

SEQ ID NO: 1890211 - RNA, 17 nt, Human
gcacagcccaaagaagg

SEQ ID NO: 1890212 - RNA, 17 nt, Human
gcaccaucucuccuccu

SEQ ID NO: 1890213 - RNA, 14 nt, Human
gcaccagcagccug

SEQ ID NO: 1890214 - RNA, 21 nt, Human
gcaccagacacccaggacuua

SEQ ID NO: 1890215 - RNA, 13 nt, Human
gcaccagcagccu

SEQ ID NO: 1890216 - RNA, 14 nt, Human
gcaccaucucuccu

SEQ ID NO: 1890217 - RNA, 15 nt, Human
gcaccaucucuccuc

SEQ ID NO: 1890218 - RNA, 15 nt, Human
gcaccacacucagcc

SEQ ID NO: 1890219 - RNA, 17 nt, Human
gcaccacacucagcccu

SEQ ID NO: 1890220 - RNA, 15 nt, Human
gcaccagacacccag

SEQ ID NO: 1890221 - RNA, 16 nt, Human
gcaccagacacccagg

SEQ ID NO: 1890222 - RNA, 17 nt, Human
gcaccagacacccagga

SEQ ID NO: 1890223 - RNA, 18 nt, Human
gcaccagacacccaggac

SEQ ID NO: 1890224 - RNA, 19 nt, Human
gcaccagacacccaggacu

SEQ ID NO: 1890225 - RNA, 20 nt, Human
gcaccagacacccaggacuu

SEQ ID NO: 1890226 - RNA, 22 nt, Human
gcaggcccaaauuaucaagcua

SEQ ID NO: 1890227 - RNA, 17 nt, Human
gcaggccaggccagcug

SEQ ID NO: 1890228 - RNA, 15 nt, Human
gcaggccaggccagc

SEQ ID NO: 1890229 - RNA, 16 nt, Human
gcaggccaggccagcu

SEQ ID NO: 1890230 - RNA, 18 nt, Human
gcaggcagccaggccaca

SEQ ID NO: 1890231 - RNA, 17 nt, Human
gcaggcagccaggccac

SEQ ID NO: 1890232 - RNA, 12 nt, Human
gcagggcagccg

SEQ ID NO: 1890233 - RNA, 17 nt, Human
gcagggcucccacagag

SEQ ID NO: 1890234 - RNA, 14 nt, Human
gcaggcggugggca

SEQ ID NO: 1890235 - RNA, 15 nt, Human
gcaggcggugggcac

SEQ ID NO: 1890236 - RNA, 16 nt, Human
gcaggcggugggcacc

SEQ ID NO: 1890237 - RNA, 23 nt, Human
gcaggcggugggcacccacccug

SEQ ID NO: 1890238 - RNA, 13 nt, Human
gcagggaugcccu

SEQ ID NO: 1890239 - RNA, 21 nt, Human
gcagggaugcccuggaggugg

SEQ ID NO: 1890240 - RNA, 23 nt, Human
gcagggaugcccuggagguggcu

SEQ ID NO: 1890241 - RNA, 22 nt, Human
gcaggggaggguagagcggaga

SEQ ID NO: 1890242 - RNA, 16 nt, Human
gcagggucucacucug

SEQ ID NO: 1890243 - RNA, 19 nt, Human
gcaggguccuagaaauucc

SEQ ID NO: 1890244 - RNA, 14 nt, Human
gcaggucccuaaua

SEQ ID NO: 1890245 - RNA, 15 nt, Human
gcaggucccuaauaa

SEQ ID NO: 1890246 - RNA, 21 nt, Human
gcaguggugcgaucuggguuc

SEQ ID NO: 1890247 - RNA, 20 nt, Human
gcaguggugcgaucuggguu

SEQ ID NO: 1890248 - RNA, 22 nt, Human
gcaguggugcgaucuggguuca

SEQ ID NO: 1890249 - RNA, 19 nt, Human
gcaguggugguuuucuguu

SEQ ID NO: 1890250 - RNA, 21 nt, Human
gcaguggugguuuucuguucu

SEQ ID NO: 1890251 - RNA, 20 nt, Human
gcaguggugguuuucuguuc

SEQ ID NO: 1890252 - RNA, 19 nt, Human
gcauacguacacauuuuau

SEQ ID NO: 1890253 - RNA, 19 nt, Human
gcaguggugcgaucugggu

SEQ ID NO: 1890254 - RNA, 18 nt, Human
gcaguggugcgaucuggg

SEQ ID NO: 1890255 - RNA, 17 nt, Human
gcagugggccuggccag

SEQ ID NO: 1890256 - RNA, 12 nt, Human
gcagugggagcu

SEQ ID NO: 1890257 - RNA, 16 nt, Human
gcagugggccuggcca

SEQ ID NO: 1890258 - RNA, 11 nt, Human
gcagugggagc

SEQ ID NO: 1890259 - RNA, 16 nt, Human
gcaggucccuaauaaa

SEQ ID NO: 1890260 - RNA, 17 nt, Human
gcaggucccuaauaaag

SEQ ID NO: 1890261 - RNA, 18 nt, Human
gcaggucccuaauaaagc

SEQ ID NO: 1890262 - RNA, 19 nt, Human
gcaggucccuaauaaagcu

SEQ ID NO: 1890263 - RNA, 20 nt, Human
gcaggucccuaauaaagcug

SEQ ID NO: 1890264 - RNA, 21 nt, Human
gcaggucccuaauaaagcugu

SEQ ID NO: 1890265 - RNA, 23 nt, Human
gcaggucccuaauaaagcugugu

SEQ ID NO: 1890266 - RNA, 22 nt, Human
gcauccacuucuuucagcagac

SEQ ID NO: 1890267 - RNA, 23 nt, Human
gcaucaggccaggcccucugccc

SEQ ID NO: 1890268 - RNA, 18 nt, Human
gcaucaggccaggcccuc

SEQ ID NO: 1890269 - RNA, 12 nt, Human
gcaucaggccag

SEQ ID NO: 1890270 - RNA, 20 nt, Human
gcaugaaguaauaugcacac

SEQ ID NO: 1890271 - RNA, 22 nt, Human
gcaugaaguaauaugcacacau

SEQ ID NO: 1890272 - RNA, 21 nt, Human
gcaugaaguaauaugcacaca

SEQ ID NO: 1890273 - RNA, 21 nt, Human
gcaugacacgaauauugcuga

SEQ ID NO: 1890274 - RNA, 22 nt, Human
gcaugacacgaauauugcugau

SEQ ID NO: 1890275 - RNA, 14 nt, Human
gcaugccuggaugg

SEQ ID NO: 1890276 - RNA, 14 nt, Human
gcaugacauuucuu

SEQ ID NO: 1890277 - RNA, 14 nt, Human
gcauguucucugag

SEQ ID NO: 1890278 - RNA, 13 nt, Human
gcauguuacauaa

SEQ ID NO: 1890279 - RNA, 15 nt, Human
gcaugccuggauggg

SEQ ID NO: 1890280 - RNA, 24 nt, Human
gcauuaucuagauacuguaucaug

SEQ ID NO: 1890281 - RNA, 22 nt, Human
gcauuaucuagauacuguauca

SEQ ID NO: 1890282 - RNA, 19 nt, Human
gcauuaucuagauacugua

SEQ ID NO: 1890283 - RNA, 18 nt, Human
gcauuaaauucacaaacu

SEQ ID NO: 1890284 - RNA, 22 nt, Human
gcauuaaauucacaaacuuuua

SEQ ID NO: 1890285 - RNA, 18 nt, Human
gcauuugaggucuguucu

SEQ ID NO: 1890286 - RNA, 22 nt, Human
gcauugaccgcgacuaauuuca

SEQ ID NO: 1890287 - RNA, 23 nt, Human
gcauugaccgcgacuaauuucaa

SEQ ID NO: 1890288 - RNA, 22 nt, Human
gcauuccccaggaggccagccu

SEQ ID NO: 1890289 - RNA, 22 nt, Human
gcauugaacacaaacuguaaau

SEQ ID NO: 1890290 - RNA, 23 nt, Human
gcauugaacacaaacuguaaaua

SEQ ID NO: 1890291 - RNA, 21 nt, Human
gcauugaacacaaacuguaaa

SEQ ID NO: 1890292 - RNA, 14 nt, Human
gcauuccccaggag

SEQ ID NO: 1890293 - RNA, 15 nt, Human
gcauuccccaggagg

SEQ ID NO: 1890294 - RNA, 16 nt, Human
gcauuccccaggaggc

SEQ ID NO: 1890295 - RNA, 17 nt, Human
gcauuccccaggaggcc

SEQ ID NO: 1890296 - RNA, 18 nt, Human
gcauuccccaggaggcca

SEQ ID NO: 1890297 - RNA, 19 nt, Human
gcauuccccaggaggccag

SEQ ID NO: 1890298 - RNA, 20 nt, Human
gcauuccccaggaggccagc

SEQ ID NO: 1890299 - RNA, 21 nt, Human
gcauuccccaggaggccagcc

SEQ ID NO: 1890300 - RNA, 22 nt, Human
gcccagaggagcugggagccgg

SEQ ID NO: 1890301 - RNA, 16 nt, Human
gcccagaggagggcag

SEQ ID NO: 1890302 - RNA, 23 nt, Human
gcccagaggagggcagcagaagg

SEQ ID NO: 1890303 - RNA, 17 nt, Human
gcccagagcccagcucc

SEQ ID NO: 1890304 - RNA, 18 nt, Human
gcccagagcccagcucca

SEQ ID NO: 1890305 - RNA, 12 nt, Human
gcccagagggcc

SEQ ID NO: 1890306 - RNA, 14 nt, Human
gcccagagggccug

SEQ ID NO: 1890307 - RNA, 15 nt, Human
gcccagagggccugc

SEQ ID NO: 1890308 - RNA, 18 nt, Human
gcccagagggccugcaag

SEQ ID NO: 1890309 - RNA, 19 nt, Human
gcccagagggccugcaagg

SEQ ID NO: 1890310 - RNA, 15 nt, Human
gcccagagagggugg

SEQ ID NO: 1890311 - RNA, 14 nt, Human
gcccagagcccagc

SEQ ID NO: 1890312 - RNA, 15 nt, Human
gcccagagcccagcu

SEQ ID NO: 1890313 - RNA, 16 nt, Human
gcccagagcccagcuc

SEQ ID NO: 1890314 - RNA, 19 nt, Human
gcccagagacccaagcugc

SEQ ID NO: 1890315 - RNA, 23 nt, Human
gcccagagacauacuugaagggc

SEQ ID NO: 1890316 - RNA, 10 nt, Human
gcccagagac

SEQ ID NO: 1890317 - RNA, 20 nt, Human
gcccagagacauacuugaag

SEQ ID NO: 1890318 - RNA, 21 nt, Human
gcccaaugcacuuuguucugg

SEQ ID NO: 1890319 - RNA, 12 nt, Human
gcccaauauuau

SEQ ID NO: 1890320 - RNA, 18 nt, Human
gcccaauauuauaauuuu

SEQ ID NO: 1890321 - RNA, 22 nt, Human
gcccaauucuuacaaacaugug

SEQ ID NO: 1890322 - RNA, 23 nt, Human
gcccagccacggacgcuggcucc

SEQ ID NO: 1890323 - RNA, 14 nt, Human
gcccagccaggccc

SEQ ID NO: 1890324 - RNA, 15 nt, Human
gcccagccaggcccc

SEQ ID NO: 1890325 - RNA, 16 nt, Human
gcccagccaggcccca

SEQ ID NO: 1890326 - RNA, 17 nt, Human
gcccagccaggccccag

SEQ ID NO: 1890327 - RNA, 9 nt, Human
gcccagccc

SEQ ID NO: 1890328 - RNA, 12 nt, Human
gcccagccccuu

SEQ ID NO: 1890329 - RNA, 11 nt, Human
gcccagccccu

SEQ ID NO: 1890330 - RNA, 22 nt, Human
gcccagagggccugcaagggag

SEQ ID NO: 1890331 - RNA, 20 nt, Human
gcccagagggccugcaaggg

SEQ ID NO: 1890332 - RNA, 21 nt, Human
gcccagagggccugcaaggga

SEQ ID NO: 1890333 - RNA, 20 nt, Human
gcccagauuaugagacacag

SEQ ID NO: 1890334 - RNA, 22 nt, Human
gcccagauuaugagacacagga

SEQ ID NO: 1890335 - RNA, 22 nt, Human
gcccagauuaaagucuuuaucc

SEQ ID NO: 1890336 - RNA, 19 nt, Human
gcccagauuaugagacaca

SEQ ID NO: 1890337 - RNA, 15 nt, Human
gcccaguugggugga

SEQ ID NO: 1890338 - RNA, 20 nt, Human
gcccagucuggaaugcagug

SEQ ID NO: 1890339 - RNA, 18 nt, Human
gcccaguccuuccaccuc

SEQ ID NO: 1890340 - RNA, 19 nt, Human
gcccaguccuuccaccucg

SEQ ID NO: 1890341 - RNA, 19 nt, Human
gcccagucuggaaugcagu

SEQ ID NO: 1890342 - RNA, 14 nt, Human
gcccaguccuucca

SEQ ID NO: 1890343 - RNA, 15 nt, Human
gcccaguccuuccac

SEQ ID NO: 1890344 - RNA, 17 nt, Human
gcccaguccuuccaccu

SEQ ID NO: 1890345 - RNA, 23 nt, Human
gcccaggcuuagucacugagaca

SEQ ID NO: 1890346 - RNA, 19 nt, Human
gcccaggcuuagucacuga

SEQ ID NO: 1890347 - RNA, 21 nt, Human
gcccaggcuuagucacugaga

SEQ ID NO: 1890348 - RNA, 20 nt, Human
gcccaggcuggcgugcagug

SEQ ID NO: 1890349 - RNA, 19 nt, Human
gcccaggcuggcgugcagu

SEQ ID NO: 1890350 - RNA, 22 nt, Human
gcccaggcuggcgugcaguggu

SEQ ID NO: 1890351 - RNA, 16 nt, Human
gcccaggcugguuucg

SEQ ID NO: 1890352 - RNA, 18 nt, Human
gcccaggaaaggcuccag

SEQ ID NO: 1890353 - RNA, 19 nt, Human
gcccaggaaaggcuccagg

SEQ ID NO: 1890354 - RNA, 20 nt, Human
gcccaggaaaggcuccagga

SEQ ID NO: 1890355 - RNA, 21 nt, Human
gcccaggaaaggcuccaggag

SEQ ID NO: 1890356 - RNA, 19 nt, Human
gcccagcugggucaggcag

SEQ ID NO: 1890357 - RNA, 20 nt, Human
gcccagcugggucaggcagg

SEQ ID NO: 1890358 - RNA, 13 nt, Human
gcccagcuggguc

SEQ ID NO: 1890359 - RNA, 14 nt, Human
gcccagcuggguca

SEQ ID NO: 1890360 - RNA, 15 nt, Human
gcccagcugggucag

SEQ ID NO: 1890361 - RNA, 18 nt, Human
gcccagcugggucaggca

SEQ ID NO: 1890362 - RNA, 18 nt, Human
gcccagcggacaguggca

SEQ ID NO: 1890363 - RNA, 19 nt, Human
gcccagcggacaguggcag

SEQ ID NO: 1890364 - RNA, 20 nt, Human
gcccagcggacaguggcagg

SEQ ID NO: 1890365 - RNA, 21 nt, Human
gcccagcggacaguggcagga

SEQ ID NO: 1890366 - RNA, 20 nt, Human
gcccagccccuucugaccca

SEQ ID NO: 1890367 - RNA, 24 nt, Human
gcccagccccuucugacccaugcu

SEQ ID NO: 1890368 - RNA, 12 nt, Human
gcccagcccucc

SEQ ID NO: 1890369 - RNA, 16 nt, Human
gcccagcccuccccau

SEQ ID NO: 1890370 - RNA, 13 nt, Human
gcccagccccuuc

SEQ ID NO: 1890371 - RNA, 14 nt, Human
gcccagccccuucu

SEQ ID NO: 1890372 - RNA, 16 nt, Human
gcccagccccuucuga

SEQ ID NO: 1890373 - RNA, 17 nt, Human
gcccagccccuucugac

SEQ ID NO: 1890374 - RNA, 21 nt, Human
gccagggagaccuggacacag

SEQ ID NO: 1890375 - RNA, 22 nt, Human
gccagggagaccuggacacagg

SEQ ID NO: 1890376 - RNA, 20 nt, Human
gccagggcaaugaugaauga

SEQ ID NO: 1890377 - RNA, 19 nt, Human
gccaggggggugaggagcu

SEQ ID NO: 1890378 - RNA, 20 nt, Human
gccaggggggugaggagcug

SEQ ID NO: 1890379 - RNA, 21 nt, Human
gccaggggggugaggagcugg

SEQ ID NO: 1890380 - RNA, 22 nt, Human
gccaggggggugaggagcuggg

SEQ ID NO: 1890381 - RNA, 17 nt, Human
gccagguuuuuggucug

SEQ ID NO: 1890382 - RNA, 12 nt, Human
gccaguaaaugg

SEQ ID NO: 1890383 - RNA, 20 nt, Human
gccagucaccccggccaccu

SEQ ID NO: 1890384 - RNA, 21 nt, Human
gccaguaaaaaaaaaaaaugg

SEQ ID NO: 1890385 - RNA, 17 nt, Human
gccagucaccccggcca

SEQ ID NO: 1890386 - RNA, 18 nt, Human
gccagucaccccggccac

SEQ ID NO: 1890387 - RNA, 15 nt, Human
gccagggagaccugg

SEQ ID NO: 1890388 - RNA, 18 nt, Human
gccagggagaccuggaca

SEQ ID NO: 1890389 - RNA, 19 nt, Human
gccagggagaccuggacac

SEQ ID NO: 1890390 - RNA, 14 nt, Human
gccagggagaagcu

SEQ ID NO: 1890391 - RNA, 15 nt, Human
gccagggagaagcuc

SEQ ID NO: 1890392 - RNA, 16 nt, Human
gccagggagaagcucc

SEQ ID NO: 1890393 - RNA, 20 nt, Human
gccagggagaagcuccucuc

SEQ ID NO: 1890394 - RNA, 23 nt, Human
gccagggacagaggggguggccu

SEQ ID NO: 1890395 - RNA, 13 nt, Human
gccagggacagag

SEQ ID NO: 1890396 - RNA, 16 nt, Human
gccagggacagagggg

SEQ ID NO: 1890397 - RNA, 18 nt, Human
gccagggacagagggggu

SEQ ID NO: 1890398 - RNA, 16 nt, Human
gccagauuucacucuc

SEQ ID NO: 1890399 - RNA, 14 nt, Human
gccagauccagccu

SEQ ID NO: 1890400 - RNA, 11 nt, Human
gccagauccag

SEQ ID NO: 1890401 - RNA, 18 nt, Human
gccagauuucacucuccu

SEQ ID NO: 1890402 - RNA, 21 nt, Human
gccagauuucacucuccuugg

SEQ ID NO: 1890403 - RNA, 13 nt, Human
gccaggcuggguc

SEQ ID NO: 1890404 - RNA, 22 nt, Human
gccaggcugaccacagcacagc

SEQ ID NO: 1890405 - RNA, 15 nt, Human
gccagugagccacuc

SEQ ID NO: 1890406 - RNA, 20 nt, Human
gccagugaugcuaaagguug

SEQ ID NO: 1890407 - RNA, 19 nt, Human
gccagugaugcuaaagguu

SEQ ID NO: 1890408 - RNA, 19 nt, Human
gccaucucaccuccugcug

SEQ ID NO: 1890409 - RNA, 20 nt, Human
gccaucucaccuccugcugg

SEQ ID NO: 1890410 - RNA, 21 nt, Human
gccaucucaccuccugcuggg

SEQ ID NO: 1890411 - RNA, 19 nt, Human
gccaugccagcuuaucuca

SEQ ID NO: 1890412 - RNA, 13 nt, Human
gccaugccagcuu

SEQ ID NO: 1890413 - RNA, 18 nt, Human
gccaugccagcuuaucuc

SEQ ID NO: 1890414 - RNA, 18 nt, Human
gccaugaggaacaaggca

SEQ ID NO: 1890415 - RNA, 20 nt, Human
gccaugaggaacaaggcaag

SEQ ID NO: 1890416 - RNA, 23 nt, Human
gccaugagaugauacauccaaag

SEQ ID NO: 1890417 - RNA, 23 nt, Human
gcccaaauuaucaagcuaauaaa

SEQ ID NO: 1890418 - RNA, 22 nt, Human
gcccaaauuaucaagcuaauaa

SEQ ID NO: 1890419 - RNA, 21 nt, Human
gcccaaauuaucaagcuaaua

SEQ ID NO: 1890420 - RNA, 23 nt, Human
gcccaaaccaccagaagcccaga

SEQ ID NO: 1890421 - RNA, 14 nt, Human
gccauuuuuacugu

SEQ ID NO: 1890422 - RNA, 22 nt, Human
gcccaaaccaccagaagcccag

SEQ ID NO: 1890423 - RNA, 21 nt, Human
gcccaaaccaccagaagccca

SEQ ID NO: 1890424 - RNA, 16 nt, Human
gcccaacccuucccuc

SEQ ID NO: 1890425 - RNA, 22 nt, Human
gccaugggacagggaggacgcu

SEQ ID NO: 1890426 - RNA, 18 nt, Human
gccauggacagaagaagg

SEQ ID NO: 1890427 - RNA, 23 nt, Human
gccaugggacagggaggacgcuc

SEQ ID NO: 1890428 - RNA, 21 nt, Human
gccaugggcacaaagggccca

SEQ ID NO: 1890429 - RNA, 20 nt, Human
gccauuuugcauuuucaucu

SEQ ID NO: 1890430 - RNA, 13 nt, Human
gccauuuugcauu

SEQ ID NO: 1890431 - RNA, 18 nt, Human
gccacggacgcuggcucc

SEQ ID NO: 1890432 - RNA, 19 nt, Human
gccacggccaggccagagg

SEQ ID NO: 1890433 - RNA, 13 nt, Human
gccacuaagcaga

SEQ ID NO: 1890434 - RNA, 14 nt, Human
gccacuaagcagag

SEQ ID NO: 1890435 - RNA, 15 nt, Human
gccacuaagcagagg

SEQ ID NO: 1890436 - RNA, 16 nt, Human
gccacuaagcagagga

SEQ ID NO: 1890437 - RNA, 17 nt, Human
gccacuaagcagaggag

SEQ ID NO: 1890438 - RNA, 19 nt, Human
gccacuaagcagaggaggg

SEQ ID NO: 1890439 - RNA, 20 nt, Human
gccacuaagcagaggagggg

SEQ ID NO: 1890440 - RNA, 23 nt, Human
gccacuaagcagaggaggggccg

SEQ ID NO: 1890441 - RNA, 16 nt, Human
gccacggacgcuggcu

SEQ ID NO: 1890442 - RNA, 18 nt, Human
gccacgcagccaggacac

SEQ ID NO: 1890443 - RNA, 17 nt, Human
gccacgcagccaggaca

SEQ ID NO: 1890444 - RNA, 16 nt, Human
gccacgcagccaggac

SEQ ID NO: 1890445 - RNA, 15 nt, Human
gccacgcagccagga

SEQ ID NO: 1890446 - RNA, 14 nt, Human
gccacgcagccagg

SEQ ID NO: 1890447 - RNA, 13 nt, Human
gccacgcagccag

SEQ ID NO: 1890448 - RNA, 17 nt, Human
gccacggccaggccaga

SEQ ID NO: 1890449 - RNA, 18 nt, Human
gccacggccaggccagag

SEQ ID NO: 1890450 - RNA, 15 nt, Human
gccacgauugcagga

SEQ ID NO: 1890451 - RNA, 22 nt, Human
gccaccugcggugcuaucuccc

SEQ ID NO: 1890452 - RNA, 14 nt, Human
gccaccugcggugc

SEQ ID NO: 1890453 - RNA, 20 nt, Human
gccaccugcggugcuaucuc

SEQ ID NO: 1890454 - RNA, 17 nt, Human
gccaccugccuguuggg

SEQ ID NO: 1890455 - RNA, 17 nt, Human
gccaccgcgcccagccu

SEQ ID NO: 1890456 - RNA, 19 nt, Human
gccaccgccuccuacagcc

SEQ ID NO: 1890457 - RNA, 15 nt, Human
gccacaggucuuuau

SEQ ID NO: 1890458 - RNA, 18 nt, Human
gccacaguagucuugaug

SEQ ID NO: 1890459 - RNA, 15 nt, Human
gccacaucaaagagg

SEQ ID NO: 1890460 - RNA, 20 nt, Human
gccagagacacaagccuucg

SEQ ID NO: 1890461 - RNA, 10 nt, Human
gccagaggag

SEQ ID NO: 1890462 - RNA, 17 nt, Human
gccagagacacaagccu

SEQ ID NO: 1890463 - RNA, 19 nt, Human
gccagagacacaagccuuc

SEQ ID NO: 1890464 - RNA, 16 nt, Human
gccagagacacaagcc

SEQ ID NO: 1890465 - RNA, 18 nt, Human
gccagaugcaccagcccu

SEQ ID NO: 1890466 - RNA, 17 nt, Human
gccagaugcaccagccc

SEQ ID NO: 1890467 - RNA, 16 nt, Human
gccagaugcaccagcc

SEQ ID NO: 1890468 - RNA, 23 nt, Human
gccagagggagugacagaggcag

SEQ ID NO: 1890469 - RNA, 22 nt, Human
gccagagggagugacagaggca

SEQ ID NO: 1890470 - RNA, 21 nt, Human
gccagagggagugacagaggc

SEQ ID NO: 1890471 - RNA, 19 nt, Human
gccagaggagagaggaccc

SEQ ID NO: 1890472 - RNA, 22 nt, Human
gccagaggagagaggacccccu

SEQ ID NO: 1890473 - RNA, 12 nt, Human
gccagaggagag

SEQ ID NO: 1890474 - RNA, 13 nt, Human
gccagaggagaga

SEQ ID NO: 1890475 - RNA, 15 nt, Human
gccagaggagagagg

SEQ ID NO: 1890476 - RNA, 17 nt, Human
gccagaggagagaggac

SEQ ID NO: 1890477 - RNA, 19 nt, Human
gccacagcccagccacgga

SEQ ID NO: 1890478 - RNA, 13 nt, Human
gccacagcccagc

SEQ ID NO: 1890479 - RNA, 23 nt, Human
gccacagagaaaguacuucucca

SEQ ID NO: 1890480 - RNA, 12 nt, Human
gccacaggacac

SEQ ID NO: 1890481 - RNA, 18 nt, Human
gccacaggacacagucag

SEQ ID NO: 1890482 - RNA, 23 nt, Human
gccacaggccugagauuucaucu

SEQ ID NO: 1890483 - RNA, 22 nt, Human
gccacaggccugagauuucauc

SEQ ID NO: 1890484 - RNA, 20 nt, Human
gccacaggccugagauuuca

SEQ ID NO: 1890485 - RNA, 15 nt, Human
gccacaggccugaga

SEQ ID NO: 1890486 - RNA, 13 nt, Human
gccacaggccuga

SEQ ID NO: 1890487 - RNA, 12 nt, Human
gccacaggccug

SEQ ID NO: 1890488 - RNA, 20 nt, Human
gccacagagaaaguacuucu

SEQ ID NO: 1890489 - RNA, 14 nt, Human
gccacagagaaagu

SEQ ID NO: 1890490 - RNA, 13 nt, Human
gccacagagaaag

SEQ ID NO: 1890491 - RNA, 22 nt, Human
gccacacucugggcuccagagu

SEQ ID NO: 1890492 - RNA, 19 nt, Human
gccacacucagcacaaggc

SEQ ID NO: 1890493 - RNA, 13 nt, Human
gccacacucagca

SEQ ID NO: 1890494 - RNA, 16 nt, Human
gccacacucagcacaa

SEQ ID NO: 1890495 - RNA, 17 nt, Human
gccacacucagcacaag

SEQ ID NO: 1890496 - RNA, 16 nt, Human
gccacaagacccuugu

SEQ ID NO: 1890497 - RNA, 22 nt, Human
gccacaagacccuugugguccc

SEQ ID NO: 1890498 - RNA, 20 nt, Human
gccaaugugaacagcggcug

SEQ ID NO: 1890499 - RNA, 15 nt, Human
gccaauucagacagg

SEQ ID NO: 1890500 - RNA, 17 nt, Human
gccaauucagacaggca

SEQ ID NO: 1890501 - RNA, 18 nt, Human
gccaauucagacaggcaa

SEQ ID NO: 1890502 - RNA, 21 nt, Human
gccacaaggacuuccugucca

SEQ ID NO: 1890503 - RNA, 14 nt, Human
gccacaaggacuuc

SEQ ID NO: 1890504 - RNA, 17 nt, Human
gccacaaggacuuccug

SEQ ID NO: 1890505 - RNA, 18 nt, Human
gccacaaggacuuccugu

SEQ ID NO: 1890506 - RNA, 19 nt, Human
gccacaaggacuuccuguc

SEQ ID NO: 1890507 - RNA, 14 nt, Human
gccaaggugggagg

SEQ ID NO: 1890508 - RNA, 15 nt, Human
gccaaggugggagga

SEQ ID NO: 1890509 - RNA, 23 nt, Human
gccaaggugggaggauugcuuga

SEQ ID NO: 1890510 - RNA, 23 nt, Human
gcauuuggugguuucagaaaugu

SEQ ID NO: 1890511 - RNA, 22 nt, Human
gcauuuggugguuucagaaaug

SEQ ID NO: 1890512 - RNA, 20 nt, Human
gcauuugaggucuguucuuu

SEQ ID NO: 1890513 - RNA, 19 nt, Human
gcauuugaggucuguucuu

SEQ ID NO: 1890514 - RNA, 21 nt, Human
gccaaggcugggggaagaagc

SEQ ID NO: 1890515 - RNA, 18 nt, Human
gccaauauuaaaucugcu

SEQ ID NO: 1890516 - RNA, 12 nt, Human
gccaaguucuua

SEQ ID NO: 1890517 - RNA, 23 nt, Human
ggaccaugcgacacugggaggcc

SEQ ID NO: 1890518 - RNA, 17 nt, Human
ggaccaucauccuacug

SEQ ID NO: 1890519 - RNA, 18 nt, Human
ggaccuugaacuggguac

SEQ ID NO: 1890520 - RNA, 19 nt, Human
ggacccaauguaggagcug

SEQ ID NO: 1890521 - RNA, 19 nt, Human
ggacgaagaagagccacag

SEQ ID NO: 1890522 - RNA, 13 nt, Human
ggacgcuggcucc

SEQ ID NO: 1890523 - RNA, 20 nt, Human
ggacgaagaagagccacagu

SEQ ID NO: 1890524 - RNA, 19 nt, Human
ggacgcucucuggccuucg

SEQ ID NO: 1890525 - RNA, 16 nt, Human
ggacgcucucuggccu

SEQ ID NO: 1890526 - RNA, 14 nt, Human
ggacugagaaauuu

SEQ ID NO: 1890527 - RNA, 19 nt, Human
ggacugaauuaugaaacuu

SEQ ID NO: 1890528 - RNA, 17 nt, Human
ggacugaauuaugaaac

SEQ ID NO: 1890529 - RNA, 16 nt, Human
ggacugaaaaccucuc

SEQ ID NO: 1890530 - RNA, 17 nt, Human
ggacugaaaaccucucc

SEQ ID NO: 1890531 - RNA, 18 nt, Human
ggacugaaaaccucuccu

SEQ ID NO: 1890532 - RNA, 12 nt, Human
ggagacaggcag

SEQ ID NO: 1890533 - RNA, 18 nt, Human
ggagaagccacaggccug

SEQ ID NO: 1890534 - RNA, 20 nt, Human
ggagaagccacaggccugag

SEQ ID NO: 1890535 - RNA, 19 nt, Human
ggagaagccacaggccuga

SEQ ID NO: 1890536 - RNA, 19 nt, Human
ggagaagcuccucucccca

SEQ ID NO: 1890537 - RNA, 18 nt, Human
ggacugagaaauuuauaa

SEQ ID NO: 1890538 - RNA, 14 nt, Human
ggacugaggccuga

SEQ ID NO: 1890539 - RNA, 13 nt, Human
ggacugaggccug

SEQ ID NO: 1890540 - RNA, 19 nt, Human
ggaccagagcugccaccug

SEQ ID NO: 1890541 - RNA, 13 nt, Human
ggaccagcucagg

SEQ ID NO: 1890542 - RNA, 14 nt, Human
ggaccagagcugcc

SEQ ID NO: 1890543 - RNA, 17 nt, Human
ggacagccccacccugg

SEQ ID NO: 1890544 - RNA, 17 nt, Human
ggacagcuccuucuguc

SEQ ID NO: 1890545 - RNA, 16 nt, Human
ggacagcuccuucugu

SEQ ID NO: 1890546 - RNA, 15 nt, Human
ggacagcuccuucug

SEQ ID NO: 1890547 - RNA, 11 nt, Human
ggacagcuccu

SEQ ID NO: 1890548 - RNA, 14 nt, Human
ggacagccccaccc

SEQ ID NO: 1890549 - RNA, 15 nt, Human
ggacagccccacccu

SEQ ID NO: 1890550 - RNA, 16 nt, Human
ggacagccccacccug

SEQ ID NO: 1890551 - RNA, 20 nt, Human
ggacagaggggguggccucc

SEQ ID NO: 1890552 - RNA, 16 nt, Human
ggacacuuaauacuac

SEQ ID NO: 1890553 - RNA, 19 nt, Human
gcuuuuaugugaaacaugu

SEQ ID NO: 1890554 - RNA, 20 nt, Human
gcuuuuaugugaaacauguu

SEQ ID NO: 1890555 - RNA, 21 nt, Human
gcuuuuaugugaaacauguuu

SEQ ID NO: 1890556 - RNA, 15 nt, Human
ggacagaagcagcuc

SEQ ID NO: 1890557 - RNA, 16 nt, Human
ggacagaagcagcucu

SEQ ID NO: 1890558 - RNA, 17 nt, Human
ggacagaagcagcucuu

SEQ ID NO: 1890559 - RNA, 23 nt, Human
ggacagacucacaaccugaaccu

SEQ ID NO: 1890560 - RNA, 14 nt, Human
ggacagaagcagcu

SEQ ID NO: 1890561 - RNA, 14 nt, Human
ggacagaagaaggc

SEQ ID NO: 1890562 - RNA, 16 nt, Human
ggacagaggggguggc

SEQ ID NO: 1890563 - RNA, 20 nt, Human
ggacagaggccccagccucc

SEQ ID NO: 1890564 - RNA, 23 nt, Human
ggacagaggccccagccucccug

SEQ ID NO: 1890565 - RNA, 14 nt, Human
ggacagaggcccca

SEQ ID NO: 1890566 - RNA, 15 nt, Human
ggacagaggccccag

SEQ ID NO: 1890567 - RNA, 16 nt, Human
ggacagaggccccagc

SEQ ID NO: 1890568 - RNA, 17 nt, Human
ggacagaggccccagcc

SEQ ID NO: 1890569 - RNA, 18 nt, Human
ggacagaggccccagccu

SEQ ID NO: 1890570 - RNA, 12 nt, Human
ggagcuagccag

SEQ ID NO: 1890571 - RNA, 14 nt, Human
ggagcuagaauuug

SEQ ID NO: 1890572 - RNA, 15 nt, Human
ggagcuagccagagg

SEQ ID NO: 1890573 - RNA, 20 nt, Human
ggagcuccaacucagaaggg

SEQ ID NO: 1890574 - RNA, 20 nt, Human
ggagcggccggccagccccu

SEQ ID NO: 1890575 - RNA, 23 nt, Human
ggagcgaacuggcgccuccgagg

SEQ ID NO: 1890576 - RNA, 20 nt, Human
ggagccuuugguucuggcca

SEQ ID NO: 1890577 - RNA, 15 nt, Human
ggagccuccugcccu

SEQ ID NO: 1890578 - RNA, 17 nt, Human
ggagccugcagagcugc

SEQ ID NO: 1890579 - RNA, 17 nt, Human
ggagacaggcagagcug

SEQ ID NO: 1890580 - RNA, 15 nt, Human
ggagcaagaggaggc

SEQ ID NO: 1890581 - RNA, 13 nt, Human
ggagcaagaggag

SEQ ID NO: 1890582 - RNA, 14 nt, Human
ggagcacacccagc

SEQ ID NO: 1890583 - RNA, 15 nt, Human
ggagcacacccagcc

SEQ ID NO: 1890584 - RNA, 17 nt, Human
ggagcacacccagcccc

SEQ ID NO: 1890585 - RNA, 16 nt, Human
ggagcccugggaggcu

SEQ ID NO: 1890586 - RNA, 19 nt, Human
ggagcccugggaggcucug

SEQ ID NO: 1890587 - RNA, 14 nt, Human
ggagccuccugccc

SEQ ID NO: 1890588 - RNA, 15 nt, Human
ggagccucccugccu

SEQ ID NO: 1890589 - RNA, 16 nt, Human
ggagccucccugccuc

SEQ ID NO: 1890590 - RNA, 22 nt, Human
ggagccucccugccucaggccu

SEQ ID NO: 1890591 - RNA, 18 nt, Human
ggagccucccugccucag

SEQ ID NO: 1890592 - RNA, 16 nt, Human
ggagccuaggccaggu

SEQ ID NO: 1890593 - RNA, 17 nt, Human
ggagccuaggccaggug

SEQ ID NO: 1890594 - RNA, 18 nt, Human
ggagccuaggccaggugc

SEQ ID NO: 1890595 - RNA, 14 nt, Human
ggagccucccugcc

SEQ ID NO: 1890596 - RNA, 20 nt, Human
ggagcccugggaggcucugg

SEQ ID NO: 1890597 - RNA, 16 nt, Human
ggagccuacccacccc

SEQ ID NO: 1890598 - RNA, 15 nt, Human
ggagccgggccgcag

SEQ ID NO: 1890599 - RNA, 21 nt, Human
ggaggauguucugggacacag

SEQ ID NO: 1890600 - RNA, 18 nt, Human
ggaggauguucugggaca

SEQ ID NO: 1890601 - RNA, 14 nt, Human
ggaggcaagcccug

SEQ ID NO: 1890602 - RNA, 16 nt, Human
ggaggacgcucucugg

SEQ ID NO: 1890603 - RNA, 17 nt, Human
ggaggcaggaguuucgu

SEQ ID NO: 1890604 - RNA, 22 nt, Human
ggaggcacuuuagggcuguaaa

SEQ ID NO: 1890605 - RNA, 17 nt, Human
ggagggagggcuccaga

SEQ ID NO: 1890606 - RNA, 13 nt, Human
ggagggagggcuc

SEQ ID NO: 1890607 - RNA, 16 nt, Human
ggagggagggcuccag

SEQ ID NO: 1890608 - RNA, 19 nt, Human
ggaggggagcaugggaagu

SEQ ID NO: 1890609 - RNA, 13 nt, Human
ggaggggccuagg

SEQ ID NO: 1890610 - RNA, 15 nt, Human
ggaggggccuaggcc

SEQ ID NO: 1890611 - RNA, 21 nt, Human
ggaggggccuaggccucagcc

SEQ ID NO: 1890612 - RNA, 22 nt, Human
ggagucccaccuuggcugcagg

SEQ ID NO: 1890613 - RNA, 18 nt, Human
ggagggggaauguaguga

SEQ ID NO: 1890614 - RNA, 15 nt, Human
ggcaugauccaagca

SEQ ID NO: 1890615 - RNA, 16 nt, Human
ggcaugauccaagcaa

SEQ ID NO: 1890616 - RNA, 18 nt, Human
ggcaugauccaagcaaga

SEQ ID NO: 1890617 - RNA, 15 nt, Human
ggcaugaugcgggcc

SEQ ID NO: 1890618 - RNA, 18 nt, Human
ggcaugugaugagaggaa

SEQ ID NO: 1890619 - RNA, 23 nt, Human
ggcaugugaugagaggaaaucac

SEQ ID NO: 1890620 - RNA, 22 nt, Human
ggcaugacacgaauauugcuga

SEQ ID NO: 1890621 - RNA, 20 nt, Human
ggcagucauuggcugucucc

SEQ ID NO: 1890622 - RNA, 21 nt, Human
ggcagcugcgguccacccagg

SEQ ID NO: 1890623 - RNA, 21 nt, Human
ggcagaguucuauaauguaaa

SEQ ID NO: 1890624 - RNA, 12 nt, Human
ggcagcugccac

SEQ ID NO: 1890625 - RNA, 17 nt, Human
ggcagaguugaagacag

SEQ ID NO: 1890626 - RNA, 19 nt, Human
ggcagaguugaagacagag

SEQ ID NO: 1890627 - RNA, 21 nt, Human
ggcagaguugaagacagagcu

SEQ ID NO: 1890628 - RNA, 24 nt, Human
ggcagcugcgguccacccaggagc

SEQ ID NO: 1890629 - RNA, 23 nt, Human
ggcagcugcgguccacccaggag

SEQ ID NO: 1890630 - RNA, 12 nt, Human
ggcaggguccua

SEQ ID NO: 1890631 - RNA, 18 nt, Human
ggcagggucucacucugu

SEQ ID NO: 1890632 - RNA, 17 nt, Human
ggcagggucucacucug

SEQ ID NO: 1890633 - RNA, 17 nt, Human
ggcagguuggugggggc

SEQ ID NO: 1890634 - RNA, 20 nt, Human
ggcauguucucugaggacac

SEQ ID NO: 1890635 - RNA, 22 nt, Human
ggccacagaaaauucuucucca

SEQ ID NO: 1890636 - RNA, 16 nt, Human
ggccacacucagcaca

SEQ ID NO: 1890637 - RNA, 21 nt, Human
ggccacacucagcacaaggcc

SEQ ID NO: 1890638 - RNA, 19 nt, Human
ggccacaucaaagaggcug

SEQ ID NO: 1890639 - RNA, 20 nt, Human
ggccacaguagucuugauga

SEQ ID NO: 1890640 - RNA, 16 nt, Human
ggccacaucaaagagg

SEQ ID NO: 1890641 - RNA, 20 nt, Human
ggccacugugaagagaacca

SEQ ID NO: 1890642 - RNA, 15 nt, Human
ggccacuucugggug

SEQ ID NO: 1890643 - RNA, 21 nt, Human
ggccacuucuggguggggcag

SEQ ID NO: 1890644 - RNA, 14 nt, Human
ggccagaagaugaa

SEQ ID NO: 1890645 - RNA, 21 nt, Human
ggccagaagaugaacagacug

SEQ ID NO: 1890646 - RNA, 16 nt, Human
ggccagacacaggccc

SEQ ID NO: 1890647 - RNA, 17 nt, Human
ggccagacacaggcccu

SEQ ID NO: 1890648 - RNA, 18 nt, Human
ggccagacacaggcccuc

SEQ ID NO: 1890649 - RNA, 15 nt, Human
ggccagacaugccac

SEQ ID NO: 1890650 - RNA, 11 nt, Human
ggccaggagcc

SEQ ID NO: 1890651 - RNA, 13 nt, Human
ggccaggagccuc

SEQ ID NO: 1890652 - RNA, 14 nt, Human
ggccaggcccucug

SEQ ID NO: 1890653 - RNA, 17 nt, Human
ggccaggcccucugccc

SEQ ID NO: 1890654 - RNA, 15 nt, Human
ggccaggcccucugc

SEQ ID NO: 1890655 - RNA, 16 nt, Human
ggccaggcccucugcc

SEQ ID NO: 1890656 - RNA, 18 nt, Human
ggcagagcugcuccccuc

SEQ ID NO: 1890657 - RNA, 22 nt, Human
ggcagagcagagaccaucccug

SEQ ID NO: 1890658 - RNA, 21 nt, Human
ggcagagguugcagugagccg

SEQ ID NO: 1890659 - RNA, 20 nt, Human
ggcacucagaagacacugau

SEQ ID NO: 1890660 - RNA, 19 nt, Human
ggcacucagaagacacuga

SEQ ID NO: 1890661 - RNA, 18 nt, Human
ggcacucagaagacacug

SEQ ID NO: 1890662 - RNA, 20 nt, Human
ggcacccggccccugcuggu

SEQ ID NO: 1890663 - RNA, 19 nt, Human
ggcacccggccccugcugg

SEQ ID NO: 1890664 - RNA, 18 nt, Human
ggcacccggccccugcug

SEQ ID NO: 1890665 - RNA, 20 nt, Human
ggcacccaccaucaugucug

SEQ ID NO: 1890666 - RNA, 18 nt, Human
ggcacccaagaccucagg

SEQ ID NO: 1890667 - RNA, 22 nt, Human
ggcacccaagaccucagggcac

SEQ ID NO: 1890668 - RNA, 17 nt, Human
ggcaccagcagccugga

SEQ ID NO: 1890669 - RNA, 19 nt, Human
ggcaagcaccuccugccuc

SEQ ID NO: 1890670 - RNA, 18 nt, Human
ggcaagcaccuccugccu

SEQ ID NO: 1890671 - RNA, 17 nt, Human
ggcaagcaccuccugcc

SEQ ID NO: 1890672 - RNA, 21 nt, Human
ggauucuuccucccucccucu

SEQ ID NO: 1890673 - RNA, 23 nt, Human
ggagucccaccuuggcugcaggg

SEQ ID NO: 1890674 - RNA, 16 nt, Human
ggaugaucuaggaaga

SEQ ID NO: 1890675 - RNA, 18 nt, Human
ggaugaucuaggaagacu

SEQ ID NO: 1890676 - RNA, 22 nt, Human
ggaugaucuaggaagacuuugg

SEQ ID NO: 1890677 - RNA, 17 nt, Human
ggaugccugguggcagc

SEQ ID NO: 1890678 - RNA, 13 nt, Human
ggaugccuggugg

SEQ ID NO: 1890679 - RNA, 19 nt, Human
ggaugcccaaagaugcagc

SEQ ID NO: 1890680 - RNA, 18 nt, Human
ggaugaugacuauggaaa

SEQ ID NO: 1890681 - RNA, 18 nt, Human
ggaugcccaaagaugcag

SEQ ID NO: 1890682 - RNA, 21 nt, Human
ggaugccugguggcagcugcg

SEQ ID NO: 1890683 - RNA, 20 nt, Human
ggaugccugguggcagcugc

SEQ ID NO: 1890684 - RNA, 19 nt, Human
ggaugccugguggcagcug

SEQ ID NO: 1890685 - RNA, 18 nt, Human
ggaugccugguggcagcu

SEQ ID NO: 1890686 - RNA, 12 nt, Human
ggauuauauuau

SEQ ID NO: 1890687 - RNA, 18 nt, Human
ggaugcccuggagguggc

SEQ ID NO: 1890688 - RNA, 21 nt, Human
ggaugcccuggagguggcuga

SEQ ID NO: 1890689 - RNA, 12 nt, Human
ggaugcccugga

SEQ ID NO: 1890690 - RNA, 13 nt, Human
ggaugcccuggag

SEQ ID NO: 1890691 - RNA, 15 nt, Human
ggaugcccuggaggu

SEQ ID NO: 1890692 - RNA, 16 nt, Human
ggauucugagagcugu

SEQ ID NO: 1890693 - RNA, 13 nt, Human
ggauuccucuuuu

SEQ ID NO: 1890694 - RNA, 18 nt, Human
ggauuccucuuuucucug

SEQ ID NO: 1890695 - RNA, 15 nt, Human
ggauuccucuuuucu

SEQ ID NO: 1890696 - RNA, 21 nt, Human
ggauucaggaauguguggccu

SEQ ID NO: 1890697 - RNA, 22 nt, Human
ggcccagaggagcugggagccg

SEQ ID NO: 1890698 - RNA, 18 nt, Human
ggcccagagcccagcucc

SEQ ID NO: 1890699 - RNA, 19 nt, Human
ggcccagagcccagcucca

SEQ ID NO: 1890700 - RNA, 14 nt, Human
ggcccagagggccu

SEQ ID NO: 1890701 - RNA, 12 nt, Human
ggcccagagccc

SEQ ID NO: 1890702 - RNA, 13 nt, Human
ggcccagagccca

SEQ ID NO: 1890703 - RNA, 14 nt, Human
ggcccagagcccag

SEQ ID NO: 1890704 - RNA, 15 nt, Human
ggcccagagcccagc

SEQ ID NO: 1890705 - RNA, 16 nt, Human
ggcccagagcccagcu

SEQ ID NO: 1890706 - RNA, 17 nt, Human
ggcccagagcccagcuc

SEQ ID NO: 1890707 - RNA, 20 nt, Human
ggcccagagggccugcaagg

SEQ ID NO: 1890708 - RNA, 17 nt, Human
ggcccagagggccugca

SEQ ID NO: 1890709 - RNA, 19 nt, Human
ggcccagagggccugcaag

SEQ ID NO: 1890710 - RNA, 22 nt, Human
ggccgggaccccgagccuggcu

SEQ ID NO: 1890711 - RNA, 23 nt, Human
ggccgggaccccgagccuggcuc

SEQ ID NO: 1890712 - RNA, 14 nt, Human
ggccgggcagaggg

SEQ ID NO: 1890713 - RNA, 16 nt, Human
ggccgggcagaggggc

SEQ ID NO: 1890714 - RNA, 18 nt, Human
ggccucaagaucaaugaa

SEQ ID NO: 1890715 - RNA, 12 nt, Human
ggccucaagauc

SEQ ID NO: 1890716 - RNA, 22 nt, Human
ggccucaagugauucuccugcc

SEQ ID NO: 1890717 - RNA, 14 nt, Human
ggccucaagugauu

SEQ ID NO: 1890718 - RNA, 22 nt, Human
ggccuagcauacguacacauuu

SEQ ID NO: 1890719 - RNA, 20 nt, Human
ggccuagcauacguacacau

SEQ ID NO: 1890720 - RNA, 14 nt, Human
ggccuccugugugu

SEQ ID NO: 1890721 - RNA, 19 nt, Human
ggccucgcaggaagaccca

SEQ ID NO: 1890722 - RNA, 20 nt, Human
ggccucucauuccagaggaa

SEQ ID NO: 1890723 - RNA, 23 nt, Human
ggccugggggcugggcagaggaa

SEQ ID NO: 1890724 - RNA, 15 nt, Human
ggccuggccugagcu

SEQ ID NO: 1890725 - RNA, 16 nt, Human
ggccuggccugagcug

SEQ ID NO: 1890726 - RNA, 18 nt, Human
ggccugagcgcuccugcc

SEQ ID NO: 1890727 - RNA, 23 nt, Human
ggcgcagcauauucaggaagcuc

SEQ ID NO: 1890728 - RNA, 24 nt, Human
ggcgcagcauauucaggaagcuca

SEQ ID NO: 1890729 - RNA, 16 nt, Human
ggcgcacugccucuca

SEQ ID NO: 1890730 - RNA, 12 nt, Human
ggcgcacuguga

SEQ ID NO: 1890731 - RNA, 14 nt, Human
ggcgcacugccucu

SEQ ID NO: 1890732 - RNA, 13 nt, Human
ggccuggccccuc

SEQ ID NO: 1890733 - RNA, 22 nt, Human
ggccugagauuucaucugcucu

SEQ ID NO: 1890734 - RNA, 20 nt, Human
ggccugagauuucaucugcu

SEQ ID NO: 1890735 - RNA, 22 nt, Human
ggccucugcacuccccugcugg

SEQ ID NO: 1890736 - RNA, 16 nt, Human
ggccugacucucagca

SEQ ID NO: 1890737 - RNA, 18 nt, Human
ggccucugcacuccccug

SEQ ID NO: 1890738 - RNA, 19 nt, Human
ggccucugcacuccccugc

SEQ ID NO: 1890739 - RNA, 14 nt, Human
ggccuggccccuca

SEQ ID NO: 1890740 - RNA, 15 nt, Human
ggccuggccccucag

SEQ ID NO: 1890741 - RNA, 17 nt, Human
ggccuggccccucaggg

SEQ ID NO: 1890742 - RNA, 18 nt, Human
ggccuggccccucagggu

SEQ ID NO: 1890743 - RNA, 23 nt, Human
ggccuggccccucagggucccug

SEQ ID NO: 1890744 - RNA, 10 nt, Human
ggccuggccu

SEQ ID NO: 1890745 - RNA, 13 nt, Human
ggccuggccugag

SEQ ID NO: 1890746 - RNA, 14 nt, Human
ggccuggccugagc

SEQ ID NO: 1890747 - RNA, 14 nt, Human
ggcucccaggacac

SEQ ID NO: 1890748 - RNA, 15 nt, Human
ggcuccaggcuccuu

SEQ ID NO: 1890749 - RNA, 14 nt, Human
ggcuccaggcuccu

SEQ ID NO: 1890750 - RNA, 15 nt, Human
ggcucucaggccagc

SEQ ID NO: 1890751 - RNA, 16 nt, Human
ggcucucaggccagcu

SEQ ID NO: 1890752 - RNA, 17 nt, Human
ggcucucaggccagcug

SEQ ID NO: 1890753 - RNA, 18 nt, Human
ggcucucaggccagcugc

SEQ ID NO: 1890754 - RNA, 19 nt, Human
ggcucucaggccagcugcu

SEQ ID NO: 1890755 - RNA, 20 nt, Human
ggcucucaggccagcugcuu

SEQ ID NO: 1890756 - RNA, 23 nt, Human
ggcucucauguuuucaacugcca

SEQ ID NO: 1890757 - RNA, 17 nt, Human
ggcucuggagcccacug

SEQ ID NO: 1890758 - RNA, 19 nt, Human
ggcucuggagcccacugua

SEQ ID NO: 1890759 - RNA, 16 nt, Human
ggcucuggagcccacu

SEQ ID NO: 1890760 - RNA, 16 nt, Human
ggcucugccucccauc

SEQ ID NO: 1890761 - RNA, 14 nt, Human
ggcucugcccuugg

SEQ ID NO: 1890762 - RNA, 15 nt, Human
ggcucugcccuuggu

SEQ ID NO: 1890763 - RNA, 13 nt, Human
ggcucugccuccc

SEQ ID NO: 1890764 - RNA, 15 nt, Human
ggcucugccucccau

SEQ ID NO: 1890765 - RNA, 12 nt, Human
ggcucugcccuu

SEQ ID NO: 1890766 - RNA, 9 nt, Human
ggcuccaga

SEQ ID NO: 1890767 - RNA, 16 nt, Human
ggcuccacuuggucug

SEQ ID NO: 1890768 - RNA, 14 nt, Human
ggcuaugcauuuga

SEQ ID NO: 1890769 - RNA, 15 nt, Human
ggcucacacugagaa

SEQ ID NO: 1890770 - RNA, 18 nt, Human
ggcucacacugagaaugu

SEQ ID NO: 1890771 - RNA, 17 nt, Human
ggcucacacugagaaug

SEQ ID NO: 1890772 - RNA, 13 nt, Human
ggcuaugcauuug

SEQ ID NO: 1890773 - RNA, 12 nt, Human
ggcuaugcauuu

SEQ ID NO: 1890774 - RNA, 13 nt, Human
ggcuccaggcucc

SEQ ID NO: 1890775 - RNA, 12 nt, Human
ggcuccaggcuc

SEQ ID NO: 1890776 - RNA, 18 nt, Human
ggcuccaggagcagccac

SEQ ID NO: 1890777 - RNA, 17 nt, Human
ggcuccaggagcagcca

SEQ ID NO: 1890778 - RNA, 10 nt, Human
ggcuccagac

SEQ ID NO: 1890779 - RNA, 14 nt, Human
ggcuccaggagcag

SEQ ID NO: 1890780 - RNA, 16 nt, Human
ggcuccaggagcagcc

SEQ ID NO: 1890781 - RNA, 17 nt, Human
ggcgcugccccuggcag

SEQ ID NO: 1890782 - RNA, 11 nt, Human
ggcgcugcccc

SEQ ID NO: 1890783 - RNA, 19 nt, Human
ggcgccgcaaaccacacug

SEQ ID NO: 1890784 - RNA, 15 nt, Human
ggcgcgguggcucac

SEQ ID NO: 1890785 - RNA, 20 nt, Human
ggcuaguaucaaaagaaaga

SEQ ID NO: 1890786 - RNA, 16 nt, Human
ggcuagucaagcuccu

SEQ ID NO: 1890787 - RNA, 17 nt, Human
ggcuagucaagcuccuc

SEQ ID NO: 1890788 - RNA, 19 nt, Human
ggcuagucaagcuccuccu

SEQ ID NO: 1890789 - RNA, 22 nt, Human
ggcuagucaagcuccuccuccc

SEQ ID NO: 1890790 - RNA, 23 nt, Human
ggcuagucaagcuccuccucccu

SEQ ID NO: 1890791 - RNA, 16 nt, Human
gggagccgggccgcag

SEQ ID NO: 1890792 - RNA, 19 nt, Human
gggagccccuucugcucag

SEQ ID NO: 1890793 - RNA, 21 nt, Human
gggagccuuugguucuggcca

SEQ ID NO: 1890794 - RNA, 12 nt, Human
gggagccucccu

SEQ ID NO: 1890795 - RNA, 21 nt, Human
gggagccucccugccucaggc

SEQ ID NO: 1890796 - RNA, 15 nt, Human
gggagcuagccagag

SEQ ID NO: 1890797 - RNA, 18 nt, Human
gggagcuagccagaggac

SEQ ID NO: 1890798 - RNA, 22 nt, Human
gggagccuuugguucuggccag

SEQ ID NO: 1890799 - RNA, 21 nt, Human
gggagcuccaacucagaaggg

SEQ ID NO: 1890800 - RNA, 22 nt, Human
gggagcugccuguucagcucca

SEQ ID NO: 1890801 - RNA, 21 nt, Human
gggagcugccuguucagcucc

SEQ ID NO: 1890802 - RNA, 13 nt, Human
gggagcugccugu

SEQ ID NO: 1890803 - RNA, 16 nt, Human
gggagcugcaggggca

SEQ ID NO: 1890804 - RNA, 12 nt, Human
gggagcugaggc

SEQ ID NO: 1890805 - RNA, 22 nt, Human
gggaggauguucugggacacag

SEQ ID NO: 1890806 - RNA, 21 nt, Human
gggaggauugcuugagcucag

SEQ ID NO: 1890807 - RNA, 23 nt, Human
gggaggaucucuugagccuggga

SEQ ID NO: 1890808 - RNA, 20 nt, Human
gggaggacgcucucuggccu

SEQ ID NO: 1890809 - RNA, 17 nt, Human
gggaggacgcucucugg

SEQ ID NO: 1890810 - RNA, 17 nt, Human
gggagugacagaggcag

SEQ ID NO: 1890811 - RNA, 18 nt, Human
gggagguugaucagaucu

SEQ ID NO: 1890812 - RNA, 21 nt, Human
gggagugaguugauagcacag

SEQ ID NO: 1890813 - RNA, 23 nt, Human
gggaggauugcuugagcucagga

SEQ ID NO: 1890814 - RNA, 20 nt, Human
gggaggugggauccuccagg

SEQ ID NO: 1890815 - RNA, 12 nt, Human
gggaaucaagau

SEQ ID NO: 1890816 - RNA, 14 nt, Human
gggaaucagaacuc

SEQ ID NO: 1890817 - RNA, 23 nt, Human
gggaauagucuagauggcuccuc

SEQ ID NO: 1890818 - RNA, 23 nt, Human
gggaagugaagacuggaagcuaa

SEQ ID NO: 1890819 - RNA, 20 nt, Human
ggcuuuuacugaagccuuuc

SEQ ID NO: 1890820 - RNA, 18 nt, Human
ggcuuuuacugaagccuu

SEQ ID NO: 1890821 - RNA, 12 nt, Human
ggcuuuggauuu

SEQ ID NO: 1890822 - RNA, 13 nt, Human
ggcuuuggcuucu

SEQ ID NO: 1890823 - RNA, 21 nt, Human
ggcuuugcaaccauuuucauu

SEQ ID NO: 1890824 - RNA, 15 nt, Human
ggcuuugcaaccauu

SEQ ID NO: 1890825 - RNA, 21 nt, Human
gggaauguuugccucugccuc

SEQ ID NO: 1890826 - RNA, 19 nt, Human
gggaauguuugccucugcc

SEQ ID NO: 1890827 - RNA, 22 nt, Human
gggacaaguggacucagggcag

SEQ ID NO: 1890828 - RNA, 14 nt, Human
gggacacccuguga

SEQ ID NO: 1890829 - RNA, 20 nt, Human
gggacaccaagccuuggcuc

SEQ ID NO: 1890830 - RNA, 19 nt, Human
gggacaaguggacucaggg

SEQ ID NO: 1890831 - RNA, 21 nt, Human
gggacccaauguaggagcugc

SEQ ID NO: 1890832 - RNA, 23 nt, Human
gggacucaaugcacugacauugu

SEQ ID NO: 1890833 - RNA, 15 nt, Human
gggacugagaaauuu

SEQ ID NO: 1890834 - RNA, 21 nt, Human
gggacugaggggaggggagca

SEQ ID NO: 1890835 - RNA, 14 nt, Human
gggacguggcucag

SEQ ID NO: 1890836 - RNA, 18 nt, Human
gggacguggcucagccag

SEQ ID NO: 1890837 - RNA, 19 nt, Human
gggagcccacuguccuggg

SEQ ID NO: 1890838 - RNA, 20 nt, Human
gggagcccacuguccugggc

SEQ ID NO: 1890839 - RNA, 21 nt, Human
gggagcccacuguccugggcc

SEQ ID NO: 1890840 - RNA, 19 nt, Human
gggacucaaugcacugaca

SEQ ID NO: 1890841 - RNA, 17 nt, Human
gggacucaaugcacuga

SEQ ID NO: 1890842 - RNA, 17 nt, Human
gggacgaagaagagcca

SEQ ID NO: 1890843 - RNA, 19 nt, Human
gggacgaagaagagccaca

SEQ ID NO: 1890844 - RNA, 20 nt, Human
gggacgaagaagagccacag

SEQ ID NO: 1890845 - RNA, 21 nt, Human
gggacgaagaagagccacagu

SEQ ID NO: 1890846 - RNA, 16 nt, Human
gggaccccgagccugg

SEQ ID NO: 1890847 - RNA, 21 nt, Human
gggacccccgcccccugcccu

SEQ ID NO: 1890848 - RNA, 24 nt, Human
gggacccccgcccccugcccuccc

SEQ ID NO: 1890849 - RNA, 13 nt, Human
gggacccccgccc

SEQ ID NO: 1890850 - RNA, 14 nt, Human
gggacccccgcccc

SEQ ID NO: 1890851 - RNA, 17 nt, Human
gggacccccgcccccug

SEQ ID NO: 1890852 - RNA, 18 nt, Human
gggacccccgcccccugc

SEQ ID NO: 1890853 - RNA, 19 nt, Human
gggacccccgcccccugcc

SEQ ID NO: 1890854 - RNA, 15 nt, Human
ggcuuaaaacaacac

SEQ ID NO: 1890855 - RNA, 20 nt, Human
ggcuguuggcugggggccuc

SEQ ID NO: 1890856 - RNA, 16 nt, Human
ggcuguuggcuggggg

SEQ ID NO: 1890857 - RNA, 15 nt, Human
ggcuguuggcugggg

SEQ ID NO: 1890858 - RNA, 14 nt, Human
ggcuguuggcuggg

SEQ ID NO: 1890859 - RNA, 15 nt, Human
ggcuugccugcaggc

SEQ ID NO: 1890860 - RNA, 14 nt, Human
ggcuugccugcagg

SEQ ID NO: 1890861 - RNA, 17 nt, Human
ggcuuggggaccagagc

SEQ ID NO: 1890862 - RNA, 18 nt, Human
ggcuuggggaccagagcu

SEQ ID NO: 1890863 - RNA, 14 nt, Human
ggcuuagucacuga

SEQ ID NO: 1890864 - RNA, 15 nt, Human
ggcuuagucacugag

SEQ ID NO: 1890865 - RNA, 20 nt, Human
ggcuucacggaagagccuug

SEQ ID NO: 1890866 - RNA, 21 nt, Human
ggcuucacggaagagccuugc

SEQ ID NO: 1890867 - RNA, 15 nt, Human
ggcuucacuccugcu

SEQ ID NO: 1890868 - RNA, 13 nt, Human
ggcuugccugcag

SEQ ID NO: 1890869 - RNA, 17 nt, Human
ggcuucacuccugcugu

SEQ ID NO: 1890870 - RNA, 21 nt, Human
ggcugcuucaaggauccugag

SEQ ID NO: 1890871 - RNA, 20 nt, Human
ggcugcuucaaggauccuga

SEQ ID NO: 1890872 - RNA, 16 nt, Human
ggcuggacugaggccu

SEQ ID NO: 1890873 - RNA, 14 nt, Human
ggcuggacugaggc

SEQ ID NO: 1890874 - RNA, 13 nt, Human
ggcuggacugagg

SEQ ID NO: 1890875 - RNA, 18 nt, Human
ggcuggacugaggccuga

SEQ ID NO: 1890876 - RNA, 17 nt, Human
ggcuggacugaggccug

SEQ ID NO: 1890877 - RNA, 13 nt, Human
ggcuggacuugga

SEQ ID NO: 1890878 - RNA, 18 nt, Human
ggcuggagcuagaauuug

SEQ ID NO: 1890879 - RNA, 18 nt, Human
ggcuggacuuggagguag

SEQ ID NO: 1890880 - RNA, 14 nt, Human
ggcuggagugagga

SEQ ID NO: 1890881 - RNA, 16 nt, Human
ggcuggagugaggaaa

SEQ ID NO: 1890882 - RNA, 23 nt, Human
ggcucuggagcccacuguacuug

SEQ ID NO: 1890883 - RNA, 23 nt, Human
ggcucugggauagcugacccagc

SEQ ID NO: 1890884 - RNA, 15 nt, Human
ggcugcuucaaggau

SEQ ID NO: 1890885 - RNA, 19 nt, Human
ggcugcuucaaggauccug

SEQ ID NO: 1890886 - RNA, 14 nt, Human
ggcugaggcuggca

SEQ ID NO: 1890887 - RNA, 17 nt, Human
ggcugaggcuggcacag

SEQ ID NO: 1890888 - RNA, 18 nt, Human
ggcugaggcuggcacagg

SEQ ID NO: 1890889 - RNA, 14 nt, Human
ggcugggggccuca

SEQ ID NO: 1890890 - RNA, 16 nt, Human
ggcugggggaagaagc

SEQ ID NO: 1890891 - RNA, 22 nt, Human
ggcugggcuucaguggcagcug

SEQ ID NO: 1890892 - RNA, 21 nt, Human
ggcugggcuucaguggcagcu

SEQ ID NO: 1890893 - RNA, 11 nt, Human
ggcugggcuuc

SEQ ID NO: 1890894 - RNA, 20 nt, Human
ggcugggcucccuucccacc

SEQ ID NO: 1890895 - RNA, 21 nt, Human
ggcugggcucccuucccaccu

SEQ ID NO: 1890896 - RNA, 20 nt, Human
ggcuggagugcaguggugug

SEQ ID NO: 1890897 - RNA, 23 nt, Human
gcuggccaucugguuaggauggc

SEQ ID NO: 1890898 - RNA, 21 nt, Human
gcuggcaugauccaagcaaga

SEQ ID NO: 1890899 - RNA, 15 nt, Human
gcuggaccuugaacu

SEQ ID NO: 1890900 - RNA, 16 nt, Human
gcuggaccuugaacug

SEQ ID NO: 1890901 - RNA, 20 nt, Human
gcuggacaguaucacugucu

SEQ ID NO: 1890902 - RNA, 20 nt, Human
gcuggaaacagacucgauuc

SEQ ID NO: 1890903 - RNA, 22 nt, Human
gcugcuuuugucuaugggacuc

SEQ ID NO: 1890904 - RNA, 21 nt, Human
gcugcgguccacccaggagcc

SEQ ID NO: 1890905 - RNA, 22 nt, Human
gcugcgguccacccaggagccc

SEQ ID NO: 1890906 - RNA, 17 nt, Human
gcugcgucauuacaggg

SEQ ID NO: 1890907 - RNA, 15 nt, Human
gcugcgguccaccca

SEQ ID NO: 1890908 - RNA, 14 nt, Human
gcugcgguccaccc

SEQ ID NO: 1890909 - RNA, 14 nt, Human
gcugccuuggcuca

SEQ ID NO: 1890910 - RNA, 15 nt, Human
gcugcggagcaagag

SEQ ID NO: 1890911 - RNA, 16 nt, Human
gcugcggagcaagagg

SEQ ID NO: 1890912 - RNA, 19 nt, Human
gcugccuguucagcuccag

SEQ ID NO: 1890913 - RNA, 18 nt, Human
gcugccuguucagcucca

SEQ ID NO: 1890914 - RNA, 22 nt, Human
gcugccuguucagcuccagcuc

SEQ ID NO: 1890915 - RNA, 20 nt, Human
gcugccuguucagcuccagc

SEQ ID NO: 1890916 - RNA, 16 nt, Human
gcugcccugcccaccu

SEQ ID NO: 1890917 - RNA, 18 nt, Human
gcugcccugcccaccugg

SEQ ID NO: 1890918 - RNA, 20 nt, Human
gcugcccugcccaccuggcc

SEQ ID NO: 1890919 - RNA, 21 nt, Human
gcugcccugcccaccuggccu

SEQ ID NO: 1890920 - RNA, 22 nt, Human
gcugcccugcccaccuggccuc

SEQ ID NO: 1890921 - RNA, 23 nt, Human
gcugcccugcccaccuggccucu

SEQ ID NO: 1890922 - RNA, 24 nt, Human
gcugcccugcccaccuggccucug

SEQ ID NO: 1890923 - RNA, 13 nt, Human
gcugcccugccca

SEQ ID NO: 1890924 - RNA, 14 nt, Human
gcugcccugcccac

SEQ ID NO: 1890925 - RNA, 12 nt, Human
gcugcccugccc

SEQ ID NO: 1890926 - RNA, 23 nt, Human
gcugcaaaggguaucaggugcug

SEQ ID NO: 1890927 - RNA, 22 nt, Human
gcugcaaaggguaucaggugcu

SEQ ID NO: 1890928 - RNA, 17 nt, Human
gcugauuuggugaccaa

SEQ ID NO: 1890929 - RNA, 21 nt, Human
gcugauuaaaccaaggcuaga

SEQ ID NO: 1890930 - RNA, 14 nt, Human
gcugauuguauuua

SEQ ID NO: 1890931 - RNA, 18 nt, Human
gcugagaagcuuuugaau

SEQ ID NO: 1890932 - RNA, 19 nt, Human
gcugcauuuaaaagauaca

SEQ ID NO: 1890933 - RNA, 18 nt, Human
gcugcauuuaaaagauac

SEQ ID NO: 1890934 - RNA, 17 nt, Human
gcugcaguugccaguca

SEQ ID NO: 1890935 - RNA, 13 nt, Human
gcugcaguugcca

SEQ ID NO: 1890936 - RNA, 14 nt, Human
gcugcaguugccag

SEQ ID NO: 1890937 - RNA, 13 nt, Human
gcugcaaaggaca

SEQ ID NO: 1890938 - RNA, 15 nt, Human
gcugcaaaggacaga

SEQ ID NO: 1890939 - RNA, 20 nt, Human
gcugccaaugggagcucaug

SEQ ID NO: 1890940 - RNA, 12 nt, Human
gcugccaccugc

SEQ ID NO: 1890941 - RNA, 14 nt, Human
gcugccacccaccu

SEQ ID NO: 1890942 - RNA, 17 nt, Human
gcugccacccaccuccc

SEQ ID NO: 1890943 - RNA, 19 nt, Human
gcugccacccaccucccug

SEQ ID NO: 1890944 - RNA, 20 nt, Human
gcugccacccaccucccugc

SEQ ID NO: 1890945 - RNA, 21 nt, Human
gcugccacccaccucccugcc

SEQ ID NO: 1890946 - RNA, 13 nt, Human
gcugccaccugcc

SEQ ID NO: 1890947 - RNA, 22 nt, Human
gcugccacccaccucccugccu

SEQ ID NO: 1890948 - RNA, 23 nt, Human
gcugccacccaccucccugccuc

SEQ ID NO: 1890949 - RNA, 19 nt, Human
gcugacagacacaggcccg

SEQ ID NO: 1890950 - RNA, 18 nt, Human
gcugacagacacaggccc

SEQ ID NO: 1890951 - RNA, 17 nt, Human
gcugacagacacaggcc

SEQ ID NO: 1890952 - RNA, 20 nt, Human
gcugacagacacaggcccgg

SEQ ID NO: 1890953 - RNA, 16 nt, Human
gcugacauucaccugc

SEQ ID NO: 1890954 - RNA, 17 nt, Human
gcugacauucaccugcc

SEQ ID NO: 1890955 - RNA, 13 nt, Human
gcugaccacagca

SEQ ID NO: 1890956 - RNA, 22 nt, Human
gcugacuguuuucucuugagag

SEQ ID NO: 1890957 - RNA, 13 nt, Human
gcugacggccagg

SEQ ID NO: 1890958 - RNA, 15 nt, Human
gcugacggccaggga

SEQ ID NO: 1890959 - RNA, 19 nt, Human
gcugacuucaucucccacc

SEQ ID NO: 1890960 - RNA, 24 nt, Human
gcugacuucaucucccaccuagca

SEQ ID NO: 1890961 - RNA, 14 nt, Human
gcugaccacagcac

SEQ ID NO: 1890962 - RNA, 16 nt, Human
gcugaccacagcacag

SEQ ID NO: 1890963 - RNA, 17 nt, Human
gcugaccacagcacagc

SEQ ID NO: 1890964 - RNA, 19 nt, Human
gcugaccacagcacagcca

SEQ ID NO: 1890965 - RNA, 19 nt, Human
gcucuugaugccuggcggg

SEQ ID NO: 1890966 - RNA, 12 nt, Human
gcucuuugcacu

SEQ ID NO: 1890967 - RNA, 13 nt, Human
gcucuuugcacua

SEQ ID NO: 1890968 - RNA, 15 nt, Human
gcucuccaagcccag

SEQ ID NO: 1890969 - RNA, 21 nt, Human
gcucucaggccagcugcuugg

SEQ ID NO: 1890970 - RNA, 20 nt, Human
gcuucaguggcagcugcuuu

SEQ ID NO: 1890971 - RNA, 13 nt, Human
gcuuaucucaggg

SEQ ID NO: 1890972 - RNA, 19 nt, Human
gcuucaguggcagcugcuu

SEQ ID NO: 1890973 - RNA, 11 nt, Human
gcuucauacac

SEQ ID NO: 1890974 - RNA, 10 nt, Human
gcuucauaca

SEQ ID NO: 1890975 - RNA, 12 nt, Human
gcuuacggcccu

SEQ ID NO: 1890976 - RNA, 15 nt, Human
gcuuacggcccuggc

SEQ ID NO: 1890977 - RNA, 16 nt, Human
gcuuacggcccuggcc

SEQ ID NO: 1890978 - RNA, 17 nt, Human
gcuuacggcccuggccu

SEQ ID NO: 1890979 - RNA, 19 nt, Human
gcuuacggcccuggccuug

SEQ ID NO: 1890980 - RNA, 22 nt, Human
gcuucucacugccaugccagcu

SEQ ID NO: 1890981 - RNA, 16 nt, Human
gcuucucauccugcag

SEQ ID NO: 1890982 - RNA, 18 nt, Human
gcuucauuuccugugucu

SEQ ID NO: 1890983 - RNA, 16 nt, Human
gcuucuguugucaccu

SEQ ID NO: 1890984 - RNA, 17 nt, Human
gcuucuguugucaccuu

SEQ ID NO: 1890985 - RNA, 18 nt, Human
gcuucucauccugcaggc

SEQ ID NO: 1890986 - RNA, 17 nt, Human
gcuucucauccugcagg

SEQ ID NO: 1890987 - RNA, 20 nt, Human
gcuuugguuauauuuagcuc

SEQ ID NO: 1890988 - RNA, 13 nt, Human
gcuuuuaugugaa

SEQ ID NO: 1890989 - RNA, 15 nt, Human
gcuuuuaugugaaac

SEQ ID NO: 1890990 - RNA, 14 nt, Human
gcuuuccaaagcca

SEQ ID NO: 1890991 - RNA, 14 nt, Human
gcuuguuggauuuu

SEQ ID NO: 1890992 - RNA, 15 nt, Human
gcuuguuauuuauaa

SEQ ID NO: 1890993 - RNA, 21 nt, Human
gcuuguuaaugcuuucugaag

SEQ ID NO: 1890994 - RNA, 13 nt, Human
gcuuguuaaugcu

SEQ ID NO: 1890995 - RNA, 23 nt, Human
gcuuguuaaugcuuucugaagcu

SEQ ID NO: 1890996 - RNA, 16 nt, Human
gcuuggacggcugggc

SEQ ID NO: 1890997 - RNA, 18 nt, Human
gcuuggaaacuggaugag

SEQ ID NO: 1890998 - RNA, 14 nt, Human
gcuugccugcaggc

SEQ ID NO: 1890999 - RNA, 13 nt, Human
gcuugccugcagg

SEQ ID NO: 1891000 - RNA, 19 nt, Human
gcuucuguugucaccuuca

SEQ ID NO: 1891001 - RNA, 15 nt, Human
gcuggugucaccuga

SEQ ID NO: 1891002 - RNA, 14 nt, Human
gcuggugucaccug

SEQ ID NO: 1891003 - RNA, 14 nt, Human
gcugucaucugugc

SEQ ID NO: 1891004 - RNA, 15 nt, Human
gcugucaucugugca

SEQ ID NO: 1891005 - RNA, 16 nt, Human
gcugucaucugugcac

SEQ ID NO: 1891006 - RNA, 17 nt, Human
gcugucagccauuccug

SEQ ID NO: 1891007 - RNA, 23 nt, Human
gcugucccuuacgugaguccugg

SEQ ID NO: 1891008 - RNA, 16 nt, Human
gcugucccuuuuccuu

SEQ ID NO: 1891009 - RNA, 22 nt, Human
gcugucaucugugcacugccca

SEQ ID NO: 1891010 - RNA, 16 nt, Human
gcuguguggcagucug

SEQ ID NO: 1891011 - RNA, 16 nt, Human
gcugugugcucuccaa

SEQ ID NO: 1891012 - RNA, 15 nt, Human
gcugugucucccuuc

SEQ ID NO: 1891013 - RNA, 13 nt, Human
gcuguccucaggu

SEQ ID NO: 1891014 - RNA, 18 nt, Human
gcuguccucagguggcca

SEQ ID NO: 1891015 - RNA, 19 nt, Human
gcuguccucagguggccau

SEQ ID NO: 1891016 - RNA, 20 nt, Human
gcuguccucagguggccaug

SEQ ID NO: 1891017 - RNA, 14 nt, Human
gcuggucccacuca

SEQ ID NO: 1891018 - RNA, 19 nt, Human
gcuggucucaaacuccuga

SEQ ID NO: 1891019 - RNA, 20 nt, Human
gcuggucucaaacuccugac

SEQ ID NO: 1891020 - RNA, 18 nt, Human
gcugggggccucagugcc

SEQ ID NO: 1891021 - RNA, 22 nt, Human
gcuggucaaacaaacucucuga

SEQ ID NO: 1891022 - RNA, 15 nt, Human
gcugggggccucagu

SEQ ID NO: 1891023 - RNA, 14 nt, Human
gcugggggccucag

SEQ ID NO: 1891024 - RNA, 14 nt, Human
gcuggggaugucuc

SEQ ID NO: 1891025 - RNA, 20 nt, Human
gcugggcuucaguggcagcu

SEQ ID NO: 1891026 - RNA, 22 nt, Human
gcugggcuucaguggcagcugc

SEQ ID NO: 1891027 - RNA, 21 nt, Human
gcugggcuucaguggcagcug

SEQ ID NO: 1891028 - RNA, 22 nt, Human
gcugggcuuggcagcccggguc

SEQ ID NO: 1891029 - RNA, 19 nt, Human
gcugggaugauuggagggg

SEQ ID NO: 1891030 - RNA, 21 nt, Human
gcugggcucccuucccaccuc

SEQ ID NO: 1891031 - RNA, 13 nt, Human
gcuggccuggccc

SEQ ID NO: 1891032 - RNA, 12 nt, Human
gcuggccuggcc

SEQ ID NO: 1891033 - RNA, 14 nt, Human
gcuggccuggcccc

SEQ ID NO: 1891034 - RNA, 15 nt, Human
gcuggccuggccccu

SEQ ID NO: 1891035 - RNA, 18 nt, Human
gcgcaguggcccugagca

SEQ ID NO: 1891036 - RNA, 15 nt, Human
gcgcaguggcccuga

SEQ ID NO: 1891037 - RNA, 18 nt, Human
gcgccaaauaaugucucu

SEQ ID NO: 1891038 - RNA, 23 nt, Human
gcgcccaguuggguggaugccug

SEQ ID NO: 1891039 - RNA, 22 nt, Human
gcgcccaguccuuccaccucga

SEQ ID NO: 1891040 - RNA, 21 nt, Human
gcgccuuaaggauguucuagc

SEQ ID NO: 1891041 - RNA, 17 nt, Human
gcgccgcaaaccacacu

SEQ ID NO: 1891042 - RNA, 18 nt, Human
gcgccgcaaaccacacug

SEQ ID NO: 1891043 - RNA, 14 nt, Human
gcgguccacccagg

SEQ ID NO: 1891044 - RNA, 13 nt, Human
gcgguccacccag

SEQ ID NO: 1891045 - RNA, 19 nt, Human
gcggugagaggggaacaga

SEQ ID NO: 1891046 - RNA, 23 nt, Human
gcgguagccagcacacagggcag

SEQ ID NO: 1891047 - RNA, 21 nt, Human
gcgguagccagcacacagggc

SEQ ID NO: 1891048 - RNA, 22 nt, Human
gcgguagccagcacacagggca

SEQ ID NO: 1891049 - RNA, 17 nt, Human
gcggggacagcuccuuc

SEQ ID NO: 1891050 - RNA, 15 nt, Human
gcggggacagcuccu

SEQ ID NO: 1891051 - RNA, 15 nt, Human
gcgguagccagcaca

SEQ ID NO: 1891052 - RNA, 14 nt, Human
gcggggacagcucc

SEQ ID NO: 1891053 - RNA, 19 nt, Human
gcggagacggagucccacc

SEQ ID NO: 1891054 - RNA, 16 nt, Human
gcggagaaaggaaggg

SEQ ID NO: 1891055 - RNA, 18 nt, Human
gcgcugccccuggcagcc

SEQ ID NO: 1891056 - RNA, 21 nt, Human
gcgcugccccuggcagccccu

SEQ ID NO: 1891057 - RNA, 20 nt, Human
gccuuguaauucuaaaugaa

SEQ ID NO: 1891058 - RNA, 17 nt, Human
gccuuguaauucuaaau

SEQ ID NO: 1891059 - RNA, 13 nt, Human
gccuuccucucuc

SEQ ID NO: 1891060 - RNA, 16 nt, Human
gccuuccucucuccag

SEQ ID NO: 1891061 - RNA, 17 nt, Human
gccuuccucucuccaga

SEQ ID NO: 1891062 - RNA, 18 nt, Human
gccuuccucucuccagau

SEQ ID NO: 1891063 - RNA, 15 nt, Human
gccuuguugaugugg

SEQ ID NO: 1891064 - RNA, 16 nt, Human
gccuuacacaaugguu

SEQ ID NO: 1891065 - RNA, 19 nt, Human
gccuuccuauuuugcauaa

SEQ ID NO: 1891066 - RNA, 15 nt, Human
gccuuacacaauggu

SEQ ID NO: 1891067 - RNA, 12 nt, Human
gcgacaaugcaa

SEQ ID NO: 1891068 - RNA, 13 nt, Human
gcgacaaugcaaa

SEQ ID NO: 1891069 - RNA, 20 nt, Human
gcgacaaugcaaaccaucau

SEQ ID NO: 1891070 - RNA, 21 nt, Human
gcgacaaugcaaaccaucauu

SEQ ID NO: 1891071 - RNA, 19 nt, Human
gccuuucccaacucuagcu

SEQ ID NO: 1891072 - RNA, 18 nt, Human
gccuuucccaacucuagc

SEQ ID NO: 1891073 - RNA, 16 nt, Human
gcgaauuuuaaaagau

SEQ ID NO: 1891074 - RNA, 15 nt, Human
gcgaauuuuaaaaga

SEQ ID NO: 1891075 - RNA, 14 nt, Human
gcgaauuuuaaaag

SEQ ID NO: 1891076 - RNA, 14 nt, Human
gccuggcacacauc

SEQ ID NO: 1891077 - RNA, 22 nt, Human
gccuggccagaugcaccagccc

SEQ ID NO: 1891078 - RNA, 21 nt, Human
gccuggccagaugcaccagcc

SEQ ID NO: 1891079 - RNA, 20 nt, Human
gccuggccagaugcaccagc

SEQ ID NO: 1891080 - RNA, 13 nt, Human
gccuggccccuca

SEQ ID NO: 1891081 - RNA, 14 nt, Human
gccuggccccucag

SEQ ID NO: 1891082 - RNA, 20 nt, Human
gccuguaauccuagcacuuu

SEQ ID NO: 1891083 - RNA, 15 nt, Human
gccuguaauccuagc

SEQ ID NO: 1891084 - RNA, 13 nt, Human
gccuggucagccc

SEQ ID NO: 1891085 - RNA, 15 nt, Human
gccuggucagcccaa

SEQ ID NO: 1891086 - RNA, 14 nt, Human
gccuggucagccca

SEQ ID NO: 1891087 - RNA, 16 nt, Human
gccuggcacacaucag

SEQ ID NO: 1891088 - RNA, 13 nt, Human
gccuggcacacau

SEQ ID NO: 1891089 - RNA, 20 nt, Human
gccuggauggggcugcaccg

SEQ ID NO: 1891090 - RNA, 20 nt, Human
gccuggauguugcugugcac

SEQ ID NO: 1891091 - RNA, 16 nt, Human
gccuggauggggcugc

SEQ ID NO: 1891092 - RNA, 18 nt, Human
gccuggauggggcugcac

SEQ ID NO: 1891093 - RNA, 18 nt, Human
gccugaagucacacagug

SEQ ID NO: 1891094 - RNA, 17 nt, Human
gccugaagucacacagu

SEQ ID NO: 1891095 - RNA, 20 nt, Human
gccugagcgacagugagacu

SEQ ID NO: 1891096 - RNA, 17 nt, Human
gccugagcgacagugag

SEQ ID NO: 1891097 - RNA, 16 nt, Human
gccugaagucacacag

SEQ ID NO: 1891098 - RNA, 22 nt, Human
gcccaguuggguggaugccugg

SEQ ID NO: 1891099 - RNA, 21 nt, Human
gcccaguuggguggaugccug

SEQ ID NO: 1891100 - RNA, 19 nt, Human
gcccaguuggguggaugcc

SEQ ID NO: 1891101 - RNA, 12 nt, Human
gccugagcuggg

SEQ ID NO: 1891102 - RNA, 22 nt, Human
gccugagcgcuccugccgcaga

SEQ ID NO: 1891103 - RNA, 23 nt, Human
gccugagcgcuccugccgcagag

SEQ ID NO: 1891104 - RNA, 17 nt, Human
gcuauaaacaauuacau

SEQ ID NO: 1891105 - RNA, 21 nt, Human
gcuaguugggcuuccucauag

SEQ ID NO: 1891106 - RNA, 19 nt, Human
gcggugcuaucucccccag

SEQ ID NO: 1891107 - RNA, 22 nt, Human
gcggugcuaucucccccagccc

SEQ ID NO: 1891108 - RNA, 16 nt, Human
gcggugcuguccucag

SEQ ID NO: 1891109 - RNA, 18 nt, Human
gcggugcuguccucaggu

SEQ ID NO: 1891110 - RNA, 18 nt, Human
gcuauaaauuccucuuug

SEQ ID NO: 1891111 - RNA, 23 nt, Human
gcuauaaauuccucuuugcuuug

SEQ ID NO: 1891112 - RNA, 19 nt, Human
gcuauccagcuauuuuuau

SEQ ID NO: 1891113 - RNA, 22 nt, Human
gcucaaguccucuuuucugaga

SEQ ID NO: 1891114 - RNA, 19 nt, Human
gcucaaguccucuuuucug

SEQ ID NO: 1891115 - RNA, 14 nt, Human
gcucacaccuguaa

SEQ ID NO: 1891116 - RNA, 18 nt, Human
gcucaaguccucuuuucu

SEQ ID NO: 1891117 - RNA, 18 nt, Human
gcucaagcgauucuccug

SEQ ID NO: 1891118 - RNA, 14 nt, Human
gcuaucucccccag

SEQ ID NO: 1891119 - RNA, 15 nt, Human
gcuaucucccccagc

SEQ ID NO: 1891120 - RNA, 15 nt, Human
gcuaucguaaaauua

SEQ ID NO: 1891121 - RNA, 16 nt, Human
gcuaucguaaaauuaa

SEQ ID NO: 1891122 - RNA, 17 nt, Human
gcuaucguaaaauuaag

SEQ ID NO: 1891123 - RNA, 13 nt, Human
gcuaucuccccca

SEQ ID NO: 1891124 - RNA, 18 nt, Human
gcucauggacuucugcca

SEQ ID NO: 1891125 - RNA, 12 nt, Human
gcucagcuucuc

SEQ ID NO: 1891126 - RNA, 13 nt, Human
gcucagcuucucc

SEQ ID NO: 1891127 - RNA, 16 nt, Human
gcucagcuucuccugu

SEQ ID NO: 1891128 - RNA, 16 nt, Human
gcucagcucugggcca

SEQ ID NO: 1891129 - RNA, 17 nt, Human
gcucagcucugggccau

SEQ ID NO: 1891130 - RNA, 23 nt, Human
gcucagcggggacagcuccuucu

SEQ ID NO: 1891131 - RNA, 19 nt, Human
gcucagcggggacagcucc

SEQ ID NO: 1891132 - RNA, 18 nt, Human
gcucagcggggacagcuc

SEQ ID NO: 1891133 - RNA, 17 nt, Human
gcucagcggggacagcu

SEQ ID NO: 1891134 - RNA, 16 nt, Human
gcucagcggggacagc

SEQ ID NO: 1891135 - RNA, 18 nt, Human
gcucaccagccccagugc

SEQ ID NO: 1891136 - RNA, 15 nt, Human
gcucaccagccccag

SEQ ID NO: 1891137 - RNA, 14 nt, Human
gcucaccagcccca

SEQ ID NO: 1891138 - RNA, 13 nt, Human
gcucaccagcccc

SEQ ID NO: 1891139 - RNA, 12 nt, Human
gcucaccagccc

SEQ ID NO: 1891140 - RNA, 16 nt, Human
gcucacauaucuguca

SEQ ID NO: 1891141 - RNA, 22 nt, Human
gcucacacugagaauguaagaa

SEQ ID NO: 1891142 - RNA, 14 nt, Human
gcucacacugagaa

SEQ ID NO: 1891143 - RNA, 13 nt, Human
gcucacacugaga

SEQ ID NO: 1891144 - RNA, 15 nt, Human
gcucagccagcacuu

SEQ ID NO: 1891145 - RNA, 14 nt, Human
gcucaccucucccu

SEQ ID NO: 1891146 - RNA, 16 nt, Human
gcucaccucucccuug

SEQ ID NO: 1891147 - RNA, 17 nt, Human
gcucaccucucccuugg

SEQ ID NO: 1891148 - RNA, 18 nt, Human
gcucaccucucccuugga

SEQ ID NO: 1891149 - RNA, 23 nt, Human
gcuccgcuuucuacccagcgagc

SEQ ID NO: 1891150 - RNA, 22 nt, Human
gcuccgcuuucuacccagcgag

SEQ ID NO: 1891151 - RNA, 21 nt, Human
gcuccgcuuucuacccagcga

SEQ ID NO: 1891152 - RNA, 18 nt, Human
gcuccgcuuucuacccag

SEQ ID NO: 1891153 - RNA, 20 nt, Human
gcucccuucccaccucucuc

SEQ ID NO: 1891154 - RNA, 12 nt, Human
gcuccaggcucc

SEQ ID NO: 1891155 - RNA, 18 nt, Human
gcuccaggccagggggcc

SEQ ID NO: 1891156 - RNA, 17 nt, Human
gcuccaggccagggggc

SEQ ID NO: 1891157 - RNA, 15 nt, Human
gcuccaggagcagcc

SEQ ID NO: 1891158 - RNA, 16 nt, Human
gcuccaggagcagcca

SEQ ID NO: 1891159 - RNA, 17 nt, Human
gcuccaggagcagccac

SEQ ID NO: 1891160 - RNA, 18 nt, Human
gcuccaggagcagccaca

SEQ ID NO: 1891161 - RNA, 11 nt, Human
gcuccaggagc

SEQ ID NO: 1891162 - RNA, 17 nt, Human
gcucauuuacuguuuua

SEQ ID NO: 1891163 - RNA, 12 nt, Human
gcuccaggagca

SEQ ID NO: 1891164 - RNA, 14 nt, Human
gcuccaggagcagc

SEQ ID NO: 1891165 - RNA, 13 nt, Human
gcuccaaacccuc

SEQ ID NO: 1891166 - RNA, 21 nt, Human
gcuccagcuguucagcugguu

SEQ ID NO: 1891167 - RNA, 18 nt, Human
gcucauucuaaugauggc

SEQ ID NO: 1891168 - RNA, 14 nt, Human
gcucauucuaauga

SEQ ID NO: 1891169 - RNA, 12 nt, Human
gcucauuuacug

SEQ ID NO: 1891170 - RNA, 21 nt, Human
gcucgagcaugccuggauggg

SEQ ID NO: 1891171 - RNA, 19 nt, Human
gcucgagcaugccuggaug

SEQ ID NO: 1891172 - RNA, 16 nt, Human
gcuccuuguuccuaga

SEQ ID NO: 1891173 - RNA, 17 nt, Human
gcuccuuuagcgcccag

SEQ ID NO: 1891174 - RNA, 14 nt, Human
gcuccuuguuccua

SEQ ID NO: 1891175 - RNA, 13 nt, Human
gcuccuucugucc

SEQ ID NO: 1891176 - RNA, 13 nt, Human
gcuccugugucuu

SEQ ID NO: 1891177 - RNA, 12 nt, Human
gcuccugugucu

SEQ ID NO: 1891178 - RNA, 24 nt, Human
gcuccgcuuucuacccagcgagcc

SEQ ID NO: 1891179 - RNA, 13 nt, Human
gcuccuagaggga

SEQ ID NO: 1891180 - RNA, 14 nt, Human
gcuccuagagggag

SEQ ID NO: 1891181 - RNA, 15 nt, Human
gcuccuagagggagg

SEQ ID NO: 1891182 - RNA, 16 nt, Human
gcuccuagagggaggg

SEQ ID NO: 1891183 - RNA, 18 nt, Human
gcuccuagagggaggggc

SEQ ID NO: 1891184 - RNA, 19 nt, Human
gcuccuagagggaggggcc

SEQ ID NO: 1891185 - RNA, 20 nt, Human
gcuccuccagggugugugcu

SEQ ID NO: 1891186 - RNA, 13 nt, Human
ucacugccauaua

SEQ ID NO: 1891187 - RNA, 18 nt, Human
ucacugccaugccagcuu

SEQ ID NO: 1891188 - RNA, 19 nt, Human
ucacugcuaagaauauuug

SEQ ID NO: 1891189 - RNA, 20 nt, Human
ucacucuuauugcccacgcu

SEQ ID NO: 1891190 - RNA, 19 nt, Human
ucacucugugucugagugg

SEQ ID NO: 1891191 - RNA, 16 nt, Human
ucaccagccccagugc

SEQ ID NO: 1891192 - RNA, 13 nt, Human
ucaccagccccag

SEQ ID NO: 1891193 - RNA, 17 nt, Human
ucacucuuauugcccac

SEQ ID NO: 1891194 - RNA, 19 nt, Human
ucaccccugguucucaucu

SEQ ID NO: 1891195 - RNA, 18 nt, Human
ucaccccugguucucauc

SEQ ID NO: 1891196 - RNA, 15 nt, Human
ucaccccugguucuc

SEQ ID NO: 1891197 - RNA, 20 nt, Human
ucaccccucccuuucucccc

SEQ ID NO: 1891198 - RNA, 18 nt, Human
ucaccccucccuuucucc

SEQ ID NO: 1891199 - RNA, 17 nt, Human
ucaccccucccuuucuc

SEQ ID NO: 1891200 - RNA, 14 nt, Human
ucaccccucccuuu

SEQ ID NO: 1891201 - RNA, 14 nt, Human
ucacugcuuaacuu

SEQ ID NO: 1891202 - RNA, 17 nt, Human
ucacuggggccuacagc

SEQ ID NO: 1891203 - RNA, 14 nt, Human
ucagaaacaggacc

SEQ ID NO: 1891204 - RNA, 10 nt, Human
ucagaaaugu

SEQ ID NO: 1891205 - RNA, 20 nt, Human
ucacuuguuuuauuuaaccu

SEQ ID NO: 1891206 - RNA, 16 nt, Human
ucagaauucucuaguu

SEQ ID NO: 1891207 - RNA, 23 nt, Human
ucagacacccucaaccucuucug

SEQ ID NO: 1891208 - RNA, 15 nt, Human
ucagacacccucaac

SEQ ID NO: 1891209 - RNA, 17 nt, Human
ucagacacccucaaccu

SEQ ID NO: 1891210 - RNA, 22 nt, Human
ucagacacccucaaccucuucu

SEQ ID NO: 1891211 - RNA, 23 nt, Human
ucagaauucucuaguuugauuaa

SEQ ID NO: 1891212 - RNA, 15 nt, Human
ucagaaauguguuau

SEQ ID NO: 1891213 - RNA, 23 nt, Human
ucagaccauaauguuacauuauu

SEQ ID NO: 1891214 - RNA, 15 nt, Human
ucagaccauaauguu

SEQ ID NO: 1891215 - RNA, 14 nt, Human
ucagacagcugccu

SEQ ID NO: 1891216 - RNA, 13 nt, Human
ucagacagcugcc

SEQ ID NO: 1891217 - RNA, 18 nt, Human
ucagaccuuuuaacuccu

SEQ ID NO: 1891218 - RNA, 18 nt, Human
ucagacgcacucgcauug

SEQ ID NO: 1891219 - RNA, 21 nt, Human
ucagaguaauccaagcaaaug

SEQ ID NO: 1891220 - RNA, 22 nt, Human
ucagaguaauccaagcaaaugu

SEQ ID NO: 1891221 - RNA, 15 nt, Human
ucagggaggucauuu

SEQ ID NO: 1891222 - RNA, 21 nt, Human
ucagggagugggcuaagcacg

SEQ ID NO: 1891223 - RNA, 15 nt, Human
ucaggcuugauaaua

SEQ ID NO: 1891224 - RNA, 16 nt, Human
ucagggaaaagcagcu

SEQ ID NO: 1891225 - RNA, 18 nt, Human
ucagggaaaagcagcucu

SEQ ID NO: 1891226 - RNA, 19 nt, Human
ucagggaaaagcagcucuc

SEQ ID NO: 1891227 - RNA, 23 nt, Human
ucagggaaaagcagcucuccccu

SEQ ID NO: 1891228 - RNA, 15 nt, Human
ucagggcagcgccag

SEQ ID NO: 1891229 - RNA, 19 nt, Human
ucagggcagcgccaggcug

SEQ ID NO: 1891230 - RNA, 14 nt, Human
ucagggccuggcuc

SEQ ID NO: 1891231 - RNA, 16 nt, Human
ucagggccuggcucag

SEQ ID NO: 1891232 - RNA, 15 nt, Human
ucaggugagaagcag

SEQ ID NO: 1891233 - RNA, 16 nt, Human
ucaggugagaagcaga

SEQ ID NO: 1891234 - RNA, 19 nt, Human
ucaggagcccugggaggcu

SEQ ID NO: 1891235 - RNA, 18 nt, Human
ucaggagcccugggaggc

SEQ ID NO: 1891236 - RNA, 20 nt, Human
ucaggagcccugggaggcuc

SEQ ID NO: 1891237 - RNA, 23 nt, Human
ucaggagcccugggaggcucugg

SEQ ID NO: 1891238 - RNA, 22 nt, Human
ucagccucccgaguagcuggga

SEQ ID NO: 1891239 - RNA, 21 nt, Human
ucagccucccgaguagcuggg

SEQ ID NO: 1891240 - RNA, 20 nt, Human
ucagccuccugaguagcugg

SEQ ID NO: 1891241 - RNA, 21 nt, Human
ucagccuccugaguagcugga

SEQ ID NO: 1891242 - RNA, 13 nt, Human
ucagccuccugag

SEQ ID NO: 1891243 - RNA, 18 nt, Human
ucagccugcuccagcugu

SEQ ID NO: 1891244 - RNA, 19 nt, Human
ucagccugcuccagcuguu

SEQ ID NO: 1891245 - RNA, 15 nt, Human
ucagcugaaccuggg

SEQ ID NO: 1891246 - RNA, 16 nt, Human
ucagcugaaccugggu

SEQ ID NO: 1891247 - RNA, 12 nt, Human
ucagccuggcca

SEQ ID NO: 1891248 - RNA, 14 nt, Human
ucagccuggccaga

SEQ ID NO: 1891249 - RNA, 15 nt, Human
ucagccuggccagac

SEQ ID NO: 1891250 - RNA, 16 nt, Human
ucagccuggccagaca

SEQ ID NO: 1891251 - RNA, 17 nt, Human
ucagccuggccagacac

SEQ ID NO: 1891252 - RNA, 18 nt, Human
ucagccuggccagacaca

SEQ ID NO: 1891253 - RNA, 21 nt, Human
ucagccucccaaagugcuggg

SEQ ID NO: 1891254 - RNA, 19 nt, Human
ucagccucccaaagugcug

SEQ ID NO: 1891255 - RNA, 14 nt, Human
ucagccucccaaag

SEQ ID NO: 1891256 - RNA, 22 nt, Human
ucagccucccgaauagcuggga

SEQ ID NO: 1891257 - RNA, 21 nt, Human
ucagccucccgaauagcuggg

SEQ ID NO: 1891258 - RNA, 18 nt, Human
ucagccucccgaguagcu

SEQ ID NO: 1891259 - RNA, 20 nt, Human
ucagccucccgaguagcugg

SEQ ID NO: 1891260 - RNA, 17 nt, Human
ucagauauaaaagacug

SEQ ID NO: 1891261 - RNA, 14 nt, Human
ucagauauaaaaga

SEQ ID NO: 1891262 - RNA, 20 nt, Human
ucagauauaaaagacugacc

SEQ ID NO: 1891263 - RNA, 18 nt, Human
ucagauauaaaagacuga

SEQ ID NO: 1891264 - RNA, 15 nt, Human
ucagauaugauucaa

SEQ ID NO: 1891265 - RNA, 13 nt, Human
ucauucaauaaau

SEQ ID NO: 1891266 - RNA, 14 nt, Human
ucauuccagaggaa

SEQ ID NO: 1891267 - RNA, 21 nt, Human
ucauucaacccaccugcgucu

SEQ ID NO: 1891268 - RNA, 16 nt, Human
ucauuuccugugucuu

SEQ ID NO: 1891269 - RNA, 13 nt, Human
ucauuuccugugu

SEQ ID NO: 1891270 - RNA, 12 nt, Human
ucauugugaaau

SEQ ID NO: 1891271 - RNA, 15 nt, Human
ucauugugaaauuau

SEQ ID NO: 1891272 - RNA, 17 nt, Human
ucauugugaaauuauuc

SEQ ID NO: 1891273 - RNA, 18 nt, Human
ucauugugaaauuauuca

SEQ ID NO: 1891274 - RNA, 21 nt, Human
ucauuucaccccucccuuucu

SEQ ID NO: 1891275 - RNA, 16 nt, Human
ucauuucaccccuccc

SEQ ID NO: 1891276 - RNA, 15 nt, Human
ucauuucaccccucc

SEQ ID NO: 1891277 - RNA, 14 nt, Human
ucauuucaccccuc

SEQ ID NO: 1891278 - RNA, 23 nt, Human
ucauuucaccccucccuuucucc

SEQ ID NO: 1891279 - RNA, 23 nt, Human
ucaucuuagguuggcaaaaaggc

SEQ ID NO: 1891280 - RNA, 16 nt, Human
ucaucugcucuccuuc

SEQ ID NO: 1891281 - RNA, 15 nt, Human
ucaucugcucuccuu

SEQ ID NO: 1891282 - RNA, 14 nt, Human
ucaucugcucuccu

SEQ ID NO: 1891283 - RNA, 12 nt, Human
ucaucugcucuc

SEQ ID NO: 1891284 - RNA, 18 nt, Human
ucaucugcucuccuuccu

SEQ ID NO: 1891285 - RNA, 17 nt, Human
ucaucugcucuccuucc

SEQ ID NO: 1891286 - RNA, 21 nt, Human
ucaucugcucuccuuccugga

SEQ ID NO: 1891287 - RNA, 19 nt, Human
ucaucuugaauuguaagga

SEQ ID NO: 1891288 - RNA, 13 nt, Human
ucaucugccgugc

SEQ ID NO: 1891289 - RNA, 15 nt, Human
ucaggugcugccauc

SEQ ID NO: 1891290 - RNA, 14 nt, Human
ucaggugcugccau

SEQ ID NO: 1891291 - RNA, 13 nt, Human
ucaggugcugcca

SEQ ID NO: 1891292 - RNA, 23 nt, Human
ucaggugccucaagagaaggcaa

SEQ ID NO: 1891293 - RNA, 21 nt, Human
ucaggugagaagcagaggaag

SEQ ID NO: 1891294 - RNA, 15 nt, Human
ucauacucaccucac

SEQ ID NO: 1891295 - RNA, 20 nt, Human
ucauacuaucuacucuccuc

SEQ ID NO: 1891296 - RNA, 19 nt, Human
ucaucaccaacgucugugc

SEQ ID NO: 1891297 - RNA, 20 nt, Human
ucaucaccaacgucugugcc

SEQ ID NO: 1891298 - RNA, 21 nt, Human
ucaucaccaacgucugugcca

SEQ ID NO: 1891299 - RNA, 17 nt, Human
uccaauuuacauacucu

SEQ ID NO: 1891300 - RNA, 18 nt, Human
uccaauuuacauacucug

SEQ ID NO: 1891301 - RNA, 18 nt, Human
uccaaaauaaaacuuuuu

SEQ ID NO: 1891302 - RNA, 20 nt, Human
uccaaaauaaaacuuuuuaa

SEQ ID NO: 1891303 - RNA, 17 nt, Human
uccacaaguuaaauaaa

SEQ ID NO: 1891304 - RNA, 18 nt, Human
uccacaaguuaaauaaau

SEQ ID NO: 1891305 - RNA, 23 nt, Human
uccacacaacauauccguauaua

SEQ ID NO: 1891306 - RNA, 16 nt, Human
uccacaagagcccagg

SEQ ID NO: 1891307 - RNA, 17 nt, Human
uccacaagagcccaggc

SEQ ID NO: 1891308 - RNA, 18 nt, Human
uccacaagagcccaggcc

SEQ ID NO: 1891309 - RNA, 12 nt, Human
uccacccugcuc

SEQ ID NO: 1891310 - RNA, 17 nt, Human
uccacagcaaccccagg

SEQ ID NO: 1891311 - RNA, 18 nt, Human
uccaccugccagggacag

SEQ ID NO: 1891312 - RNA, 21 nt, Human
uccaccugccagggacagagg

SEQ ID NO: 1891313 - RNA, 17 nt, Human
uccaccugccagggaca

SEQ ID NO: 1891314 - RNA, 15 nt, Human
uccaccugccaggga

SEQ ID NO: 1891315 - RNA, 17 nt, Human
uccagccacagaaaaga

SEQ ID NO: 1891316 - RNA, 16 nt, Human
uccacuuggucuguga

SEQ ID NO: 1891317 - RNA, 15 nt, Human
uccacuuggucugug

SEQ ID NO: 1891318 - RNA, 17 nt, Human
uccagcuguucagcugg

SEQ ID NO: 1891319 - RNA, 16 nt, Human
uccaggagcagccaca

SEQ ID NO: 1891320 - RNA, 17 nt, Human
uccagcucaccagcccc

SEQ ID NO: 1891321 - RNA, 16 nt, Human
uccagcucaccagccc

SEQ ID NO: 1891322 - RNA, 18 nt, Human
uccagcucaccagcccca

SEQ ID NO: 1891323 - RNA, 16 nt, Human
uccagguucagcuugu

SEQ ID NO: 1891324 - RNA, 15 nt, Human
uccagguucagcuug

SEQ ID NO: 1891325 - RNA, 16 nt, Human
uccagguguuacugua

SEQ ID NO: 1891326 - RNA, 14 nt, Human
uccagguggcauca

SEQ ID NO: 1891327 - RNA, 18 nt, Human
uccaggugcacaagcucc

SEQ ID NO: 1891328 - RNA, 20 nt, Human
uccaggugcacaagcuccaa

SEQ ID NO: 1891329 - RNA, 21 nt, Human
uccaggugcacaagcuccaag

SEQ ID NO: 1891330 - RNA, 22 nt, Human
uccaggugcacaagcuccaagc

SEQ ID NO: 1891331 - RNA, 15 nt, Human
uccaggugcacaagc

SEQ ID NO: 1891332 - RNA, 23 nt, Human
uccaggggugggacacccuguga

SEQ ID NO: 1891333 - RNA, 22 nt, Human
uccaggagcagccacauuccug

SEQ ID NO: 1891334 - RNA, 17 nt, Human
uccaggagcagccacau

SEQ ID NO: 1891335 - RNA, 18 nt, Human
uccaggagcagccacauu

SEQ ID NO: 1891336 - RNA, 14 nt, Human
uauuaaugcuaagg

SEQ ID NO: 1891337 - RNA, 13 nt, Human
uauuaaugcuaag

SEQ ID NO: 1891338 - RNA, 12 nt, Human
uauuaaugcuaa

SEQ ID NO: 1891339 - RNA, 23 nt, Human
uauuaauacaaugaugcuauuug

SEQ ID NO: 1891340 - RNA, 21 nt, Human
uauuaauacaaugaugcuauu

SEQ ID NO: 1891341 - RNA, 24 nt, Human
uauuaagaaagacuaucuaaaugu

SEQ ID NO: 1891342 - RNA, 12 nt, Human
uauuaaauuaug

SEQ ID NO: 1891343 - RNA, 21 nt, Human
uauuaaauuaaauuuuguguc

SEQ ID NO: 1891344 - RNA, 19 nt, Human
uauuaaauuaaauuuugug

SEQ ID NO: 1891345 - RNA, 18 nt, Human
uauuaaauggaaacugaa

SEQ ID NO: 1891346 - RNA, 19 nt, Human
uauuaaauggaaacugaaa

SEQ ID NO: 1891347 - RNA, 20 nt, Human
uauuaaauggaaacugaaac

SEQ ID NO: 1891348 - RNA, 12 nt, Human
uauguauuuaua

SEQ ID NO: 1891349 - RNA, 23 nt, Human
uauguugagucgcgcaccgaaaa

SEQ ID NO: 1891350 - RNA, 12 nt, Human
uauguugcauag

SEQ ID NO: 1891351 - RNA, 18 nt, Human
uauguugaauacuuuuua

SEQ ID NO: 1891352 - RNA, 20 nt, Human
uauguugcccaggcaggucu

SEQ ID NO: 1891353 - RNA, 12 nt, Human
uauguuuacaaa

SEQ ID NO: 1891354 - RNA, 19 nt, Human
uauguugcccaggcagguc

SEQ ID NO: 1891355 - RNA, 16 nt, Human
uauguugcccaggcag

SEQ ID NO: 1891356 - RNA, 13 nt, Human
uauguugcccagg

SEQ ID NO: 1891357 - RNA, 16 nt, Human
uauguugcauagaaua

SEQ ID NO: 1891358 - RNA, 16 nt, Human
uauguaccauguacau

SEQ ID NO: 1891359 - RNA, 15 nt, Human
uauguacaugagaag

SEQ ID NO: 1891360 - RNA, 18 nt, Human
uauguacaggaugcuuug

SEQ ID NO: 1891361 - RNA, 14 nt, Human
uauguaguaauuga

SEQ ID NO: 1891362 - RNA, 17 nt, Human
uauguaguaauugacau

SEQ ID NO: 1891363 - RNA, 20 nt, Human
uauguaguaauugacaugug

SEQ ID NO: 1891364 - RNA, 17 nt, Human
uauguaugguauccaag

SEQ ID NO: 1891365 - RNA, 18 nt, Human
uauguaguccgugcugac

SEQ ID NO: 1891366 - RNA, 13 nt, Human
gggaguggccaca

SEQ ID NO: 1891367 - RNA, 15 nt, Human
gggaguggccacaga

SEQ ID NO: 1891368 - RNA, 15 nt, Human
uauuaaugcuaaggg

SEQ ID NO: 1891369 - RNA, 13 nt, Human
uauuaauugcuuu

SEQ ID NO: 1891370 - RNA, 14 nt, Human
uauuaauugcuuug

SEQ ID NO: 1891371 - RNA, 16 nt, Human
uauuccagaaugcugu

SEQ ID NO: 1891372 - RNA, 17 nt, Human
uauuccagaaugcugua

SEQ ID NO: 1891373 - RNA, 20 nt, Human
uauuccagaaugcuguacau

SEQ ID NO: 1891374 - RNA, 21 nt, Human
uauuccagaaugcuguacauc

SEQ ID NO: 1891375 - RNA, 23 nt, Human
uauuccagaaugcuguacaucua

SEQ ID NO: 1891376 - RNA, 12 nt, Human
uauucccaugag

SEQ ID NO: 1891377 - RNA, 14 nt, Human
uauucgcuugagaa

SEQ ID NO: 1891378 - RNA, 17 nt, Human
uauucgcuugagaaaaa

SEQ ID NO: 1891379 - RNA, 22 nt, Human
uauucgcuugagaaaaaaagaa

SEQ ID NO: 1891380 - RNA, 19 nt, Human
uauuuauaaauauauuuaa

SEQ ID NO: 1891381 - RNA, 17 nt, Human
uauuuauaaauauauuu

SEQ ID NO: 1891382 - RNA, 16 nt, Human
uauuuauaaauauauu

SEQ ID NO: 1891383 - RNA, 17 nt, Human
uauuuauaaaacuucuc

SEQ ID NO: 1891384 - RNA, 14 nt, Human
uauuuauaaaacuu

SEQ ID NO: 1891385 - RNA, 24 nt, Human
uauuuauaaaaauaaaaaacacug

SEQ ID NO: 1891386 - RNA, 24 nt, Human
uauuuaaacucuguugcaagugca

SEQ ID NO: 1891387 - RNA, 18 nt, Human
uauuuaaaaauauuuuug

SEQ ID NO: 1891388 - RNA, 22 nt, Human
uauuguuuucaguguacaugga

SEQ ID NO: 1891389 - RNA, 18 nt, Human
uauuguuuucaguguaca

SEQ ID NO: 1891390 - RNA, 20 nt, Human
uauuguuuucaguguacaug

SEQ ID NO: 1891391 - RNA, 12 nt, Human
uauuguuuucag

SEQ ID NO: 1891392 - RNA, 17 nt, Human
uauuguuccagcaguuu

SEQ ID NO: 1891393 - RNA, 21 nt, Human
uauugcuugcacaaaccaauu

SEQ ID NO: 1891394 - RNA, 19 nt, Human
uauugcuuguuggauuuuu

SEQ ID NO: 1891395 - RNA, 22 nt, Human
uauuggaaauuuguuauaauga

SEQ ID NO: 1891396 - RNA, 17 nt, Human
uauugcugauggugcaa

SEQ ID NO: 1891397 - RNA, 15 nt, Human
uauugcugagagaaa

SEQ ID NO: 1891398 - RNA, 16 nt, Human
uauuguguuuguguau

SEQ ID NO: 1891399 - RNA, 16 nt, Human
uauugcugagagaaau

SEQ ID NO: 1891400 - RNA, 19 nt, Human
uauugcugagagaaauaug

SEQ ID NO: 1891401 - RNA, 17 nt, Human
uauucucuccuguaccu

SEQ ID NO: 1891402 - RNA, 18 nt, Human
uauucucuccuguaccuc

SEQ ID NO: 1891403 - RNA, 18 nt, Human
uauucucuccaaaaaugc

SEQ ID NO: 1891404 - RNA, 21 nt, Human
uauugauaugcuuauacacuu

SEQ ID NO: 1891405 - RNA, 15 nt, Human
ucaauaaaugucugu

SEQ ID NO: 1891406 - RNA, 15 nt, Human
ucaauaaagcauuua

SEQ ID NO: 1891407 - RNA, 19 nt, Human
ucaauaaagcauuuauaaa

SEQ ID NO: 1891408 - RNA, 16 nt, Human
ucaauaaaugucuguu

SEQ ID NO: 1891409 - RNA, 13 nt, Human
ucaaugcagcccc

SEQ ID NO: 1891410 - RNA, 21 nt, Human
ucaauuacaggaaguacugga

SEQ ID NO: 1891411 - RNA, 23 nt, Human
ucaauuacaggaaguacuggaga

SEQ ID NO: 1891412 - RNA, 22 nt, Human
ucaaugccccugaauuuaaaua

SEQ ID NO: 1891413 - RNA, 19 nt, Human
ucaaugguuugcaaggaag

SEQ ID NO: 1891414 - RNA, 18 nt, Human
ucaaugguuugcaaggaa

SEQ ID NO: 1891415 - RNA, 23 nt, Human
ucaauguacuaggauacugcugc

SEQ ID NO: 1891416 - RNA, 22 nt, Human
ucaauguacuaggauacugcug

SEQ ID NO: 1891417 - RNA, 20 nt, Human
ucaaugccccugaauuuaaa

SEQ ID NO: 1891418 - RNA, 18 nt, Human
ucaaugccccugaauuua

SEQ ID NO: 1891419 - RNA, 17 nt, Human
ucaaugccccugaauuu

SEQ ID NO: 1891420 - RNA, 19 nt, Human
ucaauaaacuaaagaaaaa

SEQ ID NO: 1891421 - RNA, 12 nt, Human
ucaauaaagcau

SEQ ID NO: 1891422 - RNA, 19 nt, Human
ucaauaaaaaaaagaaaug

SEQ ID NO: 1891423 - RNA, 16 nt, Human
ucaauaaaaaaaagaa

SEQ ID NO: 1891424 - RNA, 21 nt, Human
ucaagugauucuccugccuca

SEQ ID NO: 1891425 - RNA, 19 nt, Human
ucaagugauucuccugccu

SEQ ID NO: 1891426 - RNA, 18 nt, Human
ucaagugauucuccugcc

SEQ ID NO: 1891427 - RNA, 20 nt, Human
ucaagugauucuccugccuc

SEQ ID NO: 1891428 - RNA, 19 nt, Human
ucacaggcagguccagggu

SEQ ID NO: 1891429 - RNA, 18 nt, Human
ucacaggcagguccaggg

SEQ ID NO: 1891430 - RNA, 17 nt, Human
ucacaggcagguccagg

SEQ ID NO: 1891431 - RNA, 16 nt, Human
ucacaggcagguccag

SEQ ID NO: 1891432 - RNA, 22 nt, Human
ucacaguccuuaccagcagagc

SEQ ID NO: 1891433 - RNA, 23 nt, Human
ucacaguccuuaccagcagagca

SEQ ID NO: 1891434 - RNA, 19 nt, Human
ucacaguccuuaccagcag

SEQ ID NO: 1891435 - RNA, 16 nt, Human
ucacagucacauucca

SEQ ID NO: 1891436 - RNA, 18 nt, Human
ucacaagacccaaaaggc

SEQ ID NO: 1891437 - RNA, 17 nt, Human
ucacaagacccaaaagg

SEQ ID NO: 1891438 - RNA, 13 nt, Human
ucacaagacccaa

SEQ ID NO: 1891439 - RNA, 20 nt, Human
ucacaccugaacugaacacc

SEQ ID NO: 1891440 - RNA, 14 nt, Human
ucaccaaggcugau

SEQ ID NO: 1891441 - RNA, 19 nt, Human
ucaccaaaucagcugcuac

SEQ ID NO: 1891442 - RNA, 20 nt, Human
ucaccaaaucagcugcuacu

SEQ ID NO: 1891443 - RNA, 16 nt, Human
ucaccacaugugcaca

SEQ ID NO: 1891444 - RNA, 17 nt, Human
ucacauuuauucugcuc

SEQ ID NO: 1891445 - RNA, 19 nt, Human
ucacauuuauucugcucac

SEQ ID NO: 1891446 - RNA, 18 nt, Human
ucacauuuauucugcuca

SEQ ID NO: 1891447 - RNA, 23 nt, Human
uauuuauauauguauuuauaaau

SEQ ID NO: 1891448 - RNA, 16 nt, Human
uauuuauauauguauu

SEQ ID NO: 1891449 - RNA, 17 nt, Human
uauuuuauguugcauag

SEQ ID NO: 1891450 - RNA, 13 nt, Human
uauuuauauaaau

SEQ ID NO: 1891451 - RNA, 19 nt, Human
uauuuauaacaaccuaaau

SEQ ID NO: 1891452 - RNA, 20 nt, Human
uauuuauaacaaccuaaauu

SEQ ID NO: 1891453 - RNA, 15 nt, Human
uauuuauaaaacuuc

SEQ ID NO: 1891454 - RNA, 16 nt, Human
uauuuuccaugaaaau

SEQ ID NO: 1891455 - RNA, 20 nt, Human
uauuuuccaugaaaaugcaa

SEQ ID NO: 1891456 - RNA, 17 nt, Human
uauuuuauuaugcauga

SEQ ID NO: 1891457 - RNA, 14 nt, Human
uauuuuauuaugca

SEQ ID NO: 1891458 - RNA, 22 nt, Human
uauuuucccuauuagagaagag

SEQ ID NO: 1891459 - RNA, 17 nt, Human
uauuuuuuucuuuucuu

SEQ ID NO: 1891460 - RNA, 14 nt, Human
uauuuuuuuacuaa

SEQ ID NO: 1891461 - RNA, 14 nt, Human
ucaaaaaaagaaaa

SEQ ID NO: 1891462 - RNA, 15 nt, Human
ucaaaaaaagaaaaa

SEQ ID NO: 1891463 - RNA, 17 nt, Human
ucaaauuguaagcaugc

SEQ ID NO: 1891464 - RNA, 20 nt, Human
ucaaauuguaagcaugcaca

SEQ ID NO: 1891465 - RNA, 23 nt, Human
ucaaccccuucgcuccugugucu

SEQ ID NO: 1891466 - RNA, 18 nt, Human
ucaacccuaaaaagcaga

SEQ ID NO: 1891467 - RNA, 22 nt, Human
ucaacccuaaaaagcagagcuu

SEQ ID NO: 1891468 - RNA, 23 nt, Human
ucaacccuaaaaagcagagcuuu

SEQ ID NO: 1891469 - RNA, 15 nt, Human
ucaaaugagaaaaug

SEQ ID NO: 1891470 - RNA, 14 nt, Human
ucaaaugcucagac

SEQ ID NO: 1891471 - RNA, 19 nt, Human
ucaaaugcucagaccagcu

SEQ ID NO: 1891472 - RNA, 18 nt, Human
ucaaauggggccagaucc

SEQ ID NO: 1891473 - RNA, 12 nt, Human
ucaaauuaauaa

SEQ ID NO: 1891474 - RNA, 17 nt, Human
ucaaauuaauaaucuua

SEQ ID NO: 1891475 - RNA, 22 nt, Human
ucaaauuaauaaucuuauuagg

SEQ ID NO: 1891476 - RNA, 21 nt, Human
ucaaaugcucagaccagcucu

SEQ ID NO: 1891477 - RNA, 20 nt, Human
ucaaagaaauuuccacucag

SEQ ID NO: 1891478 - RNA, 19 nt, Human
ucaaagaaauuuccacuca

SEQ ID NO: 1891479 - RNA, 13 nt, Human
ucaaagaaauuuc

SEQ ID NO: 1891480 - RNA, 12 nt, Human
ucaaagaaauuu

SEQ ID NO: 1891481 - RNA, 15 nt, Human
ucaaaaaacuuguaa

SEQ ID NO: 1891482 - RNA, 14 nt, Human
ucaaaaaacuugua

SEQ ID NO: 1891483 - RNA, 14 nt, Human
ucaaaaaacaaaaa

SEQ ID NO: 1891484 - RNA, 21 nt, Human
ucaaauauauucagccuggcu

SEQ ID NO: 1891485 - RNA, 22 nt, Human
ucaaauauauucagccuggcuu

SEQ ID NO: 1891486 - RNA, 23 nt, Human
ucaaauauauucagccuggcuuc

SEQ ID NO: 1891487 - RNA, 17 nt, Human
ucugguuaggauggcag

SEQ ID NO: 1891488 - RNA, 14 nt, Human
ucuguccuacucug

SEQ ID NO: 1891489 - RNA, 19 nt, Human
ucuguccuacucuguguca

SEQ ID NO: 1891490 - RNA, 15 nt, Human
ucuguccuacucugu

SEQ ID NO: 1891491 - RNA, 20 nt, Human
ucuguccuacucugugucag

SEQ ID NO: 1891492 - RNA, 21 nt, Human
ucuguccugggagugagcugg

SEQ ID NO: 1891493 - RNA, 14 nt, Human
ucugucgcccaguc

SEQ ID NO: 1891494 - RNA, 16 nt, Human
ucugucgcccagucug

SEQ ID NO: 1891495 - RNA, 22 nt, Human
ucugucucuggauuauauuaug

SEQ ID NO: 1891496 - RNA, 16 nt, Human
ucugggaccucaguuu

SEQ ID NO: 1891497 - RNA, 13 nt, Human
ucugggaccucag

SEQ ID NO: 1891498 - RNA, 23 nt, Human
ucuggugacuuuccucuuugguc

SEQ ID NO: 1891499 - RNA, 14 nt, Human
ucugggacacaguu

SEQ ID NO: 1891500 - RNA, 14 nt, Human
ucuggcugcagagc

SEQ ID NO: 1891501 - RNA, 18 nt, Human
ucuggcucuuccaggcug

SEQ ID NO: 1891502 - RNA, 23 nt, Human
ucuggcucuuccaggcugggaga

SEQ ID NO: 1891503 - RNA, 22 nt, Human
ucuggcuaugcauuugaaaauu

SEQ ID NO: 1891504 - RNA, 19 nt, Human
ucuggcuaugcauuugaaa

SEQ ID NO: 1891505 - RNA, 23 nt, Human
ucuggccuucggccuccauccug

SEQ ID NO: 1891506 - RNA, 18 nt, Human
ucuggccuucggccucca

SEQ ID NO: 1891507 - RNA, 17 nt, Human
ucuggccuucggccucc

SEQ ID NO: 1891508 - RNA, 22 nt, Human
ucugcugacagacacaggcccg

SEQ ID NO: 1891509 - RNA, 21 nt, Human
ucugcugacagacacaggccc

SEQ ID NO: 1891510 - RNA, 20 nt, Human
ucugcugacagacacaggcc

SEQ ID NO: 1891511 - RNA, 19 nt, Human
ucugcugacagacacaggc

SEQ ID NO: 1891512 - RNA, 15 nt, Human
ucuggaaugcagugg

SEQ ID NO: 1891513 - RNA, 19 nt, Human
ucuggaauaaggagaauga

SEQ ID NO: 1891514 - RNA, 14 nt, Human
ucuggacaggcaug

SEQ ID NO: 1891515 - RNA, 16 nt, Human
ucuggaaugcaguggu

SEQ ID NO: 1891516 - RNA, 21 nt, Human
ucuggacaggcauguucucug

SEQ ID NO: 1891517 - RNA, 16 nt, Human
ucugcugguuuuaaca

SEQ ID NO: 1891518 - RNA, 19 nt, Human
ucuggaaucuggagaccag

SEQ ID NO: 1891519 - RNA, 17 nt, Human
ucugcugacagacacag

SEQ ID NO: 1891520 - RNA, 18 nt, Human
ucugcugacagacacagg

SEQ ID NO: 1891521 - RNA, 21 nt, Human
ucugcuccucuccccagcaag

SEQ ID NO: 1891522 - RNA, 18 nt, Human
ucugcuccucuccccagc

SEQ ID NO: 1891523 - RNA, 16 nt, Human
ucugccugcccaggcc

SEQ ID NO: 1891524 - RNA, 15 nt, Human
ucugccugcccaggc

SEQ ID NO: 1891525 - RNA, 16 nt, Human
ucugcuccccagggga

SEQ ID NO: 1891526 - RNA, 13 nt, Human
ucugccugcccag

SEQ ID NO: 1891527 - RNA, 14 nt, Human
ucugccugcccagg

SEQ ID NO: 1891528 - RNA, 23 nt, Human
ucuucagaucucuaacuucacca

SEQ ID NO: 1891529 - RNA, 18 nt, Human
ucuucagaucucuaacuu

SEQ ID NO: 1891530 - RNA, 15 nt, Human
ucuuaggaagagaaa

SEQ ID NO: 1891531 - RNA, 19 nt, Human
ucuuaggaagagaaaccag

SEQ ID NO: 1891532 - RNA, 12 nt, Human
ucuugaacuccu

SEQ ID NO: 1891533 - RNA, 13 nt, Human
ucuugaaaaaugc

SEQ ID NO: 1891534 - RNA, 14 nt, Human
ucuugaaagcugug

SEQ ID NO: 1891535 - RNA, 19 nt, Human
ucuucuuuuugcuucaaaa

SEQ ID NO: 1891536 - RNA, 23 nt, Human
ucuucucauuucaccccucccuu

SEQ ID NO: 1891537 - RNA, 22 nt, Human
ucuucucauuucaccccucccu

SEQ ID NO: 1891538 - RNA, 20 nt, Human
ucuucucauuucaccccucc

SEQ ID NO: 1891539 - RNA, 19 nt, Human
ucuucucauuucaccccuc

SEQ ID NO: 1891540 - RNA, 18 nt, Human
ucuucucauuucaccccu

SEQ ID NO: 1891541 - RNA, 15 nt, Human
ucuucucauuucacc

SEQ ID NO: 1891542 - RNA, 10 nt, Human
ucuucucauu

SEQ ID NO: 1891543 - RNA, 13 nt, Human
ucuuaaaaagugg

SEQ ID NO: 1891544 - RNA, 17 nt, Human
ucuuaaacaaauguaug

SEQ ID NO: 1891545 - RNA, 15 nt, Human
ucuguuuuguaaagu

SEQ ID NO: 1891546 - RNA, 22 nt, Human
ucuguuuuguaaaguccccaga

SEQ ID NO: 1891547 - RNA, 17 nt, Human
ucuguuuugaaggcaaa

SEQ ID NO: 1891548 - RNA, 13 nt, Human
ucuguuuuguaaa

SEQ ID NO: 1891549 - RNA, 22 nt, Human
ucuuaaccagaucauugugaaa

SEQ ID NO: 1891550 - RNA, 17 nt, Human
ucuuagcuccccuccaa

SEQ ID NO: 1891551 - RNA, 16 nt, Human
ucuuaaccagaucauu

SEQ ID NO: 1891552 - RNA, 17 nt, Human
ucuuaaccagaucauug

SEQ ID NO: 1891553 - RNA, 22 nt, Human
ucuuaaauauguggaguucauc

SEQ ID NO: 1891554 - RNA, 19 nt, Human
ucucuuuuuuuggcccagg

SEQ ID NO: 1891555 - RNA, 14 nt, Human
ucugaaaauugaug

SEQ ID NO: 1891556 - RNA, 13 nt, Human
ucugaaaauguau

SEQ ID NO: 1891557 - RNA, 14 nt, Human
ucugaaaauguaug

SEQ ID NO: 1891558 - RNA, 22 nt, Human
ucugaaaauugaugggauuugg

SEQ ID NO: 1891559 - RNA, 19 nt, Human
ucucuuagcuccccuccaa

SEQ ID NO: 1891560 - RNA, 15 nt, Human
ucucuuauagaauau

SEQ ID NO: 1891561 - RNA, 18 nt, Human
ucucuuagcuccccucca

SEQ ID NO: 1891562 - RNA, 17 nt, Human
ucucuuagcuccccucc

SEQ ID NO: 1891563 - RNA, 16 nt, Human
ucucuuagcuccccuc

SEQ ID NO: 1891564 - RNA, 17 nt, Human
ucucuuauagaauauuu

SEQ ID NO: 1891565 - RNA, 18 nt, Human
ucucuuauagaauauuua

SEQ ID NO: 1891566 - RNA, 20 nt, Human
ucucuuauagaauauuuauu

SEQ ID NO: 1891567 - RNA, 21 nt, Human
ucucuuauagaauauuuauua

SEQ ID NO: 1891568 - RNA, 13 nt, Human
ucugacccacugc

SEQ ID NO: 1891569 - RNA, 17 nt, Human
ucugaccagcagcgccu

SEQ ID NO: 1891570 - RNA, 18 nt, Human
ucugaccagcagcgccuu

SEQ ID NO: 1891571 - RNA, 15 nt, Human
ucugacauaaguauu

SEQ ID NO: 1891572 - RNA, 22 nt, Human
ucugacaggcaaugcuggcugu

SEQ ID NO: 1891573 - RNA, 21 nt, Human
ucugacaggcaaugcuggcug

SEQ ID NO: 1891574 - RNA, 12 nt, Human
ucugacaggcaa

SEQ ID NO: 1891575 - RNA, 19 nt, Human
ucugacacacagcucuguc

SEQ ID NO: 1891576 - RNA, 18 nt, Human
ucugacacacagcucugu

SEQ ID NO: 1891577 - RNA, 17 nt, Human
ucugacacacagcucug

SEQ ID NO: 1891578 - RNA, 16 nt, Human
ucugacacacagcucu

SEQ ID NO: 1891579 - RNA, 20 nt, Human
ucugaaauuuccugggagcu

SEQ ID NO: 1891580 - RNA, 18 nt, Human
ucugaaauuuccugggag

SEQ ID NO: 1891581 - RNA, 17 nt, Human
ucugaaauuuccuggga

SEQ ID NO: 1891582 - RNA, 23 nt, Human
ucugcacaugaaucccacccaca

SEQ ID NO: 1891583 - RNA, 12 nt, Human
ucugcacaugaa

SEQ ID NO: 1891584 - RNA, 20 nt, Human
ucugcaagaauugaagcagg

SEQ ID NO: 1891585 - RNA, 21 nt, Human
ucugcaagaauugaagcagga

SEQ ID NO: 1891586 - RNA, 15 nt, Human
ucugcaacucugaag

SEQ ID NO: 1891587 - RNA, 14 nt, Human
ucugcaacucugaa

SEQ ID NO: 1891588 - RNA, 23 nt, Human
ucugaggaauccagacccggcug

SEQ ID NO: 1891589 - RNA, 15 nt, Human
ucugacccacugcuu

SEQ ID NO: 1891590 - RNA, 14 nt, Human
ucugacccacugcu

SEQ ID NO: 1891591 - RNA, 15 nt, Human
ucugcacaugucuug

SEQ ID NO: 1891592 - RNA, 12 nt, Human
ucugcacauguc

SEQ ID NO: 1891593 - RNA, 19 nt, Human
ucugcacaugucuuguaca

SEQ ID NO: 1891594 - RNA, 17 nt, Human
ucugcacaugucuugua

SEQ ID NO: 1891595 - RNA, 16 nt, Human
ucugcacaugucuugu

SEQ ID NO: 1891596 - RNA, 16 nt, Human
ucugcauucuaguacu

SEQ ID NO: 1891597 - RNA, 15 nt, Human
ucugcauuucggugg

SEQ ID NO: 1891598 - RNA, 18 nt, Human
ucugcauuucgguggcua

SEQ ID NO: 1891599 - RNA, 19 nt, Human
ucugcauuucgguggcuag

SEQ ID NO: 1891600 - RNA, 15 nt, Human
ucuccugccucagcc

SEQ ID NO: 1891601 - RNA, 17 nt, Human
ucuccugccucagccuc

SEQ ID NO: 1891602 - RNA, 19 nt, Human
ucuccugccucagccuccc

SEQ ID NO: 1891603 - RNA, 21 nt, Human
ucuccuggaagugcuaauuuu

SEQ ID NO: 1891604 - RNA, 21 nt, Human
ucuccuggaaauauuaagaaa

SEQ ID NO: 1891605 - RNA, 15 nt, Human
ucuccuguaccucuu

SEQ ID NO: 1891606 - RNA, 17 nt, Human
ucuccuguaccucuuga

SEQ ID NO: 1891607 - RNA, 16 nt, Human
ucuccuguaccucuug

SEQ ID NO: 1891608 - RNA, 19 nt, Human
ucuccuguaccucuugagc

SEQ ID NO: 1891609 - RNA, 21 nt, Human
ucucgugguaggacuguagaa

SEQ ID NO: 1891610 - RNA, 19 nt, Human
ucucgugguaggacuguag

SEQ ID NO: 1891611 - RNA, 14 nt, Human
ucucgugauugaua

SEQ ID NO: 1891612 - RNA, 22 nt, Human
ucucgugauugauaagaaccuu

SEQ ID NO: 1891613 - RNA, 12 nt, Human
ucucuaacuuca

SEQ ID NO: 1891614 - RNA, 17 nt, Human
ucucuaacagcucagga

SEQ ID NO: 1891615 - RNA, 18 nt, Human
ucucuaacagcucaggau

SEQ ID NO: 1891616 - RNA, 22 nt, Human
ucucuaaagaguuuauuuuaag

SEQ ID NO: 1891617 - RNA, 13 nt, Human
ucucuaacaaugu

SEQ ID NO: 1891618 - RNA, 19 nt, Human
ucucuaaagaguuuauuuu

SEQ ID NO: 1891619 - RNA, 21 nt, Human
ucucuaaagaguuuauuuuaa

SEQ ID NO: 1891620 - RNA, 19 nt, Human
ucucuaacuucaccauauu

SEQ ID NO: 1891621 - RNA, 15 nt, Human
ucucugcaggucccu

SEQ ID NO: 1891622 - RNA, 16 nt, Human
ucucugcaggucccua

SEQ ID NO: 1891623 - RNA, 18 nt, Human
ucucugcaggucccuaau

SEQ ID NO: 1891624 - RNA, 21 nt, Human
ucucugggcuuggggcuuccu

SEQ ID NO: 1891625 - RNA, 16 nt, Human
ucucugugaacgauuu

SEQ ID NO: 1891626 - RNA, 14 nt, Human
ucucugugagacuc

SEQ ID NO: 1891627 - RNA, 22 nt, Human
ucucugugaacgauuuagaaag

SEQ ID NO: 1891628 - RNA, 23 nt, Human
ucucugugaacgauuuagaaaga

SEQ ID NO: 1891629 - RNA, 22 nt, Human
ucucugugagacucgagaacuu

SEQ ID NO: 1891630 - RNA, 19 nt, Human
ucucugugagacucgagaa

SEQ ID NO: 1891631 - RNA, 14 nt, Human
ucucugaggacacu

SEQ ID NO: 1891632 - RNA, 17 nt, Human
ucucugaggacacuaac

SEQ ID NO: 1891633 - RNA, 15 nt, Human
ucucugauacagaaa

SEQ ID NO: 1891634 - RNA, 13 nt, Human
ucucugcaggucc

SEQ ID NO: 1891635 - RNA, 14 nt, Human
ucucugcagguccc

SEQ ID NO: 1891636 - RNA, 15 nt, Human
ucucuaguuugauua

SEQ ID NO: 1891637 - RNA, 16 nt, Human
ucucuaguuugauuaa

SEQ ID NO: 1891638 - RNA, 12 nt, Human
ucucucugccca

SEQ ID NO: 1891639 - RNA, 14 nt, Human
ucucucugcccaac

SEQ ID NO: 1891640 - RNA, 16 nt, Human
ucucucugcccaaccc

SEQ ID NO: 1891641 - RNA, 14 nt, Human
ucuaauaucagcaa

SEQ ID NO: 1891642 - RNA, 14 nt, Human
ucuaauauggccac

SEQ ID NO: 1891643 - RNA, 22 nt, Human
ucuaauagaacucaguuuuaac

SEQ ID NO: 1891644 - RNA, 19 nt, Human
ucuaacagcucaggaucuc

SEQ ID NO: 1891645 - RNA, 19 nt, Human
ucuaacaauguauuuucuu

SEQ ID NO: 1891646 - RNA, 15 nt, Human
ucuaacagcucagga

SEQ ID NO: 1891647 - RNA, 17 nt, Human
ucuaacagcucaggauc

SEQ ID NO: 1891648 - RNA, 21 nt, Human
ucuaaaucuccaaaauaaaac

SEQ ID NO: 1891649 - RNA, 18 nt, Human
ucggccuccauccugagg

SEQ ID NO: 1891650 - RNA, 14 nt, Human
ucgagucaaaaugu

SEQ ID NO: 1891651 - RNA, 22 nt, Human
ucgagguuucucaaagaaauuu

SEQ ID NO: 1891652 - RNA, 16 nt, Human
ucgagguuucucaaag

SEQ ID NO: 1891653 - RNA, 16 nt, Human
ucgugauugauaagaa

SEQ ID NO: 1891654 - RNA, 14 nt, Human
ucuaauauguaaca

SEQ ID NO: 1891655 - RNA, 19 nt, Human
ucuacuugcucuggaccug

SEQ ID NO: 1891656 - RNA, 20 nt, Human
ucuacuugcucuggaccugc

SEQ ID NO: 1891657 - RNA, 21 nt, Human
ucuacuugcucuggaccugcc

SEQ ID NO: 1891658 - RNA, 22 nt, Human
ucuacuugcucuggaccugccc

SEQ ID NO: 1891659 - RNA, 14 nt, Human
ucuacuuuaauaaa

SEQ ID NO: 1891660 - RNA, 15 nt, Human
ucuacuuuaauaaau

SEQ ID NO: 1891661 - RNA, 16 nt, Human
ucuaggacugaauuau

SEQ ID NO: 1891662 - RNA, 23 nt, Human
ucuaggacugaauuaugaaacuu

SEQ ID NO: 1891663 - RNA, 22 nt, Human
ucucaaagaaauuuccacucag

SEQ ID NO: 1891664 - RNA, 21 nt, Human
ucucaaagaaauuuccacuca

SEQ ID NO: 1891665 - RNA, 19 nt, Human
ucucaaagaaauuuccacu

SEQ ID NO: 1891666 - RNA, 17 nt, Human
ucucaaauaacuaaaag

SEQ ID NO: 1891667 - RNA, 22 nt, Human
ucuaugauuccagguggcauca

SEQ ID NO: 1891668 - RNA, 15 nt, Human
ucuaucaaguauuau

SEQ ID NO: 1891669 - RNA, 23 nt, Human
ucuauauuuugggaaaaaaacau

SEQ ID NO: 1891670 - RNA, 22 nt, Human
ucuaucaaguauuauaccuuuu

SEQ ID NO: 1891671 - RNA, 21 nt, Human
ucuaucaaguauuauaccuuu

SEQ ID NO: 1891672 - RNA, 21 nt, Human
uccuucaccuuuguccccacc

SEQ ID NO: 1891673 - RNA, 22 nt, Human
uccuucaccuuuguccccaccg

SEQ ID NO: 1891674 - RNA, 12 nt, Human
uccuucagacac

SEQ ID NO: 1891675 - RNA, 13 nt, Human
uccuucagacacc

SEQ ID NO: 1891676 - RNA, 17 nt, Human
uccuugagacacggagc

SEQ ID NO: 1891677 - RNA, 21 nt, Human
uccuugagacacggagcccag

SEQ ID NO: 1891678 - RNA, 23 nt, Human
uccuugagacacggagcccagcc

SEQ ID NO: 1891679 - RNA, 23 nt, Human
uccuucagacacccucaaccucu

SEQ ID NO: 1891680 - RNA, 16 nt, Human
uccuuaccagcagagc

SEQ ID NO: 1891681 - RNA, 17 nt, Human
uccuuaccagcagagca

SEQ ID NO: 1891682 - RNA, 18 nt, Human
uccuuaccagcagagcac

SEQ ID NO: 1891683 - RNA, 18 nt, Human
uccuucacagaugggugc

SEQ ID NO: 1891684 - RNA, 19 nt, Human
uccuucacagaugggugcu

SEQ ID NO: 1891685 - RNA, 20 nt, Human
uccuuaccagcagagcaccu

SEQ ID NO: 1891686 - RNA, 18 nt, Human
uccuucaccuuugucccc

SEQ ID NO: 1891687 - RNA, 20 nt, Human
uccuucaccuuuguccccac

SEQ ID NO: 1891688 - RNA, 23 nt, Human
uccuuuucacaguucucuccuuc

SEQ ID NO: 1891689 - RNA, 20 nt, Human
uccuuuuaaaucuugauacc

SEQ ID NO: 1891690 - RNA, 17 nt, Human
ucgaggcggaucuuugg

SEQ ID NO: 1891691 - RNA, 22 nt, Human
ucgaggcggaucuuuggacaga

SEQ ID NO: 1891692 - RNA, 15 nt, Human
ucgaaccguuuugaa

SEQ ID NO: 1891693 - RNA, 18 nt, Human
ucgaaccguuuugaagcu

SEQ ID NO: 1891694 - RNA, 18 nt, Human
uccuuuucgcaggauucu

SEQ ID NO: 1891695 - RNA, 18 nt, Human
ucgaaacacagaaaccuu

SEQ ID NO: 1891696 - RNA, 13 nt, Human
ucgaaacacagaa

SEQ ID NO: 1891697 - RNA, 19 nt, Human
ucgaaaccugggauucagg

SEQ ID NO: 1891698 - RNA, 24 nt, Human
uccuuuuauuucuucaccagauuu

SEQ ID NO: 1891699 - RNA, 14 nt, Human
uccugccucagccu

SEQ ID NO: 1891700 - RNA, 14 nt, Human
uccugagccagauu

SEQ ID NO: 1891701 - RNA, 20 nt, Human
uccugccuaagugcagcccc

SEQ ID NO: 1891702 - RNA, 13 nt, Human
uccugagccagau

SEQ ID NO: 1891703 - RNA, 19 nt, Human
uccuggcacccggccccug

SEQ ID NO: 1891704 - RNA, 16 nt, Human
uccuggcacccggccc

SEQ ID NO: 1891705 - RNA, 14 nt, Human
uccuggcacccggc

SEQ ID NO: 1891706 - RNA, 15 nt, Human
uccugccucagccuc

SEQ ID NO: 1891707 - RNA, 13 nt, Human
uccugccucagcc

SEQ ID NO: 1891708 - RNA, 16 nt, Human
uccugccucagccucc

SEQ ID NO: 1891709 - RNA, 17 nt, Human
uccugccucagccuccc

SEQ ID NO: 1891710 - RNA, 22 nt, Human
uccuggcacccggccccugcug

SEQ ID NO: 1891711 - RNA, 17 nt, Human
uccuggcacugcuucca

SEQ ID NO: 1891712 - RNA, 21 nt, Human
uccuggcacccggccccugcu

SEQ ID NO: 1891713 - RNA, 20 nt, Human
uccuggcacccggccccugc

SEQ ID NO: 1891714 - RNA, 18 nt, Human
uccuggcacugcuuccag

SEQ ID NO: 1891715 - RNA, 22 nt, Human
uccuggcacugcuuccagugag

SEQ ID NO: 1891716 - RNA, 20 nt, Human
uccuguaccucuugagccuu

SEQ ID NO: 1891717 - RNA, 22 nt, Human
uccuguaccucuugagccuuga

SEQ ID NO: 1891718 - RNA, 13 nt, Human
uccuauaugcacu

SEQ ID NO: 1891719 - RNA, 21 nt, Human
uccuauauuguuuucagugua

SEQ ID NO: 1891720 - RNA, 17 nt, Human
uccucauuagcauuuug

SEQ ID NO: 1891721 - RNA, 22 nt, Human
uccucaucucuaacagcucagg

SEQ ID NO: 1891722 - RNA, 23 nt, Human
uccucaucucuaacagcucagga

SEQ ID NO: 1891723 - RNA, 21 nt, Human
uccuauucuuucgaaagaaga

SEQ ID NO: 1891724 - RNA, 12 nt, Human
uccucaucucua

SEQ ID NO: 1891725 - RNA, 20 nt, Human
uccucaucucuaacagcuca

SEQ ID NO: 1891726 - RNA, 18 nt, Human
uccuauauuguuuucagu

SEQ ID NO: 1891727 - RNA, 14 nt, Human
uccuacccaucccc

SEQ ID NO: 1891728 - RNA, 15 nt, Human
uccuacccauccccg

SEQ ID NO: 1891729 - RNA, 18 nt, Human
uccuacccacccuccuuu

SEQ ID NO: 1891730 - RNA, 17 nt, Human
uccgaccagacaccuug

SEQ ID NO: 1891731 - RNA, 13 nt, Human
uccgaccagacac

SEQ ID NO: 1891732 - RNA, 16 nt, Human
uccuaaucuucugaac

SEQ ID NO: 1891733 - RNA, 20 nt, Human
uccuaauaaucauuggauuc

SEQ ID NO: 1891734 - RNA, 19 nt, Human
uccuccuuggugccuggcc

SEQ ID NO: 1891735 - RNA, 17 nt, Human
uccuccuuggugccugg

SEQ ID NO: 1891736 - RNA, 16 nt, Human
uccuccuuggugccug

SEQ ID NO: 1891737 - RNA, 13 nt, Human
uccuccuuccaug

SEQ ID NO: 1891738 - RNA, 15 nt, Human
uccuccuuccaugga

SEQ ID NO: 1891739 - RNA, 20 nt, Human
uccuccagcagggaaaaugc

SEQ ID NO: 1891740 - RNA, 12 nt, Human
uccuccagcagg

SEQ ID NO: 1891741 - RNA, 14 nt, Human
uccuccagcaggga

SEQ ID NO: 1891742 - RNA, 17 nt, Human
uccucauguucugcuuu

SEQ ID NO: 1891743 - RNA, 19 nt, Human
uccuccacucucccccacc

SEQ ID NO: 1891744 - RNA, 16 nt, Human
uccuccacucuccccc

SEQ ID NO: 1891745 - RNA, 23 nt, Human
uccuccacucucccccacccccu

SEQ ID NO: 1891746 - RNA, 14 nt, Human
uccucuaggagguc

SEQ ID NO: 1891747 - RNA, 21 nt, Human
uccucguucucccugggaggc

SEQ ID NO: 1891748 - RNA, 15 nt, Human
uccucguucucccug

SEQ ID NO: 1891749 - RNA, 16 nt, Human
uccucguucucccugg

SEQ ID NO: 1891750 - RNA, 19 nt, Human
uccucguucucccugggag

SEQ ID NO: 1891751 - RNA, 19 nt, Human
uccuccuuuucacaguucu

SEQ ID NO: 1891752 - RNA, 16 nt, Human
uccucuguacagagcc

SEQ ID NO: 1891753 - RNA, 17 nt, Human
uccucuguacagagccc

SEQ ID NO: 1891754 - RNA, 18 nt, Human
uccucuguacagagccca

SEQ ID NO: 1891755 - RNA, 14 nt, Human
uccucugcugcugg

SEQ ID NO: 1891756 - RNA, 15 nt, Human
uccucugcugcuggc

SEQ ID NO: 1891757 - RNA, 16 nt, Human
uccucugcugcuggcu

SEQ ID NO: 1891758 - RNA, 17 nt, Human
uccucugcuuugaaagc

SEQ ID NO: 1891759 - RNA, 15 nt, Human
uccucugcuuugaaa

SEQ ID NO: 1891760 - RNA, 16 nt, Human
ucccugcacaagccag

SEQ ID NO: 1891761 - RNA, 15 nt, Human
ucccugcacaagcca

SEQ ID NO: 1891762 - RNA, 18 nt, Human
ucccugcacaagccaggg

SEQ ID NO: 1891763 - RNA, 13 nt, Human
ucccugcacuugc

SEQ ID NO: 1891764 - RNA, 14 nt, Human
ucccugcacuugca

SEQ ID NO: 1891765 - RNA, 20 nt, Human
ucccugccucaggccucugu

SEQ ID NO: 1891766 - RNA, 11 nt, Human
ucccugccuca

SEQ ID NO: 1891767 - RNA, 16 nt, Human
ucccugccucaggccu

SEQ ID NO: 1891768 - RNA, 17 nt, Human
ucccugccucaggccuc

SEQ ID NO: 1891769 - RNA, 18 nt, Human
ucccugccucaggccucu

SEQ ID NO: 1891770 - RNA, 23 nt, Human
ucccugccugguccucacacuca

SEQ ID NO: 1891771 - RNA, 14 nt, Human
ucccuucccaccuc

SEQ ID NO: 1891772 - RNA, 13 nt, Human
ucccuucccaccu

SEQ ID NO: 1891773 - RNA, 23 nt, Human
ucccuugaggaaacaacagcuuu

SEQ ID NO: 1891774 - RNA, 20 nt, Human
ucccuuccuuguagccuuuu

SEQ ID NO: 1891775 - RNA, 17 nt, Human
ucccuucgacagcauuu

SEQ ID NO: 1891776 - RNA, 22 nt, Human
ucccuucuaggguuauugcauu

SEQ ID NO: 1891777 - RNA, 21 nt, Human
ucccggggcagggcagccguc

SEQ ID NO: 1891778 - RNA, 16 nt, Human
ucccggggcagggcag

SEQ ID NO: 1891779 - RNA, 14 nt, Human
ucccggggcagggc

SEQ ID NO: 1891780 - RNA, 23 nt, Human
ucccguggaacguuuuuccuguu

SEQ ID NO: 1891781 - RNA, 22 nt, Human
ucccguggaacguuuuuccugu

SEQ ID NO: 1891782 - RNA, 16 nt, Human
ucccguggaacguuuu

SEQ ID NO: 1891783 - RNA, 14 nt, Human
ucccuaauaaagcu

SEQ ID NO: 1891784 - RNA, 15 nt, Human
ucccuaauaaagcug

SEQ ID NO: 1891785 - RNA, 13 nt, Human
uccccuucacucc

SEQ ID NO: 1891786 - RNA, 21 nt, Human
uccccuguuuguuucugaaag

SEQ ID NO: 1891787 - RNA, 17 nt, Human
uccagguuuaagcuguu

SEQ ID NO: 1891788 - RNA, 18 nt, Human
uccagguguuacuguaau

SEQ ID NO: 1891789 - RNA, 18 nt, Human
uccagguuuaagcuguua

SEQ ID NO: 1891790 - RNA, 18 nt, Human
uccccuguuuguuucuga

SEQ ID NO: 1891791 - RNA, 20 nt, Human
uccccuguuuguuucugaaa

SEQ ID NO: 1891792 - RNA, 11 nt, Human
ucccuccuggg

SEQ ID NO: 1891793 - RNA, 19 nt, Human
ucccuccugggaaugaagc

SEQ ID NO: 1891794 - RNA, 15 nt, Human
ucccucuacugggag

SEQ ID NO: 1891795 - RNA, 17 nt, Human
ucccucuacugggagcc

SEQ ID NO: 1891796 - RNA, 14 nt, Human
ucccucuaauuuau

SEQ ID NO: 1891797 - RNA, 16 nt, Human
ucccucuaauuuaucu

SEQ ID NO: 1891798 - RNA, 16 nt, Human
ucccuauuagagaaga

SEQ ID NO: 1891799 - RNA, 16 nt, Human
ucccuaauaaagcugu

SEQ ID NO: 1891800 - RNA, 16 nt, Human
ucccuaguaaaaauac

SEQ ID NO: 1891801 - RNA, 17 nt, Human
uguacacguguccugua

SEQ ID NO: 1891802 - RNA, 16 nt, Human
uguacacguguccugu

SEQ ID NO: 1891803 - RNA, 16 nt, Human
uguacaagaugaagga

SEQ ID NO: 1891804 - RNA, 14 nt, Human
uguacagacaacaa

SEQ ID NO: 1891805 - RNA, 11 nt, Human
uguacagagcc

SEQ ID NO: 1891806 - RNA, 11 nt, Human
uguaaugaaaa

SEQ ID NO: 1891807 - RNA, 12 nt, Human
uguaaugaaaac

SEQ ID NO: 1891808 - RNA, 13 nt, Human
uguaaugaaaacc

SEQ ID NO: 1891809 - RNA, 17 nt, Human
uguaaugaaaaccacau

SEQ ID NO: 1891810 - RNA, 17 nt, Human
uguaacaagccacccca

SEQ ID NO: 1891811 - RNA, 14 nt, Human
uguaacaagccacc

SEQ ID NO: 1891812 - RNA, 21 nt, Human
uguaaauuuggcuucuguugu

SEQ ID NO: 1891813 - RNA, 16 nt, Human
uguaaauuuggcuucu

SEQ ID NO: 1891814 - RNA, 18 nt, Human
uguaaauuuggcuucugu

SEQ ID NO: 1891815 - RNA, 17 nt, Human
uguaaauuuaugugaug

SEQ ID NO: 1891816 - RNA, 19 nt, Human
ugguugcuguuuuccuccc

SEQ ID NO: 1891817 - RNA, 20 nt, Human
ugguugcacuuaugauuuca

SEQ ID NO: 1891818 - RNA, 16 nt, Human
ugguuggagaauuuag

SEQ ID NO: 1891819 - RNA, 16 nt, Human
ugguuuucuguucuuu

SEQ ID NO: 1891820 - RNA, 20 nt, Human
ugguuguacauauaagugau

SEQ ID NO: 1891821 - RNA, 23 nt, Human
ugguuuuuaaaaaacugcugacu

SEQ ID NO: 1891822 - RNA, 20 nt, Human
ugguuuuguuccccuccucc

SEQ ID NO: 1891823 - RNA, 17 nt, Human
ugguuuuguuccccucc

SEQ ID NO: 1891824 - RNA, 16 nt, Human
ugguuuuucaguuuuc

SEQ ID NO: 1891825 - RNA, 19 nt, Human
ugguuuucuuguguguuua

SEQ ID NO: 1891826 - RNA, 21 nt, Human
ugguuuuuaaaaaacugcuga

SEQ ID NO: 1891827 - RNA, 16 nt, Human
ugguuuuguuccccuc

SEQ ID NO: 1891828 - RNA, 11 nt, Human
uguaaaauggu

SEQ ID NO: 1891829 - RNA, 12 nt, Human
uguaaaauggug

SEQ ID NO: 1891830 - RNA, 22 nt, Human
uguaaaacagguagaauuaucu

SEQ ID NO: 1891831 - RNA, 14 nt, Human
uguaaaacagguag

SEQ ID NO: 1891832 - RNA, 13 nt, Human
uguaaaacaggua

SEQ ID NO: 1891833 - RNA, 12 nt, Human
uguaaaacaggu

SEQ ID NO: 1891834 - RNA, 23 nt, Human
uggguacuuguggacacagcucu

SEQ ID NO: 1891835 - RNA, 20 nt, Human
uggguacuuguggacacagc

SEQ ID NO: 1891836 - RNA, 14 nt, Human
uggugagaggcauc

SEQ ID NO: 1891837 - RNA, 18 nt, Human
ugguggcagugggagcug

SEQ ID NO: 1891838 - RNA, 13 nt, Human
ugguggcaguggg

SEQ ID NO: 1891839 - RNA, 20 nt, Human
ugguggcagugggagcugcc

SEQ ID NO: 1891840 - RNA, 14 nt, Human
uggugcaaugaccu

SEQ ID NO: 1891841 - RNA, 19 nt, Human
uggugcaaugaccuuucaa

SEQ ID NO: 1891842 - RNA, 20 nt, Human
uggugcaaugaccuuucaau

SEQ ID NO: 1891843 - RNA, 13 nt, Human
ugguggcuggguu

SEQ ID NO: 1891844 - RNA, 16 nt, Human
uggugggggccucggu

SEQ ID NO: 1891845 - RNA, 18 nt, Human
uggugggggccucggugu

SEQ ID NO: 1891846 - RNA, 20 nt, Human
uggugggccaacaaagaaca

SEQ ID NO: 1891847 - RNA, 23 nt, Human
uggugggccaacaaagaacacua

SEQ ID NO: 1891848 - RNA, 15 nt, Human
uggugggagggggag

SEQ ID NO: 1891849 - RNA, 20 nt, Human
ugguggggcugccaggggag

SEQ ID NO: 1891850 - RNA, 15 nt, Human
uggugguaucugagu

SEQ ID NO: 1891851 - RNA, 17 nt, Human
uggugguaacccuggug

SEQ ID NO: 1891852 - RNA, 16 nt, Human
uggugguaacccuggu

SEQ ID NO: 1891853 - RNA, 18 nt, Human
uggugguuucagaaaugu

SEQ ID NO: 1891854 - RNA, 17 nt, Human
uggugguuucagaaaug

SEQ ID NO: 1891855 - RNA, 19 nt, Human
uggugguuuucuguucuuu

SEQ ID NO: 1891856 - RNA, 14 nt, Human
uggugguugcuguu

SEQ ID NO: 1891857 - RNA, 18 nt, Human
ugguugaugaucuuugca

SEQ ID NO: 1891858 - RNA, 15 nt, Human
ugguucucaucuuuc

SEQ ID NO: 1891859 - RNA, 14 nt, Human
ugguucucaucuuu

SEQ ID NO: 1891860 - RNA, 17 nt, Human
ugguucucaucuuucuu

SEQ ID NO: 1891861 - RNA, 13 nt, Human
ugguucucaucuu

SEQ ID NO: 1891862 - RNA, 11 nt, Human
ugguucucauc

SEQ ID NO: 1891863 - RNA, 18 nt, Human
ugguucugugucuguguu

SEQ ID NO: 1891864 - RNA, 12 nt, Human
ugguucuggcca

SEQ ID NO: 1891865 - RNA, 15 nt, Human
ugguucuaauagaac

SEQ ID NO: 1891866 - RNA, 16 nt, Human
uggugucaccugaaga

SEQ ID NO: 1891867 - RNA, 15 nt, Human
uggugucgggcauga

SEQ ID NO: 1891868 - RNA, 18 nt, Human
uggugucgggcaugacac

SEQ ID NO: 1891869 - RNA, 19 nt, Human
uggugucgggcaugacacg

SEQ ID NO: 1891870 - RNA, 16 nt, Human
ugguucauuaauucua

SEQ ID NO: 1891871 - RNA, 16 nt, Human
ugguuccagccugcca

SEQ ID NO: 1891872 - RNA, 15 nt, Human
ugguuccagccugcc

SEQ ID NO: 1891873 - RNA, 18 nt, Human
uguccucccagcuccuca

SEQ ID NO: 1891874 - RNA, 14 nt, Human
uguccucagcagcu

SEQ ID NO: 1891875 - RNA, 23 nt, Human
uguccuccaacaccaagcacagc

SEQ ID NO: 1891876 - RNA, 17 nt, Human
uguccuccaagccagcg

SEQ ID NO: 1891877 - RNA, 17 nt, Human
uguccccgcacugggcu

SEQ ID NO: 1891878 - RNA, 19 nt, Human
uguccccgcacugggcuug

SEQ ID NO: 1891879 - RNA, 20 nt, Human
uguccugggagugagcuggu

SEQ ID NO: 1891880 - RNA, 19 nt, Human
uguccugggagugagcugg

SEQ ID NO: 1891881 - RNA, 12 nt, Human
uguccugggagu

SEQ ID NO: 1891882 - RNA, 14 nt, Human
ugucuaaugaaacc

SEQ ID NO: 1891883 - RNA, 14 nt, Human
uguccugggccugc

SEQ ID NO: 1891884 - RNA, 15 nt, Human
uguccugggccugca

SEQ ID NO: 1891885 - RNA, 17 nt, Human
uguccugggccugcaga

SEQ ID NO: 1891886 - RNA, 14 nt, Human
ugucugagugaacc

SEQ ID NO: 1891887 - RNA, 15 nt, Human
ugucugagugaaccu

SEQ ID NO: 1891888 - RNA, 17 nt, Human
ugucugagugaaccugu

SEQ ID NO: 1891889 - RNA, 20 nt, Human
ugucugagugaaccuguaua

SEQ ID NO: 1891890 - RNA, 21 nt, Human
ugucugagugaaccuguauaa

SEQ ID NO: 1891891 - RNA, 16 nt, Human
ugucugaguggcuuca

SEQ ID NO: 1891892 - RNA, 16 nt, Human
ugucuuuucuugcaug

SEQ ID NO: 1891893 - RNA, 23 nt, Human
ugucuuuggacccugaggcccag

SEQ ID NO: 1891894 - RNA, 16 nt, Human
ugucuaugggacucaa

SEQ ID NO: 1891895 - RNA, 15 nt, Human
ugucuaugggacuca

SEQ ID NO: 1891896 - RNA, 14 nt, Human
ugucuaugggacuc

SEQ ID NO: 1891897 - RNA, 19 nt, Human
ugucuaggcaggaccugug

SEQ ID NO: 1891898 - RNA, 17 nt, Human
ugucuaggcaggaccug

SEQ ID NO: 1891899 - RNA, 14 nt, Human
ugucuagagaggga

SEQ ID NO: 1891900 - RNA, 15 nt, Human
ugucuaguuguuuga

SEQ ID NO: 1891901 - RNA, 23 nt, Human
ugucuaguuguuugauucagaca

SEQ ID NO: 1891902 - RNA, 21 nt, Human
ugucucaaaaaaagaaaaaga

SEQ ID NO: 1891903 - RNA, 22 nt, Human
uguacagcaaggagauuuacaa

SEQ ID NO: 1891904 - RNA, 21 nt, Human
uguacagagcccacgccccca

SEQ ID NO: 1891905 - RNA, 12 nt, Human
uguacagagccc

SEQ ID NO: 1891906 - RNA, 23 nt, Human
uguacagcaaggagauuuacaac

SEQ ID NO: 1891907 - RNA, 13 nt, Human
uguaucugagcag

SEQ ID NO: 1891908 - RNA, 19 nt, Human
uguauuuuacuaauaaaau

SEQ ID NO: 1891909 - RNA, 14 nt, Human
ugucacaggcaggu

SEQ ID NO: 1891910 - RNA, 13 nt, Human
ugucacacacuuu

SEQ ID NO: 1891911 - RNA, 21 nt, Human
ugucaauuacaggaaguacug

SEQ ID NO: 1891912 - RNA, 19 nt, Human
uguaugcuucauacaggga

SEQ ID NO: 1891913 - RNA, 16 nt, Human
uguaugcuucauacag

SEQ ID NO: 1891914 - RNA, 14 nt, Human
uguaugcuucauac

SEQ ID NO: 1891915 - RNA, 13 nt, Human
uguaugcuucaua

SEQ ID NO: 1891916 - RNA, 17 nt, Human
uguauggagagaaaaca

SEQ ID NO: 1891917 - RNA, 21 nt, Human
ugucacaggcagguccagggu

SEQ ID NO: 1891918 - RNA, 17 nt, Human
ugucacaggcaggucca

SEQ ID NO: 1891919 - RNA, 16 nt, Human
ugucacaggcaggucc

SEQ ID NO: 1891920 - RNA, 15 nt, Human
ugucacaggcagguc

SEQ ID NO: 1891921 - RNA, 17 nt, Human
ugucacagggacugaaa

SEQ ID NO: 1891922 - RNA, 16 nt, Human
ugucagugugacugau

SEQ ID NO: 1891923 - RNA, 19 nt, Human
ugucagugugacugaucuc

SEQ ID NO: 1891924 - RNA, 15 nt, Human
ugucagugugacuga

SEQ ID NO: 1891925 - RNA, 14 nt, Human
ugucagugugacug

SEQ ID NO: 1891926 - RNA, 22 nt, Human
uggccucaagaucaaugaaaug

SEQ ID NO: 1891927 - RNA, 21 nt, Human
uggccucaagaucaaugaaau

SEQ ID NO: 1891928 - RNA, 23 nt, Human
uggccuccaaguccacaguggaa

SEQ ID NO: 1891929 - RNA, 13 nt, Human
uggccuccaaguc

SEQ ID NO: 1891930 - RNA, 11 nt, Human
uggccucccaa

SEQ ID NO: 1891931 - RNA, 14 nt, Human
uggccucccaacuc

SEQ ID NO: 1891932 - RNA, 13 nt, Human
uggccucaagauc

SEQ ID NO: 1891933 - RNA, 23 nt, Human
uggccuagcauacguacacauuu

SEQ ID NO: 1891934 - RNA, 23 nt, Human
uggccucaagugauucuccugcc

SEQ ID NO: 1891935 - RNA, 18 nt, Human
uggccucaagugauucuc

SEQ ID NO: 1891936 - RNA, 19 nt, Human
uggccucccaacucacccc

SEQ ID NO: 1891937 - RNA, 20 nt, Human
uggccucccaacucacccca

SEQ ID NO: 1891938 - RNA, 21 nt, Human
uggccucccaacucaccccag

SEQ ID NO: 1891939 - RNA, 22 nt, Human
uggccucccaacucaccccagc

SEQ ID NO: 1891940 - RNA, 20 nt, Human
uggccucccaaaugagccau

SEQ ID NO: 1891941 - RNA, 19 nt, Human
uggcagcugcgguccaccc

SEQ ID NO: 1891942 - RNA, 17 nt, Human
uggcagcugcgguccac

SEQ ID NO: 1891943 - RNA, 11 nt, Human
uggcagcucug

SEQ ID NO: 1891944 - RNA, 21 nt, Human
uggcagcucuggacagcccca

SEQ ID NO: 1891945 - RNA, 22 nt, Human
uggcagcucuggacagccccac

SEQ ID NO: 1891946 - RNA, 16 nt, Human
uggcagcugccacgcc

SEQ ID NO: 1891947 - RNA, 13 nt, Human
uggccccucaggg

SEQ ID NO: 1891948 - RNA, 20 nt, Human
uggccccucagggucccugg

SEQ ID NO: 1891949 - RNA, 12 nt, Human
uggccccaggac

SEQ ID NO: 1891950 - RNA, 15 nt, Human
uggccccaggaccug

SEQ ID NO: 1891951 - RNA, 20 nt, Human
uggccccaggaccuggcugc

SEQ ID NO: 1891952 - RNA, 20 nt, Human
uggccuagcauacguacaca

SEQ ID NO: 1891953 - RNA, 14 nt, Human
uggccccugagauc

SEQ ID NO: 1891954 - RNA, 21 nt, Human
uggccccucagggucccuggu

SEQ ID NO: 1891955 - RNA, 22 nt, Human
uggccccucagggucccuggug

SEQ ID NO: 1891956 - RNA, 14 nt, Human
uggcuccccaaagg

SEQ ID NO: 1891957 - RNA, 15 nt, Human
uggcuccccaaaggg

SEQ ID NO: 1891958 - RNA, 13 nt, Human
uggcugcugaagg

SEQ ID NO: 1891959 - RNA, 14 nt, Human
uggcugcugaaggc

SEQ ID NO: 1891960 - RNA, 16 nt, Human
uggcugcugaaggcuc

SEQ ID NO: 1891961 - RNA, 23 nt, Human
uggcuccagaugcagggcaguca

SEQ ID NO: 1891962 - RNA, 20 nt, Human
uggcuccagaugcagggcag

SEQ ID NO: 1891963 - RNA, 21 nt, Human
uggcuccagaugcagggcagu

SEQ ID NO: 1891964 - RNA, 20 nt, Human
uggcuccauugguguugaca

SEQ ID NO: 1891965 - RNA, 15 nt, Human
uggcuccaggccagg

SEQ ID NO: 1891966 - RNA, 22 nt, Human
uggccuucggccuccauccuga

SEQ ID NO: 1891967 - RNA, 13 nt, Human
uggccucugcacu

SEQ ID NO: 1891968 - RNA, 23 nt, Human
uggccuucggccuccauccugag

SEQ ID NO: 1891969 - RNA, 22 nt, Human
uggcuuccuaaaauucagugga

SEQ ID NO: 1891970 - RNA, 23 nt, Human
uggcugggacguggcucagccag

SEQ ID NO: 1891971 - RNA, 15 nt, Human
uggcugggacguggc

SEQ ID NO: 1891972 - RNA, 19 nt, Human
uggcugggacguggcucag

SEQ ID NO: 1891973 - RNA, 14 nt, Human
ugggaaugaagcaa

SEQ ID NO: 1891974 - RNA, 18 nt, Human
ugggaugauuggaggggg

SEQ ID NO: 1891975 - RNA, 16 nt, Human
ugggaaugaaugucag

SEQ ID NO: 1891976 - RNA, 21 nt, Human
ugggaaugaaugucaguguga

SEQ ID NO: 1891977 - RNA, 14 nt, Human
ugggacacccugug

SEQ ID NO: 1891978 - RNA, 15 nt, Human
ugggacacccuguga

SEQ ID NO: 1891979 - RNA, 16 nt, Human
ugggaggaucucuuga

SEQ ID NO: 1891980 - RNA, 14 nt, Human
ugggacagggagga

SEQ ID NO: 1891981 - RNA, 14 nt, Human
ugggcagagcagag

SEQ ID NO: 1891982 - RNA, 15 nt, Human
ugggcagagcagaga

SEQ ID NO: 1891983 - RNA, 17 nt, Human
ugggcagagcagagacc

SEQ ID NO: 1891984 - RNA, 18 nt, Human
ugggcagagcagagacca

SEQ ID NO: 1891985 - RNA, 13 nt, Human
ugggcaggaaaag

SEQ ID NO: 1891986 - RNA, 19 nt, Human
uggggggcugaggugggag

SEQ ID NO: 1891987 - RNA, 17 nt, Human
uggggggcuucauacac

SEQ ID NO: 1891988 - RNA, 16 nt, Human
ugggggccucagugcc

SEQ ID NO: 1891989 - RNA, 21 nt, Human
uggggccagauccagccuggg

SEQ ID NO: 1891990 - RNA, 17 nt, Human
uggggccaggcuggguc

SEQ ID NO: 1891991 - RNA, 19 nt, Human
uggggccagauccagccug

SEQ ID NO: 1891992 - RNA, 20 nt, Human
uggggccagauccagccugg

SEQ ID NO: 1891993 - RNA, 13 nt, Human
uggggccagaucc

SEQ ID NO: 1891994 - RNA, 14 nt, Human
uggggccagaucca

SEQ ID NO: 1891995 - RNA, 15 nt, Human
uggggccagauccag

SEQ ID NO: 1891996 - RNA, 16 nt, Human
uggggccagauccagc

SEQ ID NO: 1891997 - RNA, 18 nt, Human
uggggccagauccagccu

SEQ ID NO: 1891998 - RNA, 13 nt, Human
uggggcagcuuga

SEQ ID NO: 1891999 - RNA, 23 nt, Human
ugggcuuggggaccagagcugcc

SEQ ID NO: 1892000 - RNA, 17 nt, Human
ugggcuugucuguagau

SEQ ID NO: 1892001 - RNA, 21 nt, Human
ugggcuugucuguagauuuua

SEQ ID NO: 1892002 - RNA, 22 nt, Human
ugggcuuggggaccagagcugc

SEQ ID NO: 1892003 - RNA, 21 nt, Human
ugggcuucaguggcagcugcu

SEQ ID NO: 1892004 - RNA, 22 nt, Human
ugggcuucaguggcagcugcuu

SEQ ID NO: 1892005 - RNA, 22 nt, Human
ugggcuucauccuccucagauc

SEQ ID NO: 1892006 - RNA, 15 nt, Human
ugggcuucauccucc

SEQ ID NO: 1892007 - RNA, 16 nt, Human
ugggccugcuccagac

SEQ ID NO: 1892008 - RNA, 18 nt, Human
ugggccugcuccagaccu

SEQ ID NO: 1892009 - RNA, 19 nt, Human
ugggccugcuccagaccug

SEQ ID NO: 1892010 - RNA, 20 nt, Human
ugggccugcuccagaccuga

SEQ ID NO: 1892011 - RNA, 13 nt, Human
ugggccugcagaa

SEQ ID NO: 1892012 - RNA, 14 nt, Human
ugggccugcuccag

SEQ ID NO: 1892013 - RNA, 15 nt, Human
ugggccugcuccaga

SEQ ID NO: 1892014 - RNA, 19 nt, Human
uggcacugacugggcauag

SEQ ID NO: 1892015 - RNA, 19 nt, Human
uggcacugcuuccagugag

SEQ ID NO: 1892016 - RNA, 22 nt, Human
uggcacuauaauguaagcucua

SEQ ID NO: 1892017 - RNA, 18 nt, Human
uggcacuggaugcagaaa

SEQ ID NO: 1892018 - RNA, 15 nt, Human
uggcacuggaugcag

SEQ ID NO: 1892019 - RNA, 13 nt, Human
uggcacuggaugc

SEQ ID NO: 1892020 - RNA, 22 nt, Human
uggcacugcuuccagugaggcu

SEQ ID NO: 1892021 - RNA, 15 nt, Human
uggauuuaacagaaa

SEQ ID NO: 1892022 - RNA, 17 nt, Human
uggauuuaacagaaaug

SEQ ID NO: 1892023 - RNA, 13 nt, Human
uggcaaccugcuu

SEQ ID NO: 1892024 - RNA, 21 nt, Human
uggcacuauaauguaagcucu

SEQ ID NO: 1892025 - RNA, 16 nt, Human
uggcaaggaaaaacag

SEQ ID NO: 1892026 - RNA, 14 nt, Human
uggcaaccugcuuc

SEQ ID NO: 1892027 - RNA, 22 nt, Human
uggaugcagccucacaguccuu

SEQ ID NO: 1892028 - RNA, 13 nt, Human
uggaugcagccuc

SEQ ID NO: 1892029 - RNA, 21 nt, Human
uggaugcagccucacaguccu

SEQ ID NO: 1892030 - RNA, 19 nt, Human
uggaucaaauccagccugc

SEQ ID NO: 1892031 - RNA, 23 nt, Human
uggaggggggaggugggauccuc

SEQ ID NO: 1892032 - RNA, 17 nt, Human
uggagaguuuccugaaa

SEQ ID NO: 1892033 - RNA, 22 nt, Human
uggacucugcacaugucuugua

SEQ ID NO: 1892034 - RNA, 18 nt, Human
uggacucugcacaugucu

SEQ ID NO: 1892035 - RNA, 17 nt, Human
uggacucugcacauguc

SEQ ID NO: 1892036 - RNA, 17 nt, Human
uggacucugcacaugaa

SEQ ID NO: 1892037 - RNA, 16 nt, Human
uggacucugcacauga

SEQ ID NO: 1892038 - RNA, 15 nt, Human
uggacucugcacaug

SEQ ID NO: 1892039 - RNA, 19 nt, Human
uggacucugcacaugucuu

SEQ ID NO: 1892040 - RNA, 18 nt, Human
uggagaccagggagccuu

SEQ ID NO: 1892041 - RNA, 19 nt, Human
uggagaccagggagccuuu

SEQ ID NO: 1892042 - RNA, 15 nt, Human
uggagaguuuccuga

SEQ ID NO: 1892043 - RNA, 16 nt, Human
uggagaguuuccugaa

SEQ ID NO: 1892044 - RNA, 23 nt, Human
uggacaggcauguucucugagga

SEQ ID NO: 1892045 - RNA, 17 nt, Human
uggacaggcauguucuc

SEQ ID NO: 1892046 - RNA, 14 nt, Human
uggacauuuaccuu

SEQ ID NO: 1892047 - RNA, 22 nt, Human
uggacaggcauguucucugagg

SEQ ID NO: 1892048 - RNA, 18 nt, Human
uggacaggcauguucucu

SEQ ID NO: 1892049 - RNA, 19 nt, Human
uggacuaacuugucuuugg

SEQ ID NO: 1892050 - RNA, 20 nt, Human
uggacuaacuugucuuugga

SEQ ID NO: 1892051 - RNA, 19 nt, Human
uggacguguuaugacucca

SEQ ID NO: 1892052 - RNA, 23 nt, Human
uggacguguuaugacuccagaau

SEQ ID NO: 1892053 - RNA, 15 nt, Human
uggacggcugggcac

SEQ ID NO: 1892054 - RNA, 22 nt, Human
ugcuuccagugaggcucugccc

SEQ ID NO: 1892055 - RNA, 23 nt, Human
ugcuuccagugaggcucugcccu

SEQ ID NO: 1892056 - RNA, 23 nt, Human
ugcuuccauggccguguagaagc

SEQ ID NO: 1892057 - RNA, 22 nt, Human
ugcuuccauggccguguagaag

SEQ ID NO: 1892058 - RNA, 18 nt, Human
ugcuuaacuucacauauu

SEQ ID NO: 1892059 - RNA, 17 nt, Human
ugcuuaacuucacauau

SEQ ID NO: 1892060 - RNA, 14 nt, Human
ugcuuaacuucaca

SEQ ID NO: 1892061 - RNA, 13 nt, Human
ugcuuaacuucac

SEQ ID NO: 1892062 - RNA, 19 nt, Human
ugcuuaacuucacauauug

SEQ ID NO: 1892063 - RNA, 12 nt, Human
ugcuuaaugaaa

SEQ ID NO: 1892064 - RNA, 14 nt, Human
ugcuuaaugaaaag

SEQ ID NO: 1892065 - RNA, 22 nt, Human
ugcuguuuuccucccuucugcu

SEQ ID NO: 1892066 - RNA, 16 nt, Human
ugcuguuuuccucccu

SEQ ID NO: 1892067 - RNA, 17 nt, Human
ugcuguuuuccucccuu

SEQ ID NO: 1892068 - RNA, 19 nt, Human
ugcuguuuuccucccuucu

SEQ ID NO: 1892069 - RNA, 21 nt, Human
ugcuguuuuccucccuucugc

SEQ ID NO: 1892070 - RNA, 14 nt, Human
ugcuguuuuccucc

SEQ ID NO: 1892071 - RNA, 15 nt, Human
ugcuguuuuccuccc

SEQ ID NO: 1892072 - RNA, 13 nt, Human
ugcuuugcuuucu

SEQ ID NO: 1892073 - RNA, 17 nt, Human
ugcuuuggaaaacccag

SEQ ID NO: 1892074 - RNA, 19 nt, Human
uggaaaagccaagaggcug

SEQ ID NO: 1892075 - RNA, 16 nt, Human
uggaaaagccaagagg

SEQ ID NO: 1892076 - RNA, 19 nt, Human
ugcuuugcuuucugcucag

SEQ ID NO: 1892077 - RNA, 14 nt, Human
ugcuuugcuuucug

SEQ ID NO: 1892078 - RNA, 15 nt, Human
ugcuuucugaagcuu

SEQ ID NO: 1892079 - RNA, 20 nt, Human
ugcuuucugaagcuuuacca

SEQ ID NO: 1892080 - RNA, 21 nt, Human
ugcuuucugaagcuuuaccag

SEQ ID NO: 1892081 - RNA, 23 nt, Human
ugcuuucugaagcuuuaccagcu

SEQ ID NO: 1892082 - RNA, 18 nt, Human
ugcuugugaaaggaaaga

SEQ ID NO: 1892083 - RNA, 13 nt, Human
ugcuucuucagag

SEQ ID NO: 1892084 - RNA, 15 nt, Human
uggaacacucugaga

SEQ ID NO: 1892085 - RNA, 17 nt, Human
uggaacacucugagacu

SEQ ID NO: 1892086 - RNA, 21 nt, Human
uggaaacuggaugaggucaua

SEQ ID NO: 1892087 - RNA, 17 nt, Human
uggaaccucagccuggc

SEQ ID NO: 1892088 - RNA, 18 nt, Human
uggaaccucagccuggcc

SEQ ID NO: 1892089 - RNA, 19 nt, Human
uggaaccucagccuggcca

SEQ ID NO: 1892090 - RNA, 23 nt, Human
uggaaccucagccuggccagaca

SEQ ID NO: 1892091 - RNA, 18 nt, Human
ugaucagaccauaauguu

SEQ ID NO: 1892092 - RNA, 15 nt, Human
ugaucagaucugaca

SEQ ID NO: 1892093 - RNA, 16 nt, Human
ugaucagaucugacau

SEQ ID NO: 1892094 - RNA, 17 nt, Human
ugaucagaucugacaug

SEQ ID NO: 1892095 - RNA, 23 nt, Human
ugaucagaucugacaugauuccu

SEQ ID NO: 1892096 - RNA, 22 nt, Human
ugaucacggcucacugcagccu

SEQ ID NO: 1892097 - RNA, 19 nt, Human
ugauaugcaguuuuccuua

SEQ ID NO: 1892098 - RNA, 19 nt, Human
ugauauauuuaaaaauauu

SEQ ID NO: 1892099 - RNA, 21 nt, Human
ugauaucaugccccuguacuc

SEQ ID NO: 1892100 - RNA, 19 nt, Human
ugauauccauucuuucuga

SEQ ID NO: 1892101 - RNA, 21 nt, Human
ugauauccauucuuucugaua

SEQ ID NO: 1892102 - RNA, 14 nt, Human
ugauauccuucuag

SEQ ID NO: 1892103 - RNA, 17 nt, Human
ugauauaaguguguguu

SEQ ID NO: 1892104 - RNA, 23 nt, Human
ugauauaaguguguguuuuucau

SEQ ID NO: 1892105 - RNA, 24 nt, Human
ugauaguuguaccgcaaugugacu

SEQ ID NO: 1892106 - RNA, 14 nt, Human
ugauauaaauaaaa

SEQ ID NO: 1892107 - RNA, 14 nt, Human
ugauauauuuaaaa

SEQ ID NO: 1892108 - RNA, 20 nt, Human
ugauccacccaccucagccu

SEQ ID NO: 1892109 - RNA, 16 nt, Human
ugauccacccaccuca

SEQ ID NO: 1892110 - RNA, 15 nt, Human
ugauccacccaccuc

SEQ ID NO: 1892111 - RNA, 21 nt, Human
ugauccaagcuggucccacuc

SEQ ID NO: 1892112 - RNA, 24 nt, Human
ugaucauccacugugccaugugcc

SEQ ID NO: 1892113 - RNA, 13 nt, Human
ugaucauccacug

SEQ ID NO: 1892114 - RNA, 22 nt, Human
ugauccacccaccucagccucc

SEQ ID NO: 1892115 - RNA, 21 nt, Human
ugauccacccaccucagccuc

SEQ ID NO: 1892116 - RNA, 19 nt, Human
ugaucuaggaagacuuugg

SEQ ID NO: 1892117 - RNA, 21 nt, Human
ugaucuaggaagacuuuggaa

SEQ ID NO: 1892118 - RNA, 14 nt, Human
ugaucugaaaaaua

SEQ ID NO: 1892119 - RNA, 14 nt, Human
ugaugcccugcccu

SEQ ID NO: 1892120 - RNA, 20 nt, Human
ugaugcuauuugcaauuccu

SEQ ID NO: 1892121 - RNA, 13 nt, Human
ugaugcuauuugc

SEQ ID NO: 1892122 - RNA, 15 nt, Human
ugaugcugccccuca

SEQ ID NO: 1892123 - RNA, 19 nt, Human
ugaugcuucuucagagacu

SEQ ID NO: 1892124 - RNA, 21 nt, Human
ugaugcuucuucagagacucc

SEQ ID NO: 1892125 - RNA, 22 nt, Human
ugaugcuucuucagagacuccu

SEQ ID NO: 1892126 - RNA, 13 nt, Human
ugauguacaugua

SEQ ID NO: 1892127 - RNA, 21 nt, Human
ugaugguuguacauauaagug

SEQ ID NO: 1892128 - RNA, 20 nt, Human
ugaugaugaaaugaggucag

SEQ ID NO: 1892129 - RNA, 23 nt, Human
ugaugaucuuugcagacaggcaa

SEQ ID NO: 1892130 - RNA, 22 nt, Human
ugaugaucuuugcagacaggca

SEQ ID NO: 1892131 - RNA, 14 nt, Human
ugaugaaaauauuu

SEQ ID NO: 1892132 - RNA, 14 nt, Human
ugaugccaugagga

SEQ ID NO: 1892133 - RNA, 15 nt, Human
ugaugaaaauauuua

SEQ ID NO: 1892134 - RNA, 20 nt, Human
ugaucuuugcagacaggcaa

SEQ ID NO: 1892135 - RNA, 19 nt, Human
ugaucuuugcagacaggca

SEQ ID NO: 1892136 - RNA, 13 nt, Human
ugaucuggaaccc

SEQ ID NO: 1892137 - RNA, 23 nt, Human
ugaucuuugcagacaggcaagca

SEQ ID NO: 1892138 - RNA, 21 nt, Human
ugaucuuugcagacaggcaag

SEQ ID NO: 1892139 - RNA, 14 nt, Human
ugaucuggaaccca

SEQ ID NO: 1892140 - RNA, 16 nt, Human
ugaguccuagagcuac

SEQ ID NO: 1892141 - RNA, 15 nt, Human
ugagguugcuuuguu

SEQ ID NO: 1892142 - RNA, 11 nt, Human
ugaguccuggc

SEQ ID NO: 1892143 - RNA, 18 nt, Human
ugaguccuggcaugggaa

SEQ ID NO: 1892144 - RNA, 14 nt, Human
ugagucgaggacag

SEQ ID NO: 1892145 - RNA, 19 nt, Human
ugaguccuggcaugggaau

SEQ ID NO: 1892146 - RNA, 22 nt, Human
ugaguccuggcaugggaaugaa

SEQ ID NO: 1892147 - RNA, 19 nt, Human
ugagguuucaaaccucccu

SEQ ID NO: 1892148 - RNA, 21 nt, Human
ugaguccccuguuuguuucug

SEQ ID NO: 1892149 - RNA, 16 nt, Human
ugaggugcuauguucu

SEQ ID NO: 1892150 - RNA, 15 nt, Human
ugaggugcuauguuc

SEQ ID NO: 1892151 - RNA, 19 nt, Human
ugagguggaagagggcugc

SEQ ID NO: 1892152 - RNA, 11 nt, Human
ugaggcugggc

SEQ ID NO: 1892153 - RNA, 14 nt, Human
ugaggcuggcacag

SEQ ID NO: 1892154 - RNA, 15 nt, Human
ugaggcuggcacagg

SEQ ID NO: 1892155 - RNA, 17 nt, Human
ugaggcuggcacaggac

SEQ ID NO: 1892156 - RNA, 11 nt, Human
ugaggcuggca

SEQ ID NO: 1892157 - RNA, 23 nt, Human
ugaggcugcuuuccaaagccaau

SEQ ID NO: 1892158 - RNA, 20 nt, Human
ugaggcugcuuuccaaagcc

SEQ ID NO: 1892159 - RNA, 16 nt, Human
ugaggcugcuuuccaa

SEQ ID NO: 1892160 - RNA, 15 nt, Human
ugaggucuguucuuu

SEQ ID NO: 1892161 - RNA, 14 nt, Human
ugaggucuguucuu

SEQ ID NO: 1892162 - RNA, 20 nt, Human
ugaggucuguucuuuccaaa

SEQ ID NO: 1892163 - RNA, 23 nt, Human
ugaggcuuuggauuugacauugc

SEQ ID NO: 1892164 - RNA, 13 nt, Human
ugaggcuuuggau

SEQ ID NO: 1892165 - RNA, 18 nt, Human
ugaggcuuuggauuugac

SEQ ID NO: 1892166 - RNA, 20 nt, Human
ugaguugguguugacaugug

SEQ ID NO: 1892167 - RNA, 19 nt, Human
ugaguuggggucuggcagc

SEQ ID NO: 1892168 - RNA, 21 nt, Human
ugaguuggggucuggcagccu

SEQ ID NO: 1892169 - RNA, 17 nt, Human
ugaguuggggucuggca

SEQ ID NO: 1892170 - RNA, 17 nt, Human
ugaguuggcugggaaua

SEQ ID NO: 1892171 - RNA, 18 nt, Human
ugagucgaggacagggag

SEQ ID NO: 1892172 - RNA, 16 nt, Human
ugaguuggcugggaau

SEQ ID NO: 1892173 - RNA, 14 nt, Human
ugaguuggcuggga

SEQ ID NO: 1892174 - RNA, 16 nt, Human
ugaguugauucagcuc

SEQ ID NO: 1892175 - RNA, 19 nt, Human
ugaguugauucagcucugc

SEQ ID NO: 1892176 - RNA, 16 nt, Human
ugagucgaggacaggg

SEQ ID NO: 1892177 - RNA, 15 nt, Human
ugagucgaggacagg

SEQ ID NO: 1892178 - RNA, 21 nt, Human
ugaguugauagcacagacccu

SEQ ID NO: 1892179 - RNA, 23 nt, Human
ugaguugauagcacagacccugc

SEQ ID NO: 1892180 - RNA, 15 nt, Human
ugauagcacagaccc

SEQ ID NO: 1892181 - RNA, 16 nt, Human
ugauagcacagacccu

SEQ ID NO: 1892182 - RNA, 17 nt, Human
ugauagcacagacccug

SEQ ID NO: 1892183 - RNA, 18 nt, Human
ugauagcacagacccugc

SEQ ID NO: 1892184 - RNA, 20 nt, Human
ugauagcacagacccugccc

SEQ ID NO: 1892185 - RNA, 21 nt, Human
ugauagcacagacccugcccu

SEQ ID NO: 1892186 - RNA, 16 nt, Human
ugauagugguggaguu

SEQ ID NO: 1892187 - RNA, 22 nt, Human
ugauagcacagacccugcccug

SEQ ID NO: 1892188 - RNA, 23 nt, Human
ugauagcacagacccugcccugu

SEQ ID NO: 1892189 - RNA, 12 nt, Human
ugauagcacuuu

SEQ ID NO: 1892190 - RNA, 13 nt, Human
ugauagcacuuuc

SEQ ID NO: 1892191 - RNA, 14 nt, Human
ugauagcacuuucu

SEQ ID NO: 1892192 - RNA, 15 nt, Human
ugauagcacuuucua

SEQ ID NO: 1892193 - RNA, 21 nt, Human
ugauagcacuuucuacaaugu

SEQ ID NO: 1892194 - RNA, 21 nt, Human
ugagcucccaggugcagccag

SEQ ID NO: 1892195 - RNA, 23 nt, Human
ugagcucccaggugcagccagag

SEQ ID NO: 1892196 - RNA, 21 nt, Human
ugagcucucggaacugcaugc

SEQ ID NO: 1892197 - RNA, 15 nt, Human
ugagccucagcaucc

SEQ ID NO: 1892198 - RNA, 13 nt, Human
ugagccucagcau

SEQ ID NO: 1892199 - RNA, 17 nt, Human
ugagccccugucuagag

SEQ ID NO: 1892200 - RNA, 21 nt, Human
ugagccccugucuagagaggg

SEQ ID NO: 1892201 - RNA, 22 nt, Human
ugagccccugucuagagaggga

SEQ ID NO: 1892202 - RNA, 20 nt, Human
ugagaugcuagaacucccuu

SEQ ID NO: 1892203 - RNA, 16 nt, Human
ugagaugcuagaacuc

SEQ ID NO: 1892204 - RNA, 14 nt, Human
ugagaugcuagaac

SEQ ID NO: 1892205 - RNA, 13 nt, Human
ugagcaucaggcc

SEQ ID NO: 1892206 - RNA, 13 nt, Human
ugagccccaaaag

SEQ ID NO: 1892207 - RNA, 17 nt, Human
ugagcccagcuggguca

SEQ ID NO: 1892208 - RNA, 21 nt, Human
ugagcccagcugggucaggca

SEQ ID NO: 1892209 - RNA, 14 nt, Human
ugagcaucaggcca

SEQ ID NO: 1892210 - RNA, 15 nt, Human
ugagcaucaggccag

SEQ ID NO: 1892211 - RNA, 17 nt, Human
ugagaguagagucacug

SEQ ID NO: 1892212 - RNA, 14 nt, Human
ugagagguuugacu

SEQ ID NO: 1892213 - RNA, 22 nt, Human
ugagagguuugacuagaugaug

SEQ ID NO: 1892214 - RNA, 18 nt, Human
ugagauccuuccuuuuga

SEQ ID NO: 1892215 - RNA, 20 nt, Human
ugagaugauacauccaaagc

SEQ ID NO: 1892216 - RNA, 14 nt, Human
ugagacucugucuc

SEQ ID NO: 1892217 - RNA, 13 nt, Human
ugagacucugucu

SEQ ID NO: 1892218 - RNA, 12 nt, Human
ugagacucuguc

SEQ ID NO: 1892219 - RNA, 23 nt, Human
ugagaggcauccaguaucuugaa

SEQ ID NO: 1892220 - RNA, 16 nt, Human
ugagaggcauuucccc

SEQ ID NO: 1892221 - RNA, 14 nt, Human
ugagaggcauuucc

SEQ ID NO: 1892222 - RNA, 22 nt, Human
ugagaggcauccaguaucuuga

SEQ ID NO: 1892223 - RNA, 17 nt, Human
ugagaaaucuaaaaaac

SEQ ID NO: 1892224 - RNA, 13 nt, Human
ugagaaaucuaaa

SEQ ID NO: 1892225 - RNA, 12 nt, Human
ugagacccuguc

SEQ ID NO: 1892226 - RNA, 16 nt, Human
ugagacagcucugcau

SEQ ID NO: 1892227 - RNA, 14 nt, Human
ugagacagcucugc

SEQ ID NO: 1892228 - RNA, 22 nt, Human
ugagaaauucaacguuaauaau

SEQ ID NO: 1892229 - RNA, 15 nt, Human
ucuugaacuccuggc

SEQ ID NO: 1892230 - RNA, 13 nt, Human
ucuugaaggugcu

SEQ ID NO: 1892231 - RNA, 16 nt, Human
ucuugaauaauguaag

SEQ ID NO: 1892232 - RNA, 22 nt, Human
ucuugaaucuagggagggggaa

SEQ ID NO: 1892233 - RNA, 17 nt, Human
ucuugaauuguaaggaa

SEQ ID NO: 1892234 - RNA, 20 nt, Human
ugaccauucuccaccugcca

SEQ ID NO: 1892235 - RNA, 21 nt, Human
ugaccauucuccaccugccag

SEQ ID NO: 1892236 - RNA, 22 nt, Human
ugaccauucuccaccugccagg

SEQ ID NO: 1892237 - RNA, 12 nt, Human
ugaccucugccu

SEQ ID NO: 1892238 - RNA, 23 nt, Human
ugaccucugcagcaauaaagcag

SEQ ID NO: 1892239 - RNA, 21 nt, Human
ugaccucugcagcaauaaagc

SEQ ID NO: 1892240 - RNA, 18 nt, Human
ugaccucugcagcaauaa

SEQ ID NO: 1892241 - RNA, 14 nt, Human
ugaccuuucaauag

SEQ ID NO: 1892242 - RNA, 15 nt, Human
ugaccuuucaauagg

SEQ ID NO: 1892243 - RNA, 16 nt, Human
ugaccuuucaauagga

SEQ ID NO: 1892244 - RNA, 22 nt, Human
ugaccucaggugauccacccac

SEQ ID NO: 1892245 - RNA, 16 nt, Human
ugaccucugcagcaau

SEQ ID NO: 1892246 - RNA, 13 nt, Human
ugaccucugcagc

SEQ ID NO: 1892247 - RNA, 22 nt, Human
ugaccucccucuaauuuaucuu

SEQ ID NO: 1892248 - RNA, 13 nt, Human
ugaccucccucua

SEQ ID NO: 1892249 - RNA, 14 nt, Human
ugaccucccucuaa

SEQ ID NO: 1892250 - RNA, 15 nt, Human
ugacugaauuucuuu

SEQ ID NO: 1892251 - RNA, 14 nt, Human
ugacugaauuucuu

SEQ ID NO: 1892252 - RNA, 13 nt, Human
ugacugaauuucu

SEQ ID NO: 1892253 - RNA, 17 nt, Human
ugacucuggcaaagcuu

SEQ ID NO: 1892254 - RNA, 22 nt, Human
ugacucuggcaaagcuuuuaga

SEQ ID NO: 1892255 - RNA, 17 nt, Human
ugacgccaucccagccc

SEQ ID NO: 1892256 - RNA, 18 nt, Human
ugacgccaucccagcccc

SEQ ID NO: 1892257 - RNA, 19 nt, Human
ugacgccaucccagcccca

SEQ ID NO: 1892258 - RNA, 20 nt, Human
ugacgccaucccagccccaa

SEQ ID NO: 1892259 - RNA, 19 nt, Human
ugacggccagggagaagcu

SEQ ID NO: 1892260 - RNA, 18 nt, Human
ugaccuuucaauaggaaa

SEQ ID NO: 1892261 - RNA, 22 nt, Human
ugaccuuucaauaggaaaaacu

SEQ ID NO: 1892262 - RNA, 17 nt, Human
ugaccuuuuauguagua

SEQ ID NO: 1892263 - RNA, 18 nt, Human
ugaccuuuuauguaguaa

SEQ ID NO: 1892264 - RNA, 23 nt, Human
ugaccuuuuauguaguaauugac

SEQ ID NO: 1892265 - RNA, 13 nt, Human
ugacgccauccca

SEQ ID NO: 1892266 - RNA, 14 nt, Human
ugacgccaucccag

SEQ ID NO: 1892267 - RNA, 15 nt, Human
ugacgccaucccagc

SEQ ID NO: 1892268 - RNA, 16 nt, Human
ugacgccaucccagcc

SEQ ID NO: 1892269 - RNA, 16 nt, Human
ugcaccuugugucugu

SEQ ID NO: 1892270 - RNA, 15 nt, Human
ugcaccuugugucug

SEQ ID NO: 1892271 - RNA, 14 nt, Human
ugcaccuugugucu

SEQ ID NO: 1892272 - RNA, 22 nt, Human
ugcaccuggaauauauaaccag

SEQ ID NO: 1892273 - RNA, 20 nt, Human
ugcaccuggaauauauaacc

SEQ ID NO: 1892274 - RNA, 17 nt, Human
ugcaccuggaauauaua

SEQ ID NO: 1892275 - RNA, 21 nt, Human
ugcaccggcuggccuggcccc

SEQ ID NO: 1892276 - RNA, 20 nt, Human
ugcacagaguuguuacauuu

SEQ ID NO: 1892277 - RNA, 14 nt, Human
ugcacaaaguggca

SEQ ID NO: 1892278 - RNA, 15 nt, Human
ugcacaaaguggcau

SEQ ID NO: 1892279 - RNA, 20 nt, Human
ugcacaaaguggcauaaaaa

SEQ ID NO: 1892280 - RNA, 18 nt, Human
ugcaccggcuggccuggc

SEQ ID NO: 1892281 - RNA, 19 nt, Human
ugcaccggcuggccuggcc

SEQ ID NO: 1892282 - RNA, 20 nt, Human
ugcaccggcuggccuggccc

SEQ ID NO: 1892283 - RNA, 18 nt, Human
ugcacugugaaggacccu

SEQ ID NO: 1892284 - RNA, 18 nt, Human
ugcacuuaugauuucaug

SEQ ID NO: 1892285 - RNA, 19 nt, Human
ugcacuuaugauuucaugu

SEQ ID NO: 1892286 - RNA, 20 nt, Human
ugcacuuaugauuucaugug

SEQ ID NO: 1892287 - RNA, 21 nt, Human
ugcacugacauuguuggccaa

SEQ ID NO: 1892288 - RNA, 18 nt, Human
ugcacugacauuguuggc

SEQ ID NO: 1892289 - RNA, 17 nt, Human
ugcacucuuuaagggag

SEQ ID NO: 1892290 - RNA, 15 nt, Human
ugcacugugaaggac

SEQ ID NO: 1892291 - RNA, 21 nt, Human
ugcaaugacacagucuuggcu

SEQ ID NO: 1892292 - RNA, 20 nt, Human
ugcaagaaaaugauguguac

SEQ ID NO: 1892293 - RNA, 13 nt, Human
ugcaaugaccuuu

SEQ ID NO: 1892294 - RNA, 16 nt, Human
ugcaaugaccuuucaa

SEQ ID NO: 1892295 - RNA, 17 nt, Human
ugcaaugaccuuucaau

SEQ ID NO: 1892296 - RNA, 19 nt, Human
ugcaaugaccuuucaauag

SEQ ID NO: 1892297 - RNA, 22 nt, Human
ugcaaugaccuuucaauaggaa

SEQ ID NO: 1892298 - RNA, 23 nt, Human
ugcaaugaccuuucaauaggaaa

SEQ ID NO: 1892299 - RNA, 16 nt, Human
ugcaauggcagccuug

SEQ ID NO: 1892300 - RNA, 15 nt, Human
ugcaauggcagccuu

SEQ ID NO: 1892301 - RNA, 14 nt, Human
ugcaauggcagccu

SEQ ID NO: 1892302 - RNA, 13 nt, Human
ugcaauggcagcc

SEQ ID NO: 1892303 - RNA, 22 nt, Human
ugcaauguagaggggaaaagag

SEQ ID NO: 1892304 - RNA, 16 nt, Human
ugcaaugacucaggac

SEQ ID NO: 1892305 - RNA, 22 nt, Human
ugcaaugucugagugaaccugu

SEQ ID NO: 1892306 - RNA, 19 nt, Human
ugcaaugucugagugaacc

SEQ ID NO: 1892307 - RNA, 15 nt, Human
ugcacaaacagaggc

SEQ ID NO: 1892308 - RNA, 16 nt, Human
ugcacaaacagaggcc

SEQ ID NO: 1892309 - RNA, 19 nt, Human
ugcacagaguuguuacauu

SEQ ID NO: 1892310 - RNA, 18 nt, Human
ugcacagaguuguuacau

SEQ ID NO: 1892311 - RNA, 17 nt, Human
ugcacagaguuguuaca

SEQ ID NO: 1892312 - RNA, 20 nt, Human
ugcacaaacagaggccgcca

SEQ ID NO: 1892313 - RNA, 18 nt, Human
ugcacaaaacccagaccu

SEQ ID NO: 1892314 - RNA, 19 nt, Human
ugcacaaaacccagaccug

SEQ ID NO: 1892315 - RNA, 17 nt, Human
ugcacaaacagaggccg

SEQ ID NO: 1892316 - RNA, 19 nt, Human
ugcacaaacagaggccgcc

SEQ ID NO: 1892317 - RNA, 22 nt, Human
ugauuuuuuuuuccuucagugc

SEQ ID NO: 1892318 - RNA, 23 nt, Human
ugauuuuuuuuuccuucagugcc

SEQ ID NO: 1892319 - RNA, 22 nt, Human
ugcaaaaauauuuauaaaacuu

SEQ ID NO: 1892320 - RNA, 23 nt, Human
ugcaaaaauauuuauaaaacuuc

SEQ ID NO: 1892321 - RNA, 18 nt, Human
ugcaaaaauauuuauaaa

SEQ ID NO: 1892322 - RNA, 13 nt, Human
ugauuuuuugcau

SEQ ID NO: 1892323 - RNA, 16 nt, Human
ugauuuuuuuuuccuu

SEQ ID NO: 1892324 - RNA, 17 nt, Human
ugauuuuuuuuuccuuc

SEQ ID NO: 1892325 - RNA, 19 nt, Human
ugauuuuuuuuuccuucag

SEQ ID NO: 1892326 - RNA, 20 nt, Human
ugauuuuuuuuuccuucagu

SEQ ID NO: 1892327 - RNA, 16 nt, Human
ugauuuugcuguagaa

SEQ ID NO: 1892328 - RNA, 14 nt, Human
ugauuuugcuguag

SEQ ID NO: 1892329 - RNA, 19 nt, Human
ugauuuugcuguagaagau

SEQ ID NO: 1892330 - RNA, 17 nt, Human
ugauuuugcuguagaag

SEQ ID NO: 1892331 - RNA, 19 nt, Human
ugauuuuuaaagaaaaguu

SEQ ID NO: 1892332 - RNA, 15 nt, Human
ugauuuucauugcug

SEQ ID NO: 1892333 - RNA, 13 nt, Human
ugauuuucauugc

SEQ ID NO: 1892334 - RNA, 22 nt, Human
ugaugugaagccaauucagaca

SEQ ID NO: 1892335 - RNA, 14 nt, Human
ugaugugaagccaa

SEQ ID NO: 1892336 - RNA, 17 nt, Human
ugcaacaggcugggcuu

SEQ ID NO: 1892337 - RNA, 16 nt, Human
ugcaacaggcugggcu

SEQ ID NO: 1892338 - RNA, 15 nt, Human
ugcaacaggcugggc

SEQ ID NO: 1892339 - RNA, 14 nt, Human
ugcaacaggcuggg

SEQ ID NO: 1892340 - RNA, 20 nt, Human
ugcaacaggcugggcuucag

SEQ ID NO: 1892341 - RNA, 19 nt, Human
ugcaacaggcugggcuuca

SEQ ID NO: 1892342 - RNA, 14 nt, Human
ugcaaccuccgccu

SEQ ID NO: 1892343 - RNA, 13 nt, Human
ugcaaccuccgcc

SEQ ID NO: 1892344 - RNA, 17 nt, Human
ugcaaccagggagcugc

SEQ ID NO: 1892345 - RNA, 20 nt, Human
ugcaaccagggagcugcagg

SEQ ID NO: 1892346 - RNA, 21 nt, Human
ugcaaccagggagcugcaggg

SEQ ID NO: 1892347 - RNA, 21 nt, Human
ugcaaccuccgccucuugggu

SEQ ID NO: 1892348 - RNA, 20 nt, Human
ugcaaccuccgccucuuggg

SEQ ID NO: 1892349 - RNA, 18 nt, Human
ugcaaccuccgccucuug

SEQ ID NO: 1892350 - RNA, 19 nt, Human
ugcaaccugauugugucuc

SEQ ID NO: 1892351 - RNA, 20 nt, Human
ugcaaccugauugugucucu

SEQ ID NO: 1892352 - RNA, 18 nt, Human
ugcaaccucuuggccuga

SEQ ID NO: 1892353 - RNA, 14 nt, Human
ugcaacuucugccu

SEQ ID NO: 1892354 - RNA, 13 nt, Human
ugcaacuucugcc

SEQ ID NO: 1892355 - RNA, 14 nt, Human
ugcaacuuggacuu

SEQ ID NO: 1892356 - RNA, 18 nt, Human
ugcaacuuuguauaaaag

SEQ ID NO: 1892357 - RNA, 22 nt, Human
ugcaaccugauugugucucuug

SEQ ID NO: 1892358 - RNA, 22 nt, Human
ugcaacucugaaggguaauuau

SEQ ID NO: 1892359 - RNA, 16 nt, Human
ugccucccgcccccuu

SEQ ID NO: 1892360 - RNA, 20 nt, Human
ugccguuacuuuucauauuu

SEQ ID NO: 1892361 - RNA, 13 nt, Human
ugccucccuggug

SEQ ID NO: 1892362 - RNA, 22 nt, Human
ugccucccuggugagagggccg

SEQ ID NO: 1892363 - RNA, 14 nt, Human
ugccucccugguga

SEQ ID NO: 1892364 - RNA, 22 nt, Human
ugccuccgcgugaucaaagcca

SEQ ID NO: 1892365 - RNA, 22 nt, Human
ugccuccuuugugaggaagccg

SEQ ID NO: 1892366 - RNA, 13 nt, Human
ugccucgaaacac

SEQ ID NO: 1892367 - RNA, 17 nt, Human
ugccucgaaacacagaa

SEQ ID NO: 1892368 - RNA, 21 nt, Human
ugccuccuuugugaggaagcc

SEQ ID NO: 1892369 - RNA, 20 nt, Human
ugccuccuuugugaggaagc

SEQ ID NO: 1892370 - RNA, 21 nt, Human
ugccucgaaacacagaaaccu

SEQ ID NO: 1892371 - RNA, 13 nt, Human
ugccucugggacu

SEQ ID NO: 1892372 - RNA, 19 nt, Human
ugccugguggcagcugcgg

SEQ ID NO: 1892373 - RNA, 17 nt, Human
ugccugguccucacacu

SEQ ID NO: 1892374 - RNA, 18 nt, Human
ugccugguggcagcugcg

SEQ ID NO: 1892375 - RNA, 17 nt, Human
ugccugguggcagcugc

SEQ ID NO: 1892376 - RNA, 13 nt, Human
ugccugcccaggc

SEQ ID NO: 1892377 - RNA, 16 nt, Human
ugccugccagcugcac

SEQ ID NO: 1892378 - RNA, 15 nt, Human
ugccugccagcugca

SEQ ID NO: 1892379 - RNA, 19 nt, Human
ugccugccagcugcacuga

SEQ ID NO: 1892380 - RNA, 21 nt, Human
ugccucuucucuacucuaggg

SEQ ID NO: 1892381 - RNA, 16 nt, Human
ugcccuggagguggcu

SEQ ID NO: 1892382 - RNA, 15 nt, Human
ugccgucuaccugag

SEQ ID NO: 1892383 - RNA, 16 nt, Human
ugccgucuaccugagg

SEQ ID NO: 1892384 - RNA, 17 nt, Human
ugccgucuaccugaggg

SEQ ID NO: 1892385 - RNA, 19 nt, Human
ugccgucuaccugaggggc

SEQ ID NO: 1892386 - RNA, 21 nt, Human
ugcccugcccaccuggccucu

SEQ ID NO: 1892387 - RNA, 19 nt, Human
ugcccuaaaguguauuuuu

SEQ ID NO: 1892388 - RNA, 17 nt, Human
ugcccuaaaguguauuu

SEQ ID NO: 1892389 - RNA, 22 nt, Human
ugcccugcccaccuggccucug

SEQ ID NO: 1892390 - RNA, 23 nt, Human
ugcccugcccaccuggccucugc

SEQ ID NO: 1892391 - RNA, 21 nt, Human
ugcccggggaaaggcaagguc

SEQ ID NO: 1892392 - RNA, 18 nt, Human
ugcccggggaaaggcaag

SEQ ID NO: 1892393 - RNA, 19 nt, Human
ugcccagaaugaggcugcu

SEQ ID NO: 1892394 - RNA, 18 nt, Human
ugcccagaaugaggcugc

SEQ ID NO: 1892395 - RNA, 17 nt, Human
ugcccagaaugaggcug

SEQ ID NO: 1892396 - RNA, 19 nt, Human
ugccacugacugcagggac

SEQ ID NO: 1892397 - RNA, 12 nt, Human
ugccaggaagcc

SEQ ID NO: 1892398 - RNA, 16 nt, Human
ugccaggaagccagca

SEQ ID NO: 1892399 - RNA, 18 nt, Human
ugccaggaagccagcagg

SEQ ID NO: 1892400 - RNA, 19 nt, Human
ugccaggaagccagcaggc

SEQ ID NO: 1892401 - RNA, 12 nt, Human
ugccauccaggu

SEQ ID NO: 1892402 - RNA, 22 nt, Human
ugccaucauguuuacagaggac

SEQ ID NO: 1892403 - RNA, 15 nt, Human
ugccauccagguuca

SEQ ID NO: 1892404 - RNA, 17 nt, Human
ugccagguuuuuggucu

SEQ ID NO: 1892405 - RNA, 16 nt, Human
ugccauguuggccagg

SEQ ID NO: 1892406 - RNA, 20 nt, Human
ugcccaccuggccucugcac

SEQ ID NO: 1892407 - RNA, 15 nt, Human
ugccauguuggccag

SEQ ID NO: 1892408 - RNA, 12 nt, Human
ugccauguuggc

SEQ ID NO: 1892409 - RNA, 18 nt, Human
ugcccacgcuggagugca

SEQ ID NO: 1892410 - RNA, 19 nt, Human
ugcccaccuggccucugca

SEQ ID NO: 1892411 - RNA, 13 nt, Human
ugcccacucccug

SEQ ID NO: 1892412 - RNA, 15 nt, Human
ugccaugugccaggu

SEQ ID NO: 1892413 - RNA, 14 nt, Human
ugccaugugccagg

SEQ ID NO: 1892414 - RNA, 23 nt, Human
ugccaugaggaacaaggcaaggc

SEQ ID NO: 1892415 - RNA, 20 nt, Human
ugccaugaggaacaaggcaa

SEQ ID NO: 1892416 - RNA, 16 nt, Human
ugcauguaugucuugg

SEQ ID NO: 1892417 - RNA, 15 nt, Human
ugcauguaugucuug

SEQ ID NO: 1892418 - RNA, 14 nt, Human
ugcauguaugucuu

SEQ ID NO: 1892419 - RNA, 13 nt, Human
ugcauguaugucu

SEQ ID NO: 1892420 - RNA, 15 nt, Human
ugcauguuugugauu

SEQ ID NO: 1892421 - RNA, 23 nt, Human
ugcauguuuguuguauacuuccu

SEQ ID NO: 1892422 - RNA, 17 nt, Human
ugcaugguuuagaaagc

SEQ ID NO: 1892423 - RNA, 19 nt, Human
ugcagauaaacaguaguga

SEQ ID NO: 1892424 - RNA, 15 nt, Human
ugcaucccccccacc

SEQ ID NO: 1892425 - RNA, 17 nt, Human
ugcaucccccccaccuc

SEQ ID NO: 1892426 - RNA, 17 nt, Human
ugccacaguauauuuuu

SEQ ID NO: 1892427 - RNA, 23 nt, Human
ugcauuuuggagaguuuccugaa

SEQ ID NO: 1892428 - RNA, 18 nt, Human
ugcauuaucuagauacug

SEQ ID NO: 1892429 - RNA, 21 nt, Human
ugcauuauauuuguaaauuua

SEQ ID NO: 1892430 - RNA, 17 nt, Human
ugcauuaucuagauacu

SEQ ID NO: 1892431 - RNA, 12 nt, Human
ugcauuaucuag

SEQ ID NO: 1892432 - RNA, 14 nt, Human
uuuucaaaauggag

SEQ ID NO: 1892433 - RNA, 21 nt, Human
uuuucaaaauuguuacaaauu

SEQ ID NO: 1892434 - RNA, 16 nt, Human
uuuucacauuggaaac

SEQ ID NO: 1892435 - RNA, 23 nt, Human
uuuucaccuguuuuuaagcuguu

SEQ ID NO: 1892436 - RNA, 18 nt, Human
uuuucccuauuagagaag

SEQ ID NO: 1892437 - RNA, 22 nt, Human
uuuucccuauuagagaagagau

SEQ ID NO: 1892438 - RNA, 19 nt, Human
uuuucccagcuacaccuuu

SEQ ID NO: 1892439 - RNA, 15 nt, Human
uuuucagauauaaaa

SEQ ID NO: 1892440 - RNA, 18 nt, Human
uuuucccagcuacaccuu

SEQ ID NO: 1892441 - RNA, 13 nt, Human
uuuucuacucgag

SEQ ID NO: 1892442 - RNA, 20 nt, Human
uuuucuacucgaguuacaga

SEQ ID NO: 1892443 - RNA, 22 nt, Human
uuuucuacucgaguuacagaca

SEQ ID NO: 1892444 - RNA, 23 nt, Human
uuuucuacucgaguuacagacaa

SEQ ID NO: 1892445 - RNA, 16 nt, Human
uuuucuuucagccaag

SEQ ID NO: 1892446 - RNA, 16 nt, Human
uuuucuuuaaugcuuu

SEQ ID NO: 1892447 - RNA, 22 nt, Human
uuuucuuguguguuuauuguca

SEQ ID NO: 1892448 - RNA, 13 nt, Human
uuuucuucucccu

SEQ ID NO: 1892449 - RNA, 15 nt, Human
uuuucuucacugucc

SEQ ID NO: 1892450 - RNA, 21 nt, Human
uuuuaaaguaacccuacaaaa

SEQ ID NO: 1892451 - RNA, 19 nt, Human
uuuuacguccaucucuugu

SEQ ID NO: 1892452 - RNA, 14 nt, Human
uuuuaccuucacug

SEQ ID NO: 1892453 - RNA, 15 nt, Human
uuuuacuaauagaca

SEQ ID NO: 1892454 - RNA, 19 nt, Human
uuuuaucgucacugcuuaa

SEQ ID NO: 1892455 - RNA, 18 nt, Human
uuuuauuuuuagacagag

SEQ ID NO: 1892456 - RNA, 21 nt, Human
uuuuauuuuucucaugaugag

SEQ ID NO: 1892457 - RNA, 17 nt, Human
uuuucaaaauaaaaaug

SEQ ID NO: 1892458 - RNA, 21 nt, Human
uuuuauacauaaacaagacca

SEQ ID NO: 1892459 - RNA, 13 nt, Human
uuuuauacauaaa

SEQ ID NO: 1892460 - RNA, 13 nt, Human
uuuuauacucuuu

SEQ ID NO: 1892461 - RNA, 18 nt, Human
uuuuauacucuuucugua

SEQ ID NO: 1892462 - RNA, 19 nt, Human
uuuuauacucuuucuguau

SEQ ID NO: 1892463 - RNA, 21 nt, Human
uuugagugccuuacacaaugg

SEQ ID NO: 1892464 - RNA, 14 nt, Human
uuugaguguuuuaa

SEQ ID NO: 1892465 - RNA, 20 nt, Human
uuugcacuaagauauuucca

SEQ ID NO: 1892466 - RNA, 17 nt, Human
uuuccguuaaaauacca

SEQ ID NO: 1892467 - RNA, 15 nt, Human
uuuccguuaaaauac

SEQ ID NO: 1892468 - RNA, 23 nt, Human
uuucccuuugagguugcuuuguu

SEQ ID NO: 1892469 - RNA, 12 nt, Human
uuuggaaaauaa

SEQ ID NO: 1892470 - RNA, 13 nt, Human
uuuggacccugag

SEQ ID NO: 1892471 - RNA, 19 nt, Human
uuuggacaaaauggaauac

SEQ ID NO: 1892472 - RNA, 18 nt, Human
uuugcauaacguauaaaa

SEQ ID NO: 1892473 - RNA, 17 nt, Human
uuugcauuaaauucaca

SEQ ID NO: 1892474 - RNA, 18 nt, Human
uuugcauuaaauucacaa

SEQ ID NO: 1892475 - RNA, 21 nt, Human
uuugcauuaaauucacaaacu

SEQ ID NO: 1892476 - RNA, 22 nt, Human
uuugcauuaaauucacaaacuu

SEQ ID NO: 1892477 - RNA, 19 nt, Human
uuugcauugaacacaaacu

SEQ ID NO: 1892478 - RNA, 13 nt, Human
uuugcauucuccc

SEQ ID NO: 1892479 - RNA, 15 nt, Human
uuuggucaacacuaa

SEQ ID NO: 1892480 - RNA, 23 nt, Human
uuugguaguggaaaaaaaaaaga

SEQ ID NO: 1892481 - RNA, 17 nt, Human
uuuggucuacacugugc

SEQ ID NO: 1892482 - RNA, 13 nt, Human
uuuguguauuuaa

SEQ ID NO: 1892483 - RNA, 20 nt, Human
uuuguguauuuaacagggag

SEQ ID NO: 1892484 - RNA, 15 nt, Human
uuuguugucagcuga

SEQ ID NO: 1892485 - RNA, 22 nt, Human
uuuguuaguaugaggcauuugu

SEQ ID NO: 1892486 - RNA, 23 nt, Human
uuuuaaaauccacuuuaucuuga

SEQ ID NO: 1892487 - RNA, 14 nt, Human
uuuuaaaauccacu

SEQ ID NO: 1892488 - RNA, 11 nt, Human
uuuuuuuacua

SEQ ID NO: 1892489 - RNA, 13 nt, Human
uuuuuuccaucuu

SEQ ID NO: 1892490 - RNA, 22 nt, Human
uuuuuuccaucuuuacaaaacu

SEQ ID NO: 1892491 - RNA, 12 nt, Human
uuuuuuuuaaga

SEQ ID NO: 1892492 - RNA, 12 nt, Human
uuuuuuucuuua

SEQ ID NO: 1892493 - RNA, 13 nt, Human
uuuuuccaucuuu

SEQ ID NO: 1892494 - RNA, 19 nt, Human
uuuuucccagcuacaccuu

SEQ ID NO: 1892495 - RNA, 23 nt, Human
uuuuucccuucaucugggcacug

SEQ ID NO: 1892496 - RNA, 13 nt, Human
uuuuuuaaaaacu

SEQ ID NO: 1892497 - RNA, 20 nt, Human
uuuuuuaaccccgucaacaa

SEQ ID NO: 1892498 - RNA, 18 nt, Human
uuuuuucaauauuuauua

SEQ ID NO: 1892499 - RNA, 15 nt, Human
uuuuucaguuuucag

SEQ ID NO: 1892500 - RNA, 12 nt, Human
uuuuucaguuuu

SEQ ID NO: 1892501 - RNA, 19 nt, Human
uuuuucauugccaaaaacu

SEQ ID NO: 1892502 - RNA, 12 nt, Human
uuuuuccaggcu

SEQ ID NO: 1892503 - RNA, 20 nt, Human
uuuuuaauaaagacaggguu

SEQ ID NO: 1892504 - RNA, 17 nt, Human
uuuuuaauaaagacagg

SEQ ID NO: 1892505 - RNA, 18 nt, Human
uuuuuaaguuacacauuu

SEQ ID NO: 1892506 - RNA, 13 nt, Human
uuuuuaaucuuua

SEQ ID NO: 1892507 - RNA, 13 nt, Human
uuuuuaaucucca

SEQ ID NO: 1892508 - RNA, 23 nt, Human
uuuuuaagugcugcauuuaaaag

SEQ ID NO: 1892509 - RNA, 22 nt, Human
uuuuuaagugcugcauuuaaaa

SEQ ID NO: 1892510 - RNA, 19 nt, Human
uuuuuaagugcugcauuua

SEQ ID NO: 1892511 - RNA, 18 nt, Human
uuuuuaagugcugcauuu

SEQ ID NO: 1892512 - RNA, 17 nt, Human
uuuuuaagugcugcauu

SEQ ID NO: 1892513 - RNA, 16 nt, Human
uuuuuaagugcugcau

SEQ ID NO: 1892514 - RNA, 23 nt, Human
uuuuuaagaaaaaggaugcacag

SEQ ID NO: 1892515 - RNA, 22 nt, Human
uuuuuaacucaauauuuuccau

SEQ ID NO: 1892516 - RNA, 12 nt, Human
uuuuuaagaaaa

SEQ ID NO: 1892517 - RNA, 15 nt, Human
uuuugaauaaaaacu

SEQ ID NO: 1892518 - RNA, 13 nt, Human
uuuugaaggcaaa

SEQ ID NO: 1892519 - RNA, 14 nt, Human
uuuugaaggcaaaa

SEQ ID NO: 1892520 - RNA, 19 nt, Human
uuuuuaaccccgucaacaa

SEQ ID NO: 1892521 - RNA, 21 nt, Human
uuuugacucuggcaaagcuuu

SEQ ID NO: 1892522 - RNA, 20 nt, Human
uuuugacuuucauuggaaau

SEQ ID NO: 1892523 - RNA, 13 nt, Human
uuuuuuuugacaa

SEQ ID NO: 1892524 - RNA, 21 nt, Human
uuguacauguguagccugugc

SEQ ID NO: 1892525 - RNA, 20 nt, Human
uuguacauguguagccugug

SEQ ID NO: 1892526 - RNA, 14 nt, Human
uuguauuaaagaca

SEQ ID NO: 1892527 - RNA, 13 nt, Human
uuguauuaaacuc

SEQ ID NO: 1892528 - RNA, 15 nt, Human
uuguauuaaacucuu

SEQ ID NO: 1892529 - RNA, 16 nt, Human
uuguauuaaagacaga

SEQ ID NO: 1892530 - RNA, 21 nt, Human
uuguauucagaguugaugguu

SEQ ID NO: 1892531 - RNA, 16 nt, Human
uuguauucucuccugu

SEQ ID NO: 1892532 - RNA, 15 nt, Human
uuguauucucuccug

SEQ ID NO: 1892533 - RNA, 19 nt, Human
uuguauucucuccuguacc

SEQ ID NO: 1892534 - RNA, 16 nt, Human
uuguauuaaacucuuc

SEQ ID NO: 1892535 - RNA, 15 nt, Human
uugucuuaaaaagug

SEQ ID NO: 1892536 - RNA, 12 nt, Human
uugugauuuuug

SEQ ID NO: 1892537 - RNA, 17 nt, Human
uugugauuuuuguaauu

SEQ ID NO: 1892538 - RNA, 16 nt, Human
uugugauuuuuguaau

SEQ ID NO: 1892539 - RNA, 20 nt, Human
uugugaaaggaaagaggcuc

SEQ ID NO: 1892540 - RNA, 21 nt, Human
uugugaaauaaaacuggcuuu

SEQ ID NO: 1892541 - RNA, 22 nt, Human
uugucuuaaaaaguggaaaaau

SEQ ID NO: 1892542 - RNA, 22 nt, Human
uuggguucaagcgauucuucug

SEQ ID NO: 1892543 - RNA, 19 nt, Human
uugcacguauuuuaauagc

SEQ ID NO: 1892544 - RNA, 16 nt, Human
uugcacuaagauauuu

SEQ ID NO: 1892545 - RNA, 13 nt, Human
uuggucuguguga

SEQ ID NO: 1892546 - RNA, 16 nt, Human
uuggucugugagaugc

SEQ ID NO: 1892547 - RNA, 21 nt, Human
uuggugaacauugcaauagaa

SEQ ID NO: 1892548 - RNA, 13 nt, Human
uuguaaaacaggu

SEQ ID NO: 1892549 - RNA, 17 nt, Human
uuguaaauagcucaggu

SEQ ID NO: 1892550 - RNA, 14 nt, Human
uuguaaaacaggua

SEQ ID NO: 1892551 - RNA, 15 nt, Human
uuguaaaacagguag

SEQ ID NO: 1892552 - RNA, 18 nt, Human
uuguacauaaugcgugca

SEQ ID NO: 1892553 - RNA, 23 nt, Human
uuguaaauuaacuuuuauaaacu

SEQ ID NO: 1892554 - RNA, 18 nt, Human
uuguaaauuaacuuuuau

SEQ ID NO: 1892555 - RNA, 16 nt, Human
uuguaaauuaacuuuu

SEQ ID NO: 1892556 - RNA, 15 nt, Human
uuguaaauuaacuuu

SEQ ID NO: 1892557 - RNA, 22 nt, Human
uugugccauagucacauggccu

SEQ ID NO: 1892558 - RNA, 12 nt, Human
uugugccccugc

SEQ ID NO: 1892559 - RNA, 17 nt, Human
uugugccucccugguga

SEQ ID NO: 1892560 - RNA, 12 nt, Human
uugugcauuugg

SEQ ID NO: 1892561 - RNA, 22 nt, Human
uugugccaaccuauuuugaagu

SEQ ID NO: 1892562 - RNA, 23 nt, Human
uugugcauuaucuagauacugua

SEQ ID NO: 1892563 - RNA, 22 nt, Human
uugugcauuaucuagauacugu

SEQ ID NO: 1892564 - RNA, 17 nt, Human
uugugcauuaucuagau

SEQ ID NO: 1892565 - RNA, 21 nt, Human
uuguguuuauauauaagccaa

SEQ ID NO: 1892566 - RNA, 20 nt, Human
uuguguugaagagguuuuaa

SEQ ID NO: 1892567 - RNA, 13 nt, Human
uuguguucuuugu

SEQ ID NO: 1892568 - RNA, 23 nt, Human
uuguggauuuaacagaaauguac

SEQ ID NO: 1892569 - RNA, 22 nt, Human
uuguggauuuaacagaaaugua

SEQ ID NO: 1892570 - RNA, 21 nt, Human
uuguggauuuaacagaaaugu

SEQ ID NO: 1892571 - RNA, 20 nt, Human
uuguggauuuaacagaaaug

SEQ ID NO: 1892572 - RNA, 22 nt, Human
uuguggaggagcucaggacacu

SEQ ID NO: 1892573 - RNA, 16 nt, Human
uuguggacacagcucu

SEQ ID NO: 1892574 - RNA, 17 nt, Human
uuguggacacagcucuu

SEQ ID NO: 1892575 - RNA, 22 nt, Human
uuguggaauggagauucaguuu

SEQ ID NO: 1892576 - RNA, 22 nt, Human
uuguuaguaugaggcauuuguu

SEQ ID NO: 1892577 - RNA, 20 nt, Human
uuguuagugugucuuagugu

SEQ ID NO: 1892578 - RNA, 16 nt, Human
uuguuaucagucaaua

SEQ ID NO: 1892579 - RNA, 22 nt, Human
uuguuaucagucaauauuuuua

SEQ ID NO: 1892580 - RNA, 13 nt, Human
uuguuaucuggga

SEQ ID NO: 1892581 - RNA, 19 nt, Human
uuguguuucuuuaguuuuu

SEQ ID NO: 1892582 - RNA, 17 nt, Human
uuguguuuguguauuua

SEQ ID NO: 1892583 - RNA, 19 nt, Human
uuguuaauaaaaguacaug

SEQ ID NO: 1892584 - RNA, 14 nt, Human
uuguuaauaaaagu

SEQ ID NO: 1892585 - RNA, 21 nt, Human
uuguuaauaaaaguacauguu

SEQ ID NO: 1892586 - RNA, 17 nt, Human
uuguuaauauucauuuu

SEQ ID NO: 1892587 - RNA, 14 nt, Human
uuguuacauuuuua

SEQ ID NO: 1892588 - RNA, 19 nt, Human
uuguuaaugguuugaauau

SEQ ID NO: 1892589 - RNA, 21 nt, Human
uuguuaguaugaggcauuugu

SEQ ID NO: 1892590 - RNA, 19 nt, Human
uuguuaguaugaggcauuu

SEQ ID NO: 1892591 - RNA, 19 nt, Human
uuuaacucuauaauguguu

SEQ ID NO: 1892592 - RNA, 15 nt, Human
uuuaacuagaauuua

SEQ ID NO: 1892593 - RNA, 18 nt, Human
uuuaacuccucaauucca

SEQ ID NO: 1892594 - RNA, 24 nt, Human
uuuaacucaauauuuuccaugaaa

SEQ ID NO: 1892595 - RNA, 17 nt, Human
uuuaacuagaauuuauu

SEQ ID NO: 1892596 - RNA, 18 nt, Human
uuuaacagaaauguacag

SEQ ID NO: 1892597 - RNA, 17 nt, Human
uuuaacagcugaauuau

SEQ ID NO: 1892598 - RNA, 20 nt, Human
uuuaacagcugaauuaucua

SEQ ID NO: 1892599 - RNA, 18 nt, Human
uuuaaguuacacauuuuu

SEQ ID NO: 1892600 - RNA, 20 nt, Human
uuuaagacgaaacauuuguu

SEQ ID NO: 1892601 - RNA, 22 nt, Human
uuuaagaaaaaggaugcacaga

SEQ ID NO: 1892602 - RNA, 18 nt, Human
uuuaagaaaaaggaugca

SEQ ID NO: 1892603 - RNA, 13 nt, Human
uuuaacuucugcc

SEQ ID NO: 1892604 - RNA, 16 nt, Human
uuuacacucuuuguaa

SEQ ID NO: 1892605 - RNA, 21 nt, Human
uuuacaccaguuccuuucaau

SEQ ID NO: 1892606 - RNA, 21 nt, Human
uuuaauagcgucauaacuaga

SEQ ID NO: 1892607 - RNA, 22 nt, Human
uuuaauagcgucauaacuagaa

SEQ ID NO: 1892608 - RNA, 21 nt, Human
uuuaauagguuuggacaaaau

SEQ ID NO: 1892609 - RNA, 16 nt, Human
uuuacagucuauuuga

SEQ ID NO: 1892610 - RNA, 16 nt, Human
uuuacauuguugagcu

SEQ ID NO: 1892611 - RNA, 18 nt, Human
uuuacagucuauuugaga

SEQ ID NO: 1892612 - RNA, 14 nt, Human
uuuagaaauauaau

SEQ ID NO: 1892613 - RNA, 19 nt, Human
uuuagaaauacugcaagaa

SEQ ID NO: 1892614 - RNA, 20 nt, Human
uuuagaaauacugcaagaaa

SEQ ID NO: 1892615 - RNA, 22 nt, Human
uuuagaaauacugcaagaaaau

SEQ ID NO: 1892616 - RNA, 23 nt, Human
uuuagaaagaagcccaauauuau

SEQ ID NO: 1892617 - RNA, 19 nt, Human
uuuacuucuuauacauuug

SEQ ID NO: 1892618 - RNA, 22 nt, Human
uuuacuucuuauacauuugaua

SEQ ID NO: 1892619 - RNA, 12 nt, Human
uuuagacagagu

SEQ ID NO: 1892620 - RNA, 21 nt, Human
uuuauaaaaauaaaaaacacu

SEQ ID NO: 1892621 - RNA, 23 nt, Human
uuuauaaaaauaaaaaacacugg

SEQ ID NO: 1892622 - RNA, 13 nt, Human
uuucacaaauaaa

SEQ ID NO: 1892623 - RNA, 12 nt, Human
uuucacaaauaa

SEQ ID NO: 1892624 - RNA, 22 nt, Human
uuucacaaacagaaaacaugua

SEQ ID NO: 1892625 - RNA, 18 nt, Human
uuucagauauaaaagacu

SEQ ID NO: 1892626 - RNA, 16 nt, Human
uuucagauauaaaaga

SEQ ID NO: 1892627 - RNA, 14 nt, Human
uuucagauauaaaa

SEQ ID NO: 1892628 - RNA, 12 nt, Human
uuucaauaggaa

SEQ ID NO: 1892629 - RNA, 14 nt, Human
uuucaauaggaaaa

SEQ ID NO: 1892630 - RNA, 17 nt, Human
uuucaauaggaaaaacu

SEQ ID NO: 1892631 - RNA, 19 nt, Human
uuucaauaggaaaaacuga

SEQ ID NO: 1892632 - RNA, 19 nt, Human
uuucaauuuccaagagcug

SEQ ID NO: 1892633 - RNA, 23 nt, Human
uuucaagucaaauuaauaaucuu

SEQ ID NO: 1892634 - RNA, 19 nt, Human
uuucaauaaagcauuuaua

SEQ ID NO: 1892635 - RNA, 20 nt, Human
uuucaauaaagcauuuauaa

SEQ ID NO: 1892636 - RNA, 20 nt, Human
uuucaagguaauuucuugug

SEQ ID NO: 1892637 - RNA, 18 nt, Human
uuucaagucaaauuaaua

SEQ ID NO: 1892638 - RNA, 20 nt, Human
uuucaagucaaauuaauaau

SEQ ID NO: 1892639 - RNA, 17 nt, Human
uuucauuuacuguggcu

SEQ ID NO: 1892640 - RNA, 14 nt, Human
uuucauuuacugug

SEQ ID NO: 1892641 - RNA, 18 nt, Human
uuucauuuaggugaggaa

SEQ ID NO: 1892642 - RNA, 14 nt, Human
uuucauuuagguga

SEQ ID NO: 1892643 - RNA, 16 nt, Human
uuuccaagagcugagg

SEQ ID NO: 1892644 - RNA, 14 nt, Human
uuuccaagagcuga

SEQ ID NO: 1892645 - RNA, 13 nt, Human
uuuccaagagcug

SEQ ID NO: 1892646 - RNA, 14 nt, Human
uuucagcagacuga

SEQ ID NO: 1892647 - RNA, 23 nt, Human
uuucagcaccuacaguguacagu

SEQ ID NO: 1892648 - RNA, 13 nt, Human
uuucaguguacau

SEQ ID NO: 1892649 - RNA, 14 nt, Human
uuucaguguacaug

SEQ ID NO: 1892650 - RNA, 13 nt, Human
uuuauuauggcac

SEQ ID NO: 1892651 - RNA, 13 nt, Human
uuuauuaugcaug

SEQ ID NO: 1892652 - RNA, 16 nt, Human
uuuauggcuuuugugc

SEQ ID NO: 1892653 - RNA, 14 nt, Human
uuuauggcuuuugu

SEQ ID NO: 1892654 - RNA, 17 nt, Human
uuuauacaaauuagaaa

SEQ ID NO: 1892655 - RNA, 19 nt, Human
uuuauacaaauuagaaaau

SEQ ID NO: 1892656 - RNA, 13 nt, Human
uuuauaaaacuuc

SEQ ID NO: 1892657 - RNA, 13 nt, Human
uuuauacaaauua

SEQ ID NO: 1892658 - RNA, 15 nt, Human
uuuauacaaauuaga

SEQ ID NO: 1892659 - RNA, 16 nt, Human
uuucaacugccaaaau

SEQ ID NO: 1892660 - RNA, 19 nt, Human
uuuauuuaguuccuugagu

SEQ ID NO: 1892661 - RNA, 20 nt, Human
uuuauuuacagaugaaugua

SEQ ID NO: 1892662 - RNA, 16 nt, Human
uuuauuauuuauuuau

SEQ ID NO: 1892663 - RNA, 12 nt, Human
uuuauugacaca

SEQ ID NO: 1892664 - RNA, 13 nt, Human
uuuauugacacag

SEQ ID NO: 1892665 - RNA, 14 nt, Human
uuuauugacacaga

SEQ ID NO: 1892666 - RNA, 15 nt, Human
uuuauugacacagaa

SEQ ID NO: 1892667 - RNA, 16 nt, Human
uuccuuuauguucuca

SEQ ID NO: 1892668 - RNA, 17 nt, Human
uucgggugugcaauguc

SEQ ID NO: 1892669 - RNA, 21 nt, Human
uucgggugugcaaugucugag

SEQ ID NO: 1892670 - RNA, 16 nt, Human
uuccuuucauuuacug

SEQ ID NO: 1892671 - RNA, 18 nt, Human
uucggugagcuacaaaug

SEQ ID NO: 1892672 - RNA, 21 nt, Human
uuccuugaguugauucagcuc

SEQ ID NO: 1892673 - RNA, 12 nt, Human
uuccauggccuc

SEQ ID NO: 1892674 - RNA, 16 nt, Human
uuccauggccucuuca

SEQ ID NO: 1892675 - RNA, 22 nt, Human
uuccauggccguguagaagcau

SEQ ID NO: 1892676 - RNA, 20 nt, Human
uuccugaggcugggcucccu

SEQ ID NO: 1892677 - RNA, 23 nt, Human
uuccugagggaucuauacuugcu

SEQ ID NO: 1892678 - RNA, 21 nt, Human
uuccugaggaagagggacugu

SEQ ID NO: 1892679 - RNA, 15 nt, Human
uuccugaggcugggc

SEQ ID NO: 1892680 - RNA, 21 nt, Human
uuccugcaggccaggccagcu

SEQ ID NO: 1892681 - RNA, 19 nt, Human
uucuacccagcgagcccug

SEQ ID NO: 1892682 - RNA, 12 nt, Human
uucuacccagcg

SEQ ID NO: 1892683 - RNA, 15 nt, Human
uucuacaaugugaac

SEQ ID NO: 1892684 - RNA, 16 nt, Human
uucuacaaugugaacu

SEQ ID NO: 1892685 - RNA, 18 nt, Human
uucuacaaugugaacuuu

SEQ ID NO: 1892686 - RNA, 19 nt, Human
uucuacaaugugaacuuua

SEQ ID NO: 1892687 - RNA, 22 nt, Human
uucgguggcuagucaagcuccu

SEQ ID NO: 1892688 - RNA, 21 nt, Human
uucuacccagcgagcccuggu

SEQ ID NO: 1892689 - RNA, 20 nt, Human
uucuacccagcgagcccugg

SEQ ID NO: 1892690 - RNA, 14 nt, Human
uucuacccaggugc

SEQ ID NO: 1892691 - RNA, 13 nt, Human
uucuacgccaggg

SEQ ID NO: 1892692 - RNA, 14 nt, Human
uucuauagcuuuuc

SEQ ID NO: 1892693 - RNA, 22 nt, Human
uucuacucgaguuacagacaaa

SEQ ID NO: 1892694 - RNA, 13 nt, Human
uucuacuugcucu

SEQ ID NO: 1892695 - RNA, 14 nt, Human
uucuacuugcucug

SEQ ID NO: 1892696 - RNA, 16 nt, Human
uucuacuugcucugga

SEQ ID NO: 1892697 - RNA, 22 nt, Human
uucuacuugcucuggaccugcc

SEQ ID NO: 1892698 - RNA, 19 nt, Human
uucuacuugcucuggaccu

SEQ ID NO: 1892699 - RNA, 20 nt, Human
uucuacuugcucuggaccug

SEQ ID NO: 1892700 - RNA, 23 nt, Human
uucuacuugcucuggaccugccc

SEQ ID NO: 1892701 - RNA, 16 nt, Human
uucucugcccuccaag

SEQ ID NO: 1892702 - RNA, 17 nt, Human
uucucugcccuccaaga

SEQ ID NO: 1892703 - RNA, 23 nt, Human
uucugacccaugcugcccuguga

SEQ ID NO: 1892704 - RNA, 22 nt, Human
uucugacccaugcugcccugug

SEQ ID NO: 1892705 - RNA, 18 nt, Human
uucugacccugcuucaaa

SEQ ID NO: 1892706 - RNA, 21 nt, Human
uucugacccugcuucaaauau

SEQ ID NO: 1892707 - RNA, 18 nt, Human
uucucugaggaagcuggg

SEQ ID NO: 1892708 - RNA, 19 nt, Human
uucugagagcugugcauca

SEQ ID NO: 1892709 - RNA, 13 nt, Human
uucugagagcugu

SEQ ID NO: 1892710 - RNA, 23 nt, Human
uucugauaacuagauggugcuga

SEQ ID NO: 1892711 - RNA, 22 nt, Human
uucugauaacuagauggugcug

SEQ ID NO: 1892712 - RNA, 19 nt, Human
uucugcucacauaucuguc

SEQ ID NO: 1892713 - RNA, 15 nt, Human
uucugcucagcucug

SEQ ID NO: 1892714 - RNA, 20 nt, Human
uucugcucagcucugggcca

SEQ ID NO: 1892715 - RNA, 19 nt, Human
uucugcuacuggcaaaagg

SEQ ID NO: 1892716 - RNA, 14 nt, Human
uucugcucagcucu

SEQ ID NO: 1892717 - RNA, 12 nt, Human
uucugcucagcu

SEQ ID NO: 1892718 - RNA, 15 nt, Human
uucugcucauucuaa

SEQ ID NO: 1892719 - RNA, 19 nt, Human
uucugcucauucuaaugau

SEQ ID NO: 1892720 - RNA, 22 nt, Human
uucugauaugcaguuuuccuua

SEQ ID NO: 1892721 - RNA, 19 nt, Human
uucugauccuaguuccacc

SEQ ID NO: 1892722 - RNA, 19 nt, Human
uucugcaaaaauauuuaua

SEQ ID NO: 1892723 - RNA, 16 nt, Human
uucuccacccugcucu

SEQ ID NO: 1892724 - RNA, 19 nt, Human
uucucauuucaccccuccc

SEQ ID NO: 1892725 - RNA, 16 nt, Human
uucucauuucaccccu

SEQ ID NO: 1892726 - RNA, 15 nt, Human
uucucauuucacccc

SEQ ID NO: 1892727 - RNA, 23 nt, Human
uucucauugaauuauaaaagcca

SEQ ID NO: 1892728 - RNA, 14 nt, Human
uucuccacucaguu

SEQ ID NO: 1892729 - RNA, 20 nt, Human
uucuccaccugccagggaca

SEQ ID NO: 1892730 - RNA, 16 nt, Human
uucuccaccugccagg

SEQ ID NO: 1892731 - RNA, 18 nt, Human
uucuccaccugccaggga

SEQ ID NO: 1892732 - RNA, 21 nt, Human
uucuccaccucccacaaagga

SEQ ID NO: 1892733 - RNA, 12 nt, Human
uucuccaccugc

SEQ ID NO: 1892734 - RNA, 14 nt, Human
uucuccaccugcca

SEQ ID NO: 1892735 - RNA, 15 nt, Human
uucuccaccugccag

SEQ ID NO: 1892736 - RNA, 20 nt, Human
uucucugaggacacuaacca

SEQ ID NO: 1892737 - RNA, 14 nt, Human
uucucugaggacac

SEQ ID NO: 1892738 - RNA, 11 nt, Human
uucucugcccu

SEQ ID NO: 1892739 - RNA, 12 nt, Human
uucucugcccuc

SEQ ID NO: 1892740 - RNA, 19 nt, Human
uucucuccuguaccucuug

SEQ ID NO: 1892741 - RNA, 22 nt, Human
uucucuccuguaccucuugagc

SEQ ID NO: 1892742 - RNA, 13 nt, Human
uucucugaggaag

SEQ ID NO: 1892743 - RNA, 13 nt, Human
uucucuccagccc

SEQ ID NO: 1892744 - RNA, 14 nt, Human
uucucuccagcccc

SEQ ID NO: 1892745 - RNA, 17 nt, Human
uucuccacucaguugca

SEQ ID NO: 1892746 - RNA, 18 nt, Human
uucucuccuguaccucuu

SEQ ID NO: 1892747 - RNA, 14 nt, Human
uucucuccuguacc

SEQ ID NO: 1892748 - RNA, 15 nt, Human
uucucuccagccccu

SEQ ID NO: 1892749 - RNA, 16 nt, Human
uucucuccagccccug

SEQ ID NO: 1892750 - RNA, 20 nt, Human
uucuggaauguaaucaaugu

SEQ ID NO: 1892751 - RNA, 16 nt, Human
uucuggaauguaauca

SEQ ID NO: 1892752 - RNA, 15 nt, Human
uucuggaauguaauc

SEQ ID NO: 1892753 - RNA, 22 nt, Human
uucuggaauguaaucaauguuu

SEQ ID NO: 1892754 - RNA, 19 nt, Human
uucugcuucagccucccga

SEQ ID NO: 1892755 - RNA, 14 nt, Human
uucugcuguucucu

SEQ ID NO: 1892756 - RNA, 16 nt, Human
uucugcuucagccucc

SEQ ID NO: 1892757 - RNA, 15 nt, Human
uucugcuucagccuc

SEQ ID NO: 1892758 - RNA, 14 nt, Human
uucugcuucagccu

SEQ ID NO: 1892759 - RNA, 18 nt, Human
uucugcuggaaacagacu

SEQ ID NO: 1892760 - RNA, 18 nt, Human
uucuguauuuuguuuuug

SEQ ID NO: 1892761 - RNA, 23 nt, Human
uucuuaguugcuguaugucucgu

SEQ ID NO: 1892762 - RNA, 15 nt, Human
uucuuaguugcugua

SEQ ID NO: 1892763 - RNA, 14 nt, Human
uucuuaguugcugu

SEQ ID NO: 1892764 - RNA, 21 nt, Human
uucuuccacaagagcccaggc

SEQ ID NO: 1892765 - RNA, 21 nt, Human
uucuuauacauuugauaaagu

SEQ ID NO: 1892766 - RNA, 13 nt, Human
uucuucccauucu

SEQ ID NO: 1892767 - RNA, 17 nt, Human
uucuucccauucuccau

SEQ ID NO: 1892768 - RNA, 21 nt, Human
uucuuguguguuuauugucaa

SEQ ID NO: 1892769 - RNA, 13 nt, Human
uucuuccucccuc

SEQ ID NO: 1892770 - RNA, 14 nt, Human
uucuuuccaaagua

SEQ ID NO: 1892771 - RNA, 19 nt, Human
uucuuucacaaaaaagaag

SEQ ID NO: 1892772 - RNA, 12 nt, Human
uucuuucagcca

SEQ ID NO: 1892773 - RNA, 23 nt, Human
uucuuuaaaaaacaacuauggau

SEQ ID NO: 1892774 - RNA, 16 nt, Human
uugaacuccuggccuc

SEQ ID NO: 1892775 - RNA, 15 nt, Human
uugaacuccuggccu

SEQ ID NO: 1892776 - RNA, 13 nt, Human
uugaaaagaggug

SEQ ID NO: 1892777 - RNA, 21 nt, Human
uugaaaagaggugugcaagag

SEQ ID NO: 1892778 - RNA, 14 nt, Human
uugaaaagaggugu

SEQ ID NO: 1892779 - RNA, 20 nt, Human
uugaaaaaccauuuugcugu

SEQ ID NO: 1892780 - RNA, 21 nt, Human
uucuuuccaaaguacacuguu

SEQ ID NO: 1892781 - RNA, 23 nt, Human
uugaaaacacuguucucugcccu

SEQ ID NO: 1892782 - RNA, 21 nt, Human
uugacucuuuugccauuaaac

SEQ ID NO: 1892783 - RNA, 15 nt, Human
uugacucuuuugcca

SEQ ID NO: 1892784 - RNA, 19 nt, Human
uugacucuggcaaagcuuu

SEQ ID NO: 1892785 - RNA, 20 nt, Human
uugacgccaucccagcccca

SEQ ID NO: 1892786 - RNA, 16 nt, Human
uugaccucugcagcaa

SEQ ID NO: 1892787 - RNA, 17 nt, Human
uugacgccaucccagcc

SEQ ID NO: 1892788 - RNA, 18 nt, Human
uugacgccaucccagccc

SEQ ID NO: 1892789 - RNA, 19 nt, Human
uugacgccaucccagcccc

SEQ ID NO: 1892790 - RNA, 14 nt, Human
uugacccacaagaa

SEQ ID NO: 1892791 - RNA, 17 nt, Human
uugaccgugaggccaga

SEQ ID NO: 1892792 - RNA, 17 nt, Human
uugacccacaagaaaug

SEQ ID NO: 1892793 - RNA, 21 nt, Human
uugaccucaggugauccaccc

SEQ ID NO: 1892794 - RNA, 20 nt, Human
uugaccgcgacuaauuucaa

SEQ ID NO: 1892795 - RNA, 15 nt, Human
uugaccucugcagca

SEQ ID NO: 1892796 - RNA, 14 nt, Human
uugaccucugcagc

SEQ ID NO: 1892797 - RNA, 16 nt, Human
uugacaaccaugagac

SEQ ID NO: 1892798 - RNA, 12 nt, Human
uugacaacaucu

SEQ ID NO: 1892799 - RNA, 13 nt, Human
uugacaacaucug

SEQ ID NO: 1892800 - RNA, 20 nt, Human
uugacaaagucaagccacau

SEQ ID NO: 1892801 - RNA, 19 nt, Human
uugacaaagucaagccaca

SEQ ID NO: 1892802 - RNA, 12 nt, Human
uugaauuuuaca

SEQ ID NO: 1892803 - RNA, 18 nt, Human
uugaacuggguacuugug

SEQ ID NO: 1892804 - RNA, 13 nt, Human
uugaacuuugacc

SEQ ID NO: 1892805 - RNA, 20 nt, Human
uugaacuguaccaugugcua

SEQ ID NO: 1892806 - RNA, 14 nt, Human
uugaauuguaagga

SEQ ID NO: 1892807 - RNA, 23 nt, Human
uugauauccucuuugagugaagc

SEQ ID NO: 1892808 - RNA, 18 nt, Human
uugauauaaauaaaacau

SEQ ID NO: 1892809 - RNA, 20 nt, Human
uugaugaccaaaguccuuuu

SEQ ID NO: 1892810 - RNA, 11 nt, Human
uugagccuggg

SEQ ID NO: 1892811 - RNA, 13 nt, Human
uugaggguugggc

SEQ ID NO: 1892812 - RNA, 16 nt, Human
uugaggguugggcugg

SEQ ID NO: 1892813 - RNA, 16 nt, Human
uugaugaucuuugcag

SEQ ID NO: 1892814 - RNA, 12 nt, Human
uugauucugcag

SEQ ID NO: 1892815 - RNA, 20 nt, Human
uugauucugcaguaaaucuu

SEQ ID NO: 1892816 - RNA, 13 nt, Human
uugauugauuuga

SEQ ID NO: 1892817 - RNA, 14 nt, Human
uugauugauuugaa

SEQ ID NO: 1892818 - RNA, 13 nt, Human
uugauuugaagaa

SEQ ID NO: 1892819 - RNA, 14 nt, Human
uugauuugaagaac

SEQ ID NO: 1892820 - RNA, 21 nt, Human
uugcaaaguaucccuacugua

SEQ ID NO: 1892821 - RNA, 12 nt, Human
uugcaaaucuug

SEQ ID NO: 1892822 - RNA, 15 nt, Human
uugcaaaucuugaaa

SEQ ID NO: 1892823 - RNA, 16 nt, Human
uugcaaaucuugaaau

SEQ ID NO: 1892824 - RNA, 17 nt, Human
uugcaaaucuugaaauu

SEQ ID NO: 1892825 - RNA, 18 nt, Human
uugauuugaagaacaugu

SEQ ID NO: 1892826 - RNA, 13 nt, Human
uugauuugcauug

SEQ ID NO: 1892827 - RNA, 14 nt, Human
uugauuugcauuga

SEQ ID NO: 1892828 - RNA, 15 nt, Human
uugauuugcauugaa

SEQ ID NO: 1892829 - RNA, 17 nt, Human
uugauuugcauugaaca

SEQ ID NO: 1892830 - RNA, 19 nt, Human
uugauuugcauugaacaca

SEQ ID NO: 1892831 - RNA, 11 nt, Human
uucacaaauaa

SEQ ID NO: 1892832 - RNA, 22 nt, Human
uucacaaacuuuuauacucuuu

SEQ ID NO: 1892833 - RNA, 15 nt, Human
uucacaaagcccaag

SEQ ID NO: 1892834 - RNA, 16 nt, Human
uucacaaacuuuuaua

SEQ ID NO: 1892835 - RNA, 17 nt, Human
uucacaaacuuuuauac

SEQ ID NO: 1892836 - RNA, 15 nt, Human
uucaauauccuuugc

SEQ ID NO: 1892837 - RNA, 11 nt, Human
uucaauauuua

SEQ ID NO: 1892838 - RNA, 21 nt, Human
uucaauaggaaaaacugauuu

SEQ ID NO: 1892839 - RNA, 22 nt, Human
uucaauaggaaaaacugauuuu

SEQ ID NO: 1892840 - RNA, 14 nt, Human
uucaccuuuguccc

SEQ ID NO: 1892841 - RNA, 19 nt, Human
uucaccuuuguccccaccg

SEQ ID NO: 1892842 - RNA, 20 nt, Human
uucaccuuuguccccaccgc

SEQ ID NO: 1892843 - RNA, 13 nt, Human
uucacccuuuucu

SEQ ID NO: 1892844 - RNA, 22 nt, Human
uucaccccucccuuucuccccu

SEQ ID NO: 1892845 - RNA, 20 nt, Human
uucaccccucccuuucuccc

SEQ ID NO: 1892846 - RNA, 18 nt, Human
uucaccccucccuuucuc

SEQ ID NO: 1892847 - RNA, 17 nt, Human
uucaccccucccuuucu

SEQ ID NO: 1892848 - RNA, 16 nt, Human
uucaccccucccuuuc

SEQ ID NO: 1892849 - RNA, 15 nt, Human
uucaccccucccuuu

SEQ ID NO: 1892850 - RNA, 22 nt, Human
uucacaagacccaaaaggcaga

SEQ ID NO: 1892851 - RNA, 13 nt, Human
uucacggaagagc

SEQ ID NO: 1892852 - RNA, 22 nt, Human
uucaccuuuguccccaccgcag

SEQ ID NO: 1892853 - RNA, 17 nt, Human
uucacggaagagccuug

SEQ ID NO: 1892854 - RNA, 14 nt, Human
uucagacagcugcc

SEQ ID NO: 1892855 - RNA, 15 nt, Human
uucagacagcugccu

SEQ ID NO: 1892856 - RNA, 16 nt, Human
uucagacagcugccug

SEQ ID NO: 1892857 - RNA, 17 nt, Human
uucagacagcugccugg

SEQ ID NO: 1892858 - RNA, 15 nt, Human
uucagauauaaaaga

SEQ ID NO: 1892859 - RNA, 14 nt, Human
uucagauauaaaag

SEQ ID NO: 1892860 - RNA, 19 nt, Human
uucagauauaaaagacuga

SEQ ID NO: 1892861 - RNA, 12 nt, Human
uucagauauaaa

SEQ ID NO: 1892862 - RNA, 19 nt, Human
uucaauaaaugucuguuga

SEQ ID NO: 1892863 - RNA, 18 nt, Human
uucaauaaaugucuguug

SEQ ID NO: 1892864 - RNA, 18 nt, Human
uucaaccagggauuguuu

SEQ ID NO: 1892865 - RNA, 22 nt, Human
uucaaccagggauuguuucugu

SEQ ID NO: 1892866 - RNA, 16 nt, Human
uucaaccaugaagucu

SEQ ID NO: 1892867 - RNA, 18 nt, Human
uucaaauguauuacagug

SEQ ID NO: 1892868 - RNA, 22 nt, Human
uuauuuuggaaaauaaauuauu

SEQ ID NO: 1892869 - RNA, 14 nt, Human
uuauuuucaccugu

SEQ ID NO: 1892870 - RNA, 18 nt, Human
uucaaaugcuguaacuuu

SEQ ID NO: 1892871 - RNA, 18 nt, Human
uuauuuuauuaugcauga

SEQ ID NO: 1892872 - RNA, 17 nt, Human
uuauuuuaauucaguug

SEQ ID NO: 1892873 - RNA, 13 nt, Human
uuauuuuaaaaga

SEQ ID NO: 1892874 - RNA, 16 nt, Human
uuauuagggagaaaau

SEQ ID NO: 1892875 - RNA, 17 nt, Human
uuauuagggagaaaauu

SEQ ID NO: 1892876 - RNA, 18 nt, Human
uuauuagggagaaaauuc

SEQ ID NO: 1892877 - RNA, 19 nt, Human
uuauuagggagaaaauuca

SEQ ID NO: 1892878 - RNA, 20 nt, Human
uuauuagggagaaaauucaa

SEQ ID NO: 1892879 - RNA, 19 nt, Human
uuauuucuuaaacaaaugu

SEQ ID NO: 1892880 - RNA, 23 nt, Human
uuauuagggagaaaauucaauug

SEQ ID NO: 1892881 - RNA, 23 nt, Human
uucaguuauuauauuuacaaaug

SEQ ID NO: 1892882 - RNA, 20 nt, Human
uucauaaauaaaguuuguug

SEQ ID NO: 1892883 - RNA, 15 nt, Human
uucauaaccuagccu

SEQ ID NO: 1892884 - RNA, 15 nt, Human
uucauaaagaauugu

SEQ ID NO: 1892885 - RNA, 15 nt, Human
uucauccuccucaga

SEQ ID NO: 1892886 - RNA, 19 nt, Human
uucauccuccucagaucuu

SEQ ID NO: 1892887 - RNA, 19 nt, Human
uucaucugcucuccuuccu

SEQ ID NO: 1892888 - RNA, 16 nt, Human
uucaucugcucuccuu

SEQ ID NO: 1892889 - RNA, 15 nt, Human
uucaucugcucuccu

SEQ ID NO: 1892890 - RNA, 13 nt, Human
uucaucugcucuc

SEQ ID NO: 1892891 - RNA, 23 nt, Human
uucaucgaaucuacuaauuccac

SEQ ID NO: 1892892 - RNA, 20 nt, Human
uucaucgaaucuacuaauuc

SEQ ID NO: 1892893 - RNA, 18 nt, Human
uucaucgaaucuacuaau

SEQ ID NO: 1892894 - RNA, 16 nt, Human
uucaguggcagcugcu

SEQ ID NO: 1892895 - RNA, 15 nt, Human
uucaguggcagcugc

SEQ ID NO: 1892896 - RNA, 17 nt, Human
uucaguggcagcugcuu

SEQ ID NO: 1892897 - RNA, 12 nt, Human
uucaguguacau

SEQ ID NO: 1892898 - RNA, 13 nt, Human
uucaguguacaug

SEQ ID NO: 1892899 - RNA, 15 nt, Human
uucagcuccagcuca

SEQ ID NO: 1892900 - RNA, 12 nt, Human
uucagcuccagc

SEQ ID NO: 1892901 - RNA, 22 nt, Human
uucagcuccagcucaccagccc

SEQ ID NO: 1892902 - RNA, 14 nt, Human
uucaguggcagcug

SEQ ID NO: 1892903 - RNA, 13 nt, Human
uucagcuugggga

SEQ ID NO: 1892904 - RNA, 22 nt, Human
uucagcuuguaaauagcucagg

SEQ ID NO: 1892905 - RNA, 11 nt, Human
uuccagaaucc

SEQ ID NO: 1892906 - RNA, 14 nt, Human
uuccagaaugcugu

SEQ ID NO: 1892907 - RNA, 15 nt, Human
uuccagaaugcugua

SEQ ID NO: 1892908 - RNA, 19 nt, Human
uuccagaaugcuguacauc

SEQ ID NO: 1892909 - RNA, 16 nt, Human
uuccagaaugcuguac

SEQ ID NO: 1892910 - RNA, 18 nt, Human
uuccagaaugcuguacau

SEQ ID NO: 1892911 - RNA, 19 nt, Human
uuccaacccucaucaccaa

SEQ ID NO: 1892912 - RNA, 13 nt, Human
uuccagagccuca

SEQ ID NO: 1892913 - RNA, 20 nt, Human
uuccagacuuccuugagaca

SEQ ID NO: 1892914 - RNA, 14 nt, Human
uuccauggacuuug

SEQ ID NO: 1892915 - RNA, 15 nt, Human
uuccauggacuuugu

SEQ ID NO: 1892916 - RNA, 13 nt, Human
uuccaaaguacac

SEQ ID NO: 1892917 - RNA, 22 nt, Human
uuccaaagaguagaauugcauu

SEQ ID NO: 1892918 - RNA, 18 nt, Human
uucauuuuuuuccaggcu

SEQ ID NO: 1892919 - RNA, 16 nt, Human
uuccaaaguacacugu

SEQ ID NO: 1892920 - RNA, 16 nt, Human
uuccaacacugauuuc

SEQ ID NO: 1892921 - RNA, 22 nt, Human
uuccaacacugauuuccccuuu

SEQ ID NO: 1892922 - RNA, 21 nt, Human
uucauuuuuguuauccuuuuu

SEQ ID NO: 1892923 - RNA, 17 nt, Human
uucauuuuuuuccaggc

SEQ ID NO: 1892924 - RNA, 14 nt, Human
uucauuuuuuucca

SEQ ID NO: 1892925 - RNA, 21 nt, Human
uucaucugcucuccuuccugg

SEQ ID NO: 1892926 - RNA, 13 nt, Human
uuauaauauacua

SEQ ID NO: 1892927 - RNA, 18 nt, Human
uuauaauaauguuaacau

SEQ ID NO: 1892928 - RNA, 15 nt, Human
uuauaauaauguuaa

SEQ ID NO: 1892929 - RNA, 15 nt, Human
uuauaaugaaugaaa

SEQ ID NO: 1892930 - RNA, 12 nt, Human
uuauaauuuaaa

SEQ ID NO: 1892931 - RNA, 12 nt, Human
uuauaauuuuaa

SEQ ID NO: 1892932 - RNA, 17 nt, Human
uuauaauuuuaaauguu

SEQ ID NO: 1892933 - RNA, 21 nt, Human
uuauaauuuuaaauguuuuuu

SEQ ID NO: 1892934 - RNA, 21 nt, Human
ugugaaaagaaaaaugagccu

SEQ ID NO: 1892935 - RNA, 17 nt, Human
ugugaaaagaaaaauga

SEQ ID NO: 1892936 - RNA, 13 nt, Human
ugugaaaagaaaa

SEQ ID NO: 1892937 - RNA, 15 nt, Human
ugugaaaagaaaaau

SEQ ID NO: 1892938 - RNA, 16 nt, Human
uuauauuaugaagcuu

SEQ ID NO: 1892939 - RNA, 16 nt, Human
uuauauguacaugaga

SEQ ID NO: 1892940 - RNA, 19 nt, Human
uuauauguacaugagaagg

SEQ ID NO: 1892941 - RNA, 16 nt, Human
uuauaugaagauaagu

SEQ ID NO: 1892942 - RNA, 13 nt, Human
uuauacauaaaca

SEQ ID NO: 1892943 - RNA, 11 nt, Human
uuauacauaaa

SEQ ID NO: 1892944 - RNA, 23 nt, Human
uuauaucuauauuuuacauaaau

SEQ ID NO: 1892945 - RNA, 19 nt, Human
uuauaucuauauuuuacau

SEQ ID NO: 1892946 - RNA, 19 nt, Human
uuauacaaauuagaaaaug

SEQ ID NO: 1892947 - RNA, 16 nt, Human
uuauaauuuuuuucaa

SEQ ID NO: 1892948 - RNA, 16 nt, Human
uuauauuuacaaaugg

SEQ ID NO: 1892949 - RNA, 24 nt, Human
uuauccuuuuuuaaaaguaaaugu

SEQ ID NO: 1892950 - RNA, 19 nt, Human
uuaucuaauaccucugugu

SEQ ID NO: 1892951 - RNA, 21 nt, Human
uuaucuaaaagaaaugucuau

SEQ ID NO: 1892952 - RNA, 15 nt, Human
uuaucuaaaagaaau

SEQ ID NO: 1892953 - RNA, 20 nt, Human
uuaucuaauaccucugugug

SEQ ID NO: 1892954 - RNA, 11 nt, Human
uuaucuaauuu

SEQ ID NO: 1892955 - RNA, 17 nt, Human
uuaucuaauuuauaaaa

SEQ ID NO: 1892956 - RNA, 16 nt, Human
uuaucuaauuuauaaa

SEQ ID NO: 1892957 - RNA, 14 nt, Human
uuaucuagauacug

SEQ ID NO: 1892958 - RNA, 19 nt, Human
uuaucuauacauaucuuua

SEQ ID NO: 1892959 - RNA, 14 nt, Human
uuaucuugaauaau

SEQ ID NO: 1892960 - RNA, 16 nt, Human
uuaucuugaauaaugu

SEQ ID NO: 1892961 - RNA, 23 nt, Human
uuauuaaaaaucucaaauuucua

SEQ ID NO: 1892962 - RNA, 19 nt, Human
uuauuaaaugcccagcccc

SEQ ID NO: 1892963 - RNA, 21 nt, Human
uuauuaaaugcccagccccuu

SEQ ID NO: 1892964 - RNA, 22 nt, Human
uuauguuuuuuaaaauauuuau

SEQ ID NO: 1892965 - RNA, 20 nt, Human
uuauuaaauacaaaacuucc

SEQ ID NO: 1892966 - RNA, 16 nt, Human
uuauuaaauggaaacu

SEQ ID NO: 1892967 - RNA, 13 nt, Human
uuauuaaucacua

SEQ ID NO: 1892968 - RNA, 15 nt, Human
uuauuaccucugaua

SEQ ID NO: 1892969 - RNA, 12 nt, Human
uuauuaccucug

SEQ ID NO: 1892970 - RNA, 13 nt, Human
uuauuaccucuga

SEQ ID NO: 1892971 - RNA, 19 nt, Human
uuauuacccccuccuucag

SEQ ID NO: 1892972 - RNA, 20 nt, Human
uuauuacccccuccuucaga

SEQ ID NO: 1892973 - RNA, 22 nt, Human
uuauuacccccuccuucagaca

SEQ ID NO: 1892974 - RNA, 19 nt, Human
uuaugauuuuuaaagaaaa

SEQ ID NO: 1892975 - RNA, 16 nt, Human
uuaugauuuuuaaaga

SEQ ID NO: 1892976 - RNA, 17 nt, Human
uuauggaacacucugag

SEQ ID NO: 1892977 - RNA, 21 nt, Human
uuauggacaaugacccagugg

SEQ ID NO: 1892978 - RNA, 14 nt, Human
uuauggaauugauu

SEQ ID NO: 1892979 - RNA, 19 nt, Human
uuauggaauugauuugcau

SEQ ID NO: 1892980 - RNA, 18 nt, Human
uuauggaacacucugaga

SEQ ID NO: 1892981 - RNA, 20 nt, Human
uuauggaacacucugagacu

SEQ ID NO: 1892982 - RNA, 17 nt, Human
uuauggcuuuugugcau

SEQ ID NO: 1892983 - RNA, 18 nt, Human
uuauggcuuuugugcauu

SEQ ID NO: 1892984 - RNA, 17 nt, Human
uuauguugcauagaaua

SEQ ID NO: 1892985 - RNA, 14 nt, Human
uuauggcacaucag

SEQ ID NO: 1892986 - RNA, 20 nt, Human
uuauggaauugauuugcauu

SEQ ID NO: 1892987 - RNA, 21 nt, Human
uuauggaauugauuugcauug

SEQ ID NO: 1892988 - RNA, 23 nt, Human
uuauggaauugauuugcauugaa

SEQ ID NO: 1892989 - RNA, 16 nt, Human
uuauggcuuuugugca

SEQ ID NO: 1892990 - RNA, 15 nt, Human
aaaaaauauuuuccu

SEQ ID NO: 1892991 - RNA, 19 nt, Human
aaaaacccagcaacagaaa

SEQ ID NO: 1892992 - RNA, 21 nt, Human
acugugagcucccaggugcag

SEQ ID NO: 1892993 - RNA, 19 nt, Human
acugugacccccagcuccg

SEQ ID NO: 1892994 - RNA, 21 nt, Human
acugugacccccagcuccggc

SEQ ID NO: 1892995 - RNA, 16 nt, Human
acugugaaggacccuu

SEQ ID NO: 1892996 - RNA, 15 nt, Human
acugugaaggacccu

SEQ ID NO: 1892997 - RNA, 18 nt, Human
acugguuccauggccucu

SEQ ID NO: 1892998 - RNA, 17 nt, Human
acuggaagcacagcuuc

SEQ ID NO: 1892999 - RNA, 19 nt, Human
acuggaagcacagcuucau

SEQ ID NO: 1893000 - RNA, 16 nt, Human
acuggaagcuaauuug

SEQ ID NO: 1893001 - RNA, 21 nt, Human
acugcccauggacaggcuggc

SEQ ID NO: 1893002 - RNA, 19 nt, Human
acugcccauggacaggcug

SEQ ID NO: 1893003 - RNA, 18 nt, Human
acugguaggaaacuaggu

SEQ ID NO: 1893004 - RNA, 20 nt, Human
acugguaggaacuugagaac

SEQ ID NO: 1893005 - RNA, 14 nt, Human
acugguauuuuauc

SEQ ID NO: 1893006 - RNA, 15 nt, Human
acuggagaaaaugga

SEQ ID NO: 1893007 - RNA, 19 nt, Human
acuggaagcuaauuugcau

SEQ ID NO: 1893008 - RNA, 15 nt, Human
acuggagccaugggc

SEQ ID NO: 1893009 - RNA, 20 nt, Human
acucugucucaguccaugaa

SEQ ID NO: 1893010 - RNA, 18 nt, Human
acucugucucaguccaug

SEQ ID NO: 1893011 - RNA, 15 nt, Human
acucugucuaaaaaa

SEQ ID NO: 1893012 - RNA, 22 nt, Human
acuguuugccuucuacuuuuaa

SEQ ID NO: 1893013 - RNA, 21 nt, Human
acuguuugccuucuacuuuua

SEQ ID NO: 1893014 - RNA, 12 nt, Human
acuucagacaua

SEQ ID NO: 1893015 - RNA, 17 nt, Human
acuucuggguggggcag

SEQ ID NO: 1893016 - RNA, 16 nt, Human
acuucuggguggggca

SEQ ID NO: 1893017 - RNA, 19 nt, Human
acuucacgcuuucagcgaa

SEQ ID NO: 1893018 - RNA, 20 nt, Human
acuuggggagauggaguucu

SEQ ID NO: 1893019 - RNA, 21 nt, Human
acuuggggaguuaagaccugg

SEQ ID NO: 1893020 - RNA, 15 nt, Human
acuugggccacugug

SEQ ID NO: 1893021 - RNA, 14 nt, Human
acuugggccacugu

SEQ ID NO: 1893022 - RNA, 13 nt, Human
acuucuugaaggu

SEQ ID NO: 1893023 - RNA, 16 nt, Human
acuucuugaaggugcu

SEQ ID NO: 1893024 - RNA, 16 nt, Human
acuucuuauggaauug

SEQ ID NO: 1893025 - RNA, 17 nt, Human
acuucuuauggaauuga

SEQ ID NO: 1893026 - RNA, 20 nt, Human
acuucuuauggaauugauuu

SEQ ID NO: 1893027 - RNA, 21 nt, Human
acuucuuauggaauugauuug

SEQ ID NO: 1893028 - RNA, 23 nt, Human
acuucuuauggaauugauuugca

SEQ ID NO: 1893029 - RNA, 12 nt, Human
acuucuugaagg

SEQ ID NO: 1893030 - RNA, 16 nt, Human
acuugguuuuuaaaaa

SEQ ID NO: 1893031 - RNA, 23 nt, Human
acuuggggaguuaagaccuggca

SEQ ID NO: 1893032 - RNA, 22 nt, Human
acugugcugagucugaaggcug

SEQ ID NO: 1893033 - RNA, 20 nt, Human
acugugcugagucugaaggc

SEQ ID NO: 1893034 - RNA, 23 nt, Human
acuuuaucuaauaccucugugug

SEQ ID NO: 1893035 - RNA, 22 nt, Human
acuuuaucuugaauaauguaag

SEQ ID NO: 1893036 - RNA, 12 nt, Human
acuuuauuucca

SEQ ID NO: 1893037 - RNA, 21 nt, Human
acuuuauuuccaaguuguuca

SEQ ID NO: 1893038 - RNA, 22 nt, Human
acuuuauuuucuauaauuuaaa

SEQ ID NO: 1893039 - RNA, 16 nt, Human
acuuuguucuggcucu

SEQ ID NO: 1893040 - RNA, 17 nt, Human
acuuuguucuggcucuu

SEQ ID NO: 1893041 - RNA, 20 nt, Human
acuuuguucuggcucuucca

SEQ ID NO: 1893042 - RNA, 19 nt, Human
acuuuguucuggcucuucc

SEQ ID NO: 1893043 - RNA, 12 nt, Human
acuuuuaugaua

SEQ ID NO: 1893044 - RNA, 16 nt, Human
acuuuuaugauacuug

SEQ ID NO: 1893045 - RNA, 13 nt, Human
acuuuuauaaacu

SEQ ID NO: 1893046 - RNA, 16 nt, Human
agaaaaucaggcuggc

SEQ ID NO: 1893047 - RNA, 19 nt, Human
agaaaauaguggugugauu

SEQ ID NO: 1893048 - RNA, 15 nt, Human
agaaaauaccaagga

SEQ ID NO: 1893049 - RNA, 14 nt, Human
acuuuucuuugugg

SEQ ID NO: 1893050 - RNA, 14 nt, Human
agaaaauaacaaua

SEQ ID NO: 1893051 - RNA, 20 nt, Human
acuuuucauaaccuagccuu

SEQ ID NO: 1893052 - RNA, 23 nt, Human
acuuuuaugauacuugaaaauua

SEQ ID NO: 1893053 - RNA, 16 nt, Human
acuuuucuuucagcca

SEQ ID NO: 1893054 - RNA, 19 nt, Human
acuuuucauauuugcacua

SEQ ID NO: 1893055 - RNA, 19 nt, Human
agaaaauggaaccaggcuu

SEQ ID NO: 1893056 - RNA, 22 nt, Human
agaaaauggaaccaggcuugga

SEQ ID NO: 1893057 - RNA, 20 nt, Human
agaaaauggaaccaggcuug

SEQ ID NO: 1893058 - RNA, 16 nt, Human
agaaaggauaaaguug

SEQ ID NO: 1893059 - RNA, 14 nt, Human
agaaaggggagccc

SEQ ID NO: 1893060 - RNA, 15 nt, Human
agaaaggggagccca

SEQ ID NO: 1893061 - RNA, 16 nt, Human
agaaaggggagcccac

SEQ ID NO: 1893062 - RNA, 17 nt, Human
agaaaggggagcccacu

SEQ ID NO: 1893063 - RNA, 22 nt, Human
agaaaguacuucuccacccugc

SEQ ID NO: 1893064 - RNA, 20 nt, Human
agaaaggggcaguuuaaagc

SEQ ID NO: 1893065 - RNA, 23 nt, Human
agaaaguacuucuccacccugcu

SEQ ID NO: 1893066 - RNA, 21 nt, Human
agaaagguuuugagcaugggu

SEQ ID NO: 1893067 - RNA, 19 nt, Human
agaaagguuuugagcaugg

SEQ ID NO: 1893068 - RNA, 12 nt, Human
agaaaguuuccc

SEQ ID NO: 1893069 - RNA, 20 nt, Human
agaaaguuuccccaccagug

SEQ ID NO: 1893070 - RNA, 17 nt, Human
agaaauaaaaggaagcc

SEQ ID NO: 1893071 - RNA, 18 nt, Human
agaaauaaaaggaagcca

SEQ ID NO: 1893072 - RNA, 21 nt, Human
agaaauaaaguuugcuuagaa

SEQ ID NO: 1893073 - RNA, 14 nt, Human
agaaaguucaugcu

SEQ ID NO: 1893074 - RNA, 23 nt, Human
agaaagugugcuuuaugcugaaa

SEQ ID NO: 1893075 - RNA, 15 nt, Human
agaaagugugcuuua

SEQ ID NO: 1893076 - RNA, 16 nt, Human
agaaagugugcuuuau

SEQ ID NO: 1893077 - RNA, 22 nt, Human
agaaagugugcuuuaugcugaa

SEQ ID NO: 1893078 - RNA, 14 nt, Human
acgccacagcccag

SEQ ID NO: 1893079 - RNA, 15 nt, Human
acgccacagcccagc

SEQ ID NO: 1893080 - RNA, 20 nt, Human
acgccacagcccagccacgg

SEQ ID NO: 1893081 - RNA, 11 nt, Human
acgcugugcug

SEQ ID NO: 1893082 - RNA, 12 nt, Human
acgcugugcugc

SEQ ID NO: 1893083 - RNA, 14 nt, Human
acgcugugcugccc

SEQ ID NO: 1893084 - RNA, 14 nt, Human
acgucugacaggca

SEQ ID NO: 1893085 - RNA, 13 nt, Human
acgucugacaggc

SEQ ID NO: 1893086 - RNA, 14 nt, Human
acggaacucaaaua

SEQ ID NO: 1893087 - RNA, 17 nt, Human
acgcuuugggagaaugu

SEQ ID NO: 1893088 - RNA, 12 nt, Human
acgcuuugauuc

SEQ ID NO: 1893089 - RNA, 13 nt, Human
acgcuuugauuca

SEQ ID NO: 1893090 - RNA, 14 nt, Human
acgcuuugauucau

SEQ ID NO: 1893091 - RNA, 16 nt, Human
acgcuuugauucauag

SEQ ID NO: 1893092 - RNA, 19 nt, Human
acgcuuucagcgaaugaca

SEQ ID NO: 1893093 - RNA, 11 nt, Human
acgcuuugauu

SEQ ID NO: 1893094 - RNA, 17 nt, Human
acgcuuucuagcuguug

SEQ ID NO: 1893095 - RNA, 11 nt, Human
acgugaguccu

SEQ ID NO: 1893096 - RNA, 16 nt, Human
acuaagaauucaaacu

SEQ ID NO: 1893097 - RNA, 18 nt, Human
acuaagaauucaaacugg

SEQ ID NO: 1893098 - RNA, 22 nt, Human
acuaagcagaggaggggccgcu

SEQ ID NO: 1893099 - RNA, 21 nt, Human
acuaaggggcccggccagcca

SEQ ID NO: 1893100 - RNA, 22 nt, Human
acuaaggggcccggccagccau

SEQ ID NO: 1893101 - RNA, 15 nt, Human
acuaauuccacaccu

SEQ ID NO: 1893102 - RNA, 19 nt, Human
acuaagcagaggaggggcc

SEQ ID NO: 1893103 - RNA, 12 nt, Human
acuaaggggccc

SEQ ID NO: 1893104 - RNA, 20 nt, Human
acuaauuucaaaaugcuuuu

SEQ ID NO: 1893105 - RNA, 16 nt, Human
acuaauuucaaaaugc

SEQ ID NO: 1893106 - RNA, 19 nt, Human
acuaauuucaaaaugcuuu

SEQ ID NO: 1893107 - RNA, 23 nt, Human
acuaauuccacaccuuuuauuga

SEQ ID NO: 1893108 - RNA, 14 nt, Human
acuaauucuugcau

SEQ ID NO: 1893109 - RNA, 22 nt, Human
acuaauucuugcauauuuugua

SEQ ID NO: 1893110 - RNA, 14 nt, Human
acuaauuucaaaau

SEQ ID NO: 1893111 - RNA, 18 nt, Human
accuuggcugcagggagu

SEQ ID NO: 1893112 - RNA, 17 nt, Human
accuuggcugcagggag

SEQ ID NO: 1893113 - RNA, 17 nt, Human
accuguuagcagacagg

SEQ ID NO: 1893114 - RNA, 13 nt, Human
accuuucccaucu

SEQ ID NO: 1893115 - RNA, 18 nt, Human
accuuucccaucuuccaa

SEQ ID NO: 1893116 - RNA, 15 nt, Human
accuuuaagagaaau

SEQ ID NO: 1893117 - RNA, 19 nt, Human
accuuucauaaucuuugcu

SEQ ID NO: 1893118 - RNA, 20 nt, Human
accuuucauaaucuuugcuu

SEQ ID NO: 1893119 - RNA, 21 nt, Human
accuuucauaaucuuugcuuu

SEQ ID NO: 1893120 - RNA, 16 nt, Human
accugucccccugaca

SEQ ID NO: 1893121 - RNA, 12 nt, Human
accugucccccu

SEQ ID NO: 1893122 - RNA, 15 nt, Human
accugucccccugac

SEQ ID NO: 1893123 - RNA, 17 nt, Human
accugucuccuggcggu

SEQ ID NO: 1893124 - RNA, 13 nt, Human
accugccucagga

SEQ ID NO: 1893125 - RNA, 15 nt, Human
accucugcagcaaua

SEQ ID NO: 1893126 - RNA, 20 nt, Human
accucugcagcaauaaagca

SEQ ID NO: 1893127 - RNA, 18 nt, Human
accucugcagcaauaaag

SEQ ID NO: 1893128 - RNA, 21 nt, Human
accucugcagcaauaaagcag

SEQ ID NO: 1893129 - RNA, 16 nt, Human
acuagugcugaagcuu

SEQ ID NO: 1893130 - RNA, 15 nt, Human
acuagugcugaagcu

SEQ ID NO: 1893131 - RNA, 14 nt, Human
acuagugcugaagc

SEQ ID NO: 1893132 - RNA, 19 nt, Human
acuagugcugaagcuuauu

SEQ ID NO: 1893133 - RNA, 18 nt, Human
acuagugcugaagcuuau

SEQ ID NO: 1893134 - RNA, 17 nt, Human
acuagugcugaagcuua

SEQ ID NO: 1893135 - RNA, 18 nt, Human
acuauuuuucagaaucuc

SEQ ID NO: 1893136 - RNA, 14 nt, Human
acuauuuuucagaa

SEQ ID NO: 1893137 - RNA, 13 nt, Human
acucaaaagcugg

SEQ ID NO: 1893138 - RNA, 18 nt, Human
acucaaaagcugggcagg

SEQ ID NO: 1893139 - RNA, 19 nt, Human
acucaguccauagcagaga

SEQ ID NO: 1893140 - RNA, 13 nt, Human
acucaggaagaac

SEQ ID NO: 1893141 - RNA, 16 nt, Human
acucaggcccaaagcc

SEQ ID NO: 1893142 - RNA, 21 nt, Human
acucagcccucauuggcucuu

SEQ ID NO: 1893143 - RNA, 17 nt, Human
acucagcccucauuggc

SEQ ID NO: 1893144 - RNA, 18 nt, Human
acucaaaugcucagacca

SEQ ID NO: 1893145 - RNA, 21 nt, Human
acucaaaugcucagaccagcu

SEQ ID NO: 1893146 - RNA, 23 nt, Human
acucaaaugcucagaccagcucu

SEQ ID NO: 1893147 - RNA, 17 nt, Human
acucaaauggggccaga

SEQ ID NO: 1893148 - RNA, 20 nt, Human
acucaaauggggccagaucc

SEQ ID NO: 1893149 - RNA, 21 nt, Human
acucaaauggggccagaucca

SEQ ID NO: 1893150 - RNA, 22 nt, Human
acucaaauggggccagauccag

SEQ ID NO: 1893151 - RNA, 23 nt, Human
acucaaauggggccagauccagc

SEQ ID NO: 1893152 - RNA, 15 nt, Human
acuagauggugcuga

SEQ ID NO: 1893153 - RNA, 16 nt, Human
acuagauggugcugag

SEQ ID NO: 1893154 - RNA, 18 nt, Human
acuagauggugcugagaa

SEQ ID NO: 1893155 - RNA, 19 nt, Human
acucugucgcccagucugg

SEQ ID NO: 1893156 - RNA, 23 nt, Human
acucuaucaaguauuauaccuuu

SEQ ID NO: 1893157 - RNA, 20 nt, Human
acucuagcugggggugggcc

SEQ ID NO: 1893158 - RNA, 17 nt, Human
acucuauguucuaagaa

SEQ ID NO: 1893159 - RNA, 21 nt, Human
acucuaucaaguauuauaccu

SEQ ID NO: 1893160 - RNA, 15 nt, Human
acucuagggaaaaac

SEQ ID NO: 1893161 - RNA, 17 nt, Human
acucuagggaaaaacca

SEQ ID NO: 1893162 - RNA, 15 nt, Human
acucauauuuucaug

SEQ ID NO: 1893163 - RNA, 13 nt, Human
acucauauuacug

SEQ ID NO: 1893164 - RNA, 15 nt, Human
acucauauuacuggu

SEQ ID NO: 1893165 - RNA, 22 nt, Human
acucauauuacugguaggaacu

SEQ ID NO: 1893166 - RNA, 17 nt, Human
acaagaaaguuucccca

SEQ ID NO: 1893167 - RNA, 15 nt, Human
acaagaaaguuuccc

SEQ ID NO: 1893168 - RNA, 15 nt, Human
acaacuacagaaaaa

SEQ ID NO: 1893169 - RNA, 19 nt, Human
acaacuacagaaaaaccag

SEQ ID NO: 1893170 - RNA, 20 nt, Human
acaacuacagaaaaaccaga

SEQ ID NO: 1893171 - RNA, 21 nt, Human
acaagaaaguuuccccaccag

SEQ ID NO: 1893172 - RNA, 13 nt, Human
acaagaaaugaaa

SEQ ID NO: 1893173 - RNA, 17 nt, Human
acaaggauugcuacugu

SEQ ID NO: 1893174 - RNA, 12 nt, Human
acaaggcaaggc

SEQ ID NO: 1893175 - RNA, 14 nt, Human
acaaggcaaggcug

SEQ ID NO: 1893176 - RNA, 22 nt, Human
acaaaauguaggguuauaauaa

SEQ ID NO: 1893177 - RNA, 14 nt, Human
acaaaauuucuauu

SEQ ID NO: 1893178 - RNA, 19 nt, Human
acaaacaaaauuucuauua

SEQ ID NO: 1893179 - RNA, 18 nt, Human
acaaacaaaauuucuauu

SEQ ID NO: 1893180 - RNA, 16 nt, Human
acaaacaaaauuucua

SEQ ID NO: 1893181 - RNA, 16 nt, Human
acaaacaaacaaacaa

SEQ ID NO: 1893182 - RNA, 15 nt, Human
acaaggcaaggcugu

SEQ ID NO: 1893183 - RNA, 18 nt, Human
acaaggccaucugggcuc

SEQ ID NO: 1893184 - RNA, 17 nt, Human
acacgcgugcacacacc

SEQ ID NO: 1893185 - RNA, 15 nt, Human
acacgcgugcacaca

SEQ ID NO: 1893186 - RNA, 14 nt, Human
acaccaagcacagc

SEQ ID NO: 1893187 - RNA, 13 nt, Human
acacagcucuucu

SEQ ID NO: 1893188 - RNA, 11 nt, Human
acacagcucuu

SEQ ID NO: 1893189 - RNA, 22 nt, Human
acacauuuuauuuuauuaugca

SEQ ID NO: 1893190 - RNA, 21 nt, Human
acacauuuuauuuuauuaugc

SEQ ID NO: 1893191 - RNA, 22 nt, Human
acacauuuuuuaaaugcaccug

SEQ ID NO: 1893192 - RNA, 20 nt, Human
acacauuuuuuaaaugcacc

SEQ ID NO: 1893193 - RNA, 14 nt, Human
acacauuuuucaga

SEQ ID NO: 1893194 - RNA, 12 nt, Human
acacauuuuucu

SEQ ID NO: 1893195 - RNA, 19 nt, Human
acacagaggcugccucucc

SEQ ID NO: 1893196 - RNA, 20 nt, Human
acacagcucuguccugggag

SEQ ID NO: 1893197 - RNA, 21 nt, Human
acacagacuguugucccugca

SEQ ID NO: 1893198 - RNA, 19 nt, Human
acagagugagacucugucu

SEQ ID NO: 1893199 - RNA, 23 nt, Human
acagagucucacuguugcccagg

SEQ ID NO: 1893200 - RNA, 17 nt, Human
acagaggcuauuguccc

SEQ ID NO: 1893201 - RNA, 15 nt, Human
acagagugagacucu

SEQ ID NO: 1893202 - RNA, 14 nt, Human
acagaggggguggc

SEQ ID NO: 1893203 - RNA, 19 nt, Human
acagccaacuauggccugu

SEQ ID NO: 1893204 - RNA, 17 nt, Human
acagccaacuauggccu

SEQ ID NO: 1893205 - RNA, 24 nt, Human
acagccaacacgcaccugccucag

SEQ ID NO: 1893206 - RNA, 20 nt, Human
acagccaacacgcaccugcc

SEQ ID NO: 1893207 - RNA, 21 nt, Human
acagccaacacgcaccugccu

SEQ ID NO: 1893208 - RNA, 22 nt, Human
acagccaacacgcaccugccuc

SEQ ID NO: 1893209 - RNA, 15 nt, Human
acagaggcagcccca

SEQ ID NO: 1893210 - RNA, 14 nt, Human
acagaggcagcccc

SEQ ID NO: 1893211 - RNA, 14 nt, Human
acagacacaggccc

SEQ ID NO: 1893212 - RNA, 13 nt, Human
acagacacaggcc

SEQ ID NO: 1893213 - RNA, 23 nt, Human
acagaggcagccccauucugccu

SEQ ID NO: 1893214 - RNA, 19 nt, Human
acagaggcagccccauucu

SEQ ID NO: 1893215 - RNA, 15 nt, Human
acagacacaggcccg

SEQ ID NO: 1893216 - RNA, 15 nt, Human
acagaggccccagcc

SEQ ID NO: 1893217 - RNA, 16 nt, Human
acagaggccccagccu

SEQ ID NO: 1893218 - RNA, 17 nt, Human
acagaggccccagccuc

SEQ ID NO: 1893219 - RNA, 18 nt, Human
acagaggccccagccucc

SEQ ID NO: 1893220 - RNA, 22 nt, Human
acagaggccccagccucccuga

SEQ ID NO: 1893221 - RNA, 11 nt, Human
acagacacagg

SEQ ID NO: 1893222 - RNA, 13 nt, Human
acagacaaagcgu

SEQ ID NO: 1893223 - RNA, 15 nt, Human
acacuguacugcaau

SEQ ID NO: 1893224 - RNA, 15 nt, Human
acacugcauguuugu

SEQ ID NO: 1893225 - RNA, 14 nt, Human
acacugcauguuug

SEQ ID NO: 1893226 - RNA, 23 nt, Human
acacugcuuguguuuuuaacuca

SEQ ID NO: 1893227 - RNA, 16 nt, Human
acacuggacuccggcc

SEQ ID NO: 1893228 - RNA, 19 nt, Human
acacugcuuguguuuuuaa

SEQ ID NO: 1893229 - RNA, 14 nt, Human
acacugggaaacag

SEQ ID NO: 1893230 - RNA, 17 nt, Human
acagccacggccaggcc

SEQ ID NO: 1893231 - RNA, 16 nt, Human
acagccacggccaggc

SEQ ID NO: 1893232 - RNA, 15 nt, Human
acagccacggccagg

SEQ ID NO: 1893233 - RNA, 18 nt, Human
acagccacggccaggcca

SEQ ID NO: 1893234 - RNA, 18 nt, Human
acagcucuucuccaggcu

SEQ ID NO: 1893235 - RNA, 15 nt, Human
acaggaucagucuga

SEQ ID NO: 1893236 - RNA, 17 nt, Human
acagcucuucuccaggc

SEQ ID NO: 1893237 - RNA, 16 nt, Human
acagcucuucuccagg

SEQ ID NO: 1893238 - RNA, 12 nt, Human
acaggcaagcac

SEQ ID NO: 1893239 - RNA, 18 nt, Human
acaggcaaugcuggcugu

SEQ ID NO: 1893240 - RNA, 21 nt, Human
acaggaugaugacuauggaaa

SEQ ID NO: 1893241 - RNA, 15 nt, Human
acaggaugcuuuggu

SEQ ID NO: 1893242 - RNA, 14 nt, Human
acaggauuauugga

SEQ ID NO: 1893243 - RNA, 21 nt, Human
acaugugacacauaugcaccu

SEQ ID NO: 1893244 - RNA, 18 nt, Human
acaugugcacaugcacgu

SEQ ID NO: 1893245 - RNA, 16 nt, Human
acaugugcacaugcac

SEQ ID NO: 1893246 - RNA, 16 nt, Human
acaugauuuccuugaa

SEQ ID NO: 1893247 - RNA, 17 nt, Human
acaugauuuccuugaau

SEQ ID NO: 1893248 - RNA, 19 nt, Human
acaugaucuucuuuauaau

SEQ ID NO: 1893249 - RNA, 13 nt, Human
acaugauuccuuc

SEQ ID NO: 1893250 - RNA, 13 nt, Human
acaugauuuccuu

SEQ ID NO: 1893251 - RNA, 14 nt, Human
acaugauuccuucc

SEQ ID NO: 1893252 - RNA, 15 nt, Human
acaugauuccuuccu

SEQ ID NO: 1893253 - RNA, 22 nt, Human
acaugauuccuuccuguucuga

SEQ ID NO: 1893254 - RNA, 19 nt, Human
acaucagcacgauuucugu

SEQ ID NO: 1893255 - RNA, 18 nt, Human
acaucagcacgauuucug

SEQ ID NO: 1893256 - RNA, 17 nt, Human
acaucagcacgauuucu

SEQ ID NO: 1893257 - RNA, 15 nt, Human
acaucagcacgauuu

SEQ ID NO: 1893258 - RNA, 23 nt, Human
acauguuucuuuguaaugaaaac

SEQ ID NO: 1893259 - RNA, 19 nt, Human
acauguuucuuuguaauga

SEQ ID NO: 1893260 - RNA, 22 nt, Human
acauguuucuuuguaaugaaaa

SEQ ID NO: 1893261 - RNA, 19 nt, Human
acaggguuuugccauguug

SEQ ID NO: 1893262 - RNA, 15 nt, Human
acaggguuucaccau

SEQ ID NO: 1893263 - RNA, 23 nt, Human
acaggcaaugcuggcuguuggcu

SEQ ID NO: 1893264 - RNA, 19 nt, Human
acaggcaaugcuggcuguu

SEQ ID NO: 1893265 - RNA, 21 nt, Human
acauaaugcgugcauaccacu

SEQ ID NO: 1893266 - RNA, 22 nt, Human
acauaaugcgugcauaccacuu

SEQ ID NO: 1893267 - RNA, 23 nt, Human
acauaaugcgugcauaccacuuu

SEQ ID NO: 1893268 - RNA, 17 nt, Human
acauaaugggguccugg

SEQ ID NO: 1893269 - RNA, 14 nt, Human
acauuuauucugcu

SEQ ID NO: 1893270 - RNA, 15 nt, Human
acauuuauucugcuc

SEQ ID NO: 1893271 - RNA, 19 nt, Human
acauuuguucuauagcuuu

SEQ ID NO: 1893272 - RNA, 12 nt, Human
accaagcccagu

SEQ ID NO: 1893273 - RNA, 17 nt, Human
accaagcacagcagccu

SEQ ID NO: 1893274 - RNA, 14 nt, Human
accaagcacagcag

SEQ ID NO: 1893275 - RNA, 16 nt, Human
accaagcacagcagcc

SEQ ID NO: 1893276 - RNA, 13 nt, Human
accagaucauugu

SEQ ID NO: 1893277 - RNA, 13 nt, Human
accagaggcagcu

SEQ ID NO: 1893278 - RNA, 19 nt, Human
accagagcugccaccugcc

SEQ ID NO: 1893279 - RNA, 13 nt, Human
accagcagaaaug

SEQ ID NO: 1893280 - RNA, 15 nt, Human
accagcauuccuuuu

SEQ ID NO: 1893281 - RNA, 15 nt, Human
accagcccagacccu

SEQ ID NO: 1893282 - RNA, 17 nt, Human
accagccaguaaauggg

SEQ ID NO: 1893283 - RNA, 17 nt, Human
accagcauuccuuuuga

SEQ ID NO: 1893284 - RNA, 11 nt, Human
acccccugaau

SEQ ID NO: 1893285 - RNA, 16 nt, Human
acccaccucagccucc

SEQ ID NO: 1893286 - RNA, 13 nt, Human
acccaccucccug

SEQ ID NO: 1893287 - RNA, 14 nt, Human
acccaccucccugc

SEQ ID NO: 1893288 - RNA, 15 nt, Human
acccaccucccugcc

SEQ ID NO: 1893289 - RNA, 22 nt, Human
acccagugcccccacugaccag

SEQ ID NO: 1893290 - RNA, 16 nt, Human
acccaccucccugccu

SEQ ID NO: 1893291 - RNA, 18 nt, Human
acccaccucccugccucc

SEQ ID NO: 1893292 - RNA, 15 nt, Human
acccaccucagccuc

SEQ ID NO: 1893293 - RNA, 14 nt, Human
acccaccucagccu

SEQ ID NO: 1893294 - RNA, 13 nt, Human
acccaccucagcc

SEQ ID NO: 1893295 - RNA, 23 nt, Human
acccaagggccuggccugagcug

SEQ ID NO: 1893296 - RNA, 17 nt, Human
acccacaagaaaugaaa

SEQ ID NO: 1893297 - RNA, 21 nt, Human
acccacaagaaaugaaagcag

SEQ ID NO: 1893298 - RNA, 20 nt, Human
accauauuaccacagacaua

SEQ ID NO: 1893299 - RNA, 18 nt, Human
acccaagggccuggccug

SEQ ID NO: 1893300 - RNA, 19 nt, Human
acccaagggccuggccuga

SEQ ID NO: 1893301 - RNA, 22 nt, Human
acccaagggccuggccugagcu

SEQ ID NO: 1893302 - RNA, 16 nt, Human
accauauuaccacaga

SEQ ID NO: 1893303 - RNA, 14 nt, Human
accauauuaccaca

SEQ ID NO: 1893304 - RNA, 19 nt, Human
accccuccaugugggcuag

SEQ ID NO: 1893305 - RNA, 16 nt, Human
accccuccaugugggc

SEQ ID NO: 1893306 - RNA, 22 nt, Human
accccucccucacucccaccug

SEQ ID NO: 1893307 - RNA, 12 nt, Human
aacucagaaggg

SEQ ID NO: 1893308 - RNA, 14 nt, Human
aacucacuuuccuc

SEQ ID NO: 1893309 - RNA, 15 nt, Human
aacggauuccaaaga

SEQ ID NO: 1893310 - RNA, 15 nt, Human
aacgcagacacugag

SEQ ID NO: 1893311 - RNA, 19 nt, Human
aacgcucucuacucugcuu

SEQ ID NO: 1893312 - RNA, 13 nt, Human
aacgauuuagaaa

SEQ ID NO: 1893313 - RNA, 12 nt, Human
aacgauuuagaa

SEQ ID NO: 1893314 - RNA, 14 nt, Human
aacugauaaagaug

SEQ ID NO: 1893315 - RNA, 18 nt, Human
aacugagauccuuccuuu

SEQ ID NO: 1893316 - RNA, 13 nt, Human
aacuuaacaugaa

SEQ ID NO: 1893317 - RNA, 12 nt, Human
aacucagaucca

SEQ ID NO: 1893318 - RNA, 13 nt, Human
aacucagauccag

SEQ ID NO: 1893319 - RNA, 14 nt, Human
aacucagauccagg

SEQ ID NO: 1893320 - RNA, 15 nt, Human
aacucagauccaggg

SEQ ID NO: 1893321 - RNA, 22 nt, Human
aacucagauccagggacagagg

SEQ ID NO: 1893322 - RNA, 18 nt, Human
aacuuaaucuaaauggaa

SEQ ID NO: 1893323 - RNA, 16 nt, Human
aacuuaaucuaaaugg

SEQ ID NO: 1893324 - RNA, 15 nt, Human
aacuuaaucuaaaug

SEQ ID NO: 1893325 - RNA, 20 nt, Human
aacuuuaugcuaagugaaau

SEQ ID NO: 1893326 - RNA, 21 nt, Human
aacuuuaugcuaagugaaaua

SEQ ID NO: 1893327 - RNA, 14 nt, Human
aacuuuauuaaaua

SEQ ID NO: 1893328 - RNA, 22 nt, Human
aaccacuggaaaguuuaugguu

SEQ ID NO: 1893329 - RNA, 15 nt, Human
aaccacuucagcuga

SEQ ID NO: 1893330 - RNA, 13 nt, Human
aaccacgcuggac

SEQ ID NO: 1893331 - RNA, 19 nt, Human
aaccaccagaagcccagaa

SEQ ID NO: 1893332 - RNA, 18 nt, Human
aaccaccagaagcccaga

SEQ ID NO: 1893333 - RNA, 11 nt, Human
aacauccaaaa

SEQ ID NO: 1893334 - RNA, 16 nt, Human
aacauccaaccuuccc

SEQ ID NO: 1893335 - RNA, 17 nt, Human
aacauccaaccuuccca

SEQ ID NO: 1893336 - RNA, 15 nt, Human
aacauccaauauuuu

SEQ ID NO: 1893337 - RNA, 23 nt, Human
aacccuucuccucuuguaaauaa

SEQ ID NO: 1893338 - RNA, 21 nt, Human
aaccgaacugauguaaguaaa

SEQ ID NO: 1893339 - RNA, 14 nt, Human
aaccagaggcagcu

SEQ ID NO: 1893340 - RNA, 21 nt, Human
aacccuaaaaagcagagcuuu

SEQ ID NO: 1893341 - RNA, 19 nt, Human
aaccuaggagugccccauu

SEQ ID NO: 1893342 - RNA, 18 nt, Human
aacacuaacauauaaugu

SEQ ID NO: 1893343 - RNA, 13 nt, Human
aacacggccacau

SEQ ID NO: 1893344 - RNA, 21 nt, Human
aacacggccacaucaaagagg

SEQ ID NO: 1893345 - RNA, 13 nt, Human
aacacgcaggagc

SEQ ID NO: 1893346 - RNA, 14 nt, Human
aacacgcaggagca

SEQ ID NO: 1893347 - RNA, 19 nt, Human
aacaccauugaaggcuuaa

SEQ ID NO: 1893348 - RNA, 17 nt, Human
aacaccauugaaggcuu

SEQ ID NO: 1893349 - RNA, 15 nt, Human
aacaccauugaaggc

SEQ ID NO: 1893350 - RNA, 21 nt, Human
aacacauuaagccuuccacac

SEQ ID NO: 1893351 - RNA, 18 nt, Human
aaauuuuuuuuguuucau

SEQ ID NO: 1893352 - RNA, 17 nt, Human
aaauuuuuuuuguuuca

SEQ ID NO: 1893353 - RNA, 18 nt, Human
aacaaauuuacagagaca

SEQ ID NO: 1893354 - RNA, 13 nt, Human
aacaacauguaua

SEQ ID NO: 1893355 - RNA, 17 nt, Human
aaaucuuauaauuuaaa

SEQ ID NO: 1893356 - RNA, 23 nt, Human
aaaugccuuacccucauguucuu

SEQ ID NO: 1893357 - RNA, 15 nt, Human
aaaugccuuuguacu

SEQ ID NO: 1893358 - RNA, 19 nt, Human
aaauugacacuuaaaaaug

SEQ ID NO: 1893359 - RNA, 20 nt, Human
aaauugacacaaguggaccu

SEQ ID NO: 1893360 - RNA, 23 nt, Human
aaauugaaucaguauaaacaaag

SEQ ID NO: 1893361 - RNA, 21 nt, Human
aaauuaacacugcuuguguuu

SEQ ID NO: 1893362 - RNA, 18 nt, Human
aaauuaacagaaaaacag

SEQ ID NO: 1893363 - RNA, 13 nt, Human
aaauuaacacugc

SEQ ID NO: 1893364 - RNA, 12 nt, Human
aaauuaacacug

SEQ ID NO: 1893365 - RNA, 21 nt, Human
aaauucuugcaaaguaucccu

SEQ ID NO: 1893366 - RNA, 13 nt, Human
aaauucuuucauu

SEQ ID NO: 1893367 - RNA, 19 nt, Human
aaauaguggugugauuugg

SEQ ID NO: 1893368 - RNA, 17 nt, Human
aaauaguuaagacauga

SEQ ID NO: 1893369 - RNA, 22 nt, Human
aaauaguuaagacaugauuucc

SEQ ID NO: 1893370 - RNA, 15 nt, Human
aaauagcuucuguuu

SEQ ID NO: 1893371 - RNA, 17 nt, Human
aaauagcuuuuuucucu

SEQ ID NO: 1893372 - RNA, 20 nt, Human
aaauagcuuuuuucucugau

SEQ ID NO: 1893373 - RNA, 24 nt, Human
aaauagcucaggugucccugcacu

SEQ ID NO: 1893374 - RNA, 23 nt, Human
aaaucaaguauuugggaagugaa

SEQ ID NO: 1893375 - RNA, 18 nt, Human
aaaucaaguauuugggaa

SEQ ID NO: 1893376 - RNA, 16 nt, Human
aaauaaaacuuuuuaa

SEQ ID NO: 1893377 - RNA, 13 nt, Human
aaauaaaacuuuu

SEQ ID NO: 1893378 - RNA, 19 nt, Human
aaauaaaacuuuuuaaaau

SEQ ID NO: 1893379 - RNA, 17 nt, Human
aaauaaaaggaagccaa

SEQ ID NO: 1893380 - RNA, 20 nt, Human
aaauaaaguuugcuuagaaa

SEQ ID NO: 1893381 - RNA, 19 nt, Human
aaauaaaguuggucuuuug

SEQ ID NO: 1893382 - RNA, 13 nt, Human
aaaguggaaaaau

SEQ ID NO: 1893383 - RNA, 12 nt, Human
aaaguccccaga

SEQ ID NO: 1893384 - RNA, 16 nt, Human
aaaguccuuuuuuucc

SEQ ID NO: 1893385 - RNA, 18 nt, Human
aaaguccuuuuuuuccau

SEQ ID NO: 1893386 - RNA, 22 nt, Human
aaaguccuuuuuuuccaucuuu

SEQ ID NO: 1893387 - RNA, 19 nt, Human
aaaggcuccaggagcagcc

SEQ ID NO: 1893388 - RNA, 20 nt, Human
aaaggcuccaggagcagcca

SEQ ID NO: 1893389 - RNA, 14 nt, Human
aaaggcagaagcaa

SEQ ID NO: 1893390 - RNA, 17 nt, Human
aaaggccagaccugcag

SEQ ID NO: 1893391 - RNA, 20 nt, Human
aaaggccagaccugcagacg

SEQ ID NO: 1893392 - RNA, 15 nt, Human
aaaggcuccaggagc

SEQ ID NO: 1893393 - RNA, 16 nt, Human
aaaggcuccaggagca

SEQ ID NO: 1893394 - RNA, 14 nt, Human
aaagcccugugcuc

SEQ ID NO: 1893395 - RNA, 13 nt, Human
aaaggcaaggucc

SEQ ID NO: 1893396 - RNA, 16 nt, Human
aaagccuccuccagcc

SEQ ID NO: 1893397 - RNA, 13 nt, Human
aaagcccugugcu

SEQ ID NO: 1893398 - RNA, 19 nt, Human
aaagcccuuaggaagaauu

SEQ ID NO: 1893399 - RNA, 17 nt, Human
aaagccaaugugaacag

SEQ ID NO: 1893400 - RNA, 15 nt, Human
aaagccaaugugaac

SEQ ID NO: 1893401 - RNA, 19 nt, Human
aaagccacaaccacauaca

SEQ ID NO: 1893402 - RNA, 20 nt, Human
aaaccauuaugaagaagaga

SEQ ID NO: 1893403 - RNA, 19 nt, Human
aaaccccuacccucacaau

SEQ ID NO: 1893404 - RNA, 13 nt, Human
aaacccucgaggc

SEQ ID NO: 1893405 - RNA, 24 nt, Human
aaacccucgaggcggaucuuugga

SEQ ID NO: 1893406 - RNA, 18 nt, Human
aaacucuccucugcugcu

SEQ ID NO: 1893407 - RNA, 12 nt, Human
aaacucucugaa

SEQ ID NO: 1893408 - RNA, 13 nt, Human
aaacucucugaac

SEQ ID NO: 1893409 - RNA, 18 nt, Human
aaaccaucauugaaaucu

SEQ ID NO: 1893410 - RNA, 15 nt, Human
aaagaaauauaccua

SEQ ID NO: 1893411 - RNA, 17 nt, Human
aaagaaauauaccuaaa

SEQ ID NO: 1893412 - RNA, 13 nt, Human
aaagaaauaucug

SEQ ID NO: 1893413 - RNA, 22 nt, Human
aaacugagauccuuccuuuuga

SEQ ID NO: 1893414 - RNA, 19 nt, Human
aaagaguguggcaaaauaa

SEQ ID NO: 1893415 - RNA, 16 nt, Human
aaagaagcccccagcu

SEQ ID NO: 1893416 - RNA, 14 nt, Human
aaagaguaggaaga

SEQ ID NO: 1893417 - RNA, 13 nt, Human
aaagaaaugcaaa

SEQ ID NO: 1893418 - RNA, 14 nt, Human
aaagaaaugcaaaa

SEQ ID NO: 1893419 - RNA, 20 nt, Human
aaagaagcccaauauuauaa

SEQ ID NO: 1893420 - RNA, 16 nt, Human
aaagauauuuugcuuu

SEQ ID NO: 1893421 - RNA, 12 nt, Human
aaagauauuuug

SEQ ID NO: 1893422 - RNA, 20 nt, Human
aaagauauuuugcuuuguga

SEQ ID NO: 1893423 - RNA, 17 nt, Human
aaagauauuuugcuuug

SEQ ID NO: 1893424 - RNA, 23 nt, Human
aaagaaguaggggaagacaugca

SEQ ID NO: 1893425 - RNA, 21 nt, Human
aaaauugaugggauuugguca

SEQ ID NO: 1893426 - RNA, 15 nt, Human
aaaauugcaaaucuu

SEQ ID NO: 1893427 - RNA, 22 nt, Human
aaaaucucaaauuucuaaaucu

SEQ ID NO: 1893428 - RNA, 19 nt, Human
aaaaucucaaauuucuaaa

SEQ ID NO: 1893429 - RNA, 16 nt, Human
aaacacuguucucugc

SEQ ID NO: 1893430 - RNA, 22 nt, Human
aaacacugggagaaaugaaaaa

SEQ ID NO: 1893431 - RNA, 21 nt, Human
aaacacugggagaaaugaaaa

SEQ ID NO: 1893432 - RNA, 21 nt, Human
aaacacgcacuuagucucuaa

SEQ ID NO: 1893433 - RNA, 12 nt, Human
aaacagaagccu

SEQ ID NO: 1893434 - RNA, 22 nt, Human
aaacagaccuaaugcuccuugu

SEQ ID NO: 1893435 - RNA, 15 nt, Human
aaaaagaaaggaggg

SEQ ID NO: 1893436 - RNA, 12 nt, Human
aaaaagaaauga

SEQ ID NO: 1893437 - RNA, 17 nt, Human
aaaagugggcuugauuc

SEQ ID NO: 1893438 - RNA, 18 nt, Human
aaaagugggcuugauucu

SEQ ID NO: 1893439 - RNA, 21 nt, Human
aaaaucuacacuccagugaga

SEQ ID NO: 1893440 - RNA, 22 nt, Human
aaaaucccuuaccucggugccu

SEQ ID NO: 1893441 - RNA, 17 nt, Human
aaaauaaaacuuuuuaa

SEQ ID NO: 1893442 - RNA, 13 nt, Human
aaaaguugaauuu

SEQ ID NO: 1893443 - RNA, 18 nt, Human
aaaaguucugcagauaaa

SEQ ID NO: 1893444 - RNA, 16 nt, Human
aagcagccagccguga

SEQ ID NO: 1893445 - RNA, 20 nt, Human
aagcagcguuucuaugacac

SEQ ID NO: 1893446 - RNA, 17 nt, Human
aagcagcguuucuauga

SEQ ID NO: 1893447 - RNA, 14 nt, Human
aagcagcguuucua

SEQ ID NO: 1893448 - RNA, 22 nt, Human
aagcagcguuucuaugacacau

SEQ ID NO: 1893449 - RNA, 21 nt, Human
aagcagcguuucuaugacaca

SEQ ID NO: 1893450 - RNA, 22 nt, Human
aagcagcggucagcagacaagg

SEQ ID NO: 1893451 - RNA, 17 nt, Human
aagccaauucagacagg

SEQ ID NO: 1893452 - RNA, 23 nt, Human
aagccacaggccugagauuucau

SEQ ID NO: 1893453 - RNA, 22 nt, Human
aagccacaggccugagauuuca

SEQ ID NO: 1893454 - RNA, 19 nt, Human
aagccacaggccugagauu

SEQ ID NO: 1893455 - RNA, 17 nt, Human
aagccacaggccugaga

SEQ ID NO: 1893456 - RNA, 15 nt, Human
aagccacaggccuga

SEQ ID NO: 1893457 - RNA, 14 nt, Human
aagccacaggccug

SEQ ID NO: 1893458 - RNA, 14 nt, Human
aagccacagcuggu

SEQ ID NO: 1893459 - RNA, 13 nt, Human
aagcagcucuccc

SEQ ID NO: 1893460 - RNA, 20 nt, Human
aagccagcaggcucucaggc

SEQ ID NO: 1893461 - RNA, 23 nt, Human
aagccagcaggcucucaggccag

SEQ ID NO: 1893462 - RNA, 19 nt, Human
aacuuuccucuuccugccu

SEQ ID NO: 1893463 - RNA, 17 nt, Human
aacuuucauuuuuuucc

SEQ ID NO: 1893464 - RNA, 14 nt, Human
aacuuucauuuuuu

SEQ ID NO: 1893465 - RNA, 11 nt, Human
aacuuucauuu

SEQ ID NO: 1893466 - RNA, 17 nt, Human
aacuuuauuaaauacaa

SEQ ID NO: 1893467 - RNA, 19 nt, Human
aacuuuauuaaauacaaaa

SEQ ID NO: 1893468 - RNA, 23 nt, Human
aacuuuauuaaauacaaaacuuc

SEQ ID NO: 1893469 - RNA, 21 nt, Human
aacuuuauuaaauacaaaacu

SEQ ID NO: 1893470 - RNA, 13 nt, Human
aacuuuauuucca

SEQ ID NO: 1893471 - RNA, 12 nt, Human
aagauaaaugug

SEQ ID NO: 1893472 - RNA, 13 nt, Human
aagauaaaugugc

SEQ ID NO: 1893473 - RNA, 14 nt, Human
aagauaaaugugcu

SEQ ID NO: 1893474 - RNA, 17 nt, Human
aagauaaagccagaagc

SEQ ID NO: 1893475 - RNA, 13 nt, Human
aagauacugaaau

SEQ ID NO: 1893476 - RNA, 17 nt, Human
aagauuacuuuuucuuu

SEQ ID NO: 1893477 - RNA, 21 nt, Human
aagauucccaggaguucugcu

SEQ ID NO: 1893478 - RNA, 17 nt, Human
aagauucccaggaguuc

SEQ ID NO: 1893479 - RNA, 19 nt, Human
aagauucccaggaguucug

SEQ ID NO: 1893480 - RNA, 13 nt, Human
aagauucccagga

SEQ ID NO: 1893481 - RNA, 14 nt, Human
aagauucccaggag

SEQ ID NO: 1893482 - RNA, 15 nt, Human
aagauucccaggagu

SEQ ID NO: 1893483 - RNA, 16 nt, Human
aagauucccaggaguu

SEQ ID NO: 1893484 - RNA, 21 nt, Human
aagcuggucccacucagucca

SEQ ID NO: 1893485 - RNA, 18 nt, Human
aagcuggucccacucagu

SEQ ID NO: 1893486 - RNA, 16 nt, Human
aagcugggguucauga

SEQ ID NO: 1893487 - RNA, 18 nt, Human
aagcuguguggcagucug

SEQ ID NO: 1893488 - RNA, 13 nt, Human
aagcuguggccag

SEQ ID NO: 1893489 - RNA, 14 nt, Human
aagcuguauuuuga

SEQ ID NO: 1893490 - RNA, 22 nt, Human
aagcugggguucaugacaaugg

SEQ ID NO: 1893491 - RNA, 13 nt, Human
aaggacacuagaa

SEQ ID NO: 1893492 - RNA, 21 nt, Human
aagcugugugcucuccaagcc

SEQ ID NO: 1893493 - RNA, 17 nt, Human
aaggacuuccuguccag

SEQ ID NO: 1893494 - RNA, 20 nt, Human
aaggacuuccuguccagcuc

SEQ ID NO: 1893495 - RNA, 21 nt, Human
aaggacuuccuguccagcucc

SEQ ID NO: 1893496 - RNA, 22 nt, Human
aaggacuuccuguccagcucca

SEQ ID NO: 1893497 - RNA, 15 nt, Human
aaggauugcuacugu

SEQ ID NO: 1893498 - RNA, 15 nt, Human
aaggauguucuagca

SEQ ID NO: 1893499 - RNA, 23 nt, Human
aaggacuuccuguccagcuccaa

SEQ ID NO: 1893500 - RNA, 20 nt, Human
aaggcagggagcgagggaga

SEQ ID NO: 1893501 - RNA, 21 nt, Human
aagcgauucuucugcuucagc

SEQ ID NO: 1893502 - RNA, 14 nt, Human
aagcuaauuugcau

SEQ ID NO: 1893503 - RNA, 15 nt, Human
aagcuaauuugcauu

SEQ ID NO: 1893504 - RNA, 22 nt, Human
aagcuaauuugcauuaaauuca

SEQ ID NO: 1893505 - RNA, 23 nt, Human
aagcuaauuugcauuaaauucac

SEQ ID NO: 1893506 - RNA, 17 nt, Human
aagcuacaaucuguuca

SEQ ID NO: 1893507 - RNA, 22 nt, Human
aagucucuuuuuuuggcccagg

SEQ ID NO: 1893508 - RNA, 15 nt, Human
aagucuccaaagucu

SEQ ID NO: 1893509 - RNA, 21 nt, Human
aaguggaaaaauagccugccu

SEQ ID NO: 1893510 - RNA, 19 nt, Human
aaguggaaaaauagccugc

SEQ ID NO: 1893511 - RNA, 12 nt, Human
aaguugaauuuu

SEQ ID NO: 1893512 - RNA, 22 nt, Human
aaguugcagugagcugauauca

SEQ ID NO: 1893513 - RNA, 17 nt, Human
aaguccuacaagcuaaa

SEQ ID NO: 1893514 - RNA, 18 nt, Human
aaguccucuuuucugaga

SEQ ID NO: 1893515 - RNA, 19 nt, Human
aaguccacaguggaaccag

SEQ ID NO: 1893516 - RNA, 14 nt, Human
aaguccacagugga

SEQ ID NO: 1893517 - RNA, 18 nt, Human
aaguauccugcuucugau

SEQ ID NO: 1893518 - RNA, 12 nt, Human
aaguccaaugug

SEQ ID NO: 1893519 - RNA, 22 nt, Human
aaguccucuuuucugagaggac

SEQ ID NO: 1893520 - RNA, 21 nt, Human
aaguccuuuuuuuccaucuuu

SEQ ID NO: 1893521 - RNA, 14 nt, Human
aagucuccaaaguc

SEQ ID NO: 1893522 - RNA, 19 nt, Human
aaguagaagucuuagaugu

SEQ ID NO: 1893523 - RNA, 20 nt, Human
aaguagaagucuuagaugua

SEQ ID NO: 1893524 - RNA, 20 nt, Human
aaggugaggagcuugaaacc

SEQ ID NO: 1893525 - RNA, 17 nt, Human
aaggugauauauuuaaa

SEQ ID NO: 1893526 - RNA, 20 nt, Human
aagguccucugucagucaca

SEQ ID NO: 1893527 - RNA, 15 nt, Human
aaguaguggagcccc

SEQ ID NO: 1893528 - RNA, 17 nt, Human
aaguaucccuacuguaa

SEQ ID NO: 1893529 - RNA, 23 nt, Human
aaguaucccuacuguaauuugug

SEQ ID NO: 1893530 - RNA, 18 nt, Human
aaguaucccuacuguaau

SEQ ID NO: 1893531 - RNA, 21 nt, Human
aaguagaagucuuagauguau

SEQ ID NO: 1893532 - RNA, 17 nt, Human
aagggagcuagccagag

SEQ ID NO: 1893533 - RNA, 18 nt, Human
aagggacgcuacccggga

SEQ ID NO: 1893534 - RNA, 19 nt, Human
aaggucauuuuuuuuaaga

SEQ ID NO: 1893535 - RNA, 18 nt, Human
aaggucauuuuuuuuaag

SEQ ID NO: 1893536 - RNA, 17 nt, Human
aagggccagagccaggg

SEQ ID NO: 1893537 - RNA, 11 nt, Human
aagggccagag

SEQ ID NO: 1893538 - RNA, 12 nt, Human
aagggccagagc

SEQ ID NO: 1893539 - RNA, 13 nt, Human
aagggccagagcc

SEQ ID NO: 1893540 - RNA, 14 nt, Human
aagggccagagcca

SEQ ID NO: 1893541 - RNA, 15 nt, Human
aagggccagagccag

SEQ ID NO: 1893542 - RNA, 16 nt, Human
aagggccagagccagg

SEQ ID NO: 1893543 - RNA, 23 nt, Human
aauguuucuucuagguucuaaaa

SEQ ID NO: 1893544 - RNA, 22 nt, Human
aauguuucuucuagguucuaaa

SEQ ID NO: 1893545 - RNA, 13 nt, Human
aauguuuccuuua

SEQ ID NO: 1893546 - RNA, 16 nt, Human
aauguuugccucugcc

SEQ ID NO: 1893547 - RNA, 15 nt, Human
aauguuugccucugc

SEQ ID NO: 1893548 - RNA, 12 nt, Human
aauguuuccuuu

SEQ ID NO: 1893549 - RNA, 23 nt, Human
aauguuuacacucuuuguaagag

SEQ ID NO: 1893550 - RNA, 20 nt, Human
aauguuuacacucuuuguaa

SEQ ID NO: 1893551 - RNA, 17 nt, Human
aaugugaaaagaaaaau

SEQ ID NO: 1893552 - RNA, 15 nt, Human
aaugugaaaagaaaa

SEQ ID NO: 1893553 - RNA, 23 nt, Human
aaugucacguuuuguuuugugcc

SEQ ID NO: 1893554 - RNA, 22 nt, Human
aaugucacguuuuguuuugugc

SEQ ID NO: 1893555 - RNA, 15 nt, Human
aaugucaguaugugg

SEQ ID NO: 1893556 - RNA, 13 nt, Human
aaugucaguaugu

SEQ ID NO: 1893557 - RNA, 23 nt, Human
aaugccuuacccucauguucuua

SEQ ID NO: 1893558 - RNA, 18 nt, Human
aaugcgugcauaccacuu

SEQ ID NO: 1893559 - RNA, 19 nt, Human
aaugcgugcauaccacuuu

SEQ ID NO: 1893560 - RNA, 15 nt, Human
aauguuuuuuuuuaa

SEQ ID NO: 1893561 - RNA, 20 nt, Human
aauguuuuuuuuuaaagacu

SEQ ID NO: 1893562 - RNA, 22 nt, Human
aauguuuuuuuuuaaagacuuu

SEQ ID NO: 1893563 - RNA, 21 nt, Human
aauuaaaaaaaaagaucuguu

SEQ ID NO: 1893564 - RNA, 20 nt, Human
aaucaagauuuaauccuaga

SEQ ID NO: 1893565 - RNA, 15 nt, Human
aaucaccgaaaacgu

SEQ ID NO: 1893566 - RNA, 14 nt, Human
aaucaccgaaaacg

SEQ ID NO: 1893567 - RNA, 17 nt, Human
aauauacuauauuuaug

SEQ ID NO: 1893568 - RNA, 13 nt, Human
aauagacaauuua

SEQ ID NO: 1893569 - RNA, 16 nt, Human
aauauauaucaaauau

SEQ ID NO: 1893570 - RNA, 20 nt, Human
aauacucuacccucuuagaa

SEQ ID NO: 1893571 - RNA, 22 nt, Human
aauacucuacccucuuagaaaa

SEQ ID NO: 1893572 - RNA, 13 nt, Human
aauacucuuauau

SEQ ID NO: 1893573 - RNA, 23 nt, Human
aauacucuuaggaagagaaacca

SEQ ID NO: 1893574 - RNA, 17 nt, Human
aauacuaccuugaaaau

SEQ ID NO: 1893575 - RNA, 18 nt, Human
aauacuaccuugaaaaua

SEQ ID NO: 1893576 - RNA, 21 nt, Human
aauacuaccuugaaaauaaga

SEQ ID NO: 1893577 - RNA, 21 nt, Human
aauacuauauuuauacuguau

SEQ ID NO: 1893578 - RNA, 10 nt, Human
aauacuuuuu

SEQ ID NO: 1893579 - RNA, 15 nt, Human
aauacuuuuuacaau

SEQ ID NO: 1893580 - RNA, 23 nt, Human
aaugaaagucuugugacuagugc

SEQ ID NO: 1893581 - RNA, 21 nt, Human
aaugaaagucuugugacuagu

SEQ ID NO: 1893582 - RNA, 20 nt, Human
aaugaaagucuugugacuag

SEQ ID NO: 1893583 - RNA, 16 nt, Human
aaugauccccagcugu

SEQ ID NO: 1893584 - RNA, 17 nt, Human
aaugaaguuguagguaa

SEQ ID NO: 1893585 - RNA, 20 nt, Human
aaugauccccagcuguuuau

SEQ ID NO: 1893586 - RNA, 19 nt, Human
aaugauccccagcuguuua

SEQ ID NO: 1893587 - RNA, 22 nt, Human
aaugauccccagcuguuuaugc

SEQ ID NO: 1893588 - RNA, 19 nt, Human
aaugaaagucuugugacua

SEQ ID NO: 1893589 - RNA, 16 nt, Human
aaucucuccauucccg

SEQ ID NO: 1893590 - RNA, 17 nt, Human
aauccaggcagauccag

SEQ ID NO: 1893591 - RNA, 18 nt, Human
aauccaggcagauccagg

SEQ ID NO: 1893592 - RNA, 18 nt, Human
aaucucaaauuucuaaau

SEQ ID NO: 1893593 - RNA, 17 nt, Human
aaucucaaauuucuaaa

SEQ ID NO: 1893594 - RNA, 15 nt, Human
aauccaaugaaauga

SEQ ID NO: 1893595 - RNA, 17 nt, Human
aauccagacccggcugc

SEQ ID NO: 1893596 - RNA, 19 nt, Human
aauccagacccggcugcgu

SEQ ID NO: 1893597 - RNA, 13 nt, Human
aauccagccugcu

SEQ ID NO: 1893598 - RNA, 15 nt, Human
aaucucaaauuucua

SEQ ID NO: 1893599 - RNA, 16 nt, Human
aaucucaaauuucuaa

SEQ ID NO: 1893600 - RNA, 17 nt, Human
aauccaagcaaauguga

SEQ ID NO: 1893601 - RNA, 18 nt, Human
aauccaagcaaaugugaa

SEQ ID NO: 1893602 - RNA, 11 nt, Human
agccgggccgc

SEQ ID NO: 1893603 - RNA, 13 nt, Human
agccgcuggggcc

SEQ ID NO: 1893604 - RNA, 21 nt, Human
agccgccaugcuccuggccca

SEQ ID NO: 1893605 - RNA, 14 nt, Human
agcccucgucuccc

SEQ ID NO: 1893606 - RNA, 23 nt, Human
agcccucaccccugguucucauc

SEQ ID NO: 1893607 - RNA, 14 nt, Human
agccgggccgcaga

SEQ ID NO: 1893608 - RNA, 21 nt, Human
agccgggcgugguggugagug

SEQ ID NO: 1893609 - RNA, 14 nt, Human
agccgugagugcag

SEQ ID NO: 1893610 - RNA, 21 nt, Human
agccucccaaagugcugggau

SEQ ID NO: 1893611 - RNA, 22 nt, Human
agccucccacgacugcccggca

SEQ ID NO: 1893612 - RNA, 18 nt, Human
agccgugcucgccccagc

SEQ ID NO: 1893613 - RNA, 19 nt, Human
agccucccgaguagcuggg

SEQ ID NO: 1893614 - RNA, 18 nt, Human
agccucccgaguagcugg

SEQ ID NO: 1893615 - RNA, 20 nt, Human
agccucccgaguagcuggga

SEQ ID NO: 1893616 - RNA, 17 nt, Human
agccucccauccagggc

SEQ ID NO: 1893617 - RNA, 14 nt, Human
agccuccuccagcc

SEQ ID NO: 1893618 - RNA, 18 nt, Human
agccucccauccagggcc

SEQ ID NO: 1893619 - RNA, 12 nt, Human
agccucccugcc

SEQ ID NO: 1893620 - RNA, 13 nt, Human
agccucccugccu

SEQ ID NO: 1893621 - RNA, 14 nt, Human
agccucccugccuc

SEQ ID NO: 1893622 - RNA, 23 nt, Human
agccucccugccucaggccucug

SEQ ID NO: 1893623 - RNA, 16 nt, Human
agccccauucugccug

SEQ ID NO: 1893624 - RNA, 13 nt, Human
agccccauucugc

SEQ ID NO: 1893625 - RNA, 22 nt, Human
agcccucaccccugguucucau

SEQ ID NO: 1893626 - RNA, 15 nt, Human
agccccagugcccac

SEQ ID NO: 1893627 - RNA, 14 nt, Human
agccccagugccca

SEQ ID NO: 1893628 - RNA, 13 nt, Human
agccccagugccc

SEQ ID NO: 1893629 - RNA, 18 nt, Human
agccagcaggcucucagg

SEQ ID NO: 1893630 - RNA, 19 nt, Human
agccagcaggcucucaggc

SEQ ID NO: 1893631 - RNA, 17 nt, Human
agccagcaggcucucag

SEQ ID NO: 1893632 - RNA, 20 nt, Human
agccagcaggcucucaggcc

SEQ ID NO: 1893633 - RNA, 23 nt, Human
agcauccuggcacccggccccug

SEQ ID NO: 1893634 - RNA, 22 nt, Human
agcauccuggcacccggccccu

SEQ ID NO: 1893635 - RNA, 14 nt, Human
agcaugacauuucu

SEQ ID NO: 1893636 - RNA, 15 nt, Human
agcaugacauuucuu

SEQ ID NO: 1893637 - RNA, 23 nt, Human
agccaagugugguagagugugcc

SEQ ID NO: 1893638 - RNA, 15 nt, Human
agccagcacacaggg

SEQ ID NO: 1893639 - RNA, 17 nt, Human
agccagcacacagggca

SEQ ID NO: 1893640 - RNA, 18 nt, Human
agccagcacacagggcag

SEQ ID NO: 1893641 - RNA, 19 nt, Human
agccagcacacagggcagu

SEQ ID NO: 1893642 - RNA, 20 nt, Human
agccagcacuuguccagcug

SEQ ID NO: 1893643 - RNA, 21 nt, Human
agccagcacuuguccagcuga

SEQ ID NO: 1893644 - RNA, 22 nt, Human
agccagcacuuguccagcugag

SEQ ID NO: 1893645 - RNA, 20 nt, Human
agcaugccuggauggggcug

SEQ ID NO: 1893646 - RNA, 23 nt, Human
agcaugccuggauggggcugcac

SEQ ID NO: 1893647 - RNA, 21 nt, Human
agcaugcugugauugugccua

SEQ ID NO: 1893648 - RNA, 15 nt, Human
agccaaaugguuuaa

SEQ ID NO: 1893649 - RNA, 18 nt, Human
agccaacacgcaccugcc

SEQ ID NO: 1893650 - RNA, 19 nt, Human
agccaacacgcaccugccu

SEQ ID NO: 1893651 - RNA, 18 nt, Human
agccaacagaagcuucca

SEQ ID NO: 1893652 - RNA, 22 nt, Human
agccaacacgcaccugccucag

SEQ ID NO: 1893653 - RNA, 18 nt, Human
agcagugggccuggccag

SEQ ID NO: 1893654 - RNA, 18 nt, Human
agcagugcaugcuguccc

SEQ ID NO: 1893655 - RNA, 22 nt, Human
agcagcugguaaucuugcucug

SEQ ID NO: 1893656 - RNA, 19 nt, Human
agcagugcaugcugucccu

SEQ ID NO: 1893657 - RNA, 20 nt, Human
agcagugcaugcugucccuu

SEQ ID NO: 1893658 - RNA, 22 nt, Human
agcagcugaaauaugcuggcug

SEQ ID NO: 1893659 - RNA, 23 nt, Human
agcagcugaaauaugcuggcugg

SEQ ID NO: 1893660 - RNA, 12 nt, Human
agcagcucuccc

SEQ ID NO: 1893661 - RNA, 14 nt, Human
agcagcucuccccu

SEQ ID NO: 1893662 - RNA, 13 nt, Human
agcagcguuucua

SEQ ID NO: 1893663 - RNA, 14 nt, Human
agcagcgccuuucc

SEQ ID NO: 1893664 - RNA, 15 nt, Human
agcagcgccuuuccc

SEQ ID NO: 1893665 - RNA, 20 nt, Human
agcacagacccugcccugug

SEQ ID NO: 1893666 - RNA, 18 nt, Human
agcacagacccugcccug

SEQ ID NO: 1893667 - RNA, 19 nt, Human
agcacagacccugcccugu

SEQ ID NO: 1893668 - RNA, 23 nt, Human
agcacacuugacaucaacugcau

SEQ ID NO: 1893669 - RNA, 20 nt, Human
agcacacucauccccucacu

SEQ ID NO: 1893670 - RNA, 14 nt, Human
agcacacucauccc

SEQ ID NO: 1893671 - RNA, 17 nt, Human
agcacagacccugcccu

SEQ ID NO: 1893672 - RNA, 16 nt, Human
agacuggaagcacagc

SEQ ID NO: 1893673 - RNA, 17 nt, Human
agacuggaagcacagcu

SEQ ID NO: 1893674 - RNA, 19 nt, Human
agacuggaagcacagcuuc

SEQ ID NO: 1893675 - RNA, 14 nt, Human
agacuggaagcuaa

SEQ ID NO: 1893676 - RNA, 19 nt, Human
agacuggaagcuaauuugc

SEQ ID NO: 1893677 - RNA, 12 nt, Human
agagaaaaagag

SEQ ID NO: 1893678 - RNA, 16 nt, Human
agagaaaaagaaaugc

SEQ ID NO: 1893679 - RNA, 20 nt, Human
agagaaaaagaaaugcaaaa

SEQ ID NO: 1893680 - RNA, 21 nt, Human
agagaaaaagaaaugcaaaaa

SEQ ID NO: 1893681 - RNA, 21 nt, Human
agagaggguggugaccucugc

SEQ ID NO: 1893682 - RNA, 20 nt, Human
agagaggguggugaccucug

SEQ ID NO: 1893683 - RNA, 22 nt, Human
agagaggguggugaccucugcc

SEQ ID NO: 1893684 - RNA, 19 nt, Human
agagcccaccuuggcucaa

SEQ ID NO: 1893685 - RNA, 13 nt, Human
agagcccacgccc

SEQ ID NO: 1893686 - RNA, 17 nt, Human
agagcccacgcccccac

SEQ ID NO: 1893687 - RNA, 15 nt, Human
agagcccagcuccaa

SEQ ID NO: 1893688 - RNA, 16 nt, Human
agagcccacgccccca

SEQ ID NO: 1893689 - RNA, 21 nt, Human
agacgcugugcugcccugccc

SEQ ID NO: 1893690 - RNA, 12 nt, Human
agacagcugccu

SEQ ID NO: 1893691 - RNA, 11 nt, Human
agacagcucuu

SEQ ID NO: 1893692 - RNA, 12 nt, Human
agacagcucuua

SEQ ID NO: 1893693 - RNA, 18 nt, Human
agacggagucccaccuug

SEQ ID NO: 1893694 - RNA, 22 nt, Human
agacgcugugcugcccugccca

SEQ ID NO: 1893695 - RNA, 17 nt, Human
agacgugauuuugcugu

SEQ ID NO: 1893696 - RNA, 15 nt, Human
agacagauacuccuc

SEQ ID NO: 1893697 - RNA, 21 nt, Human
agacagauacuccuccaaggu

SEQ ID NO: 1893698 - RNA, 16 nt, Human
agacagcccgggcucu

SEQ ID NO: 1893699 - RNA, 21 nt, Human
agacagcuccacccuggccga

SEQ ID NO: 1893700 - RNA, 14 nt, Human
agacagcccgggcu

SEQ ID NO: 1893701 - RNA, 15 nt, Human
agacagcccgggcuc

SEQ ID NO: 1893702 - RNA, 23 nt, Human
agacagagucucacuguugccca

SEQ ID NO: 1893703 - RNA, 19 nt, Human
agauauaugcucugcaugu

SEQ ID NO: 1893704 - RNA, 14 nt, Human
agaucuucuguggg

SEQ ID NO: 1893705 - RNA, 14 nt, Human
agauggcuccucuc

SEQ ID NO: 1893706 - RNA, 15 nt, Human
agauggcuccucuca

SEQ ID NO: 1893707 - RNA, 14 nt, Human
agauggcagucacu

SEQ ID NO: 1893708 - RNA, 17 nt, Human
agaguguggcaaaauaa

SEQ ID NO: 1893709 - RNA, 20 nt, Human
agaguguggagucauucuca

SEQ ID NO: 1893710 - RNA, 14 nt, Human
agagugugccugaa

SEQ ID NO: 1893711 - RNA, 23 nt, Human
agaggguggugaccucugccuga

SEQ ID NO: 1893712 - RNA, 11 nt, Human
agagugggagc

SEQ ID NO: 1893713 - RNA, 19 nt, Human
agaguggggauaugauuua

SEQ ID NO: 1893714 - RNA, 19 nt, Human
agaggguggugaccucugc

SEQ ID NO: 1893715 - RNA, 15 nt, Human
agagggccgggcaga

SEQ ID NO: 1893716 - RNA, 17 nt, Human
agagggccgggcagagg

SEQ ID NO: 1893717 - RNA, 18 nt, Human
agagggccgggcagaggg

SEQ ID NO: 1893718 - RNA, 22 nt, Human
agaggguggugaccucugccug

SEQ ID NO: 1893719 - RNA, 20 nt, Human
agaggguggugaccucugcc

SEQ ID NO: 1893720 - RNA, 12 nt, Human
agagggcacaga

SEQ ID NO: 1893721 - RNA, 17 nt, Human
agagggaugcauggaga

SEQ ID NO: 1893722 - RNA, 14 nt, Human
agaggacuuuucuu

SEQ ID NO: 1893723 - RNA, 22 nt, Human
agaggacgagcgauugaggugu

SEQ ID NO: 1893724 - RNA, 15 nt, Human
agaggagagaggacc

SEQ ID NO: 1893725 - RNA, 16 nt, Human
agaggagagaggaccc

SEQ ID NO: 1893726 - RNA, 20 nt, Human
agaggacaguauuugugggg

SEQ ID NO: 1893727 - RNA, 15 nt, Human
agaggaccggcggcu

SEQ ID NO: 1893728 - RNA, 16 nt, Human
agaggaaggagaggag

SEQ ID NO: 1893729 - RNA, 15 nt, Human
agagcccaggccucc

SEQ ID NO: 1893730 - RNA, 13 nt, Human
agagcccaggccu

SEQ ID NO: 1893731 - RNA, 14 nt, Human
agagcccaggccuc

SEQ ID NO: 1893732 - RNA, 13 nt, Human
aggacccaagcag

SEQ ID NO: 1893733 - RNA, 15 nt, Human
aggacccaagcagag

SEQ ID NO: 1893734 - RNA, 18 nt, Human
aggacccaagcagagaag

SEQ ID NO: 1893735 - RNA, 17 nt, Human
aggaauccagacccggc

SEQ ID NO: 1893736 - RNA, 21 nt, Human
aggaaucaugugccaagcaga

SEQ ID NO: 1893737 - RNA, 20 nt, Human
aggaauccagacccggcugc

SEQ ID NO: 1893738 - RNA, 21 nt, Human
agcuuuucccuuuuuuuaagu

SEQ ID NO: 1893739 - RNA, 18 nt, Human
agcuuuugaauaaaaacu

SEQ ID NO: 1893740 - RNA, 16 nt, Human
aggaguguggccacgu

SEQ ID NO: 1893741 - RNA, 18 nt, Human
aggagugugugauuuuuu

SEQ ID NO: 1893742 - RNA, 17 nt, Human
aggaguuauuuguaaug

SEQ ID NO: 1893743 - RNA, 23 nt, Human
aggaugcuuguacauaaugcgug

SEQ ID NO: 1893744 - RNA, 21 nt, Human
aggaugcuuguacauaaugcg

SEQ ID NO: 1893745 - RNA, 18 nt, Human
aggaguggguugauuuca

SEQ ID NO: 1893746 - RNA, 21 nt, Human
aggagucccugccaucauguu

SEQ ID NO: 1893747 - RNA, 13 nt, Human
aggaccucaggug

SEQ ID NO: 1893748 - RNA, 16 nt, Human
aggaccggcggcucgg

SEQ ID NO: 1893749 - RNA, 16 nt, Human
aggauguucugggaca

SEQ ID NO: 1893750 - RNA, 15 nt, Human
aggauguucugggac

SEQ ID NO: 1893751 - RNA, 22 nt, Human
aggauguucuagcauggcugcc

SEQ ID NO: 1893752 - RNA, 14 nt, Human
aggauggaacacgg

SEQ ID NO: 1893753 - RNA, 19 nt, Human
aggauggaacacggccaca

SEQ ID NO: 1893754 - RNA, 14 nt, Human
aggaugcuuugguu

SEQ ID NO: 1893755 - RNA, 18 nt, Human
aggauguucugggacaca

SEQ ID NO: 1893756 - RNA, 14 nt, Human
aggauuauuggaaa

SEQ ID NO: 1893757 - RNA, 22 nt, Human
agcuuccccaacacgcaggagc

SEQ ID NO: 1893758 - RNA, 23 nt, Human
agcuuccauuccaagccugacca

SEQ ID NO: 1893759 - RNA, 22 nt, Human
agcuuccaugauucuauuuaua

SEQ ID NO: 1893760 - RNA, 22 nt, Human
agcuucuggugaccuuccaaga

SEQ ID NO: 1893761 - RNA, 21 nt, Human
agcuucuggugaccuuccaag

SEQ ID NO: 1893762 - RNA, 23 nt, Human
agcugcgguccacccaggagccc

SEQ ID NO: 1893763 - RNA, 21 nt, Human
agcugcuauagccuggggugg

SEQ ID NO: 1893764 - RNA, 15 nt, Human
agcugcuauagccug

SEQ ID NO: 1893765 - RNA, 16 nt, Human
agcugcuauagccugg

SEQ ID NO: 1893766 - RNA, 16 nt, Human
agcugcucagggaaaa

SEQ ID NO: 1893767 - RNA, 21 nt, Human
agcugcucagggaaaagcagc

SEQ ID NO: 1893768 - RNA, 23 nt, Human
agcuccgcuuucuacccagcgag

SEQ ID NO: 1893769 - RNA, 21 nt, Human
agcuccgcuuucuacccagcg

SEQ ID NO: 1893770 - RNA, 20 nt, Human
agcuccgcuuucuacccagc

SEQ ID NO: 1893771 - RNA, 13 nt, Human
agcuccuucuguc

SEQ ID NO: 1893772 - RNA, 12 nt, Human
agcuccuucugu

SEQ ID NO: 1893773 - RNA, 23 nt, Human
agcugaacaauaggcuguuccca

SEQ ID NO: 1893774 - RNA, 14 nt, Human
agcugagcaggugu

SEQ ID NO: 1893775 - RNA, 14 nt, Human
agcugaaaguuggg

SEQ ID NO: 1893776 - RNA, 17 nt, Human
agcugaaaguugggacu

SEQ ID NO: 1893777 - RNA, 18 nt, Human
agcugaaauaugcuggcu

SEQ ID NO: 1893778 - RNA, 20 nt, Human
agcugaaauaugcuggcugg

SEQ ID NO: 1893779 - RNA, 21 nt, Human
agcugaacaauaggcuguucc

SEQ ID NO: 1893780 - RNA, 22 nt, Human
agcugaacaauaggcuguuccc

SEQ ID NO: 1893781 - RNA, 22 nt, Human
agggacgcggcucccggggcag

SEQ ID NO: 1893782 - RNA, 17 nt, Human
agggacgcuacccggga

SEQ ID NO: 1893783 - RNA, 17 nt, Human
agggacgaagaagagcc

SEQ ID NO: 1893784 - RNA, 21 nt, Human
agggacgaagaagagccacag

SEQ ID NO: 1893785 - RNA, 22 nt, Human
agggacgaagaagagccacagu

SEQ ID NO: 1893786 - RNA, 18 nt, Human
aggcuguaucccaugagc

SEQ ID NO: 1893787 - RNA, 13 nt, Human
aggcuguauccca

SEQ ID NO: 1893788 - RNA, 20 nt, Human
aggcugucaauuacaggaag

SEQ ID NO: 1893789 - RNA, 22 nt, Human
aggcugguucggauuuggggug

SEQ ID NO: 1893790 - RNA, 16 nt, Human
aggcugguggcccagg

SEQ ID NO: 1893791 - RNA, 17 nt, Human
aggcugguggcccagga

SEQ ID NO: 1893792 - RNA, 21 nt, Human
aggcugucaauuacaggaagu

SEQ ID NO: 1893793 - RNA, 22 nt, Human
agggacagaggggguggccucc

SEQ ID NO: 1893794 - RNA, 23 nt, Human
agggacagaggggguggccuccc

SEQ ID NO: 1893795 - RNA, 13 nt, Human
agggaccucuccc

SEQ ID NO: 1893796 - RNA, 15 nt, Human
agggaccucucccag

SEQ ID NO: 1893797 - RNA, 16 nt, Human
agggaccucucccagg

SEQ ID NO: 1893798 - RNA, 23 nt, Human
aggcuacuguaaggcaaucaugg

SEQ ID NO: 1893799 - RNA, 21 nt, Human
aggcuagaaccaccugccuau

SEQ ID NO: 1893800 - RNA, 13 nt, Human
aggcuaaacaucc

SEQ ID NO: 1893801 - RNA, 21 nt, Human
aggcuaaacauccaauauuuu

SEQ ID NO: 1893802 - RNA, 22 nt, Human
aggcccuucucuccagccccug

SEQ ID NO: 1893803 - RNA, 23 nt, Human
aggcccuucucuccagccccugg

SEQ ID NO: 1893804 - RNA, 20 nt, Human
aggcccuucucuccagcccc

SEQ ID NO: 1893805 - RNA, 21 nt, Human
aggcccuucucuccagccccu

SEQ ID NO: 1893806 - RNA, 18 nt, Human
aggguccagaaggagaca

SEQ ID NO: 1893807 - RNA, 15 nt, Human
agggucagccagggc

SEQ ID NO: 1893808 - RNA, 17 nt, Human
agggucagccagggccu

SEQ ID NO: 1893809 - RNA, 18 nt, Human
agggucagccagggccug

SEQ ID NO: 1893810 - RNA, 19 nt, Human
agggucagccagggccugc

SEQ ID NO: 1893811 - RNA, 23 nt, Human
agggucagccagggccugcgagg

SEQ ID NO: 1893812 - RNA, 21 nt, Human
aggguaucaggugcugccauc

SEQ ID NO: 1893813 - RNA, 15 nt, Human
aggguaucuggugac

SEQ ID NO: 1893814 - RNA, 19 nt, Human
aggguaucaggugcugcca

SEQ ID NO: 1893815 - RNA, 16 nt, Human
aggggccuaggccuca

SEQ ID NO: 1893816 - RNA, 19 nt, Human
aggggccuaggccucagcc

SEQ ID NO: 1893817 - RNA, 23 nt, Human
aggggccuaggccucagccagag

SEQ ID NO: 1893818 - RNA, 19 nt, Human
aggggccucuuaugggcug

SEQ ID NO: 1893819 - RNA, 20 nt, Human
aggggccucuuaugggcugg

SEQ ID NO: 1893820 - RNA, 21 nt, Human
aggggccucuuaugggcuggg

SEQ ID NO: 1893821 - RNA, 19 nt, Human
aggguccagaaggagacag

SEQ ID NO: 1893822 - RNA, 21 nt, Human
aggguccagaaggagacaggc

SEQ ID NO: 1893823 - RNA, 11 nt, Human
agggucccugg

SEQ ID NO: 1893824 - RNA, 12 nt, Human
agggucccuggg

SEQ ID NO: 1893825 - RNA, 20 nt, Human
agguaaaagcaucacaugaa

SEQ ID NO: 1893826 - RNA, 18 nt, Human
agguaaaucagacuauga

SEQ ID NO: 1893827 - RNA, 23 nt, Human
agguaaaucagacuaugaaguuu

SEQ ID NO: 1893828 - RNA, 19 nt, Human
agguaauuucuugugccuc

SEQ ID NO: 1893829 - RNA, 16 nt, Human
agguaauuucuugugc

SEQ ID NO: 1893830 - RNA, 12 nt, Human
aggucccuaaua

SEQ ID NO: 1893831 - RNA, 11 nt, Human
aggucccuaau

SEQ ID NO: 1893832 - RNA, 13 nt, Human
aggucccuaauaa

SEQ ID NO: 1893833 - RNA, 15 nt, Human
aggucccuaauaaag

SEQ ID NO: 1893834 - RNA, 16 nt, Human
aggucccuaauaaagc

SEQ ID NO: 1893835 - RNA, 18 nt, Human
aggucuguucuuuccaaa

SEQ ID NO: 1893836 - RNA, 23 nt, Human
aggucuguucuuuccaaaguaca

SEQ ID NO: 1893837 - RNA, 22 nt, Human
aggucuguucuuuccaaaguac

SEQ ID NO: 1893838 - RNA, 15 nt, Human
agguucaaagauauu

SEQ ID NO: 1893839 - RNA, 14 nt, Human
agguucaaagauau

SEQ ID NO: 1893840 - RNA, 22 nt, Human
agguucccuuugacgccauccc

SEQ ID NO: 1893841 - RNA, 13 nt, Human
agguucccuuuga

SEQ ID NO: 1893842 - RNA, 23 nt, Human
agguucccuuugacgccauccca

SEQ ID NO: 1893843 - RNA, 23 nt, Human
aggugcuaggaacacuccuucac

SEQ ID NO: 1893844 - RNA, 21 nt, Human
agguggaauuauuuuaaaaga

SEQ ID NO: 1893845 - RNA, 17 nt, Human
agguggaauuauuuuaa

SEQ ID NO: 1893846 - RNA, 19 nt, Human
aggugcuaggaacacuccu

SEQ ID NO: 1893847 - RNA, 22 nt, Human
aggugcuaggaacacuccuuca

SEQ ID NO: 1893848 - RNA, 20 nt, Human
agguggagguugcagugagc

SEQ ID NO: 1893849 - RNA, 14 nt, Human
auaucauucagcaa

SEQ ID NO: 1893850 - RNA, 13 nt, Human
auaucauucagca

SEQ ID NO: 1893851 - RNA, 15 nt, Human
auaucaauuuaaaaa

SEQ ID NO: 1893852 - RNA, 16 nt, Human
auaucaaauauauuca

SEQ ID NO: 1893853 - RNA, 19 nt, Human
auauauuuuuuucugaaau

SEQ ID NO: 1893854 - RNA, 15 nt, Human
auaucauucagcaac

SEQ ID NO: 1893855 - RNA, 21 nt, Human
auaugcuuauacacuuacacu

SEQ ID NO: 1893856 - RNA, 22 nt, Human
auauuaccacagacauacuaac

SEQ ID NO: 1893857 - RNA, 19 nt, Human
auauuaccacagacauacu

SEQ ID NO: 1893858 - RNA, 19 nt, Human
auauuuacuucuuauacau

SEQ ID NO: 1893859 - RNA, 23 nt, Human
auauuuauuauuuucaccuguuu

SEQ ID NO: 1893860 - RNA, 14 nt, Human
auauuuacguauga

SEQ ID NO: 1893861 - RNA, 23 nt, Human
auauuaugaagcuuuuaugugaa

SEQ ID NO: 1893862 - RNA, 23 nt, Human
auagcaucuuugaauacaaagaa

SEQ ID NO: 1893863 - RNA, 22 nt, Human
auagcaucuuguggcuuugcaa

SEQ ID NO: 1893864 - RNA, 15 nt, Human
auagccaaggccaaa

SEQ ID NO: 1893865 - RNA, 21 nt, Human
auagccaaggccaaaggaagc

SEQ ID NO: 1893866 - RNA, 13 nt, Human
auagccacauuug

SEQ ID NO: 1893867 - RNA, 16 nt, Human
auagccacauuuggaa

SEQ ID NO: 1893868 - RNA, 21 nt, Human
auagccacauuuggaauacuu

SEQ ID NO: 1893869 - RNA, 22 nt, Human
auagccacauuuggaauacuuu

SEQ ID NO: 1893870 - RNA, 23 nt, Human
auagccacauuuggaauacuuuu

SEQ ID NO: 1893871 - RNA, 18 nt, Human
auagcagcuuauucacaa

SEQ ID NO: 1893872 - RNA, 15 nt, Human
auagguuuaauaauu

SEQ ID NO: 1893873 - RNA, 18 nt, Human
auagguuuggacaaaaug

SEQ ID NO: 1893874 - RNA, 14 nt, Human
auagguuuggacaa

SEQ ID NO: 1893875 - RNA, 18 nt, Human
auaguaugguggcugggu

SEQ ID NO: 1893876 - RNA, 17 nt, Human
auaguaugguggcuggg

SEQ ID NO: 1893877 - RNA, 22 nt, Human
auauacucuagaugaaguuuua

SEQ ID NO: 1893878 - RNA, 11 nt, Human
auauacuuuuu

SEQ ID NO: 1893879 - RNA, 20 nt, Human
auauacuuuuuuuucuuuaa

SEQ ID NO: 1893880 - RNA, 19 nt, Human
auagcaugacauuucuuug

SEQ ID NO: 1893881 - RNA, 14 nt, Human
auaccucugugugc

SEQ ID NO: 1893882 - RNA, 13 nt, Human
auaccucugugug

SEQ ID NO: 1893883 - RNA, 12 nt, Human
auaccucugugu

SEQ ID NO: 1893884 - RNA, 18 nt, Human
auaccugucccccugaca

SEQ ID NO: 1893885 - RNA, 11 nt, Human
auacccacccc

SEQ ID NO: 1893886 - RNA, 12 nt, Human
auacccaccccc

SEQ ID NO: 1893887 - RNA, 15 nt, Human
auaauguaagcucua

SEQ ID NO: 1893888 - RNA, 11 nt, Human
auaaugucucu

SEQ ID NO: 1893889 - RNA, 19 nt, Human
auaaugucucugugagacu

SEQ ID NO: 1893890 - RNA, 15 nt, Human
auaaugucucuguga

SEQ ID NO: 1893891 - RNA, 20 nt, Human
auacaccacuacauucuguu

SEQ ID NO: 1893892 - RNA, 19 nt, Human
auacaccacuacauucugu

SEQ ID NO: 1893893 - RNA, 21 nt, Human
auacaccacuacauucuguua

SEQ ID NO: 1893894 - RNA, 18 nt, Human
auacaccacuacauucug

SEQ ID NO: 1893895 - RNA, 21 nt, Human
auaaugcgugcauaccacuuu

SEQ ID NO: 1893896 - RNA, 20 nt, Human
auaaugcgugcauaccacuu

SEQ ID NO: 1893897 - RNA, 14 nt, Human
auaauguaagcucu

SEQ ID NO: 1893898 - RNA, 19 nt, Human
auaaggccauaaaacaggu

SEQ ID NO: 1893899 - RNA, 18 nt, Human
auaaaggauuaaugucaa

SEQ ID NO: 1893900 - RNA, 22 nt, Human
auaaauuuuuuuuguuucauau

SEQ ID NO: 1893901 - RNA, 19 nt, Human
auaaauuuuuuuuguuuca

SEQ ID NO: 1893902 - RNA, 11 nt, Human
auaaagacagg

SEQ ID NO: 1893903 - RNA, 13 nt, Human
auaaagcagcguu

SEQ ID NO: 1893904 - RNA, 20 nt, Human
auaaagcagcguuucuauga

SEQ ID NO: 1893905 - RNA, 19 nt, Human
auaaagcagcguuucuaug

SEQ ID NO: 1893906 - RNA, 18 nt, Human
auaaagcagcguuucuau

SEQ ID NO: 1893907 - RNA, 14 nt, Human
auaaagcagcguuu

SEQ ID NO: 1893908 - RNA, 15 nt, Human
auaaagcaggcagaa

SEQ ID NO: 1893909 - RNA, 14 nt, Human
auaaagcauuuaua

SEQ ID NO: 1893910 - RNA, 18 nt, Human
auaaagcauuuauaaauu

SEQ ID NO: 1893911 - RNA, 14 nt, Human
auaaagcccuggga

SEQ ID NO: 1893912 - RNA, 20 nt, Human
auaaagcccugggaucacug

SEQ ID NO: 1893913 - RNA, 18 nt, Human
auaaagcuguguggcagu

SEQ ID NO: 1893914 - RNA, 13 nt, Human
auaaaggauguga

SEQ ID NO: 1893915 - RNA, 14 nt, Human
auaaaggaugugau

SEQ ID NO: 1893916 - RNA, 17 nt, Human
auaaaggaugugauugu

SEQ ID NO: 1893917 - RNA, 21 nt, Human
auaaaggaugugauuguggaa

SEQ ID NO: 1893918 - RNA, 22 nt, Human
auaaaggaugugauuguggaau

SEQ ID NO: 1893919 - RNA, 11 nt, Human
auaaaacuuuu

SEQ ID NO: 1893920 - RNA, 15 nt, Human
auaaaacuuuuuaaa

SEQ ID NO: 1893921 - RNA, 22 nt, Human
auaaaaauaaauuugguucuaa

SEQ ID NO: 1893922 - RNA, 13 nt, Human
auaaaaauaaauu

SEQ ID NO: 1893923 - RNA, 12 nt, Human
auaaaaaggugu

SEQ ID NO: 1893924 - RNA, 20 nt, Human
auaaacuuuuuucuuacugu

SEQ ID NO: 1893925 - RNA, 24 nt, Human
auaaacuuuaccuuuuuuauacau

SEQ ID NO: 1893926 - RNA, 16 nt, Human
auaaacuuuaccuuuu

SEQ ID NO: 1893927 - RNA, 21 nt, Human
auaaacuuuaccuuuuuuaua

SEQ ID NO: 1893928 - RNA, 17 nt, Human
auaaaacuuuuuaaaau

SEQ ID NO: 1893929 - RNA, 23 nt, Human
aguugaaaaucuuauaauuuaaa

SEQ ID NO: 1893930 - RNA, 19 nt, Human
aguugaaccuauuucucuu

SEQ ID NO: 1893931 - RNA, 17 nt, Human
aguugaaccuauuucuc

SEQ ID NO: 1893932 - RNA, 14 nt, Human
aguugaagacagag

SEQ ID NO: 1893933 - RNA, 16 nt, Human
aguuguguuugaagca

SEQ ID NO: 1893934 - RNA, 20 nt, Human
aguuguuugauucagacagc

SEQ ID NO: 1893935 - RNA, 16 nt, Human
aguuguuaauaaaagu

SEQ ID NO: 1893936 - RNA, 22 nt, Human
aguugaaaaucuuauaauuuaa

SEQ ID NO: 1893937 - RNA, 18 nt, Human
aguuccaaaaugccaaau

SEQ ID NO: 1893938 - RNA, 22 nt, Human
aguucauguauguucagaagaa

SEQ ID NO: 1893939 - RNA, 19 nt, Human
aguucagguaacaggcaga

SEQ ID NO: 1893940 - RNA, 17 nt, Human
aguuacagacaaagcgu

SEQ ID NO: 1893941 - RNA, 20 nt, Human
aguucagguaacaggcagau

SEQ ID NO: 1893942 - RNA, 18 nt, Human
aguucauaaauuuauggu

SEQ ID NO: 1893943 - RNA, 12 nt, Human
aguuaaauaaau

SEQ ID NO: 1893944 - RNA, 14 nt, Human
aguuacagacaaag

SEQ ID NO: 1893945 - RNA, 16 nt, Human
aguuacagacaaagcg

SEQ ID NO: 1893946 - RNA, 18 nt, Human
aguuacacuaaaagguga

SEQ ID NO: 1893947 - RNA, 14 nt, Human
agugggagcugccu

SEQ ID NO: 1893948 - RNA, 15 nt, Human
agugggagcugccug

SEQ ID NO: 1893949 - RNA, 16 nt, Human
agugggagcugccugu

SEQ ID NO: 1893950 - RNA, 18 nt, Human
aguguauuuuuuuacuaa

SEQ ID NO: 1893951 - RNA, 17 nt, Human
aguguauuuuuuuacua

SEQ ID NO: 1893952 - RNA, 16 nt, Human
aguguauuuuucaaua

SEQ ID NO: 1893953 - RNA, 21 nt, Human
aguguauuuuucaauaaagca

SEQ ID NO: 1893954 - RNA, 23 nt, Human
aguggcuuaaaacaacacucaca

SEQ ID NO: 1893955 - RNA, 18 nt, Human
aguggcuucacuccugcu

SEQ ID NO: 1893956 - RNA, 19 nt, Human
aguggcuucacuccugcug

SEQ ID NO: 1893957 - RNA, 21 nt, Human
aguggcuucacuccugcugua

SEQ ID NO: 1893958 - RNA, 20 nt, Human
aguggcuucacuccugcugu

SEQ ID NO: 1893959 - RNA, 16 nt, Human
aguggcuggaucugug

SEQ ID NO: 1893960 - RNA, 14 nt, Human
aguguccuuagaac

SEQ ID NO: 1893961 - RNA, 12 nt, Human
aguccuguaaug

SEQ ID NO: 1893962 - RNA, 17 nt, Human
agucugaaggcuggguu

SEQ ID NO: 1893963 - RNA, 16 nt, Human
agucugaaggcugggu

SEQ ID NO: 1893964 - RNA, 13 nt, Human
agucugaaggcug

SEQ ID NO: 1893965 - RNA, 15 nt, Human
agucugaaggcuggg

SEQ ID NO: 1893966 - RNA, 22 nt, Human
aguccuggcaugggaaugaaug

SEQ ID NO: 1893967 - RNA, 20 nt, Human
aguccuggcaugggaaugaa

SEQ ID NO: 1893968 - RNA, 21 nt, Human
aguccuggcaugggaaugaau

SEQ ID NO: 1893969 - RNA, 18 nt, Human
agucuggaaugcaguggu

SEQ ID NO: 1893970 - RNA, 20 nt, Human
agugaacuugggccacugug

SEQ ID NO: 1893971 - RNA, 17 nt, Human
agucuggaaugcagugg

SEQ ID NO: 1893972 - RNA, 23 nt, Human
agucugcgucucugcuuuaaagu

SEQ ID NO: 1893973 - RNA, 18 nt, Human
agucugauucccaagcuc

SEQ ID NO: 1893974 - RNA, 16 nt, Human
agucugauucccaagc

SEQ ID NO: 1893975 - RNA, 20 nt, Human
agucugauucccaagcucug

SEQ ID NO: 1893976 - RNA, 16 nt, Human
agugaagacaaugacu

SEQ ID NO: 1893977 - RNA, 14 nt, Human
agugaagacaauga

SEQ ID NO: 1893978 - RNA, 16 nt, Human
agugaagacuggaagc

SEQ ID NO: 1893979 - RNA, 19 nt, Human
agugaaguugcuucuucua

SEQ ID NO: 1893980 - RNA, 17 nt, Human
agugaagugagaaguuc

SEQ ID NO: 1893981 - RNA, 14 nt, Human
aguaugguggcugg

SEQ ID NO: 1893982 - RNA, 22 nt, Human
agucaaaugguaggcauuuccu

SEQ ID NO: 1893983 - RNA, 23 nt, Human
agucaaaugguaggcauuuccua

SEQ ID NO: 1893984 - RNA, 14 nt, Human
agucaaauuaauaa

SEQ ID NO: 1893985 - RNA, 15 nt, Human
agucaaauuaauaau

SEQ ID NO: 1893986 - RNA, 18 nt, Human
agucaaauuaauaaucuu

SEQ ID NO: 1893987 - RNA, 20 nt, Human
agucaaauuaauaaucuuau

SEQ ID NO: 1893988 - RNA, 22 nt, Human
agucaaauuaauaaucuuauua

SEQ ID NO: 1893989 - RNA, 16 nt, Human
aguaugaggcauuugu

SEQ ID NO: 1893990 - RNA, 15 nt, Human
aguaugaggcauuug

SEQ ID NO: 1893991 - RNA, 16 nt, Human
aguaucuuuuuauuca

SEQ ID NO: 1893992 - RNA, 11 nt, Human
aguaucuugaa

SEQ ID NO: 1893993 - RNA, 12 nt, Human
aguaucuugaag

SEQ ID NO: 1893994 - RNA, 15 nt, Human
aguaucuugaagacu

SEQ ID NO: 1893995 - RNA, 15 nt, Human
aucaugugaaaucau

SEQ ID NO: 1893996 - RNA, 22 nt, Human
aucagcuggucaaacaaacucu

SEQ ID NO: 1893997 - RNA, 14 nt, Human
aucaugugaaauca

SEQ ID NO: 1893998 - RNA, 16 nt, Human
aucaugugaaaucauu

SEQ ID NO: 1893999 - RNA, 20 nt, Human
aucagccugcuccagcuguu

SEQ ID NO: 1894000 - RNA, 19 nt, Human
aucagccugcuccagcugu

SEQ ID NO: 1894001 - RNA, 17 nt, Human
aucagccugcuccagcu

SEQ ID NO: 1894002 - RNA, 18 nt, Human
aucagccugcuccagcug

SEQ ID NO: 1894003 - RNA, 14 nt, Human
aucagccugugcca

SEQ ID NO: 1894004 - RNA, 18 nt, Human
aucagcuccacuuucagu

SEQ ID NO: 1894005 - RNA, 23 nt, Human
aucagcacgauuucuguuuagau

SEQ ID NO: 1894006 - RNA, 20 nt, Human
aucagcacgauuucuguuua

SEQ ID NO: 1894007 - RNA, 19 nt, Human
aucagcacgauuucuguuu

SEQ ID NO: 1894008 - RNA, 14 nt, Human
aucaccgaaaacgu

SEQ ID NO: 1894009 - RNA, 19 nt, Human
aucaccgaaaacguggcug

SEQ ID NO: 1894010 - RNA, 21 nt, Human
aucaccgaaaacguggcugcu

SEQ ID NO: 1894011 - RNA, 21 nt, Human
aucacagccucugaaaaccaa

SEQ ID NO: 1894012 - RNA, 18 nt, Human
aucaccaacgucugugcc

SEQ ID NO: 1894013 - RNA, 19 nt, Human
aucaccaacgucugugcca

SEQ ID NO: 1894014 - RNA, 19 nt, Human
auccucccaccucagccuc

SEQ ID NO: 1894015 - RNA, 18 nt, Human
auccucccaccucagccu

SEQ ID NO: 1894016 - RNA, 20 nt, Human
auccucccaccucagccucc

SEQ ID NO: 1894017 - RNA, 21 nt, Human
aucggaucuggggcucuggga

SEQ ID NO: 1894018 - RNA, 15 nt, Human
auccucccaccucag

SEQ ID NO: 1894019 - RNA, 23 nt, Human
auccuccaggugcacaagcucca

SEQ ID NO: 1894020 - RNA, 11 nt, Human
auccuccaggu

SEQ ID NO: 1894021 - RNA, 11 nt, Human
auccuccagca

SEQ ID NO: 1894022 - RNA, 13 nt, Human
auccuccagcagg

SEQ ID NO: 1894023 - RNA, 15 nt, Human
auccuccagcaggga

SEQ ID NO: 1894024 - RNA, 22 nt, Human
auccccgcagugugcacuaagg

SEQ ID NO: 1894025 - RNA, 15 nt, Human
auccccuguagagug

SEQ ID NO: 1894026 - RNA, 12 nt, Human
auccccugccuc

SEQ ID NO: 1894027 - RNA, 13 nt, Human
auccccugccucc

SEQ ID NO: 1894028 - RNA, 13 nt, Human
auccuauucuuuc

SEQ ID NO: 1894029 - RNA, 21 nt, Human
auccuauugaaccauguuugu

SEQ ID NO: 1894030 - RNA, 14 nt, Human
aucccauuuaaaaa

SEQ ID NO: 1894031 - RNA, 14 nt, Human
auccaggcagaucc

SEQ ID NO: 1894032 - RNA, 15 nt, Human
auccaggcagaucca

SEQ ID NO: 1894033 - RNA, 16 nt, Human
auccaggcagauccag

SEQ ID NO: 1894034 - RNA, 15 nt, Human
aucccauuuaaaaaa

SEQ ID NO: 1894035 - RNA, 22 nt, Human
auccaggacuauauuugggccu

SEQ ID NO: 1894036 - RNA, 23 nt, Human
auccaggacuauauuugggccug

SEQ ID NO: 1894037 - RNA, 15 nt, Human
auccagacccggcug

SEQ ID NO: 1894038 - RNA, 18 nt, Human
auccagaaagaaaacuug

SEQ ID NO: 1894039 - RNA, 16 nt, Human
auccagaaagaaaacu

SEQ ID NO: 1894040 - RNA, 22 nt, Human
aucuucugaacuuggcgcugcc

SEQ ID NO: 1894041 - RNA, 18 nt, Human
aucuugaagacuuuucuu

SEQ ID NO: 1894042 - RNA, 14 nt, Human
aucuucuuuauaau

SEQ ID NO: 1894043 - RNA, 18 nt, Human
aucuugaauaauguaaga

SEQ ID NO: 1894044 - RNA, 17 nt, Human
aucuugaauuguaagga

SEQ ID NO: 1894045 - RNA, 18 nt, Human
aucucccuucacaaguuu

SEQ ID NO: 1894046 - RNA, 22 nt, Human
aucugcuuuuuaaagaaugcuc

SEQ ID NO: 1894047 - RNA, 11 nt, Human
aucuggaaccc

SEQ ID NO: 1894048 - RNA, 14 nt, Human
aucuggaacccaga

SEQ ID NO: 1894049 - RNA, 15 nt, Human
aucuggaacccagac

SEQ ID NO: 1894050 - RNA, 16 nt, Human
aucuggaacccagacu

SEQ ID NO: 1894051 - RNA, 17 nt, Human
aucuggaacccagacuc

SEQ ID NO: 1894052 - RNA, 18 nt, Human
aucuggaacccagacuca

SEQ ID NO: 1894053 - RNA, 23 nt, Human
aucuauucucuccaaaaaugcac

SEQ ID NO: 1894054 - RNA, 21 nt, Human
aucucccccagccccauccuc

SEQ ID NO: 1894055 - RNA, 15 nt, Human
aucuauuaaaaccac

SEQ ID NO: 1894056 - RNA, 21 nt, Human
aucuauauuuuacauaaauuu

SEQ ID NO: 1894057 - RNA, 13 nt, Human
aucuauauuuugg

SEQ ID NO: 1894058 - RNA, 17 nt, Human
aucuauauuuuacauaa

SEQ ID NO: 1894059 - RNA, 14 nt, Human
aucuauauuuuaca

SEQ ID NO: 1894060 - RNA, 13 nt, Human
augaaagacugua

SEQ ID NO: 1894061 - RNA, 16 nt, Human
augaaagacuguacaa

SEQ ID NO: 1894062 - RNA, 17 nt, Human
augaaagacuguacaaa

SEQ ID NO: 1894063 - RNA, 19 nt, Human
augaaagacuguacaaagu

SEQ ID NO: 1894064 - RNA, 23 nt, Human
augaaaaaauauauaucaaauau

SEQ ID NO: 1894065 - RNA, 19 nt, Human
augaaguuuuuuuuauaca

SEQ ID NO: 1894066 - RNA, 14 nt, Human
augaaguuuuacau

SEQ ID NO: 1894067 - RNA, 16 nt, Human
augaaguuuuacauug

SEQ ID NO: 1894068 - RNA, 22 nt, Human
augaagcuuuuaugugaaacau

SEQ ID NO: 1894069 - RNA, 21 nt, Human
augaaggagaggcaacaucca

SEQ ID NO: 1894070 - RNA, 19 nt, Human
augaagguuucugaaaauu

SEQ ID NO: 1894071 - RNA, 17 nt, Human
augaagguuucugaaaa

SEQ ID NO: 1894072 - RNA, 21 nt, Human
augaccuuucaauaggaaaaa

SEQ ID NO: 1894073 - RNA, 22 nt, Human
augaccuuucaauaggaaaaac

SEQ ID NO: 1894074 - RNA, 23 nt, Human
augaccuuucaauaggaaaaacu

SEQ ID NO: 1894075 - RNA, 11 nt, Human
augcugcccug

SEQ ID NO: 1894076 - RNA, 12 nt, Human
augcugccccuc

SEQ ID NO: 1894077 - RNA, 18 nt, Human
augcugcaggacuugaga

SEQ ID NO: 1894078 - RNA, 19 nt, Human
augcugcaggacuugagaa

SEQ ID NO: 1894079 - RNA, 16 nt, Human
augcucuuuacuucau

SEQ ID NO: 1894080 - RNA, 23 nt, Human
auggaaaggagccuaggccaggu

SEQ ID NO: 1894081 - RNA, 15 nt, Human
auggauuuccagcca

SEQ ID NO: 1894082 - RNA, 19 nt, Human
auggauucuccacucaguu

SEQ ID NO: 1894083 - RNA, 14 nt, Human
augcuuguacauaa

SEQ ID NO: 1894084 - RNA, 13 nt, Human
augcuuguacaua

SEQ ID NO: 1894085 - RNA, 12 nt, Human
augcuuguacau

SEQ ID NO: 1894086 - RNA, 12 nt, Human
augcugcccugu

SEQ ID NO: 1894087 - RNA, 16 nt, Human
auggaaacugaaacua

SEQ ID NO: 1894088 - RNA, 16 nt, Human
auggcuguggagugug

SEQ ID NO: 1894089 - RNA, 24 nt, Human
augauguuuuccaugaguccccug

SEQ ID NO: 1894090 - RNA, 17 nt, Human
augaugcuauuugcaau

SEQ ID NO: 1894091 - RNA, 16 nt, Human
augaugcuauuugcaa

SEQ ID NO: 1894092 - RNA, 15 nt, Human
augcacaaacagagg

SEQ ID NO: 1894093 - RNA, 16 nt, Human
augaugccaugaggaa

SEQ ID NO: 1894094 - RNA, 17 nt, Human
augaugccaugaggaac

SEQ ID NO: 1894095 - RNA, 16 nt, Human
augcauauuauuuuau

SEQ ID NO: 1894096 - RNA, 20 nt, Human
augcauauuauuuuauguug

SEQ ID NO: 1894097 - RNA, 17 nt, Human
augccucucucaggcca

SEQ ID NO: 1894098 - RNA, 16 nt, Human
augcaugaaguaauau

SEQ ID NO: 1894099 - RNA, 19 nt, Human
augccucucucaggccaaa

SEQ ID NO: 1894100 - RNA, 16 nt, Human
augcacagaguuguua

SEQ ID NO: 1894101 - RNA, 16 nt, Human
augcacaaacagaggc

SEQ ID NO: 1894102 - RNA, 17 nt, Human
augcacaaacagaggcc

SEQ ID NO: 1894103 - RNA, 18 nt, Human
augcacagaguuguuaca

SEQ ID NO: 1894104 - RNA, 17 nt, Human
augcacagaguuguuac

SEQ ID NO: 1894105 - RNA, 23 nt, Human
auguaauuaaguacuauguauca

SEQ ID NO: 1894106 - RNA, 23 nt, Human
auguauuuucuucaccucugcua

SEQ ID NO: 1894107 - RNA, 15 nt, Human
auggucggaaaacau

SEQ ID NO: 1894108 - RNA, 15 nt, Human
auguaauuaaguacu

SEQ ID NO: 1894109 - RNA, 17 nt, Human
auguaauuaaguacuau

SEQ ID NO: 1894110 - RNA, 19 nt, Human
auggucaccaaaucagcug

SEQ ID NO: 1894111 - RNA, 15 nt, Human
auggucacacacuga

SEQ ID NO: 1894112 - RNA, 16 nt, Human
auggucacacacugau

SEQ ID NO: 1894113 - RNA, 18 nt, Human
auggucacacacugaugc

SEQ ID NO: 1894114 - RNA, 19 nt, Human
auggucacacacugaugcu

SEQ ID NO: 1894115 - RNA, 20 nt, Human
auggucacacacugaugcuu

SEQ ID NO: 1894116 - RNA, 14 nt, Human
auggucacacacug

SEQ ID NO: 1894117 - RNA, 14 nt, Human
augucuuuucuugc

SEQ ID NO: 1894118 - RNA, 15 nt, Human
augugaaacauguuu

SEQ ID NO: 1894119 - RNA, 22 nt, Human
augugaaacuggauuaaacuua

SEQ ID NO: 1894120 - RNA, 23 nt, Human
augugaacaguuguguuugaagc

SEQ ID NO: 1894121 - RNA, 21 nt, Human
augugaacaguuguguuugaa

SEQ ID NO: 1894122 - RNA, 11 nt, Human
augugaacagu

SEQ ID NO: 1894123 - RNA, 17 nt, Human
augugaacuuuauuaaa

SEQ ID NO: 1894124 - RNA, 12 nt, Human
augugaagccaa

SEQ ID NO: 1894125 - RNA, 21 nt, Human
augugaagccaauucagacag

SEQ ID NO: 1894126 - RNA, 22 nt, Human
augugaagccaauucagacagg

SEQ ID NO: 1894127 - RNA, 15 nt, Human
augugaacuuuauua

SEQ ID NO: 1894128 - RNA, 20 nt, Human
augugggcuaguugggcuuc

SEQ ID NO: 1894129 - RNA, 17 nt, Human
auguucuaagaagugaa

SEQ ID NO: 1894130 - RNA, 22 nt, Human
auguuccuuuggaagaaaaaau

SEQ ID NO: 1894131 - RNA, 12 nt, Human
auguucugggac

SEQ ID NO: 1894132 - RNA, 11 nt, Human
auguucuggga

SEQ ID NO: 1894133 - RNA, 13 nt, Human
auguucugcuuuc

SEQ ID NO: 1894134 - RNA, 13 nt, Human
auguucugggaca

SEQ ID NO: 1894135 - RNA, 19 nt, Human
auguuugccucugccucug

SEQ ID NO: 1894136 - RNA, 15 nt, Human
auguuuccagacuuc

SEQ ID NO: 1894137 - RNA, 22 nt, Human
auguuugccucugccucugaca

SEQ ID NO: 1894138 - RNA, 16 nt, Human
auuaaauacaaaacuu

SEQ ID NO: 1894139 - RNA, 17 nt, Human
auuaaauacaaaacuuc

SEQ ID NO: 1894140 - RNA, 19 nt, Human
auuaaauacaaaacuucca

SEQ ID NO: 1894141 - RNA, 11 nt, Human
auuaaauagcu

SEQ ID NO: 1894142 - RNA, 16 nt, Human
auguggcuugagaaau

SEQ ID NO: 1894143 - RNA, 21 nt, Human
auguggcuugagaaauaugga

SEQ ID NO: 1894144 - RNA, 18 nt, Human
cugcugacuguuuucucu

SEQ ID NO: 1894145 - RNA, 21 nt, Human
cugcugacuguuuucucuuga

SEQ ID NO: 1894146 - RNA, 22 nt, Human
cugcucauucuaaugauggccc

SEQ ID NO: 1894147 - RNA, 18 nt, Human
cugcucagcuucuccugu

SEQ ID NO: 1894148 - RNA, 23 nt, Human
cugcucagggaaaagcagcucuc

SEQ ID NO: 1894149 - RNA, 16 nt, Human
cugcucagcuucuccu

SEQ ID NO: 1894150 - RNA, 22 nt, Human
cugcucagggaaaagcagcucu

SEQ ID NO: 1894151 - RNA, 23 nt, Human
cugccuguugggccaggagccuc

SEQ ID NO: 1894152 - RNA, 21 nt, Human
cugccuguugggccaggagcc

SEQ ID NO: 1894153 - RNA, 22 nt, Human
cugccuguugggccaggagccu

SEQ ID NO: 1894154 - RNA, 15 nt, Human
cugcucagcuucucc

SEQ ID NO: 1894155 - RNA, 14 nt, Human
cugcuauagccugg

SEQ ID NO: 1894156 - RNA, 15 nt, Human
cugcuauagccuggg

SEQ ID NO: 1894157 - RNA, 21 nt, Human
cugccucccgcccccuuggcu

SEQ ID NO: 1894158 - RNA, 20 nt, Human
cugccuccccucuccuuccu

SEQ ID NO: 1894159 - RNA, 21 nt, Human
cugaugaacucuuaaucaaau

SEQ ID NO: 1894160 - RNA, 19 nt, Human
cugccuguucagcuccagc

SEQ ID NO: 1894161 - RNA, 20 nt, Human
cugccuguugggccaggagc

SEQ ID NO: 1894162 - RNA, 18 nt, Human
cugccuguucagcuccag

SEQ ID NO: 1894163 - RNA, 17 nt, Human
cugccuguucagcucca

SEQ ID NO: 1894164 - RNA, 23 nt, Human
cugccugguccucacacucaccc

SEQ ID NO: 1894165 - RNA, 19 nt, Human
cugccugguccucacacuc

SEQ ID NO: 1894166 - RNA, 17 nt, Human
cugccugguccucacac

SEQ ID NO: 1894167 - RNA, 23 nt, Human
cugccuccgcgugaucaaagcca

SEQ ID NO: 1894168 - RNA, 23 nt, Human
cugccucucccaucacuucccua

SEQ ID NO: 1894169 - RNA, 15 nt, Human
cugccucucccauca

SEQ ID NO: 1894170 - RNA, 22 nt, Human
cugccucucccaucacuucccu

SEQ ID NO: 1894171 - RNA, 20 nt, Human
cugcuuuugucuaugggacu

SEQ ID NO: 1894172 - RNA, 22 nt, Human
cugcuucaaggauccugagcca

SEQ ID NO: 1894173 - RNA, 23 nt, Human
cugcuucaaggauccugagccag

SEQ ID NO: 1894174 - RNA, 19 nt, Human
cugcuucaaauauuucccu

SEQ ID NO: 1894175 - RNA, 12 nt, Human
cugcuucaagga

SEQ ID NO: 1894176 - RNA, 13 nt, Human
cugcuucaaggau

SEQ ID NO: 1894177 - RNA, 21 nt, Human
cugcuucaaggauccugagcc

SEQ ID NO: 1894178 - RNA, 14 nt, Human
cugcuucaaauauu

SEQ ID NO: 1894179 - RNA, 13 nt, Human
cuggaguuucaug

SEQ ID NO: 1894180 - RNA, 22 nt, Human
cuggaguuucauguacaagaug

SEQ ID NO: 1894181 - RNA, 18 nt, Human
cuggaguuucauguacaa

SEQ ID NO: 1894182 - RNA, 21 nt, Human
cuggacugaccugguccacag

SEQ ID NO: 1894183 - RNA, 12 nt, Human
cuggacugaggc

SEQ ID NO: 1894184 - RNA, 14 nt, Human
cuggacugaccugg

SEQ ID NO: 1894185 - RNA, 18 nt, Human
cuggacugaggccugagc

SEQ ID NO: 1894186 - RNA, 16 nt, Human
cuggacugaggccuga

SEQ ID NO: 1894187 - RNA, 15 nt, Human
cuggacugaggccug

SEQ ID NO: 1894188 - RNA, 13 nt, Human
cuggacugaggcc

SEQ ID NO: 1894189 - RNA, 13 nt, Human
cuggacuuggagg

SEQ ID NO: 1894190 - RNA, 14 nt, Human
cuggagaaaaugga

SEQ ID NO: 1894191 - RNA, 20 nt, Human
cuggaguugaucuggaaccc

SEQ ID NO: 1894192 - RNA, 22 nt, Human
cuggaguugaucuggaacccag

SEQ ID NO: 1894193 - RNA, 21 nt, Human
cugcuuuugucuaugggacuc

SEQ ID NO: 1894194 - RNA, 19 nt, Human
cugcuuuuuaaagaaugcu

SEQ ID NO: 1894195 - RNA, 14 nt, Human
cuggaacuugggga

SEQ ID NO: 1894196 - RNA, 14 nt, Human
cuggaagcacagcu

SEQ ID NO: 1894197 - RNA, 12 nt, Human
cugggcagaagg

SEQ ID NO: 1894198 - RNA, 15 nt, Human
cugggcagaaggaag

SEQ ID NO: 1894199 - RNA, 18 nt, Human
cugggccacuucugggug

SEQ ID NO: 1894200 - RNA, 14 nt, Human
cuggggagaaagua

SEQ ID NO: 1894201 - RNA, 17 nt, Human
cuggggaugucucucau

SEQ ID NO: 1894202 - RNA, 16 nt, Human
cuggggaugucucuca

SEQ ID NO: 1894203 - RNA, 20 nt, Human
cuggguucacugcaaccucc

SEQ ID NO: 1894204 - RNA, 18 nt, Human
cuggguucacugcaaccu

SEQ ID NO: 1894205 - RNA, 15 nt, Human
cuggguucacugcaa

SEQ ID NO: 1894206 - RNA, 15 nt, Human
cuggguggggcagug

SEQ ID NO: 1894207 - RNA, 15 nt, Human
cuggggccaggcugg

SEQ ID NO: 1894208 - RNA, 18 nt, Human
cuggggcuagggggagcc

SEQ ID NO: 1894209 - RNA, 15 nt, Human
cuggggcucugggau

SEQ ID NO: 1894210 - RNA, 14 nt, Human
cuggggcucuggga

SEQ ID NO: 1894211 - RNA, 17 nt, Human
cuggcagaguugaagac

SEQ ID NO: 1894212 - RNA, 18 nt, Human
cuggcagaguugaagaca

SEQ ID NO: 1894213 - RNA, 19 nt, Human
cuggcagaguugaagacag

SEQ ID NO: 1894214 - RNA, 11 nt, Human
cuggcagccca

SEQ ID NO: 1894215 - RNA, 12 nt, Human
cuggcagccccu

SEQ ID NO: 1894216 - RNA, 12 nt, Human
cuggcagccucc

SEQ ID NO: 1894217 - RNA, 14 nt, Human
cuggcagccuccca

SEQ ID NO: 1894218 - RNA, 15 nt, Human
cuggcagccucccau

SEQ ID NO: 1894219 - RNA, 13 nt, Human
cuggcagccccug

SEQ ID NO: 1894220 - RNA, 11 nt, Human
cugggacacag

SEQ ID NO: 1894221 - RNA, 18 nt, Human
cugggaauaagugccagg

SEQ ID NO: 1894222 - RNA, 20 nt, Human
cuggcucucccauuuccuga

SEQ ID NO: 1894223 - RNA, 14 nt, Human
cuggccuagcauac

SEQ ID NO: 1894224 - RNA, 22 nt, Human
cuggccgggaccccgagccugg

SEQ ID NO: 1894225 - RNA, 22 nt, Human
cuggccccucagggucccuggu

SEQ ID NO: 1894226 - RNA, 20 nt, Human
cuggcagccucccauccagg

SEQ ID NO: 1894227 - RNA, 22 nt, Human
cuggcagccucccauccagggc

SEQ ID NO: 1894228 - RNA, 23 nt, Human
cuggcagccucccauccagggcc

SEQ ID NO: 1894229 - RNA, 23 nt, Human
cuggccccugagaucucugcagg

SEQ ID NO: 1894230 - RNA, 22 nt, Human
cuggccccugagaucucugcag

SEQ ID NO: 1894231 - RNA, 18 nt, Human
cuggccccugagaucucu

SEQ ID NO: 1894232 - RNA, 15 nt, Human
cuuaggaagaauuuu

SEQ ID NO: 1894233 - RNA, 17 nt, Human
cuuaggaagagaaacca

SEQ ID NO: 1894234 - RNA, 22 nt, Human
cuuaggaagagaaaccagggag

SEQ ID NO: 1894235 - RNA, 15 nt, Human
cuuaggccagcacca

SEQ ID NO: 1894236 - RNA, 19 nt, Human
cuuagggaaggauacaaaa

SEQ ID NO: 1894237 - RNA, 12 nt, Human
cuuaggccuucc

SEQ ID NO: 1894238 - RNA, 13 nt, Human
cuuaggccuuccu

SEQ ID NO: 1894239 - RNA, 15 nt, Human
cuuaggccuuccucu

SEQ ID NO: 1894240 - RNA, 17 nt, Human
cuuaggccuuccucucu

SEQ ID NO: 1894241 - RNA, 21 nt, Human
cuuagggaaggauacaaaagc

SEQ ID NO: 1894242 - RNA, 23 nt, Human
cuuaggccuuccucucuccagau

SEQ ID NO: 1894243 - RNA, 22 nt, Human
cuuagcucauucuccuuguguu

SEQ ID NO: 1894244 - RNA, 16 nt, Human
cuuaccagcagagcac

SEQ ID NO: 1894245 - RNA, 17 nt, Human
cuuagcuccccuccaac

SEQ ID NO: 1894246 - RNA, 23 nt, Human
cuuagcucauucuccuuguguua

SEQ ID NO: 1894247 - RNA, 14 nt, Human
cuuagcuccccucc

SEQ ID NO: 1894248 - RNA, 23 nt, Human
cuguucaauguuuuuaaaaaucu

SEQ ID NO: 1894249 - RNA, 22 nt, Human
cuguucaauguuuuuaaaaauc

SEQ ID NO: 1894250 - RNA, 14 nt, Human
cuguuggcuggggg

SEQ ID NO: 1894251 - RNA, 22 nt, Human
cuguuggcugggggccucagug

SEQ ID NO: 1894252 - RNA, 19 nt, Human
cuguuggcugggggccuca

SEQ ID NO: 1894253 - RNA, 12 nt, Human
cuguuuaagaga

SEQ ID NO: 1894254 - RNA, 14 nt, Human
cuguuuaagagaca

SEQ ID NO: 1894255 - RNA, 21 nt, Human
cuuaaaaaugguuuaaauggu

SEQ ID NO: 1894256 - RNA, 17 nt, Human
cuguugucaccuucacc

SEQ ID NO: 1894257 - RNA, 18 nt, Human
cuguugucaccuucaccu

SEQ ID NO: 1894258 - RNA, 23 nt, Human
cuguugucaccuucaccuccuuu

SEQ ID NO: 1894259 - RNA, 21 nt, Human
cuguugucaccuucaccuccu

SEQ ID NO: 1894260 - RNA, 14 nt, Human
cuuaaaacaacacu

SEQ ID NO: 1894261 - RNA, 17 nt, Human
cuuacaagccagcugga

SEQ ID NO: 1894262 - RNA, 16 nt, Human
cuuacaagccagcugg

SEQ ID NO: 1894263 - RNA, 20 nt, Human
cuuacauuuuacuuuuuccu

SEQ ID NO: 1894264 - RNA, 20 nt, Human
cuuacauuguucaauuagaa

SEQ ID NO: 1894265 - RNA, 15 nt, Human
cuuaccagcagagca

SEQ ID NO: 1894266 - RNA, 22 nt, Human
cuggugacaugucuuuucuugc

SEQ ID NO: 1894267 - RNA, 13 nt, Human
cuguagaguggga

SEQ ID NO: 1894268 - RNA, 19 nt, Human
cuguagaaaagggaacuga

SEQ ID NO: 1894269 - RNA, 15 nt, Human
cuguacucuuagaug

SEQ ID NO: 1894270 - RNA, 16 nt, Human
cuguacugggccaugu

SEQ ID NO: 1894271 - RNA, 16 nt, Human
cugucgcccagucugg

SEQ ID NO: 1894272 - RNA, 15 nt, Human
cugucgcccagucug

SEQ ID NO: 1894273 - RNA, 19 nt, Human
cugucaauuacaggaagua

SEQ ID NO: 1894274 - RNA, 20 nt, Human
cugucaauuacaggaaguac

SEQ ID NO: 1894275 - RNA, 23 nt, Human
cugucaauuacaggaaguacugg

SEQ ID NO: 1894276 - RNA, 14 nt, Human
cugucauagaaagu

SEQ ID NO: 1894277 - RNA, 21 nt, Human
cuguccugggagugagcuggu

SEQ ID NO: 1894278 - RNA, 13 nt, Human
cuguccugggccu

SEQ ID NO: 1894279 - RNA, 14 nt, Human
cuguccugggccug

SEQ ID NO: 1894280 - RNA, 18 nt, Human
cuguccugggccugcaga

SEQ ID NO: 1894281 - RNA, 17 nt, Human
cuguccuccaagccagc

SEQ ID NO: 1894282 - RNA, 16 nt, Human
cugugacccccagcuc

SEQ ID NO: 1894283 - RNA, 17 nt, Human
cugugacccccagcucc

SEQ ID NO: 1894284 - RNA, 18 nt, Human
cugugacccccagcuccg

SEQ ID NO: 1894285 - RNA, 21 nt, Human
cugugacccccagcuccggcc

SEQ ID NO: 1894286 - RNA, 13 nt, Human
cugugacccccag

SEQ ID NO: 1894287 - RNA, 15 nt, Human
cugugacccccagcu

SEQ ID NO: 1894288 - RNA, 12 nt, Human
cugugcugcccu

SEQ ID NO: 1894289 - RNA, 13 nt, Human
cugugcugcccug

SEQ ID NO: 1894290 - RNA, 14 nt, Human
cugugcugcccugc

SEQ ID NO: 1894291 - RNA, 19 nt, Human
cugugccuucuuuugauua

SEQ ID NO: 1894292 - RNA, 16 nt, Human
cugugccuuuugccau

SEQ ID NO: 1894293 - RNA, 13 nt, Human
cuguuagucauuu

SEQ ID NO: 1894294 - RNA, 15 nt, Human
cuguuagucauuugc

SEQ ID NO: 1894295 - RNA, 14 nt, Human
cuguuagucauuug

SEQ ID NO: 1894296 - RNA, 18 nt, Human
cuguuagucauuugcuga

SEQ ID NO: 1894297 - RNA, 21 nt, Human
cugugcugcccugcccaccug

SEQ ID NO: 1894298 - RNA, 19 nt, Human
cuguguauuuuuuaaagcu

SEQ ID NO: 1894299 - RNA, 23 nt, Human
cuguguauuuuuuaaagcuacaa

SEQ ID NO: 1894300 - RNA, 17 nt, Human
cugugucagcauagaag

SEQ ID NO: 1894301 - RNA, 19 nt, Human
cugugucagcauagaagua

SEQ ID NO: 1894302 - RNA, 15 nt, Human
cugugcugcccugcc

SEQ ID NO: 1894303 - RNA, 17 nt, Human
cugugcugcccugccca

SEQ ID NO: 1894304 - RNA, 18 nt, Human
cugugcugcccugcccac

SEQ ID NO: 1894305 - RNA, 19 nt, Human
cugugcugcccugcccacc

SEQ ID NO: 1894306 - RNA, 16 nt, Human
cuuucuacccagcgag

SEQ ID NO: 1894307 - RNA, 15 nt, Human
cuuucuacccagcga

SEQ ID NO: 1894308 - RNA, 15 nt, Human
cuuucuacaauguga

SEQ ID NO: 1894309 - RNA, 18 nt, Human
cuuucuacaaugugaacu

SEQ ID NO: 1894310 - RNA, 20 nt, Human
cuuucuacaaugugaacuuu

SEQ ID NO: 1894311 - RNA, 21 nt, Human
cuuugacucuuuugccauuaa

SEQ ID NO: 1894312 - RNA, 16 nt, Human
cuuugacgccauccca

SEQ ID NO: 1894313 - RNA, 17 nt, Human
cuuugacgccaucccag

SEQ ID NO: 1894314 - RNA, 14 nt, Human
cuuugaccuguugg

SEQ ID NO: 1894315 - RNA, 22 nt, Human
cuuuguauucucuccuguaccu

SEQ ID NO: 1894316 - RNA, 19 nt, Human
cuuuuauaaacuuuaccuu

SEQ ID NO: 1894317 - RNA, 21 nt, Human
cuuuuauaaacuuuaccuuuu

SEQ ID NO: 1894318 - RNA, 20 nt, Human
cuuuuauaaacuuuaccuuu

SEQ ID NO: 1894319 - RNA, 20 nt, Human
cuuugguuaaauagucuaga

SEQ ID NO: 1894320 - RNA, 19 nt, Human
cuuugguuauauuuagcuc

SEQ ID NO: 1894321 - RNA, 20 nt, Human
cuuugauucuccuucagccc

SEQ ID NO: 1894322 - RNA, 22 nt, Human
cuuugauucuccuucagcccuc

SEQ ID NO: 1894323 - RNA, 19 nt, Human
cuuugauucuccuucagcc

SEQ ID NO: 1894324 - RNA, 18 nt, Human
cuuugauucuccuucagc

SEQ ID NO: 1894325 - RNA, 16 nt, Human
cuuugauucuccuuca

SEQ ID NO: 1894326 - RNA, 14 nt, Human
cuuuguaaugaaaa

SEQ ID NO: 1894327 - RNA, 15 nt, Human
cuuuguaaugaaaac

SEQ ID NO: 1894328 - RNA, 14 nt, Human
cuuugguucuggcc

SEQ ID NO: 1894329 - RNA, 19 nt, Human
cuuugguucuggccagaau

SEQ ID NO: 1894330 - RNA, 21 nt, Human
cuuugguucuggccagaaugc

SEQ ID NO: 1894331 - RNA, 20 nt, Human
cuuugguuuaauuuaaagcc

SEQ ID NO: 1894332 - RNA, 16 nt, Human
cuuuguaaugaaaacc

SEQ ID NO: 1894333 - RNA, 17 nt, Human
cuuuguauucucuccug

SEQ ID NO: 1894334 - RNA, 17 nt, Human
cuuucagcagacugauc

SEQ ID NO: 1894335 - RNA, 11 nt, Human
cuugugccaua

SEQ ID NO: 1894336 - RNA, 19 nt, Human
cuugugccauagucacaug

SEQ ID NO: 1894337 - RNA, 20 nt, Human
cuugugacuagugcugaagc

SEQ ID NO: 1894338 - RNA, 15 nt, Human
cuugugcaguguuga

SEQ ID NO: 1894339 - RNA, 23 nt, Human
cuuuaaugucacaggcaggucca

SEQ ID NO: 1894340 - RNA, 14 nt, Human
cuuucacccuuuuc

SEQ ID NO: 1894341 - RNA, 15 nt, Human
cuuucacccuuuucu

SEQ ID NO: 1894342 - RNA, 20 nt, Human
cuuucacccuuuucuguuug

SEQ ID NO: 1894343 - RNA, 19 nt, Human
cuugugacuagugcugaag

SEQ ID NO: 1894344 - RNA, 18 nt, Human
cuugugacuagugcugaa

SEQ ID NO: 1894345 - RNA, 17 nt, Human
cuugugacuagugcuga

SEQ ID NO: 1894346 - RNA, 16 nt, Human
cuugugacuagugcug

SEQ ID NO: 1894347 - RNA, 15 nt, Human
cuugugacuagugcu

SEQ ID NO: 1894348 - RNA, 14 nt, Human
cuugugacuagugc

SEQ ID NO: 1894349 - RNA, 13 nt, Human
cuugucuuuggac

SEQ ID NO: 1894350 - RNA, 15 nt, Human
cuugucuuuggaccc

SEQ ID NO: 1894351 - RNA, 18 nt, Human
cuugucuuuggacccuga

SEQ ID NO: 1894352 - RNA, 19 nt, Human
cuugucuuuggacccugag

SEQ ID NO: 1894353 - RNA, 19 nt, Human
cuuggugucgggcaugaca

SEQ ID NO: 1894354 - RNA, 20 nt, Human
cuuggugucgggcaugacac

SEQ ID NO: 1894355 - RNA, 17 nt, Human
cuugggucccagggaag

SEQ ID NO: 1894356 - RNA, 23 nt, Human
cuuggguucaagugauucuccug

SEQ ID NO: 1894357 - RNA, 22 nt, Human
cuugguagaagcccuucuaccu

SEQ ID NO: 1894358 - RNA, 14 nt, Human
cuugguccugcugc

SEQ ID NO: 1894359 - RNA, 16 nt, Human
cuuggucugugagaug

SEQ ID NO: 1894360 - RNA, 19 nt, Human
cuuggucugugagaugcua

SEQ ID NO: 1894361 - RNA, 18 nt, Human
cuucuucagagacuccug

SEQ ID NO: 1894362 - RNA, 13 nt, Human
cuucuucagagac

SEQ ID NO: 1894363 - RNA, 14 nt, Human
cuucuucagagacu

SEQ ID NO: 1894364 - RNA, 20 nt, Human
cuucuuaaucuuuucacaaa

SEQ ID NO: 1894365 - RNA, 17 nt, Human
cuucuuaaucuuuucac

SEQ ID NO: 1894366 - RNA, 16 nt, Human
cuucuuaaucuuuuca

SEQ ID NO: 1894367 - RNA, 22 nt, Human
cuucuuaaucuuuucacaaaua

SEQ ID NO: 1894368 - RNA, 21 nt, Human
cuucuuaaucuuuucacaaau

SEQ ID NO: 1894369 - RNA, 23 nt, Human
cuucuuaaucuuuucacaaauaa

SEQ ID NO: 1894370 - RNA, 16 nt, Human
cuucuagguucuaaaa

SEQ ID NO: 1894371 - RNA, 21 nt, Human
cuucuaggguuauugcauuug

SEQ ID NO: 1894372 - RNA, 23 nt, Human
cuucuaaagguguugucccuucu

SEQ ID NO: 1894373 - RNA, 20 nt, Human
cuucucacauuuauauuuuu

SEQ ID NO: 1894374 - RNA, 13 nt, Human
cuucucacauuua

SEQ ID NO: 1894375 - RNA, 22 nt, Human
cuucucugugaacgauuuagaa

SEQ ID NO: 1894376 - RNA, 21 nt, Human
cuucucugugaacgauuuaga

SEQ ID NO: 1894377 - RNA, 13 nt, Human
cuuccuccuggug

SEQ ID NO: 1894378 - RNA, 22 nt, Human
cuuccucuuuccaucuacccuc

SEQ ID NO: 1894379 - RNA, 16 nt, Human
cuuccucucuccagau

SEQ ID NO: 1894380 - RNA, 21 nt, Human
cuuccucuuuccaucuacccu

SEQ ID NO: 1894381 - RNA, 15 nt, Human
cuuccucucuccaga

SEQ ID NO: 1894382 - RNA, 23 nt, Human
cuuggauuguccccgacccuugc

SEQ ID NO: 1894383 - RNA, 24 nt, Human
cuuggauuguccccgacccuugcc

SEQ ID NO: 1894384 - RNA, 17 nt, Human
cuuggccugaucagacc

SEQ ID NO: 1894385 - RNA, 12 nt, Human
cuugcaaaguau

SEQ ID NO: 1894386 - RNA, 12 nt, Human
cuugauucauaa

SEQ ID NO: 1894387 - RNA, 13 nt, Human
cuugaagggccag

SEQ ID NO: 1894388 - RNA, 14 nt, Human
cuugaagggccaga

SEQ ID NO: 1894389 - RNA, 15 nt, Human
cuugaagggccagag

SEQ ID NO: 1894390 - RNA, 16 nt, Human
cuugaagggccagagc

SEQ ID NO: 1894391 - RNA, 17 nt, Human
cuugaagggccagagcc

SEQ ID NO: 1894392 - RNA, 18 nt, Human
cuugaagggccagagcca

SEQ ID NO: 1894393 - RNA, 19 nt, Human
cuugaagggccagagccag

SEQ ID NO: 1894394 - RNA, 21 nt, Human
cuugaagggccagagccaggg

SEQ ID NO: 1894395 - RNA, 20 nt, Human
cuugaauugcauuuuuuaaa

SEQ ID NO: 1894396 - RNA, 16 nt, Human
cuugacaucaacugca

SEQ ID NO: 1894397 - RNA, 20 nt, Human
cuugaauguggcuugagaaa

SEQ ID NO: 1894398 - RNA, 19 nt, Human
cuugaauguggcuugagaa

SEQ ID NO: 1894399 - RNA, 22 nt, Human
cuugaauguggcuugagaaaua

SEQ ID NO: 1894400 - RNA, 11 nt, Human
cuugaagucag

SEQ ID NO: 1894401 - RNA, 20 nt, Human
cuugaagggccagagccagg

SEQ ID NO: 1894402 - RNA, 14 nt, Human
cuugaaggugcuga

SEQ ID NO: 1894403 - RNA, 22 nt, Human
cuugaaggugcugacggccagg

SEQ ID NO: 1894404 - RNA, 22 nt, Human
cuugauauccucuuugagugaa

SEQ ID NO: 1894405 - RNA, 17 nt, Human
cuugauauccucuuuga

SEQ ID NO: 1894406 - RNA, 17 nt, Human
cuugaucaacaucuuuu

SEQ ID NO: 1894407 - RNA, 23 nt, Human
cuugaucaacaucuuuucuugcc

SEQ ID NO: 1894408 - RNA, 18 nt, Human
cuugauguguuaucucuu

SEQ ID NO: 1894409 - RNA, 20 nt, Human
cuugauuaagaucucagugg

SEQ ID NO: 1894410 - RNA, 16 nt, Human
cuugauuauccauauu

SEQ ID NO: 1894411 - RNA, 19 nt, Human
gaaaacuuguauuaugugu

SEQ ID NO: 1894412 - RNA, 22 nt, Human
gaaaacuuguauuauguguguu

SEQ ID NO: 1894413 - RNA, 23 nt, Human
gaaaagaaaaaugagccuggcaa

SEQ ID NO: 1894414 - RNA, 21 nt, Human
gaaaacuuuaugcuaagugaa

SEQ ID NO: 1894415 - RNA, 23 nt, Human
gaaaagauuuuaaucaaguugaa

SEQ ID NO: 1894416 - RNA, 13 nt, Human
gaaaagauuuuaa

SEQ ID NO: 1894417 - RNA, 17 nt, Human
gaaaagauuuuaaucaa

SEQ ID NO: 1894418 - RNA, 15 nt, Human
gaaaauguuauuuaa

SEQ ID NO: 1894419 - RNA, 16 nt, Human
gaaaauguuauuuaac

SEQ ID NO: 1894420 - RNA, 15 nt, Human
gaaaauguugagaau

SEQ ID NO: 1894421 - RNA, 17 nt, Human
gaaaauguugagaaucc

SEQ ID NO: 1894422 - RNA, 20 nt, Human
gaaaauguugagaaucccaa

SEQ ID NO: 1894423 - RNA, 22 nt, Human
gaaaagaaaucuaugauuccag

SEQ ID NO: 1894424 - RNA, 21 nt, Human
gaaacaagucagucauucaga

SEQ ID NO: 1894425 - RNA, 14 nt, Human
gaaacaacuuggaa

SEQ ID NO: 1894426 - RNA, 15 nt, Human
gaaacaacagcuuua

SEQ ID NO: 1894427 - RNA, 21 nt, Human
gaaacaacagcuuuaaaagaa

SEQ ID NO: 1894428 - RNA, 17 nt, Human
gaaacuggauuaaacuu

SEQ ID NO: 1894429 - RNA, 13 nt, Human
gaaacuggauuaa

SEQ ID NO: 1894430 - RNA, 18 nt, Human
gaaagaaaaucaggcugg

SEQ ID NO: 1894431 - RNA, 13 nt, Human
gaaagggcccaga

SEQ ID NO: 1894432 - RNA, 16 nt, Human
gaaaggcuccaggagc

SEQ ID NO: 1894433 - RNA, 13 nt, Human
gaaaggcuccagg

SEQ ID NO: 1894434 - RNA, 14 nt, Human
gaaaggcuccagga

SEQ ID NO: 1894435 - RNA, 15 nt, Human
gaaaggcuccaggag

SEQ ID NO: 1894436 - RNA, 16 nt, Human
gaacacccuauauuuu

SEQ ID NO: 1894437 - RNA, 20 nt, Human
gaacaccauugaaggcuuaa

SEQ ID NO: 1894438 - RNA, 19 nt, Human
gaacaccauugaaggcuua

SEQ ID NO: 1894439 - RNA, 14 nt, Human
gaacacggccacau

SEQ ID NO: 1894440 - RNA, 22 nt, Human
gaacacggccacaucaaagagg

SEQ ID NO: 1894441 - RNA, 16 nt, Human
gaacaccauugaaggc

SEQ ID NO: 1894442 - RNA, 19 nt, Human
gaacacaaacuguaaauaa

SEQ ID NO: 1894443 - RNA, 19 nt, Human
gaacaauauugacuuuguc

SEQ ID NO: 1894444 - RNA, 20 nt, Human
gaacaauauugacuuugucu

SEQ ID NO: 1894445 - RNA, 17 nt, Human
gaacacaaacuguaaau

SEQ ID NO: 1894446 - RNA, 16 nt, Human
gaaagggcccagagag

SEQ ID NO: 1894447 - RNA, 15 nt, Human
gaaagggcccagaga

SEQ ID NO: 1894448 - RNA, 13 nt, Human
gaaaggggagccc

SEQ ID NO: 1894449 - RNA, 15 nt, Human
gaaaggggagcccac

SEQ ID NO: 1894450 - RNA, 16 nt, Human
gaaaggggagcccacu

SEQ ID NO: 1894451 - RNA, 18 nt, Human
gaaaucuaugauuccagg

SEQ ID NO: 1894452 - RNA, 20 nt, Human
gaaaucuaugauuccaggug

SEQ ID NO: 1894453 - RNA, 20 nt, Human
gaaaggggcaguuuaaagca

SEQ ID NO: 1894454 - RNA, 14 nt, Human
gaacaaagcagcca

SEQ ID NO: 1894455 - RNA, 15 nt, Human
gaacaaagcagccac

SEQ ID NO: 1894456 - RNA, 16 nt, Human
gaacaaagcagccacg

SEQ ID NO: 1894457 - RNA, 19 nt, Human
gaacaaagcagccacgagg

SEQ ID NO: 1894458 - RNA, 11 nt, Human
gaaaugaaaaa

SEQ ID NO: 1894459 - RNA, 22 nt, Human
gaaccaccacacccagcccacu

SEQ ID NO: 1894460 - RNA, 21 nt, Human
gaaccaccacacccagcccac

SEQ ID NO: 1894461 - RNA, 20 nt, Human
gaaccaccacacccagccca

SEQ ID NO: 1894462 - RNA, 18 nt, Human
gaaccaccacacccagcc

SEQ ID NO: 1894463 - RNA, 17 nt, Human
gaaccccuucauccucu

SEQ ID NO: 1894464 - RNA, 22 nt, Human
gaaccccuggcuccaggccagg

SEQ ID NO: 1894465 - RNA, 20 nt, Human
gaaccccggggugcccacag

SEQ ID NO: 1894466 - RNA, 18 nt, Human
gaaccccuggcuccaggc

SEQ ID NO: 1894467 - RNA, 13 nt, Human
gaacccagacuca

SEQ ID NO: 1894468 - RNA, 16 nt, Human
gaacccagacucagac

SEQ ID NO: 1894469 - RNA, 17 nt, Human
gaacccagacucagaca

SEQ ID NO: 1894470 - RNA, 19 nt, Human
gaacccagacucagacauu

SEQ ID NO: 1894471 - RNA, 15 nt, Human
gaaccaggcuuggaa

SEQ ID NO: 1894472 - RNA, 19 nt, Human
gaaccaguccccccacccu

SEQ ID NO: 1894473 - RNA, 22 nt, Human
gaaccauggucggaaaacaugc

SEQ ID NO: 1894474 - RNA, 16 nt, Human
gaaccauguuuguggc

SEQ ID NO: 1894475 - RNA, 23 nt, Human
gaaccaccacacccagcccacuu

SEQ ID NO: 1894476 - RNA, 20 nt, Human
gaacucuuaaucaaauagca

SEQ ID NO: 1894477 - RNA, 13 nt, Human
gaacucuuaauca

SEQ ID NO: 1894478 - RNA, 14 nt, Human
gaacuccuggccuc

SEQ ID NO: 1894479 - RNA, 15 nt, Human
gaacuccuggccuca

SEQ ID NO: 1894480 - RNA, 13 nt, Human
gaacuccuggccu

SEQ ID NO: 1894481 - RNA, 15 nt, Human
gaacuccugaccuca

SEQ ID NO: 1894482 - RNA, 19 nt, Human
gaacccgggaggcagaggu

SEQ ID NO: 1894483 - RNA, 17 nt, Human
gaacccgggaggcagag

SEQ ID NO: 1894484 - RNA, 14 nt, Human
gaacugagcuugga

SEQ ID NO: 1894485 - RNA, 22 nt, Human
gaacugagcuuggaagcuucug

SEQ ID NO: 1894486 - RNA, 21 nt, Human
gaacugagcuuggaagcuucu

SEQ ID NO: 1894487 - RNA, 16 nt, Human
gaacugagcuuggaag

SEQ ID NO: 1894488 - RNA, 15 nt, Human
gaacugagcuuggaa

SEQ ID NO: 1894489 - RNA, 17 nt, Human
gaacugauguaaguaaa

SEQ ID NO: 1894490 - RNA, 16 nt, Human
gaagacucauucuucu

SEQ ID NO: 1894491 - RNA, 18 nt, Human
gaagacucauucuucugu

SEQ ID NO: 1894492 - RNA, 17 nt, Human
gaagacucauucuucug

SEQ ID NO: 1894493 - RNA, 14 nt, Human
gaagcacagcuuca

SEQ ID NO: 1894494 - RNA, 13 nt, Human
gaagcacagcuuc

SEQ ID NO: 1894495 - RNA, 14 nt, Human
gaagcacaugccuc

SEQ ID NO: 1894496 - RNA, 17 nt, Human
gaagcacagugaucaag

SEQ ID NO: 1894497 - RNA, 22 nt, Human
gaagcacaugccucucucaggc

SEQ ID NO: 1894498 - RNA, 16 nt, Human
gaagcaccauaacuuu

SEQ ID NO: 1894499 - RNA, 12 nt, Human
gaagcagcucuu

SEQ ID NO: 1894500 - RNA, 12 nt, Human
gaagcagguucc

SEQ ID NO: 1894501 - RNA, 19 nt, Human
gaagcagguucccaagcuc

SEQ ID NO: 1894502 - RNA, 14 nt, Human
gaagacagcucuua

SEQ ID NO: 1894503 - RNA, 15 nt, Human
gaagacagcucuuau

SEQ ID NO: 1894504 - RNA, 14 nt, Human
gaagacauugcacc

SEQ ID NO: 1894505 - RNA, 19 nt, Human
gaagacccaacacauggga

SEQ ID NO: 1894506 - RNA, 20 nt, Human
gaagaccucaccuagaaauu

SEQ ID NO: 1894507 - RNA, 19 nt, Human
gaagaccucaccuagaaau

SEQ ID NO: 1894508 - RNA, 16 nt, Human
gaagacacugaugggc

SEQ ID NO: 1894509 - RNA, 15 nt, Human
gaacugcaugcugcu

SEQ ID NO: 1894510 - RNA, 21 nt, Human
gaagacacugaugggcaaccc

SEQ ID NO: 1894511 - RNA, 19 nt, Human
gaacugcaugcugcuggac

SEQ ID NO: 1894512 - RNA, 21 nt, Human
gaagacacugaaauauacaca

SEQ ID NO: 1894513 - RNA, 13 nt, Human
gaagacagagcua

SEQ ID NO: 1894514 - RNA, 15 nt, Human
gaagacagagcuaca

SEQ ID NO: 1894515 - RNA, 12 nt, Human
gaagacagcucu

SEQ ID NO: 1894516 - RNA, 13 nt, Human
gaagacagcucuu

SEQ ID NO: 1894517 - RNA, 17 nt, Human
gagaagcggcuggcagc

SEQ ID NO: 1894518 - RNA, 14 nt, Human
gacugugugcucag

SEQ ID NO: 1894519 - RNA, 16 nt, Human
gacugugugcucagga

SEQ ID NO: 1894520 - RNA, 17 nt, Human
gacugugugcucaggag

SEQ ID NO: 1894521 - RNA, 20 nt, Human
gacugugugcucaggagccc

SEQ ID NO: 1894522 - RNA, 22 nt, Human
gacuguacaaaguagaagucuu

SEQ ID NO: 1894523 - RNA, 14 nt, Human
gacucacaccugaa

SEQ ID NO: 1894524 - RNA, 23 nt, Human
gacucacaccugaacugaacacc

SEQ ID NO: 1894525 - RNA, 17 nt, Human
gacucaaugcacugaca

SEQ ID NO: 1894526 - RNA, 18 nt, Human
gacucacaaccugaaccu

SEQ ID NO: 1894527 - RNA, 19 nt, Human
gacucacaaccugaaccua

SEQ ID NO: 1894528 - RNA, 14 nt, Human
gacucaaugcacug

SEQ ID NO: 1894529 - RNA, 22 nt, Human
gacucaagauucccaggaguuc

SEQ ID NO: 1894530 - RNA, 22 nt, Human
gacuuuguuaguuucuccaagc

SEQ ID NO: 1894531 - RNA, 23 nt, Human
gacuuuucuguccgagcuuugaa

SEQ ID NO: 1894532 - RNA, 21 nt, Human
gacuuuucuguccgagcuuug

SEQ ID NO: 1894533 - RNA, 16 nt, Human
gacuguuuucucuuga

SEQ ID NO: 1894534 - RNA, 18 nt, Human
gacuguuuucucuugaga

SEQ ID NO: 1894535 - RNA, 14 nt, Human
gacuuuggaaagac

SEQ ID NO: 1894536 - RNA, 14 nt, Human
gacuuuggaaagag

SEQ ID NO: 1894537 - RNA, 19 nt, Human
gacuagugcugaagcuuau

SEQ ID NO: 1894538 - RNA, 23 nt, Human
gacuagugcugaagcuuauuaau

SEQ ID NO: 1894539 - RNA, 18 nt, Human
gacuagugcugaagcuua

SEQ ID NO: 1894540 - RNA, 17 nt, Human
gacuagugcugaagcuu

SEQ ID NO: 1894541 - RNA, 16 nt, Human
gacuagugcugaagcu

SEQ ID NO: 1894542 - RNA, 15 nt, Human
gacuagugcugaagc

SEQ ID NO: 1894543 - RNA, 14 nt, Human
gacuagugcugaag

SEQ ID NO: 1894544 - RNA, 13 nt, Human
gacuagugcugaa

SEQ ID NO: 1894545 - RNA, 12 nt, Human
gacuagugcuga

SEQ ID NO: 1894546 - RNA, 18 nt, Human
gacuauauuguacacacc

SEQ ID NO: 1894547 - RNA, 19 nt, Human
gacuauauuugggccugcu

SEQ ID NO: 1894548 - RNA, 21 nt, Human
gacuauauuugggccugcucc

SEQ ID NO: 1894549 - RNA, 15 nt, Human
gacuauggagcugag

SEQ ID NO: 1894550 - RNA, 18 nt, Human
gacucaaaguuucagaga

SEQ ID NO: 1894551 - RNA, 22 nt, Human
gacucaaaugcucagaccagcu

SEQ ID NO: 1894552 - RNA, 12 nt, Human
gacucaagauuc

SEQ ID NO: 1894553 - RNA, 16 nt, Human
gacucaagauucccag

SEQ ID NO: 1894554 - RNA, 17 nt, Human
gacucaagauucccagg

SEQ ID NO: 1894555 - RNA, 18 nt, Human
gacucaagauucccagga

SEQ ID NO: 1894556 - RNA, 19 nt, Human
gacucaagauucccaggag

SEQ ID NO: 1894557 - RNA, 20 nt, Human
gacucaagauucccaggagu

SEQ ID NO: 1894558 - RNA, 13 nt, Human
gacgcugugcugc

SEQ ID NO: 1894559 - RNA, 15 nt, Human
gacgcugugcugccc

SEQ ID NO: 1894560 - RNA, 12 nt, Human
gacgcuggcucc

SEQ ID NO: 1894561 - RNA, 12 nt, Human
gacgcugugcug

SEQ ID NO: 1894562 - RNA, 14 nt, Human
gacagaaagcagaa

SEQ ID NO: 1894563 - RNA, 16 nt, Human
gacacuccccgaaguc

SEQ ID NO: 1894564 - RNA, 21 nt, Human
gacacuccccgaagucuuuug

SEQ ID NO: 1894565 - RNA, 20 nt, Human
gacagaaagcagaacaguga

SEQ ID NO: 1894566 - RNA, 15 nt, Human
gacagcuccuucugu

SEQ ID NO: 1894567 - RNA, 14 nt, Human
gacagcuccuucug

SEQ ID NO: 1894568 - RNA, 13 nt, Human
gacagcuccuucu

SEQ ID NO: 1894569 - RNA, 20 nt, Human
gacaggggcaggaggaaggg

SEQ ID NO: 1894570 - RNA, 18 nt, Human
gacaggggcaggaggaag

SEQ ID NO: 1894571 - RNA, 22 nt, Human
gaagcauggugcccuggcuucu

SEQ ID NO: 1894572 - RNA, 20 nt, Human
gacaguauggcagcuuuccu

SEQ ID NO: 1894573 - RNA, 17 nt, Human
gacaggguuucaccaug

SEQ ID NO: 1894574 - RNA, 19 nt, Human
gacagguuugggaccccug

SEQ ID NO: 1894575 - RNA, 22 nt, Human
gacagguuugggaccccuggug

SEQ ID NO: 1894576 - RNA, 17 nt, Human
gacaguaucacugucuu

SEQ ID NO: 1894577 - RNA, 21 nt, Human
gacaguaucacugucuuuccu

SEQ ID NO: 1894578 - RNA, 23 nt, Human
gaccaggcauccuccacaauagc

SEQ ID NO: 1894579 - RNA, 14 nt, Human
gaccaucccugaag

SEQ ID NO: 1894580 - RNA, 15 nt, Human
gaccaucccugaagg

SEQ ID NO: 1894581 - RNA, 15 nt, Human
gaccauaauguuaca

SEQ ID NO: 1894582 - RNA, 16 nt, Human
gaccaucccugaaggc

SEQ ID NO: 1894583 - RNA, 17 nt, Human
gaccaucccugaaggcc

SEQ ID NO: 1894584 - RNA, 16 nt, Human
gaccauucuccaccug

SEQ ID NO: 1894585 - RNA, 17 nt, Human
gaccauucuccaccugc

SEQ ID NO: 1894586 - RNA, 13 nt, Human
gacccggcugcgu

SEQ ID NO: 1894587 - RNA, 12 nt, Human
gacccggcugcg

SEQ ID NO: 1894588 - RNA, 16 nt, Human
gacccuauugcugcuu

SEQ ID NO: 1894589 - RNA, 14 nt, Human
gacccguccauuug

SEQ ID NO: 1894590 - RNA, 18 nt, Human
gagguggaauuauuuuaa

SEQ ID NO: 1894591 - RNA, 19 nt, Human
gagguggagguugcaguga

SEQ ID NO: 1894592 - RNA, 17 nt, Human
gaggugggauccuccag

SEQ ID NO: 1894593 - RNA, 14 nt, Human
gagucacuggaaca

SEQ ID NO: 1894594 - RNA, 21 nt, Human
gagucacuggaacacuaauga

SEQ ID NO: 1894595 - RNA, 15 nt, Human
gaggugggauccucc

SEQ ID NO: 1894596 - RNA, 16 nt, Human
gaggugggauccucca

SEQ ID NO: 1894597 - RNA, 13 nt, Human
gaggugggauccu

SEQ ID NO: 1894598 - RNA, 20 nt, Human
gagguggcugagccccuguc

SEQ ID NO: 1894599 - RNA, 18 nt, Human
gagugcagugagccgaga

SEQ ID NO: 1894600 - RNA, 13 nt, Human
gagugcagugagc

SEQ ID NO: 1894601 - RNA, 22 nt, Human
gaguugauacuacaguuuguua

SEQ ID NO: 1894602 - RNA, 21 nt, Human
gaguugauagcacagacccug

SEQ ID NO: 1894603 - RNA, 19 nt, Human
gaguugauacuacaguuug

SEQ ID NO: 1894604 - RNA, 23 nt, Human
gagugccccauucuuuuguaauu

SEQ ID NO: 1894605 - RNA, 18 nt, Human
gagugagacucugucuca

SEQ ID NO: 1894606 - RNA, 14 nt, Human
gagugagacucugu

SEQ ID NO: 1894607 - RNA, 14 nt, Human
gaguccaagcuggg

SEQ ID NO: 1894608 - RNA, 12 nt, Human
gaguccaagcug

SEQ ID NO: 1894609 - RNA, 18 nt, Human
gagucagaaguuucugcc

SEQ ID NO: 1894610 - RNA, 18 nt, Human
gagucauucguucugugg

SEQ ID NO: 1894611 - RNA, 20 nt, Human
gaggccagagacacaagccu

SEQ ID NO: 1894612 - RNA, 12 nt, Human
gaggcucugccc

SEQ ID NO: 1894613 - RNA, 13 nt, Human
gaggcucugcccu

SEQ ID NO: 1894614 - RNA, 14 nt, Human
gaggcucugcccuu

SEQ ID NO: 1894615 - RNA, 14 nt, Human
gaggcucuggagcc

SEQ ID NO: 1894616 - RNA, 19 nt, Human
gaggcucuggagcccacug

SEQ ID NO: 1894617 - RNA, 15 nt, Human
gaggcucugcccuug

SEQ ID NO: 1894618 - RNA, 17 nt, Human
gaggcucugcccuuggu

SEQ ID NO: 1894619 - RNA, 14 nt, Human
gaggcugccucucc

SEQ ID NO: 1894620 - RNA, 12 nt, Human
gaggggaacaga

SEQ ID NO: 1894621 - RNA, 12 nt, Human
gagggcuccaga

SEQ ID NO: 1894622 - RNA, 13 nt, Human
gagggcuccagac

SEQ ID NO: 1894623 - RNA, 14 nt, Human
gagggcuccagaca

SEQ ID NO: 1894624 - RNA, 15 nt, Human
gagggcuccagacac

SEQ ID NO: 1894625 - RNA, 19 nt, Human
gagcugccuguucagcucc

SEQ ID NO: 1894626 - RNA, 16 nt, Human
gagcugccuguucagc

SEQ ID NO: 1894627 - RNA, 15 nt, Human
gagcugccuguucag

SEQ ID NO: 1894628 - RNA, 17 nt, Human
gagcggagaaaggaagg

SEQ ID NO: 1894629 - RNA, 20 nt, Human
gagcugccuguucagcucca

SEQ ID NO: 1894630 - RNA, 20 nt, Human
gagcugugcaucagcuagaa

SEQ ID NO: 1894631 - RNA, 17 nt, Human
gagcaucaggccaggcc

SEQ ID NO: 1894632 - RNA, 12 nt, Human
gagccuuccagg

SEQ ID NO: 1894633 - RNA, 13 nt, Human
gagccuuccaggg

SEQ ID NO: 1894634 - RNA, 15 nt, Human
gagcgacagugagac

SEQ ID NO: 1894635 - RNA, 13 nt, Human
gagcgacagugag

SEQ ID NO: 1894636 - RNA, 23 nt, Human
gagcgcuccugccgcagagcugg

SEQ ID NO: 1894637 - RNA, 22 nt, Human
gagcgcuccugccgcagagcug

SEQ ID NO: 1894638 - RNA, 21 nt, Human
gagcgcuccugccgcagagcu

SEQ ID NO: 1894639 - RNA, 15 nt, Human
gagcgcuccugccgc

SEQ ID NO: 1894640 - RNA, 20 nt, Human
gagcaucaggccaggcccuc

SEQ ID NO: 1894641 - RNA, 22 nt, Human
gagcaucaggccaggcccucug

SEQ ID NO: 1894642 - RNA, 18 nt, Human
gagcagugggccuggcca

SEQ ID NO: 1894643 - RNA, 17 nt, Human
gagcagugggccuggcc

SEQ ID NO: 1894644 - RNA, 15 nt, Human
gagcagugggccugg

SEQ ID NO: 1894645 - RNA, 19 nt, Human
gagaagcuccucuccccag

SEQ ID NO: 1894646 - RNA, 21 nt, Human
gagaagcucucgggcuaggaa

SEQ ID NO: 1894647 - RNA, 22 nt, Human
gagaagcuccucuccccagccc

SEQ ID NO: 1894648 - RNA, 22 nt, Human
gcacuauagccuaggugacaga

SEQ ID NO: 1894649 - RNA, 17 nt, Human
gcacuccagccugggug

SEQ ID NO: 1894650 - RNA, 12 nt, Human
gcacuccccugc

SEQ ID NO: 1894651 - RNA, 12 nt, Human
gcaccuccugcc

SEQ ID NO: 1894652 - RNA, 20 nt, Human
gcacacaccagagcccaccu

SEQ ID NO: 1894653 - RNA, 11 nt, Human
gcacacauuuu

SEQ ID NO: 1894654 - RNA, 13 nt, Human
gcacacagggcag

SEQ ID NO: 1894655 - RNA, 12 nt, Human
gcacacauuuuu

SEQ ID NO: 1894656 - RNA, 21 nt, Human
gcaccuacaguguacagucuu

SEQ ID NO: 1894657 - RNA, 19 nt, Human
gcaccuacaguguacaguc

SEQ ID NO: 1894658 - RNA, 18 nt, Human
gcaccuacaguguacagu

SEQ ID NO: 1894659 - RNA, 22 nt, Human
gcaccuaauccaggcagaucca

SEQ ID NO: 1894660 - RNA, 23 nt, Human
gcaccuaauccaggcagauccag

SEQ ID NO: 1894661 - RNA, 17 nt, Human
gcaccggcuggccuggc

SEQ ID NO: 1894662 - RNA, 17 nt, Human
gcaccuaauccaggcag

SEQ ID NO: 1894663 - RNA, 18 nt, Human
gcaccuaauccaggcaga

SEQ ID NO: 1894664 - RNA, 15 nt, Human
gcaccggcuggccug

SEQ ID NO: 1894665 - RNA, 16 nt, Human
gcaccggcuggccugg

SEQ ID NO: 1894666 - RNA, 11 nt, Human
gcaauaaagca

SEQ ID NO: 1894667 - RNA, 21 nt, Human
gcaauaaagcagcguuucuau

SEQ ID NO: 1894668 - RNA, 19 nt, Human
gcacacaccagagcccacc

SEQ ID NO: 1894669 - RNA, 18 nt, Human
gcacacaccagagcccac

SEQ ID NO: 1894670 - RNA, 17 nt, Human
gcacacaccagagccca

SEQ ID NO: 1894671 - RNA, 16 nt, Human
gcacacaccagagccc

SEQ ID NO: 1894672 - RNA, 15 nt, Human
gcacacaccagagcc

SEQ ID NO: 1894673 - RNA, 14 nt, Human
gcacacaccagagc

SEQ ID NO: 1894674 - RNA, 12 nt, Human
gcacacaccaga

SEQ ID NO: 1894675 - RNA, 18 nt, Human
gcaaccuccgccucuugg

SEQ ID NO: 1894676 - RNA, 22 nt, Human
gcaacccuggugaccagcacca

SEQ ID NO: 1894677 - RNA, 18 nt, Human
gcaacccccagccugcua

SEQ ID NO: 1894678 - RNA, 17 nt, Human
gcaacccccagccugcu

SEQ ID NO: 1894679 - RNA, 16 nt, Human
gcaaaagaugcuucuc

SEQ ID NO: 1894680 - RNA, 15 nt, Human
gcaaaagaugcuucu

SEQ ID NO: 1894681 - RNA, 19 nt, Human
gauucuccugccucagccu

SEQ ID NO: 1894682 - RNA, 21 nt, Human
gauucuccugccucagccucc

SEQ ID NO: 1894683 - RNA, 20 nt, Human
gauucuccugccucagccuc

SEQ ID NO: 1894684 - RNA, 11 nt, Human
gauucuccuuc

SEQ ID NO: 1894685 - RNA, 21 nt, Human
gauucuucugcuucagccucc

SEQ ID NO: 1894686 - RNA, 23 nt, Human
gauucuuauggacaaugacccag

SEQ ID NO: 1894687 - RNA, 23 nt, Human
gauuuaacagaaauguacagcaa

SEQ ID NO: 1894688 - RNA, 20 nt, Human
gauuuaacagaaauguacag

SEQ ID NO: 1894689 - RNA, 13 nt, Human
gauuucacucucc

SEQ ID NO: 1894690 - RNA, 16 nt, Human
gauuucacucuccuug

SEQ ID NO: 1894691 - RNA, 17 nt, Human
gauuucacucuccuugg

SEQ ID NO: 1894692 - RNA, 18 nt, Human
gauuucacucuccuuggu

SEQ ID NO: 1894693 - RNA, 22 nt, Human
gauuuuuuuuuccuucagugcc

SEQ ID NO: 1894694 - RNA, 23 nt, Human
gauuuuuuuuuccuucagugccu

SEQ ID NO: 1894695 - RNA, 15 nt, Human
gauuucaucugcucu

SEQ ID NO: 1894696 - RNA, 12 nt, Human
gauuucaucugc

SEQ ID NO: 1894697 - RNA, 15 nt, Human
gaugugauuguggaa

SEQ ID NO: 1894698 - RNA, 16 nt, Human
gaugugauuguggaau

SEQ ID NO: 1894699 - RNA, 18 nt, Human
gaugugauuguggaaugg

SEQ ID NO: 1894700 - RNA, 18 nt, Human
gaucuggguucacugcaa

SEQ ID NO: 1894701 - RNA, 22 nt, Human
gaguugauagcacagacccugc

SEQ ID NO: 1894702 - RNA, 23 nt, Human
gaucuggaaccucagccuggcca

SEQ ID NO: 1894703 - RNA, 20 nt, Human
gaucuggguucacugcaacc

SEQ ID NO: 1894704 - RNA, 17 nt, Human
gaucuggggcucuggga

SEQ ID NO: 1894705 - RNA, 18 nt, Human
gaucuggggcucugggau

SEQ ID NO: 1894706 - RNA, 23 nt, Human
gaugcuucucacugccaugccag

SEQ ID NO: 1894707 - RNA, 13 nt, Human
gaugcugugaaau

SEQ ID NO: 1894708 - RNA, 14 nt, Human
gaugaugacuaugg

SEQ ID NO: 1894709 - RNA, 19 nt, Human
gauggaguucuugugccau

SEQ ID NO: 1894710 - RNA, 18 nt, Human
gauggaguucuugugcca

SEQ ID NO: 1894711 - RNA, 16 nt, Human
gauggaguucuugugc

SEQ ID NO: 1894712 - RNA, 22 nt, Human
gauggaaaaaccacccccaaau

SEQ ID NO: 1894713 - RNA, 16 nt, Human
gaugcuuguacauaau

SEQ ID NO: 1894714 - RNA, 14 nt, Human
gaugcuuguacaua

SEQ ID NO: 1894715 - RNA, 19 nt, Human
gaugcugugaaauucccaa

SEQ ID NO: 1894716 - RNA, 19 nt, Human
gccaaggccaaaggaagca

SEQ ID NO: 1894717 - RNA, 17 nt, Human
gccaaggccaaaggaag

SEQ ID NO: 1894718 - RNA, 11 nt, Human
gccaaggccaa

SEQ ID NO: 1894719 - RNA, 21 nt, Human
gccaaggagcugcuauagccu

SEQ ID NO: 1894720 - RNA, 23 nt, Human
gccaaggagcugcuauagccugg

SEQ ID NO: 1894721 - RNA, 20 nt, Human
gccaaggagggugagugcaa

SEQ ID NO: 1894722 - RNA, 21 nt, Human
gccaaggagggugagugcaag

SEQ ID NO: 1894723 - RNA, 17 nt, Human
gccaagaggcugcagcc

SEQ ID NO: 1894724 - RNA, 11 nt, Human
gccaaggagcu

SEQ ID NO: 1894725 - RNA, 12 nt, Human
gccaaggagcug

SEQ ID NO: 1894726 - RNA, 13 nt, Human
gccaaggagcugc

SEQ ID NO: 1894727 - RNA, 14 nt, Human
gccaaggagcugcu

SEQ ID NO: 1894728 - RNA, 15 nt, Human
gccaaggagcugcua

SEQ ID NO: 1894729 - RNA, 16 nt, Human
gccaaggagcugcuau

SEQ ID NO: 1894730 - RNA, 20 nt, Human
gccaaggagcugcuauagcc

SEQ ID NO: 1894731 - RNA, 21 nt, Human
gcauccuggcacccggccccu

SEQ ID NO: 1894732 - RNA, 17 nt, Human
gcauccuggcacccggc

SEQ ID NO: 1894733 - RNA, 23 nt, Human
gcauccuggcacccggccccugc

SEQ ID NO: 1894734 - RNA, 22 nt, Human
gcauccuggcacccggccccug

SEQ ID NO: 1894735 - RNA, 15 nt, Human
gcauguaugucuugg

SEQ ID NO: 1894736 - RNA, 14 nt, Human
gcauguaugucuug

SEQ ID NO: 1894737 - RNA, 22 nt, Human
gcauguacccuaaggucauuac

SEQ ID NO: 1894738 - RNA, 19 nt, Human
gcaugggaaugaaugucag

SEQ ID NO: 1894739 - RNA, 13 nt, Human
gcaugggaaugaa

SEQ ID NO: 1894740 - RNA, 16 nt, Human
gcaugggaaugaaugu

SEQ ID NO: 1894741 - RNA, 17 nt, Human
gcaugugaugagaggaa

SEQ ID NO: 1894742 - RNA, 16 nt, Human
gcauuugaaaauuuug

SEQ ID NO: 1894743 - RNA, 14 nt, Human
gcauuugaaaauuu

SEQ ID NO: 1894744 - RNA, 15 nt, Human
gccaaccuauuuuga

SEQ ID NO: 1894745 - RNA, 23 nt, Human
gccaacccuucuccucuuguaaa

SEQ ID NO: 1894746 - RNA, 13 nt, Human
gccaacccuucuc

SEQ ID NO: 1894747 - RNA, 22 nt, Human
gccaacccuucuccucuuguaa

SEQ ID NO: 1894748 - RNA, 15 nt, Human
gcauuuaaaagauac

SEQ ID NO: 1894749 - RNA, 12 nt, Human
gcauuuaaaaga

SEQ ID NO: 1894750 - RNA, 22 nt, Human
gcauugugugugcagacuucag

SEQ ID NO: 1894751 - RNA, 21 nt, Human
gcauuuccuaucaccuauuuc

SEQ ID NO: 1894752 - RNA, 14 nt, Human
gccaacuauggccu

SEQ ID NO: 1894753 - RNA, 15 nt, Human
gccaacuauggccug

SEQ ID NO: 1894754 - RNA, 16 nt, Human
gccaaccuauuuugaa

SEQ ID NO: 1894755 - RNA, 19 nt, Human
gccaacuauggccugugga

SEQ ID NO: 1894756 - RNA, 14 nt, Human
gccaagaauucuua

SEQ ID NO: 1894757 - RNA, 18 nt, Human
gccaagaauucuuaaaua

SEQ ID NO: 1894758 - RNA, 15 nt, Human
gccaagaaacgucuu

SEQ ID NO: 1894759 - RNA, 21 nt, Human
gccaagaaacgucuucuaaac

SEQ ID NO: 1894760 - RNA, 22 nt, Human
gccaagaaacgucuucuaaacu

SEQ ID NO: 1894761 - RNA, 14 nt, Human
gccaagaggcugca

SEQ ID NO: 1894762 - RNA, 13 nt, Human
gccaagaggcugc

SEQ ID NO: 1894763 - RNA, 12 nt, Human
gccaagaggcug

SEQ ID NO: 1894764 - RNA, 16 nt, Human
gcacuuuguucuggcu

SEQ ID NO: 1894765 - RNA, 22 nt, Human
gcacugaagggauaugugaaac

SEQ ID NO: 1894766 - RNA, 17 nt, Human
gcacugaaaaaaaaucu

SEQ ID NO: 1894767 - RNA, 20 nt, Human
gcacucuuuaagggagugua

SEQ ID NO: 1894768 - RNA, 20 nt, Human
gcagcugcuuuugucuaugg

SEQ ID NO: 1894769 - RNA, 13 nt, Human
gcagcugcuuuug

SEQ ID NO: 1894770 - RNA, 23 nt, Human
gcagcugcgguccacccaggagc

SEQ ID NO: 1894771 - RNA, 22 nt, Human
gcagcugcgguccacccaggag

SEQ ID NO: 1894772 - RNA, 16 nt, Human
gcagcuugaggguugg

SEQ ID NO: 1894773 - RNA, 15 nt, Human
gcagcuuauucacaa

SEQ ID NO: 1894774 - RNA, 21 nt, Human
gcagcuugaggguugggcugg

SEQ ID NO: 1894775 - RNA, 19 nt, Human
gcagcuugaggguugggcu

SEQ ID NO: 1894776 - RNA, 22 nt, Human
gcaggcucgggcuccccagccc

SEQ ID NO: 1894777 - RNA, 12 nt, Human
gcaggcucucag

SEQ ID NO: 1894778 - RNA, 13 nt, Human
gcaggcucucagg

SEQ ID NO: 1894779 - RNA, 14 nt, Human
gcaggcucucaggc

SEQ ID NO: 1894780 - RNA, 15 nt, Human
gcaggcucucaggcc

SEQ ID NO: 1894781 - RNA, 16 nt, Human
gcaggcucucaggcca

SEQ ID NO: 1894782 - RNA, 22 nt, Human
gcagggaaacagcuaaugggac

SEQ ID NO: 1894783 - RNA, 18 nt, Human
gcaggcucucaggccagc

SEQ ID NO: 1894784 - RNA, 17 nt, Human
gcaggcucucaggccag

SEQ ID NO: 1894785 - RNA, 16 nt, Human
gcauaccacuuuuguu

SEQ ID NO: 1894786 - RNA, 15 nt, Human
gcauaccacuuuugu

SEQ ID NO: 1894787 - RNA, 22 nt, Human
gcagggacacgggcagccuggc

SEQ ID NO: 1894788 - RNA, 19 nt, Human
gcagggacacgggcagccu

SEQ ID NO: 1894789 - RNA, 18 nt, Human
gcagggacacgggcagcc

SEQ ID NO: 1894790 - RNA, 14 nt, Human
gcagggacaaagag

SEQ ID NO: 1894791 - RNA, 15 nt, Human
gcagggacaaagagg

SEQ ID NO: 1894792 - RNA, 21 nt, Human
gcagggacaaagaggccuuua

SEQ ID NO: 1894793 - RNA, 18 nt, Human
gcagguucccaagcucag

SEQ ID NO: 1894794 - RNA, 19 nt, Human
gcagguucccaagcucaga

SEQ ID NO: 1894795 - RNA, 13 nt, Human
gcagguucccaag

SEQ ID NO: 1894796 - RNA, 15 nt, Human
gcagguucccaagcu

SEQ ID NO: 1894797 - RNA, 16 nt, Human
gcagguucccaagcuc

SEQ ID NO: 1894798 - RNA, 15 nt, Human
gcauaaaaauuagcc

SEQ ID NO: 1894799 - RNA, 14 nt, Human
gcaguugccaguca

SEQ ID NO: 1894800 - RNA, 23 nt, Human
gcaguugccagucaccccggcca

SEQ ID NO: 1894801 - RNA, 17 nt, Human
gcucugaucauccacug

SEQ ID NO: 1894802 - RNA, 23 nt, Human
gcucugaucauccacugugccau

SEQ ID NO: 1894803 - RNA, 23 nt, Human
gcucugcaagaauugaagcagga

SEQ ID NO: 1894804 - RNA, 11 nt, Human
gcucugcccuu

SEQ ID NO: 1894805 - RNA, 15 nt, Human
gcuccacuuggucug

SEQ ID NO: 1894806 - RNA, 16 nt, Human
gcuccacccuggccga

SEQ ID NO: 1894807 - RNA, 19 nt, Human
gcuccacccuggccgaguc

SEQ ID NO: 1894808 - RNA, 17 nt, Human
gcucccggggcagggca

SEQ ID NO: 1894809 - RNA, 20 nt, Human
gcuccccucugcacggacca

SEQ ID NO: 1894810 - RNA, 18 nt, Human
gcucccccuccaccugcu

SEQ ID NO: 1894811 - RNA, 17 nt, Human
gcucccccuccaccugc

SEQ ID NO: 1894812 - RNA, 19 nt, Human
gcucccggggcagggcagc

SEQ ID NO: 1894813 - RNA, 20 nt, Human
gcucccggggcagggcagcc

SEQ ID NO: 1894814 - RNA, 17 nt, Human
gcuccugagggagcucc

SEQ ID NO: 1894815 - RNA, 19 nt, Human
gcuccugagggagcuccaa

SEQ ID NO: 1894816 - RNA, 14 nt, Human
gcuccuggcccacu

SEQ ID NO: 1894817 - RNA, 15 nt, Human
gcuccuggcccacug

SEQ ID NO: 1894818 - RNA, 20 nt, Human
gcuccuggcccacugcaucg

SEQ ID NO: 1894819 - RNA, 18 nt, Human
gcuccuggcccacugcau

SEQ ID NO: 1894820 - RNA, 19 nt, Human
gcuccuggcccacugcauc

SEQ ID NO: 1894821 - RNA, 13 nt, Human
gcucccaggacac

SEQ ID NO: 1894822 - RNA, 17 nt, Human
gcucccaggcauucccc

SEQ ID NO: 1894823 - RNA, 12 nt, Human
gcucccaggaca

SEQ ID NO: 1894824 - RNA, 18 nt, Human
gcuccagcucaccagccc

SEQ ID NO: 1894825 - RNA, 19 nt, Human
gcuccacuuggucugugag

SEQ ID NO: 1894826 - RNA, 18 nt, Human
gcuccacuuggucuguga

SEQ ID NO: 1894827 - RNA, 21 nt, Human
gcuccagcucaccagccccag

SEQ ID NO: 1894828 - RNA, 20 nt, Human
gcuccagcucaccagcccca

SEQ ID NO: 1894829 - RNA, 13 nt, Human
gcuaugcauuuga

SEQ ID NO: 1894830 - RNA, 19 nt, Human
gcuauucaguaauaacucu

SEQ ID NO: 1894831 - RNA, 12 nt, Human
gcuaugcauuug

SEQ ID NO: 1894832 - RNA, 14 nt, Human
gcuaugagggccuu

SEQ ID NO: 1894833 - RNA, 21 nt, Human
gcuagugugguguuuccuggc

SEQ ID NO: 1894834 - RNA, 22 nt, Human
gcuagugugguguuuccuggca

SEQ ID NO: 1894835 - RNA, 23 nt, Human
gcuaggccuggccagaugcacca

SEQ ID NO: 1894836 - RNA, 17 nt, Human
gcuaggccuggccagau

SEQ ID NO: 1894837 - RNA, 16 nt, Human
gcuaggccuggccaga

SEQ ID NO: 1894838 - RNA, 20 nt, Human
gcuauucaguaauaacucua

SEQ ID NO: 1894839 - RNA, 22 nt, Human
gcuauugauauaaauaaaacau

SEQ ID NO: 1894840 - RNA, 17 nt, Human
gcuauuugcaauuccug

SEQ ID NO: 1894841 - RNA, 19 nt, Human
gcuauuugcaauuccugcu

SEQ ID NO: 1894842 - RNA, 22 nt, Human
gcuauuuuuauuuguuugugca

SEQ ID NO: 1894843 - RNA, 14 nt, Human
gcucacugcagccu

SEQ ID NO: 1894844 - RNA, 13 nt, Human
gcucacugcagcc

SEQ ID NO: 1894845 - RNA, 12 nt, Human
gcucacugcagc

SEQ ID NO: 1894846 - RNA, 11 nt, Human
gcucacugcag

SEQ ID NO: 1894847 - RNA, 16 nt, Human
gcucacugcagccuca

SEQ ID NO: 1894848 - RNA, 15 nt, Human
gcucacugcagccuc

SEQ ID NO: 1894849 - RNA, 17 nt, Human
gcucacugcagccucaa

SEQ ID NO: 1894850 - RNA, 17 nt, Human
gcucaggugucccugca

SEQ ID NO: 1894851 - RNA, 16 nt, Human
gcucaggugucccugc

SEQ ID NO: 1894852 - RNA, 14 nt, Human
gcucaggugucccu

SEQ ID NO: 1894853 - RNA, 23 nt, Human
gcucagguggggucacucuggca

SEQ ID NO: 1894854 - RNA, 15 nt, Human
gcucagggaaaagca

SEQ ID NO: 1894855 - RNA, 17 nt, Human
gcucagggaaaagcagc

SEQ ID NO: 1894856 - RNA, 14 nt, Human
gcucaggaucucuu

SEQ ID NO: 1894857 - RNA, 18 nt, Human
gcucaggaucucuuagca

SEQ ID NO: 1894858 - RNA, 14 nt, Human
gcucagagagggug

SEQ ID NO: 1894859 - RNA, 17 nt, Human
gcucaggacagaugcca

SEQ ID NO: 1894860 - RNA, 20 nt, Human
gcucaggacagaugccacac

SEQ ID NO: 1894861 - RNA, 16 nt, Human
gcucagacauguuuuc

SEQ ID NO: 1894862 - RNA, 13 nt, Human
gcucagagagggu

SEQ ID NO: 1894863 - RNA, 21 nt, Human
gcucagacauguuuuccguga

SEQ ID NO: 1894864 - RNA, 16 nt, Human
gcucagaccagcucuu

SEQ ID NO: 1894865 - RNA, 18 nt, Human
gcuagaacucccuuucaa

SEQ ID NO: 1894866 - RNA, 16 nt, Human
gcuagaacucccuuuc

SEQ ID NO: 1894867 - RNA, 15 nt, Human
gcuagaacucccuuu

SEQ ID NO: 1894868 - RNA, 14 nt, Human
gcuagaacucccuu

SEQ ID NO: 1894869 - RNA, 13 nt, Human
gcuagaacucccu

SEQ ID NO: 1894870 - RNA, 12 nt, Human
gcuagaacuccc

SEQ ID NO: 1894871 - RNA, 22 nt, Human
gcgugguguggagugugugucu

SEQ ID NO: 1894872 - RNA, 19 nt, Human
gcgugcagggacaaagagg

SEQ ID NO: 1894873 - RNA, 23 nt, Human
gcgugcacacaccagagcccacc

SEQ ID NO: 1894874 - RNA, 18 nt, Human
gcgugcagggacaaagag

SEQ ID NO: 1894875 - RNA, 19 nt, Human
gcgugcacacaccagagcc

SEQ ID NO: 1894876 - RNA, 18 nt, Human
gcguuucuaugacacaug

SEQ ID NO: 1894877 - RNA, 22 nt, Human
gcguuugaccuuuuauguagua

SEQ ID NO: 1894878 - RNA, 20 nt, Human
gcgugcacacaccagagccc

SEQ ID NO: 1894879 - RNA, 22 nt, Human
gcgggaggauguucugggacac

SEQ ID NO: 1894880 - RNA, 21 nt, Human
gcgggaggauguucugggaca

SEQ ID NO: 1894881 - RNA, 20 nt, Human
gcgggaggauguucugggac

SEQ ID NO: 1894882 - RNA, 21 nt, Human
gcuaauaaaauaucauucagc

SEQ ID NO: 1894883 - RNA, 20 nt, Human
gcuaauaaaauaucauucag

SEQ ID NO: 1894884 - RNA, 19 nt, Human
gcuaauaaaauaucauuca

SEQ ID NO: 1894885 - RNA, 18 nt, Human
gcuaauaaaauaucauuc

SEQ ID NO: 1894886 - RNA, 23 nt, Human
gcuaauaaaauaucauucagcaa

SEQ ID NO: 1894887 - RNA, 17 nt, Human
gcuaauaaaauaucauu

SEQ ID NO: 1894888 - RNA, 14 nt, Human
gcuaauaaaauauc

SEQ ID NO: 1894889 - RNA, 23 nt, Human
gcuaagugauccucccaccucag

SEQ ID NO: 1894890 - RNA, 13 nt, Human
gcuaaugggacac

SEQ ID NO: 1894891 - RNA, 15 nt, Human
gcuaaugggacacua

SEQ ID NO: 1894892 - RNA, 22 nt, Human
gcuaauucuuugaccuguuggg

SEQ ID NO: 1894893 - RNA, 15 nt, Human
gccugcccaggcccc

SEQ ID NO: 1894894 - RNA, 22 nt, Human
gccugcccaggccccugccacc

SEQ ID NO: 1894895 - RNA, 21 nt, Human
gccuccagggcuggacugagg

SEQ ID NO: 1894896 - RNA, 23 nt, Human
gccuccagggcuggacugaggcc

SEQ ID NO: 1894897 - RNA, 22 nt, Human
gccuccagggcuggacugaggc

SEQ ID NO: 1894898 - RNA, 24 nt, Human
gccuccagggcuggacugaggccu

SEQ ID NO: 1894899 - RNA, 15 nt, Human
gccuccaucagcuaa

SEQ ID NO: 1894900 - RNA, 12 nt, Human
gccuccauccug

SEQ ID NO: 1894901 - RNA, 17 nt, Human
gccucccaaagugcugg

SEQ ID NO: 1894902 - RNA, 16 nt, Human
gccucccaaagugcug

SEQ ID NO: 1894903 - RNA, 14 nt, Human
gccuccauccuagu

SEQ ID NO: 1894904 - RNA, 23 nt, Human
gccuccugugugugcgccuacag

SEQ ID NO: 1894905 - RNA, 19 nt, Human
gccuccugugugugcgccu

SEQ ID NO: 1894906 - RNA, 17 nt, Human
gccucgaacuggcugca

SEQ ID NO: 1894907 - RNA, 22 nt, Human
gccucgaacuggcugcaaaggg

SEQ ID NO: 1894908 - RNA, 20 nt, Human
gccucgaacuggcugcaaag

SEQ ID NO: 1894909 - RNA, 17 nt, Human
gccucgacacagagugg

SEQ ID NO: 1894910 - RNA, 17 nt, Human
gccucuuaugggcuggg

SEQ ID NO: 1894911 - RNA, 18 nt, Human
gccucuuaugggcugggu

SEQ ID NO: 1894912 - RNA, 16 nt, Human
gccucuuaugggcugg

SEQ ID NO: 1894913 - RNA, 14 nt, Human
gccugcccaggccc

SEQ ID NO: 1894914 - RNA, 13 nt, Human
gccugcccaggcc

SEQ ID NO: 1894915 - RNA, 14 nt, Human
gccucuuggguuca

SEQ ID NO: 1894916 - RNA, 21 nt, Human
gccucuuaugggcuggguucu

SEQ ID NO: 1894917 - RNA, 22 nt, Human
gcgaucuggguucacugcaacc

SEQ ID NO: 1894918 - RNA, 20 nt, Human
gcgcagcauauucaggaagc

SEQ ID NO: 1894919 - RNA, 22 nt, Human
gcgcacugugacccccagcucc

SEQ ID NO: 1894920 - RNA, 15 nt, Human
gcgcaccgaaaaacu

SEQ ID NO: 1894921 - RNA, 13 nt, Human
gcgcacugccucu

SEQ ID NO: 1894922 - RNA, 15 nt, Human
gcgagcccugguggc

SEQ ID NO: 1894923 - RNA, 17 nt, Human
gcgagcccugguggcag

SEQ ID NO: 1894924 - RNA, 14 nt, Human
gccuugccagagau

SEQ ID NO: 1894925 - RNA, 13 nt, Human
gccuugccagaga

SEQ ID NO: 1894926 - RNA, 17 nt, Human
gccuugccagagaucca

SEQ ID NO: 1894927 - RNA, 17 nt, Human
gccuugaccauucucca

SEQ ID NO: 1894928 - RNA, 19 nt, Human
gccuugaccauucuccacc

SEQ ID NO: 1894929 - RNA, 20 nt, Human
gccuugaccauucuccaccu

SEQ ID NO: 1894930 - RNA, 21 nt, Human
gccuugaccauucuccaccug

SEQ ID NO: 1894931 - RNA, 21 nt, Human
gccuguugggccaggagccuc

SEQ ID NO: 1894932 - RNA, 20 nt, Human
gccuucggccuccauccuga

SEQ ID NO: 1894933 - RNA, 23 nt, Human
gccuucggccuccauccugaggc

SEQ ID NO: 1894934 - RNA, 21 nt, Human
gccuucggccuccauccugag

SEQ ID NO: 1894935 - RNA, 13 nt, Human
gccuggcucaggu

SEQ ID NO: 1894936 - RNA, 16 nt, Human
gccugugccucuggga

SEQ ID NO: 1894937 - RNA, 17 nt, Human
gccugugccucugggac

SEQ ID NO: 1894938 - RNA, 18 nt, Human
gccugugccucugggacu

SEQ ID NO: 1894939 - RNA, 14 nt, Human
gccuguugggccag

SEQ ID NO: 1894940 - RNA, 15 nt, Human
gccuguugggccagg

SEQ ID NO: 1894941 - RNA, 16 nt, Human
gccuguugggccagga

SEQ ID NO: 1894942 - RNA, 18 nt, Human
gccuguugggccaggagc

SEQ ID NO: 1894943 - RNA, 20 nt, Human
gccuguugggccaggagccu

SEQ ID NO: 1894944 - RNA, 13 nt, Human
gccuggccugagc

SEQ ID NO: 1894945 - RNA, 14 nt, Human
gccuggccugagcu

SEQ ID NO: 1894946 - RNA, 18 nt, Human
gccuggccugagcuggga

SEQ ID NO: 1894947 - RNA, 20 nt, Human
gccuggccugagcugggaug

SEQ ID NO: 1894948 - RNA, 16 nt, Human
gccuggccuggcacac

SEQ ID NO: 1894949 - RNA, 13 nt, Human
gccuggccuggca

SEQ ID NO: 1894950 - RNA, 12 nt, Human
gcccccacuggu

SEQ ID NO: 1894951 - RNA, 12 nt, Human
gcccccacugac

SEQ ID NO: 1894952 - RNA, 17 nt, Human
gcccccacugaccagaa

SEQ ID NO: 1894953 - RNA, 17 nt, Human
gcccccaccgugggcag

SEQ ID NO: 1894954 - RNA, 18 nt, Human
gcccccaccgugggcagg

SEQ ID NO: 1894955 - RNA, 20 nt, Human
gcccccaccgugggcaggga

SEQ ID NO: 1894956 - RNA, 22 nt, Human
gcccccaccgugggcagggagc

SEQ ID NO: 1894957 - RNA, 16 nt, Human
gccccugccacccugg

SEQ ID NO: 1894958 - RNA, 17 nt, Human
gccccugccacccuggg

SEQ ID NO: 1894959 - RNA, 15 nt, Human
gcccccccuuccacu

SEQ ID NO: 1894960 - RNA, 16 nt, Human
gccccugccagacccc

SEQ ID NO: 1894961 - RNA, 11 nt, Human
gccccugccag

SEQ ID NO: 1894962 - RNA, 18 nt, Human
gcccccaucucaugcccc

SEQ ID NO: 1894963 - RNA, 16 nt, Human
gcccccccccaccccu

SEQ ID NO: 1894964 - RNA, 17 nt, Human
gcccccccccaccccug

SEQ ID NO: 1894965 - RNA, 13 nt, Human
gcccccccuucca

SEQ ID NO: 1894966 - RNA, 14 nt, Human
gcccccccuuccac

SEQ ID NO: 1894967 - RNA, 17 nt, Human
gcccucaccacccacuu

SEQ ID NO: 1894968 - RNA, 18 nt, Human
gcccucaccccugguucu

SEQ ID NO: 1894969 - RNA, 22 nt, Human
gcccucaccccugguucucauc

SEQ ID NO: 1894970 - RNA, 21 nt, Human
gcccucaccccugguucucau

SEQ ID NO: 1894971 - RNA, 19 nt, Human
gcccucaaacuugacucua

SEQ ID NO: 1894972 - RNA, 15 nt, Human
gccccugcucuggug

SEQ ID NO: 1894973 - RNA, 20 nt, Human
gccccugccucucugcaggu

SEQ ID NO: 1894974 - RNA, 23 nt, Human
gccccugccucucugcagguccc

SEQ ID NO: 1894975 - RNA, 23 nt, Human
gcccgggcucugccucccaucac

SEQ ID NO: 1894976 - RNA, 20 nt, Human
gccuaggugacagagugaga

SEQ ID NO: 1894977 - RNA, 18 nt, Human
gccgcccgggcccagagg

SEQ ID NO: 1894978 - RNA, 20 nt, Human
gccuagcauacguacacauu

SEQ ID NO: 1894979 - RNA, 22 nt, Human
gccuagcauacguacacauuuu

SEQ ID NO: 1894980 - RNA, 21 nt, Human
gccuagcauacguacacauuu

SEQ ID NO: 1894981 - RNA, 23 nt, Human
gccuagcauacguacacauuuua

SEQ ID NO: 1894982 - RNA, 15 nt, Human
gccuaggugacagag

SEQ ID NO: 1894983 - RNA, 14 nt, Human
gccuaggugacaga

SEQ ID NO: 1894984 - RNA, 13 nt, Human
gccuaggugacag

SEQ ID NO: 1894985 - RNA, 20 nt, Human
gccuaggccucagccagaga

SEQ ID NO: 1894986 - RNA, 17 nt, Human
gccuaggccucagccag

SEQ ID NO: 1894987 - RNA, 18 nt, Human
gccuaggccucagccaga

SEQ ID NO: 1894988 - RNA, 13 nt, Human
gccuaggccaggu

SEQ ID NO: 1894989 - RNA, 14 nt, Human
gccuaggccaggug

SEQ ID NO: 1894990 - RNA, 13 nt, Human
gccuaggccucag

SEQ ID NO: 1894991 - RNA, 16 nt, Human
gccuaggccaggugca

SEQ ID NO: 1894992 - RNA, 16 nt, Human
gccuaggccucagcca

SEQ ID NO: 1894993 - RNA, 16 nt, Human
gccgcccgggcccaga

SEQ ID NO: 1894994 - RNA, 15 nt, Human
gccgcccgggcccag

SEQ ID NO: 1894995 - RNA, 18 nt, Human
gccgcccugcgggugaac

SEQ ID NO: 1894996 - RNA, 22 nt, Human
gcccuuagcagggaaacagcua

SEQ ID NO: 1894997 - RNA, 20 nt, Human
gccgcagcccugcagagggc

SEQ ID NO: 1894998 - RNA, 20 nt, Human
gcccuuagcagggaaacagc

SEQ ID NO: 1894999 - RNA, 21 nt, Human
gcccugugcaaccucuuggcc

SEQ ID NO: 1895000 - RNA, 14 nt, Human
gcccugccuccuuu

SEQ ID NO: 1895001 - RNA, 12 nt, Human
gcccugccuccu

SEQ ID NO: 1895002 - RNA, 13 nt, Human
gcccugccuccuu

SEQ ID NO: 1895003 - RNA, 18 nt, Human
gcccugcagagggcacag

SEQ ID NO: 1895004 - RNA, 11 nt, Human
gcccugccucc

SEQ ID NO: 1895005 - RNA, 17 nt, Human
gcccugcccaccuggcc

SEQ ID NO: 1895006 - RNA, 20 nt, Human
gcccugcccaccuggccucu

SEQ ID NO: 1895007 - RNA, 21 nt, Human
gcccugcccaccuggccucug

SEQ ID NO: 1895008 - RNA, 22 nt, Human
gcccugcccaccuggccucugc

SEQ ID NO: 1895009 - RNA, 15 nt, Human
ggaagagaaaaaaua

SEQ ID NO: 1895010 - RNA, 13 nt, Human
ggaagagaaacca

SEQ ID NO: 1895011 - RNA, 18 nt, Human
ggaagacuuuggaaagag

SEQ ID NO: 1895012 - RNA, 13 nt, Human
ggaagagaaaaaa

SEQ ID NO: 1895013 - RNA, 13 nt, Human
ggaagacagcucu

SEQ ID NO: 1895014 - RNA, 14 nt, Human
ggaagacagcucuu

SEQ ID NO: 1895015 - RNA, 20 nt, Human
ggaacuuauuaaauggaaac

SEQ ID NO: 1895016 - RNA, 13 nt, Human
ggaacuugagaac

SEQ ID NO: 1895017 - RNA, 22 nt, Human
ggaagacaaugugaaaagaaaa

SEQ ID NO: 1895018 - RNA, 13 nt, Human
ggaagacuuugga

SEQ ID NO: 1895019 - RNA, 17 nt, Human
ggaagacuuuggaaaga

SEQ ID NO: 1895020 - RNA, 12 nt, Human
ggaagacuuugg

SEQ ID NO: 1895021 - RNA, 22 nt, Human
ggaacuuggggaguuaagaccu

SEQ ID NO: 1895022 - RNA, 12 nt, Human
ggaacacucuga

SEQ ID NO: 1895023 - RNA, 14 nt, Human
ggaacacucugaga

SEQ ID NO: 1895024 - RNA, 15 nt, Human
ggaacacucugagac

SEQ ID NO: 1895025 - RNA, 16 nt, Human
ggaacacucugagacu

SEQ ID NO: 1895026 - RNA, 20 nt, Human
ggaacugcugggcuuggcag

SEQ ID NO: 1895027 - RNA, 13 nt, Human
ggaagcccccacc

SEQ ID NO: 1895028 - RNA, 21 nt, Human
ggaagcccccaccgugggcag

SEQ ID NO: 1895029 - RNA, 22 nt, Human
ggaagcccccaccgugggcagg

SEQ ID NO: 1895030 - RNA, 15 nt, Human
ggaagccgcuggggc

SEQ ID NO: 1895031 - RNA, 16 nt, Human
ggaagcuaauuugcau

SEQ ID NO: 1895032 - RNA, 19 nt, Human
ggaaggaaacccagcucug

SEQ ID NO: 1895033 - RNA, 20 nt, Human
ggaaggaaacccagcucugg

SEQ ID NO: 1895034 - RNA, 22 nt, Human
ggaagugugggucugugugugu

SEQ ID NO: 1895035 - RNA, 21 nt, Human
ggaagugugggucugugugug

SEQ ID NO: 1895036 - RNA, 12 nt, Human
ggaagugugggu

SEQ ID NO: 1895037 - RNA, 16 nt, Human
ggaaggaaacccagcu

SEQ ID NO: 1895038 - RNA, 11 nt, Human
ggaagcuccgc

SEQ ID NO: 1895039 - RNA, 15 nt, Human
ggaagcucagggccu

SEQ ID NO: 1895040 - RNA, 23 nt, Human
ggaagcucagggccuggcucagg

SEQ ID NO: 1895041 - RNA, 13 nt, Human
ggaauaauaccua

SEQ ID NO: 1895042 - RNA, 18 nt, Human
ggaauaacauguaauuaa

SEQ ID NO: 1895043 - RNA, 21 nt, Human
ggaaguuuuguggaggagcuc

SEQ ID NO: 1895044 - RNA, 16 nt, Human
ggaauccagacccggc

SEQ ID NO: 1895045 - RNA, 13 nt, Human
ggacaagagcagg

SEQ ID NO: 1895046 - RNA, 22 nt, Human
ggacaaggaugaucuaggaaga

SEQ ID NO: 1895047 - RNA, 23 nt, Human
ggacaaggaugaucuaggaagac

SEQ ID NO: 1895048 - RNA, 19 nt, Human
ggaaugaagauacugaaau

SEQ ID NO: 1895049 - RNA, 21 nt, Human
ggacacgggcagccuggcucc

SEQ ID NO: 1895050 - RNA, 17 nt, Human
ggacacuaaccacgcug

SEQ ID NO: 1895051 - RNA, 19 nt, Human
ggacagcuccuucuguccu

SEQ ID NO: 1895052 - RNA, 22 nt, Human
ggacacuaaccacgcuggaccu

SEQ ID NO: 1895053 - RNA, 20 nt, Human
ggacagcuccuucuguccua

SEQ ID NO: 1895054 - RNA, 18 nt, Human
ggacacagcucuucucca

SEQ ID NO: 1895055 - RNA, 15 nt, Human
ggacacagcucuucu

SEQ ID NO: 1895056 - RNA, 21 nt, Human
ggacacagcucuucuccaggc

SEQ ID NO: 1895057 - RNA, 20 nt, Human
ggacaaguggacucagggca

SEQ ID NO: 1895058 - RNA, 14 nt, Human
ggacacagcucuuc

SEQ ID NO: 1895059 - RNA, 23 nt, Human
ggacaggcauguucucugaggac

SEQ ID NO: 1895060 - RNA, 14 nt, Human
ggacccccgccccc

SEQ ID NO: 1895061 - RNA, 15 nt, Human
ggacccccgcccccu

SEQ ID NO: 1895062 - RNA, 16 nt, Human
ggacccccgcccccug

SEQ ID NO: 1895063 - RNA, 19 nt, Human
ggacccccgcccccugccc

SEQ ID NO: 1895064 - RNA, 20 nt, Human
ggacccccgcccccugcccu

SEQ ID NO: 1895065 - RNA, 22 nt, Human
ggacccccgcccccugcccucc

SEQ ID NO: 1895066 - RNA, 18 nt, Human
ggaccccgagccuggcuc

SEQ ID NO: 1895067 - RNA, 11 nt, Human
ggacccugagg

SEQ ID NO: 1895068 - RNA, 15 nt, Human
ggaccccgagccugg

SEQ ID NO: 1895069 - RNA, 23 nt, Human
ggacccccgcccccugcccuccc

SEQ ID NO: 1895070 - RNA, 12 nt, Human
ggacccccugaa

SEQ ID NO: 1895071 - RNA, 20 nt, Human
ggacguguuaugacuccaga

SEQ ID NO: 1895072 - RNA, 18 nt, Human
ggacguggcucagccagc

SEQ ID NO: 1895073 - RNA, 20 nt, Human
ggaccucaggccugggggcu

SEQ ID NO: 1895074 - RNA, 15 nt, Human
ggacggcugggcaca

SEQ ID NO: 1895075 - RNA, 14 nt, Human
ggaccucaggccug

SEQ ID NO: 1895076 - RNA, 15 nt, Human
ggaccucaggccugg

SEQ ID NO: 1895077 - RNA, 13 nt, Human
ggaccucaggccu

SEQ ID NO: 1895078 - RNA, 12 nt, Human
ggacccugaggc

SEQ ID NO: 1895079 - RNA, 13 nt, Human
ggacccugaggcc

SEQ ID NO: 1895080 - RNA, 13 nt, Human
ggacccugaaggg

SEQ ID NO: 1895081 - RNA, 13 nt, Human
ggacgugggcugg

SEQ ID NO: 1895082 - RNA, 19 nt, Human
ggacguggcucagccagca

SEQ ID NO: 1895083 - RNA, 20 nt, Human
ggacuaacuugucuuuggac

SEQ ID NO: 1895084 - RNA, 14 nt, Human
ggacuacaggugug

SEQ ID NO: 1895085 - RNA, 24 nt, Human
ggacuaacuugucuuuggacccug

SEQ ID NO: 1895086 - RNA, 15 nt, Human
ggacucaaugcacug

SEQ ID NO: 1895087 - RNA, 23 nt, Human
ggacuauauuugggccugcucca

SEQ ID NO: 1895088 - RNA, 18 nt, Human
ggacucaaugcacugaca

SEQ ID NO: 1895089 - RNA, 16 nt, Human
ggacucaaugcacuga

SEQ ID NO: 1895090 - RNA, 13 nt, Human
ggacucagggcag

SEQ ID NO: 1895091 - RNA, 15 nt, Human
ggacucagggcagcg

SEQ ID NO: 1895092 - RNA, 22 nt, Human
ggacucagggcagcgccaggcu

SEQ ID NO: 1895093 - RNA, 14 nt, Human
ggacuuggaagcuc

SEQ ID NO: 1895094 - RNA, 16 nt, Human
ggacuccggcccuccu

SEQ ID NO: 1895095 - RNA, 9 nt, Human
ggacuuugu

SEQ ID NO: 1895096 - RNA, 16 nt, Human
ggagaaaggaagggcu

SEQ ID NO: 1895097 - RNA, 13 nt, Human
ggagaaacuggaa

SEQ ID NO: 1895098 - RNA, 22 nt, Human
gcuggagugcagugagccgaga

SEQ ID NO: 1895099 - RNA, 20 nt, Human
gcuggccuggccccucaggg

SEQ ID NO: 1895100 - RNA, 17 nt, Human
gcuggagugcagugagc

SEQ ID NO: 1895101 - RNA, 18 nt, Human
gcuggagugcagugagcc

SEQ ID NO: 1895102 - RNA, 20 nt, Human
gcuggcgugcaguggugcga

SEQ ID NO: 1895103 - RNA, 15 nt, Human
gcuggagugcagugg

SEQ ID NO: 1895104 - RNA, 12 nt, Human
gcuggagugagg

SEQ ID NO: 1895105 - RNA, 13 nt, Human
gcugcuggcuggu

SEQ ID NO: 1895106 - RNA, 18 nt, Human
gcugcugaaggcucgagc

SEQ ID NO: 1895107 - RNA, 15 nt, Human
gcugcugaaggcuca

SEQ ID NO: 1895108 - RNA, 21 nt, Human
gcugcuggacaguaucacugu

SEQ ID NO: 1895109 - RNA, 13 nt, Human
gcucugcccuugg

SEQ ID NO: 1895110 - RNA, 14 nt, Human
gcucugggccauuc

SEQ ID NO: 1895111 - RNA, 20 nt, Human
gcucugggccauucuccaca

SEQ ID NO: 1895112 - RNA, 23 nt, Human
gcucugggccauucuccacagca

SEQ ID NO: 1895113 - RNA, 15 nt, Human
gcucugguccauaga

SEQ ID NO: 1895114 - RNA, 16 nt, Human
gcucugguccauagag

SEQ ID NO: 1895115 - RNA, 23 nt, Human
gcucugguccauagagagcaaga

SEQ ID NO: 1895116 - RNA, 13 nt, Human
gcugcugaaggcu

SEQ ID NO: 1895117 - RNA, 14 nt, Human
gcugcugaaggcuc

SEQ ID NO: 1895118 - RNA, 15 nt, Human
gcugcugaaggcucg

SEQ ID NO: 1895119 - RNA, 21 nt, Human
gcuggguggcaccagcagccu

SEQ ID NO: 1895120 - RNA, 22 nt, Human
gcuggguggcaccagcagccug

SEQ ID NO: 1895121 - RNA, 23 nt, Human
gcuggguggcaccagcagccugg

SEQ ID NO: 1895122 - RNA, 17 nt, Human
gcuggcuccccaaaggg

SEQ ID NO: 1895123 - RNA, 13 nt, Human
gcuggcuccccaa

SEQ ID NO: 1895124 - RNA, 23 nt, Human
gcuggcuccagaugcagggcagu

SEQ ID NO: 1895125 - RNA, 21 nt, Human
gcuggcuccccaaagggugug

SEQ ID NO: 1895126 - RNA, 14 nt, Human
gcuggcuccagaug

SEQ ID NO: 1895127 - RNA, 17 nt, Human
gcuggcuccagaugcag

SEQ ID NO: 1895128 - RNA, 21 nt, Human
gcuggcuccagaugcagggca

SEQ ID NO: 1895129 - RNA, 22 nt, Human
gcuggcuccagaugcagggcag

SEQ ID NO: 1895130 - RNA, 17 nt, Human
gcuggcuguuggcuggg

SEQ ID NO: 1895131 - RNA, 16 nt, Human
gcuggcuguuggcugg

SEQ ID NO: 1895132 - RNA, 15 nt, Human
gcuggcuguuggcug

SEQ ID NO: 1895133 - RNA, 23 nt, Human
gcugggccccugccucucugcag

SEQ ID NO: 1895134 - RNA, 21 nt, Human
gcugggccccugccucucugc

SEQ ID NO: 1895135 - RNA, 22 nt, Human
gcugggccccugccucucugca

SEQ ID NO: 1895136 - RNA, 12 nt, Human
gcugggucgccc

SEQ ID NO: 1895137 - RNA, 16 nt, Human
gcugggucaggcaggg

SEQ ID NO: 1895138 - RNA, 13 nt, Human
gcugggucaggca

SEQ ID NO: 1895139 - RNA, 14 nt, Human
gcugggucaggcag

SEQ ID NO: 1895140 - RNA, 15 nt, Human
gcugggucaggcagg

SEQ ID NO: 1895141 - RNA, 22 nt, Human
gcuuccucauaguaugguggcu

SEQ ID NO: 1895142 - RNA, 20 nt, Human
gcuuguaaauagcucaggug

SEQ ID NO: 1895143 - RNA, 14 nt, Human
gcuugagcucagga

SEQ ID NO: 1895144 - RNA, 20 nt, Human
gcuugagaaauauggacacu

SEQ ID NO: 1895145 - RNA, 12 nt, Human
gcuuguacauaa

SEQ ID NO: 1895146 - RNA, 21 nt, Human
gcuuugaaagccccagaaauc

SEQ ID NO: 1895147 - RNA, 21 nt, Human
gcuuucuuucacaaaaaagaa

SEQ ID NO: 1895148 - RNA, 12 nt, Human
gcuucagccucc

SEQ ID NO: 1895149 - RNA, 19 nt, Human
gcuucacggaagagccuug

SEQ ID NO: 1895150 - RNA, 18 nt, Human
gcuucacggaagagccuu

SEQ ID NO: 1895151 - RNA, 16 nt, Human
gcuuauuaaugcuaag

SEQ ID NO: 1895152 - RNA, 15 nt, Human
gcuuauuaaugcuaa

SEQ ID NO: 1895153 - RNA, 20 nt, Human
gcuuauuaaugcuaagggca

SEQ ID NO: 1895154 - RNA, 19 nt, Human
gcuuauuaaugcuaagggc

SEQ ID NO: 1895155 - RNA, 18 nt, Human
gcuucaaggauccugagc

SEQ ID NO: 1895156 - RNA, 19 nt, Human
gcuucaaggauccugagcc

SEQ ID NO: 1895157 - RNA, 20 nt, Human
gcuucaaggauccugagcca

SEQ ID NO: 1895158 - RNA, 21 nt, Human
gcuucaaggauccugagccag

SEQ ID NO: 1895159 - RNA, 17 nt, Human
gcuucacggaagagccu

SEQ ID NO: 1895160 - RNA, 15 nt, Human
gcuucacggaagagc

SEQ ID NO: 1895161 - RNA, 14 nt, Human
ggccaguugguccc

SEQ ID NO: 1895162 - RNA, 17 nt, Human
ggccaguuggucccccu

SEQ ID NO: 1895163 - RNA, 20 nt, Human
ggccagugugacaaggauug

SEQ ID NO: 1895164 - RNA, 17 nt, Human
ggccagucccugaggca

SEQ ID NO: 1895165 - RNA, 23 nt, Human
ggccagucccugaggcagguccc

SEQ ID NO: 1895166 - RNA, 14 nt, Human
ggccccugcugguu

SEQ ID NO: 1895167 - RNA, 13 nt, Human
ggccccugcuggu

SEQ ID NO: 1895168 - RNA, 23 nt, Human
ggccccugcugguucaggguugg

SEQ ID NO: 1895169 - RNA, 13 nt, Human
ggcccggcuccag

SEQ ID NO: 1895170 - RNA, 12 nt, Human
ggcccggccagc

SEQ ID NO: 1895171 - RNA, 19 nt, Human
ggcccuucucuccagcccc

SEQ ID NO: 1895172 - RNA, 20 nt, Human
ggcccuucucuccagccccu

SEQ ID NO: 1895173 - RNA, 21 nt, Human
ggcccuucucuccagccccug

SEQ ID NO: 1895174 - RNA, 15 nt, Human
ggcccggcuccaggc

SEQ ID NO: 1895175 - RNA, 20 nt, Human
ggcccggccagccaugucug

SEQ ID NO: 1895176 - RNA, 16 nt, Human
ggcccuccuacccugc

SEQ ID NO: 1895177 - RNA, 20 nt, Human
ggcccuccuacccugcgccc

SEQ ID NO: 1895178 - RNA, 17 nt, Human
ggcccuccuacccugcg

SEQ ID NO: 1895179 - RNA, 19 nt, Human
ggcccuccuacccugcgcc

SEQ ID NO: 1895180 - RNA, 21 nt, Human
ggcccuccuacccugcgccca

SEQ ID NO: 1895181 - RNA, 16 nt, Human
ggccuccauccugagg

SEQ ID NO: 1895182 - RNA, 15 nt, Human
ggccuccauccugag

SEQ ID NO: 1895183 - RNA, 14 nt, Human
ggccuccauccuga

SEQ ID NO: 1895184 - RNA, 15 nt, Human
ggccucagccagaga

SEQ ID NO: 1895185 - RNA, 17 nt, Human
ggccucagccagagaag

SEQ ID NO: 1895186 - RNA, 20 nt, Human
ggccucagccagagaagcua

SEQ ID NO: 1895187 - RNA, 22 nt, Human
ggcccuucucuccagccccugg

SEQ ID NO: 1895188 - RNA, 23 nt, Human
ggcccuucucuccagccccugga

SEQ ID NO: 1895189 - RNA, 23 nt, Human
ggccucaagugauucuccugccu

SEQ ID NO: 1895190 - RNA, 11 nt, Human
ggcagccccug

SEQ ID NO: 1895191 - RNA, 23 nt, Human
ggcagccccauucugccugccca

SEQ ID NO: 1895192 - RNA, 20 nt, Human
ggcacagaaaauggaagaca

SEQ ID NO: 1895193 - RNA, 21 nt, Human
ggcacagaaaauggaagacag

SEQ ID NO: 1895194 - RNA, 19 nt, Human
ggcacagaaaauggaagac

SEQ ID NO: 1895195 - RNA, 23 nt, Human
ggcacagaaaauggaagacagcu

SEQ ID NO: 1895196 - RNA, 23 nt, Human
ggcacucagaagacacugauggg

SEQ ID NO: 1895197 - RNA, 23 nt, Human
ggcacugaagggauaugugaaac

SEQ ID NO: 1895198 - RNA, 13 nt, Human
ggcacaucagcac

SEQ ID NO: 1895199 - RNA, 12 nt, Human
ggagagaaaaca

SEQ ID NO: 1895200 - RNA, 16 nt, Human
ggagagaagagaaugc

SEQ ID NO: 1895201 - RNA, 21 nt, Human
ggcagggcucccacagagaca

SEQ ID NO: 1895202 - RNA, 15 nt, Human
ggcagggcugaggcc

SEQ ID NO: 1895203 - RNA, 17 nt, Human
ggcagggcucccacaga

SEQ ID NO: 1895204 - RNA, 22 nt, Human
ggcagccccuguucuggcagag

SEQ ID NO: 1895205 - RNA, 14 nt, Human
ggcaguuggccaga

SEQ ID NO: 1895206 - RNA, 18 nt, Human
ggcaguuuaaagcacaau

SEQ ID NO: 1895207 - RNA, 21 nt, Human
ggcaguggugguuuucuguuc

SEQ ID NO: 1895208 - RNA, 20 nt, Human
ggcaguggugguuuucuguu

SEQ ID NO: 1895209 - RNA, 17 nt, Human
ggcuccaaacccucgag

SEQ ID NO: 1895210 - RNA, 14 nt, Human
ggcuccacuugguc

SEQ ID NO: 1895211 - RNA, 18 nt, Human
ggcucagcggggacagcu

SEQ ID NO: 1895212 - RNA, 14 nt, Human
ggcucagagugggg

SEQ ID NO: 1895213 - RNA, 20 nt, Human
ggcucagcggggacagcucc

SEQ ID NO: 1895214 - RNA, 19 nt, Human
ggcucagcggggacagcuc

SEQ ID NO: 1895215 - RNA, 19 nt, Human
ggcucagguggggucacuc

SEQ ID NO: 1895216 - RNA, 20 nt, Human
ggcucagguggggucacucu

SEQ ID NO: 1895217 - RNA, 13 nt, Human
ggcugcugaaggc

SEQ ID NO: 1895218 - RNA, 14 nt, Human
ggcugggagagccu

SEQ ID NO: 1895219 - RNA, 15 nt, Human
ggcugggagagccuu

SEQ ID NO: 1895220 - RNA, 16 nt, Human
ggcugggagagccuuc

SEQ ID NO: 1895221 - RNA, 11 nt, Human
ggcucucaggc

SEQ ID NO: 1895222 - RNA, 14 nt, Human
ggcucucaggccag

SEQ ID NO: 1895223 - RNA, 13 nt, Human
ggcucucaggcca

SEQ ID NO: 1895224 - RNA, 14 nt, Human
ggcucuuccaggcu

SEQ ID NO: 1895225 - RNA, 12 nt, Human
ggcucuuccagg

SEQ ID NO: 1895226 - RNA, 19 nt, Human
ggcugccaaugggagcuca

SEQ ID NO: 1895227 - RNA, 20 nt, Human
ggcugccaaugggagcucau

SEQ ID NO: 1895228 - RNA, 13 nt, Human
ggcugaccacagc

SEQ ID NO: 1895229 - RNA, 15 nt, Human
ggcugaccacagcac

SEQ ID NO: 1895230 - RNA, 16 nt, Human
ggcugaccacagcaca

SEQ ID NO: 1895231 - RNA, 17 nt, Human
ggcugaccacagcacag

SEQ ID NO: 1895232 - RNA, 18 nt, Human
ggcugaccacagcacagc

SEQ ID NO: 1895233 - RNA, 22 nt, Human
ggcugcggaaugaaccacaucu

SEQ ID NO: 1895234 - RNA, 19 nt, Human
ggcugaccacagcacagcc

SEQ ID NO: 1895235 - RNA, 21 nt, Human
ggcugccaaugggagcucaug

SEQ ID NO: 1895236 - RNA, 14 nt, Human
gggaggucauuuug

SEQ ID NO: 1895237 - RNA, 17 nt, Human
gggagggucagccaggg

SEQ ID NO: 1895238 - RNA, 15 nt, Human
gggaggucgaggcag

SEQ ID NO: 1895239 - RNA, 18 nt, Human
gggaggucaaggcugcag

SEQ ID NO: 1895240 - RNA, 15 nt, Human
gggagggagggcucc

SEQ ID NO: 1895241 - RNA, 16 nt, Human
gggagggagggcucca

SEQ ID NO: 1895242 - RNA, 23 nt, Human
gggagcaggcucgggcuccccag

SEQ ID NO: 1895243 - RNA, 15 nt, Human
gggagagccuuccag

SEQ ID NO: 1895244 - RNA, 19 nt, Human
gggagagccuuccaggggu

SEQ ID NO: 1895245 - RNA, 24 nt, Human
gggagcaggcggugggcacccacc

SEQ ID NO: 1895246 - RNA, 10 nt, Human
gggagcccac

SEQ ID NO: 1895247 - RNA, 23 nt, Human
gggacuuggaagcuccgcuuucu

SEQ ID NO: 1895248 - RNA, 18 nt, Human
gggacuuggaagcuccgc

SEQ ID NO: 1895249 - RNA, 17 nt, Human
gggacuuggaagcuccg

SEQ ID NO: 1895250 - RNA, 15 nt, Human
gggacuuggaagcuc

SEQ ID NO: 1895251 - RNA, 21 nt, Human
gggagaaccaaaaagaggcua

SEQ ID NO: 1895252 - RNA, 13 nt, Human
gggagaaaauuca

SEQ ID NO: 1895253 - RNA, 15 nt, Human
gggagaaaauucaau

SEQ ID NO: 1895254 - RNA, 22 nt, Human
aaaagccagcaggcuucaaacu

SEQ ID NO: 1895255 - RNA, 18 nt, Human
aaaagccaagaggcugca

SEQ ID NO: 1895256 - RNA, 18 nt, Human
aaaaggaagccaaagagu

SEQ ID NO: 1895257 - RNA, 18 nt, Human
aaaacucuccucugcugc

SEQ ID NO: 1895258 - RNA, 12 nt, Human
aaaacucuuuua

SEQ ID NO: 1895259 - RNA, 23 nt, Human
aaaacugaaagugaaaguccaga

SEQ ID NO: 1895260 - RNA, 15 nt, Human
aaaacuucagacaua

SEQ ID NO: 1895261 - RNA, 15 nt, Human
aaaagauuuuaauca

SEQ ID NO: 1895262 - RNA, 14 nt, Human
aaaagauuuuaauc

SEQ ID NO: 1895263 - RNA, 14 nt, Human
aaaacaugcuacac

SEQ ID NO: 1895264 - RNA, 13 nt, Human
aaaacaugcuaca

SEQ ID NO: 1895265 - RNA, 13 nt, Human
aaaacaucuauuc

SEQ ID NO: 1895266 - RNA, 16 nt, Human
aaaacaucuauucucu

SEQ ID NO: 1895267 - RNA, 21 nt, Human
aaaacaucuauucucuccaaa

SEQ ID NO: 1895268 - RNA, 12 nt, Human
aaaacccaagug

SEQ ID NO: 1895269 - RNA, 11 nt, Human
aaaaccaggcc

SEQ ID NO: 1895270 - RNA, 14 nt, Human
gggaccagagcugc

SEQ ID NO: 1895271 - RNA, 20 nt, Human
gggaccagagcugccaccug

SEQ ID NO: 1895272 - RNA, 15 nt, Human
gggacauugggaagg

SEQ ID NO: 1895273 - RNA, 17 nt, Human
aaaaaugguuuaaaugg

SEQ ID NO: 1895274 - RNA, 14 nt, Human
gggacacgggcagc

SEQ ID NO: 1895275 - RNA, 13 nt, Human
gggaagagacuug

SEQ ID NO: 1895276 - RNA, 13 nt, Human
gggacagcuccuu

SEQ ID NO: 1895277 - RNA, 12 nt, Human
gggacagcuccu

SEQ ID NO: 1895278 - RNA, 17 nt, Human
gggacagaggccccagc

SEQ ID NO: 1895279 - RNA, 18 nt, Human
gggacagaggccccagcc

SEQ ID NO: 1895280 - RNA, 19 nt, Human
gggacagaggccccagccu

SEQ ID NO: 1895281 - RNA, 20 nt, Human
gggacagaggccccagccuc

SEQ ID NO: 1895282 - RNA, 21 nt, Human
gggacagaggccccagccucc

SEQ ID NO: 1895283 - RNA, 15 nt, Human
gggacagcuccuucu

SEQ ID NO: 1895284 - RNA, 18 nt, Human
gggacaggggcaggagga

SEQ ID NO: 1895285 - RNA, 17 nt, Human
gggacaggggcaggagg

SEQ ID NO: 1895286 - RNA, 18 nt, Human
gggaagaagcucucuccu

SEQ ID NO: 1895287 - RNA, 16 nt, Human
gggaacucagauccag

SEQ ID NO: 1895288 - RNA, 21 nt, Human
ggcuuccuccugguguggaag

SEQ ID NO: 1895289 - RNA, 15 nt, Human
ggcuucucugaggaa

SEQ ID NO: 1895290 - RNA, 16 nt, Human
ggcuucucugaggaag

SEQ ID NO: 1895291 - RNA, 14 nt, Human
aaaaauaacaauga

SEQ ID NO: 1895292 - RNA, 21 nt, Human
aaaaauaaauuugguucuaau

SEQ ID NO: 1895293 - RNA, 19 nt, Human
ggcugggggccucagugcc

SEQ ID NO: 1895294 - RNA, 17 nt, Human
ggcugggggccucagug

SEQ ID NO: 1895295 - RNA, 16 nt, Human
ggcugggggccucagu

SEQ ID NO: 1895296 - RNA, 15 nt, Human
ggcugggggccucag

SEQ ID NO: 1895297 - RNA, 14 nt, Human
ggcugggucgcccu

SEQ ID NO: 1895298 - RNA, 17 nt, Human
ggcugggucgcccugga

SEQ ID NO: 1895299 - RNA, 20 nt, Human
ggcugggucgcccuggacug

SEQ ID NO: 1895300 - RNA, 19 nt, Human
ggcuggguggcaccagcag

SEQ ID NO: 1895301 - RNA, 19 nt, Human
ggcuggguucuacccaggu

SEQ ID NO: 1895302 - RNA, 21 nt, Human
ggcuggguucuacccaggugc

SEQ ID NO: 1895303 - RNA, 18 nt, Human
ggcuguaucccaugagcc

SEQ ID NO: 1895304 - RNA, 22 nt, Human
ggcugguucggauuuggggugg

SEQ ID NO: 1895305 - RNA, 23 nt, Human
ggcugguucggauuuggggugga

SEQ ID NO: 1895306 - RNA, 16 nt, Human
ggcuguaaaaugcaug

SEQ ID NO: 1895307 - RNA, 20 nt, Human
ggcuucaguggcagcugcuu

SEQ ID NO: 1895308 - RNA, 19 nt, Human
ggcuucaguggcagcugcu

SEQ ID NO: 1895309 - RNA, 17 nt, Human
ggcuucaguggcagcug

SEQ ID NO: 1895310 - RNA, 18 nt, Human
ggcuucaguggcagcugc

SEQ ID NO: 1895311 - RNA, 16 nt, Human
ggcuuccucauaguau

SEQ ID NO: 1895312 - RNA, 12 nt, Human
ggcuucauacac

SEQ ID NO: 1895313 - RNA, 22 nt, Human
ggcuucauccuccucagaucuu

SEQ ID NO: 1895314 - RNA, 18 nt, Human
ggcuucauccuccucaga

SEQ ID NO: 1895315 - RNA, 11 nt, Human
ggcuucauaca

SEQ ID NO: 1895316 - RNA, 9 nt, Human
ggcuucaua

SEQ ID NO: 1895317 - RNA, 13 nt, Human
ggugcagccagag

SEQ ID NO: 1895318 - RNA, 17 nt, Human
ggugcagccagaggcac

SEQ ID NO: 1895319 - RNA, 12 nt, Human
ggugcagguaga

SEQ ID NO: 1895320 - RNA, 21 nt, Human
ggugcauauuuauaaaaauaa

SEQ ID NO: 1895321 - RNA, 21 nt, Human
ggugcauuugaggucuguucu

SEQ ID NO: 1895322 - RNA, 16 nt, Human
ggugcagugugaaaag

SEQ ID NO: 1895323 - RNA, 11 nt, Human
ggugcugggcc

SEQ ID NO: 1895324 - RNA, 13 nt, Human
ggugcugggcccc

SEQ ID NO: 1895325 - RNA, 15 nt, Human
ggugcugggccccug

SEQ ID NO: 1895326 - RNA, 16 nt, Human
ggugcugggccccugc

SEQ ID NO: 1895327 - RNA, 13 nt, Human
gguggaugccugg

SEQ ID NO: 1895328 - RNA, 15 nt, Human
gguggaguuaaucuu

SEQ ID NO: 1895329 - RNA, 15 nt, Human
gguggaauuauuuua

SEQ ID NO: 1895330 - RNA, 17 nt, Human
ggucgacuucgggcugg

SEQ ID NO: 1895331 - RNA, 14 nt, Human
ggucgcccuggacu

SEQ ID NO: 1895332 - RNA, 13 nt, Human
ggucgaggcagga

SEQ ID NO: 1895333 - RNA, 13 nt, Human
ggugaacagaaca

SEQ ID NO: 1895334 - RNA, 20 nt, Human
ggucgcccuggacugugugc

SEQ ID NO: 1895335 - RNA, 24 nt, Human
ggugauccacccaccucagccucc

SEQ ID NO: 1895336 - RNA, 23 nt, Human
ggugauccacccaccucagccuc

SEQ ID NO: 1895337 - RNA, 18 nt, Human
ggugauccacccaccuca

SEQ ID NO: 1895338 - RNA, 18 nt, Human
ggugaacaaagcagccac

SEQ ID NO: 1895339 - RNA, 19 nt, Human
ggugaacaaagcagccacg

SEQ ID NO: 1895340 - RNA, 12 nt, Human
ggugcaaugacc

SEQ ID NO: 1895341 - RNA, 12 nt, Human
ggugcaaccagg

SEQ ID NO: 1895342 - RNA, 13 nt, Human
ggugcaaugaccu

SEQ ID NO: 1895343 - RNA, 16 nt, Human
ggugcaaugaccuuuc

SEQ ID NO: 1895344 - RNA, 19 nt, Human
aaagcacgaaauguuauuu

SEQ ID NO: 1895345 - RNA, 15 nt, Human
aaagcucacuuuacu

SEQ ID NO: 1895346 - RNA, 15 nt, Human
aaagcuuguuaagau

SEQ ID NO: 1895347 - RNA, 15 nt, Human
aaagcuuuuagaaau

SEQ ID NO: 1895348 - RNA, 13 nt, Human
aaagcugcugaca

SEQ ID NO: 1895349 - RNA, 21 nt, Human
aaagcugcucagggaaaagca

SEQ ID NO: 1895350 - RNA, 22 nt, Human
aaagggacuuggaagcuccgcu

SEQ ID NO: 1895351 - RNA, 20 nt, Human
aaagggacugagaaauuuau

SEQ ID NO: 1895352 - RNA, 20 nt, Human
aaaggagccuaggccaggug

SEQ ID NO: 1895353 - RNA, 14 nt, Human
aaagguaaaucaga

SEQ ID NO: 1895354 - RNA, 17 nt, Human
aaaggagauuggaagga

SEQ ID NO: 1895355 - RNA, 21 nt, Human
aaaggagagcuagcagcaggg

SEQ ID NO: 1895356 - RNA, 22 nt, Human
aaaggaaagagggagguaagga

SEQ ID NO: 1895357 - RNA, 12 nt, Human
aaaggaagccaa

SEQ ID NO: 1895358 - RNA, 14 nt, Human
aaaggaagccaaag

SEQ ID NO: 1895359 - RNA, 15 nt, Human
aaaggaagccaaaga

SEQ ID NO: 1895360 - RNA, 13 nt, Human
aaaggaagaaaaa

SEQ ID NO: 1895361 - RNA, 20 nt, Human
aaacuuuccucuuccugccu

SEQ ID NO: 1895362 - RNA, 14 nt, Human
aaacuuugcuaaau

SEQ ID NO: 1895363 - RNA, 16 nt, Human
aaacuuguauuaugug

SEQ ID NO: 1895364 - RNA, 19 nt, Human
aaacuuguaaauaaaggaa

SEQ ID NO: 1895365 - RNA, 21 nt, Human
aaacuuccagugcaacacuga

SEQ ID NO: 1895366 - RNA, 22 nt, Human
aaacuuccagugcaacacugaa

SEQ ID NO: 1895367 - RNA, 14 nt, Human
ggguggccucccaa

SEQ ID NO: 1895368 - RNA, 23 nt, Human
ggguggccuaagaguugagcucu

SEQ ID NO: 1895369 - RNA, 17 nt, Human
ggguggggggcuucaua

SEQ ID NO: 1895370 - RNA, 19 nt, Human
aaacuucagacauagaauu

SEQ ID NO: 1895371 - RNA, 19 nt, Human
ggguggggggcuucauaca

SEQ ID NO: 1895372 - RNA, 19 nt, Human
aaacuuccagugcaacacu

SEQ ID NO: 1895373 - RNA, 13 nt, Human
aaagacagugaaa

SEQ ID NO: 1895374 - RNA, 9 nt, Human
aaagacaga

SEQ ID NO: 1895375 - RNA, 14 nt, Human
aaagacagagcugg

SEQ ID NO: 1895376 - RNA, 22 nt, Human
aaagacagggcugauaagcuaa

SEQ ID NO: 1895377 - RNA, 19 nt, Human
aaagacugaccaauauugu

SEQ ID NO: 1895378 - RNA, 11 nt, Human
gguccugcugc

SEQ ID NO: 1895379 - RNA, 12 nt, Human
gguccugcugca

SEQ ID NO: 1895380 - RNA, 14 nt, Human
gguccugcugcagu

SEQ ID NO: 1895381 - RNA, 14 nt, Human
aaagacuguacaaa

SEQ ID NO: 1895382 - RNA, 22 nt, Human
aaagagaugaugaaaauauuua

SEQ ID NO: 1895383 - RNA, 20 nt, Human
aaagagaugaugaaaauauu

SEQ ID NO: 1895384 - RNA, 19 nt, Human
aaagagaugaugaaaauau

SEQ ID NO: 1895385 - RNA, 23 nt, Human
aaagacugaguacguugugcauu

SEQ ID NO: 1895386 - RNA, 13 nt, Human
aaagacuguacaa

SEQ ID NO: 1895387 - RNA, 19 nt, Human
aaagaugcuucucacugcc

SEQ ID NO: 1895388 - RNA, 17 nt, Human
aaagaugcuucucacug

SEQ ID NO: 1895389 - RNA, 14 nt, Human
aaagaugcuucuca

SEQ ID NO: 1895390 - RNA, 15 nt, Human
aaagaggaaugaagu

SEQ ID NO: 1895391 - RNA, 17 nt, Human
gggucgacuucgggcug

SEQ ID NO: 1895392 - RNA, 23 nt, Human
gggucggaacccaagcuuagaac

SEQ ID NO: 1895393 - RNA, 13 nt, Human
gggucgcccugga

SEQ ID NO: 1895394 - RNA, 15 nt, Human
gggucgcccuggacu

SEQ ID NO: 1895395 - RNA, 19 nt, Human
gggggugcugggccccugc

SEQ ID NO: 1895396 - RNA, 18 nt, Human
ggguccaggauuccucuu

SEQ ID NO: 1895397 - RNA, 20 nt, Human
ggguccaggauuccucuuuu

SEQ ID NO: 1895398 - RNA, 16 nt, Human
ggguccagggagcagg

SEQ ID NO: 1895399 - RNA, 17 nt, Human
ggguccagggagcaggc

SEQ ID NO: 1895400 - RNA, 15 nt, Human
aaacgggcucagcaa

SEQ ID NO: 1895401 - RNA, 18 nt, Human
aaaccuuuguuugcaucu

SEQ ID NO: 1895402 - RNA, 18 nt, Human
aaaccuuuuauauuuagu

SEQ ID NO: 1895403 - RNA, 11 nt, Human
aaaccucuccu

SEQ ID NO: 1895404 - RNA, 22 nt, Human
aaaccucuccucauguucugcu

SEQ ID NO: 1895405 - RNA, 23 nt, Human
aaaccaagucaagugaaaaagga

SEQ ID NO: 1895406 - RNA, 13 nt, Human
aaacucuccucug

SEQ ID NO: 1895407 - RNA, 19 nt, Human
aaacuguuaauaguucagg

SEQ ID NO: 1895408 - RNA, 16 nt, Human
aaacuuaaucuaaaug

SEQ ID NO: 1895409 - RNA, 18 nt, Human
aaacuuaaucuaaaugga

SEQ ID NO: 1895410 - RNA, 17 nt, Human
aaacuuaaucuaaaugg

SEQ ID NO: 1895411 - RNA, 22 nt, Human
ggguggccuaagaguugagcuc

SEQ ID NO: 1895412 - RNA, 22 nt, Human
aaacuaggugcauauuuauaaa

SEQ ID NO: 1895413 - RNA, 20 nt, Human
aaacuaggggacaaagcaaa

SEQ ID NO: 1895414 - RNA, 18 nt, Human
aaacuaggugcauauuua

SEQ ID NO: 1895415 - RNA, 14 nt, Human
aaacgucuuaaaua

SEQ ID NO: 1895416 - RNA, 13 nt, Human
aaacgucuuaaau

SEQ ID NO: 1895417 - RNA, 15 nt, Human
aaacucauuuauaaa

SEQ ID NO: 1895418 - RNA, 24 nt, Human
aaacucauuuauaaagcuaaaaua

SEQ ID NO: 1895419 - RNA, 13 nt, Human
gggaugagaaagg

SEQ ID NO: 1895420 - RNA, 16 nt, Human
aaaauguuauuuaaca

SEQ ID NO: 1895421 - RNA, 14 nt, Human
aaaauguugagaau

SEQ ID NO: 1895422 - RNA, 19 nt, Human
aaaauuuagaaauauaauu

SEQ ID NO: 1895423 - RNA, 20 nt, Human
aaaauuuugauguuuuaagg

SEQ ID NO: 1895424 - RNA, 19 nt, Human
aaacacaaacgggcucagc

SEQ ID NO: 1895425 - RNA, 22 nt, Human
aaacaauguuaacauuuuuggu

SEQ ID NO: 1895426 - RNA, 17 nt, Human
aaacaaaguuacuaggu

SEQ ID NO: 1895427 - RNA, 11 nt, Human
aaacacauuuu

SEQ ID NO: 1895428 - RNA, 12 nt, Human
aaacacauuuuu

SEQ ID NO: 1895429 - RNA, 22 nt, Human
ggggaauguuugccucugccuc

SEQ ID NO: 1895430 - RNA, 18 nt, Human
ggggaauguuugccucug

SEQ ID NO: 1895431 - RNA, 15 nt, Human
ggggaccagagcugc

SEQ ID NO: 1895432 - RNA, 16 nt, Human
ggggaccagagcugcc

SEQ ID NO: 1895433 - RNA, 15 nt, Human
ggggaauucaucucu

SEQ ID NO: 1895434 - RNA, 14 nt, Human
aaacaguagugaua

SEQ ID NO: 1895435 - RNA, 16 nt, Human
aaacauggccuuugcu

SEQ ID NO: 1895436 - RNA, 17 nt, Human
aaacauggccuuugcuu

SEQ ID NO: 1895437 - RNA, 20 nt, Human
aaacaugugguuacacagug

SEQ ID NO: 1895438 - RNA, 11 nt, Human
ggggagaaagu

SEQ ID NO: 1895439 - RNA, 14 nt, Human
ggggccgcugccac

SEQ ID NO: 1895440 - RNA, 22 nt, Human
ggggccgcugccacccaccucc

SEQ ID NO: 1895441 - RNA, 18 nt, Human
ggggacccccgcccccug

SEQ ID NO: 1895442 - RNA, 13 nt, Human
ggggacccccgcc

SEQ ID NO: 1895443 - RNA, 15 nt, Human
ggggacccccgcccc

SEQ ID NO: 1895444 - RNA, 21 nt, Human
ggggacccaauguaggagcug

SEQ ID NO: 1895445 - RNA, 18 nt, Human
gggggccucagugccacu

SEQ ID NO: 1895446 - RNA, 17 nt, Human
gggggccucagugccac

SEQ ID NO: 1895447 - RNA, 15 nt, Human
gggggccucagugcc

SEQ ID NO: 1895448 - RNA, 12 nt, Human
gggggccucagu

SEQ ID NO: 1895449 - RNA, 15 nt, Human
ggggccucagugcca

SEQ ID NO: 1895450 - RNA, 23 nt, Human
ggggccuacagcuuugaucccug

SEQ ID NO: 1895451 - RNA, 20 nt, Human
ggggccuaggccucagccag

SEQ ID NO: 1895452 - RNA, 23 nt, Human
ggggccuaggccucagccagaga

SEQ ID NO: 1895453 - RNA, 17 nt, Human
guacacguguccuguag

SEQ ID NO: 1895454 - RNA, 15 nt, Human
guacacguguccugu

SEQ ID NO: 1895455 - RNA, 14 nt, Human
guacacguguccug

SEQ ID NO: 1895456 - RNA, 18 nt, Human
guaauuuuauaugaagau

SEQ ID NO: 1895457 - RNA, 15 nt, Human
guaauuuuauaugaa

SEQ ID NO: 1895458 - RNA, 15 nt, Human
aaauacaaaacuucc

SEQ ID NO: 1895459 - RNA, 17 nt, Human
aaauacagauagauaua

SEQ ID NO: 1895460 - RNA, 18 nt, Human
aaauaccagccaguaaau

SEQ ID NO: 1895461 - RNA, 22 nt, Human
aaauacgugggcauucaaaugu

SEQ ID NO: 1895462 - RNA, 17 nt, Human
aaauacugcaagaaaau

SEQ ID NO: 1895463 - RNA, 15 nt, Human
aaauauacacacagc

SEQ ID NO: 1895464 - RNA, 20 nt, Human
guaauaggcguaacuaauuu

SEQ ID NO: 1895465 - RNA, 22 nt, Human
guaauuugugauacaaugcugu

SEQ ID NO: 1895466 - RNA, 23 nt, Human
guaauuuaaaauugugauguguc

SEQ ID NO: 1895467 - RNA, 20 nt, Human
guaauuuaaaauugugaugu

SEQ ID NO: 1895468 - RNA, 19 nt, Human
guaauuuaaaauugugaug

SEQ ID NO: 1895469 - RNA, 15 nt, Human
guaauccaccugccu

SEQ ID NO: 1895470 - RNA, 20 nt, Human
guaaucccagcacuuuggga

SEQ ID NO: 1895471 - RNA, 21 nt, Human
guaauccaagcaaaugugaau

SEQ ID NO: 1895472 - RNA, 18 nt, Human
guaauaugcacacauuuu

SEQ ID NO: 1895473 - RNA, 17 nt, Human
guaauaugcacacauuu

SEQ ID NO: 1895474 - RNA, 16 nt, Human
guaauaugcacacauu

SEQ ID NO: 1895475 - RNA, 14 nt, Human
guaauaugcacaca

SEQ ID NO: 1895476 - RNA, 16 nt, Human
aaaguugguaaaccuu

SEQ ID NO: 1895477 - RNA, 17 nt, Human
aaaguugguaaaccuuu

SEQ ID NO: 1895478 - RNA, 20 nt, Human
aaaguuuaaaacagaagccu

SEQ ID NO: 1895479 - RNA, 21 nt, Human
aaauaacuggaggaauuuucu

SEQ ID NO: 1895480 - RNA, 18 nt, Human
aaauaaccaaucuacaau

SEQ ID NO: 1895481 - RNA, 14 nt, Human
aaauaaaaauaaau

SEQ ID NO: 1895482 - RNA, 13 nt, Human
aaauaaaaagaaa

SEQ ID NO: 1895483 - RNA, 14 nt, Human
aaauaagaauagaa

SEQ ID NO: 1895484 - RNA, 17 nt, Human
aaauaagaauagaaaua

SEQ ID NO: 1895485 - RNA, 23 nt, Human
aaaguucugcagauaaacaguag

SEQ ID NO: 1895486 - RNA, 14 nt, Human
aaaguuauucuuga

SEQ ID NO: 1895487 - RNA, 12 nt, Human
aaaguuacuagg

SEQ ID NO: 1895488 - RNA, 15 nt, Human
aaaguuacuagguaa

SEQ ID NO: 1895489 - RNA, 20 nt, Human
aaaguuacuagguaacuuca

SEQ ID NO: 1895490 - RNA, 21 nt, Human
aaaguuacuagguaacuucau

SEQ ID NO: 1895491 - RNA, 19 nt, Human
aaaguauucuguacucuua

SEQ ID NO: 1895492 - RNA, 21 nt, Human
aaaguacuucuccacccugcu

SEQ ID NO: 1895493 - RNA, 20 nt, Human
aaaguacuucuccacccugc

SEQ ID NO: 1895494 - RNA, 23 nt, Human
aaaguacuucuccacccugcucu

SEQ ID NO: 1895495 - RNA, 18 nt, Human
aaaguaucccuacuguaa

SEQ ID NO: 1895496 - RNA, 19 nt, Human
aaaguacuucuccacccug

SEQ ID NO: 1895497 - RNA, 16 nt, Human
aaaguacauguuaaac

SEQ ID NO: 1895498 - RNA, 20 nt, Human
aaaguacacuguuucaaacu

SEQ ID NO: 1895499 - RNA, 20 nt, Human
aaagguauuuuaaucaccaa

SEQ ID NO: 1895500 - RNA, 20 nt, Human
guacauguguagccugugca

SEQ ID NO: 1895501 - RNA, 19 nt, Human
guacauguguagccugugc

SEQ ID NO: 1895502 - RNA, 19 nt, Human
guacauggaauaacaugua

SEQ ID NO: 1895503 - RNA, 11 nt, Human
guacaugagaa

SEQ ID NO: 1895504 - RNA, 20 nt, Human
guacaugaaaacacauuuuu

SEQ ID NO: 1895505 - RNA, 19 nt, Human
guacaugaaaacacauuuu

SEQ ID NO: 1895506 - RNA, 18 nt, Human
guacaugaaaacacauuu

SEQ ID NO: 1895507 - RNA, 17 nt, Human
guacaugaaaacacauu

SEQ ID NO: 1895508 - RNA, 16 nt, Human
guacaugaaaacacau

SEQ ID NO: 1895509 - RNA, 15 nt, Human
guacaugaaaacaca

SEQ ID NO: 1895510 - RNA, 14 nt, Human
guacaugaaaacac

SEQ ID NO: 1895511 - RNA, 18 nt, Human
guacaucuauuuuggauu

SEQ ID NO: 1895512 - RNA, 20 nt, Human
guacaucuauuuuggauugu

SEQ ID NO: 1895513 - RNA, 15 nt, Human
guaccaaucauuuua

SEQ ID NO: 1895514 - RNA, 14 nt, Human
guaccaaucauuuu

SEQ ID NO: 1895515 - RNA, 21 nt, Human
guaccaaucauuuuaauuauu

SEQ ID NO: 1895516 - RNA, 15 nt, Human
guaccaccaaaaaag

SEQ ID NO: 1895517 - RNA, 20 nt, Human
guaccaagacuacuagggaa

SEQ ID NO: 1895518 - RNA, 23 nt, Human
guaccaagacuacuagggaaaug

SEQ ID NO: 1895519 - RNA, 12 nt, Human
guacccacugcu

SEQ ID NO: 1895520 - RNA, 19 nt, Human
guaccauuuauacaaauua

SEQ ID NO: 1895521 - RNA, 21 nt, Human
guaccauuuauacaaauuaga

SEQ ID NO: 1895522 - RNA, 20 nt, Human
guaccauaguaccauuuaua

SEQ ID NO: 1895523 - RNA, 21 nt, Human
guaccaugugcuacaggggcc

SEQ ID NO: 1895524 - RNA, 15 nt, Human
aaauccacuuuaucu

SEQ ID NO: 1895525 - RNA, 19 nt, Human
aaaucagccguguaaccau

SEQ ID NO: 1895526 - RNA, 12 nt, Human
aaaucagccugc

SEQ ID NO: 1895527 - RNA, 16 nt, Human
aaaucagcugcuacua

SEQ ID NO: 1895528 - RNA, 18 nt, Human
aaaucagccugcuccagc

SEQ ID NO: 1895529 - RNA, 14 nt, Human
aaaucagacuauga

SEQ ID NO: 1895530 - RNA, 21 nt, Human
aaaucagacuaugaaguuuuu

SEQ ID NO: 1895531 - RNA, 16 nt, Human
guacugagccuuguaa

SEQ ID NO: 1895532 - RNA, 16 nt, Human
guacuggagaaaaugg

SEQ ID NO: 1895533 - RNA, 19 nt, Human
guacuggcugauggaguaa

SEQ ID NO: 1895534 - RNA, 14 nt, Human
guacccacugcucu

SEQ ID NO: 1895535 - RNA, 13 nt, Human
guacccacugcuc

SEQ ID NO: 1895536 - RNA, 18 nt, Human
guacuacaguccucccau

SEQ ID NO: 1895537 - RNA, 19 nt, Human
guacuacaguccucccauc

SEQ ID NO: 1895538 - RNA, 13 nt, Human
guacuauguauca

SEQ ID NO: 1895539 - RNA, 17 nt, Human
guacuacaguccuccca

SEQ ID NO: 1895540 - RNA, 18 nt, Human
guacuaggauacugcugc

SEQ ID NO: 1895541 - RNA, 22 nt, Human
guacuaggauacugcugcguca

SEQ ID NO: 1895542 - RNA, 14 nt, Human
guacucauuaaaaa

SEQ ID NO: 1895543 - RNA, 15 nt, Human
guacuauguaucaau

SEQ ID NO: 1895544 - RNA, 17 nt, Human
guacuauguaucaauga

SEQ ID NO: 1895545 - RNA, 20 nt, Human
guacucaucaucaacccuaa

SEQ ID NO: 1895546 - RNA, 20 nt, Human
guagaaauaucugaaaaugu

SEQ ID NO: 1895547 - RNA, 21 nt, Human
guagaaauaucugaaaaugua

SEQ ID NO: 1895548 - RNA, 23 nt, Human
guagaaauaucugaaaauguaug

SEQ ID NO: 1895549 - RNA, 22 nt, Human
guagaacacaaggucauuugcu

SEQ ID NO: 1895550 - RNA, 21 nt, Human
guagaagucuuagauguauau

SEQ ID NO: 1895551 - RNA, 12 nt, Human
guagaagauggc

SEQ ID NO: 1895552 - RNA, 18 nt, Human
guagaagcccuucuaccu

SEQ ID NO: 1895553 - RNA, 22 nt, Human
guagaauuaucuaauuuauaaa

SEQ ID NO: 1895554 - RNA, 17 nt, Human
guagaauuaucuaauuu

SEQ ID NO: 1895555 - RNA, 14 nt, Human
guagaauugcauug

SEQ ID NO: 1895556 - RNA, 15 nt, Human
guagaauugcauuga

SEQ ID NO: 1895557 - RNA, 11 nt, Human
guagagccagg

SEQ ID NO: 1895558 - RNA, 15 nt, Human
guagagccagagguc

SEQ ID NO: 1895559 - RNA, 10 nt, Human
guagagccag

SEQ ID NO: 1895560 - RNA, 13 nt, Human
guagagacagggu

SEQ ID NO: 1895561 - RNA, 18 nt, Human
guagagccagggucucac

SEQ ID NO: 1895562 - RNA, 15 nt, Human
guagagccagggucu

SEQ ID NO: 1895563 - RNA, 12 nt, Human
guagagacaggg

SEQ ID NO: 1895564 - RNA, 11 nt, Human
guagagacagg

SEQ ID NO: 1895565 - RNA, 21 nt, Human
guagaccugucuccuggcggu

SEQ ID NO: 1895566 - RNA, 19 nt, Human
guagaccugucuccuggcg

SEQ ID NO: 1895567 - RNA, 14 nt, Human
ccacgcagccagga

SEQ ID NO: 1895568 - RNA, 13 nt, Human
ccacgcagccagg

SEQ ID NO: 1895569 - RNA, 16 nt, Human
ccacgcagccaggaca

SEQ ID NO: 1895570 - RNA, 15 nt, Human
ccacgcagccaggac

SEQ ID NO: 1895571 - RNA, 17 nt, Human
ccacgcagccaggacac

SEQ ID NO: 1895572 - RNA, 13 nt, Human
ccacgcccccacu

SEQ ID NO: 1895573 - RNA, 19 nt, Human
ccaccuuggcugcagggag

SEQ ID NO: 1895574 - RNA, 18 nt, Human
ccaccuuggcugcaggga

SEQ ID NO: 1895575 - RNA, 18 nt, Human
ccacgcuggaccuugaac

SEQ ID NO: 1895576 - RNA, 13 nt, Human
ccacgcuggagug

SEQ ID NO: 1895577 - RNA, 16 nt, Human
ccaccuuggcugcagg

SEQ ID NO: 1895578 - RNA, 15 nt, Human
ccaccuuggcugcag

SEQ ID NO: 1895579 - RNA, 14 nt, Human
ccaccuuggcugca

SEQ ID NO: 1895580 - RNA, 12 nt, Human
ccaccuuggcug

SEQ ID NO: 1895581 - RNA, 13 nt, Human
ccaccuagcagca

SEQ ID NO: 1895582 - RNA, 14 nt, Human
ccaccuagcagcac

SEQ ID NO: 1895583 - RNA, 23 nt, Human
ccaccuagcagcaccguucugug

SEQ ID NO: 1895584 - RNA, 19 nt, Human
ccaccaucaugucuggcua

SEQ ID NO: 1895585 - RNA, 18 nt, Human
ccaccaucaugucuggcu

SEQ ID NO: 1895586 - RNA, 14 nt, Human
ccaccagucauuuu

SEQ ID NO: 1895587 - RNA, 19 nt, Human
ccacagcccagccacggac

SEQ ID NO: 1895588 - RNA, 18 nt, Human
ccacagcccagccacgga

SEQ ID NO: 1895589 - RNA, 15 nt, Human
ccacagcccagccac

SEQ ID NO: 1895590 - RNA, 20 nt, Human
ccacagcccagccacggacg

SEQ ID NO: 1895591 - RNA, 17 nt, Human
ccacagagacaaggagg

SEQ ID NO: 1895592 - RNA, 22 nt, Human
ccacagagaaaguacuucucca

SEQ ID NO: 1895593 - RNA, 21 nt, Human
ccacacuggacuccggcccuc

SEQ ID NO: 1895594 - RNA, 22 nt, Human
ccacacuggacuccggcccucc

SEQ ID NO: 1895595 - RNA, 17 nt, Human
cauuuuuuaaaacaaga

SEQ ID NO: 1895596 - RNA, 16 nt, Human
cauuuuuuaaaacaag

SEQ ID NO: 1895597 - RNA, 19 nt, Human
cauuuuuuaaaugcaccug

SEQ ID NO: 1895598 - RNA, 16 nt, Human
cauuuuuuaaaugcac

SEQ ID NO: 1895599 - RNA, 15 nt, Human
cauuuuuuaaaugca

SEQ ID NO: 1895600 - RNA, 15 nt, Human
cauuuuuuaaaacaa

SEQ ID NO: 1895601 - RNA, 14 nt, Human
cauuuuuuaaaaca

SEQ ID NO: 1895602 - RNA, 17 nt, Human
cauuugucacacacuuu

SEQ ID NO: 1895603 - RNA, 15 nt, Human
cauuuggauuggaug

SEQ ID NO: 1895604 - RNA, 14 nt, Human
cauuuggauugggg

SEQ ID NO: 1895605 - RNA, 23 nt, Human
cauuuggauuggggucccucuaa

SEQ ID NO: 1895606 - RNA, 15 nt, Human
cauuuggaauacuuu

SEQ ID NO: 1895607 - RNA, 17 nt, Human
cauuuggaauacuuuuu

SEQ ID NO: 1895608 - RNA, 15 nt, Human
cauuuauucugcuca

SEQ ID NO: 1895609 - RNA, 14 nt, Human
cauuuauucugcuc

SEQ ID NO: 1895610 - RNA, 18 nt, Human
cauuuauaaagcuaaaau

SEQ ID NO: 1895611 - RNA, 21 nt, Human
cauuuauaaagcuaaaauaac

SEQ ID NO: 1895612 - RNA, 12 nt, Human
cauuuauacaaa

SEQ ID NO: 1895613 - RNA, 15 nt, Human
cauuuauacaaauua

SEQ ID NO: 1895614 - RNA, 17 nt, Human
cauuuauacaaauuaga

SEQ ID NO: 1895615 - RNA, 18 nt, Human
cauuuauacaaauuagaa

SEQ ID NO: 1895616 - RNA, 19 nt, Human
cauuuauacaaauuagaaa

SEQ ID NO: 1895617 - RNA, 20 nt, Human
cauuuauacaaauuagaaaa

SEQ ID NO: 1895618 - RNA, 12 nt, Human
cauuggaaauua

SEQ ID NO: 1895619 - RNA, 16 nt, Human
ccaaggccaaaggaag

SEQ ID NO: 1895620 - RNA, 18 nt, Human
ccaaucccagcuaccuca

SEQ ID NO: 1895621 - RNA, 17 nt, Human
ccaaauaaugucucugu

SEQ ID NO: 1895622 - RNA, 16 nt, Human
ccaaauaaugucucug

SEQ ID NO: 1895623 - RNA, 15 nt, Human
ccaaauaaugucucu

SEQ ID NO: 1895624 - RNA, 13 nt, Human
ccaagaagcccag

SEQ ID NO: 1895625 - RNA, 16 nt, Human
ccaacgucugugccau

SEQ ID NO: 1895626 - RNA, 24 nt, Human
ccaacggcaagggaacaaguacuu

SEQ ID NO: 1895627 - RNA, 14 nt, Human
ccaagaaacgucuu

SEQ ID NO: 1895628 - RNA, 22 nt, Human
ccaaauggaaaugggcagagca

SEQ ID NO: 1895629 - RNA, 13 nt, Human
ccaacgucugugc

SEQ ID NO: 1895630 - RNA, 15 nt, Human
ccaacgucugugcca

SEQ ID NO: 1895631 - RNA, 19 nt, Human
ccaagcuggucccacucag

SEQ ID NO: 1895632 - RNA, 12 nt, Human
ccaagcuggucc

SEQ ID NO: 1895633 - RNA, 14 nt, Human
ccaagaagcccagg

SEQ ID NO: 1895634 - RNA, 15 nt, Human
ccaaggccaaaggaa

SEQ ID NO: 1895635 - RNA, 12 nt, Human
cauuccuguucc

SEQ ID NO: 1895636 - RNA, 21 nt, Human
cauuaugaugugggucaagga

SEQ ID NO: 1895637 - RNA, 22 nt, Human
cauuaggugugacugaauuucu

SEQ ID NO: 1895638 - RNA, 18 nt, Human
cauguugcuguuuccagu

SEQ ID NO: 1895639 - RNA, 17 nt, Human
cauuagggggaacucua

SEQ ID NO: 1895640 - RNA, 23 nt, Human
cauuaucuagauacuguaucaug

SEQ ID NO: 1895641 - RNA, 13 nt, Human
cauguuggccagg

SEQ ID NO: 1895642 - RNA, 12 nt, Human
cauguuggccag

SEQ ID NO: 1895643 - RNA, 18 nt, Human
cauguccaagaagcccag

SEQ ID NO: 1895644 - RNA, 19 nt, Human
cauguccaagaagcccagg

SEQ ID NO: 1895645 - RNA, 20 nt, Human
cauguccaagaagcccagga

SEQ ID NO: 1895646 - RNA, 20 nt, Human
cauguauaauauuuuuaauu

SEQ ID NO: 1895647 - RNA, 18 nt, Human
cauguauaauauuuuuaa

SEQ ID NO: 1895648 - RNA, 15 nt, Human
cauguauaauauuuu

SEQ ID NO: 1895649 - RNA, 16 nt, Human
caugcacgugugugca

SEQ ID NO: 1895650 - RNA, 13 nt, Human
caugcuccuggcc

SEQ ID NO: 1895651 - RNA, 12 nt, Human
caugcugcccug

SEQ ID NO: 1895652 - RNA, 13 nt, Human
caugcugcccugu

SEQ ID NO: 1895653 - RNA, 22 nt, Human
caugauuaaccacuucagcuga

SEQ ID NO: 1895654 - RNA, 23 nt, Human
caugauuaaccacuucagcugac

SEQ ID NO: 1895655 - RNA, 12 nt, Human
caugcacaaauu

SEQ ID NO: 1895656 - RNA, 24 nt, Human
caugauuaaccacuucagcugacu

SEQ ID NO: 1895657 - RNA, 21 nt, Human
caugacacgaauauugcugau

SEQ ID NO: 1895658 - RNA, 18 nt, Human
caugaagguuucugaaaa

SEQ ID NO: 1895659 - RNA, 15 nt, Human
caugaagguuucuga

SEQ ID NO: 1895660 - RNA, 23 nt, Human
caugacacgaauauugcugaugg

SEQ ID NO: 1895661 - RNA, 23 nt, Human
caugaaguaauaugcacacauuu

SEQ ID NO: 1895662 - RNA, 22 nt, Human
caugaaguaauaugcacacauu

SEQ ID NO: 1895663 - RNA, 19 nt, Human
caugaaguaauaugcacac

SEQ ID NO: 1895664 - RNA, 15 nt, Human
caugaaguaauaugc

SEQ ID NO: 1895665 - RNA, 14 nt, Human
caugcugcccugug

SEQ ID NO: 1895666 - RNA, 15 nt, Human
caugcugcccuguga

SEQ ID NO: 1895667 - RNA, 15 nt, Human
cagugggagcugccu

SEQ ID NO: 1895668 - RNA, 14 nt, Human
cauacaccagcauu

SEQ ID NO: 1895669 - RNA, 18 nt, Human
cauacaccagcauuccuu

SEQ ID NO: 1895670 - RNA, 20 nt, Human
cauacaccagcauuccuuuu

SEQ ID NO: 1895671 - RNA, 13 nt, Human
cauaauuucagcu

SEQ ID NO: 1895672 - RNA, 13 nt, Human
cauacaccagcau

SEQ ID NO: 1895673 - RNA, 22 nt, Human
cauagcagagaaugaaagggcc

SEQ ID NO: 1895674 - RNA, 19 nt, Human
cauagcagagaaugaaagg

SEQ ID NO: 1895675 - RNA, 22 nt, Human
cauagcuuacaagccagcugga

SEQ ID NO: 1895676 - RNA, 22 nt, Human
cauaugccugggcagaaggaag

SEQ ID NO: 1895677 - RNA, 15 nt, Human
cauaugccugggcag

SEQ ID NO: 1895678 - RNA, 20 nt, Human
cauaugccugggcagaagga

SEQ ID NO: 1895679 - RNA, 22 nt, Human
cauauucaggaagcucagggcc

SEQ ID NO: 1895680 - RNA, 20 nt, Human
cauauucaggaagcucaggg

SEQ ID NO: 1895681 - RNA, 14 nt, Human
cauauucaggaagc

SEQ ID NO: 1895682 - RNA, 15 nt, Human
cauauucaggaagcu

SEQ ID NO: 1895683 - RNA, 16 nt, Human
cauccccugccuccau

SEQ ID NO: 1895684 - RNA, 14 nt, Human
cauccccuguagag

SEQ ID NO: 1895685 - RNA, 19 nt, Human
cauccccgcagugugcacu

SEQ ID NO: 1895686 - RNA, 13 nt, Human
cauccccugccuc

SEQ ID NO: 1895687 - RNA, 14 nt, Human
cauccccugccucc

SEQ ID NO: 1895688 - RNA, 15 nt, Human
cauccccugccucca

SEQ ID NO: 1895689 - RNA, 22 nt, Human
cauccccugccuccauccuagu

SEQ ID NO: 1895690 - RNA, 19 nt, Human
caucccauaugccugggca

SEQ ID NO: 1895691 - RNA, 15 nt, Human
caucugcucuccuuc

SEQ ID NO: 1895692 - RNA, 14 nt, Human
caucugcucuccuu

SEQ ID NO: 1895693 - RNA, 13 nt, Human
caucugcucuccu

SEQ ID NO: 1895694 - RNA, 18 nt, Human
cauccuuccucacaccag

SEQ ID NO: 1895695 - RNA, 15 nt, Human
cauccuucccugucu

SEQ ID NO: 1895696 - RNA, 21 nt, Human
cauccuucccugucugccagg

SEQ ID NO: 1895697 - RNA, 22 nt, Human
cauccuucccugucugccaggg

SEQ ID NO: 1895698 - RNA, 20 nt, Human
caucugccgugccuggaucc

SEQ ID NO: 1895699 - RNA, 16 nt, Human
caucaggccaggcccu

SEQ ID NO: 1895700 - RNA, 19 nt, Human
caucaggccaggcccucug

SEQ ID NO: 1895701 - RNA, 19 nt, Human
cauccauggggcugauugu

SEQ ID NO: 1895702 - RNA, 15 nt, Human
caucaggccaggccc

SEQ ID NO: 1895703 - RNA, 20 nt, Human
caucugggcuccuccagggu

SEQ ID NO: 1895704 - RNA, 16 nt, Human
caucugggcuccucca

SEQ ID NO: 1895705 - RNA, 17 nt, Human
caucugggcuccuccag

SEQ ID NO: 1895706 - RNA, 21 nt, Human
cagcugccucugccacugacu

SEQ ID NO: 1895707 - RNA, 12 nt, Human
cagcugcacuga

SEQ ID NO: 1895708 - RNA, 18 nt, Human
cagcugcacugaugcugc

SEQ ID NO: 1895709 - RNA, 14 nt, Human
caggaaaggcucca

SEQ ID NO: 1895710 - RNA, 15 nt, Human
caggaaaggcuccag

SEQ ID NO: 1895711 - RNA, 18 nt, Human
caggaaaggcccagccac

SEQ ID NO: 1895712 - RNA, 19 nt, Human
cagcuucauuuccuguguc

SEQ ID NO: 1895713 - RNA, 18 nt, Human
cagcuucauuuccugugu

SEQ ID NO: 1895714 - RNA, 15 nt, Human
cagcuucauuuccug

SEQ ID NO: 1895715 - RNA, 18 nt, Human
cagcugugcucuggacag

SEQ ID NO: 1895716 - RNA, 20 nt, Human
cagcuccagcucaccagccc

SEQ ID NO: 1895717 - RNA, 18 nt, Human
cagcuccagcucaccagc

SEQ ID NO: 1895718 - RNA, 17 nt, Human
cagcuccagcucaccag

SEQ ID NO: 1895719 - RNA, 16 nt, Human
cagcuccagcucacca

SEQ ID NO: 1895720 - RNA, 22 nt, Human
cagcuccagcucaccagcccca

SEQ ID NO: 1895721 - RNA, 13 nt, Human
cagcuccacccug

SEQ ID NO: 1895722 - RNA, 15 nt, Human
cagcuccacccuggc

SEQ ID NO: 1895723 - RNA, 15 nt, Human
cagcuccagcucacc

SEQ ID NO: 1895724 - RNA, 14 nt, Human
cagcuccagcucac

SEQ ID NO: 1895725 - RNA, 13 nt, Human
cagcuccagcuca

SEQ ID NO: 1895726 - RNA, 19 nt, Human
cagcuccaagaauuucuag

SEQ ID NO: 1895727 - RNA, 23 nt, Human
cagcuccaaccugcaaagaucug

SEQ ID NO: 1895728 - RNA, 16 nt, Human
cagcuccaagaauuuc

SEQ ID NO: 1895729 - RNA, 17 nt, Human
cagcuccaaccugcaaa

SEQ ID NO: 1895730 - RNA, 20 nt, Human
cagcuccaaccugcaaagau

SEQ ID NO: 1895731 - RNA, 21 nt, Human
cagccgagauagccaaggcca

SEQ ID NO: 1895732 - RNA, 21 nt, Human
cagcccuuagcagggaaacag

SEQ ID NO: 1895733 - RNA, 16 nt, Human
cagcccuuagcaggga

SEQ ID NO: 1895734 - RNA, 22 nt, Human
cagccccuggaugcagccucac

SEQ ID NO: 1895735 - RNA, 15 nt, Human
cagcccuuagcaggg

SEQ ID NO: 1895736 - RNA, 17 nt, Human
cagccccuggaugcagc

SEQ ID NO: 1895737 - RNA, 18 nt, Human
cagccccuggaugcagcc

SEQ ID NO: 1895738 - RNA, 19 nt, Human
cagccccuggaugcagccu

SEQ ID NO: 1895739 - RNA, 21 nt, Human
cagccccuggaugcagccuca

SEQ ID NO: 1895740 - RNA, 12 nt, Human
cagccccuggau

SEQ ID NO: 1895741 - RNA, 13 nt, Human
cagccccuggaug

SEQ ID NO: 1895742 - RNA, 14 nt, Human
cagccccuggaugc

SEQ ID NO: 1895743 - RNA, 18 nt, Human
cagccugagcgacaguga

SEQ ID NO: 1895744 - RNA, 22 nt, Human
cagccugagcgacagugagacu

SEQ ID NO: 1895745 - RNA, 19 nt, Human
cagccugagcgacagugag

SEQ ID NO: 1895746 - RNA, 17 nt, Human
cagcggggacagcuccu

SEQ ID NO: 1895747 - RNA, 16 nt, Human
cagcggggacagcucc

SEQ ID NO: 1895748 - RNA, 15 nt, Human
cagcggggacagcuc

SEQ ID NO: 1895749 - RNA, 16 nt, Human
cagccugagcaacucu

SEQ ID NO: 1895750 - RNA, 20 nt, Human
cagccugagcaacucuugau

SEQ ID NO: 1895751 - RNA, 21 nt, Human
cagccugagcaacucuugauu

SEQ ID NO: 1895752 - RNA, 15 nt, Human
cagcguacucaucau

SEQ ID NO: 1895753 - RNA, 20 nt, Human
cagcaccuacaguguacagu

SEQ ID NO: 1895754 - RNA, 21 nt, Human
cagcagguccccagcuuuggc

SEQ ID NO: 1895755 - RNA, 15 nt, Human
cagcaccuacagugu

SEQ ID NO: 1895756 - RNA, 17 nt, Human
cagcaccguucugugca

SEQ ID NO: 1895757 - RNA, 18 nt, Human
cagcaccguucugugcac

SEQ ID NO: 1895758 - RNA, 16 nt, Human
cagcaccguucugugc

SEQ ID NO: 1895759 - RNA, 13 nt, Human
cagcacagccaac

SEQ ID NO: 1895760 - RNA, 19 nt, Human
cagcacacagggcagugag

SEQ ID NO: 1895761 - RNA, 18 nt, Human
cagcacacagggcaguga

SEQ ID NO: 1895762 - RNA, 22 nt, Human
cagccaggccacaagacccuug

SEQ ID NO: 1895763 - RNA, 12 nt, Human
cagccaggccac

SEQ ID NO: 1895764 - RNA, 13 nt, Human
cagccaggccaca

SEQ ID NO: 1895765 - RNA, 19 nt, Human
cagcauauucaggaagcuc

SEQ ID NO: 1895766 - RNA, 22 nt, Human
cagcauauucaggaagcucagg

SEQ ID NO: 1895767 - RNA, 23 nt, Human
cagcauauucaggaagcucaggg

SEQ ID NO: 1895768 - RNA, 22 nt, Human
cagagggccugcaagggaguga

SEQ ID NO: 1895769 - RNA, 14 nt, Human
cagaggggcagaug

SEQ ID NO: 1895770 - RNA, 17 nt, Human
cagaggggcagauggaa

SEQ ID NO: 1895771 - RNA, 23 nt, Human
cagaaguuucugccgcagcccug

SEQ ID NO: 1895772 - RNA, 19 nt, Human
cagaaguuucugccgcagc

SEQ ID NO: 1895773 - RNA, 20 nt, Human
cagaaguuugagaucagccu

SEQ ID NO: 1895774 - RNA, 22 nt, Human
cagaaguuugagaucagccugg

SEQ ID NO: 1895775 - RNA, 23 nt, Human
cagaaguuugagaucagccuggg

SEQ ID NO: 1895776 - RNA, 16 nt, Human
cagagcugccaccugc

SEQ ID NO: 1895777 - RNA, 18 nt, Human
cagagcugccaccugccu

SEQ ID NO: 1895778 - RNA, 20 nt, Human
cagagcugggauguuucugu

SEQ ID NO: 1895779 - RNA, 20 nt, Human
cagagucagaaguuucugcc

SEQ ID NO: 1895780 - RNA, 18 nt, Human
cagaggggguggccuccc

SEQ ID NO: 1895781 - RNA, 17 nt, Human
cagaggggguggccucc

SEQ ID NO: 1895782 - RNA, 19 nt, Human
cagaggggguggccuccca

SEQ ID NO: 1895783 - RNA, 20 nt, Human
cagaggggguggccucccaa

SEQ ID NO: 1895784 - RNA, 19 nt, Human
cagauaugauucaaauguc

SEQ ID NO: 1895785 - RNA, 17 nt, Human
cagauaugauucaaaug

SEQ ID NO: 1895786 - RNA, 16 nt, Human
cagauaugauucaaau

SEQ ID NO: 1895787 - RNA, 15 nt, Human
cagauaugauucaaa

SEQ ID NO: 1895788 - RNA, 12 nt, Human
caggagcuuccu

SEQ ID NO: 1895789 - RNA, 16 nt, Human
caggacccugaagggg

SEQ ID NO: 1895790 - RNA, 14 nt, Human
caggacccugaagg

SEQ ID NO: 1895791 - RNA, 15 nt, Human
caggacccugaaggg

SEQ ID NO: 1895792 - RNA, 23 nt, Human
caggagcuuccuguccucccagc

SEQ ID NO: 1895793 - RNA, 13 nt, Human
caggaggaagggg

SEQ ID NO: 1895794 - RNA, 14 nt, Human
caggaggccagccu

SEQ ID NO: 1895795 - RNA, 15 nt, Human
caggaggccagccuu

SEQ ID NO: 1895796 - RNA, 16 nt, Human
caggaggccagccuug

SEQ ID NO: 1895797 - RNA, 13 nt, Human
caggacccugaag

SEQ ID NO: 1895798 - RNA, 14 nt, Human
caggaccccugagu

SEQ ID NO: 1895799 - RNA, 12 nt, Human
caggaccccuga

SEQ ID NO: 1895800 - RNA, 17 nt, Human
caggaggccagccuuga

SEQ ID NO: 1895801 - RNA, 23 nt, Human
caggcacccaccaucaugucugg

SEQ ID NO: 1895802 - RNA, 22 nt, Human
caggcacccaccaucaugucug

SEQ ID NO: 1895803 - RNA, 18 nt, Human
caggcacccaccaucaug

SEQ ID NO: 1895804 - RNA, 15 nt, Human
caggagguggucugg

SEQ ID NO: 1895805 - RNA, 15 nt, Human
caggcagauccagga

SEQ ID NO: 1895806 - RNA, 17 nt, Human
caggcagauccaggacu

SEQ ID NO: 1895807 - RNA, 18 nt, Human
caggcagauccaggacua

SEQ ID NO: 1895808 - RNA, 21 nt, Human
caggccagagggagugacaga

SEQ ID NO: 1895809 - RNA, 19 nt, Human
caggccagagggagugaca

SEQ ID NO: 1895810 - RNA, 23 nt, Human
caggccagagggagugacagagg

SEQ ID NO: 1895811 - RNA, 19 nt, Human
caggcugggcuucaguggc

SEQ ID NO: 1895812 - RNA, 17 nt, Human
caggcugggcuucagug

SEQ ID NO: 1895813 - RNA, 18 nt, Human
cagggaggacgcucucug

SEQ ID NO: 1895814 - RNA, 17 nt, Human
cagggaggacgcucucu

SEQ ID NO: 1895815 - RNA, 19 nt, Human
cagggaggacgcucucugg

SEQ ID NO: 1895816 - RNA, 16 nt, Human
caggcugggcuucagu

SEQ ID NO: 1895817 - RNA, 15 nt, Human
caggcuggcgugcag

SEQ ID NO: 1895818 - RNA, 21 nt, Human
caggcggugggcacccacccu

SEQ ID NO: 1895819 - RNA, 15 nt, Human
caggcggugggcacc

SEQ ID NO: 1895820 - RNA, 17 nt, Human
caggcggugggcaccca

SEQ ID NO: 1895821 - RNA, 23 nt, Human
caggccugagauuucaucugcuc

SEQ ID NO: 1895822 - RNA, 21 nt, Human
caggccugagauuucaucugc

SEQ ID NO: 1895823 - RNA, 19 nt, Human
caggccugagauuucaucu

SEQ ID NO: 1895824 - RNA, 18 nt, Human
caggccugagauuucauc

SEQ ID NO: 1895825 - RNA, 16 nt, Human
caggccugagauuuca

SEQ ID NO: 1895826 - RNA, 14 nt, Human
caggccugagauuu

SEQ ID NO: 1895827 - RNA, 15 nt, Human
caggccugacucuca

SEQ ID NO: 1895828 - RNA, 18 nt, Human
cagggaggugaccccagg

SEQ ID NO: 1895829 - RNA, 22 nt, Human
cagggaguccgaaagggacuug

SEQ ID NO: 1895830 - RNA, 17 nt, Human
caggugcagccagaggc

SEQ ID NO: 1895831 - RNA, 19 nt, Human
caggugcagccagaggcac

SEQ ID NO: 1895832 - RNA, 14 nt, Human
caggugcagccaga

SEQ ID NO: 1895833 - RNA, 15 nt, Human
caggugcagccagag

SEQ ID NO: 1895834 - RNA, 16 nt, Human
caggugcagccagagg

SEQ ID NO: 1895835 - RNA, 22 nt, Human
caggugaguccuagagcuacag

SEQ ID NO: 1895836 - RNA, 23 nt, Human
caggugaguccuagagcuacagg

SEQ ID NO: 1895837 - RNA, 20 nt, Human
caggugauccacccaccuca

SEQ ID NO: 1895838 - RNA, 20 nt, Human
caggugaguccuagagcuac

SEQ ID NO: 1895839 - RNA, 14 nt, Human
caggguuggccccu

SEQ ID NO: 1895840 - RNA, 12 nt, Human
caggguuggccc

SEQ ID NO: 1895841 - RNA, 17 nt, Human
caggugauccacccacc

SEQ ID NO: 1895842 - RNA, 16 nt, Human
caggugauccacccac

SEQ ID NO: 1895843 - RNA, 14 nt, Human
cagguugguggggg

SEQ ID NO: 1895844 - RNA, 14 nt, Human
caggugcgaaagga

SEQ ID NO: 1895845 - RNA, 18 nt, Human
caggugcuaggaacacuc

SEQ ID NO: 1895846 - RNA, 20 nt, Human
caggugcuaggaacacuccu

SEQ ID NO: 1895847 - RNA, 12 nt, Human
cagggugugucu

SEQ ID NO: 1895848 - RNA, 13 nt, Human
cagggugugugcu

SEQ ID NO: 1895849 - RNA, 18 nt, Human
cagggucucacucugucg

SEQ ID NO: 1895850 - RNA, 17 nt, Human
cagggucucacucuguc

SEQ ID NO: 1895851 - RNA, 21 nt, Human
cagggucucacucugucgccc

SEQ ID NO: 1895852 - RNA, 22 nt, Human
cagggucucacucugucgccca

SEQ ID NO: 1895853 - RNA, 20 nt, Human
cagucaccccggccaccugc

SEQ ID NO: 1895854 - RNA, 19 nt, Human
cagucaccccggccaccug

SEQ ID NO: 1895855 - RNA, 22 nt, Human
cagucaccccggccaccugcgg

SEQ ID NO: 1895856 - RNA, 16 nt, Human
cagguuuaagcuguua

SEQ ID NO: 1895857 - RNA, 18 nt, Human
cagguuuaagcuguuacu

SEQ ID NO: 1895858 - RNA, 15 nt, Human
cagguuugggacccc

SEQ ID NO: 1895859 - RNA, 23 nt, Human
cagguuugggaccccuggugguu

SEQ ID NO: 1895860 - RNA, 18 nt, Human
cagguuugggaccccugg

SEQ ID NO: 1895861 - RNA, 15 nt, Human
cagugccaaaaacaa

SEQ ID NO: 1895862 - RNA, 12 nt, Human
cagugcccacag

SEQ ID NO: 1895863 - RNA, 11 nt, Human
cagugggagcu

SEQ ID NO: 1895864 - RNA, 20 nt, Human
cagucugauucccaagcucu

SEQ ID NO: 1895865 - RNA, 19 nt, Human
cagucugauucccaagcuc

SEQ ID NO: 1895866 - RNA, 15 nt, Human
cagucugaucuguga

SEQ ID NO: 1895867 - RNA, 22 nt, Human
cagugcacuaauguguaagaca

SEQ ID NO: 1895868 - RNA, 19 nt, Human
cagugcaugcugucccuua

SEQ ID NO: 1895869 - RNA, 22 nt, Human
cagugcaugcugucccuuacgu

SEQ ID NO: 1895870 - RNA, 23 nt, Human
cagugcaugcugucccuuacgug

SEQ ID NO: 1895871 - RNA, 22 nt, Human
cagucugaugagaacucugagc

SEQ ID NO: 1895872 - RNA, 16 nt, Human
cagucuccaccaggaa

SEQ ID NO: 1895873 - RNA, 17 nt, Human
cagucuccaccaggaac

SEQ ID NO: 1895874 - RNA, 15 nt, Human
caguccuuccaccuc

SEQ ID NO: 1895875 - RNA, 17 nt, Human
auuucacuuaauaaugu

SEQ ID NO: 1895876 - RNA, 12 nt, Human
auuucacuuaau

SEQ ID NO: 1895877 - RNA, 16 nt, Human
auuuaugcauauuauu

SEQ ID NO: 1895878 - RNA, 22 nt, Human
auuuaugcauauuauuuuaugu

SEQ ID NO: 1895879 - RNA, 19 nt, Human
auuuaucuugucucugggc

SEQ ID NO: 1895880 - RNA, 15 nt, Human
auuuauauguacaug

SEQ ID NO: 1895881 - RNA, 16 nt, Human
auuuauauguacauga

SEQ ID NO: 1895882 - RNA, 17 nt, Human
auuuauauguacaugag

SEQ ID NO: 1895883 - RNA, 16 nt, Human
auuuaaugaaagacug

SEQ ID NO: 1895884 - RNA, 15 nt, Human
auuuaaugaaagacu

SEQ ID NO: 1895885 - RNA, 20 nt, Human
auuuaaugaaagacuguaca

SEQ ID NO: 1895886 - RNA, 21 nt, Human
auuuaaugaaagacuguacaa

SEQ ID NO: 1895887 - RNA, 18 nt, Human
auuucugcauauguugaa

SEQ ID NO: 1895888 - RNA, 22 nt, Human
auuucugcauauguugaauacu

SEQ ID NO: 1895889 - RNA, 23 nt, Human
auuucugcauauguugaauacuu

SEQ ID NO: 1895890 - RNA, 17 nt, Human
auuucuauuuauuuacu

SEQ ID NO: 1895891 - RNA, 13 nt, Human
auuucuauuuauu

SEQ ID NO: 1895892 - RNA, 16 nt, Human
auuucuauuuauuuac

SEQ ID NO: 1895893 - RNA, 12 nt, Human
auuucuauuuau

SEQ ID NO: 1895894 - RNA, 12 nt, Human
auuucagacucc

SEQ ID NO: 1895895 - RNA, 12 nt, Human
auuucauaaaga

SEQ ID NO: 1895896 - RNA, 16 nt, Human
auugcuuguuggauuu

SEQ ID NO: 1895897 - RNA, 14 nt, Human
auugcuugcacaaa

SEQ ID NO: 1895898 - RNA, 12 nt, Human
auugcuuugagc

SEQ ID NO: 1895899 - RNA, 10 nt, Human
auugcuuuga

SEQ ID NO: 1895900 - RNA, 20 nt, Human
auugugugugcucugcuuca

SEQ ID NO: 1895901 - RNA, 13 nt, Human
auuguguuugugu

SEQ ID NO: 1895902 - RNA, 16 nt, Human
auuguugucugcaacu

SEQ ID NO: 1895903 - RNA, 13 nt, Human
auucaauaaauug

SEQ ID NO: 1895904 - RNA, 16 nt, Human
auucaauauccuuugc

SEQ ID NO: 1895905 - RNA, 19 nt, Human
auucaauauccuuugccuc

SEQ ID NO: 1895906 - RNA, 17 nt, Human
auuaugggaaucaagau

SEQ ID NO: 1895907 - RNA, 18 nt, Human
auuaugggaaucaagauu

SEQ ID NO: 1895908 - RNA, 18 nt, Human
auucaaauguauuacagu

SEQ ID NO: 1895909 - RNA, 18 nt, Human
auucaacagguuuuccug

SEQ ID NO: 1895910 - RNA, 16 nt, Human
auucaaaugucuauaa

SEQ ID NO: 1895911 - RNA, 20 nt, Human
auuaguacuccccuccuuga

SEQ ID NO: 1895912 - RNA, 16 nt, Human
auuagggagaaaauuc

SEQ ID NO: 1895913 - RNA, 17 nt, Human
auuagggagaaaauuca

SEQ ID NO: 1895914 - RNA, 22 nt, Human
auuaguaccauaguaccauuua

SEQ ID NO: 1895915 - RNA, 11 nt, Human
auuaaauuaug

SEQ ID NO: 1895916 - RNA, 17 nt, Human
auuaaaugcccagcccc

SEQ ID NO: 1895917 - RNA, 19 nt, Human
auuaaaugcccagccccuu

SEQ ID NO: 1895918 - RNA, 14 nt, Human
auucuugcaaagua

SEQ ID NO: 1895919 - RNA, 16 nt, Human
auucuugcaaaguauc

SEQ ID NO: 1895920 - RNA, 15 nt, Human
auucuugcaaaguau

SEQ ID NO: 1895921 - RNA, 12 nt, Human
auucuugcauau

SEQ ID NO: 1895922 - RNA, 13 nt, Human
auucuugcauauu

SEQ ID NO: 1895923 - RNA, 22 nt, Human
auucuucuguacgucugacagg

SEQ ID NO: 1895924 - RNA, 20 nt, Human
auucuucugcuucagccucc

SEQ ID NO: 1895925 - RNA, 19 nt, Human
auucuucugcuucagccuc

SEQ ID NO: 1895926 - RNA, 19 nt, Human
auucucuaguuugauuaaa

SEQ ID NO: 1895927 - RNA, 18 nt, Human
auucucuaguuugauuaa

SEQ ID NO: 1895928 - RNA, 17 nt, Human
auucucuaguuugauua

SEQ ID NO: 1895929 - RNA, 22 nt, Human
auucuccuuguguuacuaaguu

SEQ ID NO: 1895930 - RNA, 21 nt, Human
auucuccuuguguuacuaagu

SEQ ID NO: 1895931 - RNA, 19 nt, Human
auucuccuuguguuacuaa

SEQ ID NO: 1895932 - RNA, 18 nt, Human
auucuccuuguguuacua

SEQ ID NO: 1895933 - RNA, 12 nt, Human
auuccuuuccag

SEQ ID NO: 1895934 - RNA, 17 nt, Human
auuccucaacguauugu

SEQ ID NO: 1895935 - RNA, 12 nt, Human
auuccuuccugu

SEQ ID NO: 1895936 - RNA, 14 nt, Human
auuccuuccuguuc

SEQ ID NO: 1895937 - RNA, 16 nt, Human
auuccuuccuguucug

SEQ ID NO: 1895938 - RNA, 17 nt, Human
auuccuuccuguucuga

SEQ ID NO: 1895939 - RNA, 18 nt, Human
auuccuuccuguucugaa

SEQ ID NO: 1895940 - RNA, 21 nt, Human
caaaaggauaaugaauacuuu

SEQ ID NO: 1895941 - RNA, 20 nt, Human
caaacaugugguuaaugcca

SEQ ID NO: 1895942 - RNA, 16 nt, Human
auuuuuuugagacaga

SEQ ID NO: 1895943 - RNA, 18 nt, Human
auuuuuuuuuccuucagu

SEQ ID NO: 1895944 - RNA, 20 nt, Human
auuuuuuuuuccuucagugc

SEQ ID NO: 1895945 - RNA, 22 nt, Human
auuuuuuuuuccuucagugccu

SEQ ID NO: 1895946 - RNA, 23 nt, Human
auuuuuuuuuccuucagugccuu

SEQ ID NO: 1895947 - RNA, 13 nt, Human
caaaagaagcccc

SEQ ID NO: 1895948 - RNA, 16 nt, Human
caaaagaagcccccag

SEQ ID NO: 1895949 - RNA, 17 nt, Human
caaaagaagcccccagc

SEQ ID NO: 1895950 - RNA, 18 nt, Human
caaaagaagcccccagcu

SEQ ID NO: 1895951 - RNA, 19 nt, Human
caaaagaagcccccagcua

SEQ ID NO: 1895952 - RNA, 14 nt, Human
auuuuuagacagag

SEQ ID NO: 1895953 - RNA, 21 nt, Human
auuuuuagauaguuagaaccu

SEQ ID NO: 1895954 - RNA, 19 nt, Human
auuuuuaagugcugcauuu

SEQ ID NO: 1895955 - RNA, 18 nt, Human
auuuuuaagugcugcauu

SEQ ID NO: 1895956 - RNA, 16 nt, Human
auuuuuaagugcugca

SEQ ID NO: 1895957 - RNA, 21 nt, Human
auuuuauaucaauuuaaaaaa

SEQ ID NO: 1895958 - RNA, 19 nt, Human
auuuuagggguagcauuug

SEQ ID NO: 1895959 - RNA, 18 nt, Human
auuuucuucaccucugcu

SEQ ID NO: 1895960 - RNA, 20 nt, Human
auuuugaauaaauaaaugua

SEQ ID NO: 1895961 - RNA, 23 nt, Human
caaccaugagaccacuguuauca

SEQ ID NO: 1895962 - RNA, 18 nt, Human
caaccaugagaccacugu

SEQ ID NO: 1895963 - RNA, 19 nt, Human
caaccagggagcugcaggg

SEQ ID NO: 1895964 - RNA, 17 nt, Human
caaccagcuaagaaaag

SEQ ID NO: 1895965 - RNA, 17 nt, Human
caaccagggagcugcag

SEQ ID NO: 1895966 - RNA, 22 nt, Human
caaccagggauuguuucuguuu

SEQ ID NO: 1895967 - RNA, 15 nt, Human
caaccagcuaagaaa

SEQ ID NO: 1895968 - RNA, 22 nt, Human
caaccagcuaagaaaagauuuu

SEQ ID NO: 1895969 - RNA, 18 nt, Human
caaccccccagcacugag

SEQ ID NO: 1895970 - RNA, 16 nt, Human
caaccccccagcacug

SEQ ID NO: 1895971 - RNA, 15 nt, Human
caaccccccagcacu

SEQ ID NO: 1895972 - RNA, 14 nt, Human
caaccccccagcac

SEQ ID NO: 1895973 - RNA, 16 nt, Human
caacccccauuucuau

SEQ ID NO: 1895974 - RNA, 20 nt, Human
caaccccccagcacugagga

SEQ ID NO: 1895975 - RNA, 19 nt, Human
caaccccccagcacugagg

SEQ ID NO: 1895976 - RNA, 17 nt, Human
caacuacagaaaaacca

SEQ ID NO: 1895977 - RNA, 18 nt, Human
caacucaccccagcccca

SEQ ID NO: 1895978 - RNA, 17 nt, Human
caacucauauuuucaug

SEQ ID NO: 1895979 - RNA, 19 nt, Human
caagacccaaaaggcagaa

SEQ ID NO: 1895980 - RNA, 20 nt, Human
caagaauuucuaggacugaa

SEQ ID NO: 1895981 - RNA, 18 nt, Human
caagaccacguuucuaaa

SEQ ID NO: 1895982 - RNA, 17 nt, Human
caagaccacguuucuaa

SEQ ID NO: 1895983 - RNA, 14 nt, Human
caacucuccuccag

SEQ ID NO: 1895984 - RNA, 22 nt, Human
caagaauugaagcaggacuaaa

SEQ ID NO: 1895985 - RNA, 18 nt, Human
caacucuccccugaccug

SEQ ID NO: 1895986 - RNA, 24 nt, Human
caacucuccccugaccugugagcc

SEQ ID NO: 1895987 - RNA, 13 nt, Human
caacucuagcugg

SEQ ID NO: 1895988 - RNA, 11 nt, Human
caaagggugug

SEQ ID NO: 1895989 - RNA, 22 nt, Human
caaagguaaaucagacuaugaa

SEQ ID NO: 1895990 - RNA, 14 nt, Human
caaagguaaaucag

SEQ ID NO: 1895991 - RNA, 22 nt, Human
caaaguagaagucuuagaugua

SEQ ID NO: 1895992 - RNA, 21 nt, Human
caaaguaucccuacuguaauu

SEQ ID NO: 1895993 - RNA, 19 nt, Human
caaaguaucccuacuguaa

SEQ ID NO: 1895994 - RNA, 17 nt, Human
caaaggguccagaagga

SEQ ID NO: 1895995 - RNA, 21 nt, Human
caaaggguccagaaggagaca

SEQ ID NO: 1895996 - RNA, 22 nt, Human
caaagcagugcaugcugucccu

SEQ ID NO: 1895997 - RNA, 16 nt, Human
caaagauauuuugcuu

SEQ ID NO: 1895998 - RNA, 14 nt, Human
caaagauauuuugc

SEQ ID NO: 1895999 - RNA, 18 nt, Human
caaagcagugcaugcugu

SEQ ID NO: 1896000 - RNA, 21 nt, Human
caaagcagugcaugcuguccc

SEQ ID NO: 1896001 - RNA, 22 nt, Human
caaaugagaaaaugucuuuauu

SEQ ID NO: 1896002 - RNA, 12 nt, Human
caaaugagccau

SEQ ID NO: 1896003 - RNA, 13 nt, Human
caaaugagccaug

SEQ ID NO: 1896004 - RNA, 15 nt, Human
caaaugcuaauguca

SEQ ID NO: 1896005 - RNA, 21 nt, Human
caaaugcuaaugucaaacuug

SEQ ID NO: 1896006 - RNA, 23 nt, Human
caaaugcuguaacuuucugaaau

SEQ ID NO: 1896007 - RNA, 14 nt, Human
caacaaagaacacu

SEQ ID NO: 1896008 - RNA, 22 nt, Human
caacaaaucuaggaaaauauuu

SEQ ID NO: 1896009 - RNA, 13 nt, Human
caaaucuugaaau

SEQ ID NO: 1896010 - RNA, 19 nt, Human
caaaucuugaaauuaagaa

SEQ ID NO: 1896011 - RNA, 12 nt, Human
caaaucuugaaa

SEQ ID NO: 1896012 - RNA, 14 nt, Human
caaaguccuuuuuu

SEQ ID NO: 1896013 - RNA, 17 nt, Human
caaaguccuuuuuuucc

SEQ ID NO: 1896014 - RNA, 19 nt, Human
caaaguccuuuuuuuccau

SEQ ID NO: 1896015 - RNA, 23 nt, Human
caaaguccuuuuuuuccaucuuu

SEQ ID NO: 1896016 - RNA, 22 nt, Human
caacaacauguauaauauuuuu

SEQ ID NO: 1896017 - RNA, 21 nt, Human
caacaacauguauaauauuuu

SEQ ID NO: 1896018 - RNA, 13 nt, Human
caacaccaagcac

SEQ ID NO: 1896019 - RNA, 22 nt, Human
caccuacuuuucuuuccucaga

SEQ ID NO: 1896020 - RNA, 14 nt, Human
caccuagcagcacc

SEQ ID NO: 1896021 - RNA, 12 nt, Human
caccucagccuc

SEQ ID NO: 1896022 - RNA, 16 nt, Human
cacgaaauguuauuuu

SEQ ID NO: 1896023 - RNA, 15 nt, Human
cacgaaauguuauuu

SEQ ID NO: 1896024 - RNA, 13 nt, Human
cacgaaauguuau

SEQ ID NO: 1896025 - RNA, 20 nt, Human
caccuuuugggaauguuuua

SEQ ID NO: 1896026 - RNA, 14 nt, Human
caccuuucccaucu

SEQ ID NO: 1896027 - RNA, 21 nt, Human
caccuuuguuuagaacacugg

SEQ ID NO: 1896028 - RNA, 16 nt, Human
caccuuucuccuuugu

SEQ ID NO: 1896029 - RNA, 22 nt, Human
caccuuucauaaucuuugcuuu

SEQ ID NO: 1896030 - RNA, 16 nt, Human
caccuuggcugcaggg

SEQ ID NO: 1896031 - RNA, 15 nt, Human
caccuuggcugcagg

SEQ ID NO: 1896032 - RNA, 18 nt, Human
caccuuggcugcagggag

SEQ ID NO: 1896033 - RNA, 15 nt, Human
caccugccccaacuc

SEQ ID NO: 1896034 - RNA, 16 nt, Human
caccugccccaacucu

SEQ ID NO: 1896035 - RNA, 22 nt, Human
cacucuuauugcccacgcugga

SEQ ID NO: 1896036 - RNA, 21 nt, Human
cacucuuauugcccacgcugg

SEQ ID NO: 1896037 - RNA, 20 nt, Human
cacucuuauugcccacgcug

SEQ ID NO: 1896038 - RNA, 21 nt, Human
cacuacauuauaaaugucucu

SEQ ID NO: 1896039 - RNA, 17 nt, Human
cacuacauucuguuaau

SEQ ID NO: 1896040 - RNA, 16 nt, Human
cacuacauucuguuaa

SEQ ID NO: 1896041 - RNA, 21 nt, Human
cacuacauucuguuaaucauu

SEQ ID NO: 1896042 - RNA, 12 nt, Human
cacuccagccug

SEQ ID NO: 1896043 - RNA, 13 nt, Human
cacuccagccuga

SEQ ID NO: 1896044 - RNA, 13 nt, Human
cacuccagccugg

SEQ ID NO: 1896045 - RNA, 14 nt, Human
cacuccagccuggg

SEQ ID NO: 1896046 - RNA, 23 nt, Human
cacuccagccugagcgacaguga

SEQ ID NO: 1896047 - RNA, 17 nt, Human
cacucugugucugagug

SEQ ID NO: 1896048 - RNA, 23 nt, Human
cacucugugucugaguggcuuca

SEQ ID NO: 1896049 - RNA, 20 nt, Human
cacucugucgcccagucugg

SEQ ID NO: 1896050 - RNA, 13 nt, Human
cacggccaggcca

SEQ ID NO: 1896051 - RNA, 12 nt, Human
cacggccaggcc

SEQ ID NO: 1896052 - RNA, 17 nt, Human
cacggccaggccagagg

SEQ ID NO: 1896053 - RNA, 14 nt, Human
cacggcucacugca

SEQ ID NO: 1896054 - RNA, 15 nt, Human
cacggcucacugcag

SEQ ID NO: 1896055 - RNA, 13 nt, Human
cacggccacauca

SEQ ID NO: 1896056 - RNA, 19 nt, Human
cacggccacaucaaagagg

SEQ ID NO: 1896057 - RNA, 14 nt, Human
cacugccauauacu

SEQ ID NO: 1896058 - RNA, 17 nt, Human
cacugccaugccagcuu

SEQ ID NO: 1896059 - RNA, 23 nt, Human
cacugcagccucaaccuccuggg

SEQ ID NO: 1896060 - RNA, 22 nt, Human
cacugcagccucaaccuccugg

SEQ ID NO: 1896061 - RNA, 21 nt, Human
cacugcagccucaaccuccug

SEQ ID NO: 1896062 - RNA, 20 nt, Human
cacugcagccucaaccuccu

SEQ ID NO: 1896063 - RNA, 14 nt, Human
cacugcagccucaa

SEQ ID NO: 1896064 - RNA, 19 nt, Human
cacugcagccucaaccucc

SEQ ID NO: 1896065 - RNA, 14 nt, Human
cacugggaggccag

SEQ ID NO: 1896066 - RNA, 19 nt, Human
cacugggagaaaugaaaaa

SEQ ID NO: 1896067 - RNA, 21 nt, Human
cacugggaggccagugagcca

SEQ ID NO: 1896068 - RNA, 20 nt, Human
cacugggcuuggggaccaga

SEQ ID NO: 1896069 - RNA, 23 nt, Human
cacuguugcccaggcuggcgugc

SEQ ID NO: 1896070 - RNA, 19 nt, Human
cacuguugcccaggcuggc

SEQ ID NO: 1896071 - RNA, 18 nt, Human
cacuguugcccaggcugg

SEQ ID NO: 1896072 - RNA, 15 nt, Human
cacuuaaaaaugguu

SEQ ID NO: 1896073 - RNA, 18 nt, Human
cacuuguguuaugaagca

SEQ ID NO: 1896074 - RNA, 18 nt, Human
cacuuucuagccagagga

SEQ ID NO: 1896075 - RNA, 16 nt, Human
cacuuucuagccagag

SEQ ID NO: 1896076 - RNA, 17 nt, Human
cacuuucuagccagagg

SEQ ID NO: 1896077 - RNA, 13 nt, Human
cacuuucuagcca

SEQ ID NO: 1896078 - RNA, 15 nt, Human
cacuuuagggcugua

SEQ ID NO: 1896079 - RNA, 17 nt, Human
cacuuuagggcuguaaa

SEQ ID NO: 1896080 - RNA, 18 nt, Human
cacuuuagggcuguaaaa

SEQ ID NO: 1896081 - RNA, 23 nt, Human
cacuuuagggcuguaaaaugcau

SEQ ID NO: 1896082 - RNA, 19 nt, Human
cacuuucuacaaugugaac

SEQ ID NO: 1896083 - RNA, 23 nt, Human
cacuuucuacaaugugaacuuua

SEQ ID NO: 1896084 - RNA, 11 nt, Human
cagaacaguga

SEQ ID NO: 1896085 - RNA, 17 nt, Human
cagaacagugauuacca

SEQ ID NO: 1896086 - RNA, 12 nt, Human
cagaacagugau

SEQ ID NO: 1896087 - RNA, 14 nt, Human
cagaaguuucugcc

SEQ ID NO: 1896088 - RNA, 16 nt, Human
cagaaguuucugccgc

SEQ ID NO: 1896089 - RNA, 18 nt, Human
cagaacagugauuaccag

SEQ ID NO: 1896090 - RNA, 16 nt, Human
cagaaauguacagcaa

SEQ ID NO: 1896091 - RNA, 20 nt, Human
cagaaagguuuucuucuuuu

SEQ ID NO: 1896092 - RNA, 16 nt, Human
cagaaagugugcuuua

SEQ ID NO: 1896093 - RNA, 17 nt, Human
cagaaagugugcuuuau

SEQ ID NO: 1896094 - RNA, 22 nt, Human
cagaaagugugcuuuaugcuga

SEQ ID NO: 1896095 - RNA, 23 nt, Human
cagaaagugugcuuuaugcugaa

SEQ ID NO: 1896096 - RNA, 17 nt, Human
caaucauuuuaauuauu

SEQ ID NO: 1896097 - RNA, 20 nt, Human
caaucauauuaauacaauga

SEQ ID NO: 1896098 - RNA, 21 nt, Human
caaugcuggcuguuggcuggg

SEQ ID NO: 1896099 - RNA, 20 nt, Human
caaugcuggcuguuggcugg

SEQ ID NO: 1896100 - RNA, 13 nt, Human
caaugcuggcugu

SEQ ID NO: 1896101 - RNA, 20 nt, Human
caaucccuuuauuacccccu

SEQ ID NO: 1896102 - RNA, 12 nt, Human
caaucccagcua

SEQ ID NO: 1896103 - RNA, 17 nt, Human
caaucccagcuaccuca

SEQ ID NO: 1896104 - RNA, 18 nt, Human
cacaagagcccaggccuc

SEQ ID NO: 1896105 - RNA, 19 nt, Human
cacaagagcccaggccucc

SEQ ID NO: 1896106 - RNA, 20 nt, Human
cacaagagcccaggccuccu

SEQ ID NO: 1896107 - RNA, 18 nt, Human
cacaagcuccaagcuccc

SEQ ID NO: 1896108 - RNA, 19 nt, Human
cacaagcuccaagcuccca

SEQ ID NO: 1896109 - RNA, 15 nt, Human
caaugggagcucaug

SEQ ID NO: 1896110 - RNA, 19 nt, Human
caauggcuaccuaaaaaga

SEQ ID NO: 1896111 - RNA, 18 nt, Human
caauggcuuacuccagga

SEQ ID NO: 1896112 - RNA, 22 nt, Human
caauugcuuugucauauagcug

SEQ ID NO: 1896113 - RNA, 17 nt, Human
caauuuccaagagcuga

SEQ ID NO: 1896114 - RNA, 20 nt, Human
cacaagcuccaagcucccag

SEQ ID NO: 1896115 - RNA, 21 nt, Human
cacaagcuccaagcucccagg

SEQ ID NO: 1896116 - RNA, 21 nt, Human
caagucagucauucagauaug

SEQ ID NO: 1896117 - RNA, 12 nt, Human
caagauuucaga

SEQ ID NO: 1896118 - RNA, 17 nt, Human
caaggcaaggcugucaa

SEQ ID NO: 1896119 - RNA, 16 nt, Human
caaggcaaggcuguca

SEQ ID NO: 1896120 - RNA, 18 nt, Human
caaggcaaggcugucaau

SEQ ID NO: 1896121 - RNA, 21 nt, Human
caaggccaaaggaagcacaug

SEQ ID NO: 1896122 - RNA, 19 nt, Human
caaggccaaaggaagcaca

SEQ ID NO: 1896123 - RNA, 20 nt, Human
caaggccaaaggaagcacau

SEQ ID NO: 1896124 - RNA, 14 nt, Human
cacagacccugccc

SEQ ID NO: 1896125 - RNA, 16 nt, Human
cacagacccugcccug

SEQ ID NO: 1896126 - RNA, 17 nt, Human
cacagacccugcccugu

SEQ ID NO: 1896127 - RNA, 14 nt, Human
cacagcucuguccu

SEQ ID NO: 1896128 - RNA, 11 nt, Human
cacagcucugu

SEQ ID NO: 1896129 - RNA, 18 nt, Human
cacagacccugcccugug

SEQ ID NO: 1896130 - RNA, 19 nt, Human
cacagcucuguccugggag

SEQ ID NO: 1896131 - RNA, 18 nt, Human
cacagcucuguccuggga

SEQ ID NO: 1896132 - RNA, 16 nt, Human
cacagcucuguccugg

SEQ ID NO: 1896133 - RNA, 15 nt, Human
cacagcucuguccug

SEQ ID NO: 1896134 - RNA, 15 nt, Human
cacagcucuucucca

SEQ ID NO: 1896135 - RNA, 14 nt, Human
cacagcucuucucc

SEQ ID NO: 1896136 - RNA, 17 nt, Human
cacagcucuucuccagg

SEQ ID NO: 1896137 - RNA, 23 nt, Human
cacagaaaagaaaguucaugcuu

SEQ ID NO: 1896138 - RNA, 12 nt, Human
cacagaaaccuu

SEQ ID NO: 1896139 - RNA, 11 nt, Human
cacacauuuuu

SEQ ID NO: 1896140 - RNA, 10 nt, Human
cacacauuuu

SEQ ID NO: 1896141 - RNA, 20 nt, Human
cacacauuuuuuaaaugcac

SEQ ID NO: 1896142 - RNA, 19 nt, Human
cacacauuuuuuaaaugca

SEQ ID NO: 1896143 - RNA, 16 nt, Human
cacacauuuuuuaaau

SEQ ID NO: 1896144 - RNA, 12 nt, Human
cacacauuuuuu

SEQ ID NO: 1896145 - RNA, 22 nt, Human
cacagggacugaaaaccucucc

SEQ ID NO: 1896146 - RNA, 16 nt, Human
cacccaggagccccga

SEQ ID NO: 1896147 - RNA, 18 nt, Human
cacccaccucagccuccc

SEQ ID NO: 1896148 - RNA, 13 nt, Human
cacccaccucccu

SEQ ID NO: 1896149 - RNA, 14 nt, Human
cacccaccucccug

SEQ ID NO: 1896150 - RNA, 15 nt, Human
cacccaccucccugc

SEQ ID NO: 1896151 - RNA, 16 nt, Human
cacccaccucccugcc

SEQ ID NO: 1896152 - RNA, 18 nt, Human
cacccaccucccugccuc

SEQ ID NO: 1896153 - RNA, 21 nt, Human
cacccaccucccugccuccag

SEQ ID NO: 1896154 - RNA, 23 nt, Human
cacccaccucccugccuccagga

SEQ ID NO: 1896155 - RNA, 16 nt, Human
caccagccccagugcc

SEQ ID NO: 1896156 - RNA, 13 nt, Human
caccagccccagu

SEQ ID NO: 1896157 - RNA, 17 nt, Human
cacccaccucagccucc

SEQ ID NO: 1896158 - RNA, 20 nt, Human
caccaggcuugccugcaggc

SEQ ID NO: 1896159 - RNA, 17 nt, Human
cacauuuuauuuuauua

SEQ ID NO: 1896160 - RNA, 11 nt, Human
cacaucucugc

SEQ ID NO: 1896161 - RNA, 21 nt, Human
cacauuuuauuuuauuaugca

SEQ ID NO: 1896162 - RNA, 12 nt, Human
cacaucuucccu

SEQ ID NO: 1896163 - RNA, 20 nt, Human
cacauuuuauuuuauuaugc

SEQ ID NO: 1896164 - RNA, 19 nt, Human
cacauuuuauuuuauuaug

SEQ ID NO: 1896165 - RNA, 16 nt, Human
caccaacgucugugcc

SEQ ID NO: 1896166 - RNA, 14 nt, Human
caccaacgucugug

SEQ ID NO: 1896167 - RNA, 22 nt, Human
cacaucuaagccugaaggggcg

SEQ ID NO: 1896168 - RNA, 21 nt, Human
ccauugcuaucuauugauaau

SEQ ID NO: 1896169 - RNA, 15 nt, Human
cccaacucaccccag

SEQ ID NO: 1896170 - RNA, 16 nt, Human
cccaacucaccccagc

SEQ ID NO: 1896171 - RNA, 15 nt, Human
cccacccacauguga

SEQ ID NO: 1896172 - RNA, 15 nt, Human
cccaagcucugcucc

SEQ ID NO: 1896173 - RNA, 12 nt, Human
cccaagcucugc

SEQ ID NO: 1896174 - RNA, 14 nt, Human
cccaagcucugcuc

SEQ ID NO: 1896175 - RNA, 13 nt, Human
cccaagcucugcu

SEQ ID NO: 1896176 - RNA, 18 nt, Human
cccaagaccucagggcac

SEQ ID NO: 1896177 - RNA, 15 nt, Human
cccaacucuagcugg

SEQ ID NO: 1896178 - RNA, 16 nt, Human
cccaacucuagcuggg

SEQ ID NO: 1896179 - RNA, 21 nt, Human
cccaacucuagcugggggugg

SEQ ID NO: 1896180 - RNA, 15 nt, Human
cccaagaaugggagg

SEQ ID NO: 1896181 - RNA, 17 nt, Human
cccaacucaccccagcc

SEQ ID NO: 1896182 - RNA, 20 nt, Human
cccaacucaccccagcccca

SEQ ID NO: 1896183 - RNA, 23 nt, Human
cccacugcuuuuggucuguguga

SEQ ID NO: 1896184 - RNA, 14 nt, Human
cccacugaccagaa

SEQ ID NO: 1896185 - RNA, 12 nt, Human
cccaccccuggg

SEQ ID NO: 1896186 - RNA, 22 nt, Human
cccaccccugggggcucucaug

SEQ ID NO: 1896187 - RNA, 13 nt, Human
cccacucccugca

SEQ ID NO: 1896188 - RNA, 12 nt, Human
cccacucccugc

SEQ ID NO: 1896189 - RNA, 16 nt, Human
ccauguacaugaagaa

SEQ ID NO: 1896190 - RNA, 22 nt, Human
ccaugaugacaacuacagaaaa

SEQ ID NO: 1896191 - RNA, 14 nt, Human
ccauguagcccccu

SEQ ID NO: 1896192 - RNA, 20 nt, Human
ccauguagcccccuggccuc

SEQ ID NO: 1896193 - RNA, 22 nt, Human
ccauguagcccccuggccucug

SEQ ID NO: 1896194 - RNA, 23 nt, Human
ccauguagcccccuggccucugu

SEQ ID NO: 1896195 - RNA, 18 nt, Human
ccaugaguccccuguuug

SEQ ID NO: 1896196 - RNA, 21 nt, Human
ccaugaguuggggucuggcag

SEQ ID NO: 1896197 - RNA, 22 nt, Human
ccaugaguuggggucuggcagc

SEQ ID NO: 1896198 - RNA, 23 nt, Human
ccaugaguuggggucuggcagcc

SEQ ID NO: 1896199 - RNA, 23 nt, Human
ccaugaggaacaaggcaaggcug

SEQ ID NO: 1896200 - RNA, 20 nt, Human
ccaugaggaacaaggcaagg

SEQ ID NO: 1896201 - RNA, 23 nt, Human
ccaguuggguggaugccuggugg

SEQ ID NO: 1896202 - RNA, 13 nt, Human
ccaguuggucccc

SEQ ID NO: 1896203 - RNA, 19 nt, Human
ccauccagguucagcuugu

SEQ ID NO: 1896204 - RNA, 18 nt, Human
ccauccagguucagcuug

SEQ ID NO: 1896205 - RNA, 18 nt, Human
ccaguuggucccccuucc

SEQ ID NO: 1896206 - RNA, 20 nt, Human
ccaguuggucccccuuccau

SEQ ID NO: 1896207 - RNA, 20 nt, Human
ccaucccaaacccuucagug

SEQ ID NO: 1896208 - RNA, 19 nt, Human
ccaucccauaugccugggc

SEQ ID NO: 1896209 - RNA, 20 nt, Human
ccaucccauaugccugggca

SEQ ID NO: 1896210 - RNA, 21 nt, Human
ccaucccauaugccugggcag

SEQ ID NO: 1896211 - RNA, 17 nt, Human
ccagccccagugcccac

SEQ ID NO: 1896212 - RNA, 14 nt, Human
ccagcagagcaccu

SEQ ID NO: 1896213 - RNA, 12 nt, Human
ccagcagagcac

SEQ ID NO: 1896214 - RNA, 13 nt, Human
ccagcagagcacc

SEQ ID NO: 1896215 - RNA, 18 nt, Human
ccagccccauccucugua

SEQ ID NO: 1896216 - RNA, 15 nt, Human
ccagccccauccucu

SEQ ID NO: 1896217 - RNA, 17 nt, Human
ccagccccauccucugu

SEQ ID NO: 1896218 - RNA, 12 nt, Human
ccagcagaaaug

SEQ ID NO: 1896219 - RNA, 16 nt, Human
ccagcacuuguccagc

SEQ ID NO: 1896220 - RNA, 19 nt, Human
ccagcacuuguccagcuga

SEQ ID NO: 1896221 - RNA, 20 nt, Human
ccagcacuuguccagcugag

SEQ ID NO: 1896222 - RNA, 23 nt, Human
ccagccccuucugacccaugcug

SEQ ID NO: 1896223 - RNA, 24 nt, Human
ccagccccuucugacccaugcugc

SEQ ID NO: 1896224 - RNA, 14 nt, Human
ccagccccuugaga

SEQ ID NO: 1896225 - RNA, 22 nt, Human
ccagcuauugauauaaauaaaa

SEQ ID NO: 1896226 - RNA, 14 nt, Human
ccagcuccaaccug

SEQ ID NO: 1896227 - RNA, 15 nt, Human
ccagcuccaaccugc

SEQ ID NO: 1896228 - RNA, 20 nt, Human
ccagcuccaaccugcaaaga

SEQ ID NO: 1896229 - RNA, 22 nt, Human
ccagcuccaaggggaaucagaa

SEQ ID NO: 1896230 - RNA, 14 nt, Human
ccagcucccucuau

SEQ ID NO: 1896231 - RNA, 16 nt, Human
ccaggcuggcgugcag

SEQ ID NO: 1896232 - RNA, 12 nt, Human
ccaggcuggcgu

SEQ ID NO: 1896233 - RNA, 21 nt, Human
ccaggggaaaaucagccugcu

SEQ ID NO: 1896234 - RNA, 16 nt, Human
ccaggggaguuguguc

SEQ ID NO: 1896235 - RNA, 18 nt, Human
ccaggggaguugugucug

SEQ ID NO: 1896236 - RNA, 14 nt, Human
ccaggcaggucuug

SEQ ID NO: 1896237 - RNA, 12 nt, Human
ccaggcaggucu

SEQ ID NO: 1896238 - RNA, 23 nt, Human
ccaggcaggucuugaacuccugg

SEQ ID NO: 1896239 - RNA, 21 nt, Human
ccaggauggaacacggccaca

SEQ ID NO: 1896240 - RNA, 15 nt, Human
ccagucccugaggca

SEQ ID NO: 1896241 - RNA, 17 nt, Human
ccaggggggugaggagc

SEQ ID NO: 1896242 - RNA, 19 nt, Human
ccaggggggugaggagcug

SEQ ID NO: 1896243 - RNA, 20 nt, Human
ccaggggggugaggagcugg

SEQ ID NO: 1896244 - RNA, 23 nt, Human
ccagggggccagucccugaggca

SEQ ID NO: 1896245 - RNA, 15 nt, Human
ccccugacaacacuc

SEQ ID NO: 1896246 - RNA, 13 nt, Human
ccccugaauuuaa

SEQ ID NO: 1896247 - RNA, 17 nt, Human
ccccugaauuuaaauag

SEQ ID NO: 1896248 - RNA, 13 nt, Human
ccccugcacucca

SEQ ID NO: 1896249 - RNA, 16 nt, Human
ccccugccacccuggg

SEQ ID NO: 1896250 - RNA, 14 nt, Human
ccccugccacccug

SEQ ID NO: 1896251 - RNA, 10 nt, Human
ccccugccag

SEQ ID NO: 1896252 - RNA, 19 nt, Human
ccccugcccccaggacugg

SEQ ID NO: 1896253 - RNA, 18 nt, Human
ccccugcccccaggacug

SEQ ID NO: 1896254 - RNA, 23 nt, Human
ccccugcccccaggacugggcca

SEQ ID NO: 1896255 - RNA, 17 nt, Human
ccccugcccccaggacu

SEQ ID NO: 1896256 - RNA, 16 nt, Human
ccccugcccccaggac

SEQ ID NO: 1896257 - RNA, 16 nt, Human
cccggccccugcuggu

SEQ ID NO: 1896258 - RNA, 15 nt, Human
cccggccccugcugg

SEQ ID NO: 1896259 - RNA, 11 nt, Human
cccggccagcc

SEQ ID NO: 1896260 - RNA, 15 nt, Human
cccgggaagggggcu

SEQ ID NO: 1896261 - RNA, 22 nt, Human
cccgaauagcugggacuacagg

SEQ ID NO: 1896262 - RNA, 18 nt, Human
cccgaauagcugggacua

SEQ ID NO: 1896263 - RNA, 17 nt, Human
cccgaauagcugggacu

SEQ ID NO: 1896264 - RNA, 16 nt, Human
cccgaauagcugggac

SEQ ID NO: 1896265 - RNA, 13 nt, Human
ccccuucugaccc

SEQ ID NO: 1896266 - RNA, 14 nt, Human
ccccuucugaccca

SEQ ID NO: 1896267 - RNA, 16 nt, Human
ccccuucugacccaug

SEQ ID NO: 1896268 - RNA, 20 nt, Human
cccucaacucuccuccagag

SEQ ID NO: 1896269 - RNA, 16 nt, Human
cccucaacucuccucc

SEQ ID NO: 1896270 - RNA, 16 nt, Human
cccucaaccucuucug

SEQ ID NO: 1896271 - RNA, 22 nt, Human
cccgggaagggggcugggacau

SEQ ID NO: 1896272 - RNA, 17 nt, Human
cccggcuaauuuuugua

SEQ ID NO: 1896273 - RNA, 16 nt, Human
cccucaacaccucugc

SEQ ID NO: 1896274 - RNA, 18 nt, Human
cccgggaagggggcuggg

SEQ ID NO: 1896275 - RNA, 21 nt, Human
cccgggaagggggcugggaca

SEQ ID NO: 1896276 - RNA, 20 nt, Human
cccucaccuuggcaccagac

SEQ ID NO: 1896277 - RNA, 21 nt, Human
cccucaccuuggcaccagaca

SEQ ID NO: 1896278 - RNA, 23 nt, Human
cccucaccuuggcaccagacacc

SEQ ID NO: 1896279 - RNA, 15 nt, Human
cccucacucucuaca

SEQ ID NO: 1896280 - RNA, 14 nt, Human
cccuccuccacucu

SEQ ID NO: 1896281 - RNA, 13 nt, Human
cccuccuccacuc

SEQ ID NO: 1896282 - RNA, 12 nt, Human
cccuccuccacu

SEQ ID NO: 1896283 - RNA, 15 nt, Human
cccauucugccugcc

SEQ ID NO: 1896284 - RNA, 14 nt, Human
cccauucugccugc

SEQ ID NO: 1896285 - RNA, 19 nt, Human
cccauucugccugcccagg

SEQ ID NO: 1896286 - RNA, 15 nt, Human
cccauuugcuccuuu

SEQ ID NO: 1896287 - RNA, 20 nt, Human
ccccagauugcaacaggcug

SEQ ID NO: 1896288 - RNA, 15 nt, Human
ccccagauugcaaca

SEQ ID NO: 1896289 - RNA, 12 nt, Human
ccccagcccaga

SEQ ID NO: 1896290 - RNA, 13 nt, Human
ccccagcccagag

SEQ ID NO: 1896291 - RNA, 15 nt, Human
ccccagcccagagac

SEQ ID NO: 1896292 - RNA, 16 nt, Human
ccccagcccagagaca

SEQ ID NO: 1896293 - RNA, 14 nt, Human
ccccgcacugggcu

SEQ ID NO: 1896294 - RNA, 20 nt, Human
cccaggcuggagugcaauga

SEQ ID NO: 1896295 - RNA, 22 nt, Human
cccaggcuuagucacugagaca

SEQ ID NO: 1896296 - RNA, 17 nt, Human
cccaggaaaggcuccag

SEQ ID NO: 1896297 - RNA, 18 nt, Human
cccaggaaaggcuccagg

SEQ ID NO: 1896298 - RNA, 16 nt, Human
cccauccccgcagugu

SEQ ID NO: 1896299 - RNA, 15 nt, Human
cccagggaaguuuug

SEQ ID NO: 1896300 - RNA, 21 nt, Human
cccacugggguccagggagca

SEQ ID NO: 1896301 - RNA, 14 nt, Human
cccagcacugagga

SEQ ID NO: 1896302 - RNA, 13 nt, Human
cccagcacugagg

SEQ ID NO: 1896303 - RNA, 21 nt, Human
cccagccaggccccaggcagg

SEQ ID NO: 1896304 - RNA, 15 nt, Human
cccaggaaaggcucc

SEQ ID NO: 1896305 - RNA, 16 nt, Human
cccaggaaaggcucca

SEQ ID NO: 1896306 - RNA, 21 nt, Human
cccauccucuguacagagccc

SEQ ID NO: 1896307 - RNA, 22 nt, Human
cccauccucuguacagagccca

SEQ ID NO: 1896308 - RNA, 16 nt, Human
cccauccccuguggga

SEQ ID NO: 1896309 - RNA, 19 nt, Human
cccauccucuucuuuuagc

SEQ ID NO: 1896310 - RNA, 20 nt, Human
cccauccucuucuuuuagca

SEQ ID NO: 1896311 - RNA, 21 nt, Human
cccaucgccagcugaugacuc

SEQ ID NO: 1896312 - RNA, 22 nt, Human
cccaucgccagcugaugacuca

SEQ ID NO: 1896313 - RNA, 23 nt, Human
cccaucgccagcugaugacucaa

SEQ ID NO: 1896314 - RNA, 16 nt, Human
ccuccgagggacgcgg

SEQ ID NO: 1896315 - RNA, 13 nt, Human
ccuccgccucuug

SEQ ID NO: 1896316 - RNA, 15 nt, Human
ccucccuuucucccc

SEQ ID NO: 1896317 - RNA, 14 nt, Human
ccucccuuucuccc

SEQ ID NO: 1896318 - RNA, 13 nt, Human
ccucccuuucucc

SEQ ID NO: 1896319 - RNA, 12 nt, Human
ccucccuuucuc

SEQ ID NO: 1896320 - RNA, 14 nt, Human
ccuccgccucuugg

SEQ ID NO: 1896321 - RNA, 20 nt, Human
ccuccgcgugaucaaagcca

SEQ ID NO: 1896322 - RNA, 15 nt, Human
ccuccuagccaccca

SEQ ID NO: 1896323 - RNA, 17 nt, Human
ccucccuucugcuacug

SEQ ID NO: 1896324 - RNA, 15 nt, Human
ccucccuucugcuac

SEQ ID NO: 1896325 - RNA, 16 nt, Human
ccucccuucugcuacu

SEQ ID NO: 1896326 - RNA, 10 nt, Human
ccucccuucu

SEQ ID NO: 1896327 - RNA, 13 nt, Human
ccucccuucugcu

SEQ ID NO: 1896328 - RNA, 16 nt, Human
ccucccuucucuucac

SEQ ID NO: 1896329 - RNA, 12 nt, Human
ccucgcuuggac

SEQ ID NO: 1896330 - RNA, 21 nt, Human
ccucgagguuucucaaagaaa

SEQ ID NO: 1896331 - RNA, 15 nt, Human
ccucgcaggaagacc

SEQ ID NO: 1896332 - RNA, 18 nt, Human
ccuccuuuucacaguucu

SEQ ID NO: 1896333 - RNA, 16 nt, Human
ccucgaaacacagaaa

SEQ ID NO: 1896334 - RNA, 20 nt, Human
ccucgaaacacagaaaccuu

SEQ ID NO: 1896335 - RNA, 23 nt, Human
ccuccuuugugaggaagccgcug

SEQ ID NO: 1896336 - RNA, 17 nt, Human
ccucccaucacccgcua

SEQ ID NO: 1896337 - RNA, 15 nt, Human
ccucccauccagggc

SEQ ID NO: 1896338 - RNA, 20 nt, Human
ccuccaagaccuucuccuuc

SEQ ID NO: 1896339 - RNA, 12 nt, Human
ccucccaucacc

SEQ ID NO: 1896340 - RNA, 16 nt, Human
ccuccaagaccuucuc

SEQ ID NO: 1896341 - RNA, 17 nt, Human
ccuccaagaccuucucc

SEQ ID NO: 1896342 - RNA, 19 nt, Human
ccuccaagaccuucuccuu

SEQ ID NO: 1896343 - RNA, 20 nt, Human
ccucaagugauucuccugcc

SEQ ID NO: 1896344 - RNA, 16 nt, Human
ccucaagaaauaaaag

SEQ ID NO: 1896345 - RNA, 23 nt, Human
ccucaagugauucuccugccuca

SEQ ID NO: 1896346 - RNA, 22 nt, Human
ccucagccuugccagagaucca

SEQ ID NO: 1896347 - RNA, 10 nt, Human
ccucaggccu

SEQ ID NO: 1896348 - RNA, 12 nt, Human
ccucaggcaggu

SEQ ID NO: 1896349 - RNA, 18 nt, Human
ccucaggcaggugggaug

SEQ ID NO: 1896350 - RNA, 15 nt, Human
ccucaaccuccuggg

SEQ ID NO: 1896351 - RNA, 19 nt, Human
ccucaacucuccuccagag

SEQ ID NO: 1896352 - RNA, 21 nt, Human
ccucaacucuccuccagaguc

SEQ ID NO: 1896353 - RNA, 23 nt, Human
ccucaacucuccuccagagucag

SEQ ID NO: 1896354 - RNA, 16 nt, Human
ccucaacaccucugca

SEQ ID NO: 1896355 - RNA, 14 nt, Human
ccucaaaugagaaa

SEQ ID NO: 1896356 - RNA, 18 nt, Human
ccgaagccgccuguggac

SEQ ID NO: 1896357 - RNA, 14 nt, Human
cccuucucuccagc

SEQ ID NO: 1896358 - RNA, 19 nt, Human
cccuucucuccagccccug

SEQ ID NO: 1896359 - RNA, 17 nt, Human
cccuucuccucuuguaa

SEQ ID NO: 1896360 - RNA, 21 nt, Human
cccuuuuuuggcugcugaagg

SEQ ID NO: 1896361 - RNA, 22 nt, Human
cccuuuuuuggcugcugaaggc

SEQ ID NO: 1896362 - RNA, 23 nt, Human
cccuuuuuuggcugcugaaggcu

SEQ ID NO: 1896363 - RNA, 15 nt, Human
cccuucucucaucuc

SEQ ID NO: 1896364 - RNA, 18 nt, Human
cccuucuccucuuguaaa

SEQ ID NO: 1896365 - RNA, 20 nt, Human
cccuucuccucuuguaaaua

SEQ ID NO: 1896366 - RNA, 14 nt, Human
cccuccuuucacca

SEQ ID NO: 1896367 - RNA, 12 nt, Human
cccuccuucaga

SEQ ID NO: 1896368 - RNA, 21 nt, Human
cccugugaguacuacaguccu

SEQ ID NO: 1896369 - RNA, 23 nt, Human
cccugugaguacuacaguccucc

SEQ ID NO: 1896370 - RNA, 15 nt, Human
cccugugauggggcc

SEQ ID NO: 1896371 - RNA, 15 nt, Human
cccugugggccccca

SEQ ID NO: 1896372 - RNA, 23 nt, Human
cccuucuaggguuauugcauuug

SEQ ID NO: 1896373 - RNA, 14 nt, Human
ccgcagcccugcag

SEQ ID NO: 1896374 - RNA, 13 nt, Human
ccgcagagcuggc

SEQ ID NO: 1896375 - RNA, 15 nt, Human
ccgcagagcuggccg

SEQ ID NO: 1896376 - RNA, 18 nt, Human
ccgcagcccugcagaggg

SEQ ID NO: 1896377 - RNA, 23 nt, Human
ccgcagcccugcagagggcacag

SEQ ID NO: 1896378 - RNA, 17 nt, Human
ccggccaccugcggugc

SEQ ID NO: 1896379 - RNA, 18 nt, Human
ccggccaccugcggugcu

SEQ ID NO: 1896380 - RNA, 15 nt, Human
ccggccagccauguc

SEQ ID NO: 1896381 - RNA, 11 nt, Human
ccggccagccc

SEQ ID NO: 1896382 - RNA, 22 nt, Human
ccgguucacucuucucagccac

SEQ ID NO: 1896383 - RNA, 19 nt, Human
ccuagccuuagaagucaca

SEQ ID NO: 1896384 - RNA, 23 nt, Human
ccuagccugugccucugggacug

SEQ ID NO: 1896385 - RNA, 22 nt, Human
ccuagccuuagaagucacacag

SEQ ID NO: 1896386 - RNA, 12 nt, Human
ccuaauaaagcu

SEQ ID NO: 1896387 - RNA, 13 nt, Human
ccuaauaaagcug

SEQ ID NO: 1896388 - RNA, 17 nt, Human
ccgugaaaacggagcug

SEQ ID NO: 1896389 - RNA, 18 nt, Human
ccgugaaaacggagcuga

SEQ ID NO: 1896390 - RNA, 16 nt, Human
ccuaaugcuccuuguu

SEQ ID NO: 1896391 - RNA, 19 nt, Human
ccuaaugcuccuuguuccu

SEQ ID NO: 1896392 - RNA, 21 nt, Human
ccuagcauacguacacauuuu

SEQ ID NO: 1896393 - RNA, 16 nt, Human
ccuagccacccaccac

SEQ ID NO: 1896394 - RNA, 12 nt, Human
ccuagccaccca

SEQ ID NO: 1896395 - RNA, 13 nt, Human
ccugagggagcuc

SEQ ID NO: 1896396 - RNA, 22 nt, Human
ccugagggaucuauacuugcuu

SEQ ID NO: 1896397 - RNA, 15 nt, Human
ccugagggagcucca

SEQ ID NO: 1896398 - RNA, 20 nt, Human
ccugaggcuuuggauuugac

SEQ ID NO: 1896399 - RNA, 22 nt, Human
ccugaggcuuuggauuugacau

SEQ ID NO: 1896400 - RNA, 19 nt, Human
ccugaguuccuagccaccg

SEQ ID NO: 1896401 - RNA, 18 nt, Human
ccugagaucucugcagga

SEQ ID NO: 1896402 - RNA, 23 nt, Human
ccugagauuucaucugcucuccu

SEQ ID NO: 1896403 - RNA, 22 nt, Human
ccugagauuucaucugcucucc

SEQ ID NO: 1896404 - RNA, 18 nt, Human
ccugagauuucaucugcu

SEQ ID NO: 1896405 - RNA, 17 nt, Human
ccugagauuucaucugc

SEQ ID NO: 1896406 - RNA, 16 nt, Human
ccugagauuucaucug

SEQ ID NO: 1896407 - RNA, 15 nt, Human
ccugagauuucaucu

SEQ ID NO: 1896408 - RNA, 11 nt, Human
ccugagauuuc

SEQ ID NO: 1896409 - RNA, 14 nt, Human
ccugcaggcagcca

SEQ ID NO: 1896410 - RNA, 12 nt, Human
ccugcaggcagc

SEQ ID NO: 1896411 - RNA, 13 nt, Human
ccugcaggcagcc

SEQ ID NO: 1896412 - RNA, 19 nt, Human
ccugauaagcuucaaagcu

SEQ ID NO: 1896413 - RNA, 21 nt, Human
ccugaguuccuagccaccgcc

SEQ ID NO: 1896414 - RNA, 20 nt, Human
ccugaguuccuagccaccgc

SEQ ID NO: 1896415 - RNA, 15 nt, Human
ccucuuugagugaag

SEQ ID NO: 1896416 - RNA, 19 nt, Human
ccucuuucccucccuuccu

SEQ ID NO: 1896417 - RNA, 22 nt, Human
ccucggccucccaaagugcugg

SEQ ID NO: 1896418 - RNA, 15 nt, Human
ccugcccaccuggcc

SEQ ID NO: 1896419 - RNA, 17 nt, Human
ccugcccaccuggccuc

SEQ ID NO: 1896420 - RNA, 20 nt, Human
ccugccaucauguuuacaga

SEQ ID NO: 1896421 - RNA, 18 nt, Human
ccugccaucauguuuaca

SEQ ID NO: 1896422 - RNA, 19 nt, Human
ccugcccaggccccugcca

SEQ ID NO: 1896423 - RNA, 18 nt, Human
ccugcccaggccccugcc

SEQ ID NO: 1896424 - RNA, 18 nt, Human
ccugcccaccuggccucu

SEQ ID NO: 1896425 - RNA, 19 nt, Human
ccugcccaccuggccucug

SEQ ID NO: 1896426 - RNA, 22 nt, Human
ccugcccaggccccugccaccc

SEQ ID NO: 1896427 - RNA, 21 nt, Human
ccugcccaggccccugccacc

SEQ ID NO: 1896428 - RNA, 15 nt, Human
ccugccucagccucc

SEQ ID NO: 1896429 - RNA, 16 nt, Human
ccugccucagccuccc

SEQ ID NO: 1896430 - RNA, 12 nt, Human
ccugccucagga

SEQ ID NO: 1896431 - RNA, 19 nt, Human
ccugccucaggccucugug

SEQ ID NO: 1896432 - RNA, 13 nt, Human
ccugccucucugc

SEQ ID NO: 1896433 - RNA, 14 nt, Human
ccugccucucugca

SEQ ID NO: 1896434 - RNA, 15 nt, Human
ccugccucucugcag

SEQ ID NO: 1896435 - RNA, 21 nt, Human
ccuggcacacaucaggaguuc

SEQ ID NO: 1896436 - RNA, 15 nt, Human
ccuggcacacaucag

SEQ ID NO: 1896437 - RNA, 13 nt, Human
ccuggcacacauc

SEQ ID NO: 1896438 - RNA, 12 nt, Human
ccuggcacacau

SEQ ID NO: 1896439 - RNA, 17 nt, Human
ccuggauggggcugcac

SEQ ID NO: 1896440 - RNA, 18 nt, Human
ccuggauggggcugcacc

SEQ ID NO: 1896441 - RNA, 14 nt, Human
ccuggauguugcug

SEQ ID NO: 1896442 - RNA, 15 nt, Human
ccuggauggggcugc

SEQ ID NO: 1896443 - RNA, 13 nt, Human
ccuggccuggcac

SEQ ID NO: 1896444 - RNA, 12 nt, Human
ccuggccuggca

SEQ ID NO: 1896445 - RNA, 22 nt, Human
ccuggccucaagugauucuccu

SEQ ID NO: 1896446 - RNA, 20 nt, Human
ccuggccccucagggucccu

SEQ ID NO: 1896447 - RNA, 21 nt, Human
ccuggccccucagggucccug

SEQ ID NO: 1896448 - RNA, 18 nt, Human
ccuggccccucagggucc

SEQ ID NO: 1896449 - RNA, 19 nt, Human
ccuggccuggcacacauca

SEQ ID NO: 1896450 - RNA, 16 nt, Human
ccuggccuggcacaca

SEQ ID NO: 1896451 - RNA, 15 nt, Human
ccuggccuggcacac

SEQ ID NO: 1896452 - RNA, 15 nt, Human
ccuggggagaaagua

SEQ ID NO: 1896453 - RNA, 19 nt, Human
ccugguggcagugggagcu

SEQ ID NO: 1896454 - RNA, 18 nt, Human
ccugguggcagugggagc

SEQ ID NO: 1896455 - RNA, 15 nt, Human
ccuggggcuggccuc

SEQ ID NO: 1896456 - RNA, 16 nt, Human
ccuggggcuggccucc

SEQ ID NO: 1896457 - RNA, 17 nt, Human
ccuggggcuggccuccc

SEQ ID NO: 1896458 - RNA, 20 nt, Human
ccugguggcagugggagcug

SEQ ID NO: 1896459 - RNA, 19 nt, Human
ccuggggcuggccucccaa

SEQ ID NO: 1896460 - RNA, 13 nt, Human
ccugguguggaag

SEQ ID NO: 1896461 - RNA, 21 nt, Human
ccuggugguugcuguuuuccu

SEQ ID NO: 1896462 - RNA, 12 nt, Human
ccuggugguuca

SEQ ID NO: 1896463 - RNA, 22 nt, Human
ccuggugguucacucuuggagc

SEQ ID NO: 1896464 - RNA, 13 nt, Human
ccuggugguucac

SEQ ID NO: 1896465 - RNA, 17 nt, Human
ccugucucuacuaaaaa

SEQ ID NO: 1896466 - RNA, 16 nt, Human
ccugucuccuggcggu

SEQ ID NO: 1896467 - RNA, 13 nt, Human
ccugucuccuggc

SEQ ID NO: 1896468 - RNA, 13 nt, Human
ccugguucucauc

SEQ ID NO: 1896469 - RNA, 14 nt, Human
cucacuucacccug

SEQ ID NO: 1896470 - RNA, 19 nt, Human
cucaccuuggcaccagaca

SEQ ID NO: 1896471 - RNA, 18 nt, Human
cucacuuguuuuauuuaa

SEQ ID NO: 1896472 - RNA, 20 nt, Human
cucacuuuccuccugaggcu

SEQ ID NO: 1896473 - RNA, 16 nt, Human
cucaccuuggcaccag

SEQ ID NO: 1896474 - RNA, 17 nt, Human
cucaccuuggcaccaga

SEQ ID NO: 1896475 - RNA, 21 nt, Human
cucagaagggagcuagccaga

SEQ ID NO: 1896476 - RNA, 22 nt, Human
cucagaagggagcuagccagag

SEQ ID NO: 1896477 - RNA, 14 nt, Human
cucaccuccugcug

SEQ ID NO: 1896478 - RNA, 16 nt, Human
cucaccucuaaaacag

SEQ ID NO: 1896479 - RNA, 13 nt, Human
cucaccugccccu

SEQ ID NO: 1896480 - RNA, 18 nt, Human
cucaccugccccucaacu

SEQ ID NO: 1896481 - RNA, 14 nt, Human
cucaccugccccuc

SEQ ID NO: 1896482 - RNA, 16 nt, Human
cucaccugccccucaa

SEQ ID NO: 1896483 - RNA, 13 nt, Human
cucaccuccugcu

SEQ ID NO: 1896484 - RNA, 13 nt, Human
cucaccucucccu

SEQ ID NO: 1896485 - RNA, 19 nt, Human
cucaccuauccacacaaca

SEQ ID NO: 1896486 - RNA, 14 nt, Human
cucaccucucccuu

SEQ ID NO: 1896487 - RNA, 15 nt, Human
cucaccucucccuug

SEQ ID NO: 1896488 - RNA, 16 nt, Human
cucaccucucccuugg

SEQ ID NO: 1896489 - RNA, 17 nt, Human
cucaccucucccuugga

SEQ ID NO: 1896490 - RNA, 23 nt, Human
cuaugucauuugcuggagcucug

SEQ ID NO: 1896491 - RNA, 15 nt, Human
cuauguugcccaggc

SEQ ID NO: 1896492 - RNA, 22 nt, Human
cuauguguagggcgggaggaug

SEQ ID NO: 1896493 - RNA, 18 nt, Human
cuauguggauuuuuuccu

SEQ ID NO: 1896494 - RNA, 19 nt, Human
cuauguggauuuuuuccua

SEQ ID NO: 1896495 - RNA, 19 nt, Human
cuauguaucaaugaguaac

SEQ ID NO: 1896496 - RNA, 20 nt, Human
cuaucucccccagccccauc

SEQ ID NO: 1896497 - RNA, 17 nt, Human
cuauguugcccaggcag

SEQ ID NO: 1896498 - RNA, 16 nt, Human
cuauguugcccaggca

SEQ ID NO: 1896499 - RNA, 14 nt, Human
cuauuuuucagaau

SEQ ID NO: 1896500 - RNA, 18 nt, Human
cucaaaaaaagaaaaaga

SEQ ID NO: 1896501 - RNA, 22 nt, Human
cucaaagaaauuuccacucagg

SEQ ID NO: 1896502 - RNA, 13 nt, Human
cucaaaggccaga

SEQ ID NO: 1896503 - RNA, 22 nt, Human
cucaaaggccagaccugcagac

SEQ ID NO: 1896504 - RNA, 14 nt, Human
cucacaaaggaugc

SEQ ID NO: 1896505 - RNA, 16 nt, Human
cucacaaccugaaccu

SEQ ID NO: 1896506 - RNA, 17 nt, Human
cucacaaccugaaccua

SEQ ID NO: 1896507 - RNA, 12 nt, Human
cucaaauaacua

SEQ ID NO: 1896508 - RNA, 20 nt, Human
cucacaaccugaaccuagga

SEQ ID NO: 1896509 - RNA, 14 nt, Human
cucacacaugagca

SEQ ID NO: 1896510 - RNA, 21 nt, Human
cucacacaugagcaucaggcc

SEQ ID NO: 1896511 - RNA, 19 nt, Human
cuaggccuccuggcccagg

SEQ ID NO: 1896512 - RNA, 19 nt, Human
cuaggccucagccagagaa

SEQ ID NO: 1896513 - RNA, 12 nt, Human
cuaggccugggg

SEQ ID NO: 1896514 - RNA, 13 nt, Human
cuaggccugggga

SEQ ID NO: 1896515 - RNA, 19 nt, Human
cuaggccuggccagaugca

SEQ ID NO: 1896516 - RNA, 18 nt, Human
cuaggccuggccagaugc

SEQ ID NO: 1896517 - RNA, 15 nt, Human
cuaggccuggccaga

SEQ ID NO: 1896518 - RNA, 14 nt, Human
cuaggccuggccag

SEQ ID NO: 1896519 - RNA, 17 nt, Human
cuaggccuccuggccca

SEQ ID NO: 1896520 - RNA, 18 nt, Human
cuaggccuccuggcccag

SEQ ID NO: 1896521 - RNA, 15 nt, Human
cuaggccucagccag

SEQ ID NO: 1896522 - RNA, 16 nt, Human
cuaggccucagccaga

SEQ ID NO: 1896523 - RNA, 17 nt, Human
cuaggccucagccagag

SEQ ID NO: 1896524 - RNA, 18 nt, Human
cuaggccucagccagaga

SEQ ID NO: 1896525 - RNA, 13 nt, Human
cuaggccuggcca

SEQ ID NO: 1896526 - RNA, 13 nt, Human
cuaggccucagcc

SEQ ID NO: 1896527 - RNA, 12 nt, Human
cuaggccgggcg

SEQ ID NO: 1896528 - RNA, 19 nt, Human
cuagccagaggagagagga

SEQ ID NO: 1896529 - RNA, 17 nt, Human
cuagccagaggagagag

SEQ ID NO: 1896530 - RNA, 15 nt, Human
cuagaauuuauucaa

SEQ ID NO: 1896531 - RNA, 20 nt, Human
cuagcauacguacacauuuu

SEQ ID NO: 1896532 - RNA, 19 nt, Human
cuagcauacguacacauuu

SEQ ID NO: 1896533 - RNA, 18 nt, Human
cuagcauacguacacauu

SEQ ID NO: 1896534 - RNA, 16 nt, Human
cuagcauacguacaca

SEQ ID NO: 1896535 - RNA, 12 nt, Human
cuagaauuuauu

SEQ ID NO: 1896536 - RNA, 13 nt, Human
cuagaauuuauuc

SEQ ID NO: 1896537 - RNA, 17 nt, Human
cuauaaacaauuacaug

SEQ ID NO: 1896538 - RNA, 16 nt, Human
cuauaaacaauuacau

SEQ ID NO: 1896539 - RNA, 20 nt, Human
cuaguuugauuaaauucuug

SEQ ID NO: 1896540 - RNA, 19 nt, Human
cuaguuugauuaaauucuu

SEQ ID NO: 1896541 - RNA, 17 nt, Human
cuaguuugauuaaauuc

SEQ ID NO: 1896542 - RNA, 14 nt, Human
cuagggaagauaau

SEQ ID NO: 1896543 - RNA, 23 nt, Human
cuagggggagccccuucugcuca

SEQ ID NO: 1896544 - RNA, 14 nt, Human
cuaccuugaaaaua

SEQ ID NO: 1896545 - RNA, 19 nt, Human
cuaccuugaaaauaagaau

SEQ ID NO: 1896546 - RNA, 17 nt, Human
cuacuaauuccacaccu

SEQ ID NO: 1896547 - RNA, 12 nt, Human
cuacuaauucca

SEQ ID NO: 1896548 - RNA, 15 nt, Human
cuacuaauuccacac

SEQ ID NO: 1896549 - RNA, 13 nt, Human
cuacuaaaacuac

SEQ ID NO: 1896550 - RNA, 16 nt, Human
cuaccugaggggccuc

SEQ ID NO: 1896551 - RNA, 19 nt, Human
cuaccugaggggccucuua

SEQ ID NO: 1896552 - RNA, 23 nt, Human
cuaccugaggggccucuuauggg

SEQ ID NO: 1896553 - RNA, 20 nt, Human
cuacuagggaaaugccuuug

SEQ ID NO: 1896554 - RNA, 20 nt, Human
cuacucaaguagcauuuacu

SEQ ID NO: 1896555 - RNA, 17 nt, Human
cuacucaaguagcauuu

SEQ ID NO: 1896556 - RNA, 18 nt, Human
cuacucaaguagcauuua

SEQ ID NO: 1896557 - RNA, 16 nt, Human
cgcuggcuccccaaag

SEQ ID NO: 1896558 - RNA, 13 nt, Human
cgcuggcucccca

SEQ ID NO: 1896559 - RNA, 17 nt, Human
cgcuggggccaguuggu

SEQ ID NO: 1896560 - RNA, 18 nt, Human
cgcuggccgggaccccga

SEQ ID NO: 1896561 - RNA, 23 nt, Human
cgcuggccgggaccccgagccug

SEQ ID NO: 1896562 - RNA, 20 nt, Human
cgcuggggccaguugguccc

SEQ ID NO: 1896563 - RNA, 13 nt, Human
cgcugccccuggc

SEQ ID NO: 1896564 - RNA, 16 nt, Human
cgcugccccuggcagc

SEQ ID NO: 1896565 - RNA, 17 nt, Human
cgcugccccuggcagcc

SEQ ID NO: 1896566 - RNA, 23 nt, Human
cgcuggaccuugaacuggguacu

SEQ ID NO: 1896567 - RNA, 19 nt, Human
cgcuggaccuugaacuggg

SEQ ID NO: 1896568 - RNA, 18 nt, Human
cgcugccccuggcagccc

SEQ ID NO: 1896569 - RNA, 16 nt, Human
cgccuuaaggauguuc

SEQ ID NO: 1896570 - RNA, 18 nt, Human
cgcauccccugccuccau

SEQ ID NO: 1896571 - RNA, 13 nt, Human
cgcauccccugcc

SEQ ID NO: 1896572 - RNA, 14 nt, Human
cgcauccccugccu

SEQ ID NO: 1896573 - RNA, 15 nt, Human
cgcauccccugccuc

SEQ ID NO: 1896574 - RNA, 16 nt, Human
cgcauccccugccucc

SEQ ID NO: 1896575 - RNA, 21 nt, Human
cgagguuucucaaagaaauuu

SEQ ID NO: 1896576 - RNA, 13 nt, Human
cguuaaaauacca

SEQ ID NO: 1896577 - RNA, 12 nt, Human
cguguuuguguu

SEQ ID NO: 1896578 - RNA, 15 nt, Human
cuaaagcugccagcc

SEQ ID NO: 1896579 - RNA, 16 nt, Human
cuaaaggcuaccuuug

SEQ ID NO: 1896580 - RNA, 15 nt, Human
cuaaaggcuaccuuu

SEQ ID NO: 1896581 - RNA, 14 nt, Human
cuaaagcugccagc

SEQ ID NO: 1896582 - RNA, 19 nt, Human
cuaaaggcuaccuuuguau

SEQ ID NO: 1896583 - RNA, 17 nt, Human
cuaaaggcuaccuuugu

SEQ ID NO: 1896584 - RNA, 22 nt, Human
cuaaaguguauuuuuuuacuaa

SEQ ID NO: 1896585 - RNA, 20 nt, Human
cuaacugcuacaaauacucu

SEQ ID NO: 1896586 - RNA, 13 nt, Human
cgguguggagaag

SEQ ID NO: 1896587 - RNA, 22 nt, Human
cgguucacucuucucagccacu

SEQ ID NO: 1896588 - RNA, 21 nt, Human
cgguuccucguucucccuggg

SEQ ID NO: 1896589 - RNA, 19 nt, Human
cgguuccucguucucccug

SEQ ID NO: 1896590 - RNA, 16 nt, Human
cguacacauuuuauuu

SEQ ID NO: 1896591 - RNA, 13 nt, Human
cguacacauuuua

SEQ ID NO: 1896592 - RNA, 15 nt, Human
cggagacggaguccc

SEQ ID NO: 1896593 - RNA, 19 nt, Human
cucuuuuuuuggcccaggc

SEQ ID NO: 1896594 - RNA, 18 nt, Human
cucuuuuuuuggcccagg

SEQ ID NO: 1896595 - RNA, 16 nt, Human
cucuuuuuuuggccca

SEQ ID NO: 1896596 - RNA, 17 nt, Human
cugaaagaggaaugaag

SEQ ID NO: 1896597 - RNA, 13 nt, Human
cugaaagaggaau

SEQ ID NO: 1896598 - RNA, 24 nt, Human
cucuugauucauaaugacuuaagc

SEQ ID NO: 1896599 - RNA, 13 nt, Human
cucuugagccugg

SEQ ID NO: 1896600 - RNA, 14 nt, Human
cucuugagccuggg

SEQ ID NO: 1896601 - RNA, 22 nt, Human
cucuugauucauaaugacuuaa

SEQ ID NO: 1896602 - RNA, 15 nt, Human
cucuugagccuggga

SEQ ID NO: 1896603 - RNA, 16 nt, Human
cucuugagccugggag

SEQ ID NO: 1896604 - RNA, 17 nt, Human
cucugcacaagcugcac

SEQ ID NO: 1896605 - RNA, 18 nt, Human
cucugcacaagcugcacc

SEQ ID NO: 1896606 - RNA, 19 nt, Human
cucugcacaagcugcaccc

SEQ ID NO: 1896607 - RNA, 23 nt, Human
cugacacacagcucuguccuggg

SEQ ID NO: 1896608 - RNA, 22 nt, Human
cugacacacagcucuguccugg

SEQ ID NO: 1896609 - RNA, 21 nt, Human
cugacacacagcucuguccug

SEQ ID NO: 1896610 - RNA, 20 nt, Human
cugacacacagcucuguccu

SEQ ID NO: 1896611 - RNA, 19 nt, Human
cugacacacagcucugucc

SEQ ID NO: 1896612 - RNA, 18 nt, Human
cugacacacagcucuguc

SEQ ID NO: 1896613 - RNA, 17 nt, Human
cugacacacagcucugu

SEQ ID NO: 1896614 - RNA, 16 nt, Human
cugacacacagcucug

SEQ ID NO: 1896615 - RNA, 15 nt, Human
cugacacacagcucu

SEQ ID NO: 1896616 - RNA, 13 nt, Human
cugacacacagcu

SEQ ID NO: 1896617 - RNA, 14 nt, Human
cugaaaauguaugu

SEQ ID NO: 1896618 - RNA, 19 nt, Human
cugaagcagguucccaagc

SEQ ID NO: 1896619 - RNA, 20 nt, Human
cugaagcagguucccaagcu

SEQ ID NO: 1896620 - RNA, 21 nt, Human
cugaagcagguucccaagcuc

SEQ ID NO: 1896621 - RNA, 14 nt, Human
cugacaccuuucau

SEQ ID NO: 1896622 - RNA, 21 nt, Human
cugaguaaaaaagcugugugc

SEQ ID NO: 1896623 - RNA, 23 nt, Human
cugaggaauccagacccggcugc

SEQ ID NO: 1896624 - RNA, 14 nt, Human
cugaggggccucuu

SEQ ID NO: 1896625 - RNA, 13 nt, Human
cugaggugggagg

SEQ ID NO: 1896626 - RNA, 22 nt, Human
cugaggugggaggaucucuuga

SEQ ID NO: 1896627 - RNA, 21 nt, Human
cugaggugggagauguggaaa

SEQ ID NO: 1896628 - RNA, 14 nt, Human
cugaggaauccaga

SEQ ID NO: 1896629 - RNA, 23 nt, Human
cugaggaagaacggggcucuucu

SEQ ID NO: 1896630 - RNA, 19 nt, Human
cugaggaagcugggguuca

SEQ ID NO: 1896631 - RNA, 18 nt, Human
cugaggaagaacggggcu

SEQ ID NO: 1896632 - RNA, 15 nt, Human
cugaggaagaacggg

SEQ ID NO: 1896633 - RNA, 23 nt, Human
cugaggaagagggacuguucuuu

SEQ ID NO: 1896634 - RNA, 18 nt, Human
cugaggaagagggacugu

SEQ ID NO: 1896635 - RNA, 12 nt, Human
cugagcuuggaa

SEQ ID NO: 1896636 - RNA, 15 nt, Human
cugagcuucucugug

SEQ ID NO: 1896637 - RNA, 16 nt, Human
cugagcuucucuguga

SEQ ID NO: 1896638 - RNA, 21 nt, Human
cugagcuuggaagcuucuggu

SEQ ID NO: 1896639 - RNA, 20 nt, Human
cugagcuuggaagcuucugg

SEQ ID NO: 1896640 - RNA, 14 nt, Human
cugagcuuggaagc

SEQ ID NO: 1896641 - RNA, 22 nt, Human
cugagcugggaugauuggaggg

SEQ ID NO: 1896642 - RNA, 12 nt, Human
cugagcugggau

SEQ ID NO: 1896643 - RNA, 19 nt, Human
cugacccugcuucaaauau

SEQ ID NO: 1896644 - RNA, 17 nt, Human
cugaucucucgugauug

SEQ ID NO: 1896645 - RNA, 18 nt, Human
cugaucucucgugauuga

SEQ ID NO: 1896646 - RNA, 10 nt, Human
cucuccucug

SEQ ID NO: 1896647 - RNA, 17 nt, Human
cucucuggccuucggcc

SEQ ID NO: 1896648 - RNA, 22 nt, Human
cucucuggccuucggccuccau

SEQ ID NO: 1896649 - RNA, 19 nt, Human
cucucuggccuucggccuc

SEQ ID NO: 1896650 - RNA, 20 nt, Human
cucucuugauuaagaucuca

SEQ ID NO: 1896651 - RNA, 16 nt, Human
cucuccgaccagacac

SEQ ID NO: 1896652 - RNA, 13 nt, Human
cucuccuccuuuu

SEQ ID NO: 1896653 - RNA, 20 nt, Human
cucuccuccuuuucacaguu

SEQ ID NO: 1896654 - RNA, 17 nt, Human
cucgugguaggacugua

SEQ ID NO: 1896655 - RNA, 16 nt, Human
cucgugguaggacugu

SEQ ID NO: 1896656 - RNA, 15 nt, Human
cucgugguaggacug

SEQ ID NO: 1896657 - RNA, 13 nt, Human
cucucccuuggau

SEQ ID NO: 1896658 - RNA, 16 nt, Human
cucugcacaagcugca

SEQ ID NO: 1896659 - RNA, 22 nt, Human
cuccuuuagcgcccaguugggu

SEQ ID NO: 1896660 - RNA, 17 nt, Human
cuccuuuagcgcccagu

SEQ ID NO: 1896661 - RNA, 16 nt, Human
cuccuuuagcgcccag

SEQ ID NO: 1896662 - RNA, 22 nt, Human
cuccuagccugugccucuggga

SEQ ID NO: 1896663 - RNA, 23 nt, Human
cuccuagagggaggggccuaggc

SEQ ID NO: 1896664 - RNA, 16 nt, Human
cuccuagccacccacc

SEQ ID NO: 1896665 - RNA, 24 nt, Human
cuccuuuucacaguucucuccuuc

SEQ ID NO: 1896666 - RNA, 23 nt, Human
cuccuuugugaggaagccgcugg

SEQ ID NO: 1896667 - RNA, 20 nt, Human
cucgaaacacagaaaccuuu

SEQ ID NO: 1896668 - RNA, 14 nt, Human
cucgaaacacagaa

SEQ ID NO: 1896669 - RNA, 15 nt, Human
cucgaaacacagaaa

SEQ ID NO: 1896670 - RNA, 19 nt, Human
cucgaaacacagaaaccuu

SEQ ID NO: 1896671 - RNA, 11 nt, Human
cucggugccuu

SEQ ID NO: 1896672 - RNA, 17 nt, Human
cucccaccucagccucc

SEQ ID NO: 1896673 - RNA, 16 nt, Human
cucccaccucagccuc

SEQ ID NO: 1896674 - RNA, 14 nt, Human
cucccaccucagcc

SEQ ID NO: 1896675 - RNA, 22 nt, Human
cuccaggugcacaagcuccaag

SEQ ID NO: 1896676 - RNA, 18 nt, Human
cuccaggugcacaagcuc

SEQ ID NO: 1896677 - RNA, 19 nt, Human
cuccaggugcacaagcucc

SEQ ID NO: 1896678 - RNA, 20 nt, Human
cuccaggugcacaagcucca

SEQ ID NO: 1896679 - RNA, 23 nt, Human
cuccaggcuguaucccaugagcc

SEQ ID NO: 1896680 - RNA, 16 nt, Human
cuccagacacaugucc

SEQ ID NO: 1896681 - RNA, 17 nt, Human
cucagacauuggcaccu

SEQ ID NO: 1896682 - RNA, 22 nt, Human
cuccagaauuucccaaagcagu

SEQ ID NO: 1896683 - RNA, 11 nt, Human
cuccagacaca

SEQ ID NO: 1896684 - RNA, 16 nt, Human
cucagaaucucaaaua

SEQ ID NO: 1896685 - RNA, 17 nt, Human
cucagaaucucaaauaa

SEQ ID NO: 1896686 - RNA, 21 nt, Human
cuccagaauuucccaaagcag

SEQ ID NO: 1896687 - RNA, 13 nt, Human
cucagacauuggc

SEQ ID NO: 1896688 - RNA, 20 nt, Human
cucagacauguuuuccguga

SEQ ID NO: 1896689 - RNA, 19 nt, Human
cucagacauguuuuccgug

SEQ ID NO: 1896690 - RNA, 16 nt, Human
cucccucccucuuucc

SEQ ID NO: 1896691 - RNA, 23 nt, Human
cuccccaucgccagcugaugacu

SEQ ID NO: 1896692 - RNA, 21 nt, Human
cuccccaucgccagcugauga

SEQ ID NO: 1896693 - RNA, 15 nt, Human
cucccucuuucccuc

SEQ ID NO: 1896694 - RNA, 19 nt, Human
cucccucuuucccucccuu

SEQ ID NO: 1896695 - RNA, 20 nt, Human
cuccgcuuucuacccagcga

SEQ ID NO: 1896696 - RNA, 21 nt, Human
cuccgcuuucuacccagcgag

SEQ ID NO: 1896697 - RNA, 22 nt, Human
cuccgcuuucuacccagcgagc

SEQ ID NO: 1896698 - RNA, 14 nt, Human
cuccgucaacucau

SEQ ID NO: 1896699 - RNA, 13 nt, Human
cuccuagagggag

SEQ ID NO: 1896700 - RNA, 15 nt, Human
cuccuagagggaggg

SEQ ID NO: 1896701 - RNA, 18 nt, Human
cuccuagagggaggggcc

SEQ ID NO: 1896702 - RNA, 19 nt, Human
cuccuagagggaggggccu

SEQ ID NO: 1896703 - RNA, 17 nt, Human
gugaccaggcauccucc

SEQ ID NO: 1896704 - RNA, 18 nt, Human
gugaccauguuuuguuua

SEQ ID NO: 1896705 - RNA, 18 nt, Human
gugaccagcaccaucucu

SEQ ID NO: 1896706 - RNA, 21 nt, Human
gugaccagcaccaucucuccu

SEQ ID NO: 1896707 - RNA, 17 nt, Human
gugaccaaugaugguca

SEQ ID NO: 1896708 - RNA, 19 nt, Human
gugacagaggcagccccau

SEQ ID NO: 1896709 - RNA, 18 nt, Human
gugacagaggcagcccca

SEQ ID NO: 1896710 - RNA, 16 nt, Human
gugacagaggcagccc

SEQ ID NO: 1896711 - RNA, 20 nt, Human
gugaaggccucgcaggaaga

SEQ ID NO: 1896712 - RNA, 14 nt, Human
gugacaugucuuuu

SEQ ID NO: 1896713 - RNA, 14 nt, Human
gugaaggcuggcau

SEQ ID NO: 1896714 - RNA, 12 nt, Human
gugaaggcuggc

SEQ ID NO: 1896715 - RNA, 13 nt, Human
gugaaggcuggca

SEQ ID NO: 1896716 - RNA, 14 nt, Human
gugaagugaagaca

SEQ ID NO: 1896717 - RNA, 10 nt, Human
gugaagccaa

SEQ ID NO: 1896718 - RNA, 20 nt, Human
gugaagccaauucagacagg

SEQ ID NO: 1896719 - RNA, 22 nt, Human
gugaagccaauucagacaggca

SEQ ID NO: 1896720 - RNA, 12 nt, Human
gugaaggacccu

SEQ ID NO: 1896721 - RNA, 13 nt, Human
gugaaggacccuu

SEQ ID NO: 1896722 - RNA, 12 nt, Human
gugaaggccucg

SEQ ID NO: 1896723 - RNA, 23 nt, Human
gugaagacaaugacuuacuguac

SEQ ID NO: 1896724 - RNA, 16 nt, Human
aacucugcauucuagu

SEQ ID NO: 1896725 - RNA, 15 nt, Human
gugagucgaggacag

SEQ ID NO: 1896726 - RNA, 20 nt, Human
gugaguccuggcaugggaau

SEQ ID NO: 1896727 - RNA, 19 nt, Human
gugaguccuagagcuacag

SEQ ID NO: 1896728 - RNA, 17 nt, Human
gugaguccuggcauggg

SEQ ID NO: 1896729 - RNA, 19 nt, Human
gugaguacuacaguccucc

SEQ ID NO: 1896730 - RNA, 21 nt, Human
gugaguacuacaguccuccca

SEQ ID NO: 1896731 - RNA, 15 nt, Human
aacugaacauuccag

SEQ ID NO: 1896732 - RNA, 22 nt, Human
aacugaacaccauugaaggcuu

SEQ ID NO: 1896733 - RNA, 21 nt, Human
aacugaacaccauugaaggcu

SEQ ID NO: 1896734 - RNA, 23 nt, Human
aacugaacaccauugaaggcuua

SEQ ID NO: 1896735 - RNA, 16 nt, Human
gugagaggggaacaga

SEQ ID NO: 1896736 - RNA, 13 nt, Human
gugagagcugggu

SEQ ID NO: 1896737 - RNA, 15 nt, Human
gugagcaauccugca

SEQ ID NO: 1896738 - RNA, 21 nt, Human
gugagcacuaaggugugcucu

SEQ ID NO: 1896739 - RNA, 17 nt, Human
gugaguacuacaguccu

SEQ ID NO: 1896740 - RNA, 12 nt, Human
gugaccccaggu

SEQ ID NO: 1896741 - RNA, 15 nt, Human
gugacccccagcucc

SEQ ID NO: 1896742 - RNA, 17 nt, Human
gugacccccagcuccgg

SEQ ID NO: 1896743 - RNA, 16 nt, Human
gugacccccagcuccg

SEQ ID NO: 1896744 - RNA, 12 nt, Human
gugagagcuggg

SEQ ID NO: 1896745 - RNA, 22 nt, Human
aaccaugagaccacuguuauca

SEQ ID NO: 1896746 - RNA, 17 nt, Human
gucucuugguccugcug

SEQ ID NO: 1896747 - RNA, 13 nt, Human
gucucuugguccu

SEQ ID NO: 1896748 - RNA, 20 nt, Human
aaccaugaagucucuaacaa

SEQ ID NO: 1896749 - RNA, 20 nt, Human
gucucuugguccugcugcag

SEQ ID NO: 1896750 - RNA, 18 nt, Human
gucucuugguccugcugc

SEQ ID NO: 1896751 - RNA, 19 nt, Human
gucucuugguccugcugca

SEQ ID NO: 1896752 - RNA, 23 nt, Human
gucucuuuaaugucacaggcagg

SEQ ID NO: 1896753 - RNA, 22 nt, Human
gucucuuuaaugucacaggcag

SEQ ID NO: 1896754 - RNA, 14 nt, Human
gucugaaggcuggg

SEQ ID NO: 1896755 - RNA, 19 nt, Human
gucugaaggcuggguucug

SEQ ID NO: 1896756 - RNA, 20 nt, Human
gucucuuuaaugucacaggc

SEQ ID NO: 1896757 - RNA, 19 nt, Human
gucucuuuaaugucacagg

SEQ ID NO: 1896758 - RNA, 18 nt, Human
gucucuuuaaugucacag

SEQ ID NO: 1896759 - RNA, 16 nt, Human
gucucuuguauuaaac

SEQ ID NO: 1896760 - RNA, 19 nt, Human
gucucuuguauuaaacucu

SEQ ID NO: 1896761 - RNA, 23 nt, Human
gucugacaggcaaugcuggcugu

SEQ ID NO: 1896762 - RNA, 22 nt, Human
gucugacaggcaaugcuggcug

SEQ ID NO: 1896763 - RNA, 21 nt, Human
gucugacaggcaaugcuggcu

SEQ ID NO: 1896764 - RNA, 21 nt, Human
gucuggaguugaucuggaacc

SEQ ID NO: 1896765 - RNA, 23 nt, Human
aacuaagaaauaugcacaauagc

SEQ ID NO: 1896766 - RNA, 17 nt, Human
aacuagaacugaauuuu

SEQ ID NO: 1896767 - RNA, 17 nt, Human
aacuagaauuuauucaa

SEQ ID NO: 1896768 - RNA, 19 nt, Human
aacuagaauuuauucaauu

SEQ ID NO: 1896769 - RNA, 22 nt, Human
aacuagaauuuauucaauuccu

SEQ ID NO: 1896770 - RNA, 23 nt, Human
aacguggcugcuucaaggauccu

SEQ ID NO: 1896771 - RNA, 16 nt, Human
gucuucaguaagccgu

SEQ ID NO: 1896772 - RNA, 15 nt, Human
gucuuuguacagaca

SEQ ID NO: 1896773 - RNA, 16 nt, Human
gucuuuguacagacaa

SEQ ID NO: 1896774 - RNA, 19 nt, Human
gucuuuguuaaguucuauu

SEQ ID NO: 1896775 - RNA, 19 nt, Human
aaccugauugugucucuug

SEQ ID NO: 1896776 - RNA, 18 nt, Human
aaccugauugugucucuu

SEQ ID NO: 1896777 - RNA, 16 nt, Human
gucuagacuaaaagau

SEQ ID NO: 1896778 - RNA, 13 nt, Human
gucuagagaggga

SEQ ID NO: 1896779 - RNA, 14 nt, Human
gucuagagagggag

SEQ ID NO: 1896780 - RNA, 15 nt, Human
gucuagagagggagg

SEQ ID NO: 1896781 - RNA, 16 nt, Human
gucuagagagggaggc

SEQ ID NO: 1896782 - RNA, 21 nt, Human
gucuagagagggaggcaagcc

SEQ ID NO: 1896783 - RNA, 15 nt, Human
gucuagauggcuccu

SEQ ID NO: 1896784 - RNA, 16 nt, Human
gucuagauggcuccuc

SEQ ID NO: 1896785 - RNA, 19 nt, Human
gucuagauggcuccucuca

SEQ ID NO: 1896786 - RNA, 17 nt, Human
gucuagauggcuccucu

SEQ ID NO: 1896787 - RNA, 18 nt, Human
gucuagauggcuccucuc

SEQ ID NO: 1896788 - RNA, 23 nt, Human
gucgcccagucuggaaugcagug

SEQ ID NO: 1896789 - RNA, 14 nt, Human
gucgcccuggacug

SEQ ID NO: 1896790 - RNA, 18 nt, Human
gucgcccuggacugugug

SEQ ID NO: 1896791 - RNA, 15 nt, Human
gucgcccucccaggc

SEQ ID NO: 1896792 - RNA, 20 nt, Human
gucuaccugaggggccucuu

SEQ ID NO: 1896793 - RNA, 18 nt, Human
gucgacuucgggcuggcc

SEQ ID NO: 1896794 - RNA, 14 nt, Human
gucgaggacaggga

SEQ ID NO: 1896795 - RNA, 16 nt, Human
guccuuuuuuuccauc

SEQ ID NO: 1896796 - RNA, 19 nt, Human
guccuuuuuuuccaucuuu

SEQ ID NO: 1896797 - RNA, 14 nt, Human
gucgcccagucugg

SEQ ID NO: 1896798 - RNA, 13 nt, Human
gucgcccagucug

SEQ ID NO: 1896799 - RNA, 20 nt, Human
gucgcccaggcuggagugca

SEQ ID NO: 1896800 - RNA, 17 nt, Human
guccugcugcaguugcc

SEQ ID NO: 1896801 - RNA, 13 nt, Human
guccugcugcagu

SEQ ID NO: 1896802 - RNA, 16 nt, Human
guccugcugcaguugc

SEQ ID NO: 1896803 - RNA, 23 nt, Human
gucucaguccaugaagauguaga

SEQ ID NO: 1896804 - RNA, 21 nt, Human
gucuccaaccccccagcacug

SEQ ID NO: 1896805 - RNA, 20 nt, Human
gucuccaaccccccagcacu

SEQ ID NO: 1896806 - RNA, 17 nt, Human
gucuccaaccccccagc

SEQ ID NO: 1896807 - RNA, 16 nt, Human
gucuccaaccccccag

SEQ ID NO: 1896808 - RNA, 22 nt, Human
gucuccaaccccccagcacuga

SEQ ID NO: 1896809 - RNA, 12 nt, Human
gucuccaccagg

SEQ ID NO: 1896810 - RNA, 15 nt, Human
gucuccaccaggaac

SEQ ID NO: 1896811 - RNA, 16 nt, Human
gucuccaccaggaacc

SEQ ID NO: 1896812 - RNA, 17 nt, Human
gucuccaccaggaaccu

SEQ ID NO: 1896813 - RNA, 19 nt, Human
gucuccaccaggaaccucu

SEQ ID NO: 1896814 - RNA, 20 nt, Human
gucuccaccaggaaccucuu

SEQ ID NO: 1896815 - RNA, 21 nt, Human
gucuccaccaggaaccucuuc

SEQ ID NO: 1896816 - RNA, 15 nt, Human
gucuaugggacucaa

SEQ ID NO: 1896817 - RNA, 14 nt, Human
gucuaugggacuca

SEQ ID NO: 1896818 - RNA, 22 nt, Human
gucucaaacucuugaccucagg

SEQ ID NO: 1896819 - RNA, 16 nt, Human
gucucaaacuccugac

SEQ ID NO: 1896820 - RNA, 22 nt, Human
aacauuuguucuauagcuuuuc

SEQ ID NO: 1896821 - RNA, 14 nt, Human
aacauuuuaauuca

SEQ ID NO: 1896822 - RNA, 16 nt, Human
aacauuuugucauaua

SEQ ID NO: 1896823 - RNA, 15 nt, Human
aacauuuuacccaca

SEQ ID NO: 1896824 - RNA, 17 nt, Human
aacauuuuacccacaca

SEQ ID NO: 1896825 - RNA, 13 nt, Human
aacauuuucacac

SEQ ID NO: 1896826 - RNA, 13 nt, Human
gucuccauguuug

SEQ ID NO: 1896827 - RNA, 13 nt, Human
aaccacaucuugc

SEQ ID NO: 1896828 - RNA, 22 nt, Human
aaccacauacaacacaaagaga

SEQ ID NO: 1896829 - RNA, 16 nt, Human
aaccaaauauuccaga

SEQ ID NO: 1896830 - RNA, 12 nt, Human
guagccugugca

SEQ ID NO: 1896831 - RNA, 16 nt, Human
guagccuuuugacuuu

SEQ ID NO: 1896832 - RNA, 22 nt, Human
guagcucuaggagggcuggcaa

SEQ ID NO: 1896833 - RNA, 18 nt, Human
gucccaccuuggcugcag

SEQ ID NO: 1896834 - RNA, 17 nt, Human
gucccaccuuggcugca

SEQ ID NO: 1896835 - RNA, 19 nt, Human
gucccaccuuggcugcagg

SEQ ID NO: 1896836 - RNA, 23 nt, Human
guccccuguuuguuucugaaagg

SEQ ID NO: 1896837 - RNA, 11 nt, Human
guccccuucuc

SEQ ID NO: 1896838 - RNA, 18 nt, Human
gucccccugacaacacuc

SEQ ID NO: 1896839 - RNA, 13 nt, Human
gucccccugacaa

SEQ ID NO: 1896840 - RNA, 15 nt, Human
guccccgcacugggc

SEQ ID NO: 1896841 - RNA, 16 nt, Human
guccccgcacugggcu

SEQ ID NO: 1896842 - RNA, 21 nt, Human
guccgaaagggacuuggaagc

SEQ ID NO: 1896843 - RNA, 13 nt, Human
gucccuuuuccuu

SEQ ID NO: 1896844 - RNA, 20 nt, Human
guccccuucucucaucucuu

SEQ ID NO: 1896845 - RNA, 19 nt, Human
guccccuucucucaucucu

SEQ ID NO: 1896846 - RNA, 18 nt, Human
guccccuucucucaucuc

SEQ ID NO: 1896847 - RNA, 17 nt, Human
guccccuucucucaucu

SEQ ID NO: 1896848 - RNA, 14 nt, Human
guccccuucucuca

SEQ ID NO: 1896849 - RNA, 13 nt, Human
guccccuucucuc

SEQ ID NO: 1896850 - RNA, 12 nt, Human
guccccuucucu

SEQ ID NO: 1896851 - RNA, 22 nt, Human
guccgaaagggacuuggaagcu

SEQ ID NO: 1896852 - RNA, 13 nt, Human
guccuaaaacacc

SEQ ID NO: 1896853 - RNA, 19 nt, Human
aacagguuuuccugaagaa

SEQ ID NO: 1896854 - RNA, 20 nt, Human
aacagacuggaagcacagcu

SEQ ID NO: 1896855 - RNA, 13 nt, Human
guccuacccaccc

SEQ ID NO: 1896856 - RNA, 14 nt, Human
aacaucaacaucuu

SEQ ID NO: 1896857 - RNA, 22 nt, Human
aacauguuuuucuucucccuca

SEQ ID NO: 1896858 - RNA, 18 nt, Human
aacauacucccaucugug

SEQ ID NO: 1896859 - RNA, 16 nt, Human
aacauacucccaucug

SEQ ID NO: 1896860 - RNA, 20 nt, Human
aacauacucccaucugugaa

SEQ ID NO: 1896861 - RNA, 17 nt, Human
gugggcaaacaggcagu

SEQ ID NO: 1896862 - RNA, 18 nt, Human
guggggggggugcugggc

SEQ ID NO: 1896863 - RNA, 14 nt, Human
gugggggucugugu

SEQ ID NO: 1896864 - RNA, 16 nt, Human
gugggggucugugugu

SEQ ID NO: 1896865 - RNA, 15 nt, Human
gugggggucugugug

SEQ ID NO: 1896866 - RNA, 14 nt, Human
gugggucaaggaau

SEQ ID NO: 1896867 - RNA, 15 nt, Human
gugguguuuccuggc

SEQ ID NO: 1896868 - RNA, 16 nt, Human
gugguguuuccuggca

SEQ ID NO: 1896869 - RNA, 20 nt, Human
gugguguuuccugcaggcca

SEQ ID NO: 1896870 - RNA, 22 nt, Human
gugguguggagaagccacaggc

SEQ ID NO: 1896871 - RNA, 14 nt, Human
gugguguggagaag

SEQ ID NO: 1896872 - RNA, 14 nt, Human
guggcuucuuaauc

SEQ ID NO: 1896873 - RNA, 15 nt, Human
guggccucccaacuc

SEQ ID NO: 1896874 - RNA, 23 nt, Human
gugggaaagauuacuuuuucuuu

SEQ ID NO: 1896875 - RNA, 22 nt, Human
guggcuugagaaauauggacac

SEQ ID NO: 1896876 - RNA, 13 nt, Human
guggccucccaac

SEQ ID NO: 1896877 - RNA, 14 nt, Human
guggccucccaacu

SEQ ID NO: 1896878 - RNA, 15 nt, Human
gugggauccuccagg

SEQ ID NO: 1896879 - RNA, 18 nt, Human
gugggauccuccaggugc

SEQ ID NO: 1896880 - RNA, 12 nt, Human
gugggagcugag

SEQ ID NO: 1896881 - RNA, 16 nt, Human
aagagcuguccuggua

SEQ ID NO: 1896882 - RNA, 18 nt, Human
aagagcugaggcaauucu

SEQ ID NO: 1896883 - RNA, 11 nt, Human
aagagcugagg

SEQ ID NO: 1896884 - RNA, 16 nt, Human
aagagcccaggccucc

SEQ ID NO: 1896885 - RNA, 15 nt, Human
aagagauuccugagc

SEQ ID NO: 1896886 - RNA, 12 nt, Human
aagagcccaggc

SEQ ID NO: 1896887 - RNA, 14 nt, Human
aagagcccaggccu

SEQ ID NO: 1896888 - RNA, 16 nt, Human
aagacuguacaaagua

SEQ ID NO: 1896889 - RNA, 20 nt, Human
aagagaugaugaaaauauuu

SEQ ID NO: 1896890 - RNA, 16 nt, Human
aagagauugugguuuc

SEQ ID NO: 1896891 - RNA, 19 nt, Human
aagagauugugguuucauu

SEQ ID NO: 1896892 - RNA, 19 nt, Human
aagacccaacacaugggac

SEQ ID NO: 1896893 - RNA, 21 nt, Human
aagacgcugugcugcccugcc

SEQ ID NO: 1896894 - RNA, 22 nt, Human
aagacgcugugcugcccugccc

SEQ ID NO: 1896895 - RNA, 23 nt, Human
aagacgcugugcugcccugccca

SEQ ID NO: 1896896 - RNA, 17 nt, Human
aagacucauucuucugu

SEQ ID NO: 1896897 - RNA, 20 nt, Human
aagacuggaagcuaauuugc

SEQ ID NO: 1896898 - RNA, 22 nt, Human
aagacuggaagcuaauuugcau

SEQ ID NO: 1896899 - RNA, 23 nt, Human
aagacuggaagcuaauuugcauu

SEQ ID NO: 1896900 - RNA, 13 nt, Human
aagcaaacccaga

SEQ ID NO: 1896901 - RNA, 14 nt, Human
aagcaaacacauua

SEQ ID NO: 1896902 - RNA, 16 nt, Human
aagcaaacccagacgg

SEQ ID NO: 1896903 - RNA, 19 nt, Human
aagcaaacccagacggcuc

SEQ ID NO: 1896904 - RNA, 12 nt, Human
aagcaaacacau

SEQ ID NO: 1896905 - RNA, 13 nt, Human
aagcaaacacauu

SEQ ID NO: 1896906 - RNA, 13 nt, Human
aagcaaaugugaa

SEQ ID NO: 1896907 - RNA, 14 nt, Human
aagcaaaugugaau

SEQ ID NO: 1896908 - RNA, 16 nt, Human
aagcaagauuucagau

SEQ ID NO: 1896909 - RNA, 22 nt, Human
aagauguagaggagaaacugga

SEQ ID NO: 1896910 - RNA, 15 nt, Human
aagaugcaauguaga

SEQ ID NO: 1896911 - RNA, 13 nt, Human
aagcaaaauguga

SEQ ID NO: 1896912 - RNA, 19 nt, Human
aagauguagaggagaaacu

SEQ ID NO: 1896913 - RNA, 16 nt, Human
aagaguaggaagacuu

SEQ ID NO: 1896914 - RNA, 18 nt, Human
aagaguaggaagacuuug

SEQ ID NO: 1896915 - RNA, 19 nt, Human
aagaguaggaagacuuugg

SEQ ID NO: 1896916 - RNA, 15 nt, Human
aagauauuuugcuuu

SEQ ID NO: 1896917 - RNA, 19 nt, Human
gugguguuuccuggcacug

SEQ ID NO: 1896918 - RNA, 18 nt, Human
gugguuauggagagggug

SEQ ID NO: 1896919 - RNA, 23 nt, Human
gugguuaaugccauggacagaag

SEQ ID NO: 1896920 - RNA, 14 nt, Human
gugguuacacagug

SEQ ID NO: 1896921 - RNA, 13 nt, Human
gugguuacacagu

SEQ ID NO: 1896922 - RNA, 21 nt, Human
gugguucacucuuggagccug

SEQ ID NO: 1896923 - RNA, 20 nt, Human
gugguucacucuuggagccu

SEQ ID NO: 1896924 - RNA, 22 nt, Human
aagauauuuugcuuugugauuu

SEQ ID NO: 1896925 - RNA, 20 nt, Human
aagaguaggaagacuuugga

SEQ ID NO: 1896926 - RNA, 20 nt, Human
aagauauuuugcuuugugau

SEQ ID NO: 1896927 - RNA, 17 nt, Human
aagauauuuugcuuugu

SEQ ID NO: 1896928 - RNA, 14 nt, Human
guguguguaugugg

SEQ ID NO: 1896929 - RNA, 13 nt, Human
gugugugugaaug

SEQ ID NO: 1896930 - RNA, 17 nt, Human
guguguguugugugugg

SEQ ID NO: 1896931 - RNA, 19 nt, Human
gugugguguuuccuggcac

SEQ ID NO: 1896932 - RNA, 13 nt, Human
guguggugcagug

SEQ ID NO: 1896933 - RNA, 14 nt, Human
guguggugcagugu

SEQ ID NO: 1896934 - RNA, 18 nt, Human
guguggugcagugugaaa

SEQ ID NO: 1896935 - RNA, 13 nt, Human
guguguguaugug

SEQ ID NO: 1896936 - RNA, 13 nt, Human
guguucuuugugu

SEQ ID NO: 1896937 - RNA, 13 nt, Human
guguucugugaua

SEQ ID NO: 1896938 - RNA, 20 nt, Human
gugucccaaaaagaaaggag

SEQ ID NO: 1896939 - RNA, 19 nt, Human
gugucuugcaauggcagcc

SEQ ID NO: 1896940 - RNA, 18 nt, Human
gugucuuuaaaugcugcu

SEQ ID NO: 1896941 - RNA, 19 nt, Human
gugucuuuaaaugcugcuu

SEQ ID NO: 1896942 - RNA, 21 nt, Human
gugucuugcaauggcagccuu

SEQ ID NO: 1896943 - RNA, 18 nt, Human
gugugagucaccaagccc

SEQ ID NO: 1896944 - RNA, 13 nt, Human
gugugagucacca

SEQ ID NO: 1896945 - RNA, 15 nt, Human
gugugguguuuccug

SEQ ID NO: 1896946 - RNA, 19 nt, Human
guguggugcagugugaaaa

SEQ ID NO: 1896947 - RNA, 19 nt, Human
gugccuggccuggcacaca

SEQ ID NO: 1896948 - RNA, 15 nt, Human
gugccuggccuggca

SEQ ID NO: 1896949 - RNA, 12 nt, Human
gugccuggccug

SEQ ID NO: 1896950 - RNA, 15 nt, Human
gugccucugggacug

SEQ ID NO: 1896951 - RNA, 14 nt, Human
aacuuggcgcugcc

SEQ ID NO: 1896952 - RNA, 15 nt, Human
aacuuggauuuuuga

SEQ ID NO: 1896953 - RNA, 14 nt, Human
aacuuggaaauagu

SEQ ID NO: 1896954 - RNA, 17 nt, Human
aacuuggcgcugccccu

SEQ ID NO: 1896955 - RNA, 23 nt, Human
aacuugguucccauuugcuccuu

SEQ ID NO: 1896956 - RNA, 17 nt, Human
gugcacacaccagagcc

SEQ ID NO: 1896957 - RNA, 18 nt, Human
gugcacguacacacacau

SEQ ID NO: 1896958 - RNA, 14 nt, Human
gugcacacaccaga

SEQ ID NO: 1896959 - RNA, 12 nt, Human
gugcacacacca

SEQ ID NO: 1896960 - RNA, 14 nt, Human
aacugcaugcugcu

SEQ ID NO: 1896961 - RNA, 16 nt, Human
aacugcaugcugcugg

SEQ ID NO: 1896962 - RNA, 20 nt, Human
gugcauuugaggucuguucu

SEQ ID NO: 1896963 - RNA, 20 nt, Human
gugcacuaauguguaagaca

SEQ ID NO: 1896964 - RNA, 22 nt, Human
gugcauuugaggucuguucuuu

SEQ ID NO: 1896965 - RNA, 21 nt, Human
gugcauuugaggucuguucuu

SEQ ID NO: 1896966 - RNA, 15 nt, Human
gugcauuuggugguu

SEQ ID NO: 1896967 - RNA, 14 nt, Human
gugccaagcagagg

SEQ ID NO: 1896968 - RNA, 17 nt, Human
aacuuguauuaaagaca

SEQ ID NO: 1896969 - RNA, 20 nt, Human
aagaaaaaggaugcacagag

SEQ ID NO: 1896970 - RNA, 19 nt, Human
aagaaaaaggaugcacaga

SEQ ID NO: 1896971 - RNA, 22 nt, Human
aagaaaaaggaugcacagaguu

SEQ ID NO: 1896972 - RNA, 22 nt, Human
aagaaaaguuuuguaaauuucu

SEQ ID NO: 1896973 - RNA, 21 nt, Human
aagaaaaguuuuguaaauuuc

SEQ ID NO: 1896974 - RNA, 16 nt, Human
aagaaaaguuuuguaa

SEQ ID NO: 1896975 - RNA, 15 nt, Human
aagaaaaguuuugua

SEQ ID NO: 1896976 - RNA, 12 nt, Human
aagaaaagauuu

SEQ ID NO: 1896977 - RNA, 22 nt, Human
aagaaaagauuuuaaucaaguu

SEQ ID NO: 1896978 - RNA, 18 nt, Human
aagaaaacaucuauucuc

SEQ ID NO: 1896979 - RNA, 23 nt, Human
aagaaaguuuccccaccagugaa

SEQ ID NO: 1896980 - RNA, 16 nt, Human
aagaagcccaggaaag

SEQ ID NO: 1896981 - RNA, 17 nt, Human
aagaagcccaggaaagg

SEQ ID NO: 1896982 - RNA, 19 nt, Human
aagaagccacagaccuagg

SEQ ID NO: 1896983 - RNA, 15 nt, Human
aagaagcccccagcu

SEQ ID NO: 1896984 - RNA, 16 nt, Human
aagaagcccccagcua

SEQ ID NO: 1896985 - RNA, 19 nt, Human
aagaagcccccagcuaaga

SEQ ID NO: 1896986 - RNA, 14 nt, Human
aagaagcucucucc

SEQ ID NO: 1896987 - RNA, 15 nt, Human
aagaagcucucuccu

SEQ ID NO: 1896988 - RNA, 15 nt, Human
aagaaaguuucccca

SEQ ID NO: 1896989 - RNA, 13 nt, Human
aagaaaguuuccc

SEQ ID NO: 1896990 - RNA, 21 nt, Human
aagaaauaaaaggaagccaaa

SEQ ID NO: 1896991 - RNA, 23 nt, Human
aagaaauaaaaggaagccaaaga

SEQ ID NO: 1896992 - RNA, 17 nt, Human
guggacucugcacaugu

SEQ ID NO: 1896993 - RNA, 14 nt, Human
guggacucugcaca

SEQ ID NO: 1896994 - RNA, 14 nt, Human
guggacucagggca

SEQ ID NO: 1896995 - RNA, 15 nt, Human
guggacucagggcag

SEQ ID NO: 1896996 - RNA, 16 nt, Human
guggacucagggcagc

SEQ ID NO: 1896997 - RNA, 21 nt, Human
guggacucagggcagcgccag

SEQ ID NO: 1896998 - RNA, 21 nt, Human
guggauuuaacagaaauguac

SEQ ID NO: 1896999 - RNA, 23 nt, Human
guggauuuaacagaaauguacag

SEQ ID NO: 1897000 - RNA, 21 nt, Human
guggauuuugguuuuguuccc

SEQ ID NO: 1897001 - RNA, 14 nt, Human
guggcaaccugcuu

SEQ ID NO: 1897002 - RNA, 14 nt, Human
guggcagcugcggu

SEQ ID NO: 1897003 - RNA, 22 nt, Human
guggcagcucaccucucccuug

SEQ ID NO: 1897004 - RNA, 13 nt, Human
guggcaccagcag

SEQ ID NO: 1897005 - RNA, 14 nt, Human
guggcaccagcagc

SEQ ID NO: 1897006 - RNA, 13 nt, Human
aagacccaaaagg

SEQ ID NO: 1897007 - RNA, 19 nt, Human
aagaauucaaacuggggcc

SEQ ID NO: 1897008 - RNA, 24 nt, Human
aagaauuucuaggacugaauuaug

SEQ ID NO: 1897009 - RNA, 17 nt, Human
guggcagcugcggucca

SEQ ID NO: 1897010 - RNA, 11 nt, Human
aagaauauuug

SEQ ID NO: 1897011 - RNA, 15 nt, Human
aagaauauuugaaug

SEQ ID NO: 1897012 - RNA, 19 nt, Human
gugcugggccccugccucu

SEQ ID NO: 1897013 - RNA, 16 nt, Human
gugcugggccccugcc

SEQ ID NO: 1897014 - RNA, 15 nt, Human
gugcuggcaaccacu

SEQ ID NO: 1897015 - RNA, 18 nt, Human
gugcugcccugcccaccu

SEQ ID NO: 1897016 - RNA, 20 nt, Human
aagaaguaggggaagacaug

SEQ ID NO: 1897017 - RNA, 21 nt, Human
gugcugcccugcccaccuggc

SEQ ID NO: 1897018 - RNA, 19 nt, Human
gugcugcccugcccaccug

SEQ ID NO: 1897019 - RNA, 20 nt, Human
gugcugcccugcccaccugg

SEQ ID NO: 1897020 - RNA, 24 nt, Human
guggacacagcucuucuccaggcu

SEQ ID NO: 1897021 - RNA, 17 nt, Human
guggacacagcucuucu

SEQ ID NO: 1897022 - RNA, 15 nt, Human
guggacacagcucuu

SEQ ID NO: 1897023 - RNA, 14 nt, Human
guggacacagcucu

SEQ ID NO: 1897024 - RNA, 18 nt, Human
gugcuguccucagguggc

SEQ ID NO: 1897025 - RNA, 20 nt, Human
guggaauuauuuuaaaagau

SEQ ID NO: 1897026 - RNA, 17 nt, Human
guggaagagggcugcaa

SEQ ID NO: 1897027 - RNA, 14 nt, Human
guggaagagggcug

SEQ ID NO: 1897028 - RNA, 21 nt, Human
aauaaaauaucauucagcaac

SEQ ID NO: 1897029 - RNA, 17 nt, Human
aauaaaauaucauucag

SEQ ID NO: 1897030 - RNA, 16 nt, Human
aauaaaauaucauuca

SEQ ID NO: 1897031 - RNA, 15 nt, Human
aauaaaauaucauuc

SEQ ID NO: 1897032 - RNA, 14 nt, Human
aauaaaauaucauu

SEQ ID NO: 1897033 - RNA, 12 nt, Human
aauaaaauauca

SEQ ID NO: 1897034 - RNA, 20 nt, Human
aauaaaauaucauucagcaa

SEQ ID NO: 1897035 - RNA, 19 nt, Human
aauaaaauaucauucagca

SEQ ID NO: 1897036 - RNA, 18 nt, Human
aauaaaauaucauucagc

SEQ ID NO: 1897037 - RNA, 14 nt, Human
aauaaaguaauuau

SEQ ID NO: 1897038 - RNA, 18 nt, Human
aauaaagguuguuuugaa

SEQ ID NO: 1897039 - RNA, 18 nt, Human
aauaaaggaugugauugu

SEQ ID NO: 1897040 - RNA, 12 nt, Human
aauaaaaauaau

SEQ ID NO: 1897041 - RNA, 16 nt, Human
aauaaaaauaaauuug

SEQ ID NO: 1897042 - RNA, 20 nt, Human
aauaaaaggaagccaaagag

SEQ ID NO: 1897043 - RNA, 21 nt, Human
aauaaaaggaagccaaagagu

SEQ ID NO: 1897044 - RNA, 16 nt, Human
aauaaaagugaccuuu

SEQ ID NO: 1897045 - RNA, 20 nt, Human
uaaaguguauuuuuuuacua

SEQ ID NO: 1897046 - RNA, 18 nt, Human
aauaaaaaaaagaaauga

SEQ ID NO: 1897047 - RNA, 20 nt, Human
aauaaaaaaaagaaaugaaa

SEQ ID NO: 1897048 - RNA, 19 nt, Human
uaaaguguauuuuuuuacu

SEQ ID NO: 1897049 - RNA, 15 nt, Human
uaaaguguauuuuuu

SEQ ID NO: 1897050 - RNA, 14 nt, Human
uaaaguguauuuuu

SEQ ID NO: 1897051 - RNA, 13 nt, Human
uaaagucaggggu

SEQ ID NO: 1897052 - RNA, 23 nt, Human
uaaagucauggucauugcaggaa

SEQ ID NO: 1897053 - RNA, 15 nt, Human
aauaacaauaaaaga

SEQ ID NO: 1897054 - RNA, 21 nt, Human
aauaaauuugguucuaauaga

SEQ ID NO: 1897055 - RNA, 12 nt, Human
aauaacauguaa

SEQ ID NO: 1897056 - RNA, 19 nt, Human
aauaacauguaauuaagua

SEQ ID NO: 1897057 - RNA, 22 nt, Human
aauaacauguaauuaaguacua

SEQ ID NO: 1897058 - RNA, 12 nt, Human
aauaaauuauuu

SEQ ID NO: 1897059 - RNA, 19 nt, Human
aauaaaguuugcuuagaaa

SEQ ID NO: 1897060 - RNA, 15 nt, Human
aauaacuaaaaggua

SEQ ID NO: 1897061 - RNA, 17 nt, Human
aauaagugccaggaugg

SEQ ID NO: 1897062 - RNA, 13 nt, Human
uaaaugaauguuu

SEQ ID NO: 1897063 - RNA, 22 nt, Human
uaaaucuccaaaauaaaacuuu

SEQ ID NO: 1897064 - RNA, 12 nt, Human
uaaaugaauguu

SEQ ID NO: 1897065 - RNA, 21 nt, Human
uaaaucuccaaaauaaaacuu

SEQ ID NO: 1897066 - RNA, 20 nt, Human
uaaaucuccaaaauaaaacu

SEQ ID NO: 1897067 - RNA, 17 nt, Human
uaaaugauuucauucaa

SEQ ID NO: 1897068 - RNA, 20 nt, Human
uaaauguuuuuuuuuaaaga

SEQ ID NO: 1897069 - RNA, 22 nt, Human
uaaauuaacuuuuauaaacuuu

SEQ ID NO: 1897070 - RNA, 13 nt, Human
uaacaagccaccc

SEQ ID NO: 1897071 - RNA, 19 nt, Human
uaaauuuuuuuuguuucau

SEQ ID NO: 1897072 - RNA, 12 nt, Human
uaacaaaugaac

SEQ ID NO: 1897073 - RNA, 21 nt, Human
uaaauagucuagacuaaaaga

SEQ ID NO: 1897074 - RNA, 17 nt, Human
uaaauccuuuacuguua

SEQ ID NO: 1897075 - RNA, 19 nt, Human
uaaaucuccaaaauaaaac

SEQ ID NO: 1897076 - RNA, 17 nt, Human
uaaauagcuuuuguguc

SEQ ID NO: 1897077 - RNA, 12 nt, Human
uaaauagcuuuu

SEQ ID NO: 1897078 - RNA, 17 nt, Human
uaaauacaaaacuucca

SEQ ID NO: 1897079 - RNA, 13 nt, Human
uaaauaacuuuuu

SEQ ID NO: 1897080 - RNA, 22 nt, Human
uaaauaacuggaggaauuuucu

SEQ ID NO: 1897081 - RNA, 21 nt, Human
aauacaccacuacauucuguu

SEQ ID NO: 1897082 - RNA, 22 nt, Human
uaaauaaauguaucuuauucac

SEQ ID NO: 1897083 - RNA, 20 nt, Human
aauacaccacuacauucugu

SEQ ID NO: 1897084 - RNA, 18 nt, Human
aauacaccacuacauucu

SEQ ID NO: 1897085 - RNA, 16 nt, Human
aauacaccacuacauu

SEQ ID NO: 1897086 - RNA, 15 nt, Human
aauacaccacuacau

SEQ ID NO: 1897087 - RNA, 14 nt, Human
aauacaauaaguua

SEQ ID NO: 1897088 - RNA, 17 nt, Human
uaaacuaaagaaaaauu

SEQ ID NO: 1897089 - RNA, 17 nt, Human
uaaacgucuuaaauauu

SEQ ID NO: 1897090 - RNA, 13 nt, Human
uaaacgucuuaaa

SEQ ID NO: 1897091 - RNA, 15 nt, Human
uaaacggauuccaaa

SEQ ID NO: 1897092 - RNA, 16 nt, Human
uaaaccgccaaggcug

SEQ ID NO: 1897093 - RNA, 18 nt, Human
uaaaccgccaaggcuggg

SEQ ID NO: 1897094 - RNA, 19 nt, Human
uaaacccaguaguggugac

SEQ ID NO: 1897095 - RNA, 23 nt, Human
uaaacccauauuguaaaacaggu

SEQ ID NO: 1897096 - RNA, 15 nt, Human
uaaacucuguugcaa

SEQ ID NO: 1897097 - RNA, 20 nt, Human
uaaacucuucacaaaaucug

SEQ ID NO: 1897098 - RNA, 14 nt, Human
uaaacucauuuaua

SEQ ID NO: 1897099 - RNA, 15 nt, Human
uaaagacagaggcag

SEQ ID NO: 1897100 - RNA, 10 nt, Human
uaaagacaga

SEQ ID NO: 1897101 - RNA, 9 nt, Human
uaaagacag

SEQ ID NO: 1897102 - RNA, 16 nt, Human
uaaagacuuuuaugau

SEQ ID NO: 1897103 - RNA, 19 nt, Human
uaaagaacacccuauauuu

SEQ ID NO: 1897104 - RNA, 14 nt, Human
uaaagaguguggca

SEQ ID NO: 1897105 - RNA, 17 nt, Human
uaaagauaaagccagaa

SEQ ID NO: 1897106 - RNA, 13 nt, Human
uaaagauggaaaa

SEQ ID NO: 1897107 - RNA, 19 nt, Human
uaaaggcuaccuuuguauu

SEQ ID NO: 1897108 - RNA, 21 nt, Human
uaaaggcuaccuuuguauucu

SEQ ID NO: 1897109 - RNA, 19 nt, Human
uaaaauuuuuaaucuuuaa

SEQ ID NO: 1897110 - RNA, 19 nt, Human
uaaaccaaggcuagaacca

SEQ ID NO: 1897111 - RNA, 14 nt, Human
uaaacaaaguuacu

SEQ ID NO: 1897112 - RNA, 15 nt, Human
uaaacaaaguuacua

SEQ ID NO: 1897113 - RNA, 17 nt, Human
uaaacaaaguuacuagg

SEQ ID NO: 1897114 - RNA, 17 nt, Human
uaaaauuuuuaaucuuu

SEQ ID NO: 1897115 - RNA, 14 nt, Human
uaaaauguuaaaac

SEQ ID NO: 1897116 - RNA, 21 nt, Human
aaguuuucccuugaggaaaca

SEQ ID NO: 1897117 - RNA, 22 nt, Human
aaguuuucccuugaggaaacaa

SEQ ID NO: 1897118 - RNA, 21 nt, Human
aaguuucagagaccauugcaa

SEQ ID NO: 1897119 - RNA, 13 nt, Human
aaguuugcuuaga

SEQ ID NO: 1897120 - RNA, 16 nt, Human
aaguuugcuuagaaaa

SEQ ID NO: 1897121 - RNA, 15 nt, Human
aaguuugcuuagaaa

SEQ ID NO: 1897122 - RNA, 17 nt, Human
guuuuuuuuuaaagacu

SEQ ID NO: 1897123 - RNA, 23 nt, Human
aaguguuuaacuugucaaaaaac

SEQ ID NO: 1897124 - RNA, 17 nt, Human
aaguuacacauuuuuca

SEQ ID NO: 1897125 - RNA, 14 nt, Human
aaguuaaauuuuau

SEQ ID NO: 1897126 - RNA, 12 nt, Human
aaguuaaauaaa

SEQ ID NO: 1897127 - RNA, 14 nt, Human
aaguuaaauaaauc

SEQ ID NO: 1897128 - RNA, 18 nt, Human
aaguuacuagguaacuuc

SEQ ID NO: 1897129 - RNA, 19 nt, Human
aaguuacuagguaacuuca

SEQ ID NO: 1897130 - RNA, 20 nt, Human
aaguuacuagguaacuucau

SEQ ID NO: 1897131 - RNA, 21 nt, Human
aaguuacuagguaacuucaua

SEQ ID NO: 1897132 - RNA, 17 nt, Human
aaguucaugcuuuguuc

SEQ ID NO: 1897133 - RNA, 16 nt, Human
aaguucagccacccug

SEQ ID NO: 1897134 - RNA, 17 nt, Human
aaguucugcagauaaac

SEQ ID NO: 1897135 - RNA, 21 nt, Human
aaguucuauuggaaaaaccac

SEQ ID NO: 1897136 - RNA, 14 nt, Human
aaguuuaauugacu

SEQ ID NO: 1897137 - RNA, 18 nt, Human
guuugccuucuacuuuua

SEQ ID NO: 1897138 - RNA, 13 nt, Human
guuugcuaaguga

SEQ ID NO: 1897139 - RNA, 17 nt, Human
guuugccucugccucug

SEQ ID NO: 1897140 - RNA, 19 nt, Human
guuugcaucugaaaauuga

SEQ ID NO: 1897141 - RNA, 22 nt, Human
guuucugccgcagcccugcaga

SEQ ID NO: 1897142 - RNA, 18 nt, Human
guuucugccgcagcccug

SEQ ID NO: 1897143 - RNA, 16 nt, Human
guuuuaagaggcaggg

SEQ ID NO: 1897144 - RNA, 18 nt, Human
guuuuaaggaugcuugua

SEQ ID NO: 1897145 - RNA, 14 nt, Human
guuuuaagaggcag

SEQ ID NO: 1897146 - RNA, 16 nt, Human
guuuuacugcagcuuu

SEQ ID NO: 1897147 - RNA, 18 nt, Human
guuuuacugcagcuuugu

SEQ ID NO: 1897148 - RNA, 13 nt, Human
aagggcccagaga

SEQ ID NO: 1897149 - RNA, 15 nt, Human
aagggcccagagagg

SEQ ID NO: 1897150 - RNA, 15 nt, Human
aaggcugcuuagaau

SEQ ID NO: 1897151 - RNA, 19 nt, Human
aaggguaucaggugcugcc

SEQ ID NO: 1897152 - RNA, 16 nt, Human
aaggguaucuggugac

SEQ ID NO: 1897153 - RNA, 17 nt, Human
aaggggcaguggugguu

SEQ ID NO: 1897154 - RNA, 17 nt, Human
aaggguaucaggugcug

SEQ ID NO: 1897155 - RNA, 14 nt, Human
aaggggcaguggug

SEQ ID NO: 1897156 - RNA, 13 nt, Human
aaggggagcccac

SEQ ID NO: 1897157 - RNA, 16 nt, Human
aaggggagcccacugu

SEQ ID NO: 1897158 - RNA, 16 nt, Human
aaggguucccucaaga

SEQ ID NO: 1897159 - RNA, 15 nt, Human
guuuuuuaugcuaau

SEQ ID NO: 1897160 - RNA, 21 nt, Human
guuuuuuaaaauauuuaucug

SEQ ID NO: 1897161 - RNA, 15 nt, Human
guuuuuuuuuaaaga

SEQ ID NO: 1897162 - RNA, 23 nt, Human
guuuuuuucauugccaaaaacua

SEQ ID NO: 1897163 - RNA, 16 nt, Human
guuuuugucuuaaaaa

SEQ ID NO: 1897164 - RNA, 22 nt, Human
aagucuuauauauuguagauaa

SEQ ID NO: 1897165 - RNA, 18 nt, Human
aagucuuagauguauaua

SEQ ID NO: 1897166 - RNA, 19 nt, Human
aagucuuagauguauauau

SEQ ID NO: 1897167 - RNA, 17 nt, Human
aagucuuagauguauau

SEQ ID NO: 1897168 - RNA, 18 nt, Human
guuuuucuaggccugggg

SEQ ID NO: 1897169 - RNA, 18 nt, Human
aaguauucuuauuuaaug

SEQ ID NO: 1897170 - RNA, 19 nt, Human
aaguauucuuauuuaauga

SEQ ID NO: 1897171 - RNA, 21 nt, Human
aaguauucuguacucuuagau

SEQ ID NO: 1897172 - RNA, 24 nt, Human
aagucacacaguauuacuucugcu

SEQ ID NO: 1897173 - RNA, 21 nt, Human
aagucaagugaaaaaggagga

SEQ ID NO: 1897174 - RNA, 13 nt, Human
aagucacacagug

SEQ ID NO: 1897175 - RNA, 20 nt, Human
aagucacauuccugaacagg

SEQ ID NO: 1897176 - RNA, 23 nt, Human
aaguacuucuccacccugcucuc

SEQ ID NO: 1897177 - RNA, 22 nt, Human
aaguacuucuccacccugcucu

SEQ ID NO: 1897178 - RNA, 21 nt, Human
aaguacuucuccacccugcuc

SEQ ID NO: 1897179 - RNA, 15 nt, Human
aaguacuggagaaaa

SEQ ID NO: 1897180 - RNA, 16 nt, Human
aaguacuauguaucaa

SEQ ID NO: 1897181 - RNA, 15 nt, Human
aaguacuauguauca

SEQ ID NO: 1897182 - RNA, 23 nt, Human
guugcugaugaacucuuaaucaa

SEQ ID NO: 1897183 - RNA, 23 nt, Human
guuggcugggggccucagugcca

SEQ ID NO: 1897184 - RNA, 17 nt, Human
guugcccaggcuggcgu

SEQ ID NO: 1897185 - RNA, 16 nt, Human
guugcccaggcuggcg

SEQ ID NO: 1897186 - RNA, 15 nt, Human
guugcccaggcuggc

SEQ ID NO: 1897187 - RNA, 17 nt, Human
guugggcuggugucacc

SEQ ID NO: 1897188 - RNA, 21 nt, Human
guugggagaaugucaguaugu

SEQ ID NO: 1897189 - RNA, 14 nt, Human
guugggagaauguc

SEQ ID NO: 1897190 - RNA, 16 nt, Human
guuggggucuggcagc

SEQ ID NO: 1897191 - RNA, 14 nt, Human
guugcccaggcugg

SEQ ID NO: 1897192 - RNA, 15 nt, Human
aaggcuaccuuugua

SEQ ID NO: 1897193 - RNA, 13 nt, Human
aaggcuaccuuug

SEQ ID NO: 1897194 - RNA, 18 nt, Human
aaggccucgcaggaagac

SEQ ID NO: 1897195 - RNA, 17 nt, Human
aaggccucgcaggaaga

SEQ ID NO: 1897196 - RNA, 19 nt, Human
aaggccccgcccaggcuua

SEQ ID NO: 1897197 - RNA, 15 nt, Human
aaggccucgcaggaa

SEQ ID NO: 1897198 - RNA, 14 nt, Human
aaggccccgcccag

SEQ ID NO: 1897199 - RNA, 16 nt, Human
aaggccccgcccaggc

SEQ ID NO: 1897200 - RNA, 22 nt, Human
aaggaugcacagaguuguuaca

SEQ ID NO: 1897201 - RNA, 18 nt, Human
aaggaucuuuguggccaa

SEQ ID NO: 1897202 - RNA, 20 nt, Human
aaggaucuuuguggccaagg

SEQ ID NO: 1897203 - RNA, 24 nt, Human
aaggaugcacagaguuguuacauu

SEQ ID NO: 1897204 - RNA, 14 nt, Human
aaggaugcccaaag

SEQ ID NO: 1897205 - RNA, 19 nt, Human
aaggaugcccaaagaugca

SEQ ID NO: 1897206 - RNA, 19 nt, Human
aaggagacaggcagagcug

SEQ ID NO: 1897207 - RNA, 14 nt, Human
aaggagacaggcag

SEQ ID NO: 1897208 - RNA, 16 nt, Human
aaggagacaggcagag

SEQ ID NO: 1897209 - RNA, 22 nt, Human
aaggagcaagucagaauagaaa

SEQ ID NO: 1897210 - RNA, 18 nt, Human
aaggagauuuacaacugg

SEQ ID NO: 1897211 - RNA, 16 nt, Human
aaggaaacccagcucu

SEQ ID NO: 1897212 - RNA, 15 nt, Human
aaggaaacccagcuc

SEQ ID NO: 1897213 - RNA, 19 nt, Human
guugaucuggaacccagac

SEQ ID NO: 1897214 - RNA, 15 nt, Human
guugaucuggaaccc

SEQ ID NO: 1897215 - RNA, 14 nt, Human
guugaucagaucug

SEQ ID NO: 1897216 - RNA, 16 nt, Human
guugaucuggaaccca

SEQ ID NO: 1897217 - RNA, 17 nt, Human
guugaucuggaacccag

SEQ ID NO: 1897218 - RNA, 13 nt, Human
aaggauaaugaau

SEQ ID NO: 1897219 - RNA, 23 nt, Human
aaggauaaaguugguaaaccuuu

SEQ ID NO: 1897220 - RNA, 21 nt, Human
aaggauaaaguugguaaaccu

SEQ ID NO: 1897221 - RNA, 20 nt, Human
aaggaggaagagaaaaaaua

SEQ ID NO: 1897222 - RNA, 11 nt, Human
aaggauaaagu

SEQ ID NO: 1897223 - RNA, 20 nt, Human
aaggauagaugcuggcccag

SEQ ID NO: 1897224 - RNA, 11 nt, Human
aaggauccuga

SEQ ID NO: 1897225 - RNA, 12 nt, Human
aaggauccugag

SEQ ID NO: 1897226 - RNA, 20 nt, Human
aaggauccugagccagauuu

SEQ ID NO: 1897227 - RNA, 22 nt, Human
aaggauccugagccagauuuca

SEQ ID NO: 1897228 - RNA, 16 nt, Human
aaggaucuuuguggcc

SEQ ID NO: 1897229 - RNA, 19 nt, Human
aaggauagaugcuggccca

SEQ ID NO: 1897230 - RNA, 19 nt, Human
aaggaaaaaauaacaauga

SEQ ID NO: 1897231 - RNA, 16 nt, Human
aaggaaaaaauaacaa

SEQ ID NO: 1897232 - RNA, 22 nt, Human
guuccccuccuccacucucccc

SEQ ID NO: 1897233 - RNA, 16 nt, Human
aagcuuuuaugugaaa

SEQ ID NO: 1897234 - RNA, 13 nt, Human
aagcuuuuagaaa

SEQ ID NO: 1897235 - RNA, 14 nt, Human
aagcuuuuagaaau

SEQ ID NO: 1897236 - RNA, 18 nt, Human
aagcuuuuagaaauacug

SEQ ID NO: 1897237 - RNA, 13 nt, Human
aagcucugcuccu

SEQ ID NO: 1897238 - RNA, 18 nt, Human
aagcuguuacugucuuca

SEQ ID NO: 1897239 - RNA, 14 nt, Human
aagcuuugacacug

SEQ ID NO: 1897240 - RNA, 15 nt, Human
aagcuguuuccauag

SEQ ID NO: 1897241 - RNA, 23 nt, Human
aagcuguuuccauagggugacac

SEQ ID NO: 1897242 - RNA, 16 nt, Human
guguuuaugugugugu

SEQ ID NO: 1897243 - RNA, 12 nt, Human
guguuuaugugu

SEQ ID NO: 1897244 - RNA, 11 nt, Human
aagcucccagg

SEQ ID NO: 1897245 - RNA, 13 nt, Human
guguuuauuguca

SEQ ID NO: 1897246 - RNA, 23 nt, Human
aagcucccaggcauuccccagga

SEQ ID NO: 1897247 - RNA, 12 nt, Human
aagcucccaggc

SEQ ID NO: 1897248 - RNA, 22 nt, Human
aagcucccaggcauuccccagg

SEQ ID NO: 1897249 - RNA, 16 nt, Human
aagcuccucuccccag

SEQ ID NO: 1897250 - RNA, 21 nt, Human
aagcuccuccucccugcaucu

SEQ ID NO: 1897251 - RNA, 13 nt, Human
aagcuccuccucc

SEQ ID NO: 1897252 - RNA, 15 nt, Human
aagcuccuccucccu

SEQ ID NO: 1897253 - RNA, 16 nt, Human
aagcuccuccucccug

SEQ ID NO: 1897254 - RNA, 17 nt, Human
aagcuccuccucccugc

SEQ ID NO: 1897255 - RNA, 18 nt, Human
aagcuccuccucccugca

SEQ ID NO: 1897256 - RNA, 19 nt, Human
aagcuccuccucccugcau

SEQ ID NO: 1897257 - RNA, 18 nt, Human
guugacaguucauaugua

SEQ ID NO: 1897258 - RNA, 23 nt, Human
guugauagcacagacccugcccu

SEQ ID NO: 1897259 - RNA, 13 nt, Human
guugagcuguuuu

SEQ ID NO: 1897260 - RNA, 24 nt, Human
guugagcucucggaacugcaugcu

SEQ ID NO: 1897261 - RNA, 22 nt, Human
guugauagcacagacccugccc

SEQ ID NO: 1897262 - RNA, 13 nt, Human
guugaauuuuaca

SEQ ID NO: 1897263 - RNA, 15 nt, Human
guugacacaggucuu

SEQ ID NO: 1897264 - RNA, 15 nt, Human
guucugugucugugu

SEQ ID NO: 1897265 - RNA, 16 nt, Human
guucucaucuuucuug

SEQ ID NO: 1897266 - RNA, 11 nt, Human
guucucaucuu

SEQ ID NO: 1897267 - RNA, 16 nt, Human
guucucugaggacacu

SEQ ID NO: 1897268 - RNA, 11 nt, Human
guucucugccc

SEQ ID NO: 1897269 - RNA, 16 nt, Human
guucucccugggaggc

SEQ ID NO: 1897270 - RNA, 13 nt, Human
guucucugcccuc

SEQ ID NO: 1897271 - RNA, 12 nt, Human
guucucugcccu

SEQ ID NO: 1897272 - RNA, 11 nt, Human
guucugugcac

SEQ ID NO: 1897273 - RNA, 18 nt, Human
uaccccuuucuggcucuc

SEQ ID NO: 1897274 - RNA, 14 nt, Human
uacccgcagaguuc

SEQ ID NO: 1897275 - RNA, 20 nt, Human
uacccgggaagggggcuggg

SEQ ID NO: 1897276 - RNA, 15 nt, Human
uacccucauguucuu

SEQ ID NO: 1897277 - RNA, 16 nt, Human
uacccucauguucuua

SEQ ID NO: 1897278 - RNA, 20 nt, Human
uacccuggcacuauaaugua

SEQ ID NO: 1897279 - RNA, 22 nt, Human
uacccuggcacuauaauguaag

SEQ ID NO: 1897280 - RNA, 22 nt, Human
uacccucuucauggauggggga

SEQ ID NO: 1897281 - RNA, 17 nt, Human
uaccauccccuguagag

SEQ ID NO: 1897282 - RNA, 20 nt, Human
uaccauaguaccauuuauac

SEQ ID NO: 1897283 - RNA, 17 nt, Human
uaccacuuuuguucuug

SEQ ID NO: 1897284 - RNA, 23 nt, Human
uacauuguuugucugucuucaua

SEQ ID NO: 1897285 - RNA, 16 nt, Human
aauuaaggcauaagaa

SEQ ID NO: 1897286 - RNA, 13 nt, Human
aauuaaguacuau

SEQ ID NO: 1897287 - RNA, 17 nt, Human
uacauguacugauuacu

SEQ ID NO: 1897288 - RNA, 23 nt, Human
uacauggcuggagcuagaauuug

SEQ ID NO: 1897289 - RNA, 15 nt, Human
uacauuguucaauua

SEQ ID NO: 1897290 - RNA, 13 nt, Human
uacauuguugagc

SEQ ID NO: 1897291 - RNA, 23 nt, Human
uacauuguugagcuauugcuguu

SEQ ID NO: 1897292 - RNA, 19 nt, Human
uacauuguuugucugucuu

SEQ ID NO: 1897293 - RNA, 14 nt, Human
uacauuguucaauu

SEQ ID NO: 1897294 - RNA, 19 nt, Human
aauuaacaugaauauuuag

SEQ ID NO: 1897295 - RNA, 18 nt, Human
aauuaaauuuugugucuc

SEQ ID NO: 1897296 - RNA, 17 nt, Human
aauuaaauuuugugucu

SEQ ID NO: 1897297 - RNA, 12 nt, Human
aauuaacacugc

SEQ ID NO: 1897298 - RNA, 14 nt, Human
aauuaacagaaaaa

SEQ ID NO: 1897299 - RNA, 20 nt, Human
aauuaagaaaggauaaaguu

SEQ ID NO: 1897300 - RNA, 22 nt, Human
aauuaacuuuuauaaacuuuac

SEQ ID NO: 1897301 - RNA, 20 nt, Human
aauuaacuuuuauaaacuuu

SEQ ID NO: 1897302 - RNA, 18 nt, Human
aauuaacuuuuauaaacu

SEQ ID NO: 1897303 - RNA, 19 nt, Human
aaugugaacagcggcugga

SEQ ID NO: 1897304 - RNA, 15 nt, Human
aaugugaacuuuauu

SEQ ID NO: 1897305 - RNA, 20 nt, Human
aaugugaacuuuauuaaaua

SEQ ID NO: 1897306 - RNA, 18 nt, Human
aauguugagaaucccaaa

SEQ ID NO: 1897307 - RNA, 15 nt, Human
aauguacauuaauua

SEQ ID NO: 1897308 - RNA, 23 nt, Human
aauguacagcaaggagauuuaca

SEQ ID NO: 1897309 - RNA, 21 nt, Human
aauguacagcaaggagauuua

SEQ ID NO: 1897310 - RNA, 18 nt, Human
uacaccuuucuccuuugu

SEQ ID NO: 1897311 - RNA, 19 nt, Human
uacaccuuucuccuuugua

SEQ ID NO: 1897312 - RNA, 20 nt, Human
uacaccuuucuccuuuguac

SEQ ID NO: 1897313 - RNA, 22 nt, Human
uacagcaaggagauuuacaacu

SEQ ID NO: 1897314 - RNA, 16 nt, Human
aaugguuuaaaugguc

SEQ ID NO: 1897315 - RNA, 22 nt, Human
aaugguuuaacuucugccugug

SEQ ID NO: 1897316 - RNA, 14 nt, Human
aaugguuugaauau

SEQ ID NO: 1897317 - RNA, 17 nt, Human
aaugguuuaacuucugc

SEQ ID NO: 1897318 - RNA, 22 nt, Human
uacaaucucccuucacaaguuu

SEQ ID NO: 1897319 - RNA, 13 nt, Human
aauguaagacaaa

SEQ ID NO: 1897320 - RNA, 13 nt, Human
aauguaagcucua

SEQ ID NO: 1897321 - RNA, 15 nt, Human
aauguaagcucuacu

SEQ ID NO: 1897322 - RNA, 17 nt, Human
aaugguuuucuugugug

SEQ ID NO: 1897323 - RNA, 18 nt, Human
aaugguuuucuugugugu

SEQ ID NO: 1897324 - RNA, 22 nt, Human
aaugguuuucuuguguguuuau

SEQ ID NO: 1897325 - RNA, 23 nt, Human
aaugguuugaauauaaacacuau

SEQ ID NO: 1897326 - RNA, 17 nt, Human
aaugguuugaauauaaa

SEQ ID NO: 1897327 - RNA, 12 nt, Human
uacagucuugua

SEQ ID NO: 1897328 - RNA, 13 nt, Human
uacagucuuguau

SEQ ID NO: 1897329 - RNA, 15 nt, Human
uacauaaugcgugca

SEQ ID NO: 1897330 - RNA, 20 nt, Human
uacaguggggaaugaagaua

SEQ ID NO: 1897331 - RNA, 18 nt, Human
uacaguaucucagggccu

SEQ ID NO: 1897332 - RNA, 12 nt, Human
uacaguccuccc

SEQ ID NO: 1897333 - RNA, 15 nt, Human
uacaguccucccauc

SEQ ID NO: 1897334 - RNA, 17 nt, Human
uacaguccucccaucuc

SEQ ID NO: 1897335 - RNA, 18 nt, Human
uacaguccucccaucuca

SEQ ID NO: 1897336 - RNA, 13 nt, Human
uacagucuauuug

SEQ ID NO: 1897337 - RNA, 13 nt, Human
aaugucacaggca

SEQ ID NO: 1897338 - RNA, 14 nt, Human
aaugucacaggcag

SEQ ID NO: 1897339 - RNA, 22 nt, Human
aaugugaaacuggauuaaacuu

SEQ ID NO: 1897340 - RNA, 13 nt, Human
aauguaucuuauu

SEQ ID NO: 1897341 - RNA, 16 nt, Human
aauguaucuuauucac

SEQ ID NO: 1897342 - RNA, 17 nt, Human
aauguaugcuucauaca

SEQ ID NO: 1897343 - RNA, 16 nt, Human
aauguaugcuucauac

SEQ ID NO: 1897344 - RNA, 15 nt, Human
aauguaugcuucaua

SEQ ID NO: 1897345 - RNA, 17 nt, Human
aauguaucuuauucaca

SEQ ID NO: 1897346 - RNA, 18 nt, Human
aauguaucuuauucacau

SEQ ID NO: 1897347 - RNA, 12 nt, Human
aauguagagggg

SEQ ID NO: 1897348 - RNA, 22 nt, Human
aauguagugaagggauguauca

SEQ ID NO: 1897349 - RNA, 15 nt, Human
uacauacaccagcau

SEQ ID NO: 1897350 - RNA, 16 nt, Human
uacauacaccagcauu

SEQ ID NO: 1897351 - RNA, 20 nt, Human
uacauacaccagcauuccuu

SEQ ID NO: 1897352 - RNA, 16 nt, Human
uaauuaucuaaaguau

SEQ ID NO: 1897353 - RNA, 23 nt, Human
uaauuaguuccucauuagcauuu

SEQ ID NO: 1897354 - RNA, 19 nt, Human
aaugcacuuuguucuggcu

SEQ ID NO: 1897355 - RNA, 20 nt, Human
aaugcacuuuguucuggcuc

SEQ ID NO: 1897356 - RNA, 19 nt, Human
aaugcacaaacagaggccg

SEQ ID NO: 1897357 - RNA, 20 nt, Human
aaugcacaaacagaggccgc

SEQ ID NO: 1897358 - RNA, 13 nt, Human
aaugcacuuuguu

SEQ ID NO: 1897359 - RNA, 16 nt, Human
aaugcacuuuguucug

SEQ ID NO: 1897360 - RNA, 18 nt, Human
aaugcacaaacagaggcc

SEQ ID NO: 1897361 - RNA, 18 nt, Human
aaugcaacaacauguaua

SEQ ID NO: 1897362 - RNA, 15 nt, Human
aaugcaacaacaugu

SEQ ID NO: 1897363 - RNA, 22 nt, Human
aaugcaaaccaucauugaaauc

SEQ ID NO: 1897364 - RNA, 23 nt, Human
aaugcaaaccaucauugaaaucu

SEQ ID NO: 1897365 - RNA, 20 nt, Human
aaugaaugucagugugacug

SEQ ID NO: 1897366 - RNA, 21 nt, Human
aaugaaugucagugugacuga

SEQ ID NO: 1897367 - RNA, 19 nt, Human
aaugaccacaccugccucu

SEQ ID NO: 1897368 - RNA, 13 nt, Human
aaugaccuuucaa

SEQ ID NO: 1897369 - RNA, 14 nt, Human
aaugaccuuucaau

SEQ ID NO: 1897370 - RNA, 15 nt, Human
aaugaccuuucaaua

SEQ ID NO: 1897371 - RNA, 16 nt, Human
aaugcaaaccaucauu

SEQ ID NO: 1897372 - RNA, 21 nt, Human
uacaagcgugagccacugcac

SEQ ID NO: 1897373 - RNA, 19 nt, Human
uacaagcccccccuuccac

SEQ ID NO: 1897374 - RNA, 20 nt, Human
uacaagcgugagccacugca

SEQ ID NO: 1897375 - RNA, 19 nt, Human
uacaagcgugagccacugc

SEQ ID NO: 1897376 - RNA, 18 nt, Human
uacaagcgugagccacug

SEQ ID NO: 1897377 - RNA, 16 nt, Human
uacaagcgugagccac

SEQ ID NO: 1897378 - RNA, 16 nt, Human
uacaaaaacauggccu

SEQ ID NO: 1897379 - RNA, 16 nt, Human
uaauuuuuuucaauau

SEQ ID NO: 1897380 - RNA, 22 nt, Human
uaauuuuuuucaauauuuauua

SEQ ID NO: 1897381 - RNA, 18 nt, Human
uacaagccagcuggagaa

SEQ ID NO: 1897382 - RNA, 14 nt, Human
uacaagcccccccu

SEQ ID NO: 1897383 - RNA, 15 nt, Human
uacaagcccccccuu

SEQ ID NO: 1897384 - RNA, 13 nt, Human
uaauucauguugc

SEQ ID NO: 1897385 - RNA, 19 nt, Human
uaauucaucccaacugucu

SEQ ID NO: 1897386 - RNA, 17 nt, Human
uaauuuaccugaagucu

SEQ ID NO: 1897387 - RNA, 18 nt, Human
uaauuuaccugaagucuu

SEQ ID NO: 1897388 - RNA, 13 nt, Human
uaauuuuuuacua

SEQ ID NO: 1897389 - RNA, 20 nt, Human
uaauuugcauuaaauucaca

SEQ ID NO: 1897390 - RNA, 22 nt, Human
uaauuuuuguguuuuuaauaaa

SEQ ID NO: 1897391 - RNA, 12 nt, Human
uaauuugcauua

SEQ ID NO: 1897392 - RNA, 16 nt, Human
uaauuugcauuaaauu

SEQ ID NO: 1897393 - RNA, 17 nt, Human
uaauuugcauuaaauuc

SEQ ID NO: 1897394 - RNA, 22 nt, Human
uaauuugauaguauugugcaua

SEQ ID NO: 1897395 - RNA, 17 nt, Human
aaucuuuucacaaauaa

SEQ ID NO: 1897396 - RNA, 16 nt, Human
aaucuuuucacaaaua

SEQ ID NO: 1897397 - RNA, 15 nt, Human
aaucuuuucacaaau

SEQ ID NO: 1897398 - RNA, 14 nt, Human
aaucuuuucacaaa

SEQ ID NO: 1897399 - RNA, 18 nt, Human
aaucuuuucacaaauaaa

SEQ ID NO: 1897400 - RNA, 15 nt, Human
aaugaaugucagugu

SEQ ID NO: 1897401 - RNA, 14 nt, Human
aaugaaugucagug

SEQ ID NO: 1897402 - RNA, 14 nt, Human
aaugaaugaaacau

SEQ ID NO: 1897403 - RNA, 15 nt, Human
aaugaaugaaugaau

SEQ ID NO: 1897404 - RNA, 23 nt, Human
aaucuucugaacuuggcgcugcc

SEQ ID NO: 1897405 - RNA, 13 nt, Human
uaaugucaaacuu

SEQ ID NO: 1897406 - RNA, 18 nt, Human
uaaugucaaacuugaguc

SEQ ID NO: 1897407 - RNA, 17 nt, Human
uaaugugccuaguucuu

SEQ ID NO: 1897408 - RNA, 17 nt, Human
aaucuugaaauuaagaa

SEQ ID NO: 1897409 - RNA, 14 nt, Human
aaucuugaaauuaa

SEQ ID NO: 1897410 - RNA, 23 nt, Human
aaucuuuuacaacugccucgaaa

SEQ ID NO: 1897411 - RNA, 13 nt, Human
aaucuugcucugc

SEQ ID NO: 1897412 - RNA, 15 nt, Human
uaaugucacaggcag

SEQ ID NO: 1897413 - RNA, 17 nt, Human
uaaugucacaggcaggu

SEQ ID NO: 1897414 - RNA, 16 nt, Human
uaaugucacaggcagg

SEQ ID NO: 1897415 - RNA, 23 nt, Human
uaaugugaaacuggauuaaacuu

SEQ ID NO: 1897416 - RNA, 22 nt, Human
uaaugugaaacuggauuaaacu

SEQ ID NO: 1897417 - RNA, 20 nt, Human
uaaugugaaacuggauuaaa

SEQ ID NO: 1897418 - RNA, 12 nt, Human
uaaugugaaacu

SEQ ID NO: 1897419 - RNA, 15 nt, Human
uaauguaagacaaau

SEQ ID NO: 1897420 - RNA, 16 nt, Human
uaauguaagcucuacu

SEQ ID NO: 1897421 - RNA, 17 nt, Human
uaauguaagcucuacug

SEQ ID NO: 1897422 - RNA, 19 nt, Human
uaaucagggaggucauuuu

SEQ ID NO: 1897423 - RNA, 21 nt, Human
uaauauugauaugcuuauaca

SEQ ID NO: 1897424 - RNA, 17 nt, Human
uaaucuuuaauuuuaca

SEQ ID NO: 1897425 - RNA, 13 nt, Human
uaauccagcugau

SEQ ID NO: 1897426 - RNA, 14 nt, Human
uaaucuugcucugc

SEQ ID NO: 1897427 - RNA, 15 nt, Human
uaaucuugcucugcu

SEQ ID NO: 1897428 - RNA, 20 nt, Human
uaaucuugcucugcuugaca

SEQ ID NO: 1897429 - RNA, 22 nt, Human
uaauccaagcaaaugugaauca

SEQ ID NO: 1897430 - RNA, 15 nt, Human
uaauaccucugugug

SEQ ID NO: 1897431 - RNA, 14 nt, Human
uaauaccucugugu

SEQ ID NO: 1897432 - RNA, 13 nt, Human
uaauaccucugug

SEQ ID NO: 1897433 - RNA, 18 nt, Human
uaauaccucugugugcuc

SEQ ID NO: 1897434 - RNA, 18 nt, Human
uaauacuugcuuuggaaa

SEQ ID NO: 1897435 - RNA, 20 nt, Human
aauacaguaucucagggccu

SEQ ID NO: 1897436 - RNA, 23 nt, Human
uaauacaccacuacauucuguua

SEQ ID NO: 1897437 - RNA, 21 nt, Human
uaauacaccacuacauucugu

SEQ ID NO: 1897438 - RNA, 22 nt, Human
uaauacaccacuacauucuguu

SEQ ID NO: 1897439 - RNA, 18 nt, Human
uagcaugucgucaaagcu

SEQ ID NO: 1897440 - RNA, 21 nt, Human
uagcaugucgucaaagcugaa

SEQ ID NO: 1897441 - RNA, 22 nt, Human
uagauuuuagacccuauugcug

SEQ ID NO: 1897442 - RNA, 16 nt, Human
uagcacagacccugcc

SEQ ID NO: 1897443 - RNA, 17 nt, Human
uagcacagacccugccc

SEQ ID NO: 1897444 - RNA, 18 nt, Human
uagcacagacccugcccu

SEQ ID NO: 1897445 - RNA, 19 nt, Human
uagcacagacccugcccug

SEQ ID NO: 1897446 - RNA, 12 nt, Human
uagagcuuucuu

SEQ ID NO: 1897447 - RNA, 23 nt, Human
uagagcuuucuuucacaaaaaag

SEQ ID NO: 1897448 - RNA, 16 nt, Human
acaaaaagcauaaaaa

SEQ ID NO: 1897449 - RNA, 20 nt, Human
acaagaagccacagaccuag

SEQ ID NO: 1897450 - RNA, 22 nt, Human
acaagaaaugaaagcagggacu

SEQ ID NO: 1897451 - RNA, 12 nt, Human
acaacacucaca

SEQ ID NO: 1897452 - RNA, 14 nt, Human
acaacacaaagaga

SEQ ID NO: 1897453 - RNA, 18 nt, Human
acaaauucugucucugga

SEQ ID NO: 1897454 - RNA, 15 nt, Human
acaacaacaaaauga

SEQ ID NO: 1897455 - RNA, 19 nt, Human
uagcauuuguguugaagag

SEQ ID NO: 1897456 - RNA, 22 nt, Human
acaaauuagaaaauguuauuua

SEQ ID NO: 1897457 - RNA, 15 nt, Human
acaagccagggugug

SEQ ID NO: 1897458 - RNA, 11 nt, Human
acaagccaggg

SEQ ID NO: 1897459 - RNA, 15 nt, Human
acaagccagcuggag

SEQ ID NO: 1897460 - RNA, 13 nt, Human
acaagccagcugg

SEQ ID NO: 1897461 - RNA, 12 nt, Human
acaagccacccc

SEQ ID NO: 1897462 - RNA, 14 nt, Human
acaagcuaaaauua

SEQ ID NO: 1897463 - RNA, 13 nt, Human
acaagcugcaccc

SEQ ID NO: 1897464 - RNA, 21 nt, Human
acaagcgugagccacugcacc

SEQ ID NO: 1897465 - RNA, 20 nt, Human
acaagcgugagccacugcac

SEQ ID NO: 1897466 - RNA, 16 nt, Human
acaagcaaacccagac

SEQ ID NO: 1897467 - RNA, 19 nt, Human
acaagcaaacccagacggc

SEQ ID NO: 1897468 - RNA, 18 nt, Human
acaagcacuaaacaaaga

SEQ ID NO: 1897469 - RNA, 17 nt, Human
acaagagcccaggccuc

SEQ ID NO: 1897470 - RNA, 18 nt, Human
acaagagcccaggccucc

SEQ ID NO: 1897471 - RNA, 15 nt, Human
acaagagcacuacau

SEQ ID NO: 1897472 - RNA, 21 nt, Human
acaagagcacuacauucauuu

SEQ ID NO: 1897473 - RNA, 17 nt, Human
aauuuuuuugagacaga

SEQ ID NO: 1897474 - RNA, 13 nt, Human
acaaaaacauggc

SEQ ID NO: 1897475 - RNA, 23 nt, Human
acaaaaaaaccucuuaauauucu

SEQ ID NO: 1897476 - RNA, 19 nt, Human
aauuuuuuucaauauuuau

SEQ ID NO: 1897477 - RNA, 15 nt, Human
aauuuuuuucaauau

SEQ ID NO: 1897478 - RNA, 12 nt, Human
uagacagucccu

SEQ ID NO: 1897479 - RNA, 14 nt, Human
uagacagucccugc

SEQ ID NO: 1897480 - RNA, 17 nt, Human
aauuuuuauuaaauuau

SEQ ID NO: 1897481 - RNA, 18 nt, Human
aauuuuuauuaaauuaug

SEQ ID NO: 1897482 - RNA, 15 nt, Human
uagaagucacacagu

SEQ ID NO: 1897483 - RNA, 18 nt, Human
uagaagauggcacuuaua

SEQ ID NO: 1897484 - RNA, 22 nt, Human
uagaacugaauuuugucuuuau

SEQ ID NO: 1897485 - RNA, 19 nt, Human
uagaacuuuaagcaacaag

SEQ ID NO: 1897486 - RNA, 17 nt, Human
uagaacugaauuuuguc

SEQ ID NO: 1897487 - RNA, 13 nt, Human
uagaacugaauuu

SEQ ID NO: 1897488 - RNA, 15 nt, Human
uagaacucccuuuca

SEQ ID NO: 1897489 - RNA, 19 nt, Human
uagaacucaguuuuaacua

SEQ ID NO: 1897490 - RNA, 22 nt, Human
uagaacucaguuuuaacuagaa

SEQ ID NO: 1897491 - RNA, 16 nt, Human
uagacaauuuauuaug

SEQ ID NO: 1897492 - RNA, 22 nt, Human
uagacaaguccagccuggcaag

SEQ ID NO: 1897493 - RNA, 23 nt, Human
uagaauuuauucaauuccucugg

SEQ ID NO: 1897494 - RNA, 13 nt, Human
uagaauugcauug

SEQ ID NO: 1897495 - RNA, 14 nt, Human
uagaauugcauuga

SEQ ID NO: 1897496 - RNA, 15 nt, Human
uagaauugcauugac

SEQ ID NO: 1897497 - RNA, 15 nt, Human
uagaauuuauucaau

SEQ ID NO: 1897498 - RNA, 20 nt, Human
uagaauuuauucaauuccuc

SEQ ID NO: 1897499 - RNA, 22 nt, Human
uagaauuuauucaauuccucug

SEQ ID NO: 1897500 - RNA, 20 nt, Human
uagaagucuuagauguauau

SEQ ID NO: 1897501 - RNA, 18 nt, Human
uagaagucuuagauguau

SEQ ID NO: 1897502 - RNA, 19 nt, Human
uagaagucuuagauguaua

SEQ ID NO: 1897503 - RNA, 16 nt, Human
uagaagucacacagua

SEQ ID NO: 1897504 - RNA, 23 nt, Human
uagaagucacauuccugaacagg

SEQ ID NO: 1897505 - RNA, 16 nt, Human
uagaagucuuagaugu

SEQ ID NO: 1897506 - RNA, 17 nt, Human
uagaagucuuagaugua

SEQ ID NO: 1897507 - RNA, 22 nt, Human
uacucaauguuacuaucugcuu

SEQ ID NO: 1897508 - RNA, 20 nt, Human
uacucuuauaucuauauuuu

SEQ ID NO: 1897509 - RNA, 18 nt, Human
uacucuuaggaagagaaa

SEQ ID NO: 1897510 - RNA, 22 nt, Human
uacucuuauaucuauauuuuac

SEQ ID NO: 1897511 - RNA, 21 nt, Human
uacucuuaggaagagaaacca

SEQ ID NO: 1897512 - RNA, 14 nt, Human
uacgucugacaggc

SEQ ID NO: 1897513 - RNA, 13 nt, Human
uacguaugagacg

SEQ ID NO: 1897514 - RNA, 14 nt, Human
uacguugugcauuu

SEQ ID NO: 1897515 - RNA, 13 nt, Human
uacguugugcauu

SEQ ID NO: 1897516 - RNA, 19 nt, Human
uacuagguaacuucauauu

SEQ ID NO: 1897517 - RNA, 15 nt, Human
uacuagguaacuuca

SEQ ID NO: 1897518 - RNA, 16 nt, Human
uacuagguaacuucau

SEQ ID NO: 1897519 - RNA, 16 nt, Human
uacuauaauuuaccug

SEQ ID NO: 1897520 - RNA, 16 nt, Human
uacuauguaucaauga

SEQ ID NO: 1897521 - RNA, 19 nt, Human
uacucaaguagcauuuacu

SEQ ID NO: 1897522 - RNA, 21 nt, Human
uacucaaguagcauuuacugu

SEQ ID NO: 1897523 - RNA, 15 nt, Human
uacucaagcccgcgg

SEQ ID NO: 1897524 - RNA, 22 nt, Human
uacuauucaguggcgagaaaua

SEQ ID NO: 1897525 - RNA, 21 nt, Human
aauucuugccaaauauaaaua

SEQ ID NO: 1897526 - RNA, 20 nt, Human
aauucuugcaaaguaucccu

SEQ ID NO: 1897527 - RNA, 14 nt, Human
aauucuugcaaagu

SEQ ID NO: 1897528 - RNA, 22 nt, Human
aauucuucuccacuuucuagcc

SEQ ID NO: 1897529 - RNA, 17 nt, Human
aauucuuacaaacaugu

SEQ ID NO: 1897530 - RNA, 15 nt, Human
aauucuuauucuuuc

SEQ ID NO: 1897531 - RNA, 19 nt, Human
aauucuuauuuuuuaaaaa

SEQ ID NO: 1897532 - RNA, 23 nt, Human
aauucuuauuuuuuaaaaagcua

SEQ ID NO: 1897533 - RNA, 21 nt, Human
uacccugcgcccaguccuucc

SEQ ID NO: 1897534 - RNA, 23 nt, Human
uacccugcgcccaguccuuccac

SEQ ID NO: 1897535 - RNA, 15 nt, Human
uacguacacauuuua

SEQ ID NO: 1897536 - RNA, 19 nt, Human
aauugacccacaagaaaug

SEQ ID NO: 1897537 - RNA, 16 nt, Human
aauugacccacaagaa

SEQ ID NO: 1897538 - RNA, 13 nt, Human
aauugacccacaa

SEQ ID NO: 1897539 - RNA, 17 nt, Human
aauucuugcauauuuug

SEQ ID NO: 1897540 - RNA, 13 nt, Human
aauucuugcauau

SEQ ID NO: 1897541 - RNA, 14 nt, Human
aauucuuucauuuu

SEQ ID NO: 1897542 - RNA, 22 nt, Human
aauucuuugaccuguugggagu

SEQ ID NO: 1897543 - RNA, 18 nt, Human
aauucuuugaccuguugg

SEQ ID NO: 1897544 - RNA, 22 nt, Human
aauuguuuggggaugagaaagg

SEQ ID NO: 1897545 - RNA, 12 nt, Human
aauuguuucaca

SEQ ID NO: 1897546 - RNA, 21 nt, Human
aauugugugugcucugcuuca

SEQ ID NO: 1897547 - RNA, 23 nt, Human
aauugugugugaugugaagccaa

SEQ ID NO: 1897548 - RNA, 13 nt, Human
aauuuaaaagucu

SEQ ID NO: 1897549 - RNA, 20 nt, Human
aauuguuuguaagugaagug

SEQ ID NO: 1897550 - RNA, 16 nt, Human
aauuguuugucuuuaa

SEQ ID NO: 1897551 - RNA, 12 nt, Human
aauuuaaagcaa

SEQ ID NO: 1897552 - RNA, 20 nt, Human
aauuuaaagaaguaugggaa

SEQ ID NO: 1897553 - RNA, 15 nt, Human
aauuuaaagccacaa

SEQ ID NO: 1897554 - RNA, 19 nt, Human
aauuuacauacucugcuua

SEQ ID NO: 1897555 - RNA, 16 nt, Human
aauuuaaauagcuuuu

SEQ ID NO: 1897556 - RNA, 15 nt, Human
aauuuaaauagcuuu

SEQ ID NO: 1897557 - RNA, 16 nt, Human
aauuucucuacugucu

SEQ ID NO: 1897558 - RNA, 20 nt, Human
aauuugaaacacuuugcaua

SEQ ID NO: 1897559 - RNA, 17 nt, Human
aauuugagauacaaaca

SEQ ID NO: 1897560 - RNA, 18 nt, Human
aauuugauaugugaacag

SEQ ID NO: 1897561 - RNA, 16 nt, Human
aauuugauaugugaac

SEQ ID NO: 1897562 - RNA, 15 nt, Human
aauuugauaugugaa

SEQ ID NO: 1897563 - RNA, 21 nt, Human
aauuugauaguauugugcaua

SEQ ID NO: 1897564 - RNA, 19 nt, Human
aauuugauaugugaacagu

SEQ ID NO: 1897565 - RNA, 21 nt, Human
aauuucuaaaucuccaaaaua

SEQ ID NO: 1897566 - RNA, 13 nt, Human
aauuucuaaaucu

SEQ ID NO: 1897567 - RNA, 14 nt, Human
aauuuaugugaugg

SEQ ID NO: 1897568 - RNA, 17 nt, Human
aauuuagaaauauaauu

SEQ ID NO: 1897569 - RNA, 15 nt, Human
aauuuaccugaaguc

SEQ ID NO: 1897570 - RNA, 18 nt, Human
aauuuagguuuuuauuag

SEQ ID NO: 1897571 - RNA, 20 nt, Human
aauuuagguuuuuauuagua

SEQ ID NO: 1897572 - RNA, 20 nt, Human
aauuuaucuugucucugggc

SEQ ID NO: 1897573 - RNA, 18 nt, Human
aauuuaucuugucucugg

SEQ ID NO: 1897574 - RNA, 19 nt, Human
aauuuaucuugucucuggg

SEQ ID NO: 1897575 - RNA, 12 nt, Human
uauuaaagacag

SEQ ID NO: 1897576 - RNA, 23 nt, Human
uauuaaaaaucucaaauuucuaa

SEQ ID NO: 1897577 - RNA, 16 nt, Human
uauuaaauacaaaacu

SEQ ID NO: 1897578 - RNA, 18 nt, Human
uauuaaauacaaaacuuc

SEQ ID NO: 1897579 - RNA, 19 nt, Human
uauuaaauacaaaacuucc

SEQ ID NO: 1897580 - RNA, 23 nt, Human
uauuacaguggggaaugaagaua

SEQ ID NO: 1897581 - RNA, 19 nt, Human
uauguuuuaagaggcaggg

SEQ ID NO: 1897582 - RNA, 17 nt, Human
uauguuuuaagaggcag

SEQ ID NO: 1897583 - RNA, 23 nt, Human
uauguguguguguuguguguggg

SEQ ID NO: 1897584 - RNA, 22 nt, Human
uauuaaaaaucucaaauuucua

SEQ ID NO: 1897585 - RNA, 20 nt, Human
uauuaaaaaucucaaauuuc

SEQ ID NO: 1897586 - RNA, 18 nt, Human
uauuaaaaaucucaaauu

SEQ ID NO: 1897587 - RNA, 16 nt, Human
uauuaaaaaucucaaa

SEQ ID NO: 1897588 - RNA, 22 nt, Human
uauguguguguguugugugugg

SEQ ID NO: 1897589 - RNA, 14 nt, Human
uauguguguguguu

SEQ ID NO: 1897590 - RNA, 11 nt, Human
uaugugugugu

SEQ ID NO: 1897591 - RNA, 22 nt, Human
acagcugcuccuagagggaggg

SEQ ID NO: 1897592 - RNA, 23 nt, Human
acagcugcuccuagagggagggg

SEQ ID NO: 1897593 - RNA, 15 nt, Human
uauucagcucaugga

SEQ ID NO: 1897594 - RNA, 22 nt, Human
uauucaauaaaaaaaagaaaug

SEQ ID NO: 1897595 - RNA, 23 nt, Human
uauucaauaaaaaaaagaaauga

SEQ ID NO: 1897596 - RNA, 20 nt, Human
uauucaauaaaaaaaagaaa

SEQ ID NO: 1897597 - RNA, 18 nt, Human
uauucaggaagcucaggg

SEQ ID NO: 1897598 - RNA, 22 nt, Human
uauucaggaagcucagggccug

SEQ ID NO: 1897599 - RNA, 23 nt, Human
uauucauagcagcuuauucacaa

SEQ ID NO: 1897600 - RNA, 14 nt, Human
uauucauaauuauu

SEQ ID NO: 1897601 - RNA, 12 nt, Human
uauuagagaaga

SEQ ID NO: 1897602 - RNA, 14 nt, Human
uauuaccucugaua

SEQ ID NO: 1897603 - RNA, 19 nt, Human
uauuaccucugauaccuca

SEQ ID NO: 1897604 - RNA, 16 nt, Human
uauuaccacagacaua

SEQ ID NO: 1897605 - RNA, 21 nt, Human
uauuacccccuccuucagaca

SEQ ID NO: 1897606 - RNA, 22 nt, Human
uauuacccccuccuucagacac

SEQ ID NO: 1897607 - RNA, 11 nt, Human
uauuaccucug

SEQ ID NO: 1897608 - RNA, 13 nt, Human
uauuaccucugau

SEQ ID NO: 1897609 - RNA, 15 nt, Human
uauuaguuuugcaua

SEQ ID NO: 1897610 - RNA, 15 nt, Human
acagggcaccugcca

SEQ ID NO: 1897611 - RNA, 13 nt, Human
acagggcacaggc

SEQ ID NO: 1897612 - RNA, 17 nt, Human
acagggcaccugccacc

SEQ ID NO: 1897613 - RNA, 22 nt, Human
acagggcacaccgggcacucag

SEQ ID NO: 1897614 - RNA, 22 nt, Human
acagguuuuccugaagaauuga

SEQ ID NO: 1897615 - RNA, 16 nt, Human
acagggcacaggccau

SEQ ID NO: 1897616 - RNA, 17 nt, Human
acaggcugggcuucagu

SEQ ID NO: 1897617 - RNA, 14 nt, Human
acaggcugggcuuc

SEQ ID NO: 1897618 - RNA, 21 nt, Human
acaggcugggcuucaguggca

SEQ ID NO: 1897619 - RNA, 21 nt, Human
acaguauggcagcuuuccuca

SEQ ID NO: 1897620 - RNA, 23 nt, Human
acaguaucacugucuuuccuaga

SEQ ID NO: 1897621 - RNA, 21 nt, Human
acaguaucacugucuuuccua

SEQ ID NO: 1897622 - RNA, 19 nt, Human
acaguauuacuucugcuac

SEQ ID NO: 1897623 - RNA, 17 nt, Human
acaguauuacuucugcu

SEQ ID NO: 1897624 - RNA, 16 nt, Human
acaguauuacuucugc

SEQ ID NO: 1897625 - RNA, 15 nt, Human
acaguauuacuucug

SEQ ID NO: 1897626 - RNA, 13 nt, Human
acagucccugcca

SEQ ID NO: 1897627 - RNA, 17 nt, Human
acaguccucccaucuca

SEQ ID NO: 1897628 - RNA, 18 nt, Human
acaguccuuaccagcaga

SEQ ID NO: 1897629 - RNA, 20 nt, Human
acaguccuuaccagcagagc

SEQ ID NO: 1897630 - RNA, 15 nt, Human
acagucccugccaau

SEQ ID NO: 1897631 - RNA, 13 nt, Human
acaguccucccau

SEQ ID NO: 1897632 - RNA, 14 nt, Human
acaguccucccauc

SEQ ID NO: 1897633 - RNA, 15 nt, Human
acaguccucccaucu

SEQ ID NO: 1897634 - RNA, 20 nt, Human
acagugaaagaaaauaacaa

SEQ ID NO: 1897635 - RNA, 22 nt, Human
acagucuuguauuaaguuguua

SEQ ID NO: 1897636 - RNA, 18 nt, Human
acagucuuguauuaaguu

SEQ ID NO: 1897637 - RNA, 15 nt, Human
acagucuuguauuaa

SEQ ID NO: 1897638 - RNA, 14 nt, Human
acagucuuguauua

SEQ ID NO: 1897639 - RNA, 21 nt, Human
acaguccuuaccagcagagca

SEQ ID NO: 1897640 - RNA, 22 nt, Human
acaguccuuaccagcagagcac

SEQ ID NO: 1897641 - RNA, 23 nt, Human
acagucuauuugagacuccucag

SEQ ID NO: 1897642 - RNA, 15 nt, Human
acaguuaagagaaau

SEQ ID NO: 1897643 - RNA, 11 nt, Human
acaguguuccg

SEQ ID NO: 1897644 - RNA, 18 nt, Human
acagugagacucugucuc

SEQ ID NO: 1897645 - RNA, 14 nt, Human
acagugagacucug

SEQ ID NO: 1897646 - RNA, 19 nt, Human
acagugugaauaaagugcu

SEQ ID NO: 1897647 - RNA, 20 nt, Human
uauuuaagauaauuauaaua

SEQ ID NO: 1897648 - RNA, 17 nt, Human
uauuuaagauaauuaua

SEQ ID NO: 1897649 - RNA, 20 nt, Human
uauuuaaguaacuuuaaauu

SEQ ID NO: 1897650 - RNA, 15 nt, Human
uauuuaaugaaagac

SEQ ID NO: 1897651 - RNA, 21 nt, Human
uauuuaaugaaagacuguaca

SEQ ID NO: 1897652 - RNA, 14 nt, Human
uauuuaauagguuu

SEQ ID NO: 1897653 - RNA, 14 nt, Human
uauugucuuuuugu

SEQ ID NO: 1897654 - RNA, 18 nt, Human
uauuuaaccucuaaauuc

SEQ ID NO: 1897655 - RNA, 17 nt, Human
uauuuaaccucuaaauu

SEQ ID NO: 1897656 - RNA, 15 nt, Human
uauuuaacagcugaa

SEQ ID NO: 1897657 - RNA, 21 nt, Human
uauuuaacagcugaauuaucu

SEQ ID NO: 1897658 - RNA, 23 nt, Human
uauuuaacagcugaauuaucuau

SEQ ID NO: 1897659 - RNA, 13 nt, Human
uauugucaaagug

SEQ ID NO: 1897660 - RNA, 17 nt, Human
uauugucaaagugguga

SEQ ID NO: 1897661 - RNA, 21 nt, Human
uauuguagcauccuggaauau

SEQ ID NO: 1897662 - RNA, 20 nt, Human
uauuguagcauccuggaaua

SEQ ID NO: 1897663 - RNA, 18 nt, Human
uauuguagcauccuggaa

SEQ ID NO: 1897664 - RNA, 17 nt, Human
uauuguagcauccugga

SEQ ID NO: 1897665 - RNA, 17 nt, Human
uauuguacaguuuuuau

SEQ ID NO: 1897666 - RNA, 11 nt, Human
uauuguaccuc

SEQ ID NO: 1897667 - RNA, 13 nt, Human
uauuguaccucuc

SEQ ID NO: 1897668 - RNA, 14 nt, Human
uauuguaccucucu

SEQ ID NO: 1897669 - RNA, 15 nt, Human
uauuguacaguuuuu

SEQ ID NO: 1897670 - RNA, 14 nt, Human
uauuguacaguuuu

SEQ ID NO: 1897671 - RNA, 13 nt, Human
uauuguacaguuu

SEQ ID NO: 1897672 - RNA, 12 nt, Human
uauuguacaguu

SEQ ID NO: 1897673 - RNA, 11 nt, Human
uauuguacagu

SEQ ID NO: 1897674 - RNA, 18 nt, Human
uauuuacuucuuauacau

SEQ ID NO: 1897675 - RNA, 23 nt, Human
uauuuacugagcuucucugugaa

SEQ ID NO: 1897676 - RNA, 21 nt, Human
uauuuacugagcuucucugug

SEQ ID NO: 1897677 - RNA, 22 nt, Human
uauuuacugagcuucucuguga

SEQ ID NO: 1897678 - RNA, 14 nt, Human
uauuuacgcuuuga

SEQ ID NO: 1897679 - RNA, 15 nt, Human
uauuuacgcuuugau

SEQ ID NO: 1897680 - RNA, 19 nt, Human
uauuuacgcuuugauucau

SEQ ID NO: 1897681 - RNA, 22 nt, Human
uauuuacgcuuugauucauagu

SEQ ID NO: 1897682 - RNA, 14 nt, Human
uauuuacugagcuu

SEQ ID NO: 1897683 - RNA, 16 nt, Human
uauuuacugagcuucu

SEQ ID NO: 1897684 - RNA, 19 nt, Human
uauuuacugagcuucucug

SEQ ID NO: 1897685 - RNA, 23 nt, Human
uauuuaauuuuuuugagacagag

SEQ ID NO: 1897686 - RNA, 14 nt, Human
uauuuaauucaugu

SEQ ID NO: 1897687 - RNA, 21 nt, Human
uauuuaaugccgauauacucu

SEQ ID NO: 1897688 - RNA, 19 nt, Human
uauuuaguguucauaaaua

SEQ ID NO: 1897689 - RNA, 22 nt, Human
uauuuagcuccaaaccuucaca

SEQ ID NO: 1897690 - RNA, 13 nt, Human
uauuuauuuaaau

SEQ ID NO: 1897691 - RNA, 13 nt, Human
uauuuauuuacug

SEQ ID NO: 1897692 - RNA, 17 nt, Human
uauuuauuuacugagcu

SEQ ID NO: 1897693 - RNA, 14 nt, Human
uauuuauuuaaauu

SEQ ID NO: 1897694 - RNA, 11 nt, Human
uauuuauuuac

SEQ ID NO: 1897695 - RNA, 22 nt, Human
uauuucaauuuccaagagcuga

SEQ ID NO: 1897696 - RNA, 14 nt, Human
uauucuucauaaca

SEQ ID NO: 1897697 - RNA, 15 nt, Human
uauucuuauuuaaug

SEQ ID NO: 1897698 - RNA, 16 nt, Human
uauucuguuggccagu

SEQ ID NO: 1897699 - RNA, 14 nt, Human
uauucuuauucaaa

SEQ ID NO: 1897700 - RNA, 17 nt, Human
uauucuuauucaaagaa

SEQ ID NO: 1897701 - RNA, 24 nt, Human
uauucucuccuguaccucuugagc

SEQ ID NO: 1897702 - RNA, 20 nt, Human
uauucucuccuguaccucuu

SEQ ID NO: 1897703 - RNA, 19 nt, Human
acaguucuuugggccagac

SEQ ID NO: 1897704 - RNA, 20 nt, Human
acaguucuuugggccagaca

SEQ ID NO: 1897705 - RNA, 17 nt, Human
acaguucucuccuucuu

SEQ ID NO: 1897706 - RNA, 17 nt, Human
acaguucuuugggccag

SEQ ID NO: 1897707 - RNA, 18 nt, Human
acaguucuuugggccaga

SEQ ID NO: 1897708 - RNA, 15 nt, Human
acaguucauauguac

SEQ ID NO: 1897709 - RNA, 20 nt, Human
acaguucaauucucauuugu

SEQ ID NO: 1897710 - RNA, 20 nt, Human
acaguuacucagaauucucu

SEQ ID NO: 1897711 - RNA, 13 nt, Human
acaguuacucaga

SEQ ID NO: 1897712 - RNA, 22 nt, Human
acaguucggugagcuacaaaug

SEQ ID NO: 1897713 - RNA, 19 nt, Human
acaguucggugagcuacaa

SEQ ID NO: 1897714 - RNA, 23 nt, Human
acaguucggugagcuacaaaugc

SEQ ID NO: 1897715 - RNA, 16 nt, Human
acaguucucuccuucu

SEQ ID NO: 1897716 - RNA, 15 nt, Human
uauuguaaaacaggu

SEQ ID NO: 1897717 - RNA, 17 nt, Human
uauuggguuccauucuc

SEQ ID NO: 1897718 - RNA, 14 nt, Human
uauugacuuugucu

SEQ ID NO: 1897719 - RNA, 14 nt, Human
uauugagucaaaug

SEQ ID NO: 1897720 - RNA, 22 nt, Human
uauucuuucgaaagaagaaaau

SEQ ID NO: 1897721 - RNA, 16 nt, Human
uauugaaucuauuuaa

SEQ ID NO: 1897722 - RNA, 17 nt, Human
uauugaaucuauuuaag

SEQ ID NO: 1897723 - RNA, 11 nt, Human
uauugaaucua

SEQ ID NO: 1897724 - RNA, 22 nt, Human
uauugaauauaauauauuugug

SEQ ID NO: 1897725 - RNA, 20 nt, Human
uauugaauauaauauauuug

SEQ ID NO: 1897726 - RNA, 21 nt, Human
uauugaauauaauauauuugu

SEQ ID NO: 1897727 - RNA, 23 nt, Human
uauugacacagaaaauguugaga

SEQ ID NO: 1897728 - RNA, 13 nt, Human
uauugacacagaa

SEQ ID NO: 1897729 - RNA, 16 nt, Human
uauugacacagaaaau

SEQ ID NO: 1897730 - RNA, 18 nt, Human
uauugacacagaaaaugu

SEQ ID NO: 1897731 - RNA, 20 nt, Human
uauugacacagaaaauguug

SEQ ID NO: 1897732 - RNA, 17 nt, Human
acacccagcccccacau

SEQ ID NO: 1897733 - RNA, 19 nt, Human
acacccugugauggggccc

SEQ ID NO: 1897734 - RNA, 19 nt, Human
acaccuaaauaaccaaucu

SEQ ID NO: 1897735 - RNA, 12 nt, Human
acacccagcccc

SEQ ID NO: 1897736 - RNA, 11 nt, Human
acacccuguga

SEQ ID NO: 1897737 - RNA, 12 nt, Human
acacccugugau

SEQ ID NO: 1897738 - RNA, 18 nt, Human
acacccugugauggggcc

SEQ ID NO: 1897739 - RNA, 21 nt, Human
acacccagcccacuucugcca

SEQ ID NO: 1897740 - RNA, 20 nt, Human
acacccagcccacuucugcc

SEQ ID NO: 1897741 - RNA, 19 nt, Human
acacccagcccacuucugc

SEQ ID NO: 1897742 - RNA, 21 nt, Human
acaccaggcuugccugcaggc

SEQ ID NO: 1897743 - RNA, 21 nt, Human
acacaugcaaggucauuuuuu

SEQ ID NO: 1897744 - RNA, 12 nt, Human
uauaaaagccug

SEQ ID NO: 1897745 - RNA, 14 nt, Human
uauaaaagccuguu

SEQ ID NO: 1897746 - RNA, 17 nt, Human
uauaaaagccuguuuaa

SEQ ID NO: 1897747 - RNA, 18 nt, Human
acacaugcaaggucauuu

SEQ ID NO: 1897748 - RNA, 16 nt, Human
acacaucgcacugugg

SEQ ID NO: 1897749 - RNA, 20 nt, Human
acacaugcaaggucauuuuu

SEQ ID NO: 1897750 - RNA, 19 nt, Human
acacaugcaaggucauuuu

SEQ ID NO: 1897751 - RNA, 21 nt, Human
uagucaggugccucaagagaa

SEQ ID NO: 1897752 - RNA, 19 nt, Human
acaagcugcacccucaggc

SEQ ID NO: 1897753 - RNA, 21 nt, Human
acaagcugcacccucaggcag

SEQ ID NO: 1897754 - RNA, 22 nt, Human
acaagcugcacccucaggcagg

SEQ ID NO: 1897755 - RNA, 23 nt, Human
acaagcugcacccucaggcaggu

SEQ ID NO: 1897756 - RNA, 19 nt, Human
uagucagaauuagcugcuu

SEQ ID NO: 1897757 - RNA, 21 nt, Human
uagucucuuguauuaaacucu

SEQ ID NO: 1897758 - RNA, 20 nt, Human
uaguuccucauuagcauuuu

SEQ ID NO: 1897759 - RNA, 20 nt, Human
uauagccuaggugacagagu

SEQ ID NO: 1897760 - RNA, 19 nt, Human
uauaggaauugacccacaa

SEQ ID NO: 1897761 - RNA, 14 nt, Human
uauaggaauugacc

SEQ ID NO: 1897762 - RNA, 13 nt, Human
uauaggaauugac

SEQ ID NO: 1897763 - RNA, 18 nt, Human
uauagguuuuaaagaccu

SEQ ID NO: 1897764 - RNA, 19 nt, Human
acacucauugaccugaggc

SEQ ID NO: 1897765 - RNA, 21 nt, Human
acacucauugaccugaggccc

SEQ ID NO: 1897766 - RNA, 23 nt, Human
acacucauugaccugaggcccuu

SEQ ID NO: 1897767 - RNA, 13 nt, Human
uauauaucaaaua

SEQ ID NO: 1897768 - RNA, 23 nt, Human
uauauauuuuuuucugaaauuuc

SEQ ID NO: 1897769 - RNA, 20 nt, Human
uauauauuuuuuucugaaau

SEQ ID NO: 1897770 - RNA, 22 nt, Human
uauauauuuuuuucugaaauuu

SEQ ID NO: 1897771 - RNA, 21 nt, Human
uauauauuuuuuucugaaauu

SEQ ID NO: 1897772 - RNA, 14 nt, Human
uauacauuugauaa

SEQ ID NO: 1897773 - RNA, 14 nt, Human
uauacauaaacaag

SEQ ID NO: 1897774 - RNA, 13 nt, Human
uauacauaaacaa

SEQ ID NO: 1897775 - RNA, 21 nt, Human
uauacacuuacacuuuaugca

SEQ ID NO: 1897776 - RNA, 12 nt, Human
uauacacacagc

SEQ ID NO: 1897777 - RNA, 20 nt, Human
uauaaccaguguuguggauu

SEQ ID NO: 1897778 - RNA, 14 nt, Human
uauauuuacaaaug

SEQ ID NO: 1897779 - RNA, 15 nt, Human
uauauuuacaaaugg

SEQ ID NO: 1897780 - RNA, 21 nt, Human
uaucaaguauuauaccuuuuu

SEQ ID NO: 1897781 - RNA, 18 nt, Human
uaucaaguauuauaccuu

SEQ ID NO: 1897782 - RNA, 18 nt, Human
uaucacccagaagaaaau

SEQ ID NO: 1897783 - RNA, 23 nt, Human
acagacacaggcccggcuccagg

SEQ ID NO: 1897784 - RNA, 11 nt, Human
acacuccuuca

SEQ ID NO: 1897785 - RNA, 15 nt, Human
acacuccccgaaguc

SEQ ID NO: 1897786 - RNA, 21 nt, Human
acagacacucccacuuggcau

SEQ ID NO: 1897787 - RNA, 17 nt, Human
acagacccugcccugug

SEQ ID NO: 1897788 - RNA, 16 nt, Human
acagacccugcccugu

SEQ ID NO: 1897789 - RNA, 18 nt, Human
acagacccugcccugugg

SEQ ID NO: 1897790 - RNA, 20 nt, Human
acagacccugcccugugggc

SEQ ID NO: 1897791 - RNA, 20 nt, Human
acagacucaaaugcucagac

SEQ ID NO: 1897792 - RNA, 22 nt, Human
acagacucgauucauauugaau

SEQ ID NO: 1897793 - RNA, 20 nt, Human
acagacucacaaccugaacc

SEQ ID NO: 1897794 - RNA, 22 nt, Human
acagacucacaaccugaaccua

SEQ ID NO: 1897795 - RNA, 14 nt, Human
acagacuggaagca

SEQ ID NO: 1897796 - RNA, 19 nt, Human
acagacugaccuugaugag

SEQ ID NO: 1897797 - RNA, 16 nt, Human
uauauugauccagaaa

SEQ ID NO: 1897798 - RNA, 18 nt, Human
uaucucccccagccccau

SEQ ID NO: 1897799 - RNA, 17 nt, Human
uaucucccccagcccca

SEQ ID NO: 1897800 - RNA, 19 nt, Human
uaucuagauacuguaucau

SEQ ID NO: 1897801 - RNA, 16 nt, Human
uaucuagauacuguau

SEQ ID NO: 1897802 - RNA, 15 nt, Human
uaucuagauacugua

SEQ ID NO: 1897803 - RNA, 21 nt, Human
uaucuacucuccucaucucua

SEQ ID NO: 1897804 - RNA, 14 nt, Human
uaucuacucuccuc

SEQ ID NO: 1897805 - RNA, 20 nt, Human
uaucuacucuccucaucucu

SEQ ID NO: 1897806 - RNA, 14 nt, Human
uauccauucuuucu

SEQ ID NO: 1897807 - RNA, 16 nt, Human
uauccauucuuucuga

SEQ ID NO: 1897808 - RNA, 10 nt, Human
uaucagaauu

SEQ ID NO: 1897809 - RNA, 22 nt, Human
uauccauauugagucaaauggu

SEQ ID NO: 1897810 - RNA, 21 nt, Human
acagagugagacucugucuca

SEQ ID NO: 1897811 - RNA, 18 nt, Human
acagagcuacacagggga

SEQ ID NO: 1897812 - RNA, 22 nt, Human
acagaguggacuguucccugag

SEQ ID NO: 1897813 - RNA, 16 nt, Human
acagagcuacacaggg

SEQ ID NO: 1897814 - RNA, 20 nt, Human
acagagcccacgcccccacu

SEQ ID NO: 1897815 - RNA, 19 nt, Human
acagacuguugucccugca

SEQ ID NO: 1897816 - RNA, 20 nt, Human
acagacuguugucccugcac

SEQ ID NO: 1897817 - RNA, 16 nt, Human
acagcccagccacgga

SEQ ID NO: 1897818 - RNA, 17 nt, Human
acagcccagccacggac

SEQ ID NO: 1897819 - RNA, 19 nt, Human
acagcccaaagaaggaaaa

SEQ ID NO: 1897820 - RNA, 13 nt, Human
acagcccaccugg

SEQ ID NO: 1897821 - RNA, 15 nt, Human
acagccccacccugg

SEQ ID NO: 1897822 - RNA, 12 nt, Human
acagccccaccc

SEQ ID NO: 1897823 - RNA, 13 nt, Human
acagccccacccu

SEQ ID NO: 1897824 - RNA, 14 nt, Human
acagccccacccug

SEQ ID NO: 1897825 - RNA, 18 nt, Human
acagaguuuucacucuua

SEQ ID NO: 1897826 - RNA, 20 nt, Human
acagaguuuucacucuuauu

SEQ ID NO: 1897827 - RNA, 22 nt, Human
acagcagccuggggcuggccuc

SEQ ID NO: 1897828 - RNA, 14 nt, Human
uaugaucacggcuc

SEQ ID NO: 1897829 - RNA, 23 nt, Human
uaugaucacggcucacugcagcc

SEQ ID NO: 1897830 - RNA, 21 nt, Human
uaugaucacggcucacugcag

SEQ ID NO: 1897831 - RNA, 13 nt, Human
uaugaggcauuug

SEQ ID NO: 1897832 - RNA, 15 nt, Human
uaucuugaauaaugu

SEQ ID NO: 1897833 - RNA, 15 nt, Human
uaucuugaagacuuu

SEQ ID NO: 1897834 - RNA, 19 nt, Human
uaugcucugcauguuacau

SEQ ID NO: 1897835 - RNA, 19 nt, Human
uaugcugaaacagaauacu

SEQ ID NO: 1897836 - RNA, 22 nt, Human
uauggccugugagcuaggaauu

SEQ ID NO: 1897837 - RNA, 14 nt, Human
uauggccuguggau

SEQ ID NO: 1897838 - RNA, 14 nt, Human
uaugcucugcaugu

SEQ ID NO: 1897839 - RNA, 18 nt, Human
uaugcucugcauguuaca

SEQ ID NO: 1897840 - RNA, 18 nt, Human
uaugaugugggucaagga

SEQ ID NO: 1897841 - RNA, 17 nt, Human
acagcuaacauggaagu

SEQ ID NO: 1897842 - RNA, 15 nt, Human
acagcuccaagaauu

SEQ ID NO: 1897843 - RNA, 21 nt, Human
acagcucaggaucucuuagca

SEQ ID NO: 1897844 - RNA, 17 nt, Human
acagcuccacccuggcc

SEQ ID NO: 1897845 - RNA, 14 nt, Human
acagccugugucuu

SEQ ID NO: 1897846 - RNA, 18 nt, Human
acagccugugucuuuaaa

SEQ ID NO: 1897847 - RNA, 23 nt, Human
acagccugugucuuuaaaugcug

SEQ ID NO: 1897848 - RNA, 14 nt, Human
acagcuaacaugga

SEQ ID NO: 1897849 - RNA, 15 nt, Human
acagcuaacauggaa

SEQ ID NO: 1897850 - RNA, 19 nt, Human
uauggggauagaugugugg

SEQ ID NO: 1897851 - RNA, 18 nt, Human
uauggggauagaugugug

SEQ ID NO: 1897852 - RNA, 17 nt, Human
uauggggauagaugugu

SEQ ID NO: 1897853 - RNA, 16 nt, Human
uauggcuuuugugcau

SEQ ID NO: 1897854 - RNA, 19 nt, Human
uccucagaucauccagaag

SEQ ID NO: 1897855 - RNA, 20 nt, Human
uccucagaucuucugugggu

SEQ ID NO: 1897856 - RNA, 19 nt, Human
acucuuauugcccacgcug

SEQ ID NO: 1897857 - RNA, 16 nt, Human
acucuuauugcccacg

SEQ ID NO: 1897858 - RNA, 20 nt, Human
uccucaauuccaacacugau

SEQ ID NO: 1897859 - RNA, 15 nt, Human
uccucacacacagac

SEQ ID NO: 1897860 - RNA, 17 nt, Human
uccucaagaaauaaaag

SEQ ID NO: 1897861 - RNA, 23 nt, Human
uccucaagaaauaaaaggaagcc

SEQ ID NO: 1897862 - RNA, 19 nt, Human
uccucccucccucuuuccc

SEQ ID NO: 1897863 - RNA, 14 nt, Human
uccucccugcaucu

SEQ ID NO: 1897864 - RNA, 17 nt, Human
uccucccucccucuuuc

SEQ ID NO: 1897865 - RNA, 15 nt, Human
uccucccucccucuu

SEQ ID NO: 1897866 - RNA, 12 nt, Human
uccucuccccag

SEQ ID NO: 1897867 - RNA, 22 nt, Human
uccucccugcaucugaccagca

SEQ ID NO: 1897868 - RNA, 22 nt, Human
uccucauacccacccccaccca

SEQ ID NO: 1897869 - RNA, 14 nt, Human
uccucauacccacc

SEQ ID NO: 1897870 - RNA, 18 nt, Human
uccucauacccaccccca

SEQ ID NO: 1897871 - RNA, 11 nt, Human
uccucagccuu

SEQ ID NO: 1897872 - RNA, 23 nt, Human
uccucagguggccaugccucagc

SEQ ID NO: 1897873 - RNA, 16 nt, Human
uccucauaaaaagcaa

SEQ ID NO: 1897874 - RNA, 23 nt, Human
uccucauaaaaagcaaaacaaaa

SEQ ID NO: 1897875 - RNA, 22 nt, Human
acucugcacaugucuuguacau

SEQ ID NO: 1897876 - RNA, 21 nt, Human
acucugcacaugucuuguaca

SEQ ID NO: 1897877 - RNA, 19 nt, Human
acucugcacaugucuugua

SEQ ID NO: 1897878 - RNA, 18 nt, Human
acucugcacaugucuugu

SEQ ID NO: 1897879 - RNA, 16 nt, Human
acucugcauucuagua

SEQ ID NO: 1897880 - RNA, 23 nt, Human
acucuuauaucuauauuuuacau

SEQ ID NO: 1897881 - RNA, 21 nt, Human
acucuggagguuuguuuagaa

SEQ ID NO: 1897882 - RNA, 17 nt, Human
acucugcacaugucuug

SEQ ID NO: 1897883 - RNA, 13 nt, Human
acucugcacaugu

SEQ ID NO: 1897884 - RNA, 11 nt, Human
acucugcacau

SEQ ID NO: 1897885 - RNA, 21 nt, Human
acucuccucugcugcuggcug

SEQ ID NO: 1897886 - RNA, 14 nt, Human
acucucccccaccc

SEQ ID NO: 1897887 - RNA, 18 nt, Human
acucuccucugcugcugg

SEQ ID NO: 1897888 - RNA, 19 nt, Human
acucuccucugcugcuggc

SEQ ID NO: 1897889 - RNA, 17 nt, Human
acucuccucugcugcug

SEQ ID NO: 1897890 - RNA, 10 nt, Human
acucuccccc

SEQ ID NO: 1897891 - RNA, 20 nt, Human
acucgcgacaaugcaaacca

SEQ ID NO: 1897892 - RNA, 23 nt, Human
acucgcgacaaugcaaaccauca

SEQ ID NO: 1897893 - RNA, 19 nt, Human
uccuaggcauuugcugaau

SEQ ID NO: 1897894 - RNA, 18 nt, Human
acucgcgacaaugcaaac

SEQ ID NO: 1897895 - RNA, 22 nt, Human
ucccucauccucauacccaccc

SEQ ID NO: 1897896 - RNA, 20 nt, Human
ucccucaccuuggcaccaga

SEQ ID NO: 1897897 - RNA, 21 nt, Human
ucccucagucuggcccuuccu

SEQ ID NO: 1897898 - RNA, 15 nt, Human
ucccucaccuuggca

SEQ ID NO: 1897899 - RNA, 21 nt, Human
ucccucaccuuggcaccagac

SEQ ID NO: 1897900 - RNA, 16 nt, Human
acucaucuagguaaau

SEQ ID NO: 1897901 - RNA, 18 nt, Human
acucaucuagguaaauua

SEQ ID NO: 1897902 - RNA, 15 nt, Human
acucauugcugagcc

SEQ ID NO: 1897903 - RNA, 18 nt, Human
acucauugcugagccucu

SEQ ID NO: 1897904 - RNA, 20 nt, Human
acucauugcugagccucugc

SEQ ID NO: 1897905 - RNA, 21 nt, Human
acucauugcugagccucugcu

SEQ ID NO: 1897906 - RNA, 22 nt, Human
acucauugcugagccucugcuc

SEQ ID NO: 1897907 - RNA, 23 nt, Human
acucauugcugagccucugcucc

SEQ ID NO: 1897908 - RNA, 21 nt, Human
acucauuuauaaagcuaaaau

SEQ ID NO: 1897909 - RNA, 20 nt, Human
acucauuuaaaguauuuuau

SEQ ID NO: 1897910 - RNA, 18 nt, Human
acuccaacagaagaacug

SEQ ID NO: 1897911 - RNA, 19 nt, Human
acuccaacagaagaacugu

SEQ ID NO: 1897912 - RNA, 20 nt, Human
uccuagcacuuugggaggcc

SEQ ID NO: 1897913 - RNA, 21 nt, Human
uccuagauggcagucacugaa

SEQ ID NO: 1897914 - RNA, 14 nt, Human
uccuaggcauuugc

SEQ ID NO: 1897915 - RNA, 22 nt, Human
uccuagauggcagucacugaau

SEQ ID NO: 1897916 - RNA, 18 nt, Human
uccuagauggcagucacu

SEQ ID NO: 1897917 - RNA, 17 nt, Human
uccuaaaacaccuggua

SEQ ID NO: 1897918 - RNA, 14 nt, Human
uccuagaguagagu

SEQ ID NO: 1897919 - RNA, 18 nt, Human
ucccuuuuaauccuggcu

SEQ ID NO: 1897920 - RNA, 22 nt, Human
ucccuuugacgccaucccagcc

SEQ ID NO: 1897921 - RNA, 23 nt, Human
ucccuuugacgccaucccagccc

SEQ ID NO: 1897922 - RNA, 18 nt, Human
uccgugaaaacggagcug

SEQ ID NO: 1897923 - RNA, 16 nt, Human
ucccuguaggauuuuu

SEQ ID NO: 1897924 - RNA, 17 nt, Human
ucccuguuccccagaga

SEQ ID NO: 1897925 - RNA, 15 nt, Human
ucccuguuccccaga

SEQ ID NO: 1897926 - RNA, 16 nt, Human
ucccuguuccccagag

SEQ ID NO: 1897927 - RNA, 18 nt, Human
ucccuguuccccagagaa

SEQ ID NO: 1897928 - RNA, 22 nt, Human
ucccuuuccaaaugcccagcuu

SEQ ID NO: 1897929 - RNA, 18 nt, Human
ucccuuacgugaguccug

SEQ ID NO: 1897930 - RNA, 22 nt, Human
ucccuuacgugaguccuggcau

SEQ ID NO: 1897931 - RNA, 14 nt, Human
uccccaaagggugu

SEQ ID NO: 1897932 - RNA, 20 nt, Human
uccccaauaauugcagaacu

SEQ ID NO: 1897933 - RNA, 21 nt, Human
uccccaauaauugcagaacua

SEQ ID NO: 1897934 - RNA, 17 nt, Human
ucccauagccaggaaac

SEQ ID NO: 1897935 - RNA, 16 nt, Human
ucccauaugccugggc

SEQ ID NO: 1897936 - RNA, 15 nt, Human
ucccauaugccuggg

SEQ ID NO: 1897937 - RNA, 13 nt, Human
ucccaucucacac

SEQ ID NO: 1897938 - RNA, 14 nt, Human
ucccaucucacaca

SEQ ID NO: 1897939 - RNA, 19 nt, Human
ucccaucucacacaugagc

SEQ ID NO: 1897940 - RNA, 17 nt, Human
ucccaggugcagccaga

SEQ ID NO: 1897941 - RNA, 19 nt, Human
ucccagugccgagaaggaa

SEQ ID NO: 1897942 - RNA, 22 nt, Human
ucccagugccgagaaggaagcc

SEQ ID NO: 1897943 - RNA, 17 nt, Human
acuacaguccucccauc

SEQ ID NO: 1897944 - RNA, 16 nt, Human
acuacaguccucccau

SEQ ID NO: 1897945 - RNA, 20 nt, Human
acuacaugagaacaaacaga

SEQ ID NO: 1897946 - RNA, 13 nt, Human
acuacauucauuu

SEQ ID NO: 1897947 - RNA, 23 nt, Human
acuacaggugugagucaccaagc

SEQ ID NO: 1897948 - RNA, 17 nt, Human
acuaaccagcagaaaug

SEQ ID NO: 1897949 - RNA, 15 nt, Human
acuacaguccuccca

SEQ ID NO: 1897950 - RNA, 13 nt, Human
acuaaccacgcug

SEQ ID NO: 1897951 - RNA, 16 nt, Human
acuaaccagcagaaau

SEQ ID NO: 1897952 - RNA, 12 nt, Human
acuaaacucauu

SEQ ID NO: 1897953 - RNA, 14 nt, Human
acuaaacucauuua

SEQ ID NO: 1897954 - RNA, 16 nt, Human
acuaaacucauuuaua

SEQ ID NO: 1897955 - RNA, 14 nt, Human
uccagcucaccagc

SEQ ID NO: 1897956 - RNA, 15 nt, Human
uccagcucaccagcc

SEQ ID NO: 1897957 - RNA, 21 nt, Human
uccagcuauuuuuauuuguuu

SEQ ID NO: 1897958 - RNA, 12 nt, Human
acguuucuaaag

SEQ ID NO: 1897959 - RNA, 18 nt, Human
acguuuacaagccccccc

SEQ ID NO: 1897960 - RNA, 13 nt, Human
uccagccugggug

SEQ ID NO: 1897961 - RNA, 17 nt, Human
uccagccuggggucugg

SEQ ID NO: 1897962 - RNA, 24 nt, Human
uccagccugggugacagagcaagu

SEQ ID NO: 1897963 - RNA, 12 nt, Human
uccagccugggu

SEQ ID NO: 1897964 - RNA, 20 nt, Human
uccagccugguuuagccugg

SEQ ID NO: 1897965 - RNA, 13 nt, Human
acuaaaaauacaa

SEQ ID NO: 1897966 - RNA, 16 nt, Human
acuaaaacuacaaaaa

SEQ ID NO: 1897967 - RNA, 14 nt, Human
acguuucuaaaggc

SEQ ID NO: 1897968 - RNA, 17 nt, Human
acuauagccuaggugac

SEQ ID NO: 1897969 - RNA, 23 nt, Human
acuauaauuuaccugaagucuuu

SEQ ID NO: 1897970 - RNA, 15 nt, Human
acuauauuguacaca

SEQ ID NO: 1897971 - RNA, 23 nt, Human
uccccaggaggccagccuugacc

SEQ ID NO: 1897972 - RNA, 16 nt, Human
uccccaggcaccucac

SEQ ID NO: 1897973 - RNA, 24 nt, Human
uccccaccgcagacaggaccaggg

SEQ ID NO: 1897974 - RNA, 18 nt, Human
acuauguugcccaggcag

SEQ ID NO: 1897975 - RNA, 22 nt, Human
acuaugaaguuuuuuuuauaca

SEQ ID NO: 1897976 - RNA, 23 nt, Human
acuauguugcccaggcaggucuu

SEQ ID NO: 1897977 - RNA, 20 nt, Human
acuauguugcccaggcaggu

SEQ ID NO: 1897978 - RNA, 19 nt, Human
acuauguugcccaggcagg

SEQ ID NO: 1897979 - RNA, 18 nt, Human
ucccuauuagagaagaga

SEQ ID NO: 1897980 - RNA, 18 nt, Human
ucccgaauagcugggacu

SEQ ID NO: 1897981 - RNA, 20 nt, Human
ucccgaguagcugggacuac

SEQ ID NO: 1897982 - RNA, 18 nt, Human
uccccuuuugcauucucc

SEQ ID NO: 1897983 - RNA, 16 nt, Human
ucccgaauagcuggga

SEQ ID NO: 1897984 - RNA, 15 nt, Human
ucccgaauagcuggg

SEQ ID NO: 1897985 - RNA, 13 nt, Human
uccccuucucuca

SEQ ID NO: 1897986 - RNA, 16 nt, Human
uccccuccuccacucu

SEQ ID NO: 1897987 - RNA, 14 nt, Human
uccccuccuccacu

SEQ ID NO: 1897988 - RNA, 16 nt, Human
uccccuucucucaucu

SEQ ID NO: 1897989 - RNA, 15 nt, Human
uccccuucucucauc

SEQ ID NO: 1897990 - RNA, 18 nt, Human
uccccuucucucaucucu

SEQ ID NO: 1897991 - RNA, 20 nt, Human
acucaagacuuccagagccu

SEQ ID NO: 1897992 - RNA, 17 nt, Human
acucaagacuuccagag

SEQ ID NO: 1897993 - RNA, 12 nt, Human
uccccuccucca

SEQ ID NO: 1897994 - RNA, 22 nt, Human
uccccuccaaccuggggggcag

SEQ ID NO: 1897995 - RNA, 13 nt, Human
uccccuccaaccu

SEQ ID NO: 1897996 - RNA, 12 nt, Human
uccccuccaacc

SEQ ID NO: 1897997 - RNA, 15 nt, Human
acuggcgccuccgag

SEQ ID NO: 1897998 - RNA, 10 nt, Human
acuggcaugc

SEQ ID NO: 1897999 - RNA, 22 nt, Human
acuggcugcaaaggguaucagg

SEQ ID NO: 1898000 - RNA, 13 nt, Human
uccuucagcccuc

SEQ ID NO: 1898001 - RNA, 19 nt, Human
uccuucagcccucaccccu

SEQ ID NO: 1898002 - RNA, 15 nt, Human
uccuucagcccucac

SEQ ID NO: 1898003 - RNA, 14 nt, Human
uccuucagcccuca

SEQ ID NO: 1898004 - RNA, 22 nt, Human
uccuucagugccuuauggaaca

SEQ ID NO: 1898005 - RNA, 13 nt, Human
uccuucagugccu

SEQ ID NO: 1898006 - RNA, 20 nt, Human
uccuucagugccuuauggaa

SEQ ID NO: 1898007 - RNA, 12 nt, Human
uccuucagugcc

SEQ ID NO: 1898008 - RNA, 21 nt, Human
uccuucagcccucaccccugg

SEQ ID NO: 1898009 - RNA, 11 nt, Human
uccuucagugc

SEQ ID NO: 1898010 - RNA, 13 nt, Human
uccuucagccuga

SEQ ID NO: 1898011 - RNA, 20 nt, Human
uccuuccuggagcccagagg

SEQ ID NO: 1898012 - RNA, 21 nt, Human
uccuuccucacaccaggcuug

SEQ ID NO: 1898013 - RNA, 16 nt, Human
uccuuccucacaccag

SEQ ID NO: 1898014 - RNA, 22 nt, Human
acuggauuaaacuuaaucuaaa

SEQ ID NO: 1898015 - RNA, 22 nt, Human
acuggcaaaaggaucuuugugg

SEQ ID NO: 1898016 - RNA, 12 nt, Human
acuggcaaaagg

SEQ ID NO: 1898017 - RNA, 22 nt, Human
acugcugcgucauuacagggca

SEQ ID NO: 1898018 - RNA, 18 nt, Human
acugcuuccagugaggcu

SEQ ID NO: 1898019 - RNA, 21 nt, Human
acugcuuccagugaggcucug

SEQ ID NO: 1898020 - RNA, 22 nt, Human
acugcuuccagugaggcucugc

SEQ ID NO: 1898021 - RNA, 23 nt, Human
acugcuuccagugaggcucugcc

SEQ ID NO: 1898022 - RNA, 18 nt, Human
acugcuacuguaauuuua

SEQ ID NO: 1898023 - RNA, 22 nt, Human
acugcuacuguaauuuuauaug

SEQ ID NO: 1898024 - RNA, 19 nt, Human
acugccuuuggcagaguuc

SEQ ID NO: 1898025 - RNA, 16 nt, Human
acugccuuuggcagag

SEQ ID NO: 1898026 - RNA, 16 nt, Human
acugcauaccaaccug

SEQ ID NO: 1898027 - RNA, 20 nt, Human
acugcauaccaaccugggca

SEQ ID NO: 1898028 - RNA, 20 nt, Human
uccuuucauuuacuguggcu

SEQ ID NO: 1898029 - RNA, 16 nt, Human
uccuuucauuuacugu

SEQ ID NO: 1898030 - RNA, 14 nt, Human
uccuuuccagguau

SEQ ID NO: 1898031 - RNA, 15 nt, Human
ucgaacuggcugcaa

SEQ ID NO: 1898032 - RNA, 13 nt, Human
ucgaacuggcugc

SEQ ID NO: 1898033 - RNA, 14 nt, Human
ucgaacuggcugca

SEQ ID NO: 1898034 - RNA, 15 nt, Human
uccuuucaccacaug

SEQ ID NO: 1898035 - RNA, 19 nt, Human
uccuuucaaugguuugcaa

SEQ ID NO: 1898036 - RNA, 18 nt, Human
uccuuucaagguaacugu

SEQ ID NO: 1898037 - RNA, 14 nt, Human
uccuuccuguucug

SEQ ID NO: 1898038 - RNA, 23 nt, Human
uccuuuaggagggaguuaucuaa

SEQ ID NO: 1898039 - RNA, 16 nt, Human
uccuuccuguucugaa

SEQ ID NO: 1898040 - RNA, 14 nt, Human
ucgcgacaaugcaa

SEQ ID NO: 1898041 - RNA, 13 nt, Human
ucgcgacaaugca

SEQ ID NO: 1898042 - RNA, 17 nt, Human
ucgaggacagggaggug

SEQ ID NO: 1898043 - RNA, 14 nt, Human
ucgaggacagggag

SEQ ID NO: 1898044 - RNA, 22 nt, Human
ucgacagcauuuuccucugcuu

SEQ ID NO: 1898045 - RNA, 12 nt, Human
ucgacacagagu

SEQ ID NO: 1898046 - RNA, 17 nt, Human
ucgacagugaauauuca

SEQ ID NO: 1898047 - RNA, 14 nt, Human
ucgagcaugccugg

SEQ ID NO: 1898048 - RNA, 15 nt, Human
ucgagcaugccugga

SEQ ID NO: 1898049 - RNA, 20 nt, Human
acuguacagacagaaaaaac

SEQ ID NO: 1898050 - RNA, 17 nt, Human
acuguaauuuuauauga

SEQ ID NO: 1898051 - RNA, 14 nt, Human
acuguacaaaguag

SEQ ID NO: 1898052 - RNA, 15 nt, Human
acuguacaaaguaga

SEQ ID NO: 1898053 - RNA, 19 nt, Human
acuguaauuugugauacaa

SEQ ID NO: 1898054 - RNA, 13 nt, Human
acuguacaaagua

SEQ ID NO: 1898055 - RNA, 16 nt, Human
acuguaauaaagauga

SEQ ID NO: 1898056 - RNA, 12 nt, Human
acuguacaugug

SEQ ID NO: 1898057 - RNA, 21 nt, Human
acuguaccaugugcuacaggg

SEQ ID NO: 1898058 - RNA, 23 nt, Human
acuguagaaaagggaacugaaca

SEQ ID NO: 1898059 - RNA, 14 nt, Human
acuguacaugaaaa

SEQ ID NO: 1898060 - RNA, 13 nt, Human
acuguacaugaaa

SEQ ID NO: 1898061 - RNA, 23 nt, Human
acuguacaugaaaacacauuuuu

SEQ ID NO: 1898062 - RNA, 13 nt, Human
ucgcuccuguguc

SEQ ID NO: 1898063 - RNA, 17 nt, Human
acugggagaaaugaaaa

SEQ ID NO: 1898064 - RNA, 12 nt, Human
ucgcuccugugu

SEQ ID NO: 1898065 - RNA, 22 nt, Human
acugggaugggaggagaggaca

SEQ ID NO: 1898066 - RNA, 23 nt, Human
acugggagccuacccacccccag

SEQ ID NO: 1898067 - RNA, 12 nt, Human
acugggagccua

SEQ ID NO: 1898068 - RNA, 19 nt, Human
acuggguacuuguggacac

SEQ ID NO: 1898069 - RNA, 17 nt, Human
acuggggauuggguggg

SEQ ID NO: 1898070 - RNA, 23 nt, Human
acuggguacuuguggacacagcu

SEQ ID NO: 1898071 - RNA, 20 nt, Human
acuggguacuuguggacaca

SEQ ID NO: 1898072 - RNA, 16 nt, Human
acuguaaggcaaucau

SEQ ID NO: 1898073 - RNA, 21 nt, Human
acuggggauugggugggcagg

SEQ ID NO: 1898074 - RNA, 22 nt, Human
acugcagggacacgggcagccu

SEQ ID NO: 1898075 - RNA, 12 nt, Human
acugcagggaca

SEQ ID NO: 1898076 - RNA, 23 nt, Human
acugcagccucaaccuccugggc

SEQ ID NO: 1898077 - RNA, 22 nt, Human
acugcagccucaaccuccuggg

SEQ ID NO: 1898078 - RNA, 21 nt, Human
acugcagccucaaccuccugg

SEQ ID NO: 1898079 - RNA, 19 nt, Human
acugcagccucaaccuccu

SEQ ID NO: 1898080 - RNA, 17 nt, Human
uccuuaaagaguguggc

SEQ ID NO: 1898081 - RNA, 23 nt, Human
uccuuaaagaguguggcaaaaua

SEQ ID NO: 1898082 - RNA, 18 nt, Human
uccuuaaagaguguggca

SEQ ID NO: 1898083 - RNA, 13 nt, Human
acugcacuguuuu

SEQ ID NO: 1898084 - RNA, 24 nt, Human
uccugugucuugcaauggcagccu

SEQ ID NO: 1898085 - RNA, 23 nt, Human
uccugugucuugcaauggcagcc

SEQ ID NO: 1898086 - RNA, 19 nt, Human
uccugugugauugacagcu

SEQ ID NO: 1898087 - RNA, 22 nt, Human
uccuguguguccaaaacugccu

SEQ ID NO: 1898088 - RNA, 14 nt, Human
uccugugugugcgc

SEQ ID NO: 1898089 - RNA, 13 nt, Human
uccugugugugcg

SEQ ID NO: 1898090 - RNA, 18 nt, Human
uccugugugugcgccuac

SEQ ID NO: 1898091 - RNA, 19 nt, Human
uccuguucuuaagacguga

SEQ ID NO: 1898092 - RNA, 12 nt, Human
uccuguucugaa

SEQ ID NO: 1898093 - RNA, 19 nt, Human
uccuguucccaugagauga

SEQ ID NO: 1898094 - RNA, 19 nt, Human
uccugugccuccaucagcu

SEQ ID NO: 1898095 - RNA, 13 nt, Human
uccugcugcaguu

SEQ ID NO: 1898096 - RNA, 12 nt, Human
uccugggccugc

SEQ ID NO: 1898097 - RNA, 13 nt, Human
uccugggccugca

SEQ ID NO: 1898098 - RNA, 15 nt, Human
uccugggccugcaga

SEQ ID NO: 1898099 - RNA, 16 nt, Human
uccugggccugcagaa

SEQ ID NO: 1898100 - RNA, 20 nt, Human
uccugccucgaacuggcugc

SEQ ID NO: 1898101 - RNA, 21 nt, Human
uccugccucgaacuggcugca

SEQ ID NO: 1898102 - RNA, 19 nt, Human
uccugccucagccucccaa

SEQ ID NO: 1898103 - RNA, 22 nt, Human
uccugcaggcagccaggccaca

SEQ ID NO: 1898104 - RNA, 14 nt, Human
uccugcaggccagg

SEQ ID NO: 1898105 - RNA, 19 nt, Human
uccugcaggccaggccagc

SEQ ID NO: 1898106 - RNA, 20 nt, Human
uccugcaggccaggccagcu

SEQ ID NO: 1898107 - RNA, 16 nt, Human
uccugcaggcagccag

SEQ ID NO: 1898108 - RNA, 17 nt, Human
uccugcaggcagccagg

SEQ ID NO: 1898109 - RNA, 19 nt, Human
uccugcaggcagccaggcc

SEQ ID NO: 1898110 - RNA, 20 nt, Human
uccugcaggcagccaggcca

SEQ ID NO: 1898111 - RNA, 15 nt, Human
uccugcaggcagcca

SEQ ID NO: 1898112 - RNA, 19 nt, Human
uccugaguagcuggauuac

SEQ ID NO: 1898113 - RNA, 22 nt, Human
acugaggggaggggagcauggg

SEQ ID NO: 1898114 - RNA, 17 nt, Human
acugaggggaggggagc

SEQ ID NO: 1898115 - RNA, 14 nt, Human
acugaggccugagc

SEQ ID NO: 1898116 - RNA, 13 nt, Human
acugaggccugag

SEQ ID NO: 1898117 - RNA, 14 nt, Human
acugaggaucagag

SEQ ID NO: 1898118 - RNA, 15 nt, Human
uccucuccccagcaa

SEQ ID NO: 1898119 - RNA, 14 nt, Human
uccucuccccagcc

SEQ ID NO: 1898120 - RNA, 15 nt, Human
uccucuccccagccc

SEQ ID NO: 1898121 - RNA, 16 nt, Human
uccucuccccagccca

SEQ ID NO: 1898122 - RNA, 17 nt, Human
uccucuccccagcccag

SEQ ID NO: 1898123 - RNA, 18 nt, Human
uccucuccccagcccaga

SEQ ID NO: 1898124 - RNA, 19 nt, Human
uccucuccccagcccagag

SEQ ID NO: 1898125 - RNA, 20 nt, Human
uccucuccccagcccagaga

SEQ ID NO: 1898126 - RNA, 16 nt, Human
acugagcuucucugug

SEQ ID NO: 1898127 - RNA, 22 nt, Human
acugaggaagaacggggcucuu

SEQ ID NO: 1898128 - RNA, 13 nt, Human
acugaggaagaac

SEQ ID NO: 1898129 - RNA, 17 nt, Human
acugagcuuggaagcuu

SEQ ID NO: 1898130 - RNA, 16 nt, Human
acugagcuuggaagcu

SEQ ID NO: 1898131 - RNA, 13 nt, Human
acugagcuuggaa

SEQ ID NO: 1898132 - RNA, 12 nt, Human
acugagcuugga

SEQ ID NO: 1898133 - RNA, 17 nt, Human
acugagcuucucuguga

SEQ ID NO: 1898134 - RNA, 18 nt, Human
acugagcuucucugugaa

SEQ ID NO: 1898135 - RNA, 18 nt, Human
acugaguacguugugcau

SEQ ID NO: 1898136 - RNA, 21 nt, Human
acugaguacguugugcauuug

SEQ ID NO: 1898137 - RNA, 19 nt, Human
acugaguacguugugcauu

SEQ ID NO: 1898138 - RNA, 23 nt, Human
acugaguacguugugcauuuggu

SEQ ID NO: 1898139 - RNA, 22 nt, Human
acugaguacguugugcauuugg

SEQ ID NO: 1898140 - RNA, 14 nt, Human
acugcaaccuccgc

SEQ ID NO: 1898141 - RNA, 13 nt, Human
acugcaaccuccg

SEQ ID NO: 1898142 - RNA, 22 nt, Human
acugcaaccuccgccucuuggg

SEQ ID NO: 1898143 - RNA, 16 nt, Human
acugcaaccuccgccu

SEQ ID NO: 1898144 - RNA, 14 nt, Human
ucauuuuaauuauu

SEQ ID NO: 1898145 - RNA, 13 nt, Human
ucauuuuaauuau

SEQ ID NO: 1898146 - RNA, 20 nt, Human
ucauuuuagggguagcauuu

SEQ ID NO: 1898147 - RNA, 19 nt, Human
ucauuuguuuguuuuccuu

SEQ ID NO: 1898148 - RNA, 21 nt, Human
ucauuugagcagggcucagcg

SEQ ID NO: 1898149 - RNA, 20 nt, Human
ucauuugcuaacuagcuugg

SEQ ID NO: 1898150 - RNA, 23 nt, Human
uccaaagucucuggaauuugaaa

SEQ ID NO: 1898151 - RNA, 13 nt, Human
ucauuuuuuuuaa

SEQ ID NO: 1898152 - RNA, 16 nt, Human
ucauuuuuuuccaggc

SEQ ID NO: 1898153 - RNA, 13 nt, Human
ucauuuuuuucca

SEQ ID NO: 1898154 - RNA, 18 nt, Human
ucauuuuuuuccaggcug

SEQ ID NO: 1898155 - RNA, 19 nt, Human
ucauuugagcagggcucag

SEQ ID NO: 1898156 - RNA, 17 nt, Human
accuggaauauauaacc

SEQ ID NO: 1898157 - RNA, 14 nt, Human
accuggaauauaua

SEQ ID NO: 1898158 - RNA, 18 nt, Human
accuggaacuuggggagu

SEQ ID NO: 1898159 - RNA, 23 nt, Human
accugcggugcuaucucccccag

SEQ ID NO: 1898160 - RNA, 19 nt, Human
accugcggugcuaucuccc

SEQ ID NO: 1898161 - RNA, 22 nt, Human
accugcggugcuaucuccccca

SEQ ID NO: 1898162 - RNA, 15 nt, Human
accugaagucuuugu

SEQ ID NO: 1898163 - RNA, 22 nt, Human
accugaagucuuuguacagaca

SEQ ID NO: 1898164 - RNA, 18 nt, Human
accugcggugcuaucucc

SEQ ID NO: 1898165 - RNA, 20 nt, Human
uccacaguggaaccagccca

SEQ ID NO: 1898166 - RNA, 16 nt, Human
uccacaguggaaccag

SEQ ID NO: 1898167 - RNA, 18 nt, Human
uccaccaagccuggucag

SEQ ID NO: 1898168 - RNA, 23 nt, Human
uccaccaagccuggucagcccaa

SEQ ID NO: 1898169 - RNA, 22 nt, Human
uccaccaagccuggucagccca

SEQ ID NO: 1898170 - RNA, 15 nt, Human
uccaccaggaaccuc

SEQ ID NO: 1898171 - RNA, 11 nt, Human
uccaagcuggu

SEQ ID NO: 1898172 - RNA, 12 nt, Human
uccaagcuggga

SEQ ID NO: 1898173 - RNA, 22 nt, Human
uccaagcugggagauucaaggg

SEQ ID NO: 1898174 - RNA, 14 nt, Human
uccacagugacucc

SEQ ID NO: 1898175 - RNA, 12 nt, Human
uccacagggcac

SEQ ID NO: 1898176 - RNA, 17 nt, Human
uccaacaccaagcacag

SEQ ID NO: 1898177 - RNA, 21 nt, Human
uccaacaccaagcacagcagc

SEQ ID NO: 1898178 - RNA, 23 nt, Human
uccaacaccaagcacagcagccu

SEQ ID NO: 1898179 - RNA, 20 nt, Human
uccaacacugauuuccccuu

SEQ ID NO: 1898180 - RNA, 17 nt, Human
uccaacagaagaacugu

SEQ ID NO: 1898181 - RNA, 14 nt, Human
uccaaccuucccaa

SEQ ID NO: 1898182 - RNA, 16 nt, Human
uccaagcucccaggca

SEQ ID NO: 1898183 - RNA, 14 nt, Human
uccaagcucccagg

SEQ ID NO: 1898184 - RNA, 15 nt, Human
uccaagcucccaggc

SEQ ID NO: 1898185 - RNA, 12 nt, Human
uccaagcuccca

SEQ ID NO: 1898186 - RNA, 13 nt, Human
uccaagcucccag

SEQ ID NO: 1898187 - RNA, 15 nt, Human
accugguccacaggg

SEQ ID NO: 1898188 - RNA, 16 nt, Human
accugguccacagggc

SEQ ID NO: 1898189 - RNA, 17 nt, Human
accugguccacagggca

SEQ ID NO: 1898190 - RNA, 18 nt, Human
accugguccacagggcac

SEQ ID NO: 1898191 - RNA, 15 nt, Human
uccaccaucaagcca

SEQ ID NO: 1898192 - RNA, 16 nt, Human
uccaccagucauuuuu

SEQ ID NO: 1898193 - RNA, 18 nt, Human
uccaccagucauuuuuca

SEQ ID NO: 1898194 - RNA, 19 nt, Human
uccaccaggaaccucuuca

SEQ ID NO: 1898195 - RNA, 21 nt, Human
uccaccaggaaccucuucaga

SEQ ID NO: 1898196 - RNA, 14 nt, Human
uccaccagucauuu

SEQ ID NO: 1898197 - RNA, 15 nt, Human
uccaccagucauuuu

SEQ ID NO: 1898198 - RNA, 17 nt, Human
accuuagacagucccug

SEQ ID NO: 1898199 - RNA, 23 nt, Human
accuuaggaauaaucuccuguua

SEQ ID NO: 1898200 - RNA, 13 nt, Human
accuuaggccuuc

SEQ ID NO: 1898201 - RNA, 21 nt, Human
accuuaggccuuccucucucc

SEQ ID NO: 1898202 - RNA, 18 nt, Human
accuuaggccuuccucuc

SEQ ID NO: 1898203 - RNA, 20 nt, Human
accuuaggccuuccucucuc

SEQ ID NO: 1898204 - RNA, 14 nt, Human
accuuaggccuucc

SEQ ID NO: 1898205 - RNA, 15 nt, Human
accuuaggccuuccu

SEQ ID NO: 1898206 - RNA, 16 nt, Human
accuuaggccuuccuc

SEQ ID NO: 1898207 - RNA, 17 nt, Human
accuuaggccuuccucu

SEQ ID NO: 1898208 - RNA, 12 nt, Human
accuucuccuuc

SEQ ID NO: 1898209 - RNA, 19 nt, Human
accuucccaaacgccuccc

SEQ ID NO: 1898210 - RNA, 21 nt, Human
accuucccaaacgccuccccu

SEQ ID NO: 1898211 - RNA, 22 nt, Human
accuucccaaacgccuccccug

SEQ ID NO: 1898212 - RNA, 14 nt, Human
accuucccaaacgc

SEQ ID NO: 1898213 - RNA, 17 nt, Human
accuuccaagagccuga

SEQ ID NO: 1898214 - RNA, 14 nt, Human
accuugacagggca

SEQ ID NO: 1898215 - RNA, 15 nt, Human
accuugaaugaugcc

SEQ ID NO: 1898216 - RNA, 15 nt, Human
accuugacagggcac

SEQ ID NO: 1898217 - RNA, 16 nt, Human
accuugacagggcaca

SEQ ID NO: 1898218 - RNA, 13 nt, Human
accuucuccuuca

SEQ ID NO: 1898219 - RNA, 15 nt, Human
uccagccccuggaug

SEQ ID NO: 1898220 - RNA, 16 nt, Human
uccagccccuggaugc

SEQ ID NO: 1898221 - RNA, 17 nt, Human
uccagccccuggaugca

SEQ ID NO: 1898222 - RNA, 19 nt, Human
uccagccccuggaugcagc

SEQ ID NO: 1898223 - RNA, 21 nt, Human
uccagccccuggaugcagccu

SEQ ID NO: 1898224 - RNA, 22 nt, Human
uccagccccuggaugcagccuc

SEQ ID NO: 1898225 - RNA, 20 nt, Human
uccagccugagcgacaguga

SEQ ID NO: 1898226 - RNA, 21 nt, Human
uccagccugagcgacagugag

SEQ ID NO: 1898227 - RNA, 11 nt, Human
uccagccugcc

SEQ ID NO: 1898228 - RNA, 19 nt, Human
accuuuguauucucuccug

SEQ ID NO: 1898229 - RNA, 15 nt, Human
accuuuguauucucu

SEQ ID NO: 1898230 - RNA, 23 nt, Human
accuuuguauucucuccuguacc

SEQ ID NO: 1898231 - RNA, 22 nt, Human
uccagaaguuugagaucagccu

SEQ ID NO: 1898232 - RNA, 13 nt, Human
uccagaaugcugu

SEQ ID NO: 1898233 - RNA, 15 nt, Human
uccagaaugcuguac

SEQ ID NO: 1898234 - RNA, 16 nt, Human
uccagaaugcuguaca

SEQ ID NO: 1898235 - RNA, 17 nt, Human
uccagaaugcuguacau

SEQ ID NO: 1898236 - RNA, 22 nt, Human
uccacucucccccacccccucc

SEQ ID NO: 1898237 - RNA, 13 nt, Human
accuagccuuaga

SEQ ID NO: 1898238 - RNA, 14 nt, Human
accuagcagcaccg

SEQ ID NO: 1898239 - RNA, 21 nt, Human
accuagcagcaccguucugug

SEQ ID NO: 1898240 - RNA, 22 nt, Human
accuagcagcaccguucugugc

SEQ ID NO: 1898241 - RNA, 23 nt, Human
accuagcagcaccguucugugca

SEQ ID NO: 1898242 - RNA, 12 nt, Human
accuauccacac

SEQ ID NO: 1898243 - RNA, 14 nt, Human
accguucugugcac

SEQ ID NO: 1898244 - RNA, 20 nt, Human
accuaauccaggcagaucca

SEQ ID NO: 1898245 - RNA, 21 nt, Human
accuaauccaggcagauccag

SEQ ID NO: 1898246 - RNA, 15 nt, Human
accuaauccaggcag

SEQ ID NO: 1898247 - RNA, 20 nt, Human
accuccgccucuuggguuca

SEQ ID NO: 1898248 - RNA, 10 nt, Human
acccuuuucu

SEQ ID NO: 1898249 - RNA, 20 nt, Human
ucauauuuacuucuuauaca

SEQ ID NO: 1898250 - RNA, 21 nt, Human
ucauauuuacuucuuauacau

SEQ ID NO: 1898251 - RNA, 22 nt, Human
ucauauuuacuucuuauacauu

SEQ ID NO: 1898252 - RNA, 16 nt, Human
ucauauuuacuucuua

SEQ ID NO: 1898253 - RNA, 12 nt, Human
ucauauugaaua

SEQ ID NO: 1898254 - RNA, 17 nt, Human
accgccaaggcuggggg

SEQ ID NO: 1898255 - RNA, 20 nt, Human
accgcagacaggaccaggga

SEQ ID NO: 1898256 - RNA, 16 nt, Human
accgugggcagggagc

SEQ ID NO: 1898257 - RNA, 18 nt, Human
accgugggcagggagcgg

SEQ ID NO: 1898258 - RNA, 16 nt, Human
accgccuccuacagcc

SEQ ID NO: 1898259 - RNA, 13 nt, Human
accucucccuugg

SEQ ID NO: 1898260 - RNA, 14 nt, Human
accucucccugacc

SEQ ID NO: 1898261 - RNA, 17 nt, Human
accucucccugacccug

SEQ ID NO: 1898262 - RNA, 22 nt, Human
accucucccugacccuguauau

SEQ ID NO: 1898263 - RNA, 23 nt, Human
accucucccugacccuguauaua

SEQ ID NO: 1898264 - RNA, 14 nt, Human
accucucccuugga

SEQ ID NO: 1898265 - RNA, 15 nt, Human
accucucccuuggau

SEQ ID NO: 1898266 - RNA, 21 nt, Human
accucuaaauucuuucauuuu

SEQ ID NO: 1898267 - RNA, 12 nt, Human
accucugcacaa

SEQ ID NO: 1898268 - RNA, 13 nt, Human
accucugauaccu

SEQ ID NO: 1898269 - RNA, 15 nt, Human
accucugauaccuca

SEQ ID NO: 1898270 - RNA, 22 nt, Human
accucucuuauagaauauuuau

SEQ ID NO: 1898271 - RNA, 23 nt, Human
accucucuuauagaauauuuauu

SEQ ID NO: 1898272 - RNA, 23 nt, Human
accucucccuuggauuguccccg

SEQ ID NO: 1898273 - RNA, 14 nt, Human
accucucucacucc

SEQ ID NO: 1898274 - RNA, 19 nt, Human
accucucucacuccuugaa

SEQ ID NO: 1898275 - RNA, 14 nt, Human
accucuccucaugu

SEQ ID NO: 1898276 - RNA, 17 nt, Human
accucggugccuuccuc

SEQ ID NO: 1898277 - RNA, 18 nt, Human
accucuaaauucuuucau

SEQ ID NO: 1898278 - RNA, 21 nt, Human
ucauuggauucugagagcugu

SEQ ID NO: 1898279 - RNA, 19 nt, Human
ucauugaccugaggcccuu

SEQ ID NO: 1898280 - RNA, 21 nt, Human
ucauucuccuuguguuacuaa

SEQ ID NO: 1898281 - RNA, 15 nt, Human
ucauucguucugugg

SEQ ID NO: 1898282 - RNA, 18 nt, Human
ucauucuaaugauggccc

SEQ ID NO: 1898283 - RNA, 22 nt, Human
ucauugaccugaggcccuucuc

SEQ ID NO: 1898284 - RNA, 13 nt, Human
ucaugucuggcua

SEQ ID NO: 1898285 - RNA, 14 nt, Human
ucaugugaaaucau

SEQ ID NO: 1898286 - RNA, 17 nt, Human
ucauguucuuaauucuu

SEQ ID NO: 1898287 - RNA, 11 nt, Human
ucauguucuua

SEQ ID NO: 1898288 - RNA, 23 nt, Human
ucauccacugugccaugugccag

SEQ ID NO: 1898289 - RNA, 21 nt, Human
ucauccacugugccaugugcc

SEQ ID NO: 1898290 - RNA, 19 nt, Human
ucauccacugugccaugug

SEQ ID NO: 1898291 - RNA, 19 nt, Human
ucaugacaaagacugagua

SEQ ID NO: 1898292 - RNA, 15 nt, Human
ucaugaccagcaaau

SEQ ID NO: 1898293 - RNA, 16 nt, Human
ucaugaccagcaaaua

SEQ ID NO: 1898294 - RNA, 22 nt, Human
ucaugauagaaggcuaugggga

SEQ ID NO: 1898295 - RNA, 17 nt, Human
accccuuucuggcucuc

SEQ ID NO: 1898296 - RNA, 20 nt, Human
accccuucgcuccugugucu

SEQ ID NO: 1898297 - RNA, 21 nt, Human
acccgagucauucguucugug

SEQ ID NO: 1898298 - RNA, 15 nt, Human
acccuccacucuccu

SEQ ID NO: 1898299 - RNA, 14 nt, Human
acccucuuagaaaa

SEQ ID NO: 1898300 - RNA, 13 nt, Human
acccucuucaugg

SEQ ID NO: 1898301 - RNA, 14 nt, Human
acccugcccugugg

SEQ ID NO: 1898302 - RNA, 13 nt, Human
acccugcccugug

SEQ ID NO: 1898303 - RNA, 11 nt, Human
acccugcccug

SEQ ID NO: 1898304 - RNA, 12 nt, Human
acccugcccugu

SEQ ID NO: 1898305 - RNA, 16 nt, Human
acccuuguggucccac

SEQ ID NO: 1898306 - RNA, 17 nt, Human
acccuuguggucccacc

SEQ ID NO: 1898307 - RNA, 19 nt, Human
acccuuguggucccacccc

SEQ ID NO: 1898308 - RNA, 23 nt, Human
acccuucuccucuuguaaauaaa

SEQ ID NO: 1898309 - RNA, 15 nt, Human
acccuucuccucuug

SEQ ID NO: 1898310 - RNA, 17 nt, Human
acccuucuccucuugua

SEQ ID NO: 1898311 - RNA, 19 nt, Human
acccuucuccucuuguaaa

SEQ ID NO: 1898312 - RNA, 21 nt, Human
acccuucuccucuuguaaaua

SEQ ID NO: 1898313 - RNA, 18 nt, Human
ucagcggggacagcuccu

SEQ ID NO: 1898314 - RNA, 13 nt, Human
ucaggaagaacac

SEQ ID NO: 1898315 - RNA, 17 nt, Human
ucagcggggacagcucc

SEQ ID NO: 1898316 - RNA, 16 nt, Human
ucagcggggacagcuc

SEQ ID NO: 1898317 - RNA, 15 nt, Human
ucagcggggacagcu

SEQ ID NO: 1898318 - RNA, 19 nt, Human
ucagccuggccagacacag

SEQ ID NO: 1898319 - RNA, 20 nt, Human
ucagccuggccagacacagg

SEQ ID NO: 1898320 - RNA, 20 nt, Human
ucaggccaaacucaccugcc

SEQ ID NO: 1898321 - RNA, 23 nt, Human
ucaggccaaacucaccugccccu

SEQ ID NO: 1898322 - RNA, 22 nt, Human
ucaggaagaacacccucuaaau

SEQ ID NO: 1898323 - RNA, 16 nt, Human
ucaggaagcucagggc

SEQ ID NO: 1898324 - RNA, 17 nt, Human
ucaggaagcucagggcc

SEQ ID NO: 1898325 - RNA, 19 nt, Human
ucaggaagcucagggccug

SEQ ID NO: 1898326 - RNA, 20 nt, Human
ucaggaagcucagggccugg

SEQ ID NO: 1898327 - RNA, 19 nt, Human
accccuucgcuccuguguc

SEQ ID NO: 1898328 - RNA, 16 nt, Human
ucagguaacaggcaga

SEQ ID NO: 1898329 - RNA, 15 nt, Human
ucagguaacaggcag

SEQ ID NO: 1898330 - RNA, 13 nt, Human
ucagguaacaggc

SEQ ID NO: 1898331 - RNA, 13 nt, Human
ucagggucccugg

SEQ ID NO: 1898332 - RNA, 15 nt, Human
ucagggucauagcau

SEQ ID NO: 1898333 - RNA, 14 nt, Human
ucagggucccuggu

SEQ ID NO: 1898334 - RNA, 18 nt, Human
ucagggucccugguggca

SEQ ID NO: 1898335 - RNA, 15 nt, Human
ucaggccagcugcuu

SEQ ID NO: 1898336 - RNA, 20 nt, Human
ucaggccagcugcuugggcu

SEQ ID NO: 1898337 - RNA, 11 nt, Human
ucaggccaggc

SEQ ID NO: 1898338 - RNA, 12 nt, Human
ucaggccaggcc

SEQ ID NO: 1898339 - RNA, 14 nt, Human
ucaggcccaaagcc

SEQ ID NO: 1898340 - RNA, 15 nt, Human
ucaggccgaaggagg

SEQ ID NO: 1898341 - RNA, 13 nt, Human
ucagaagacacug

SEQ ID NO: 1898342 - RNA, 13 nt, Human
ucagaucuucugu

SEQ ID NO: 1898343 - RNA, 12 nt, Human
ucagaagaaauu

SEQ ID NO: 1898344 - RNA, 22 nt, Human
ucagaacucaaauggggccaga

SEQ ID NO: 1898345 - RNA, 21 nt, Human
ucagaacucaaauggggccag

SEQ ID NO: 1898346 - RNA, 13 nt, Human
acccagcucuggu

SEQ ID NO: 1898347 - RNA, 15 nt, Human
acccagcucuggucc

SEQ ID NO: 1898348 - RNA, 22 nt, Human
acccagcuaugguucucucgca

SEQ ID NO: 1898349 - RNA, 13 nt, Human
ucagcccugaccc

SEQ ID NO: 1898350 - RNA, 16 nt, Human
ucagcccugacccugu

SEQ ID NO: 1898351 - RNA, 15 nt, Human
acccccagccugcua

SEQ ID NO: 1898352 - RNA, 19 nt, Human
accccauuucucuccucac

SEQ ID NO: 1898353 - RNA, 14 nt, Human
acccccagccugcu

SEQ ID NO: 1898354 - RNA, 14 nt, Human
accccauuucucuc

SEQ ID NO: 1898355 - RNA, 15 nt, Human
accccauuucucucc

SEQ ID NO: 1898356 - RNA, 15 nt, Human
acccagugcccccac

SEQ ID NO: 1898357 - RNA, 18 nt, Human
acccagugcccccacuga

SEQ ID NO: 1898358 - RNA, 14 nt, Human
acccccgcccccug

SEQ ID NO: 1898359 - RNA, 21 nt, Human
acccccgcccccugcccuccc

SEQ ID NO: 1898360 - RNA, 15 nt, Human
acccccgcccccugc

SEQ ID NO: 1898361 - RNA, 18 nt, Human
acccccgcccccugcccu

SEQ ID NO: 1898362 - RNA, 19 nt, Human
acccccgcccccugcccuc

SEQ ID NO: 1898363 - RNA, 20 nt, Human
acccccgcccccugcccucc

SEQ ID NO: 1898364 - RNA, 18 nt, Human
acccccagcuccggccug

SEQ ID NO: 1898365 - RNA, 16 nt, Human
acccccaggaccccug

SEQ ID NO: 1898366 - RNA, 17 nt, Human
acccccauuucuauuua

SEQ ID NO: 1898367 - RNA, 18 nt, Human
acccccauuucuauuuau

SEQ ID NO: 1898368 - RNA, 19 nt, Human
ucagccuggcuucaaauug

SEQ ID NO: 1898369 - RNA, 10 nt, Human
ucagccuggg

SEQ ID NO: 1898370 - RNA, 12 nt, Human
ucagccugggca

SEQ ID NO: 1898371 - RNA, 22 nt, Human
accccuggcuccaggccagggg

SEQ ID NO: 1898372 - RNA, 20 nt, Human
accccuggcuccaggccagg

SEQ ID NO: 1898373 - RNA, 19 nt, Human
accccuggcuccaggccag

SEQ ID NO: 1898374 - RNA, 23 nt, Human
accccucccuuucuccccugccc

SEQ ID NO: 1898375 - RNA, 19 nt, Human
accccucccuuucuccccu

SEQ ID NO: 1898376 - RNA, 18 nt, Human
accccucccuuucucccc

SEQ ID NO: 1898377 - RNA, 16 nt, Human
accccucccuuucucc

SEQ ID NO: 1898378 - RNA, 14 nt, Human
accccucccuuucu

SEQ ID NO: 1898379 - RNA, 13 nt, Human
accccucccuuuc

SEQ ID NO: 1898380 - RNA, 15 nt, Human
acccccuccccgccc

SEQ ID NO: 1898381 - RNA, 18 nt, Human
acccaagaccucagggca

SEQ ID NO: 1898382 - RNA, 19 nt, Human
acccaagaccucagggcac

SEQ ID NO: 1898383 - RNA, 19 nt, Human
acccaacuagcucuauguu

SEQ ID NO: 1898384 - RNA, 19 nt, Human
acccacuugcuuuuaaaau

SEQ ID NO: 1898385 - RNA, 16 nt, Human
acccagaagaaaauag

SEQ ID NO: 1898386 - RNA, 18 nt, Human
acccaaaaggcagaagca

SEQ ID NO: 1898387 - RNA, 21 nt, Human
acccaaauguucaucaaugaa

SEQ ID NO: 1898388 - RNA, 18 nt, Human
acccagcccacuucugcc

SEQ ID NO: 1898389 - RNA, 17 nt, Human
acccagcccacuucugc

SEQ ID NO: 1898390 - RNA, 16 nt, Human
acccagcccacuucug

SEQ ID NO: 1898391 - RNA, 23 nt, Human
accauuuugggguacccacugcu

SEQ ID NO: 1898392 - RNA, 15 nt, Human
acccaaaaggcagaa

SEQ ID NO: 1898393 - RNA, 13 nt, Human
acccaaaaggcag

SEQ ID NO: 1898394 - RNA, 23 nt, Human
accauuuauacaaauuagaaaau

SEQ ID NO: 1898395 - RNA, 21 nt, Human
accauuuaaaaacaggcagcu

SEQ ID NO: 1898396 - RNA, 23 nt, Human
accauuuaaaaacaggcagcuca

SEQ ID NO: 1898397 - RNA, 13 nt, Human
accauuuauacaa

SEQ ID NO: 1898398 - RNA, 16 nt, Human
accauuuauacaaauu

SEQ ID NO: 1898399 - RNA, 19 nt, Human
accauuuauacaaauuaga

SEQ ID NO: 1898400 - RNA, 21 nt, Human
accauuuauacaaauuagaaa

SEQ ID NO: 1898401 - RNA, 22 nt, Human
accauuuauacaaauuagaaaa

SEQ ID NO: 1898402 - RNA, 23 nt, Human
accaugauuaaccacuucagcug

SEQ ID NO: 1898403 - RNA, 22 nt, Human
accaugauuaaccacuucagcu

SEQ ID NO: 1898404 - RNA, 23 nt, Human
accaugaagucucuaacaaugua

SEQ ID NO: 1898405 - RNA, 13 nt, Human
accauucuccacc

SEQ ID NO: 1898406 - RNA, 16 nt, Human
accauucuccaccugc

SEQ ID NO: 1898407 - RNA, 18 nt, Human
accauucuccaccugcca

SEQ ID NO: 1898408 - RNA, 14 nt, Human
accauuuaaaaaca

SEQ ID NO: 1898409 - RNA, 16 nt, Human
accauuuaaaaacagg

SEQ ID NO: 1898410 - RNA, 21 nt, Human
accaguguuguggauuuaaca

SEQ ID NO: 1898411 - RNA, 18 nt, Human
ucacuguugcccaggcug

SEQ ID NO: 1898412 - RNA, 17 nt, Human
ucacuguugcccaggcu

SEQ ID NO: 1898413 - RNA, 19 nt, Human
ucacuguugcccaggcugg

SEQ ID NO: 1898414 - RNA, 19 nt, Human
accagggagcugcaggggc

SEQ ID NO: 1898415 - RNA, 14 nt, Human
ucacugucuuuccu

SEQ ID NO: 1898416 - RNA, 20 nt, Human
accagggagccccuuugaug

SEQ ID NO: 1898417 - RNA, 16 nt, Human
accagggauuguuucu

SEQ ID NO: 1898418 - RNA, 18 nt, Human
accagggauuguuucugu

SEQ ID NO: 1898419 - RNA, 19 nt, Human
accagggauuguuucuguu

SEQ ID NO: 1898420 - RNA, 12 nt, Human
ucacugcagccu

SEQ ID NO: 1898421 - RNA, 13 nt, Human
ucacugcagccuc

SEQ ID NO: 1898422 - RNA, 16 nt, Human
ucacuguugcccaggc

SEQ ID NO: 1898423 - RNA, 12 nt, Human
ucacugucuuuc

SEQ ID NO: 1898424 - RNA, 19 nt, Human
ucacuguccuccaagccag

SEQ ID NO: 1898425 - RNA, 15 nt, Human
ucacuguccuccaag

SEQ ID NO: 1898426 - RNA, 16 nt, Human
ucacuguccuccaagc

SEQ ID NO: 1898427 - RNA, 16 nt, Human
ucaccugccccucaac

SEQ ID NO: 1898428 - RNA, 13 nt, Human
ucacugagacagc

SEQ ID NO: 1898429 - RNA, 14 nt, Human
ucacugagacagcc

SEQ ID NO: 1898430 - RNA, 15 nt, Human
ucacugagacagccc

SEQ ID NO: 1898431 - RNA, 14 nt, Human
accacaucuugcuc

SEQ ID NO: 1898432 - RNA, 22 nt, Human
accacagacauacuaaccagca

SEQ ID NO: 1898433 - RNA, 21 nt, Human
accacagacauacuaaccagc

SEQ ID NO: 1898434 - RNA, 15 nt, Human
accacagcacagcca

SEQ ID NO: 1898435 - RNA, 16 nt, Human
accacagcacagccaa

SEQ ID NO: 1898436 - RNA, 20 nt, Human
uauuucaguuuuaaauguac

SEQ ID NO: 1898437 - RNA, 22 nt, Human
accacacuggacuccggcccuc

SEQ ID NO: 1898438 - RNA, 24 nt, Human
accacaucuugcucugcugacaga

SEQ ID NO: 1898439 - RNA, 21 nt, Human
accacaucuugcucugcugac

SEQ ID NO: 1898440 - RNA, 20 nt, Human
accacaucuugcucugcuga

SEQ ID NO: 1898441 - RNA, 16 nt, Human
accacaucuugcucug

SEQ ID NO: 1898442 - RNA, 20 nt, Human
accacucuaucaaguauuau

SEQ ID NO: 1898443 - RNA, 16 nt, Human
accacaucuaagccug

SEQ ID NO: 1898444 - RNA, 20 nt, Human
accacaucuaagccugaagg

SEQ ID NO: 1898445 - RNA, 15 nt, Human
accacuucagcugac

SEQ ID NO: 1898446 - RNA, 13 nt, Human
accacuucagcug

SEQ ID NO: 1898447 - RNA, 14 nt, Human
accacuucagcuga

SEQ ID NO: 1898448 - RNA, 19 nt, Human
accacugcagaagacagua

SEQ ID NO: 1898449 - RNA, 14 nt, Human
accacugcagaaga

SEQ ID NO: 1898450 - RNA, 13 nt, Human
accacugcagaag

SEQ ID NO: 1898451 - RNA, 17 nt, Human
accagacaccuugacag

SEQ ID NO: 1898452 - RNA, 12 nt, Human
accacuuuuguu

SEQ ID NO: 1898453 - RNA, 23 nt, Human
accagacaccuugacagggcaca

SEQ ID NO: 1898454 - RNA, 22 nt, Human
accagacaccuugacagggcac

SEQ ID NO: 1898455 - RNA, 22 nt, Human
accagagcccaccuuggcucaa

SEQ ID NO: 1898456 - RNA, 19 nt, Human
accagagcccaccuuggcu

SEQ ID NO: 1898457 - RNA, 15 nt, Human
accagccugaccaaa

SEQ ID NO: 1898458 - RNA, 11 nt, Human
accagccuggc

SEQ ID NO: 1898459 - RNA, 12 nt, Human
accagccuggcc

SEQ ID NO: 1898460 - RNA, 15 nt, Human
accagccuggccaac

SEQ ID NO: 1898461 - RNA, 20 nt, Human
accagccuggccaacauggu

SEQ ID NO: 1898462 - RNA, 20 nt, Human
accagccuggucaacauggu

SEQ ID NO: 1898463 - RNA, 23 nt, Human
ucaccugaagacucauucuucug

SEQ ID NO: 1898464 - RNA, 14 nt, Human
ucaccuccugcugg

SEQ ID NO: 1898465 - RNA, 15 nt, Human
ucaccuccugcuggg

SEQ ID NO: 1898466 - RNA, 19 nt, Human
ucaccugaagacucauucu

SEQ ID NO: 1898467 - RNA, 12 nt, Human
ucaccuccugcu

SEQ ID NO: 1898468 - RNA, 13 nt, Human
ucaccuccugcug

SEQ ID NO: 1898469 - RNA, 23 nt, Human
ugaggggucgacuucgggcuggc

SEQ ID NO: 1898470 - RNA, 22 nt, Human
ugagggggaauagucuagaugg

SEQ ID NO: 1898471 - RNA, 13 nt, Human
ugaggggccucuu

SEQ ID NO: 1898472 - RNA, 12 nt, Human
ugaggggccucu

SEQ ID NO: 1898473 - RNA, 19 nt, Human
ugagggauacccaucccau

SEQ ID NO: 1898474 - RNA, 23 nt, Human
ugagggaucuauacuugcuuugu

SEQ ID NO: 1898475 - RNA, 16 nt, Human
ugaggcccuucucucc

SEQ ID NO: 1898476 - RNA, 18 nt, Human
ugaggcccuucucuccag

SEQ ID NO: 1898477 - RNA, 19 nt, Human
ugaggcccuucucuccagc

SEQ ID NO: 1898478 - RNA, 20 nt, Human
ugaggcccuucucuccagcc

SEQ ID NO: 1898479 - RNA, 22 nt, Human
ugaggcccuucucuccagcccc

SEQ ID NO: 1898480 - RNA, 23 nt, Human
ugaggcccuucucuccagccccu

SEQ ID NO: 1898481 - RNA, 24 nt, Human
ugaggcccuucucuccagccccug

SEQ ID NO: 1898482 - RNA, 17 nt, Human
agcagaggaaggagagg

SEQ ID NO: 1898483 - RNA, 12 nt, Human
agcagaggaggg

SEQ ID NO: 1898484 - RNA, 15 nt, Human
agcagaggaggggcc

SEQ ID NO: 1898485 - RNA, 19 nt, Human
agcagaggaggggccgcug

SEQ ID NO: 1898486 - RNA, 21 nt, Human
agcagaggaggggccgcugcc

SEQ ID NO: 1898487 - RNA, 20 nt, Human
agcagaggauaauuagcauc

SEQ ID NO: 1898488 - RNA, 22 nt, Human
agcagaggaggggccgcugcca

SEQ ID NO: 1898489 - RNA, 19 nt, Human
agcagauggagaccccuug

SEQ ID NO: 1898490 - RNA, 19 nt, Human
agcagaugcaaugacucag

SEQ ID NO: 1898491 - RNA, 13 nt, Human
agcagauuuuaau

SEQ ID NO: 1898492 - RNA, 21 nt, Human
agcagauuuuaauuuugaaua

SEQ ID NO: 1898493 - RNA, 22 nt, Human
agcagauuuuaauuuugaauaa

SEQ ID NO: 1898494 - RNA, 20 nt, Human
ugaggguugggcugguguca

SEQ ID NO: 1898495 - RNA, 22 nt, Human
ugagggugacuauggagcugag

SEQ ID NO: 1898496 - RNA, 17 nt, Human
ugagguacugagaguga

SEQ ID NO: 1898497 - RNA, 13 nt, Human
ugaggucagagcc

SEQ ID NO: 1898498 - RNA, 22 nt, Human
ugagguacugagagugaacaaa

SEQ ID NO: 1898499 - RNA, 16 nt, Human
ugaggucagagccugc

SEQ ID NO: 1898500 - RNA, 14 nt, Human
ugaggucagagccu

SEQ ID NO: 1898501 - RNA, 17 nt, Human
ugaggucagagccugca

SEQ ID NO: 1898502 - RNA, 17 nt, Human
agcagagaccaucccug

SEQ ID NO: 1898503 - RNA, 18 nt, Human
agcagagaccaucccuga

SEQ ID NO: 1898504 - RNA, 19 nt, Human
agcagagaccaucccugaa

SEQ ID NO: 1898505 - RNA, 20 nt, Human
agcagagaccaucccugaag

SEQ ID NO: 1898506 - RNA, 20 nt, Human
agcagagcaccuuagacagu

SEQ ID NO: 1898507 - RNA, 16 nt, Human
ugagcuacaaaugcau

SEQ ID NO: 1898508 - RNA, 21 nt, Human
ugagcggugcuguccucaggu

SEQ ID NO: 1898509 - RNA, 20 nt, Human
ugagcggugcuguccucagg

SEQ ID NO: 1898510 - RNA, 14 nt, Human
ugagcuaggaauug

SEQ ID NO: 1898511 - RNA, 13 nt, Human
ugagccuuguaau

SEQ ID NO: 1898512 - RNA, 22 nt, Human
ugagcgcuccugccgcagagcu

SEQ ID NO: 1898513 - RNA, 18 nt, Human
ugagcgcuccugccgcag

SEQ ID NO: 1898514 - RNA, 14 nt, Human
ugagcgcuccugcc

SEQ ID NO: 1898515 - RNA, 12 nt, Human
ugagcgccagga

SEQ ID NO: 1898516 - RNA, 14 nt, Human
ugagcuacaaaugc

SEQ ID NO: 1898517 - RNA, 13 nt, Human
ugagcuacaaaug

SEQ ID NO: 1898518 - RNA, 15 nt, Human
ugaggaagcaaaagc

SEQ ID NO: 1898519 - RNA, 24 nt, Human
ugaggaagaacggggcucuucuca

SEQ ID NO: 1898520 - RNA, 23 nt, Human
ugaggaagaacggggcucuucuc

SEQ ID NO: 1898521 - RNA, 19 nt, Human
ugaggaagaacggggcucu

SEQ ID NO: 1898522 - RNA, 17 nt, Human
ugaggaagaacggggcu

SEQ ID NO: 1898523 - RNA, 23 nt, Human
ugaggaaaaaaaucguccaggga

SEQ ID NO: 1898524 - RNA, 16 nt, Human
ugaggaaacaacagcu

SEQ ID NO: 1898525 - RNA, 22 nt, Human
ugaggaagcaaaagcaucuaug

SEQ ID NO: 1898526 - RNA, 14 nt, Human
ugaggaagccgcug

SEQ ID NO: 1898527 - RNA, 17 nt, Human
ugaggaagccgcugggg

SEQ ID NO: 1898528 - RNA, 18 nt, Human
ugaggaagccgcuggggc

SEQ ID NO: 1898529 - RNA, 19 nt, Human
ugaggaagccgcuggggcc

SEQ ID NO: 1898530 - RNA, 21 nt, Human
ugaggaagccgcuggggccag

SEQ ID NO: 1898531 - RNA, 17 nt, Human
ugaggaagagggacugu

SEQ ID NO: 1898532 - RNA, 22 nt, Human
ugaggaauccagacccggcugc

SEQ ID NO: 1898533 - RNA, 21 nt, Human
ugaggaauccagacccggcug

SEQ ID NO: 1898534 - RNA, 21 nt, Human
ugaggacacuaaccacgcugg

SEQ ID NO: 1898535 - RNA, 12 nt, Human
ugaggccagaga

SEQ ID NO: 1898536 - RNA, 20 nt, Human
ugaggccacacucagcacaa

SEQ ID NO: 1898537 - RNA, 23 nt, Human
ugaggccacacucagcacaaggc

SEQ ID NO: 1898538 - RNA, 12 nt, Human
ugaggccacacu

SEQ ID NO: 1898539 - RNA, 13 nt, Human
ugaggccacacuc

SEQ ID NO: 1898540 - RNA, 19 nt, Human
ugaggccacacucagcaca

SEQ ID NO: 1898541 - RNA, 12 nt, Human
ugaggcccagag

SEQ ID NO: 1898542 - RNA, 13 nt, Human
ugaggcccagagg

SEQ ID NO: 1898543 - RNA, 20 nt, Human
ugaggccagagacacaagcc

SEQ ID NO: 1898544 - RNA, 14 nt, Human
ugaggccagagaca

SEQ ID NO: 1898545 - RNA, 16 nt, Human
ugaggccagagacaca

SEQ ID NO: 1898546 - RNA, 23 nt, Human
ugaggcccagagggccugcaagg

SEQ ID NO: 1898547 - RNA, 21 nt, Human
ugaggcccagagggccugcaa

SEQ ID NO: 1898548 - RNA, 22 nt, Human
ugaggcccagagggccugcaag

SEQ ID NO: 1898549 - RNA, 15 nt, Human
ugaggcccagagggc

SEQ ID NO: 1898550 - RNA, 17 nt, Human
ugaggcccagagggccu

SEQ ID NO: 1898551 - RNA, 18 nt, Human
ugaggcccagagggccug

SEQ ID NO: 1898552 - RNA, 20 nt, Human
ugaggcccagagggccugca

SEQ ID NO: 1898553 - RNA, 21 nt, Human
agcagacaguguuuucuggga

SEQ ID NO: 1898554 - RNA, 12 nt, Human
agcagacaggcc

SEQ ID NO: 1898555 - RNA, 16 nt, Human
agcagacugaucagga

SEQ ID NO: 1898556 - RNA, 17 nt, Human
agcagacugaucaggac

SEQ ID NO: 1898557 - RNA, 18 nt, Human
agcagacugaucaggacc

SEQ ID NO: 1898558 - RNA, 19 nt, Human
agcagacugaucaggaccu

SEQ ID NO: 1898559 - RNA, 21 nt, Human
agcagagaaugaaagggccca

SEQ ID NO: 1898560 - RNA, 23 nt, Human
agcagagaaugaaagggcccaga

SEQ ID NO: 1898561 - RNA, 22 nt, Human
agcagagaaugaaagggcccag

SEQ ID NO: 1898562 - RNA, 14 nt, Human
agcagagaauucuc

SEQ ID NO: 1898563 - RNA, 21 nt, Human
agcagagaauucucuuaucca

SEQ ID NO: 1898564 - RNA, 15 nt, Human
agcagagaccauccc

SEQ ID NO: 1898565 - RNA, 16 nt, Human
agcagagaccaucccu

SEQ ID NO: 1898566 - RNA, 10 nt, Human
ugagccuggc

SEQ ID NO: 1898567 - RNA, 14 nt, Human
ugagccugggaggu

SEQ ID NO: 1898568 - RNA, 11 nt, Human
ugagccuggca

SEQ ID NO: 1898569 - RNA, 16 nt, Human
ugagccuggcaagaau

SEQ ID NO: 1898570 - RNA, 19 nt, Human
ugagccugggaggucaagg

SEQ ID NO: 1898571 - RNA, 22 nt, Human
ugagccugggaggucaaggcug

SEQ ID NO: 1898572 - RNA, 14 nt, Human
ugagccuugaacuu

SEQ ID NO: 1898573 - RNA, 19 nt, Human
ugagccuugaacuuugacc

SEQ ID NO: 1898574 - RNA, 18 nt, Human
ugagccuugaacuuugac

SEQ ID NO: 1898575 - RNA, 17 nt, Human
ugagccuugaacuuuga

SEQ ID NO: 1898576 - RNA, 15 nt, Human
ugagccuugaacuuu

SEQ ID NO: 1898577 - RNA, 20 nt, Human
ugagcgacagugagacucug

SEQ ID NO: 1898578 - RNA, 16 nt, Human
ugagcgacagugagac

SEQ ID NO: 1898579 - RNA, 14 nt, Human
ugagcgacagugag

SEQ ID NO: 1898580 - RNA, 13 nt, Human
ugagcgacaguga

SEQ ID NO: 1898581 - RNA, 18 nt, Human
agcacgaaauguuauuuu

SEQ ID NO: 1898582 - RNA, 16 nt, Human
agcacgauuucuguuu

SEQ ID NO: 1898583 - RNA, 15 nt, Human
agcacgauuucuguu

SEQ ID NO: 1898584 - RNA, 14 nt, Human
agcacgauuucugu

SEQ ID NO: 1898585 - RNA, 17 nt, Human
agcacgaaauguuauuu

SEQ ID NO: 1898586 - RNA, 13 nt, Human
agcacgauuucug

SEQ ID NO: 1898587 - RNA, 23 nt, Human
agcaccuuagacagucccugcca

SEQ ID NO: 1898588 - RNA, 19 nt, Human
agcaccuuagacagucccu

SEQ ID NO: 1898589 - RNA, 20 nt, Human
agcaccuuagacagucccug

SEQ ID NO: 1898590 - RNA, 21 nt, Human
agcaccuuagacagucccugc

SEQ ID NO: 1898591 - RNA, 22 nt, Human
agcaccuuagacagucccugcc

SEQ ID NO: 1898592 - RNA, 22 nt, Human
agcacuuugggaggccaaggug

SEQ ID NO: 1898593 - RNA, 14 nt, Human
agcacuuugggagg

SEQ ID NO: 1898594 - RNA, 16 nt, Human
agcacuuguccagcug

SEQ ID NO: 1898595 - RNA, 22 nt, Human
agcacuuucuacaaugugaacu

SEQ ID NO: 1898596 - RNA, 23 nt, Human
agcacuuugggaggccaaggugg

SEQ ID NO: 1898597 - RNA, 16 nt, Human
agcacuuugggaggcu

SEQ ID NO: 1898598 - RNA, 18 nt, Human
agcagaaaggcacgucca

SEQ ID NO: 1898599 - RNA, 13 nt, Human
agcagaaaugccu

SEQ ID NO: 1898600 - RNA, 12 nt, Human
agcagaaaugcc

SEQ ID NO: 1898601 - RNA, 19 nt, Human
agcagaaaugccuuacccu

SEQ ID NO: 1898602 - RNA, 14 nt, Human
agcagaacagugau

SEQ ID NO: 1898603 - RNA, 23 nt, Human
agcagaaggggguggugucucca

SEQ ID NO: 1898604 - RNA, 22 nt, Human
agcagaaggggguggugucucc

SEQ ID NO: 1898605 - RNA, 16 nt, Human
agcagaaggggguggu

SEQ ID NO: 1898606 - RNA, 12 nt, Human
agcagaaggggg

SEQ ID NO: 1898607 - RNA, 17 nt, Human
ugagcaauguauaaccc

SEQ ID NO: 1898608 - RNA, 18 nt, Human
ugagcaauguauaacccc

SEQ ID NO: 1898609 - RNA, 21 nt, Human
ugagcacaacuuuaagaggac

SEQ ID NO: 1898610 - RNA, 22 nt, Human
ugagcacaacuuuaagaggaca

SEQ ID NO: 1898611 - RNA, 23 nt, Human
ugagcacuaaggugugcucugau

SEQ ID NO: 1898612 - RNA, 22 nt, Human
ugagcacuaaggugugcucuga

SEQ ID NO: 1898613 - RNA, 21 nt, Human
ugagcacuaaggugugcucug

SEQ ID NO: 1898614 - RNA, 20 nt, Human
ugagcacuaaggugugcucu

SEQ ID NO: 1898615 - RNA, 16 nt, Human
ugagcaacucuugauu

SEQ ID NO: 1898616 - RNA, 18 nt, Human
ugagcaacucuugauuau

SEQ ID NO: 1898617 - RNA, 15 nt, Human
ugagcaauccugcaa

SEQ ID NO: 1898618 - RNA, 23 nt, Human
ugagccacugcaccgggccacag

SEQ ID NO: 1898619 - RNA, 13 nt, Human
ugagccagauuuc

SEQ ID NO: 1898620 - RNA, 14 nt, Human
ugagccagauuuca

SEQ ID NO: 1898621 - RNA, 16 nt, Human
ugagccagauuucacu

SEQ ID NO: 1898622 - RNA, 18 nt, Human
ugagccacugcaccgggc

SEQ ID NO: 1898623 - RNA, 21 nt, Human
ugagccacugcaccgggccac

SEQ ID NO: 1898624 - RNA, 22 nt, Human
ugagcaucaggccaggcccucu

SEQ ID NO: 1898625 - RNA, 24 nt, Human
ugagcaucaggccaggcccucugc

SEQ ID NO: 1898626 - RNA, 21 nt, Human
ugagcaucaggccaggcccuc

SEQ ID NO: 1898627 - RNA, 16 nt, Human
agcacagcuucauuuc

SEQ ID NO: 1898628 - RNA, 15 nt, Human
agcacagugaucaag

SEQ ID NO: 1898629 - RNA, 13 nt, Human
agcacaugccucu

SEQ ID NO: 1898630 - RNA, 14 nt, Human
agcacaugccucuc

SEQ ID NO: 1898631 - RNA, 23 nt, Human
agcacaugcccuaaugucuguau

SEQ ID NO: 1898632 - RNA, 13 nt, Human
agcaagugagagc

SEQ ID NO: 1898633 - RNA, 20 nt, Human
agcaagugagacccugucuc

SEQ ID NO: 1898634 - RNA, 17 nt, Human
ugagccagauuucacuc

SEQ ID NO: 1898635 - RNA, 22 nt, Human
ugagccagauuucacucuccuu

SEQ ID NO: 1898636 - RNA, 14 nt, Human
agcaagugagagcu

SEQ ID NO: 1898637 - RNA, 18 nt, Human
agcaagugagagcugggu

SEQ ID NO: 1898638 - RNA, 22 nt, Human
agcaagugagagcuggguguca

SEQ ID NO: 1898639 - RNA, 13 nt, Human
agcacagcagccu

SEQ ID NO: 1898640 - RNA, 15 nt, Human
agcacagcagccugg

SEQ ID NO: 1898641 - RNA, 23 nt, Human
agcacagcagccuggggcuggcc

SEQ ID NO: 1898642 - RNA, 12 nt, Human
agcacagccaac

SEQ ID NO: 1898643 - RNA, 13 nt, Human
agcacagccaaca

SEQ ID NO: 1898644 - RNA, 23 nt, Human
agcacagccaacacgcaccugcc

SEQ ID NO: 1898645 - RNA, 10 nt, Human
agcacagcag

SEQ ID NO: 1898646 - RNA, 12 nt, Human
agcacagcagcc

SEQ ID NO: 1898647 - RNA, 19 nt, Human
ugacuuggggagauggagu

SEQ ID NO: 1898648 - RNA, 18 nt, Human
ugacuuggggagauggag

SEQ ID NO: 1898649 - RNA, 19 nt, Human
ugacuugacagaacacugu

SEQ ID NO: 1898650 - RNA, 17 nt, Human
ugacuugacagaacacu

SEQ ID NO: 1898651 - RNA, 21 nt, Human
agauucaaugccccugaauuu

SEQ ID NO: 1898652 - RNA, 22 nt, Human
agauucaaugccccugaauuua

SEQ ID NO: 1898653 - RNA, 19 nt, Human
agauuaugagacacaggau

SEQ ID NO: 1898654 - RNA, 20 nt, Human
agauuauggagcuuuuuucc

SEQ ID NO: 1898655 - RNA, 23 nt, Human
agauuauauauauuuuuuucuga

SEQ ID NO: 1898656 - RNA, 17 nt, Human
ugacuccagaauuuccc

SEQ ID NO: 1898657 - RNA, 19 nt, Human
ugacuccagaauuucccaa

SEQ ID NO: 1898658 - RNA, 17 nt, Human
ugaccugaggcccuucu

SEQ ID NO: 1898659 - RNA, 14 nt, Human
ugaccugaggcccu

SEQ ID NO: 1898660 - RNA, 15 nt, Human
ugaccugaggcccuu

SEQ ID NO: 1898661 - RNA, 20 nt, Human
ugacuccagaauuucccaaa

SEQ ID NO: 1898662 - RNA, 23 nt, Human
ugacuccagaauuucccaaagca

SEQ ID NO: 1898663 - RNA, 21 nt, Human
ugacuuauuuauauaaauuuu

SEQ ID NO: 1898664 - RNA, 17 nt, Human
ugacuuauuuauauaaa

SEQ ID NO: 1898665 - RNA, 20 nt, Human
ugacuuauuuauauaaauuu

SEQ ID NO: 1898666 - RNA, 21 nt, Human
agauugugccccugcacucca

SEQ ID NO: 1898667 - RNA, 16 nt, Human
agauugugccccugca

SEQ ID NO: 1898668 - RNA, 23 nt, Human
agauuggcucacacugagaaugu

SEQ ID NO: 1898669 - RNA, 14 nt, Human
agauuuaugcauau

SEQ ID NO: 1898670 - RNA, 13 nt, Human
agauuucacucuc

SEQ ID NO: 1898671 - RNA, 14 nt, Human
agauuucacucucc

SEQ ID NO: 1898672 - RNA, 21 nt, Human
agcaaaaccaaauauuccaga

SEQ ID NO: 1898673 - RNA, 12 nt, Human
agcaaaacaaaa

SEQ ID NO: 1898674 - RNA, 13 nt, Human
agcaacagaaaaa

SEQ ID NO: 1898675 - RNA, 20 nt, Human
agcaacauuuuacccacaca

SEQ ID NO: 1898676 - RNA, 16 nt, Human
agcaacagaaaaaugg

SEQ ID NO: 1898677 - RNA, 22 nt, Human
agcaacauuuuacccacacaca

SEQ ID NO: 1898678 - RNA, 14 nt, Human
agcaaccccaggcu

SEQ ID NO: 1898679 - RNA, 15 nt, Human
agcaaccccaggcug

SEQ ID NO: 1898680 - RNA, 16 nt, Human
agcaaccccaggcuga

SEQ ID NO: 1898681 - RNA, 17 nt, Human
ugaccacaccugccucu

SEQ ID NO: 1898682 - RNA, 14 nt, Human
ugaccacagcacag

SEQ ID NO: 1898683 - RNA, 21 nt, Human
agaucauugugaaauuauuca

SEQ ID NO: 1898684 - RNA, 18 nt, Human
agauccaaaagaagcccc

SEQ ID NO: 1898685 - RNA, 23 nt, Human
agauccaaaagaagcccccagcu

SEQ ID NO: 1898686 - RNA, 21 nt, Human
agauccaaaagaagcccccag

SEQ ID NO: 1898687 - RNA, 19 nt, Human
agaugauggaugccaauau

SEQ ID NO: 1898688 - RNA, 16 nt, Human
agaugauggaugccaa

SEQ ID NO: 1898689 - RNA, 15 nt, Human
agauccuuccuuuug

SEQ ID NO: 1898690 - RNA, 12 nt, Human
agauccaggacu

SEQ ID NO: 1898691 - RNA, 13 nt, Human
agauccagccugg

SEQ ID NO: 1898692 - RNA, 14 nt, Human
agauccagccuggg

SEQ ID NO: 1898693 - RNA, 13 nt, Human
agauccaggacua

SEQ ID NO: 1898694 - RNA, 20 nt, Human
ugaccaaaauggugaaaccu

SEQ ID NO: 1898695 - RNA, 14 nt, Human
ugaccaaaguccuu

SEQ ID NO: 1898696 - RNA, 16 nt, Human
ugaccaaaguccuuuu

SEQ ID NO: 1898697 - RNA, 16 nt, Human
ugacagucaugcaguc

SEQ ID NO: 1898698 - RNA, 15 nt, Human
ugacauugcguuuga

SEQ ID NO: 1898699 - RNA, 19 nt, Human
ugacauugcguuugaccuu

SEQ ID NO: 1898700 - RNA, 17 nt, Human
ugacagguuugggaccc

SEQ ID NO: 1898701 - RNA, 21 nt, Human
ugaccccgacgccacagccca

SEQ ID NO: 1898702 - RNA, 14 nt, Human
ugacccccagcucc

SEQ ID NO: 1898703 - RNA, 13 nt, Human
ugaccucugccug

SEQ ID NO: 1898704 - RNA, 22 nt, Human
ugaccccgacgccacagcccag

SEQ ID NO: 1898705 - RNA, 14 nt, Human
ugaccucugccuga

SEQ ID NO: 1898706 - RNA, 12 nt, Human
ugaccugaggcc

SEQ ID NO: 1898707 - RNA, 15 nt, Human
agauguguucacaau

SEQ ID NO: 1898708 - RNA, 18 nt, Human
agauguguucacaaugga

SEQ ID NO: 1898709 - RNA, 22 nt, Human
agaugugguugcauaagguuuu

SEQ ID NO: 1898710 - RNA, 21 nt, Human
agaugugguugcauaagguuu

SEQ ID NO: 1898711 - RNA, 23 nt, Human
ugacccagugcccccacugacca

SEQ ID NO: 1898712 - RNA, 17 nt, Human
ugacccagugcccccac

SEQ ID NO: 1898713 - RNA, 18 nt, Human
ugacccagugcccccacu

SEQ ID NO: 1898714 - RNA, 16 nt, Human
ugacccagugccccca

SEQ ID NO: 1898715 - RNA, 19 nt, Human
agauggaguucuugugcca

SEQ ID NO: 1898716 - RNA, 17 nt, Human
agauggaguucuugugc

SEQ ID NO: 1898717 - RNA, 13 nt, Human
agauggauucucc

SEQ ID NO: 1898718 - RNA, 18 nt, Human
agauggauucuccacuca

SEQ ID NO: 1898719 - RNA, 23 nt, Human
agauggauucuccacucaguugc

SEQ ID NO: 1898720 - RNA, 18 nt, Human
agaugcuucucacugcca

SEQ ID NO: 1898721 - RNA, 16 nt, Human
agaugcuucucacugc

SEQ ID NO: 1898722 - RNA, 23 nt, Human
agaugcuagaacucccuuucaac

SEQ ID NO: 1898723 - RNA, 19 nt, Human
agaugcuagcacaugcccu

SEQ ID NO: 1898724 - RNA, 22 nt, Human
ugaagcuuauuaaugcuaaggg

SEQ ID NO: 1898725 - RNA, 23 nt, Human
ugaagcuuauuaaugcuaagggc

SEQ ID NO: 1898726 - RNA, 20 nt, Human
ugaagcuuauuaaugcuaag

SEQ ID NO: 1898727 - RNA, 19 nt, Human
ugaagcuuauuaaugcuaa

SEQ ID NO: 1898728 - RNA, 18 nt, Human
ugaagcuuauuaaugcua

SEQ ID NO: 1898729 - RNA, 17 nt, Human
ugaagcuuauuaaugcu

SEQ ID NO: 1898730 - RNA, 16 nt, Human
ugaagcuuauuaaugc

SEQ ID NO: 1898731 - RNA, 13 nt, Human
ugaagccuuucuu

SEQ ID NO: 1898732 - RNA, 19 nt, Human
ugaagcagguucccaagcu

SEQ ID NO: 1898733 - RNA, 20 nt, Human
ugaagcagguucccaagcuc

SEQ ID NO: 1898734 - RNA, 18 nt, Human
ugaagauguagaggagaa

SEQ ID NO: 1898735 - RNA, 17 nt, Human
ugaagauguagaggaga

SEQ ID NO: 1898736 - RNA, 22 nt, Human
agagggagggagggcuccagac

SEQ ID NO: 1898737 - RNA, 13 nt, Human
agagggaggggcc

SEQ ID NO: 1898738 - RNA, 14 nt, Human
agagggaggggccu

SEQ ID NO: 1898739 - RNA, 16 nt, Human
agagggaggggccuag

SEQ ID NO: 1898740 - RNA, 18 nt, Human
agagggaggggccuaggc

SEQ ID NO: 1898741 - RNA, 20 nt, Human
agagggaggggccuaggccu

SEQ ID NO: 1898742 - RNA, 21 nt, Human
agagggagggagggcuccaga

SEQ ID NO: 1898743 - RNA, 22 nt, Human
agagggacuguucuuuuguccc

SEQ ID NO: 1898744 - RNA, 20 nt, Human
agagggagggagggcuccag

SEQ ID NO: 1898745 - RNA, 15 nt, Human
agagggaccucuccc

SEQ ID NO: 1898746 - RNA, 16 nt, Human
agagggaccucuccca

SEQ ID NO: 1898747 - RNA, 19 nt, Human
agagggaccucucccaggg

SEQ ID NO: 1898748 - RNA, 21 nt, Human
agaggcgcaugaauuugugaa

SEQ ID NO: 1898749 - RNA, 17 nt, Human
agaggcagaagaacccu

SEQ ID NO: 1898750 - RNA, 13 nt, Human
agaggcagaagaa

SEQ ID NO: 1898751 - RNA, 18 nt, Human
agaggcaauggcuccuuc

SEQ ID NO: 1898752 - RNA, 19 nt, Human
agaggcuaaauuacucagg

SEQ ID NO: 1898753 - RNA, 21 nt, Human
agaggcuaaauuacucaggaa

SEQ ID NO: 1898754 - RNA, 21 nt, Human
agaggccuuuaaccauggugc

SEQ ID NO: 1898755 - RNA, 19 nt, Human
agagcugggugucaagagg

SEQ ID NO: 1898756 - RNA, 21 nt, Human
ugaagacaaugacuuacugua

SEQ ID NO: 1898757 - RNA, 12 nt, Human
agaggaaagcaa

SEQ ID NO: 1898758 - RNA, 16 nt, Human
agaggaaagcaaagga

SEQ ID NO: 1898759 - RNA, 18 nt, Human
agaggaaagcaaaggaga

SEQ ID NO: 1898760 - RNA, 19 nt, Human
agaggaaagcaaaggagau

SEQ ID NO: 1898761 - RNA, 11 nt, Human
agaggaaauca

SEQ ID NO: 1898762 - RNA, 12 nt, Human
agaggaaaucac

SEQ ID NO: 1898763 - RNA, 21 nt, Human
agaggaaaucaccgaaaacgu

SEQ ID NO: 1898764 - RNA, 18 nt, Human
agaggcaacugcauuggc

SEQ ID NO: 1898765 - RNA, 13 nt, Human
ucuuuguaaugaa

SEQ ID NO: 1898766 - RNA, 15 nt, Human
ucuuuguaaugaaaa

SEQ ID NO: 1898767 - RNA, 11 nt, Human
ugaacuuugac

SEQ ID NO: 1898768 - RNA, 12 nt, Human
ucuuuguaauga

SEQ ID NO: 1898769 - RNA, 14 nt, Human
ucuuuggucuacac

SEQ ID NO: 1898770 - RNA, 21 nt, Human
ucuuuggucuacacugugcug

SEQ ID NO: 1898771 - RNA, 17 nt, Human
ugaacuuugaccucugc

SEQ ID NO: 1898772 - RNA, 16 nt, Human
ugaacuuugaccucug

SEQ ID NO: 1898773 - RNA, 17 nt, Human
ugaagacaaugacuuac

SEQ ID NO: 1898774 - RNA, 13 nt, Human
ugaagacaaugac

SEQ ID NO: 1898775 - RNA, 11 nt, Human
ugaagacaaug

SEQ ID NO: 1898776 - RNA, 11 nt, Human
ugaagaagaga

SEQ ID NO: 1898777 - RNA, 12 nt, Human
agauaauuauaa

SEQ ID NO: 1898778 - RNA, 16 nt, Human
agauaaguguauuuuu

SEQ ID NO: 1898779 - RNA, 18 nt, Human
agauaaguguauuuuuca

SEQ ID NO: 1898780 - RNA, 20 nt, Human
agauaaguguauuuuucaau

SEQ ID NO: 1898781 - RNA, 19 nt, Human
agagugagacucugucuca

SEQ ID NO: 1898782 - RNA, 19 nt, Human
agauaaggguaucugguga

SEQ ID NO: 1898783 - RNA, 19 nt, Human
agauacaggaaaagcugcu

SEQ ID NO: 1898784 - RNA, 22 nt, Human
agauauuuugcuuugugauuuu

SEQ ID NO: 1898785 - RNA, 19 nt, Human
agaucaaccccuucgcucc

SEQ ID NO: 1898786 - RNA, 14 nt, Human
agaucaaccccuuc

SEQ ID NO: 1898787 - RNA, 21 nt, Human
agaucaaccccuucgcuccug

SEQ ID NO: 1898788 - RNA, 22 nt, Human
agagucucacuguugcccaggc

SEQ ID NO: 1898789 - RNA, 14 nt, Human
agagugaacaaauu

SEQ ID NO: 1898790 - RNA, 20 nt, Human
agagucucacuguugcccag

SEQ ID NO: 1898791 - RNA, 16 nt, Human
agagugagacucuguc

SEQ ID NO: 1898792 - RNA, 15 nt, Human
agagugagacucugu

SEQ ID NO: 1898793 - RNA, 22 nt, Human
agagugaacaaauuuacagaga

SEQ ID NO: 1898794 - RNA, 18 nt, Human
agagucuauuuacggaac

SEQ ID NO: 1898795 - RNA, 14 nt, Human
ugaaugucagugug

SEQ ID NO: 1898796 - RNA, 17 nt, Human
ugaauguauuuauuugg

SEQ ID NO: 1898797 - RNA, 15 nt, Human
ugaaugucaguguga

SEQ ID NO: 1898798 - RNA, 18 nt, Human
ugaaugucagugugacug

SEQ ID NO: 1898799 - RNA, 14 nt, Human
agaguccucugaau

SEQ ID NO: 1898800 - RNA, 19 nt, Human
ugaauguauuuauuuggga

SEQ ID NO: 1898801 - RNA, 23 nt, Human
ugaauguauuuauuugggagacc

SEQ ID NO: 1898802 - RNA, 12 nt, Human
agaguccucuga

SEQ ID NO: 1898803 - RNA, 13 nt, Human
agaguccucugaa

SEQ ID NO: 1898804 - RNA, 18 nt, Human
ugaagguggaaauaaacu

SEQ ID NO: 1898805 - RNA, 19 nt, Human
ugaaggugcugacggccag

SEQ ID NO: 1898806 - RNA, 20 nt, Human
ugaaggugcugacggccagg

SEQ ID NO: 1898807 - RNA, 15 nt, Human
ugaaggugcugacgg

SEQ ID NO: 1898808 - RNA, 12 nt, Human
ugaagcuuccuu

SEQ ID NO: 1898809 - RNA, 13 nt, Human
ugaagcuuuacca

SEQ ID NO: 1898810 - RNA, 16 nt, Human
ugaauauaaacacuau

SEQ ID NO: 1898811 - RNA, 21 nt, Human
ugaauauaauauauuugugua

SEQ ID NO: 1898812 - RNA, 22 nt, Human
ugaauauaauauauuuguguau

SEQ ID NO: 1898813 - RNA, 15 nt, Human
ugaauauaaacacua

SEQ ID NO: 1898814 - RNA, 16 nt, Human
ugaagguuucugaaaa

SEQ ID NO: 1898815 - RNA, 13 nt, Human
ugaagguuucuga

SEQ ID NO: 1898816 - RNA, 17 nt, Human
ucuuggacacuguacaa

SEQ ID NO: 1898817 - RNA, 16 nt, Human
ucuuggacacuguaca

SEQ ID NO: 1898818 - RNA, 12 nt, Human
ucuuggagccug

SEQ ID NO: 1898819 - RNA, 14 nt, Human
ucuuggagccugca

SEQ ID NO: 1898820 - RNA, 13 nt, Human
ucuuggagccugc

SEQ ID NO: 1898821 - RNA, 16 nt, Human
ucuugcaauggcagcc

SEQ ID NO: 1898822 - RNA, 13 nt, Human
ucuugcaauggca

SEQ ID NO: 1898823 - RNA, 17 nt, Human
ucuugcaauggcagccu

SEQ ID NO: 1898824 - RNA, 20 nt, Human
ucuugaugccuggcggggug

SEQ ID NO: 1898825 - RNA, 14 nt, Human
ucuugaugccuggc

SEQ ID NO: 1898826 - RNA, 12 nt, Human
ucuugaugacca

SEQ ID NO: 1898827 - RNA, 19 nt, Human
agaccugcagacgcccaga

SEQ ID NO: 1898828 - RNA, 23 nt, Human
agaccugauccuggaggcccagu

SEQ ID NO: 1898829 - RNA, 18 nt, Human
agacucauucuucuguac

SEQ ID NO: 1898830 - RNA, 17 nt, Human
agacucauucuucugua

SEQ ID NO: 1898831 - RNA, 19 nt, Human
agacuaucuaaauguugaa

SEQ ID NO: 1898832 - RNA, 17 nt, Human
agacuaucuaaauguug

SEQ ID NO: 1898833 - RNA, 18 nt, Human
agacuaucuaaauguuga

SEQ ID NO: 1898834 - RNA, 18 nt, Human
agaccugauccuggaggc

SEQ ID NO: 1898835 - RNA, 19 nt, Human
agaccugauccuggaggcc

SEQ ID NO: 1898836 - RNA, 21 nt, Human
agaccugauccuggaggccca

SEQ ID NO: 1898837 - RNA, 22 nt, Human
agaccugauccuggaggcccag

SEQ ID NO: 1898838 - RNA, 19 nt, Human
agaccugacaccuuucaua

SEQ ID NO: 1898839 - RNA, 14 nt, Human
agaccugauccugg

SEQ ID NO: 1898840 - RNA, 15 nt, Human
agaccugauccugga

SEQ ID NO: 1898841 - RNA, 16 nt, Human
agaccugauccuggag

SEQ ID NO: 1898842 - RNA, 12 nt, Human
agacccugcccu

SEQ ID NO: 1898843 - RNA, 13 nt, Human
agacccugcccug

SEQ ID NO: 1898844 - RNA, 14 nt, Human
agacccugcccugu

SEQ ID NO: 1898845 - RNA, 18 nt, Human
agacauguuuuccgugaa

SEQ ID NO: 1898846 - RNA, 19 nt, Human
agaccuaacgagaaauaga

SEQ ID NO: 1898847 - RNA, 15 nt, Human
agaccuaaugcuccu

SEQ ID NO: 1898848 - RNA, 18 nt, Human
agaccuaaugcuccuugu

SEQ ID NO: 1898849 - RNA, 19 nt, Human
agacccuuguggucccacc

SEQ ID NO: 1898850 - RNA, 20 nt, Human
agacccuuguggucccaccc

SEQ ID NO: 1898851 - RNA, 22 nt, Human
agacccuuguggucccacccca

SEQ ID NO: 1898852 - RNA, 23 nt, Human
agacccuuguggucccaccccac

SEQ ID NO: 1898853 - RNA, 13 nt, Human
agacccuuguggu

SEQ ID NO: 1898854 - RNA, 15 nt, Human
agacccuuguggucc

SEQ ID NO: 1898855 - RNA, 16 nt, Human
agacccugcccugugg

SEQ ID NO: 1898856 - RNA, 19 nt, Human
agacccugcccugugggcc

SEQ ID NO: 1898857 - RNA, 21 nt, Human
agacccugcccugugggcccc

SEQ ID NO: 1898858 - RNA, 23 nt, Human
agacccugcccugugggccccca

SEQ ID NO: 1898859 - RNA, 15 nt, Human
ucuuuacuucaugga

SEQ ID NO: 1898860 - RNA, 19 nt, Human
ucuuggagccugcagagcu

SEQ ID NO: 1898861 - RNA, 18 nt, Human
ucuuggagccugcagagc

SEQ ID NO: 1898862 - RNA, 15 nt, Human
ucuuggagccugcag

SEQ ID NO: 1898863 - RNA, 17 nt, Human
agacucuacagaggcca

SEQ ID NO: 1898864 - RNA, 21 nt, Human
agacucgcgacaaugcaaacc

SEQ ID NO: 1898865 - RNA, 19 nt, Human
agacucuacagaggccaug

SEQ ID NO: 1898866 - RNA, 18 nt, Human
agacuccugcaggcagcc

SEQ ID NO: 1898867 - RNA, 19 nt, Human
agacuccugcaggcagcca

SEQ ID NO: 1898868 - RNA, 20 nt, Human
agacuccugcaggcagccag

SEQ ID NO: 1898869 - RNA, 23 nt, Human
agacuccugcaggcagccaggcc

SEQ ID NO: 1898870 - RNA, 13 nt, Human
ucuuuccugaggc

SEQ ID NO: 1898871 - RNA, 14 nt, Human
ucuuuccugaggcu

SEQ ID NO: 1898872 - RNA, 15 nt, Human
ucuuuccugaggcug

SEQ ID NO: 1898873 - RNA, 16 nt, Human
ucuuuccugaggcugg

SEQ ID NO: 1898874 - RNA, 14 nt, Human
agacuccugcaggc

SEQ ID NO: 1898875 - RNA, 15 nt, Human
agacuccugcaggca

SEQ ID NO: 1898876 - RNA, 16 nt, Human
agacuccugcaggcag

SEQ ID NO: 1898877 - RNA, 17 nt, Human
agacuccugcaggcagc

SEQ ID NO: 1898878 - RNA, 15 nt, Human
agacuuuggaaagac

SEQ ID NO: 1898879 - RNA, 18 nt, Human
agagaaugaaagggccca

SEQ ID NO: 1898880 - RNA, 14 nt, Human
agacuuuggaaaga

SEQ ID NO: 1898881 - RNA, 12 nt, Human
agacuuuggaaa

SEQ ID NO: 1898882 - RNA, 15 nt, Human
agagaccaucccuga

SEQ ID NO: 1898883 - RNA, 15 nt, Human
ucuuugggccagaca

SEQ ID NO: 1898884 - RNA, 16 nt, Human
ucuuugggccagacau

SEQ ID NO: 1898885 - RNA, 20 nt, Human
ucuuugggccagacaugcca

SEQ ID NO: 1898886 - RNA, 13 nt, Human
agagaccaucccu

SEQ ID NO: 1898887 - RNA, 14 nt, Human
agagaccaucccug

SEQ ID NO: 1898888 - RNA, 14 nt, Human
agacuucaucccuc

SEQ ID NO: 1898889 - RNA, 17 nt, Human
agacuucaucccucugg

SEQ ID NO: 1898890 - RNA, 17 nt, Human
agacuguugucccugca

SEQ ID NO: 1898891 - RNA, 18 nt, Human
ucuuaaucuuuucacaaa

SEQ ID NO: 1898892 - RNA, 17 nt, Human
ucuuaaucuuuucacaa

SEQ ID NO: 1898893 - RNA, 14 nt, Human
ucuuaauauucugg

SEQ ID NO: 1898894 - RNA, 18 nt, Human
ucuuaauauucuggaguc

SEQ ID NO: 1898895 - RNA, 22 nt, Human
ucuuauugcccacgcuggagug

SEQ ID NO: 1898896 - RNA, 18 nt, Human
ucuuauugcccacgcugg

SEQ ID NO: 1898897 - RNA, 14 nt, Human
ucuuauugcccacg

SEQ ID NO: 1898898 - RNA, 18 nt, Human
ucuuaugggcuggguucu

SEQ ID NO: 1898899 - RNA, 15 nt, Human
ucuuaugggcugggu

SEQ ID NO: 1898900 - RNA, 16 nt, Human
ucuuaugggcuggguu

SEQ ID NO: 1898901 - RNA, 14 nt, Human
ucuuaugggcuggg

SEQ ID NO: 1898902 - RNA, 22 nt, Human
ucuuccaggcugggagagccuu

SEQ ID NO: 1898903 - RNA, 17 nt, Human
ucuuauuuuuuaaaaag

SEQ ID NO: 1898904 - RNA, 12 nt, Human
ucuucaacaaau

SEQ ID NO: 1898905 - RNA, 20 nt, Human
ucuucagaaagugugcuuua

SEQ ID NO: 1898906 - RNA, 23 nt, Human
ucuucagaaagugugcuuuaugc

SEQ ID NO: 1898907 - RNA, 23 nt, Human
agacaggcaagcaccuccugccu

SEQ ID NO: 1898908 - RNA, 15 nt, Human
agacaggaccaggga

SEQ ID NO: 1898909 - RNA, 16 nt, Human
agacaggaccagggau

SEQ ID NO: 1898910 - RNA, 21 nt, Human
agacaggguuuugccauguug

SEQ ID NO: 1898911 - RNA, 23 nt, Human
agacaggguuucaccauguugcc

SEQ ID NO: 1898912 - RNA, 19 nt, Human
agacaggguuucaccaugu

SEQ ID NO: 1898913 - RNA, 19 nt, Human
agacagucccugccaaugg

SEQ ID NO: 1898914 - RNA, 15 nt, Human
agacagucccugcca

SEQ ID NO: 1898915 - RNA, 16 nt, Human
agacagucccugccaa

SEQ ID NO: 1898916 - RNA, 17 nt, Human
agacagucccugccaau

SEQ ID NO: 1898917 - RNA, 22 nt, Human
agacacugaaauauacacacag

SEQ ID NO: 1898918 - RNA, 20 nt, Human
agacacugaaauauacacac

SEQ ID NO: 1898919 - RNA, 21 nt, Human
agacacugaaauauacacaca

SEQ ID NO: 1898920 - RNA, 22 nt, Human
agacacuccccgaagucuuuug

SEQ ID NO: 1898921 - RNA, 23 nt, Human
agacacuccccgaagucuuuugu

SEQ ID NO: 1898922 - RNA, 13 nt, Human
agacacugaaaua

SEQ ID NO: 1898923 - RNA, 23 nt, Human
agacagcuucucauccugcaggc

SEQ ID NO: 1898924 - RNA, 22 nt, Human
agacagcuucucauccugcagg

SEQ ID NO: 1898925 - RNA, 17 nt, Human
agaauuugauaugugaa

SEQ ID NO: 1898926 - RNA, 19 nt, Human
agaauuugauaugugaaca

SEQ ID NO: 1898927 - RNA, 18 nt, Human
agaauuugauaugugaac

SEQ ID NO: 1898928 - RNA, 20 nt, Human
agaauuugauaugugaacag

SEQ ID NO: 1898929 - RNA, 21 nt, Human
agacacccucaaccucuucug

SEQ ID NO: 1898930 - RNA, 20 nt, Human
agacacuccccgaagucuuu

SEQ ID NO: 1898931 - RNA, 12 nt, Human
agacacccagga

SEQ ID NO: 1898932 - RNA, 13 nt, Human
agacacccaggac

SEQ ID NO: 1898933 - RNA, 14 nt, Human
agacacccaggacu

SEQ ID NO: 1898934 - RNA, 15 nt, Human
agacacccaggacuu

SEQ ID NO: 1898935 - RNA, 16 nt, Human
agacacccaggacuua

SEQ ID NO: 1898936 - RNA, 19 nt, Human
agacacccucaaccucuuc

SEQ ID NO: 1898937 - RNA, 20 nt, Human
ucuguuggccagugugacaa

SEQ ID NO: 1898938 - RNA, 19 nt, Human
ucuguuggccagugugaca

SEQ ID NO: 1898939 - RNA, 18 nt, Human
ucuguuggccagugugac

SEQ ID NO: 1898940 - RNA, 18 nt, Human
ucuguucccccuucacaa

SEQ ID NO: 1898941 - RNA, 20 nt, Human
ucuguucccccuucacaaag

SEQ ID NO: 1898942 - RNA, 13 nt, Human
ucuguucccccuu

SEQ ID NO: 1898943 - RNA, 15 nt, Human
ucugugaaaggaaag

SEQ ID NO: 1898944 - RNA, 21 nt, Human
ucugugaaaggaaagagggag

SEQ ID NO: 1898945 - RNA, 18 nt, Human
ucugugccuucuuuugau

SEQ ID NO: 1898946 - RNA, 22 nt, Human
ucugugccuucuuuugauuaug

SEQ ID NO: 1898947 - RNA, 23 nt, Human
agaauuucccaaagcagugcaug

SEQ ID NO: 1898948 - RNA, 21 nt, Human
agaauuuauucaauuccucug

SEQ ID NO: 1898949 - RNA, 21 nt, Human
agaauuucuaggacugaauua

SEQ ID NO: 1898950 - RNA, 13 nt, Human
agaauuucuagga

SEQ ID NO: 1898951 - RNA, 17 nt, Human
agaauuucccaaagcag

SEQ ID NO: 1898952 - RNA, 18 nt, Human
agaauuucccaaagcagu

SEQ ID NO: 1898953 - RNA, 15 nt, Human
agaauuuagguuuuu

SEQ ID NO: 1898954 - RNA, 13 nt, Human
agaauuuauucaa

SEQ ID NO: 1898955 - RNA, 14 nt, Human
agaauuuauucaau

SEQ ID NO: 1898956 - RNA, 20 nt, Human
agaauugucuuucugucucu

SEQ ID NO: 1898957 - RNA, 15 nt, Human
ucugucauuugagca

SEQ ID NO: 1898958 - RNA, 13 nt, Human
ucugucagucaca

SEQ ID NO: 1898959 - RNA, 17 nt, Human
ucugucagucacagcca

SEQ ID NO: 1898960 - RNA, 19 nt, Human
ucugucagucacagccacc

SEQ ID NO: 1898961 - RNA, 23 nt, Human
ucugucauuugagcagggcucag

SEQ ID NO: 1898962 - RNA, 20 nt, Human
ucugucauuugagcagggcu

SEQ ID NO: 1898963 - RNA, 16 nt, Human
ucuggguucacugcaa

SEQ ID NO: 1898964 - RNA, 14 nt, Human
ucuggguucacugc

SEQ ID NO: 1898965 - RNA, 11 nt, Human
ucuggggcugu

SEQ ID NO: 1898966 - RNA, 16 nt, Human
ucuggggcucugggau

SEQ ID NO: 1898967 - RNA, 18 nt, Human
ucugguccauagagagca

SEQ ID NO: 1898968 - RNA, 14 nt, Human
ucugguccuaccca

SEQ ID NO: 1898969 - RNA, 13 nt, Human
ucugguccuaccc

SEQ ID NO: 1898970 - RNA, 15 nt, Human
ucuggggcucuggga

SEQ ID NO: 1898971 - RNA, 16 nt, Human
agaaggaaaaggcagg

SEQ ID NO: 1898972 - RNA, 22 nt, Human
agaagcuuuugaauaaaaacuu

SEQ ID NO: 1898973 - RNA, 18 nt, Human
agaagcuuccauuccaag

SEQ ID NO: 1898974 - RNA, 19 nt, Human
agaagaaaauggaaccagg

SEQ ID NO: 1898975 - RNA, 20 nt, Human
agaagaaaauggaaccaggc

SEQ ID NO: 1898976 - RNA, 15 nt, Human
agaagaaaacaucua

SEQ ID NO: 1898977 - RNA, 23 nt, Human
agaagaaaacaucuauucucucc

SEQ ID NO: 1898978 - RNA, 22 nt, Human
agaacucauguuauuuuuuaac

SEQ ID NO: 1898979 - RNA, 19 nt, Human
agaacucauguuauuuuuu

SEQ ID NO: 1898980 - RNA, 14 nt, Human
agaacucccuuuca

SEQ ID NO: 1898981 - RNA, 21 nt, Human
agaacucaugacggaagaguu

SEQ ID NO: 1898982 - RNA, 23 nt, Human
agaacuacaaacaaaauuucuau

SEQ ID NO: 1898983 - RNA, 22 nt, Human
agaacuacaaacaaaauuucua

SEQ ID NO: 1898984 - RNA, 19 nt, Human
agaacucacuggggccuac

SEQ ID NO: 1898985 - RNA, 17 nt, Human
agaacucaguuuuaacu

SEQ ID NO: 1898986 - RNA, 18 nt, Human
agaacuacaaacaaaauu

SEQ ID NO: 1898987 - RNA, 16 nt, Human
agaacuaaacucauuu

SEQ ID NO: 1898988 - RNA, 18 nt, Human
agaacuaaacucauuuau

SEQ ID NO: 1898989 - RNA, 12 nt, Human
agaacuaaacuc

SEQ ID NO: 1898990 - RNA, 21 nt, Human
agaacggggcucuucucauuu

SEQ ID NO: 1898991 - RNA, 20 nt, Human
agaacggggcucuucucauu

SEQ ID NO: 1898992 - RNA, 19 nt, Human
agaacggggcucuucucau

SEQ ID NO: 1898993 - RNA, 17 nt, Human
agaacggggcucuucuc

SEQ ID NO: 1898994 - RNA, 15 nt, Human
ucugcagaaacagaa

SEQ ID NO: 1898995 - RNA, 16 nt, Human
agaaauguacagcaag

SEQ ID NO: 1898996 - RNA, 17 nt, Human
agaaauguacagcaagg

SEQ ID NO: 1898997 - RNA, 11 nt, Human
agaaauguguu

SEQ ID NO: 1898998 - RNA, 19 nt, Human
ucugacccugcuucaaaua

SEQ ID NO: 1898999 - RNA, 15 nt, Human
agaaagacagagcug

SEQ ID NO: 1899000 - RNA, 21 nt, Human
ucugauucccaagcucugcuc

SEQ ID NO: 1899001 - RNA, 20 nt, Human
ucugauucccaagcucugcu

SEQ ID NO: 1899002 - RNA, 19 nt, Human
ucugauucccaagcucugc

SEQ ID NO: 1899003 - RNA, 17 nt, Human
ucugauacagaaaaguu

SEQ ID NO: 1899004 - RNA, 16 nt, Human
ucugauacagaaaagu

SEQ ID NO: 1899005 - RNA, 15 nt, Human
ucugagaaacaauga

SEQ ID NO: 1899006 - RNA, 22 nt, Human
agaagaaaauggaaccaggcuu

SEQ ID NO: 1899007 - RNA, 23 nt, Human
agaagaaaauggaaccaggcuug

SEQ ID NO: 1899008 - RNA, 21 nt, Human
agaagaaggcagcagguggca

SEQ ID NO: 1899009 - RNA, 14 nt, Human
agaagaaggcagca

SEQ ID NO: 1899010 - RNA, 13 nt, Human
agaagaaggcagc

SEQ ID NO: 1899011 - RNA, 20 nt, Human
agaagaacuguguuucaagu

SEQ ID NO: 1899012 - RNA, 21 nt, Human
agaagaacuguguuucaaguu

SEQ ID NO: 1899013 - RNA, 14 nt, Human
ucugcccuccaaga

SEQ ID NO: 1899014 - RNA, 18 nt, Human
ucugcccuccaagaccuu

SEQ ID NO: 1899015 - RNA, 16 nt, Human
ucugcucacauaucug

SEQ ID NO: 1899016 - RNA, 17 nt, Human
ucugcucacauaucugu

SEQ ID NO: 1899017 - RNA, 14 nt, Human
ucugcucagcuucu

SEQ ID NO: 1899018 - RNA, 15 nt, Human
ucugcucagcuucuc

SEQ ID NO: 1899019 - RNA, 18 nt, Human
ucugcucagcuucuccug

SEQ ID NO: 1899020 - RNA, 22 nt, Human
ucugcucaggagaccuggagga

SEQ ID NO: 1899021 - RNA, 14 nt, Human
ucugcucagcucug

SEQ ID NO: 1899022 - RNA, 16 nt, Human
ucugcucagcucuggg

SEQ ID NO: 1899023 - RNA, 17 nt, Human
ucugcugguuuuaacaa

SEQ ID NO: 1899024 - RNA, 21 nt, Human
ucugcuguucucuagaaagaa

SEQ ID NO: 1899025 - RNA, 12 nt, Human
ucugcuugaguc

SEQ ID NO: 1899026 - RNA, 14 nt, Human
ucugcuugagucag

SEQ ID NO: 1899027 - RNA, 18 nt, Human
ucugcuugacaacaucug

SEQ ID NO: 1899028 - RNA, 19 nt, Human
ucugcuugacaacaucuga

SEQ ID NO: 1899029 - RNA, 21 nt, Human
ucuggagucucacuugucuca

SEQ ID NO: 1899030 - RNA, 14 nt, Human
ucuggaguggccac

SEQ ID NO: 1899031 - RNA, 15 nt, Human
ucuggaguggccacu

SEQ ID NO: 1899032 - RNA, 19 nt, Human
ucuggaguggccacuaagc

SEQ ID NO: 1899033 - RNA, 16 nt, Human
ucuggaguugaucugg

SEQ ID NO: 1899034 - RNA, 17 nt, Human
ucuggaguugaucugga

SEQ ID NO: 1899035 - RNA, 21 nt, Human
ucuggaguugaucuggaaccc

SEQ ID NO: 1899036 - RNA, 18 nt, Human
ucuggagguacgaaaaga

SEQ ID NO: 1899037 - RNA, 22 nt, Human
ucuggaacccagacucagacau

SEQ ID NO: 1899038 - RNA, 23 nt, Human
ucuggaacccagacucagacauu

SEQ ID NO: 1899039 - RNA, 15 nt, Human
ucuggaaccucagcc

SEQ ID NO: 1899040 - RNA, 16 nt, Human
ucuggaaccucagccu

SEQ ID NO: 1899041 - RNA, 23 nt, Human
ucugcuuuuuaaagaaugcucuu

SEQ ID NO: 1899042 - RNA, 20 nt, Human
ucugcuugagucagguuuga

SEQ ID NO: 1899043 - RNA, 13 nt, Human
ucuggaacccaga

SEQ ID NO: 1899044 - RNA, 14 nt, Human
ucuggaacccagac

SEQ ID NO: 1899045 - RNA, 14 nt, Human
ucuggaaagcaaag

SEQ ID NO: 1899046 - RNA, 15 nt, Human
ucuggaacccagacu

SEQ ID NO: 1899047 - RNA, 16 nt, Human
ucuggaacccagacuc

SEQ ID NO: 1899048 - RNA, 17 nt, Human
ucuggaacccagacuca

SEQ ID NO: 1899049 - RNA, 18 nt, Human
ucuggaacccagacucag

SEQ ID NO: 1899050 - RNA, 12 nt, Human
ucuggauuauau

SEQ ID NO: 1899051 - RNA, 18 nt, Human
ucuggauuauauuaugaa

SEQ ID NO: 1899052 - RNA, 14 nt, Human
ucuggcagcucaga

SEQ ID NO: 1899053 - RNA, 15 nt, Human
ucuggcagcucagag

SEQ ID NO: 1899054 - RNA, 16 nt, Human
ucuggcagccucccau

SEQ ID NO: 1899055 - RNA, 15 nt, Human
agaagcggcuggcag

SEQ ID NO: 1899056 - RNA, 16 nt, Human
agaagcggcuggcagc

SEQ ID NO: 1899057 - RNA, 13 nt, Human
agaagcuaagcug

SEQ ID NO: 1899058 - RNA, 20 nt, Human
agaagcuauaaauuccucuu

SEQ ID NO: 1899059 - RNA, 21 nt, Human
agaagcuauaaauuccucuuu

SEQ ID NO: 1899060 - RNA, 16 nt, Human
ucuggcagcucagaga

SEQ ID NO: 1899061 - RNA, 21 nt, Human
ucuggcagccucccauccagg

SEQ ID NO: 1899062 - RNA, 11 nt, Human
ucuggcccuau

SEQ ID NO: 1899063 - RNA, 22 nt, Human
ucucuuuaaugucacaggcagg

SEQ ID NO: 1899064 - RNA, 15 nt, Human
ucucuuucaugaguu

SEQ ID NO: 1899065 - RNA, 13 nt, Human
ucucuugagccug

SEQ ID NO: 1899066 - RNA, 14 nt, Human
ucucuugagccugg

SEQ ID NO: 1899067 - RNA, 15 nt, Human
ucucuugagccuggg

SEQ ID NO: 1899068 - RNA, 12 nt, Human
ucucuuucuuua

SEQ ID NO: 1899069 - RNA, 18 nt, Human
agaaaaaggaugcacaga

SEQ ID NO: 1899070 - RNA, 17 nt, Human
agaaaaaugagccuggc

SEQ ID NO: 1899071 - RNA, 23 nt, Human
agaaaacacuuaaaaugaucauu

SEQ ID NO: 1899072 - RNA, 15 nt, Human
agaaagaagaugaau

SEQ ID NO: 1899073 - RNA, 12 nt, Human
agaaagaagccc

SEQ ID NO: 1899074 - RNA, 15 nt, Human
agaaacuggaacucu

SEQ ID NO: 1899075 - RNA, 13 nt, Human
agaaacuggaacu

SEQ ID NO: 1899076 - RNA, 12 nt, Human
agaaaacaucua

SEQ ID NO: 1899077 - RNA, 17 nt, Human
ucucuggccuucggccu

SEQ ID NO: 1899078 - RNA, 16 nt, Human
ucucuggccuucggcc

SEQ ID NO: 1899079 - RNA, 13 nt, Human
ucucuggccuucg

SEQ ID NO: 1899080 - RNA, 21 nt, Human
ucucugcgugcagggacaaag

SEQ ID NO: 1899081 - RNA, 14 nt, Human
ucucuugagagggu

SEQ ID NO: 1899082 - RNA, 20 nt, Human
ucuccuucaccuuugucccc

SEQ ID NO: 1899083 - RNA, 19 nt, Human
ucuccuucagcccucaccc

SEQ ID NO: 1899084 - RNA, 15 nt, Human
ucuccuucagcccuc

SEQ ID NO: 1899085 - RNA, 17 nt, Human
acuuuuuuuuguauguu

SEQ ID NO: 1899086 - RNA, 13 nt, Human
ucucuccagcccc

SEQ ID NO: 1899087 - RNA, 14 nt, Human
ucucuccagccccu

SEQ ID NO: 1899088 - RNA, 16 nt, Human
ucuccuuccugugugu

SEQ ID NO: 1899089 - RNA, 14 nt, Human
ucuccuuccugugu

SEQ ID NO: 1899090 - RNA, 13 nt, Human
ucuccuuccugug

SEQ ID NO: 1899091 - RNA, 20 nt, Human
ucuccuucagcccucacccc

SEQ ID NO: 1899092 - RNA, 22 nt, Human
ucucuccuguaccucuugagcc

SEQ ID NO: 1899093 - RNA, 20 nt, Human
ucucuccuguaccucuugag

SEQ ID NO: 1899094 - RNA, 15 nt, Human
ucucuccagccccug

SEQ ID NO: 1899095 - RNA, 13 nt, Human
ucucuccagaugu

SEQ ID NO: 1899096 - RNA, 16 nt, Human
ucucuccagauguuuc

SEQ ID NO: 1899097 - RNA, 18 nt, Human
ucucugccauaaaugauu

SEQ ID NO: 1899098 - RNA, 12 nt, Human
ucucugcccaac

SEQ ID NO: 1899099 - RNA, 13 nt, Human
ucucugcccaacc

SEQ ID NO: 1899100 - RNA, 13 nt, Human
ucuccucugcugc

SEQ ID NO: 1899101 - RNA, 14 nt, Human
ucuccucugcugcu

SEQ ID NO: 1899102 - RNA, 12 nt, Human
ucuccucugcug

SEQ ID NO: 1899103 - RNA, 19 nt, Human
ucucccuuggauugucccc

SEQ ID NO: 1899104 - RNA, 21 nt, Human
ucucccuuggauuguccccga

SEQ ID NO: 1899105 - RNA, 11 nt, Human
ucucccuugga

SEQ ID NO: 1899106 - RNA, 18 nt, Human
ucucccuuggauuguccc

SEQ ID NO: 1899107 - RNA, 14 nt, Human
acuuuuggcauuuu

SEQ ID NO: 1899108 - RNA, 14 nt, Human
acuuuuggaaggua

SEQ ID NO: 1899109 - RNA, 15 nt, Human
acuuuuuuuuaaguu

SEQ ID NO: 1899110 - RNA, 22 nt, Human
acuuuuuuuuuuuaagaguaaa

SEQ ID NO: 1899111 - RNA, 23 nt, Human
acuuuuuugcuauccagcuauuu

SEQ ID NO: 1899112 - RNA, 15 nt, Human
acuuuuucuuuaugu

SEQ ID NO: 1899113 - RNA, 23 nt, Human
acuuuggaaagacuuuuccaacc

SEQ ID NO: 1899114 - RNA, 17 nt, Human
acuuuggaaagacuuuu

SEQ ID NO: 1899115 - RNA, 12 nt, Human
acuuugggaggc

SEQ ID NO: 1899116 - RNA, 17 nt, Human
acuuugggaggccaagg

SEQ ID NO: 1899117 - RNA, 17 nt, Human
acuuugggaggcugagg

SEQ ID NO: 1899118 - RNA, 19 nt, Human
acuuugaggguguauauuu

SEQ ID NO: 1899119 - RNA, 13 nt, Human
acuuuggaaagac

SEQ ID NO: 1899120 - RNA, 14 nt, Human
acuuuggaaagacu

SEQ ID NO: 1899121 - RNA, 23 nt, Human
acuuugaccucugcagcaauaaa

SEQ ID NO: 1899122 - RNA, 19 nt, Human
acuuugaccucugcagcaa

SEQ ID NO: 1899123 - RNA, 23 nt, Human
acuuuaccuuuuuuauacauaaa

SEQ ID NO: 1899124 - RNA, 22 nt, Human
acuuuaccuuuuuuauacauaa

SEQ ID NO: 1899125 - RNA, 19 nt, Human
acuuuaccuuuuuuauaca

SEQ ID NO: 1899126 - RNA, 18 nt, Human
acuuuaccuuuuuuauac

SEQ ID NO: 1899127 - RNA, 19 nt, Human
ugcagucuguccaggcucg

SEQ ID NO: 1899128 - RNA, 21 nt, Human
ugcaggucccuaauaaagcug

SEQ ID NO: 1899129 - RNA, 17 nt, Human
ugcaggucccuaauaaa

SEQ ID NO: 1899130 - RNA, 14 nt, Human
ugcagugagccgag

SEQ ID NO: 1899131 - RNA, 18 nt, Human
ugcaggucccuaauaaag

SEQ ID NO: 1899132 - RNA, 19 nt, Human
ugcaggucccuaauaaagc

SEQ ID NO: 1899133 - RNA, 20 nt, Human
ugcaggucccuaauaaagcu

SEQ ID NO: 1899134 - RNA, 15 nt, Human
ugcauaauggucaga

SEQ ID NO: 1899135 - RNA, 11 nt, Human
ugcauaauaaa

SEQ ID NO: 1899136 - RNA, 19 nt, Human
ugcauaauaaaugcuucag

SEQ ID NO: 1899137 - RNA, 12 nt, Human
ugcaguuuuccu

SEQ ID NO: 1899138 - RNA, 19 nt, Human
ugcagugagccgagauugu

SEQ ID NO: 1899139 - RNA, 19 nt, Human
agccugagcgacagugaga

SEQ ID NO: 1899140 - RNA, 19 nt, Human
ugcagccucaaccuccugg

SEQ ID NO: 1899141 - RNA, 18 nt, Human
ugcagccucaaccuccug

SEQ ID NO: 1899142 - RNA, 18 nt, Human
agccugagcgacagugag

SEQ ID NO: 1899143 - RNA, 16 nt, Human
agccugagcaacucuu

SEQ ID NO: 1899144 - RNA, 21 nt, Human
agccugagcaacucuugauua

SEQ ID NO: 1899145 - RNA, 15 nt, Human
agccucagcauccug

SEQ ID NO: 1899146 - RNA, 16 nt, Human
agccucagcauccugg

SEQ ID NO: 1899147 - RNA, 14 nt, Human
agccucagcauccu

SEQ ID NO: 1899148 - RNA, 13 nt, Human
agccucagcaucc

SEQ ID NO: 1899149 - RNA, 18 nt, Human
agccucaaccuccugggc

SEQ ID NO: 1899150 - RNA, 17 nt, Human
agccucaaccuccuggg

SEQ ID NO: 1899151 - RNA, 22 nt, Human
ugcauaccacuuuuguucuugg

SEQ ID NO: 1899152 - RNA, 21 nt, Human
ugcauaccacuuuuguucuug

SEQ ID NO: 1899153 - RNA, 13 nt, Human
ugcauaauuucag

SEQ ID NO: 1899154 - RNA, 15 nt, Human
ugcaucugaccagca

SEQ ID NO: 1899155 - RNA, 17 nt, Human
ugcaucugaccagcagc

SEQ ID NO: 1899156 - RNA, 22 nt, Human
ugcaucugaccagcagcgccuu

SEQ ID NO: 1899157 - RNA, 18 nt, Human
ugcaucugaccagcagcg

SEQ ID NO: 1899158 - RNA, 21 nt, Human
ugcaucugaccagcagcgccu

SEQ ID NO: 1899159 - RNA, 13 nt, Human
ugcaugcuguccc

SEQ ID NO: 1899160 - RNA, 14 nt, Human
ugcaugcugucccu

SEQ ID NO: 1899161 - RNA, 15 nt, Human
ugcaugcugucccuu

SEQ ID NO: 1899162 - RNA, 20 nt, Human
ugcaugaaguaauaugcaca

SEQ ID NO: 1899163 - RNA, 22 nt, Human
ugcaugaaguaauaugcacaca

SEQ ID NO: 1899164 - RNA, 21 nt, Human
ugcaugaggcuaguguggugu

SEQ ID NO: 1899165 - RNA, 23 nt, Human
agccugcaguuauuaacacuaac

SEQ ID NO: 1899166 - RNA, 18 nt, Human
agccugccacucaggccc

SEQ ID NO: 1899167 - RNA, 16 nt, Human
agccugccucuucucu

SEQ ID NO: 1899168 - RNA, 19 nt, Human
agccugccucuucucuacu

SEQ ID NO: 1899169 - RNA, 16 nt, Human
ugcaugcugucccuua

SEQ ID NO: 1899170 - RNA, 15 nt, Human
agccugcagagcugc

SEQ ID NO: 1899171 - RNA, 14 nt, Human
agccugcagagcug

SEQ ID NO: 1899172 - RNA, 13 nt, Human
agccugcagagcu

SEQ ID NO: 1899173 - RNA, 12 nt, Human
agccugcagagc

SEQ ID NO: 1899174 - RNA, 14 nt, Human
ugcacaagccaggg

SEQ ID NO: 1899175 - RNA, 13 nt, Human
ugcacaagccagg

SEQ ID NO: 1899176 - RNA, 18 nt, Human
agcagcaccguucugugc

SEQ ID NO: 1899177 - RNA, 15 nt, Human
ugcacaagcuccaag

SEQ ID NO: 1899178 - RNA, 16 nt, Human
ugcacaagcuccaagc

SEQ ID NO: 1899179 - RNA, 18 nt, Human
ugcacaagcuccaagcuc

SEQ ID NO: 1899180 - RNA, 20 nt, Human
ugcacaagcuccaagcuccc

SEQ ID NO: 1899181 - RNA, 22 nt, Human
ugcacaagcuccaagcucccag

SEQ ID NO: 1899182 - RNA, 23 nt, Human
ugcacaagcuccaagcucccagg

SEQ ID NO: 1899183 - RNA, 23 nt, Human
ugcacaugaaucccacccacaug

SEQ ID NO: 1899184 - RNA, 15 nt, Human
ugcacacaccagagc

SEQ ID NO: 1899185 - RNA, 14 nt, Human
ugcacaagcugcac

SEQ ID NO: 1899186 - RNA, 15 nt, Human
ugcacaugucuugua

SEQ ID NO: 1899187 - RNA, 19 nt, Human
ugcacaugucuuguacaug

SEQ ID NO: 1899188 - RNA, 14 nt, Human
ugcaccacugcacu

SEQ ID NO: 1899189 - RNA, 17 nt, Human
ugcacguauuuuaauag

SEQ ID NO: 1899190 - RNA, 15 nt, Human
ugcaccacugcacuc

SEQ ID NO: 1899191 - RNA, 22 nt, Human
ugcacuauagccuaggugacag

SEQ ID NO: 1899192 - RNA, 12 nt, Human
ugcacuccccug

SEQ ID NO: 1899193 - RNA, 13 nt, Human
ugcacuccccugc

SEQ ID NO: 1899194 - RNA, 15 nt, Human
ugcacuaaggggccc

SEQ ID NO: 1899195 - RNA, 17 nt, Human
ugcacuaaggggcccgg

SEQ ID NO: 1899196 - RNA, 22 nt, Human
ugcacuaaggggcccggccagc

SEQ ID NO: 1899197 - RNA, 23 nt, Human
ugcacuaaggggcccggccagcc

SEQ ID NO: 1899198 - RNA, 20 nt, Human
ugcagacucuacagaggcca

SEQ ID NO: 1899199 - RNA, 19 nt, Human
ugcagacucuacagaggcc

SEQ ID NO: 1899200 - RNA, 14 nt, Human
ugcagaacuaaacu

SEQ ID NO: 1899201 - RNA, 15 nt, Human
ugcacuccccugcug

SEQ ID NO: 1899202 - RNA, 22 nt, Human
ugcagacucuacagaggccaug

SEQ ID NO: 1899203 - RNA, 15 nt, Human
agccucaaccuccug

SEQ ID NO: 1899204 - RNA, 22 nt, Human
agccuauguggauuuuuuccua

SEQ ID NO: 1899205 - RNA, 17 nt, Human
agccuaggugacagagu

SEQ ID NO: 1899206 - RNA, 15 nt, Human
agccuaggugacaga

SEQ ID NO: 1899207 - RNA, 12 nt, Human
agccuaggccag

SEQ ID NO: 1899208 - RNA, 13 nt, Human
agccuaggccagg

SEQ ID NO: 1899209 - RNA, 14 nt, Human
agccuaggccaggu

SEQ ID NO: 1899210 - RNA, 16 nt, Human
ugcccucaccacccac

SEQ ID NO: 1899211 - RNA, 19 nt, Human
ugccccucaacucuccucc

SEQ ID NO: 1899212 - RNA, 19 nt, Human
ugcccccaggacugggcca

SEQ ID NO: 1899213 - RNA, 17 nt, Human
ugcccccaggacugggc

SEQ ID NO: 1899214 - RNA, 16 nt, Human
ugcccccaggacuggg

SEQ ID NO: 1899215 - RNA, 15 nt, Human
ugcccccaggacugg

SEQ ID NO: 1899216 - RNA, 14 nt, Human
ugcccccaggacug

SEQ ID NO: 1899217 - RNA, 13 nt, Human
ugcccccaggacu

SEQ ID NO: 1899218 - RNA, 12 nt, Human
ugcccccaggac

SEQ ID NO: 1899219 - RNA, 11 nt, Human
ugcccaggccc

SEQ ID NO: 1899220 - RNA, 20 nt, Human
ugcccaggcaggucuugaac

SEQ ID NO: 1899221 - RNA, 17 nt, Human
ugcccaggcaggucuug

SEQ ID NO: 1899222 - RNA, 16 nt, Human
ugcccaggcaggucuu

SEQ ID NO: 1899223 - RNA, 15 nt, Human
ugcccaggcaggucu

SEQ ID NO: 1899224 - RNA, 14 nt, Human
ugcccacaggauca

SEQ ID NO: 1899225 - RNA, 22 nt, Human
ugcccaggccccugccacccug

SEQ ID NO: 1899226 - RNA, 20 nt, Human
ugcccaggccccugccaccc

SEQ ID NO: 1899227 - RNA, 14 nt, Human
ugcccaggccccug

SEQ ID NO: 1899228 - RNA, 12 nt, Human
ugcccaggcccc

SEQ ID NO: 1899229 - RNA, 11 nt, Human
ugcccccagga

SEQ ID NO: 1899230 - RNA, 17 nt, Human
ugcccccacugaccaga

SEQ ID NO: 1899231 - RNA, 19 nt, Human
agcuauggugucauaggcu

SEQ ID NO: 1899232 - RNA, 17 nt, Human
agcuauugauauaaaua

SEQ ID NO: 1899233 - RNA, 23 nt, Human
agcuauugauauaaauaaaacau

SEQ ID NO: 1899234 - RNA, 23 nt, Human
agcuauaaauuccucuuugcuuu

SEQ ID NO: 1899235 - RNA, 23 nt, Human
agcuacugugugugugaaugaac

SEQ ID NO: 1899236 - RNA, 14 nt, Human
agcuacuugggagg

SEQ ID NO: 1899237 - RNA, 15 nt, Human
agcuacugugugugu

SEQ ID NO: 1899238 - RNA, 19 nt, Human
agcuacugugugugugaau

SEQ ID NO: 1899239 - RNA, 20 nt, Human
agcuacugugugugugaaug

SEQ ID NO: 1899240 - RNA, 19 nt, Human
agcuacucgggaagcugag

SEQ ID NO: 1899241 - RNA, 19 nt, Human
ugccauguuggccaggcug

SEQ ID NO: 1899242 - RNA, 18 nt, Human
ugccauguuggccaggcu

SEQ ID NO: 1899243 - RNA, 17 nt, Human
ugccauguuggccaggc

SEQ ID NO: 1899244 - RNA, 17 nt, Human
agcucagggccuggcuc

SEQ ID NO: 1899245 - RNA, 15 nt, Human
agcucagggccuggc

SEQ ID NO: 1899246 - RNA, 16 nt, Human
agcucagggccuggcu

SEQ ID NO: 1899247 - RNA, 22 nt, Human
agcuauuuuuauuuguuugugc

SEQ ID NO: 1899248 - RNA, 21 nt, Human
ugccauguuggccaggcuggu

SEQ ID NO: 1899249 - RNA, 20 nt, Human
ugccauguuggccaggcugg

SEQ ID NO: 1899250 - RNA, 18 nt, Human
agcucagggccuggcuca

SEQ ID NO: 1899251 - RNA, 20 nt, Human
ugcccaacccuucccucacc

SEQ ID NO: 1899252 - RNA, 22 nt, Human
ugcccaacccuucccucaccuu

SEQ ID NO: 1899253 - RNA, 19 nt, Human
ugccauagucacauggccu

SEQ ID NO: 1899254 - RNA, 18 nt, Human
ugccauagucacauggcc

SEQ ID NO: 1899255 - RNA, 15 nt, Human
ugccauauucuguug

SEQ ID NO: 1899256 - RNA, 17 nt, Human
ugccauauucuguuggc

SEQ ID NO: 1899257 - RNA, 16 nt, Human
ugccauauucuguugg

SEQ ID NO: 1899258 - RNA, 22 nt, Human
ugccagucaccccggccaccug

SEQ ID NO: 1899259 - RNA, 23 nt, Human
ugccagucaccccggccaccugc

SEQ ID NO: 1899260 - RNA, 15 nt, Human
ugccagucaccccgg

SEQ ID NO: 1899261 - RNA, 16 nt, Human
ugccagucaccccggc

SEQ ID NO: 1899262 - RNA, 18 nt, Human
ugccagucaccccggcca

SEQ ID NO: 1899263 - RNA, 20 nt, Human
ugccagucaccccggccacc

SEQ ID NO: 1899264 - RNA, 24 nt, Human
agcguggcgcaguggcccugagca

SEQ ID NO: 1899265 - RNA, 22 nt, Human
agcguggcgcaguggcccugag

SEQ ID NO: 1899266 - RNA, 21 nt, Human
agcguggcgcaguggcccuga

SEQ ID NO: 1899267 - RNA, 23 nt, Human
agcgugguggacaugcacagcua

SEQ ID NO: 1899268 - RNA, 17 nt, Human
agcgugagccacugcac

SEQ ID NO: 1899269 - RNA, 16 nt, Human
agcgugagccacugca

SEQ ID NO: 1899270 - RNA, 20 nt, Human
agcgugguggacaugcacag

SEQ ID NO: 1899271 - RNA, 21 nt, Human
ugccauauucuguuggccagu

SEQ ID NO: 1899272 - RNA, 20 nt, Human
ugccauauucuguuggccag

SEQ ID NO: 1899273 - RNA, 15 nt, Human
agcggggacagcucc

SEQ ID NO: 1899274 - RNA, 17 nt, Human
agcggggacagcuccuu

SEQ ID NO: 1899275 - RNA, 16 nt, Human
agcggggacagcuccu

SEQ ID NO: 1899276 - RNA, 15 nt, Human
agcgugagccacugc

SEQ ID NO: 1899277 - RNA, 22 nt, Human
ugcauugaacacaaacuguaaa

SEQ ID NO: 1899278 - RNA, 19 nt, Human
ugcauugaacacaaacugu

SEQ ID NO: 1899279 - RNA, 21 nt, Human
ugcauugaacacaaacuguaa

SEQ ID NO: 1899280 - RNA, 23 nt, Human
ugcauuugaaaauuuugauguuu

SEQ ID NO: 1899281 - RNA, 19 nt, Human
ugcauuugaaaauuuugau

SEQ ID NO: 1899282 - RNA, 17 nt, Human
agcggcuggacuuggag

SEQ ID NO: 1899283 - RNA, 20 nt, Human
agcggcuggaauuggguggg

SEQ ID NO: 1899284 - RNA, 13 nt, Human
ugcauugaacaca

SEQ ID NO: 1899285 - RNA, 14 nt, Human
ugcauugaacacaa

SEQ ID NO: 1899286 - RNA, 15 nt, Human
ugcauugaacacaaa

SEQ ID NO: 1899287 - RNA, 17 nt, Human
ugcauugaacacaaacu

SEQ ID NO: 1899288 - RNA, 18 nt, Human
ugcauugaacacaaacug

SEQ ID NO: 1899289 - RNA, 22 nt, Human
ugccacacaaggauagaugcug

SEQ ID NO: 1899290 - RNA, 18 nt, Human
ugccaauauuaaaucugc

SEQ ID NO: 1899291 - RNA, 19 nt, Human
ugccaauauuaaaucugcu

SEQ ID NO: 1899292 - RNA, 19 nt, Human
ugccacaaggacuuccugu

SEQ ID NO: 1899293 - RNA, 22 nt, Human
agcgcccaguuggguggaugcc

SEQ ID NO: 1899294 - RNA, 14 nt, Human
agcgcccaguuggg

SEQ ID NO: 1899295 - RNA, 14 nt, Human
agccugcuccagcu

SEQ ID NO: 1899296 - RNA, 12 nt, Human
agcgccaggcug

SEQ ID NO: 1899297 - RNA, 21 nt, Human
agcgccaggcugaccacagca

SEQ ID NO: 1899298 - RNA, 21 nt, Human
agccugcgccaccgcccagag

SEQ ID NO: 1899299 - RNA, 21 nt, Human
agcgcuccugccgcagagcug

SEQ ID NO: 1899300 - RNA, 20 nt, Human
agcgcuccugccgcagagcu

SEQ ID NO: 1899301 - RNA, 17 nt, Human
agcgcuccugccgcaga

SEQ ID NO: 1899302 - RNA, 22 nt, Human
agcgcuccugccgcagagcugg

SEQ ID NO: 1899303 - RNA, 11 nt, Human
agcggccggcc

SEQ ID NO: 1899304 - RNA, 18 nt, Human
agcggccggccagccccu

SEQ ID NO: 1899305 - RNA, 22 nt, Human
agcggccggccagccccuggcc

SEQ ID NO: 1899306 - RNA, 18 nt, Human
ugcccuuggcacccaaga

SEQ ID NO: 1899307 - RNA, 14 nt, Human
agcugccagccgag

SEQ ID NO: 1899308 - RNA, 13 nt, Human
agcugccaccugc

SEQ ID NO: 1899309 - RNA, 18 nt, Human
agcugcauacaguuugca

SEQ ID NO: 1899310 - RNA, 16 nt, Human
ugccgcgucgcccucc

SEQ ID NO: 1899311 - RNA, 21 nt, Human
ugccgcgucgcccucccaggc

SEQ ID NO: 1899312 - RNA, 22 nt, Human
ugccucauuuagagaggaaaag

SEQ ID NO: 1899313 - RNA, 20 nt, Human
ugccgcgucgcccucccagg

SEQ ID NO: 1899314 - RNA, 21 nt, Human
ugccucugacacacagcucug

SEQ ID NO: 1899315 - RNA, 20 nt, Human
ugccucugacacacagcucu

SEQ ID NO: 1899316 - RNA, 19 nt, Human
ugccucucugcaggucccu

SEQ ID NO: 1899317 - RNA, 20 nt, Human
ugccucucugcaggucccua

SEQ ID NO: 1899318 - RNA, 16 nt, Human
ugccucucugcagguc

SEQ ID NO: 1899319 - RNA, 18 nt, Human
ugccucucugcagguccc

SEQ ID NO: 1899320 - RNA, 16 nt, Human
ugccucucucaggcca

SEQ ID NO: 1899321 - RNA, 15 nt, Human
ugccuccauccuagu

SEQ ID NO: 1899322 - RNA, 12 nt, Human
ugccuccauccu

SEQ ID NO: 1899323 - RNA, 15 nt, Human
ugccucucucaggcc

SEQ ID NO: 1899324 - RNA, 13 nt, Human
ugccucccaucac

SEQ ID NO: 1899325 - RNA, 14 nt, Human
ugccucccaucacc

SEQ ID NO: 1899326 - RNA, 19 nt, Human
ugccucccaucacccgcua

SEQ ID NO: 1899327 - RNA, 13 nt, Human
ugccucucucagg

SEQ ID NO: 1899328 - RNA, 14 nt, Human
ugccucucucaggc

SEQ ID NO: 1899329 - RNA, 14 nt, Human
agcucuguccuggg

SEQ ID NO: 1899330 - RNA, 12 nt, Human
agcucuguccug

SEQ ID NO: 1899331 - RNA, 18 nt, Human
agcucuucuccaggcugu

SEQ ID NO: 1899332 - RNA, 19 nt, Human
agcucuugaagacacugaa

SEQ ID NO: 1899333 - RNA, 11 nt, Human
agcugaugacu

SEQ ID NO: 1899334 - RNA, 15 nt, Human
agcugaugacucaag

SEQ ID NO: 1899335 - RNA, 13 nt, Human
agcugcacccuca

SEQ ID NO: 1899336 - RNA, 17 nt, Human
agcugcacccucaggca

SEQ ID NO: 1899337 - RNA, 22 nt, Human
agcugaugacucaagauuccca

SEQ ID NO: 1899338 - RNA, 18 nt, Human
agcugcacccucaggcag

SEQ ID NO: 1899339 - RNA, 19 nt, Human
agcugcacccucaggcagg

SEQ ID NO: 1899340 - RNA, 20 nt, Human
agcugcacccucaggcaggu

SEQ ID NO: 1899341 - RNA, 22 nt, Human
agcugcacccucaggcaggugg

SEQ ID NO: 1899342 - RNA, 12 nt, Human
agcucugcuccu

SEQ ID NO: 1899343 - RNA, 22 nt, Human
agcucugcuccucuccccagca

SEQ ID NO: 1899344 - RNA, 20 nt, Human
agcucugguccauagagagc

SEQ ID NO: 1899345 - RNA, 16 nt, Human
agcucucuccucccuu

SEQ ID NO: 1899346 - RNA, 17 nt, Human
agcucucggaacugcau

SEQ ID NO: 1899347 - RNA, 18 nt, Human
agcucucggaacugcaug

SEQ ID NO: 1899348 - RNA, 20 nt, Human
agcucucggaacugcaugcu

SEQ ID NO: 1899349 - RNA, 22 nt, Human
agcucucggaacugcaugcugc

SEQ ID NO: 1899350 - RNA, 23 nt, Human
agcucucggaacugcaugcugcu

SEQ ID NO: 1899351 - RNA, 22 nt, Human
agcucuauguuuacaaauggac

SEQ ID NO: 1899352 - RNA, 18 nt, Human
ugcccuccagcucuuucc

SEQ ID NO: 1899353 - RNA, 19 nt, Human
ugcccuccagcucuuuccu

SEQ ID NO: 1899354 - RNA, 15 nt, Human
agcucuccccucaga

SEQ ID NO: 1899355 - RNA, 22 nt, Human
ugcccuccaagaccuucuccuu

SEQ ID NO: 1899356 - RNA, 19 nt, Human
ugcccuccaagaccuucuc

SEQ ID NO: 1899357 - RNA, 20 nt, Human
ugcccuccaagaccuucucc

SEQ ID NO: 1899358 - RNA, 14 nt, Human
agcugggagccggg

SEQ ID NO: 1899359 - RNA, 15 nt, Human
agcugggagccgggc

SEQ ID NO: 1899360 - RNA, 19 nt, Human
agcugggacuacaggugug

SEQ ID NO: 1899361 - RNA, 17 nt, Human
agcugggacuacaggug

SEQ ID NO: 1899362 - RNA, 23 nt, Human
agcugggaugauuggagggggga

SEQ ID NO: 1899363 - RNA, 17 nt, Human
agcuggggccaggcugg

SEQ ID NO: 1899364 - RNA, 15 nt, Human
agcuggggaucccuc

SEQ ID NO: 1899365 - RNA, 22 nt, Human
agcuggggaucccuccccccca

SEQ ID NO: 1899366 - RNA, 14 nt, Human
agcugggcagguug

SEQ ID NO: 1899367 - RNA, 17 nt, Human
agcugggauguuucugu

SEQ ID NO: 1899368 - RNA, 19 nt, Human
agcugccucugccacugac

SEQ ID NO: 1899369 - RNA, 23 nt, Human
agcugccuccccucuccuuccug

SEQ ID NO: 1899370 - RNA, 20 nt, Human
agcugccuccccucuccuuc

SEQ ID NO: 1899371 - RNA, 22 nt, Human
ugccucugacacacagcucugu

SEQ ID NO: 1899372 - RNA, 10 nt, Human
agcugccugu

SEQ ID NO: 1899373 - RNA, 17 nt, Human
agcuggagaaauauggu

SEQ ID NO: 1899374 - RNA, 21 nt, Human
agcugccugggaucccucauc

SEQ ID NO: 1899375 - RNA, 13 nt, Human
agcugccugggau

SEQ ID NO: 1899376 - RNA, 19 nt, Human
agcugccugggaucccuca

SEQ ID NO: 1899377 - RNA, 19 nt, Human
ugcgacacugggaggccag

SEQ ID NO: 1899378 - RNA, 19 nt, Human
ugcgaaaggaugaaaguga

SEQ ID NO: 1899379 - RNA, 18 nt, Human
ugcggacagccacggcca

SEQ ID NO: 1899380 - RNA, 13 nt, Human
ugcgaaaggauga

SEQ ID NO: 1899381 - RNA, 14 nt, Human
ugccuuuacuucag

SEQ ID NO: 1899382 - RNA, 17 nt, Human
ugccuguucagcuccag

SEQ ID NO: 1899383 - RNA, 16 nt, Human
ugccuguucagcucca

SEQ ID NO: 1899384 - RNA, 15 nt, Human
ugccuguucagcucc

SEQ ID NO: 1899385 - RNA, 19 nt, Human
ugccuugugaaggaauuau

SEQ ID NO: 1899386 - RNA, 20 nt, Human
agcuggggccaggcuggguc

SEQ ID NO: 1899387 - RNA, 15 nt, Human
agcuggggaugucuc

SEQ ID NO: 1899388 - RNA, 17 nt, Human
agcugggggugggccag

SEQ ID NO: 1899389 - RNA, 18 nt, Human
agcugggggugggccagg

SEQ ID NO: 1899390 - RNA, 19 nt, Human
agcugggggugggccaggc

SEQ ID NO: 1899391 - RNA, 20 nt, Human
agcugggggugggccaggcu

SEQ ID NO: 1899392 - RNA, 21 nt, Human
agcugggggugggccaggcug

SEQ ID NO: 1899393 - RNA, 15 nt, Human
agcugugcacaaagu

SEQ ID NO: 1899394 - RNA, 20 nt, Human
agcugugcacaaaguggcau

SEQ ID NO: 1899395 - RNA, 21 nt, Human
aggaaacucugcauucuagua

SEQ ID NO: 1899396 - RNA, 12 nt, Human
aggaaagaggcu

SEQ ID NO: 1899397 - RNA, 13 nt, Human
aggaaagaggcuc

SEQ ID NO: 1899398 - RNA, 16 nt, Human
aggaaagaggcucugg

SEQ ID NO: 1899399 - RNA, 17 nt, Human
aggaaagcaaaggagau

SEQ ID NO: 1899400 - RNA, 19 nt, Human
aggaaagcaaaggagauug

SEQ ID NO: 1899401 - RNA, 14 nt, Human
ugcuauagccuggg

SEQ ID NO: 1899402 - RNA, 23 nt, Human
aggaaaccaguuaggucucaaua

SEQ ID NO: 1899403 - RNA, 21 nt, Human
aggaaacccagcucuggucca

SEQ ID NO: 1899404 - RNA, 18 nt, Human
aggaaacccagcucuggu

SEQ ID NO: 1899405 - RNA, 20 nt, Human
aggaaacccagcucuggucc

SEQ ID NO: 1899406 - RNA, 15 nt, Human
aggaaacccagcucu

SEQ ID NO: 1899407 - RNA, 13 nt, Human
aggaaaauauuuu

SEQ ID NO: 1899408 - RNA, 15 nt, Human
aggaaaauauuuuga

SEQ ID NO: 1899409 - RNA, 22 nt, Human
aggaaaauauuuugaucuucaa

SEQ ID NO: 1899410 - RNA, 16 nt, Human
aggaaacccagcucug

SEQ ID NO: 1899411 - RNA, 17 nt, Human
aggaaacccagcucugg

SEQ ID NO: 1899412 - RNA, 12 nt, Human
agcuuugaaaau

SEQ ID NO: 1899413 - RNA, 16 nt, Human
agcuuugaaaauucag

SEQ ID NO: 1899414 - RNA, 18 nt, Human
agcuuugaaaauucagug

SEQ ID NO: 1899415 - RNA, 19 nt, Human
agcuuugaaaauucagugg

SEQ ID NO: 1899416 - RNA, 21 nt, Human
aggaaaaggugauauccauuc

SEQ ID NO: 1899417 - RNA, 17 nt, Human
agcuuugacacuggaau

SEQ ID NO: 1899418 - RNA, 22 nt, Human
agcuuugacacuggaaugaguu

SEQ ID NO: 1899419 - RNA, 18 nt, Human
aggaaaaggugauaucca

SEQ ID NO: 1899420 - RNA, 22 nt, Human
agcuuauuaaugcuaagggcag

SEQ ID NO: 1899421 - RNA, 21 nt, Human
agcuuauuaaugcuaagggca

SEQ ID NO: 1899422 - RNA, 19 nt, Human
agcuuauuaaugcuaaggg

SEQ ID NO: 1899423 - RNA, 23 nt, Human
agcuuggaaacuggaugagguca

SEQ ID NO: 1899424 - RNA, 18 nt, Human
agcuuauuaaugcuaagg

SEQ ID NO: 1899425 - RNA, 17 nt, Human
agcuuauuaaugcuaag

SEQ ID NO: 1899426 - RNA, 16 nt, Human
agcuuauuaaugcuaa

SEQ ID NO: 1899427 - RNA, 15 nt, Human
agcuuauuaaugcua

SEQ ID NO: 1899428 - RNA, 14 nt, Human
agcuuauuaaugcu

SEQ ID NO: 1899429 - RNA, 21 nt, Human
agcuuguaaauagcucaggug

SEQ ID NO: 1899430 - RNA, 20 nt, Human
agcuuguaaauagcucaggu

SEQ ID NO: 1899431 - RNA, 19 nt, Human
agcuuguaaauagcucagg

SEQ ID NO: 1899432 - RNA, 14 nt, Human
agcuuucuuucaca

SEQ ID NO: 1899433 - RNA, 20 nt, Human
agcuuucuuucacaaaaaag

SEQ ID NO: 1899434 - RNA, 21 nt, Human
ugcggacagccacggccaggc

SEQ ID NO: 1899435 - RNA, 20 nt, Human
ugcggacagccacggccagg

SEQ ID NO: 1899436 - RNA, 15 nt, Human
agcuguuuucccuga

SEQ ID NO: 1899437 - RNA, 20 nt, Human
agcuuaaaggggcuagagug

SEQ ID NO: 1899438 - RNA, 18 nt, Human
agcuguuuucccugaccu

SEQ ID NO: 1899439 - RNA, 12 nt, Human
agcuuaucucag

SEQ ID NO: 1899440 - RNA, 14 nt, Human
agcuuaucucaggg

SEQ ID NO: 1899441 - RNA, 15 nt, Human
agcuuaucucagggg

SEQ ID NO: 1899442 - RNA, 17 nt, Human
ugcugacuguuuucucu

SEQ ID NO: 1899443 - RNA, 19 nt, Human
ugcucugugcccacccucc

SEQ ID NO: 1899444 - RNA, 20 nt, Human
ugcucuggaccugcccccgc

SEQ ID NO: 1899445 - RNA, 13 nt, Human
ugcucuggaccug

SEQ ID NO: 1899446 - RNA, 14 nt, Human
ugcucuggaccugc

SEQ ID NO: 1899447 - RNA, 15 nt, Human
ugcucuggaccugcc

SEQ ID NO: 1899448 - RNA, 16 nt, Human
ugcucuggaccugccc

SEQ ID NO: 1899449 - RNA, 17 nt, Human
ugcucuggacaggcaug

SEQ ID NO: 1899450 - RNA, 12 nt, Human
ugcucuggaccu

SEQ ID NO: 1899451 - RNA, 15 nt, Human
ugcucugcauguuac

SEQ ID NO: 1899452 - RNA, 18 nt, Human
ugcucugcauguuacaua

SEQ ID NO: 1899453 - RNA, 19 nt, Human
ugcucugaucauccacugu

SEQ ID NO: 1899454 - RNA, 19 nt, Human
ugcuauccagcuauuuuua

SEQ ID NO: 1899455 - RNA, 22 nt, Human
ugcucugaucauccacugugcc

SEQ ID NO: 1899456 - RNA, 21 nt, Human
ugcugacuguuuucucuugag

SEQ ID NO: 1899457 - RNA, 24 nt, Human
ugcugacuguuuucucuugagagg

SEQ ID NO: 1899458 - RNA, 18 nt, Human
aggaaaggcuccaggagc

SEQ ID NO: 1899459 - RNA, 20 nt, Human
aggaaaggcuccaggagcag

SEQ ID NO: 1899460 - RNA, 21 nt, Human
aggaaagcuugaguaaaauaa

SEQ ID NO: 1899461 - RNA, 22 nt, Human
aggaaaggcuccaggagcagcc

SEQ ID NO: 1899462 - RNA, 23 nt, Human
aggaaaggcuccaggagcagcca

SEQ ID NO: 1899463 - RNA, 23 nt, Human
aggaauccagacccggcugcgug

SEQ ID NO: 1899464 - RNA, 19 nt, Human
aggaauugacccacaagaa

SEQ ID NO: 1899465 - RNA, 17 nt, Human
aggaagcucagggccug

SEQ ID NO: 1899466 - RNA, 18 nt, Human
aggaagcucagggccugg

SEQ ID NO: 1899467 - RNA, 22 nt, Human
aggaagcucagggccuggcuca

SEQ ID NO: 1899468 - RNA, 14 nt, Human
aggaagagaaaaaa

SEQ ID NO: 1899469 - RNA, 14 nt, Human
aggaagagaaacca

SEQ ID NO: 1899470 - RNA, 15 nt, Human
aggaagacuuuggaa

SEQ ID NO: 1899471 - RNA, 15 nt, Human
ugcugccauccaggu

SEQ ID NO: 1899472 - RNA, 14 nt, Human
ugcugccauccagg

SEQ ID NO: 1899473 - RNA, 13 nt, Human
ugcugccauccag

SEQ ID NO: 1899474 - RNA, 12 nt, Human
ugcugccaucca

SEQ ID NO: 1899475 - RNA, 22 nt, Human
ugcugccauccagguucagcuu

SEQ ID NO: 1899476 - RNA, 21 nt, Human
ugcugccauccagguucagcu

SEQ ID NO: 1899477 - RNA, 11 nt, Human
ugcugccaucc

SEQ ID NO: 1899478 - RNA, 22 nt, Human
aggaauuuuauuuuuuucugaa

SEQ ID NO: 1899479 - RNA, 16 nt, Human
aggaauuuucuccaau

SEQ ID NO: 1899480 - RNA, 19 nt, Human
aggaauuuucuccaauuuu

SEQ ID NO: 1899481 - RNA, 20 nt, Human
aggauuucaugauuucauuu

SEQ ID NO: 1899482 - RNA, 19 nt, Human
aggauuucaugauuucauu

SEQ ID NO: 1899483 - RNA, 22 nt, Human
aggauugcuacuguccuaccca

SEQ ID NO: 1899484 - RNA, 18 nt, Human
aggaugcuuguacauaau

SEQ ID NO: 1899485 - RNA, 12 nt, Human
aggaucagucug

SEQ ID NO: 1899486 - RNA, 21 nt, Human
aggauccugagccagauuuca

SEQ ID NO: 1899487 - RNA, 16 nt, Human
aggaugcuuguacaua

SEQ ID NO: 1899488 - RNA, 15 nt, Human
aggaugcuuguacau

SEQ ID NO: 1899489 - RNA, 12 nt, Human
aggaucucuuga

SEQ ID NO: 1899490 - RNA, 15 nt, Human
uggacaccggaaaca

SEQ ID NO: 1899491 - RNA, 17 nt, Human
uggacaaaauggaauac

SEQ ID NO: 1899492 - RNA, 14 nt, Human
uggacaaaauggaa

SEQ ID NO: 1899493 - RNA, 14 nt, Human
aggcaagcaccucc

SEQ ID NO: 1899494 - RNA, 19 nt, Human
aggcaacugcauuggcuuu

SEQ ID NO: 1899495 - RNA, 12 nt, Human
aggcaagagaau

SEQ ID NO: 1899496 - RNA, 14 nt, Human
uggaauuugaaaca

SEQ ID NO: 1899497 - RNA, 10 nt, Human
ugcugcccug

SEQ ID NO: 1899498 - RNA, 12 nt, Human
ugcugcccugcc

SEQ ID NO: 1899499 - RNA, 17 nt, Human
uggaacacggccacauc

SEQ ID NO: 1899500 - RNA, 15 nt, Human
uggaacacggccaca

SEQ ID NO: 1899501 - RNA, 13 nt, Human
uggaagcuccgcu

SEQ ID NO: 1899502 - RNA, 18 nt, Human
uggaagcuaauuugcauu

SEQ ID NO: 1899503 - RNA, 14 nt, Human
uggaacacucugag

SEQ ID NO: 1899504 - RNA, 16 nt, Human
uggaagcuaauuugca

SEQ ID NO: 1899505 - RNA, 17 nt, Human
uggaagcuaauuugcau

SEQ ID NO: 1899506 - RNA, 12 nt, Human
uggaacacucug

SEQ ID NO: 1899507 - RNA, 20 nt, Human
uggaaguacuauaauuuacc

SEQ ID NO: 1899508 - RNA, 14 nt, Human
uggaaguaguggag

SEQ ID NO: 1899509 - RNA, 17 nt, Human
uggaaguaguggagccc

SEQ ID NO: 1899510 - RNA, 17 nt, Human
uggaaguccaauguggc

SEQ ID NO: 1899511 - RNA, 19 nt, Human
aggaguuucguuuucaaaa

SEQ ID NO: 1899512 - RNA, 21 nt, Human
aggaguuugagaccaaccugg

SEQ ID NO: 1899513 - RNA, 15 nt, Human
aggaggccagccuug

SEQ ID NO: 1899514 - RNA, 20 nt, Human
uggaagugugggucugugug

SEQ ID NO: 1899515 - RNA, 14 nt, Human
uggaagugcuaauu

SEQ ID NO: 1899516 - RNA, 14 nt, Human
uggaaguguggguc

SEQ ID NO: 1899517 - RNA, 13 nt, Human
uggaagugugggu

SEQ ID NO: 1899518 - RNA, 16 nt, Human
aggcaaugcuggcugu

SEQ ID NO: 1899519 - RNA, 14 nt, Human
uggagcuuuuuucc

SEQ ID NO: 1899520 - RNA, 15 nt, Human
aggcaaugcuggcug

SEQ ID NO: 1899521 - RNA, 16 nt, Human
uggagccugcagagcu

SEQ ID NO: 1899522 - RNA, 11 nt, Human
uggagccugca

SEQ ID NO: 1899523 - RNA, 19 nt, Human
uggagcccagaggagggca

SEQ ID NO: 1899524 - RNA, 15 nt, Human
uggagcccagaggag

SEQ ID NO: 1899525 - RNA, 21 nt, Human
uggagaagccacaggccugag

SEQ ID NO: 1899526 - RNA, 23 nt, Human
uggagcccagaggagggcagcag

SEQ ID NO: 1899527 - RNA, 20 nt, Human
uggagcccagaggagggcag

SEQ ID NO: 1899528 - RNA, 22 nt, Human
uggacuuuguuaguuucuccaa

SEQ ID NO: 1899529 - RNA, 11 nt, Human
uggacuuuguu

SEQ ID NO: 1899530 - RNA, 19 nt, Human
uggagcccacuguacuugc

SEQ ID NO: 1899531 - RNA, 23 nt, Human
uggagcccacuguacuugcucuu

SEQ ID NO: 1899532 - RNA, 16 nt, Human
uggagcccacuguacu

SEQ ID NO: 1899533 - RNA, 20 nt, Human
uggagaagccacaggccuga

SEQ ID NO: 1899534 - RNA, 19 nt, Human
uggagaagccacaggccug

SEQ ID NO: 1899535 - RNA, 18 nt, Human
uggagaagccacaggccu

SEQ ID NO: 1899536 - RNA, 24 nt, Human
uggacuuuguuaguuucuccaagc

SEQ ID NO: 1899537 - RNA, 22 nt, Human
aggcagccccauucugccugcc

SEQ ID NO: 1899538 - RNA, 21 nt, Human
aggcagccccauucugccugc

SEQ ID NO: 1899539 - RNA, 20 nt, Human
aggcagccccauucugccug

SEQ ID NO: 1899540 - RNA, 19 nt, Human
aggcagccccauucugccu

SEQ ID NO: 1899541 - RNA, 15 nt, Human
aggcacccaccauca

SEQ ID NO: 1899542 - RNA, 20 nt, Human
aggcaggaguuucguuuuca

SEQ ID NO: 1899543 - RNA, 12 nt, Human
aggcaggauggc

SEQ ID NO: 1899544 - RNA, 23 nt, Human
aggcaggaccuucgggcugugcc

SEQ ID NO: 1899545 - RNA, 22 nt, Human
aggcaggaccuucgggcugugc

SEQ ID NO: 1899546 - RNA, 21 nt, Human
aggcaggaccuucgggcugug

SEQ ID NO: 1899547 - RNA, 21 nt, Human
aggcagggucucacucugucg

SEQ ID NO: 1899548 - RNA, 20 nt, Human
aggcagggucucacucuguc

SEQ ID NO: 1899549 - RNA, 18 nt, Human
aggcagggucucacucug

SEQ ID NO: 1899550 - RNA, 19 nt, Human
aggcagggucucacucugu

SEQ ID NO: 1899551 - RNA, 14 nt, Human
aggcagguccaggg

SEQ ID NO: 1899552 - RNA, 11 nt, Human
aggcagguccc

SEQ ID NO: 1899553 - RNA, 22 nt, Human
aggcagggucucacucugucgc

SEQ ID NO: 1899554 - RNA, 14 nt, Human
aggcagggugcagu

SEQ ID NO: 1899555 - RNA, 21 nt, Human
aggcaggucuugaacuccugg

SEQ ID NO: 1899556 - RNA, 16 nt, Human
aggcagguccccagac

SEQ ID NO: 1899557 - RNA, 15 nt, Human
aggcagguccccaga

SEQ ID NO: 1899558 - RNA, 14 nt, Human
aggcagguccccag

SEQ ID NO: 1899559 - RNA, 13 nt, Human
aggcaggucccca

SEQ ID NO: 1899560 - RNA, 12 nt, Human
aggcaggucccc

SEQ ID NO: 1899561 - RNA, 13 nt, Human
aggcuccaggagc

SEQ ID NO: 1899562 - RNA, 14 nt, Human
aggcucauuuacug

SEQ ID NO: 1899563 - RNA, 15 nt, Human
aggcucauuuacugu

SEQ ID NO: 1899564 - RNA, 14 nt, Human
aggcuccaggagca

SEQ ID NO: 1899565 - RNA, 16 nt, Human
aggcuccaggagcagc

SEQ ID NO: 1899566 - RNA, 22 nt, Human
aggcuccacuuggucugugaga

SEQ ID NO: 1899567 - RNA, 21 nt, Human
aggcuccacuuggucugugag

SEQ ID NO: 1899568 - RNA, 17 nt, Human
aggcuccacuuggucug

SEQ ID NO: 1899569 - RNA, 11 nt, Human
aggcuccacuu

SEQ ID NO: 1899570 - RNA, 10 nt, Human
aggcucaggu

SEQ ID NO: 1899571 - RNA, 16 nt, Human
aggcucaggucccugg

SEQ ID NO: 1899572 - RNA, 18 nt, Human
aggccuucucugaaggac

SEQ ID NO: 1899573 - RNA, 17 nt, Human
aggccuucucugaagga

SEQ ID NO: 1899574 - RNA, 14 nt, Human
aggccuuuaaccau

SEQ ID NO: 1899575 - RNA, 21 nt, Human
aggcgcacugugacccccagc

SEQ ID NO: 1899576 - RNA, 22 nt, Human
aggcgcacugugacccccagcu

SEQ ID NO: 1899577 - RNA, 21 nt, Human
aggcuauuguccccuaaacca

SEQ ID NO: 1899578 - RNA, 22 nt, Human
uggcaugggaaugaaugucagu

SEQ ID NO: 1899579 - RNA, 19 nt, Human
uggcccacgcacuucggga

SEQ ID NO: 1899580 - RNA, 13 nt, Human
uggcccacugcau

SEQ ID NO: 1899581 - RNA, 14 nt, Human
uggcccacugcauc

SEQ ID NO: 1899582 - RNA, 17 nt, Human
uggcccaggaccaucau

SEQ ID NO: 1899583 - RNA, 15 nt, Human
uggccgaguccaagc

SEQ ID NO: 1899584 - RNA, 20 nt, Human
uggccucugcacuccccugc

SEQ ID NO: 1899585 - RNA, 19 nt, Human
uggccucugcacuccccug

SEQ ID NO: 1899586 - RNA, 22 nt, Human
uggccugaucagaccacggcuc

SEQ ID NO: 1899587 - RNA, 18 nt, Human
aggccaugggccuccugu

SEQ ID NO: 1899588 - RNA, 23 nt, Human
aggccagagacacaagccuucgg

SEQ ID NO: 1899589 - RNA, 15 nt, Human
aggcccagagggccu

SEQ ID NO: 1899590 - RNA, 16 nt, Human
aggcccagagggccug

SEQ ID NO: 1899591 - RNA, 14 nt, Human
uggcagcucagaga

SEQ ID NO: 1899592 - RNA, 15 nt, Human
uggcagcucagagag

SEQ ID NO: 1899593 - RNA, 16 nt, Human
uggcagcucagagagg

SEQ ID NO: 1899594 - RNA, 18 nt, Human
uggcagcucagagagggu

SEQ ID NO: 1899595 - RNA, 13 nt, Human
aggccagagacac

SEQ ID NO: 1899596 - RNA, 18 nt, Human
aggccagagacacaagcc

SEQ ID NO: 1899597 - RNA, 22 nt, Human
uggcagauguaaaguuauucuu

SEQ ID NO: 1899598 - RNA, 16 nt, Human
uggcaccagcagccug

SEQ ID NO: 1899599 - RNA, 17 nt, Human
uggcaccagcagccugg

SEQ ID NO: 1899600 - RNA, 23 nt, Human
uggcaccagacacccaggacuua

SEQ ID NO: 1899601 - RNA, 17 nt, Human
uggcaccagacacccag

SEQ ID NO: 1899602 - RNA, 20 nt, Human
uggcaccagacacccaggac

SEQ ID NO: 1899603 - RNA, 21 nt, Human
uggcaccagacacccaggacu

SEQ ID NO: 1899604 - RNA, 20 nt, Human
uggcacagcccaaagaagga

SEQ ID NO: 1899605 - RNA, 18 nt, Human
uggcacagcccaaagaag

SEQ ID NO: 1899606 - RNA, 14 nt, Human
uggcacaggacaug

SEQ ID NO: 1899607 - RNA, 18 nt, Human
aggcauccuuccucacac

SEQ ID NO: 1899608 - RNA, 20 nt, Human
aggcauccuuccucacacca

SEQ ID NO: 1899609 - RNA, 21 nt, Human
aggccccugccacccugggga

SEQ ID NO: 1899610 - RNA, 18 nt, Human
aggccccugccacccugg

SEQ ID NO: 1899611 - RNA, 17 nt, Human
aggccccugccacccug

SEQ ID NO: 1899612 - RNA, 15 nt, Human
aggccccugccaccc

SEQ ID NO: 1899613 - RNA, 13 nt, Human
aggccccugccac

SEQ ID NO: 1899614 - RNA, 19 nt, Human
aggcccagagggccugcaa

SEQ ID NO: 1899615 - RNA, 20 nt, Human
aggcccagagggccugcaag

SEQ ID NO: 1899616 - RNA, 16 nt, Human
aggcccggcuccaggc

SEQ ID NO: 1899617 - RNA, 15 nt, Human
aggcccggcuccagg

SEQ ID NO: 1899618 - RNA, 14 nt, Human
aggcccggcuccag

SEQ ID NO: 1899619 - RNA, 21 nt, Human
aggccccugucucagggugag

SEQ ID NO: 1899620 - RNA, 17 nt, Human
aggcccggcuccaggcu

SEQ ID NO: 1899621 - RNA, 12 nt, Human
aggccuggccag

SEQ ID NO: 1899622 - RNA, 16 nt, Human
aggccugacucucagc

SEQ ID NO: 1899623 - RNA, 13 nt, Human
aggccuggccaga

SEQ ID NO: 1899624 - RNA, 22 nt, Human
ugggaaccccuucauccucuga

SEQ ID NO: 1899625 - RNA, 20 nt, Human
ugggaaccccuucauccucu

SEQ ID NO: 1899626 - RNA, 19 nt, Human
aggcugggagagccuucca

SEQ ID NO: 1899627 - RNA, 16 nt, Human
aggcugggagagccuu

SEQ ID NO: 1899628 - RNA, 22 nt, Human
aggcugggagagccuuccaggg

SEQ ID NO: 1899629 - RNA, 20 nt, Human
aggcugggagagccuuccag

SEQ ID NO: 1899630 - RNA, 21 nt, Human
aggcugggagagccuuccagg

SEQ ID NO: 1899631 - RNA, 14 nt, Human
aggcugggcuucag

SEQ ID NO: 1899632 - RNA, 18 nt, Human
aggcugggcguaguggcu

SEQ ID NO: 1899633 - RNA, 21 nt, Human
aggcugggcucccuucccacc

SEQ ID NO: 1899634 - RNA, 23 nt, Human
aggcugggcucccuucccaccuc

SEQ ID NO: 1899635 - RNA, 13 nt, Human
aggcugggcuccc

SEQ ID NO: 1899636 - RNA, 14 nt, Human
aggcugggcucccu

SEQ ID NO: 1899637 - RNA, 18 nt, Human
aggcugggcucccuuccc

SEQ ID NO: 1899638 - RNA, 23 nt, Human
aggcugggcuucaguggcagcug

SEQ ID NO: 1899639 - RNA, 22 nt, Human
aggcugggcuucaguggcagcu

SEQ ID NO: 1899640 - RNA, 17 nt, Human
aggcugggggaagaagc

SEQ ID NO: 1899641 - RNA, 21 nt, Human
aggcugggcuucaguggcagc

SEQ ID NO: 1899642 - RNA, 20 nt, Human
aggcugggcuucaguggcag

SEQ ID NO: 1899643 - RNA, 19 nt, Human
aggcugggcuucaguggca

SEQ ID NO: 1899644 - RNA, 18 nt, Human
aggcugggcuucaguggc

SEQ ID NO: 1899645 - RNA, 20 nt, Human
aggcugggucgcccuggacu

SEQ ID NO: 1899646 - RNA, 21 nt, Human
aggcugggucgcccuggacug

SEQ ID NO: 1899647 - RNA, 14 nt, Human
aggcuggguucuga

SEQ ID NO: 1899648 - RNA, 17 nt, Human
aggcuggguucugaucc

SEQ ID NO: 1899649 - RNA, 15 nt, Human
aggcugggucgcccu

SEQ ID NO: 1899650 - RNA, 18 nt, Human
aggcugggucgcccugga

SEQ ID NO: 1899651 - RNA, 10 nt, Human
aggcuggguc

SEQ ID NO: 1899652 - RNA, 22 nt, Human
aggcugggggaagaagcucucu

SEQ ID NO: 1899653 - RNA, 17 nt, Human
aggcuuuuuuccagacu

SEQ ID NO: 1899654 - RNA, 19 nt, Human
aggcuuuggauuugacauu

SEQ ID NO: 1899655 - RNA, 18 nt, Human
aggcuuuuuuaucaugug

SEQ ID NO: 1899656 - RNA, 21 nt, Human
aggcuuuuuuaucaugugaaa

SEQ ID NO: 1899657 - RNA, 15 nt, Human
aggcuuuuuuaucau

SEQ ID NO: 1899658 - RNA, 17 nt, Human
agggaaaaugcagcagg

SEQ ID NO: 1899659 - RNA, 22 nt, Human
agggaaaaugcagcagggaugc

SEQ ID NO: 1899660 - RNA, 16 nt, Human
agggaaaagcagcucu

SEQ ID NO: 1899661 - RNA, 23 nt, Human
aggcuuagucacugagacagccc

SEQ ID NO: 1899662 - RNA, 22 nt, Human
aggcuuagucacugagacagcc

SEQ ID NO: 1899663 - RNA, 21 nt, Human
aggcuuagucacugagacagc

SEQ ID NO: 1899664 - RNA, 17 nt, Human
aggcuugccugcaggca

SEQ ID NO: 1899665 - RNA, 16 nt, Human
aggcuugccugcaggc

SEQ ID NO: 1899666 - RNA, 15 nt, Human
aggcuugccugcagg

SEQ ID NO: 1899667 - RNA, 18 nt, Human
ugggaaacaaaaggauaa

SEQ ID NO: 1899668 - RNA, 21 nt, Human
uggcuuuugugcauuaucuag

SEQ ID NO: 1899669 - RNA, 16 nt, Human
uggcuuuugugcauua

SEQ ID NO: 1899670 - RNA, 15 nt, Human
uggcuuuugugcauu

SEQ ID NO: 1899671 - RNA, 17 nt, Human
uggcuucacggaagagc

SEQ ID NO: 1899672 - RNA, 20 nt, Human
uggcuucacggaagagccuu

SEQ ID NO: 1899673 - RNA, 15 nt, Human
ugggaaacagaggcu

SEQ ID NO: 1899674 - RNA, 23 nt, Human
uggcugcaaaggguaucaggugc

SEQ ID NO: 1899675 - RNA, 13 nt, Human
uggcugagccccu

SEQ ID NO: 1899676 - RNA, 17 nt, Human
uggcugagccccugucu

SEQ ID NO: 1899677 - RNA, 22 nt, Human
uggcugcagagcagugggccug

SEQ ID NO: 1899678 - RNA, 18 nt, Human
uggcugcagagcaguggg

SEQ ID NO: 1899679 - RNA, 15 nt, Human
uggcugcagagcagu

SEQ ID NO: 1899680 - RNA, 23 nt, Human
uggcuguuggcugggggccucag

SEQ ID NO: 1899681 - RNA, 14 nt, Human
uggcuucacggaag

SEQ ID NO: 1899682 - RNA, 18 nt, Human
uggcuguuggcugggggc

SEQ ID NO: 1899683 - RNA, 16 nt, Human
uggcuguuggcugggg

SEQ ID NO: 1899684 - RNA, 16 nt, Human
uggcuguggagugugg

SEQ ID NO: 1899685 - RNA, 12 nt, Human
aggcucauuuua

SEQ ID NO: 1899686 - RNA, 18 nt, Human
uggcuaagcaaaauguga

SEQ ID NO: 1899687 - RNA, 14 nt, Human
uggcuaaauucaug

SEQ ID NO: 1899688 - RNA, 17 nt, Human
aggcuccaggagcagcc

SEQ ID NO: 1899689 - RNA, 18 nt, Human
aggcuccaggagcagcca

SEQ ID NO: 1899690 - RNA, 19 nt, Human
aggcuccaggagcagccac

SEQ ID NO: 1899691 - RNA, 23 nt, Human
aggcuccaggagcagccacauuc

SEQ ID NO: 1899692 - RNA, 17 nt, Human
uggcuaauguacugcau

SEQ ID NO: 1899693 - RNA, 19 nt, Human
uggcuaauguacugcauau

SEQ ID NO: 1899694 - RNA, 21 nt, Human
uggcucacugcaacuucugcc

SEQ ID NO: 1899695 - RNA, 13 nt, Human
uggcucacgccug

SEQ ID NO: 1899696 - RNA, 16 nt, Human
uggcucacacugagaa

SEQ ID NO: 1899697 - RNA, 15 nt, Human
uggcucacacugaga

SEQ ID NO: 1899698 - RNA, 14 nt, Human
uggcucacacugag

SEQ ID NO: 1899699 - RNA, 13 nt, Human
uggcucacacuga

SEQ ID NO: 1899700 - RNA, 12 nt, Human
uggcucacacug

SEQ ID NO: 1899701 - RNA, 19 nt, Human
uggcucacaccuguaaucc

SEQ ID NO: 1899702 - RNA, 16 nt, Human
uggcucacaccuguaa

SEQ ID NO: 1899703 - RNA, 12 nt, Human
uggcucagccag

SEQ ID NO: 1899704 - RNA, 18 nt, Human
uggcucagacauguuuuc

SEQ ID NO: 1899705 - RNA, 13 nt, Human
uggcucagccagc

SEQ ID NO: 1899706 - RNA, 16 nt, Human
uggcucagccagcacu

SEQ ID NO: 1899707 - RNA, 16 nt, Human
ugggcaaacaggcagu

SEQ ID NO: 1899708 - RNA, 15 nt, Human
ugggcaaacaggcag

SEQ ID NO: 1899709 - RNA, 14 nt, Human
ugggcaaacaggca

SEQ ID NO: 1899710 - RNA, 16 nt, Human
ugggauuuggucaaca

SEQ ID NO: 1899711 - RNA, 13 nt, Human
ugggcagaaggaa

SEQ ID NO: 1899712 - RNA, 20 nt, Human
ugggcacaaagggcccagau

SEQ ID NO: 1899713 - RNA, 16 nt, Human
ugggcacacgccuccc

SEQ ID NO: 1899714 - RNA, 21 nt, Human
ugggcacacgccucccacugg

SEQ ID NO: 1899715 - RNA, 19 nt, Human
ugggcacaaagggcccaga

SEQ ID NO: 1899716 - RNA, 15 nt, Human
ugggcaauauagcaa

SEQ ID NO: 1899717 - RNA, 16 nt, Human
ugggcaauauagcaag

SEQ ID NO: 1899718 - RNA, 23 nt, Human
ugggcagaaggaagacuucaucc

SEQ ID NO: 1899719 - RNA, 13 nt, Human
ugggcauucaaau

SEQ ID NO: 1899720 - RNA, 14 nt, Human
ugggcauucaaaug

SEQ ID NO: 1899721 - RNA, 16 nt, Human
ugggcagaaggaagac

SEQ ID NO: 1899722 - RNA, 20 nt, Human
ugggcagaaggaagacuuca

SEQ ID NO: 1899723 - RNA, 14 nt, Human
ugggaggcucugga

SEQ ID NO: 1899724 - RNA, 12 nt, Human
ugggaggcgggc

SEQ ID NO: 1899725 - RNA, 17 nt, Human
ugggaggcucuggagcc

SEQ ID NO: 1899726 - RNA, 23 nt, Human
ugggaggcucuggagcccacugu

SEQ ID NO: 1899727 - RNA, 19 nt, Human
ugggaggcugagaugggag

SEQ ID NO: 1899728 - RNA, 11 nt, Human
ugggaggcuga

SEQ ID NO: 1899729 - RNA, 16 nt, Human
ugggagggaggcucag

SEQ ID NO: 1899730 - RNA, 17 nt, Human
ugggagggaggcucagg

SEQ ID NO: 1899731 - RNA, 22 nt, Human
ugggagggaggcucaggucccu

SEQ ID NO: 1899732 - RNA, 22 nt, Human
ugggaggauugcuugagcucag

SEQ ID NO: 1899733 - RNA, 18 nt, Human
ugggaggauugcuugagc

SEQ ID NO: 1899734 - RNA, 21 nt, Human
ugggaggauugcuugagcuca

SEQ ID NO: 1899735 - RNA, 16 nt, Human
ugggagaaaugaaaaa

SEQ ID NO: 1899736 - RNA, 21 nt, Human
ugggagaaccaaaaagaggcu

SEQ ID NO: 1899737 - RNA, 22 nt, Human
ugggagaaccaaaaagaggcua

SEQ ID NO: 1899738 - RNA, 15 nt, Human
agggagcuagccaga

SEQ ID NO: 1899739 - RNA, 16 nt, Human
agggagcuagccagag

SEQ ID NO: 1899740 - RNA, 21 nt, Human
agggagcggccggccagcccc

SEQ ID NO: 1899741 - RNA, 22 nt, Human
agggagcggccggccagccccu

SEQ ID NO: 1899742 - RNA, 18 nt, Human
ugggacuacaggcaccca

SEQ ID NO: 1899743 - RNA, 18 nt, Human
agggagccuuugguucug

SEQ ID NO: 1899744 - RNA, 16 nt, Human
agggagcgagggagaa

SEQ ID NO: 1899745 - RNA, 19 nt, Human
agggagcggccggccagcc

SEQ ID NO: 1899746 - RNA, 15 nt, Human
agggagcauuuuccu

SEQ ID NO: 1899747 - RNA, 17 nt, Human
agggagcauuuuccucc

SEQ ID NO: 1899748 - RNA, 17 nt, Human
agggagccccuuugaug

SEQ ID NO: 1899749 - RNA, 22 nt, Human
agggagcuccaacucagaaggg

SEQ ID NO: 1899750 - RNA, 18 nt, Human
ugggacuagagcuuucuu

SEQ ID NO: 1899751 - RNA, 17 nt, Human
agggagcuagccagagg

SEQ ID NO: 1899752 - RNA, 23 nt, Human
agggagcuagccagaggacugug

SEQ ID NO: 1899753 - RNA, 16 nt, Human
ugggacuacaggugug

SEQ ID NO: 1899754 - RNA, 18 nt, Human
ugggacucaaugcacuga

SEQ ID NO: 1899755 - RNA, 15 nt, Human
ugggagaaaugaaaa

SEQ ID NO: 1899756 - RNA, 14 nt, Human
ugggacuuaacucc

SEQ ID NO: 1899757 - RNA, 21 nt, Human
agggagaccuggacacaggcc

SEQ ID NO: 1899758 - RNA, 22 nt, Human
agggagaccuggacacaggccu

SEQ ID NO: 1899759 - RNA, 19 nt, Human
agggagcaggcggugggca

SEQ ID NO: 1899760 - RNA, 16 nt, Human
agggagaccuggacac

SEQ ID NO: 1899761 - RNA, 19 nt, Human
agggagacccguccauuug

SEQ ID NO: 1899762 - RNA, 21 nt, Human
agggagaagacuauauuguac

SEQ ID NO: 1899763 - RNA, 13 nt, Human
agggagaagcucc

SEQ ID NO: 1899764 - RNA, 20 nt, Human
agggacuuggaagcuccgcu

SEQ ID NO: 1899765 - RNA, 15 nt, Human
agggacuuggaagcu

SEQ ID NO: 1899766 - RNA, 19 nt, Human
agggacuuggaagcuccgc

SEQ ID NO: 1899767 - RNA, 18 nt, Human
agggacuuggaagcuccg

SEQ ID NO: 1899768 - RNA, 15 nt, Human
ugggcucccuuccca

SEQ ID NO: 1899769 - RNA, 14 nt, Human
ugggcucccuuccc

SEQ ID NO: 1899770 - RNA, 23 nt, Human
ugggcuccuccagggugugugcu

SEQ ID NO: 1899771 - RNA, 13 nt, Human
ugggcuccuccag

SEQ ID NO: 1899772 - RNA, 15 nt, Human
ugggcuccuccaggg

SEQ ID NO: 1899773 - RNA, 20 nt, Human
agggcugucaucugugcacu

SEQ ID NO: 1899774 - RNA, 15 nt, Human
agggcuuacggcccu

SEQ ID NO: 1899775 - RNA, 18 nt, Human
agggcuuacggcccuggc

SEQ ID NO: 1899776 - RNA, 19 nt, Human
agggcuuacggcccuggcc

SEQ ID NO: 1899777 - RNA, 20 nt, Human
agggcuuacggcccuggccu

SEQ ID NO: 1899778 - RNA, 18 nt, Human
agggcugucaucugugca

SEQ ID NO: 1899779 - RNA, 19 nt, Human
agggcugucaucugugcac

SEQ ID NO: 1899780 - RNA, 18 nt, Human
agggcccagagagggugg

SEQ ID NO: 1899781 - RNA, 14 nt, Human
agggcccagagagg

SEQ ID NO: 1899782 - RNA, 17 nt, Human
agggcccagagcccagc

SEQ ID NO: 1899783 - RNA, 18 nt, Human
agggcccagagcccagcu

SEQ ID NO: 1899784 - RNA, 19 nt, Human
agggcccagagcccagcuc

SEQ ID NO: 1899785 - RNA, 20 nt, Human
agggcccagagcccagcucc

SEQ ID NO: 1899786 - RNA, 21 nt, Human
agggcccagagcccagcucca

SEQ ID NO: 1899787 - RNA, 20 nt, Human
agggcuccagacacaugucc

SEQ ID NO: 1899788 - RNA, 20 nt, Human
agggcuggacugaggccuga

SEQ ID NO: 1899789 - RNA, 18 nt, Human
agggcuggacugaggccu

SEQ ID NO: 1899790 - RNA, 17 nt, Human
agggcuggacugaggcc

SEQ ID NO: 1899791 - RNA, 16 nt, Human
agggcuggacugaggc

SEQ ID NO: 1899792 - RNA, 15 nt, Human
agggcuggacugagg

SEQ ID NO: 1899793 - RNA, 14 nt, Human
agggcuggacugag

SEQ ID NO: 1899794 - RNA, 19 nt, Human
agggcuccucuccagucug

SEQ ID NO: 1899795 - RNA, 18 nt, Human
agggaguguacucccagg

SEQ ID NO: 1899796 - RNA, 21 nt, Human
agggaguuaucuaaaagaaau

SEQ ID NO: 1899797 - RNA, 16 nt, Human
agggaguguacuccca

SEQ ID NO: 1899798 - RNA, 17 nt, Human
agggaguguacucccag

SEQ ID NO: 1899799 - RNA, 13 nt, Human
agggcccagagag

SEQ ID NO: 1899800 - RNA, 12 nt, Human
agggcccagaga

SEQ ID NO: 1899801 - RNA, 15 nt, Human
agggccaacccuucu

SEQ ID NO: 1899802 - RNA, 16 nt, Human
agggccaacccuucuc

SEQ ID NO: 1899803 - RNA, 17 nt, Human
agggccaacccuucucc

SEQ ID NO: 1899804 - RNA, 21 nt, Human
agggccaacccuucuccucuu

SEQ ID NO: 1899805 - RNA, 20 nt, Human
agggagugacagaggcagcc

SEQ ID NO: 1899806 - RNA, 20 nt, Human
agggagugaguugauagcac

SEQ ID NO: 1899807 - RNA, 23 nt, Human
agggaguccgaaagggacuugga

SEQ ID NO: 1899808 - RNA, 20 nt, Human
agggaguccgaaagggacuu

SEQ ID NO: 1899809 - RNA, 15 nt, Human
agggagggcugucau

SEQ ID NO: 1899810 - RNA, 22 nt, Human
agggagggcuccagacacaugu

SEQ ID NO: 1899811 - RNA, 12 nt, Human
agggagggcucc

SEQ ID NO: 1899812 - RNA, 17 nt, Human
agggagggcuccagaca

SEQ ID NO: 1899813 - RNA, 19 nt, Human
agggagggcuccagacaca

SEQ ID NO: 1899814 - RNA, 17 nt, Human
agggagggagggcucca

SEQ ID NO: 1899815 - RNA, 23 nt, Human
ugggccaacaaagaacacuaacu

SEQ ID NO: 1899816 - RNA, 23 nt, Human
agucacugugagcucccaggugc

SEQ ID NO: 1899817 - RNA, 24 nt, Human
agucacugugagcucccaggugca

SEQ ID NO: 1899818 - RNA, 19 nt, Human
ugucccuuacgugaguccu

SEQ ID NO: 1899819 - RNA, 23 nt, Human
ugucccuuacgugaguccuggca

SEQ ID NO: 1899820 - RNA, 16 nt, Human
agucccaccuuggcug

SEQ ID NO: 1899821 - RNA, 15 nt, Human
agucccaccuuggcu

SEQ ID NO: 1899822 - RNA, 20 nt, Human
agucauaaaauguaucuucc

SEQ ID NO: 1899823 - RNA, 21 nt, Human
agucauaaucauuagggggaa

SEQ ID NO: 1899824 - RNA, 19 nt, Human
agucccaccuuggcugcag

SEQ ID NO: 1899825 - RNA, 18 nt, Human
agucccaccuuggcugca

SEQ ID NO: 1899826 - RNA, 19 nt, Human
agucgcaucucagugcagg

SEQ ID NO: 1899827 - RNA, 14 nt, Human
aguccucccaucuc

SEQ ID NO: 1899828 - RNA, 16 nt, Human
aguccucccaucucac

SEQ ID NO: 1899829 - RNA, 20 nt, Human
aguccuacaagcuaaaauua

SEQ ID NO: 1899830 - RNA, 17 nt, Human
aguccucauaaaaagca

SEQ ID NO: 1899831 - RNA, 18 nt, Human
aguccucauaaaaagcaa

SEQ ID NO: 1899832 - RNA, 23 nt, Human
agucucacuguugcccaggcugg

SEQ ID NO: 1899833 - RNA, 20 nt, Human
agucuauuuacggaacucaa

SEQ ID NO: 1899834 - RNA, 15 nt, Human
agucuauuuacggaa

SEQ ID NO: 1899835 - RNA, 23 nt, Human
ugucuccaaccccccagcacuga

SEQ ID NO: 1899836 - RNA, 22 nt, Human
ugucuccaaccccccagcacug

SEQ ID NO: 1899837 - RNA, 21 nt, Human
ugucuccaaccccccagcacu

SEQ ID NO: 1899838 - RNA, 20 nt, Human
ugucuccaaccccccagcac

SEQ ID NO: 1899839 - RNA, 19 nt, Human
ugucuccaaccccccagca

SEQ ID NO: 1899840 - RNA, 17 nt, Human
ugucuccaaccccccag

SEQ ID NO: 1899841 - RNA, 16 nt, Human
ugucuccaacccccca

SEQ ID NO: 1899842 - RNA, 11 nt, Human
ugucuccaacc

SEQ ID NO: 1899843 - RNA, 19 nt, Human
agucucacuuugucgccca

SEQ ID NO: 1899844 - RNA, 19 nt, Human
aguauucuuauuuaaugaa

SEQ ID NO: 1899845 - RNA, 14 nt, Human
aguauuugugggga

SEQ ID NO: 1899846 - RNA, 15 nt, Human
agucaccaagcccag

SEQ ID NO: 1899847 - RNA, 17 nt, Human
agucaccccggccaccu

SEQ ID NO: 1899848 - RNA, 20 nt, Human
uguauauuguguuuguguau

SEQ ID NO: 1899849 - RNA, 21 nt, Human
uguauauuugugauagcacuu

SEQ ID NO: 1899850 - RNA, 15 nt, Human
aguauuaaaauuugg

SEQ ID NO: 1899851 - RNA, 23 nt, Human
ugucccugcacuugcagacucua

SEQ ID NO: 1899852 - RNA, 22 nt, Human
ugucccugcacuugcagacucu

SEQ ID NO: 1899853 - RNA, 20 nt, Human
ugucccugcacuugcagacu

SEQ ID NO: 1899854 - RNA, 22 nt, Human
uguccccuucucucaucucuua

SEQ ID NO: 1899855 - RNA, 20 nt, Human
uguccccuucucucaucucu

SEQ ID NO: 1899856 - RNA, 16 nt, Human
uguccccuucucucau

SEQ ID NO: 1899857 - RNA, 14 nt, Human
uguccccuucucuc

SEQ ID NO: 1899858 - RNA, 11 nt, Human
uguccccuucu

SEQ ID NO: 1899859 - RNA, 16 nt, Human
uguccaagaagcccag

SEQ ID NO: 1899860 - RNA, 17 nt, Human
uguccaagaagcccagg

SEQ ID NO: 1899861 - RNA, 18 nt, Human
uguccaagaagcccagga

SEQ ID NO: 1899862 - RNA, 22 nt, Human
uguccaagaagcccaggaaagg

SEQ ID NO: 1899863 - RNA, 22 nt, Human
ugucauuugagcagggcucagc

SEQ ID NO: 1899864 - RNA, 21 nt, Human
ugucauuugagcagggcucag

SEQ ID NO: 1899865 - RNA, 20 nt, Human
ugucauuugagcagggcuca

SEQ ID NO: 1899866 - RNA, 20 nt, Human
ugucagguggggcagcuuga

SEQ ID NO: 1899867 - RNA, 18 nt, Human
ugucagguggggcagcuu

SEQ ID NO: 1899868 - RNA, 17 nt, Human
ugucagguggggcagcu

SEQ ID NO: 1899869 - RNA, 14 nt, Human
uguccaagaagccc

SEQ ID NO: 1899870 - RNA, 15 nt, Human
uguccaagaagccca

SEQ ID NO: 1899871 - RNA, 16 nt, Human
uguccaaaacugccuc

SEQ ID NO: 1899872 - RNA, 15 nt, Human
uguccaaaacugccu

SEQ ID NO: 1899873 - RNA, 16 nt, Human
uguaauucuaaaugaa

SEQ ID NO: 1899874 - RNA, 15 nt, Human
uguaauucuaaauga

SEQ ID NO: 1899875 - RNA, 14 nt, Human
uguaauucuaaaug

SEQ ID NO: 1899876 - RNA, 13 nt, Human
uguaauucuaaau

SEQ ID NO: 1899877 - RNA, 19 nt, Human
uguaauuaaguacuaugua

SEQ ID NO: 1899878 - RNA, 21 nt, Human
uguaauuaaguacuauguauc

SEQ ID NO: 1899879 - RNA, 18 nt, Human
uguaauuaaguacuaugu

SEQ ID NO: 1899880 - RNA, 20 nt, Human
agguuggcaaaaaggcagga

SEQ ID NO: 1899881 - RNA, 16 nt, Human
agguuucucaaagaaa

SEQ ID NO: 1899882 - RNA, 19 nt, Human
agguuucucaaagaaauuu

SEQ ID NO: 1899883 - RNA, 14 nt, Human
agguuucugaaaau

SEQ ID NO: 1899884 - RNA, 23 nt, Human
agguuucugaaaauuaacacugc

SEQ ID NO: 1899885 - RNA, 15 nt, Human
agguuucugaaaauu

SEQ ID NO: 1899886 - RNA, 20 nt, Human
uguacauaaugcgugcauac

SEQ ID NO: 1899887 - RNA, 19 nt, Human
uguacauaaugcgugcaua

SEQ ID NO: 1899888 - RNA, 12 nt, Human
uguacaguuuuu

SEQ ID NO: 1899889 - RNA, 20 nt, Human
uguaauuuuuuuaucgucac

SEQ ID NO: 1899890 - RNA, 14 nt, Human
uguacaugaaaaca

SEQ ID NO: 1899891 - RNA, 18 nt, Human
uguacaucuauuuuggau

SEQ ID NO: 1899892 - RNA, 19 nt, Human
uguacaucuauuuuggauu

SEQ ID NO: 1899893 - RNA, 20 nt, Human
uguacaucuauuuuggauug

SEQ ID NO: 1899894 - RNA, 21 nt, Human
uguacaucuauuuuggauugu

SEQ ID NO: 1899895 - RNA, 16 nt, Human
uguacaugaaaacaca

SEQ ID NO: 1899896 - RNA, 23 nt, Human
uguacaucuauuuuggauuguau

SEQ ID NO: 1899897 - RNA, 14 nt, Human
uguacauauaagug

SEQ ID NO: 1899898 - RNA, 14 nt, Human
agguugaagcacca

SEQ ID NO: 1899899 - RNA, 14 nt, Human
agguugcagugagc

SEQ ID NO: 1899900 - RNA, 18 nt, Human
agguugcagugagcagag

SEQ ID NO: 1899901 - RNA, 12 nt, Human
aggugugcucug

SEQ ID NO: 1899902 - RNA, 14 nt, Human
aggugugcaagaga

SEQ ID NO: 1899903 - RNA, 15 nt, Human
aggugugauuauaaa

SEQ ID NO: 1899904 - RNA, 22 nt, Human
aggugugagucaccaagcccag

SEQ ID NO: 1899905 - RNA, 21 nt, Human
aggugugagucaccaagccca

SEQ ID NO: 1899906 - RNA, 20 nt, Human
aggugucccugcacuugcag

SEQ ID NO: 1899907 - RNA, 16 nt, Human
aggugucccugcacuu

SEQ ID NO: 1899908 - RNA, 20 nt, Human
agguguauggagagaaaaca

SEQ ID NO: 1899909 - RNA, 12 nt, Human
aggugggaggau

SEQ ID NO: 1899910 - RNA, 16 nt, Human
aggugggcgggcaggg

SEQ ID NO: 1899911 - RNA, 14 nt, Human
agguggcugagccc

SEQ ID NO: 1899912 - RNA, 15 nt, Human
agguggcugagcccc

SEQ ID NO: 1899913 - RNA, 17 nt, Human
agguggcugagccccug

SEQ ID NO: 1899914 - RNA, 19 nt, Human
agguggcugagccccuguc

SEQ ID NO: 1899915 - RNA, 15 nt, Human
aguaccaaucauuuu

SEQ ID NO: 1899916 - RNA, 16 nt, Human
aguaccaaucauuuua

SEQ ID NO: 1899917 - RNA, 22 nt, Human
aguaccaccaaaaaagcuguau

SEQ ID NO: 1899918 - RNA, 17 nt, Human
aguaccaccaaaaaagc

SEQ ID NO: 1899919 - RNA, 21 nt, Human
aguaccauaguaccauuuaua

SEQ ID NO: 1899920 - RNA, 23 nt, Human
aguaccauaguaccauuuauaca

SEQ ID NO: 1899921 - RNA, 17 nt, Human
aguagauguucuacuuu

SEQ ID NO: 1899922 - RNA, 19 nt, Human
aguaccauaguaccauuua

SEQ ID NO: 1899923 - RNA, 20 nt, Human
aguagcaguagaugcaugua

SEQ ID NO: 1899924 - RNA, 16 nt, Human
uguaggguuauaauaa

SEQ ID NO: 1899925 - RNA, 17 nt, Human
uguaggguuauaauaau

SEQ ID NO: 1899926 - RNA, 22 nt, Human
uguagucagaauuagcugcuuc

SEQ ID NO: 1899927 - RNA, 22 nt, Human
uguagugaaucacguaaagcua

SEQ ID NO: 1899928 - RNA, 21 nt, Human
uguaguccucauaaaaagcaa

SEQ ID NO: 1899929 - RNA, 20 nt, Human
uguaguccgugcugacagcu

SEQ ID NO: 1899930 - RNA, 22 nt, Human
uguaguccgugcugacagcugc

SEQ ID NO: 1899931 - RNA, 17 nt, Human
uguaguccucauaaaaa

SEQ ID NO: 1899932 - RNA, 18 nt, Human
uguauauauuuccuauau

SEQ ID NO: 1899933 - RNA, 12 nt, Human
uguauauacuuu

SEQ ID NO: 1899934 - RNA, 13 nt, Human
uguauauacuuuu

SEQ ID NO: 1899935 - RNA, 22 nt, Human
uguauauauuuccuauauuguu

SEQ ID NO: 1899936 - RNA, 14 nt, Human
uguauaguucacgu

SEQ ID NO: 1899937 - RNA, 15 nt, Human
uguacauguguagcc

SEQ ID NO: 1899938 - RNA, 11 nt, Human
uguacaugugu

SEQ ID NO: 1899939 - RNA, 22 nt, Human
uguacaugaagaagcuaaaucc

SEQ ID NO: 1899940 - RNA, 16 nt, Human
uguacaugagaaggaa

SEQ ID NO: 1899941 - RNA, 21 nt, Human
uguacauggaauaacauguaa

SEQ ID NO: 1899942 - RNA, 16 nt, Human
aguaaaaacaaagaaa

SEQ ID NO: 1899943 - RNA, 23 nt, Human
aguaaaaacaaagaaauuaugug

SEQ ID NO: 1899944 - RNA, 22 nt, Human
aguaauugguccgaucuuugac

SEQ ID NO: 1899945 - RNA, 21 nt, Human
aguacacuguuucaaacuuua

SEQ ID NO: 1899946 - RNA, 23 nt, Human
aguacacuguuucaaacuuuacu

SEQ ID NO: 1899947 - RNA, 18 nt, Human
aguaauugacaugugcca

SEQ ID NO: 1899948 - RNA, 20 nt, Human
aguaauugacaugugccagg

SEQ ID NO: 1899949 - RNA, 19 nt, Human
aguaaucuaauauggccac

SEQ ID NO: 1899950 - RNA, 20 nt, Human
aguaaucugagaaacaauga

SEQ ID NO: 1899951 - RNA, 21 nt, Human
ugugucuguacacguguccug

SEQ ID NO: 1899952 - RNA, 14 nt, Human
ugugucuguacacg

SEQ ID NO: 1899953 - RNA, 13 nt, Human
ugugucuguacac

SEQ ID NO: 1899954 - RNA, 12 nt, Human
ugugucugagug

SEQ ID NO: 1899955 - RNA, 20 nt, Human
ugugucuugcaauggcagcc

SEQ ID NO: 1899956 - RNA, 16 nt, Human
uguguguugccacagg

SEQ ID NO: 1899957 - RNA, 17 nt, Human
uguguguugccacagga

SEQ ID NO: 1899958 - RNA, 19 nt, Human
uguguguugccacaggaca

SEQ ID NO: 1899959 - RNA, 20 nt, Human
uguguguugccacaggacac

SEQ ID NO: 1899960 - RNA, 11 nt, Human
uguguguuuau

SEQ ID NO: 1899961 - RNA, 18 nt, Human
uguguguuguguguggga

SEQ ID NO: 1899962 - RNA, 16 nt, Human
uguguccaaaacugcc

SEQ ID NO: 1899963 - RNA, 18 nt, Human
agugcccccacugaccag

SEQ ID NO: 1899964 - RNA, 22 nt, Human
uguguuaucacccagaagaaaa

SEQ ID NO: 1899965 - RNA, 23 nt, Human
uguguuaucacccagaagaaaau

SEQ ID NO: 1899966 - RNA, 18 nt, Human
uguuaauaaaaguacaug

SEQ ID NO: 1899967 - RNA, 13 nt, Human
uguuaauaaaagu

SEQ ID NO: 1899968 - RNA, 19 nt, Human
uguuaauaaaaguacaugu

SEQ ID NO: 1899969 - RNA, 17 nt, Human
uguuacaaauuguagaa

SEQ ID NO: 1899970 - RNA, 18 nt, Human
uguuacaaauuguagaag

SEQ ID NO: 1899971 - RNA, 19 nt, Human
uguuacauaagauaaaugu

SEQ ID NO: 1899972 - RNA, 11 nt, Human
aguggcagcug

SEQ ID NO: 1899973 - RNA, 22 nt, Human
agugggcccaaugcacuuuguu

SEQ ID NO: 1899974 - RNA, 16 nt, Human
aguggggaaugaagau

SEQ ID NO: 1899975 - RNA, 16 nt, Human
agugggcuugauucug

SEQ ID NO: 1899976 - RNA, 22 nt, Human
agugggcuugauucugcaguaa

SEQ ID NO: 1899977 - RNA, 16 nt, Human
agugggguagguuggg

SEQ ID NO: 1899978 - RNA, 15 nt, Human
aguggauuucccauc

SEQ ID NO: 1899979 - RNA, 13 nt, Human
aguggacucaggg

SEQ ID NO: 1899980 - RNA, 16 nt, Human
aguggacucagggcag

SEQ ID NO: 1899981 - RNA, 21 nt, Human
aguggacuguucccugaggug

SEQ ID NO: 1899982 - RNA, 17 nt, Human
aguggaccuuaggccuu

SEQ ID NO: 1899983 - RNA, 19 nt, Human
aguggaccuuaggccuucc

SEQ ID NO: 1899984 - RNA, 20 nt, Human
aguggaccuuaggccuuccu

SEQ ID NO: 1899985 - RNA, 23 nt, Human
aguggaccuuaggccuuccucuc

SEQ ID NO: 1899986 - RNA, 14 nt, Human
agugugugucuuuc

SEQ ID NO: 1899987 - RNA, 12 nt, Human
agugugugucuu

SEQ ID NO: 1899988 - RNA, 11 nt, Human
agugugugucu

SEQ ID NO: 1899989 - RNA, 21 nt, Human
aguguuccgugguuaaacucg

SEQ ID NO: 1899990 - RNA, 18 nt, Human
aguguguguuuuucauaa

SEQ ID NO: 1899991 - RNA, 21 nt, Human
aguguucauaaauaaaguuug

SEQ ID NO: 1899992 - RNA, 16 nt, Human
aguguuguggauuuaa

SEQ ID NO: 1899993 - RNA, 17 nt, Human
aguguucugcaaaaaua

SEQ ID NO: 1899994 - RNA, 13 nt, Human
aguuacucagaau

SEQ ID NO: 1899995 - RNA, 17 nt, Human
aguuacuagguaacuuc

SEQ ID NO: 1899996 - RNA, 18 nt, Human
aguuacuagguaacuuca

SEQ ID NO: 1899997 - RNA, 19 nt, Human
aguuacuagguaacuucau

SEQ ID NO: 1899998 - RNA, 22 nt, Human
aguuacuagguaacuucauauu

SEQ ID NO: 1899999 - RNA, 20 nt, Human
aguguuguggauuuaacaga

SEQ ID NO: 1900000 - RNA, 19 nt, Human
aguguuguggauuuaacag

SEQ ID NO: 1900001 - RNA, 20 nt, Human
uguugcccaggcuggcgugc

SEQ ID NO: 1900002 - RNA, 23 nt, Human
uguugcccaggcuggcgugcagu

SEQ ID NO: 1900003 - RNA, 14 nt, Human
uguugccacaggac

SEQ ID NO: 1900004 - RNA, 15 nt, Human
uguugccacaggaca

SEQ ID NO: 1900005 - RNA, 16 nt, Human
uguugccacaggacac

SEQ ID NO: 1900006 - RNA, 15 nt, Human
uguugcauagaauaa

SEQ ID NO: 1900007 - RNA, 15 nt, Human
uguucuaagaaguga

SEQ ID NO: 1900008 - RNA, 14 nt, Human
agugugaccaggca

SEQ ID NO: 1900009 - RNA, 20 nt, Human
agugugacugaucucucgug

SEQ ID NO: 1900010 - RNA, 18 nt, Human
agugugaguaaucugaga

SEQ ID NO: 1900011 - RNA, 20 nt, Human
agugugccugaagucccaga

SEQ ID NO: 1900012 - RNA, 18 nt, Human
agugguauagaaaugcug

SEQ ID NO: 1900013 - RNA, 16 nt, Human
agugguauagaaaugc

SEQ ID NO: 1900014 - RNA, 15 nt, Human
agugguauagaaaug

SEQ ID NO: 1900015 - RNA, 14 nt, Human
agugguauagaaau

SEQ ID NO: 1900016 - RNA, 15 nt, Human
aguguggcaaaauaa

SEQ ID NO: 1900017 - RNA, 23 nt, Human
aguguggagucauucucauugaa

SEQ ID NO: 1900018 - RNA, 18 nt, Human
aguguggagucauucuca

SEQ ID NO: 1900019 - RNA, 17 nt, Human
aguguggcaguuuggca

SEQ ID NO: 1900020 - RNA, 16 nt, Human
aguguggcaguuuggc

SEQ ID NO: 1900021 - RNA, 20 nt, Human
aguguggagucauucucauu

SEQ ID NO: 1900022 - RNA, 21 nt, Human
agugugccugaagucccagau

SEQ ID NO: 1900023 - RNA, 12 nt, Human
agugugcuuuau

SEQ ID NO: 1900024 - RNA, 18 nt, Human
agugugcuuuaugcugaa

SEQ ID NO: 1900025 - RNA, 21 nt, Human
agugugcuuuaugcugaaaca

SEQ ID NO: 1900026 - RNA, 19 nt, Human
uguuccacaaguuaaauaa

SEQ ID NO: 1900027 - RNA, 22 nt, Human
uguucgcauggucacacacuga

SEQ ID NO: 1900028 - RNA, 23 nt, Human
uguucgcauggucacacacugau

SEQ ID NO: 1900029 - RNA, 20 nt, Human
uguucgacagugaauauuca

SEQ ID NO: 1900030 - RNA, 20 nt, Human
uguucgcauggucacacacu

SEQ ID NO: 1900031 - RNA, 15 nt, Human
uguuccuggcaguuu

SEQ ID NO: 1900032 - RNA, 19 nt, Human
uguuccuggcaguuuaaaa

SEQ ID NO: 1900033 - RNA, 13 nt, Human
uguuaugacucca

SEQ ID NO: 1900034 - RNA, 17 nt, Human
uguuaugacuccagaau

SEQ ID NO: 1900035 - RNA, 22 nt, Human
agugugguguuuccuggcacug

SEQ ID NO: 1900036 - RNA, 9 nt, Human
aguguguaa

SEQ ID NO: 1900037 - RNA, 21 nt, Human
agucucuuuuuuuggcccagg

SEQ ID NO: 1900038 - RNA, 20 nt, Human
agucucuuuuuuuggcccag

SEQ ID NO: 1900039 - RNA, 23 nt, Human
agucucuuuuuuuggcccaggcc

SEQ ID NO: 1900040 - RNA, 12 nt, Human
agucugaaggcu

SEQ ID NO: 1900041 - RNA, 13 nt, Human
agucuuagaugua

SEQ ID NO: 1900042 - RNA, 14 nt, Human
agucuuagauguau

SEQ ID NO: 1900043 - RNA, 16 nt, Human
agucuuagauguauau

SEQ ID NO: 1900044 - RNA, 23 nt, Human
agucuuagauguauauauuuccu

SEQ ID NO: 1900045 - RNA, 19 nt, Human
agucucgcucuguugccca

SEQ ID NO: 1900046 - RNA, 17 nt, Human
agucucuuguauuaaac

SEQ ID NO: 1900047 - RNA, 16 nt, Human
agucucuugauucaua

SEQ ID NO: 1900048 - RNA, 17 nt, Human
agucucuugauucauaa

SEQ ID NO: 1900049 - RNA, 17 nt, Human
ugugacuuaagaagccu

SEQ ID NO: 1900050 - RNA, 13 nt, Human
ugugacuggucag

SEQ ID NO: 1900051 - RNA, 16 nt, Human
ugugacugaucucucg

SEQ ID NO: 1900052 - RNA, 19 nt, Human
ugugagcucccaggugcag

SEQ ID NO: 1900053 - RNA, 23 nt, Human
ugugagcucccaggugcagccag

SEQ ID NO: 1900054 - RNA, 11 nt, Human
ugugaggaagc

SEQ ID NO: 1900055 - RNA, 19 nt, Human
ugugagacucgagaacuuu

SEQ ID NO: 1900056 - RNA, 18 nt, Human
ugugagcccagcuggguc

SEQ ID NO: 1900057 - RNA, 16 nt, Human
ugugaugcccugcccu

SEQ ID NO: 1900058 - RNA, 22 nt, Human
ugugaugaugaaaugaggucag

SEQ ID NO: 1900059 - RNA, 19 nt, Human
ugugaugagaggaaaucac

SEQ ID NO: 1900060 - RNA, 12 nt, Human
agugagcugguu

SEQ ID NO: 1900061 - RNA, 22 nt, Human
agugagcggugcuguccucagg

SEQ ID NO: 1900062 - RNA, 23 nt, Human
agugagcggugcuguccucaggu

SEQ ID NO: 1900063 - RNA, 22 nt, Human
agugagcacuaaggugugcucu

SEQ ID NO: 1900064 - RNA, 14 nt, Human
agugagcacuaagg

SEQ ID NO: 1900065 - RNA, 22 nt, Human
agucuugugacuagugcugaag

SEQ ID NO: 1900066 - RNA, 23 nt, Human
agucuugugacuagugcugaagc

SEQ ID NO: 1900067 - RNA, 21 nt, Human
agucuugugacuagugcugaa

SEQ ID NO: 1900068 - RNA, 20 nt, Human
agucuugugacuagugcuga

SEQ ID NO: 1900069 - RNA, 17 nt, Human
agucuugugacuagugc

SEQ ID NO: 1900070 - RNA, 16 nt, Human
agucuuucacauuuaa

SEQ ID NO: 1900071 - RNA, 18 nt, Human
agucuuucacauuuaaau

SEQ ID NO: 1900072 - RNA, 21 nt, Human
agugaacaaauuuacagagac

SEQ ID NO: 1900073 - RNA, 21 nt, Human
agugacugauggcuaauguac

SEQ ID NO: 1900074 - RNA, 15 nt, Human
agugaaccuguauaa

SEQ ID NO: 1900075 - RNA, 16 nt, Human
agugaacuugggccac

SEQ ID NO: 1900076 - RNA, 23 nt, Human
agugaacaaauuuacagagacag

SEQ ID NO: 1900077 - RNA, 22 nt, Human
agugaacaaauuuacagagaca

SEQ ID NO: 1900078 - RNA, 16 nt, Human
ugugcuccuccuuggu

SEQ ID NO: 1900079 - RNA, 14 nt, Human
ugugcucuccaagc

SEQ ID NO: 1900080 - RNA, 19 nt, Human
ugugcucuccaagcccagu

SEQ ID NO: 1900081 - RNA, 21 nt, Human
ugugcucaggagcccugggag

SEQ ID NO: 1900082 - RNA, 18 nt, Human
ugugcugagucugaaggc

SEQ ID NO: 1900083 - RNA, 19 nt, Human
ugugcugagucugaaggcu

SEQ ID NO: 1900084 - RNA, 12 nt, Human
ugugcugcccug

SEQ ID NO: 1900085 - RNA, 20 nt, Human
ugugcucaggagcccuggga

SEQ ID NO: 1900086 - RNA, 16 nt, Human
ugugauugacagcuuu

SEQ ID NO: 1900087 - RNA, 22 nt, Human
ugugauugacagcuuugcugcu

SEQ ID NO: 1900088 - RNA, 23 nt, Human
ugugauugacagcuuugcugcug

SEQ ID NO: 1900089 - RNA, 23 nt, Human
agugagcugguuuuuagcggaga

SEQ ID NO: 1900090 - RNA, 22 nt, Human
uguggauuuaacagaaauguac

SEQ ID NO: 1900091 - RNA, 20 nt, Human
uguggauuuaacagaaaugu

SEQ ID NO: 1900092 - RNA, 19 nt, Human
uguggauuuaacagaaaug

SEQ ID NO: 1900093 - RNA, 14 nt, Human
uguggaugauaaaa

SEQ ID NO: 1900094 - RNA, 21 nt, Human
uguggaucaaauccagccugc

SEQ ID NO: 1900095 - RNA, 18 nt, Human
ugugcugcccugcccacc

SEQ ID NO: 1900096 - RNA, 19 nt, Human
ugugcugcccugcccaccu

SEQ ID NO: 1900097 - RNA, 20 nt, Human
ugugcugcccugcccaccug

SEQ ID NO: 1900098 - RNA, 21 nt, Human
ugugcugcccugcccaccugg

SEQ ID NO: 1900099 - RNA, 21 nt, Human
agugcagaccccuuggccagc

SEQ ID NO: 1900100 - RNA, 17 nt, Human
agugcagugagccgaga

SEQ ID NO: 1900101 - RNA, 21 nt, Human
agugcacuaauguguaagaca

SEQ ID NO: 1900102 - RNA, 17 nt, Human
agugcacuaauguguaa

SEQ ID NO: 1900103 - RNA, 20 nt, Human
agugcaauaaaucugaccca

SEQ ID NO: 1900104 - RNA, 18 nt, Human
agugcaagccccugcucc

SEQ ID NO: 1900105 - RNA, 15 nt, Human
agugcaagccccugc

SEQ ID NO: 1900106 - RNA, 17 nt, Human
agugcaagccccugcuc

SEQ ID NO: 1900107 - RNA, 21 nt, Human
agugcaauaaaucugacccag

SEQ ID NO: 1900108 - RNA, 22 nt, Human
agugcaauaaaucugacccagu

SEQ ID NO: 1900109 - RNA, 23 nt, Human
agugcaauaaaucugacccagug

SEQ ID NO: 1900110 - RNA, 14 nt, Human
agugcacuaaugug

SEQ ID NO: 1900111 - RNA, 16 nt, Human
agugcaugcugucccu

SEQ ID NO: 1900112 - RNA, 14 nt, Human
agugcaugcugucc

SEQ ID NO: 1900113 - RNA, 14 nt, Human
agugccaaaaacaa

SEQ ID NO: 1900114 - RNA, 18 nt, Human
agugccaggauggaauga

SEQ ID NO: 1900115 - RNA, 16 nt, Human
agugaggaugaaaaaa

SEQ ID NO: 1900116 - RNA, 12 nt, Human
agugaggcucug

SEQ ID NO: 1900117 - RNA, 14 nt, Human
agugaggaugucug

SEQ ID NO: 1900118 - RNA, 13 nt, Human
agugaggcucugc

SEQ ID NO: 1900119 - RNA, 17 nt, Human
agugcaacacugaagcu

SEQ ID NO: 1900120 - RNA, 14 nt, Human
auagaguguuauca

SEQ ID NO: 1900121 - RNA, 15 nt, Human
auagaugcuggccca

SEQ ID NO: 1900122 - RNA, 16 nt, Human
auagaugcuggcccag

SEQ ID NO: 1900123 - RNA, 17 nt, Human
auagaugcuggcccagg

SEQ ID NO: 1900124 - RNA, 20 nt, Human
auagaugcuggcccagggcc

SEQ ID NO: 1900125 - RNA, 11 nt, Human
auagaugugug

SEQ ID NO: 1900126 - RNA, 13 nt, Human
auagaugugugga

SEQ ID NO: 1900127 - RNA, 12 nt, Human
auagaugugugg

SEQ ID NO: 1900128 - RNA, 23 nt, Human
auagaugcuggcccagggcccag

SEQ ID NO: 1900129 - RNA, 13 nt, Human
auagauguuuccu

SEQ ID NO: 1900130 - RNA, 14 nt, Human
auagauguguggac

SEQ ID NO: 1900131 - RNA, 18 nt, Human
auagauaggucagugcaa

SEQ ID NO: 1900132 - RNA, 19 nt, Human
auagaggcuaaauuacuca

SEQ ID NO: 1900133 - RNA, 15 nt, Human
auagacuaaaugaaa

SEQ ID NO: 1900134 - RNA, 14 nt, Human
auagagagagacca

SEQ ID NO: 1900135 - RNA, 13 nt, Human
auagaaguaaaaa

SEQ ID NO: 1900136 - RNA, 19 nt, Human
auagaaggcuauggggaua

SEQ ID NO: 1900137 - RNA, 13 nt, Human
auagaaaugcugg

SEQ ID NO: 1900138 - RNA, 19 nt, Human
auagaaaugcugguuuuuc

SEQ ID NO: 1900139 - RNA, 22 nt, Human
auagaaaugcugguuuuucagu

SEQ ID NO: 1900140 - RNA, 21 nt, Human
auagaacucaguuuuaacuag

SEQ ID NO: 1900141 - RNA, 14 nt, Human
auagaauaaaauuu

SEQ ID NO: 1900142 - RNA, 19 nt, Human
auagaauaaaauuuuuaau

SEQ ID NO: 1900143 - RNA, 22 nt, Human
auagaauaaaauuuuuaaucuu

SEQ ID NO: 1900144 - RNA, 17 nt, Human
auagaauuaacacauga

SEQ ID NO: 1900145 - RNA, 12 nt, Human
auagaauauuua

SEQ ID NO: 1900146 - RNA, 13 nt, Human
auagaauauuuau

SEQ ID NO: 1900147 - RNA, 19 nt, Human
auagaauauuuauuaccuc

SEQ ID NO: 1900148 - RNA, 22 nt, Human
auagaauauuuauuaccucuga

SEQ ID NO: 1900149 - RNA, 23 nt, Human
auagacaauuuauuauggcacau

SEQ ID NO: 1900150 - RNA, 22 nt, Human
auagacacuccccgaagucuuu

SEQ ID NO: 1900151 - RNA, 21 nt, Human
auagacagaauagauagcacu

SEQ ID NO: 1900152 - RNA, 22 nt, Human
auagacaauuuauuauggcaca

SEQ ID NO: 1900153 - RNA, 16 nt, Human
auagacaauuuauuau

SEQ ID NO: 1900154 - RNA, 15 nt, Human
uuauuauauuuacaa

SEQ ID NO: 1900155 - RNA, 12 nt, Human
uuauuaguuuug

SEQ ID NO: 1900156 - RNA, 13 nt, Human
uuauuaguuuugc

SEQ ID NO: 1900157 - RNA, 12 nt, Human
uuauuaugcaug

SEQ ID NO: 1900158 - RNA, 14 nt, Human
uuauuauauuuaca

SEQ ID NO: 1900159 - RNA, 24 nt, Human
uuauuaguaccauaguaccauuua

SEQ ID NO: 1900160 - RNA, 12 nt, Human
uuauucauaauu

SEQ ID NO: 1900161 - RNA, 23 nt, Human
uuauucaauaaaaaaaagaaaug

SEQ ID NO: 1900162 - RNA, 18 nt, Human
uuauucaauuccucuggg

SEQ ID NO: 1900163 - RNA, 19 nt, Human
uuauucaauuccucuggga

SEQ ID NO: 1900164 - RNA, 13 nt, Human
uuauuaugcauga

SEQ ID NO: 1900165 - RNA, 16 nt, Human
uuauuauuauuuuuua

SEQ ID NO: 1900166 - RNA, 16 nt, Human
uuauuauuuucaccug

SEQ ID NO: 1900167 - RNA, 15 nt, Human
uuauucaaagaaaua

SEQ ID NO: 1900168 - RNA, 11 nt, Human
auacucccauc

SEQ ID NO: 1900169 - RNA, 16 nt, Human
auacucauuaggaugg

SEQ ID NO: 1900170 - RNA, 17 nt, Human
uuauuccagaaugcugu

SEQ ID NO: 1900171 - RNA, 20 nt, Human
uuauuccagaaugcuguaca

SEQ ID NO: 1900172 - RNA, 22 nt, Human
uuauuccagaaugcuguacauc

SEQ ID NO: 1900173 - RNA, 21 nt, Human
auacucuuaggaagagaaacc

SEQ ID NO: 1900174 - RNA, 22 nt, Human
auacucuuaggaagagaaacca

SEQ ID NO: 1900175 - RNA, 18 nt, Human
auacucuuauaucuauau

SEQ ID NO: 1900176 - RNA, 14 nt, Human
auacucuuauaucu

SEQ ID NO: 1900177 - RNA, 16 nt, Human
auacucugcuuagaau

SEQ ID NO: 1900178 - RNA, 19 nt, Human
auacucuuaggaagagaaa

SEQ ID NO: 1900179 - RNA, 17 nt, Human
auacuccuccaagguua

SEQ ID NO: 1900180 - RNA, 14 nt, Human
auacucccaucugu

SEQ ID NO: 1900181 - RNA, 17 nt, Human
auacucuagaugaaguu

SEQ ID NO: 1900182 - RNA, 23 nt, Human
auacucuagaugaaguuuuacau

SEQ ID NO: 1900183 - RNA, 14 nt, Human
auacugcaagaaaa

SEQ ID NO: 1900184 - RNA, 16 nt, Human
auacugcaagaaaaug

SEQ ID NO: 1900185 - RNA, 14 nt, Human
auacucuuucugua

SEQ ID NO: 1900186 - RNA, 15 nt, Human
auacucuuucuguau

SEQ ID NO: 1900187 - RNA, 16 nt, Human
auacucuuucuguaua

SEQ ID NO: 1900188 - RNA, 17 nt, Human
auacucuuucuguauau

SEQ ID NO: 1900189 - RNA, 22 nt, Human
auacucuuucuguauauacuuu

SEQ ID NO: 1900190 - RNA, 23 nt, Human
auacucuuucuguauauacuuuu

SEQ ID NO: 1900191 - RNA, 19 nt, Human
auacugacugagaauauaa

SEQ ID NO: 1900192 - RNA, 12 nt, Human
auacuggcaugc

SEQ ID NO: 1900193 - RNA, 16 nt, Human
auacuggcaugcuaaa

SEQ ID NO: 1900194 - RNA, 16 nt, Human
auacugcuacuguaau

SEQ ID NO: 1900195 - RNA, 19 nt, Human
auacugcuacuguaauuuu

SEQ ID NO: 1900196 - RNA, 20 nt, Human
auacugcuacuguaauuuua

SEQ ID NO: 1900197 - RNA, 22 nt, Human
auacugcuacuguaauuuuaua

SEQ ID NO: 1900198 - RNA, 15 nt, Human
auacugcuacuguaa

SEQ ID NO: 1900199 - RNA, 16 nt, Human
uuaucauuuucaaaau

SEQ ID NO: 1900200 - RNA, 12 nt, Human
uuaucauuuuca

SEQ ID NO: 1900201 - RNA, 17 nt, Human
uuauccauauugaguca

SEQ ID NO: 1900202 - RNA, 19 nt, Human
uuauccauauugagucaaa

SEQ ID NO: 1900203 - RNA, 21 nt, Human
uuaucacccagaagaaaauag

SEQ ID NO: 1900204 - RNA, 19 nt, Human
uuaucacccagaagaaaau

SEQ ID NO: 1900205 - RNA, 18 nt, Human
uuaucacccagaagaaaa

SEQ ID NO: 1900206 - RNA, 17 nt, Human
uuaucacccagaagaaa

SEQ ID NO: 1900207 - RNA, 20 nt, Human
uuaugaagcuuuuaugugaa

SEQ ID NO: 1900208 - RNA, 19 nt, Human
uuaugaaacuuuuggaagg

SEQ ID NO: 1900209 - RNA, 14 nt, Human
uuaugaaacuuuug

SEQ ID NO: 1900210 - RNA, 18 nt, Human
uuaugaaacuuuuggaag

SEQ ID NO: 1900211 - RNA, 17 nt, Human
uuaugaaacuuuuggaa

SEQ ID NO: 1900212 - RNA, 11 nt, Human
uuaugacucca

SEQ ID NO: 1900213 - RNA, 20 nt, Human
uuaugauacuugaaaauuaa

SEQ ID NO: 1900214 - RNA, 18 nt, Human
uuaugaccucuuccuuua

SEQ ID NO: 1900215 - RNA, 17 nt, Human
uuaugggaaucaagauu

SEQ ID NO: 1900216 - RNA, 23 nt, Human
uuaugggaaccccuucauccucu

SEQ ID NO: 1900217 - RNA, 21 nt, Human
uuaugaugugggucaaggaau

SEQ ID NO: 1900218 - RNA, 20 nt, Human
uuaugaugugggucaaggaa

SEQ ID NO: 1900219 - RNA, 13 nt, Human
uuaugggcugggu

SEQ ID NO: 1900220 - RNA, 19 nt, Human
uuauggcuuuugugcauua

SEQ ID NO: 1900221 - RNA, 22 nt, Human
uuaugggcuggguucuacccag

SEQ ID NO: 1900222 - RNA, 13 nt, Human
uuaugugaaacau

SEQ ID NO: 1900223 - RNA, 19 nt, Human
uuauguaguaauugacaug

SEQ ID NO: 1900224 - RNA, 15 nt, Human
uuauguaguaauuga

SEQ ID NO: 1900225 - RNA, 16 nt, Human
uuauguaguaauugac

SEQ ID NO: 1900226 - RNA, 15 nt, Human
uuaugugaaacaugu

SEQ ID NO: 1900227 - RNA, 22 nt, Human
uuaugugccagauuuaugcaua

SEQ ID NO: 1900228 - RNA, 14 nt, Human
uuaugugugugugu

SEQ ID NO: 1900229 - RNA, 12 nt, Human
uuaugugugugu

SEQ ID NO: 1900230 - RNA, 10 nt, Human
uuaugugugu

SEQ ID NO: 1900231 - RNA, 20 nt, Human
uuaucacaaaaaagaaaaug

SEQ ID NO: 1900232 - RNA, 14 nt, Human
auacuauauuuaug

SEQ ID NO: 1900233 - RNA, 20 nt, Human
auacuaaccagcagaaaugc

SEQ ID NO: 1900234 - RNA, 19 nt, Human
auacuaaccagcagaaaug

SEQ ID NO: 1900235 - RNA, 13 nt, Human
auacuaaccagca

SEQ ID NO: 1900236 - RNA, 13 nt, Human
auacguacacauu

SEQ ID NO: 1900237 - RNA, 13 nt, Human
auacgauaaauaa

SEQ ID NO: 1900238 - RNA, 16 nt, Human
auacguacacauuuua

SEQ ID NO: 1900239 - RNA, 19 nt, Human
auacgugggcauucaaaug

SEQ ID NO: 1900240 - RNA, 18 nt, Human
auacgugggcauucaaau

SEQ ID NO: 1900241 - RNA, 15 nt, Human
auacguacacauuuu

SEQ ID NO: 1900242 - RNA, 14 nt, Human
auacguacacauuu

SEQ ID NO: 1900243 - RNA, 14 nt, Human
auaccuuuuuuaga

SEQ ID NO: 1900244 - RNA, 17 nt, Human
auaccagccaguaaaug

SEQ ID NO: 1900245 - RNA, 18 nt, Human
auaccacuuuuguucuug

SEQ ID NO: 1900246 - RNA, 17 nt, Human
auaccacuuuuguucuu

SEQ ID NO: 1900247 - RNA, 15 nt, Human
uuauaaauauauuua

SEQ ID NO: 1900248 - RNA, 22 nt, Human
uuauaaacuuuuuucuuacugu

SEQ ID NO: 1900249 - RNA, 12 nt, Human
uuauaaacuuuu

SEQ ID NO: 1900250 - RNA, 16 nt, Human
uuauaaacuuuuuucu

SEQ ID NO: 1900251 - RNA, 18 nt, Human
uuauaaacuuuaccuuuu

SEQ ID NO: 1900252 - RNA, 17 nt, Human
uuauaaacuuuaccuuu

SEQ ID NO: 1900253 - RNA, 16 nt, Human
auacagaggcaacugc

SEQ ID NO: 1900254 - RNA, 17 nt, Human
auacagaggcaacugca

SEQ ID NO: 1900255 - RNA, 20 nt, Human
auacaguuacucagaauucu

SEQ ID NO: 1900256 - RNA, 15 nt, Human
auacauacaccagca

SEQ ID NO: 1900257 - RNA, 23 nt, Human
auacauacaccagcauuccuuuu

SEQ ID NO: 1900258 - RNA, 23 nt, Human
auacauauauguauauauaugca

SEQ ID NO: 1900259 - RNA, 13 nt, Human
auacauaucuuua

SEQ ID NO: 1900260 - RNA, 14 nt, Human
auacauaucuuuau

SEQ ID NO: 1900261 - RNA, 16 nt, Human
auacauaucuuuauua

SEQ ID NO: 1900262 - RNA, 17 nt, Human
auacauaucuuuauuaa

SEQ ID NO: 1900263 - RNA, 20 nt, Human
auacauaucuuuauuaauca

SEQ ID NO: 1900264 - RNA, 23 nt, Human
auacaggaaaagcugcugacagu

SEQ ID NO: 1900265 - RNA, 23 nt, Human
auacagauagauauaugcucugc

SEQ ID NO: 1900266 - RNA, 18 nt, Human
auacaguuacucagaauu

SEQ ID NO: 1900267 - RNA, 21 nt, Human
auacaggaugaugacuaugga

SEQ ID NO: 1900268 - RNA, 16 nt, Human
auacagggaugguguu

SEQ ID NO: 1900269 - RNA, 20 nt, Human
aguuuaaauuguaauaggcg

SEQ ID NO: 1900270 - RNA, 17 nt, Human
aguuuaaauuguaauag

SEQ ID NO: 1900271 - RNA, 20 nt, Human
uuaaaaaucucaaauuucua

SEQ ID NO: 1900272 - RNA, 19 nt, Human
uuaaaaaucucaaauuucu

SEQ ID NO: 1900273 - RNA, 12 nt, Human
uuaaaaugagaa

SEQ ID NO: 1900274 - RNA, 19 nt, Human
uuaaaaugagaaaucuaaa

SEQ ID NO: 1900275 - RNA, 14 nt, Human
aguuucucuuuuca

SEQ ID NO: 1900276 - RNA, 15 nt, Human
aguuucugccgcagc

SEQ ID NO: 1900277 - RNA, 15 nt, Human
aguuuguugaaacac

SEQ ID NO: 1900278 - RNA, 18 nt, Human
aguuuuaacuagaauuua

SEQ ID NO: 1900279 - RNA, 22 nt, Human
aguuuguuaguaugaggcauuu

SEQ ID NO: 1900280 - RNA, 19 nt, Human
aguuucugccgcagcccug

SEQ ID NO: 1900281 - RNA, 16 nt, Human
uuaacagaaauguaca

SEQ ID NO: 1900282 - RNA, 19 nt, Human
uuaacacugcuuguguuuu

SEQ ID NO: 1900283 - RNA, 14 nt, Human
uuaacagaaaaaca

SEQ ID NO: 1900284 - RNA, 23 nt, Human
aguuuaucgaccaguuugaaucu

SEQ ID NO: 1900285 - RNA, 14 nt, Human
uuaacagaaaugua

SEQ ID NO: 1900286 - RNA, 13 nt, Human
uuaacagaaaugu

SEQ ID NO: 1900287 - RNA, 12 nt, Human
uuaacagaaaug

SEQ ID NO: 1900288 - RNA, 16 nt, Human
uuaaauuuugugucuc

SEQ ID NO: 1900289 - RNA, 14 nt, Human
uuaaauuuuguguc

SEQ ID NO: 1900290 - RNA, 13 nt, Human
aguuuuaucauuu

SEQ ID NO: 1900291 - RNA, 12 nt, Human
aguuuuaucauu

SEQ ID NO: 1900292 - RNA, 15 nt, Human
aguuuuuuuuauaca

SEQ ID NO: 1900293 - RNA, 22 nt, Human
aguuuuucccagcuacaccuuu

SEQ ID NO: 1900294 - RNA, 23 nt, Human
aguuuuucccagcuacaccuuuc

SEQ ID NO: 1900295 - RNA, 19 nt, Human
uuaagaaaaaggaugcaca

SEQ ID NO: 1900296 - RNA, 18 nt, Human
uuaagaaggcaaaaaugu

SEQ ID NO: 1900297 - RNA, 19 nt, Human
uuaagacgaaacauuuguu

SEQ ID NO: 1900298 - RNA, 11 nt, Human
uuaagaccugg

SEQ ID NO: 1900299 - RNA, 14 nt, Human
uuaagaccuggcag

SEQ ID NO: 1900300 - RNA, 18 nt, Human
uuaagaccuggcagcucu

SEQ ID NO: 1900301 - RNA, 18 nt, Human
uuaagacaugauuuccuu

SEQ ID NO: 1900302 - RNA, 16 nt, Human
uuaagacaugauuucc

SEQ ID NO: 1900303 - RNA, 19 nt, Human
auaaaagccuguuuaagag

SEQ ID NO: 1900304 - RNA, 13 nt, Human
auaaaaaaaagaa

SEQ ID NO: 1900305 - RNA, 20 nt, Human
auaaaagccuguuuaagaga

SEQ ID NO: 1900306 - RNA, 15 nt, Human
auaaaaggaagccaa

SEQ ID NO: 1900307 - RNA, 17 nt, Human
auaaaaggaagccaaag

SEQ ID NO: 1900308 - RNA, 22 nt, Human
auaaaagggacugagaaauuua

SEQ ID NO: 1900309 - RNA, 22 nt, Human
uuaacuuuuauaaacuuuaccu

SEQ ID NO: 1900310 - RNA, 23 nt, Human
uuaacuuuuauaaacuuuaccuu

SEQ ID NO: 1900311 - RNA, 19 nt, Human
auaaaaggaagccaaagag

SEQ ID NO: 1900312 - RNA, 20 nt, Human
auaaaaggaagccaaagagu

SEQ ID NO: 1900313 - RNA, 16 nt, Human
uuaaucuuuucacaaa

SEQ ID NO: 1900314 - RNA, 17 nt, Human
uuaaucuuuaauuuuac

SEQ ID NO: 1900315 - RNA, 13 nt, Human
uuaaucuuuaauu

SEQ ID NO: 1900316 - RNA, 15 nt, Human
uuaaucuuaucaaga

SEQ ID NO: 1900317 - RNA, 16 nt, Human
uuaauuugguuuucac

SEQ ID NO: 1900318 - RNA, 20 nt, Human
uuaaguuuccuuccagccca

SEQ ID NO: 1900319 - RNA, 21 nt, Human
uuaaguuuccuuccagcccag

SEQ ID NO: 1900320 - RNA, 16 nt, Human
uuaauaaaaguacaug

SEQ ID NO: 1900321 - RNA, 22 nt, Human
uuaagacgaaacauuuguucua

SEQ ID NO: 1900322 - RNA, 13 nt, Human
uuaagacguguuu

SEQ ID NO: 1900323 - RNA, 16 nt, Human
uuaagacguguuugug

SEQ ID NO: 1900324 - RNA, 17 nt, Human
uuaagacguguuugugu

SEQ ID NO: 1900325 - RNA, 22 nt, Human
uuaagagagucuauuuacggaa

SEQ ID NO: 1900326 - RNA, 15 nt, Human
uuaaucuaaauggaa

SEQ ID NO: 1900327 - RNA, 17 nt, Human
uuaaucacuauuguucc

SEQ ID NO: 1900328 - RNA, 19 nt, Human
auaaauuguaauuguaaag

SEQ ID NO: 1900329 - RNA, 14 nt, Human
uuacaggugugaac

SEQ ID NO: 1900330 - RNA, 20 nt, Human
uuacagggcacaggccaugg

SEQ ID NO: 1900331 - RNA, 20 nt, Human
uuacagggaugagccaccgc

SEQ ID NO: 1900332 - RNA, 19 nt, Human
uuaccagcagagcaccuua

SEQ ID NO: 1900333 - RNA, 17 nt, Human
uuacaguguagcuugcc

SEQ ID NO: 1900334 - RNA, 13 nt, Human
uuacaguguuccg

SEQ ID NO: 1900335 - RNA, 17 nt, Human
uuacaguggggaaugaa

SEQ ID NO: 1900336 - RNA, 21 nt, Human
auaaauuccucuuugcuuugc

SEQ ID NO: 1900337 - RNA, 15 nt, Human
auaaaucugacccag

SEQ ID NO: 1900338 - RNA, 16 nt, Human
auaaaucugacccagu

SEQ ID NO: 1900339 - RNA, 18 nt, Human
auaaaucugacccagugc

SEQ ID NO: 1900340 - RNA, 19 nt, Human
auaaaucugacccagugcc

SEQ ID NO: 1900341 - RNA, 15 nt, Human
uuacaaacauguggu

SEQ ID NO: 1900342 - RNA, 12 nt, Human
uuacaaacaugu

SEQ ID NO: 1900343 - RNA, 15 nt, Human
uuacugcagcuuugu

SEQ ID NO: 1900344 - RNA, 14 nt, Human
uuacucaggaagaa

SEQ ID NO: 1900345 - RNA, 17 nt, Human
uuacucaggaagaacac

SEQ ID NO: 1900346 - RNA, 23 nt, Human
uuacuguacagacagaaaaaacu

SEQ ID NO: 1900347 - RNA, 12 nt, Human
uuacuguacaug

SEQ ID NO: 1900348 - RNA, 23 nt, Human
uuacuguacaugaaaacacauuu

SEQ ID NO: 1900349 - RNA, 22 nt, Human
uuacuguacaugaaaacacauu

SEQ ID NO: 1900350 - RNA, 14 nt, Human
uuacuguacaugaa

SEQ ID NO: 1900351 - RNA, 13 nt, Human
uuacuguacauga

SEQ ID NO: 1900352 - RNA, 18 nt, Human
auaacuuuuuuuuaaguu

SEQ ID NO: 1900353 - RNA, 14 nt, Human
auaagauucauauu

SEQ ID NO: 1900354 - RNA, 16 nt, Human
uuagaagucacacagu

SEQ ID NO: 1900355 - RNA, 19 nt, Human
uuagaauaauaaauauuua

SEQ ID NO: 1900356 - RNA, 23 nt, Human
uuacugucaaggcugcuuagaau

SEQ ID NO: 1900357 - RNA, 15 nt, Human
uuacuguaauuccuc

SEQ ID NO: 1900358 - RNA, 18 nt, Human
uuagaauccaaacuugga

SEQ ID NO: 1900359 - RNA, 22 nt, Human
uuagaauccaaacuuggauuuu

SEQ ID NO: 1900360 - RNA, 13 nt, Human
uuaguagagacag

SEQ ID NO: 1900361 - RNA, 19 nt, Human
uuaguacuccccuccuuga

SEQ ID NO: 1900362 - RNA, 14 nt, Human
uuaguagagacagg

SEQ ID NO: 1900363 - RNA, 18 nt, Human
uuaguuuuugugaaguuu

SEQ ID NO: 1900364 - RNA, 21 nt, Human
uuaguuuuugugaaguuuaau

SEQ ID NO: 1900365 - RNA, 15 nt, Human
uuauaaaaauaaaaa

SEQ ID NO: 1900366 - RNA, 13 nt, Human
uuauaaacuuuac

SEQ ID NO: 1900367 - RNA, 13 nt, Human
uuauaaaacuucu

SEQ ID NO: 1900368 - RNA, 21 nt, Human
uuauaaaaauaaaaaacacug

SEQ ID NO: 1900369 - RNA, 22 nt, Human
uuauaaaaauaaaaaacacugg

SEQ ID NO: 1900370 - RNA, 19 nt, Human
uuauaaaaagguguuuuga

SEQ ID NO: 1900371 - RNA, 12 nt, Human
uuauaaaacuuc

SEQ ID NO: 1900372 - RNA, 19 nt, Human
uuaggugugggggaagcac

SEQ ID NO: 1900373 - RNA, 15 nt, Human
uuaggugaggaagca

SEQ ID NO: 1900374 - RNA, 14 nt, Human
uuaguaaucauauu

SEQ ID NO: 1900375 - RNA, 13 nt, Human
uuaguaaucauau

SEQ ID NO: 1900376 - RNA, 18 nt, Human
uuagguuggcaaaaaggc

SEQ ID NO: 1900377 - RNA, 14 nt, Human
auaagccagacauc

SEQ ID NO: 1900378 - RNA, 14 nt, Human
auaauauauuugug

SEQ ID NO: 1900379 - RNA, 21 nt, Human
auaagauucauauuuacuucu

SEQ ID NO: 1900380 - RNA, 22 nt, Human
auaagccaaaaaaugcuugcuu

SEQ ID NO: 1900381 - RNA, 18 nt, Human
auaaucacaacccuucag

SEQ ID NO: 1900382 - RNA, 20 nt, Human
auaauauuuuuaauuaaaua

SEQ ID NO: 1900383 - RNA, 15 nt, Human
auaaucuuauuaggg

SEQ ID NO: 1900384 - RNA, 14 nt, Human
auaauauuuuuaau

SEQ ID NO: 1900385 - RNA, 23 nt, Human
auaauucacauuguauucagagu

SEQ ID NO: 1900386 - RNA, 23 nt, Human
auaaucuuauuagggagaaaauu

SEQ ID NO: 1900387 - RNA, 14 nt, Human
auaauuuuaaaugu

SEQ ID NO: 1900388 - RNA, 21 nt, Human
uuagauguuccaguaaucuaa

SEQ ID NO: 1900389 - RNA, 22 nt, Human
uuagauguuccaguaaucuaau

SEQ ID NO: 1900390 - RNA, 12 nt, Human
auaauuuuaaau

SEQ ID NO: 1900391 - RNA, 13 nt, Human
auaauuuuaaaug

SEQ ID NO: 1900392 - RNA, 17 nt, Human
aucugguuaggauggca

SEQ ID NO: 1900393 - RNA, 10 nt, Human
aucuggugac

SEQ ID NO: 1900394 - RNA, 16 nt, Human
aucuggugacuuuccu

SEQ ID NO: 1900395 - RNA, 17 nt, Human
aucuggugacuuuccuc

SEQ ID NO: 1900396 - RNA, 17 nt, Human
aucugugaaaggaaaga

SEQ ID NO: 1900397 - RNA, 15 nt, Human
aucuguccucagccu

SEQ ID NO: 1900398 - RNA, 16 nt, Human
aucuguccucagccuu

SEQ ID NO: 1900399 - RNA, 17 nt, Human
aucuguccucagccuug

SEQ ID NO: 1900400 - RNA, 18 nt, Human
aucuguccucagccuugc

SEQ ID NO: 1900401 - RNA, 21 nt, Human
aucuguccucagccuugccag

SEQ ID NO: 1900402 - RNA, 14 nt, Human
aucuguccucagcc

SEQ ID NO: 1900403 - RNA, 17 nt, Human
aucuguaucuuuucucu

SEQ ID NO: 1900404 - RNA, 18 nt, Human
uugcauuuuuuaaaacaa

SEQ ID NO: 1900405 - RNA, 15 nt, Human
uugccaaaaaggggu

SEQ ID NO: 1900406 - RNA, 21 nt, Human
uugcauuuggauugggguccc

SEQ ID NO: 1900407 - RNA, 20 nt, Human
aucugcuagggaauaucaau

SEQ ID NO: 1900408 - RNA, 14 nt, Human
aucuuauaauuuaa

SEQ ID NO: 1900409 - RNA, 13 nt, Human
aucuugcucugcu

SEQ ID NO: 1900410 - RNA, 20 nt, Human
aucuuggucagauuugaacu

SEQ ID NO: 1900411 - RNA, 18 nt, Human
aucugugaaaggaaagag

SEQ ID NO: 1900412 - RNA, 17 nt, Human
aucuguuuacaguguuc

SEQ ID NO: 1900413 - RNA, 15 nt, Human
aucuguuuacagugu

SEQ ID NO: 1900414 - RNA, 17 nt, Human
aucuguuuugaaggcaa

SEQ ID NO: 1900415 - RNA, 18 nt, Human
aucuguuuugaaggcaaa

SEQ ID NO: 1900416 - RNA, 19 nt, Human
aucuguuuugaaggcaaaa

SEQ ID NO: 1900417 - RNA, 13 nt, Human
uugcucuggaccu

SEQ ID NO: 1900418 - RNA, 15 nt, Human
uugcucuggaccugc

SEQ ID NO: 1900419 - RNA, 14 nt, Human
uugcucuggaccug

SEQ ID NO: 1900420 - RNA, 14 nt, Human
aucuugucucuggg

SEQ ID NO: 1900421 - RNA, 15 nt, Human
aucuugucucugggc

SEQ ID NO: 1900422 - RNA, 22 nt, Human
uuggccgcaccuaaagcagcca

SEQ ID NO: 1900423 - RNA, 17 nt, Human
uuggccugaucagacca

SEQ ID NO: 1900424 - RNA, 18 nt, Human
uuggccccugcccggcug

SEQ ID NO: 1900425 - RNA, 21 nt, Human
uuggccccccgaccuuguaga

SEQ ID NO: 1900426 - RNA, 16 nt, Human
uuggagggugucccaa

SEQ ID NO: 1900427 - RNA, 14 nt, Human
uugcuugaaagaaa

SEQ ID NO: 1900428 - RNA, 15 nt, Human
uuggagaguuuccug

SEQ ID NO: 1900429 - RNA, 16 nt, Human
uuggagaguuuccuga

SEQ ID NO: 1900430 - RNA, 18 nt, Human
augaaagggcccagagag

SEQ ID NO: 1900431 - RNA, 14 nt, Human
aucuuuucuugccu

SEQ ID NO: 1900432 - RNA, 11 nt, Human
aucuuuugaac

SEQ ID NO: 1900433 - RNA, 23 nt, Human
aucuuuucuugccucuguccccu

SEQ ID NO: 1900434 - RNA, 22 nt, Human
aucuuuucauugaacagcaaag

SEQ ID NO: 1900435 - RNA, 17 nt, Human
aucuuugcagacaggca

SEQ ID NO: 1900436 - RNA, 19 nt, Human
aucuuugauucuccuucag

SEQ ID NO: 1900437 - RNA, 18 nt, Human
aucuuugauucuccuuca

SEQ ID NO: 1900438 - RNA, 17 nt, Human
aucuuugauucuccuuc

SEQ ID NO: 1900439 - RNA, 16 nt, Human
aucuuugauucuccuu

SEQ ID NO: 1900440 - RNA, 22 nt, Human
aucuuuucauuuaggugaggaa

SEQ ID NO: 1900441 - RNA, 20 nt, Human
aucuuugauucuccuucagc

SEQ ID NO: 1900442 - RNA, 20 nt, Human
aucuuucuuuggaugggacu

SEQ ID NO: 1900443 - RNA, 15 nt, Human
aucuuugauucuccu

SEQ ID NO: 1900444 - RNA, 14 nt, Human
aucuuugauucucc

SEQ ID NO: 1900445 - RNA, 18 nt, Human
aucuuucuugaucaacau

SEQ ID NO: 1900446 - RNA, 13 nt, Human
aucuuucuugauc

SEQ ID NO: 1900447 - RNA, 17 nt, Human
uuggcucacacugagaa

SEQ ID NO: 1900448 - RNA, 16 nt, Human
uuggcucacacugaga

SEQ ID NO: 1900449 - RNA, 13 nt, Human
uuggcucagacau

SEQ ID NO: 1900450 - RNA, 14 nt, Human
uuggcucagacaug

SEQ ID NO: 1900451 - RNA, 13 nt, Human
uuggugccuggcc

SEQ ID NO: 1900452 - RNA, 12 nt, Human
uuggugccuggc

SEQ ID NO: 1900453 - RNA, 21 nt, Human
uuggggaguuaagaccuggca

SEQ ID NO: 1900454 - RNA, 17 nt, Human
uuggggaguuaagaccu

SEQ ID NO: 1900455 - RNA, 19 nt, Human
uuggggaguuaagaccugg

SEQ ID NO: 1900456 - RNA, 20 nt, Human
uuggggaguuaagaccuggc

SEQ ID NO: 1900457 - RNA, 18 nt, Human
uuggggaccagagcugcc

SEQ ID NO: 1900458 - RNA, 23 nt, Human
uuggggacaggggcaggaggaag

SEQ ID NO: 1900459 - RNA, 21 nt, Human
augaauauuuaguguucauaa

SEQ ID NO: 1900460 - RNA, 23 nt, Human
augaauggcuaagcaaaauguga

SEQ ID NO: 1900461 - RNA, 19 nt, Human
augaagacucgcaauuuca

SEQ ID NO: 1900462 - RNA, 16 nt, Human
augaauauuuaguguu

SEQ ID NO: 1900463 - RNA, 18 nt, Human
augaacuuguaaaggaau

SEQ ID NO: 1900464 - RNA, 19 nt, Human
augaaagggcccagagagg

SEQ ID NO: 1900465 - RNA, 22 nt, Human
aucuaauaccucugugugcucc

SEQ ID NO: 1900466 - RNA, 18 nt, Human
aucuaauauguaacaagc

SEQ ID NO: 1900467 - RNA, 16 nt, Human
aucuaauauggccaca

SEQ ID NO: 1900468 - RNA, 23 nt, Human
aucuaauauggccacaguagucu

SEQ ID NO: 1900469 - RNA, 18 nt, Human
aucuacacuccagugaga

SEQ ID NO: 1900470 - RNA, 19 nt, Human
aucuacacuccagugagac

SEQ ID NO: 1900471 - RNA, 20 nt, Human
uugaguugauucagcucugc

SEQ ID NO: 1900472 - RNA, 20 nt, Human
uugagugaagcugggagaac

SEQ ID NO: 1900473 - RNA, 15 nt, Human
uugagucuguuuugu

SEQ ID NO: 1900474 - RNA, 18 nt, Human
uugagucuguuuuguaaa

SEQ ID NO: 1900475 - RNA, 16 nt, Human
uugagauguguucaca

SEQ ID NO: 1900476 - RNA, 13 nt, Human
uugaguagaggcu

SEQ ID NO: 1900477 - RNA, 15 nt, Human
uugagaucagccugg

SEQ ID NO: 1900478 - RNA, 16 nt, Human
uugagaucagccuggg

SEQ ID NO: 1900479 - RNA, 22 nt, Human
uugagacuccucaguucuugcc

SEQ ID NO: 1900480 - RNA, 12 nt, Human
uugagacagagu

SEQ ID NO: 1900481 - RNA, 12 nt, Human
uugacuuugucu

SEQ ID NO: 1900482 - RNA, 11 nt, Human
uugacuuuguc

SEQ ID NO: 1900483 - RNA, 21 nt, Human
uugacuugacagaacacuguc

SEQ ID NO: 1900484 - RNA, 20 nt, Human
uugacuugacagaacacugu

SEQ ID NO: 1900485 - RNA, 19 nt, Human
uugacuugacagaacacug

SEQ ID NO: 1900486 - RNA, 14 nt, Human
uugacagcuuugcu

SEQ ID NO: 1900487 - RNA, 17 nt, Human
uugacagcuuugcugcu

SEQ ID NO: 1900488 - RNA, 18 nt, Human
uugacagcuuugcugcug

SEQ ID NO: 1900489 - RNA, 18 nt, Human
auccucugagugugacca

SEQ ID NO: 1900490 - RNA, 16 nt, Human
auccucuguacagagc

SEQ ID NO: 1900491 - RNA, 17 nt, Human
auccucuguacagagcc

SEQ ID NO: 1900492 - RNA, 14 nt, Human
aucguucucugccu

SEQ ID NO: 1900493 - RNA, 13 nt, Human
aucuaaauggaac

SEQ ID NO: 1900494 - RNA, 18 nt, Human
aucuaaauggaaccacuc

SEQ ID NO: 1900495 - RNA, 17 nt, Human
aucuaaauggaaccacu

SEQ ID NO: 1900496 - RNA, 17 nt, Human
uugaagggaaauuucag

SEQ ID NO: 1900497 - RNA, 12 nt, Human
uugaaggcuuaa

SEQ ID NO: 1900498 - RNA, 11 nt, Human
uugaaggcuua

SEQ ID NO: 1900499 - RNA, 17 nt, Human
uugaaggcaaaauugca

SEQ ID NO: 1900500 - RNA, 12 nt, Human
uugaaggcaaaa

SEQ ID NO: 1900501 - RNA, 15 nt, Human
uugaaggcaaaauug

SEQ ID NO: 1900502 - RNA, 12 nt, Human
uugaauaaauaa

SEQ ID NO: 1900503 - RNA, 17 nt, Human
uugacagaacacugucu

SEQ ID NO: 1900504 - RNA, 16 nt, Human
uugacagaacacuguc

SEQ ID NO: 1900505 - RNA, 15 nt, Human
uugacagaacacugu

SEQ ID NO: 1900506 - RNA, 14 nt, Human
uugacagaacacug

SEQ ID NO: 1900507 - RNA, 15 nt, Human
uugaaucuauuuaag

SEQ ID NO: 1900508 - RNA, 17 nt, Human
uugaaucuauuuaagua

SEQ ID NO: 1900509 - RNA, 20 nt, Human
uugaaucuauuuaaguaaaa

SEQ ID NO: 1900510 - RNA, 17 nt, Human
uugaaucaguauaaaca

SEQ ID NO: 1900511 - RNA, 23 nt, Human
uugcauaguaccaaucauuuuaa

SEQ ID NO: 1900512 - RNA, 14 nt, Human
uugcauauauacau

SEQ ID NO: 1900513 - RNA, 18 nt, Human
uugcauauuuuguaacuu

SEQ ID NO: 1900514 - RNA, 14 nt, Human
uugcauugaacaca

SEQ ID NO: 1900515 - RNA, 15 nt, Human
uugcauugaacacaa

SEQ ID NO: 1900516 - RNA, 18 nt, Human
uugcauugaacacaaacu

SEQ ID NO: 1900517 - RNA, 22 nt, Human
uugcauugaacacaaacuguaa

SEQ ID NO: 1900518 - RNA, 23 nt, Human
uugcauugaacacaaacuguaaa

SEQ ID NO: 1900519 - RNA, 21 nt, Human
uugcauugaccgcgacuaauu

SEQ ID NO: 1900520 - RNA, 19 nt, Human
uugcaauggcagccuuggc

SEQ ID NO: 1900521 - RNA, 17 nt, Human
uugcaauggcagccuug

SEQ ID NO: 1900522 - RNA, 16 nt, Human
uugcaauggcagccuu

SEQ ID NO: 1900523 - RNA, 14 nt, Human
uugcaccacugcac

SEQ ID NO: 1900524 - RNA, 15 nt, Human
uugcaccacugcacu

SEQ ID NO: 1900525 - RNA, 16 nt, Human
uugcaccacugcacuc

SEQ ID NO: 1900526 - RNA, 18 nt, Human
uugcaccacugcacucca

SEQ ID NO: 1900527 - RNA, 14 nt, Human
uugauuaaauucuu

SEQ ID NO: 1900528 - RNA, 22 nt, Human
uugauuaagaucucagugguua

SEQ ID NO: 1900529 - RNA, 21 nt, Human
uugauuauccauauugaguca

SEQ ID NO: 1900530 - RNA, 20 nt, Human
aucugaccagcagcgccuuu

SEQ ID NO: 1900531 - RNA, 13 nt, Human
uugcaaggaagcc

SEQ ID NO: 1900532 - RNA, 12 nt, Human
uugcaaggaagc

SEQ ID NO: 1900533 - RNA, 23 nt, Human
uugauguuuuaaggaugcuugua

SEQ ID NO: 1900534 - RNA, 18 nt, Human
aucugacaugauuccuuc

SEQ ID NO: 1900535 - RNA, 19 nt, Human
aucugacaugauuccuucc

SEQ ID NO: 1900536 - RNA, 20 nt, Human
aucugacaugauuccuuccu

SEQ ID NO: 1900537 - RNA, 23 nt, Human
aucugacaugauuccuuccuguu

SEQ ID NO: 1900538 - RNA, 14 nt, Human
aucugaccagcagc

SEQ ID NO: 1900539 - RNA, 15 nt, Human
aucugaccagcagcg

SEQ ID NO: 1900540 - RNA, 16 nt, Human
aucugaccagcagcgc

SEQ ID NO: 1900541 - RNA, 13 nt, Human
uugauuaaauucu

SEQ ID NO: 1900542 - RNA, 12 nt, Human
aucugacccagu

SEQ ID NO: 1900543 - RNA, 13 nt, Human
aucugacccagug

SEQ ID NO: 1900544 - RNA, 23 nt, Human
aucugaaaauguauguguaagua

SEQ ID NO: 1900545 - RNA, 12 nt, Human
aucugaaaaugu

SEQ ID NO: 1900546 - RNA, 19 nt, Human
aucuagacccaucuucuuu

SEQ ID NO: 1900547 - RNA, 16 nt, Human
aucuacuuuaauaaau

SEQ ID NO: 1900548 - RNA, 16 nt, Human
aucucagggccugguc

SEQ ID NO: 1900549 - RNA, 21 nt, Human
aucucagguuaagugugagua

SEQ ID NO: 1900550 - RNA, 21 nt, Human
aucucaugccccuggcuggga

SEQ ID NO: 1900551 - RNA, 23 nt, Human
aucucaugccccuggcugggacg

SEQ ID NO: 1900552 - RNA, 14 nt, Human
aucuccaaaauaaa

SEQ ID NO: 1900553 - RNA, 21 nt, Human
aucuccaaaauaaaacuuuuu

SEQ ID NO: 1900554 - RNA, 20 nt, Human
aucuccaaaauaaaacuuuu

SEQ ID NO: 1900555 - RNA, 17 nt, Human
aucuccaaaauaaaacu

SEQ ID NO: 1900556 - RNA, 15 nt, Human
aucucccccagcccc

SEQ ID NO: 1900557 - RNA, 22 nt, Human
aucuccaccagucauuuuucag

SEQ ID NO: 1900558 - RNA, 17 nt, Human
aucuccaccagucauuu

SEQ ID NO: 1900559 - RNA, 18 nt, Human
aucuccaagaccagagau

SEQ ID NO: 1900560 - RNA, 16 nt, Human
aucucccccagcccca

SEQ ID NO: 1900561 - RNA, 17 nt, Human
aucucccccagccccau

SEQ ID NO: 1900562 - RNA, 16 nt, Human
aucugaaaauguaugu

SEQ ID NO: 1900563 - RNA, 19 nt, Human
aucugaaaauguaugugua

SEQ ID NO: 1900564 - RNA, 20 nt, Human
aucugaaaauguauguguaa

SEQ ID NO: 1900565 - RNA, 22 nt, Human
aucugaaaauguauguguaagu

SEQ ID NO: 1900566 - RNA, 18 nt, Human
aucucuugagccugggag

SEQ ID NO: 1900567 - RNA, 14 nt, Human
aucugaaaauguau

SEQ ID NO: 1900568 - RNA, 15 nt, Human
aucucuugagccugg

SEQ ID NO: 1900569 - RNA, 21 nt, Human
uucuaaaugaauguuuacacu

SEQ ID NO: 1900570 - RNA, 18 nt, Human
uucuaaaugaauguuuac

SEQ ID NO: 1900571 - RNA, 22 nt, Human
uucuaaagguguugucccuucu

SEQ ID NO: 1900572 - RNA, 15 nt, Human
uucuaaaugaauguu

SEQ ID NO: 1900573 - RNA, 12 nt, Human
uucuaaaugaau

SEQ ID NO: 1900574 - RNA, 20 nt, Human
uucuaaagguguugucccuu

SEQ ID NO: 1900575 - RNA, 21 nt, Human
uucuaaaucuccaaaauaaaa

SEQ ID NO: 1900576 - RNA, 21 nt, Human
uucuaaaggcuaccuuuguau

SEQ ID NO: 1900577 - RNA, 20 nt, Human
uucuaaaggcuaccuuugua

SEQ ID NO: 1900578 - RNA, 19 nt, Human
uucuaaaggcuaccuuugu

SEQ ID NO: 1900579 - RNA, 15 nt, Human
uucggccuccauccu

SEQ ID NO: 1900580 - RNA, 14 nt, Human
uucggccuccaucc

SEQ ID NO: 1900581 - RNA, 17 nt, Human
uucggauuuggggugga

SEQ ID NO: 1900582 - RNA, 20 nt, Human
uucggcagauacugucucuu

SEQ ID NO: 1900583 - RNA, 16 nt, Human
uucgcuugagaaaaaa

SEQ ID NO: 1900584 - RNA, 14 nt, Human
uucgcuugagaaaa

SEQ ID NO: 1900585 - RNA, 19 nt, Human
uucgcuccugugucuugca

SEQ ID NO: 1900586 - RNA, 15 nt, Human
uucgcuccugugucu

SEQ ID NO: 1900587 - RNA, 16 nt, Human
uucuagcauggcugcc

SEQ ID NO: 1900588 - RNA, 12 nt, Human
uucuagcuguug

SEQ ID NO: 1900589 - RNA, 20 nt, Human
uucuagcuguugagcuguuu

SEQ ID NO: 1900590 - RNA, 21 nt, Human
uucuagcuguugagcuguuuu

SEQ ID NO: 1900591 - RNA, 13 nt, Human
uucuaagaaguga

SEQ ID NO: 1900592 - RNA, 23 nt, Human
uucuaagaagugaaaaucuacac

SEQ ID NO: 1900593 - RNA, 18 nt, Human
aucagggaggucauuuug

SEQ ID NO: 1900594 - RNA, 21 nt, Human
aucagcaagucucuuuauaug

SEQ ID NO: 1900595 - RNA, 16 nt, Human
aucaggccauuguccc

SEQ ID NO: 1900596 - RNA, 13 nt, Human
aucaggccauugu

SEQ ID NO: 1900597 - RNA, 12 nt, Human
aucagaauucuc

SEQ ID NO: 1900598 - RNA, 22 nt, Human
aucagaauagccacauuuggaa

SEQ ID NO: 1900599 - RNA, 13 nt, Human
aucagcacgauuu

SEQ ID NO: 1900600 - RNA, 15 nt, Human
aucaggccaggcccu

SEQ ID NO: 1900601 - RNA, 16 nt, Human
aucaggccaggcccuc

SEQ ID NO: 1900602 - RNA, 18 nt, Human
aucaggccaggcccucug

SEQ ID NO: 1900603 - RNA, 16 nt, Human
uucuaggacugaauua

SEQ ID NO: 1900604 - RNA, 14 nt, Human
uucuaggacugaau

SEQ ID NO: 1900605 - RNA, 13 nt, Human
uucuaggacugaa

SEQ ID NO: 1900606 - RNA, 19 nt, Human
aucagaauagccacauuug

SEQ ID NO: 1900607 - RNA, 11 nt, Human
aucagaauucu

SEQ ID NO: 1900608 - RNA, 19 nt, Human
aucacuugaggucaggagu

SEQ ID NO: 1900609 - RNA, 13 nt, Human
aucaagcuaauaa

SEQ ID NO: 1900610 - RNA, 15 nt, Human
aucaagcuaauaaaa

SEQ ID NO: 1900611 - RNA, 14 nt, Human
aucaaugaguaaca

SEQ ID NO: 1900612 - RNA, 15 nt, Human
aucacggcucacugc

SEQ ID NO: 1900613 - RNA, 14 nt, Human
aucacgccacugca

SEQ ID NO: 1900614 - RNA, 13 nt, Human
aucacgccacugc

SEQ ID NO: 1900615 - RNA, 19 nt, Human
aucacggcucacugcagcc

SEQ ID NO: 1900616 - RNA, 18 nt, Human
aucacggcucacugcagc

SEQ ID NO: 1900617 - RNA, 20 nt, Human
uuccuguccucccagcuccu

SEQ ID NO: 1900618 - RNA, 14 nt, Human
uuccuguccuccca

SEQ ID NO: 1900619 - RNA, 11 nt, Human
uuccugugucu

SEQ ID NO: 1900620 - RNA, 14 nt, Human
aucaacagauaaau

SEQ ID NO: 1900621 - RNA, 13 nt, Human
aucaacaucuuuu

SEQ ID NO: 1900622 - RNA, 15 nt, Human
aucaacaucuuuucu

SEQ ID NO: 1900623 - RNA, 21 nt, Human
aucaagaugugacauguuuua

SEQ ID NO: 1900624 - RNA, 18 nt, Human
auauuuuuuguuaaauga

SEQ ID NO: 1900625 - RNA, 20 nt, Human
auauuuuuuguuaaaugauu

SEQ ID NO: 1900626 - RNA, 21 nt, Human
auauuuuuuuaaaauguuaaa

SEQ ID NO: 1900627 - RNA, 19 nt, Human
uuccguagguuauuuucag

SEQ ID NO: 1900628 - RNA, 16 nt, Human
uuccguuaaaauacca

SEQ ID NO: 1900629 - RNA, 14 nt, Human
uuccguuaaaauac

SEQ ID NO: 1900630 - RNA, 17 nt, Human
uuccgugaaaacggagc

SEQ ID NO: 1900631 - RNA, 23 nt, Human
uucccguggaacguuuuuccugu

SEQ ID NO: 1900632 - RNA, 15 nt, Human
uucccuauuagagaa

SEQ ID NO: 1900633 - RNA, 20 nt, Human
uucccucaccuuucccaucu

SEQ ID NO: 1900634 - RNA, 21 nt, Human
uucccucaccuuggcaccaga

SEQ ID NO: 1900635 - RNA, 17 nt, Human
uuccuaauccucuagga

SEQ ID NO: 1900636 - RNA, 20 nt, Human
uuccuaaauauauuuuaaga

SEQ ID NO: 1900637 - RNA, 14 nt, Human
uuccugaaccgaug

SEQ ID NO: 1900638 - RNA, 14 nt, Human
uuccugaacaggau

SEQ ID NO: 1900639 - RNA, 18 nt, Human
uuccugaagaauugaaaa

SEQ ID NO: 1900640 - RNA, 16 nt, Human
uuccugaagaaccagu

SEQ ID NO: 1900641 - RNA, 19 nt, Human
uuccugaagaaccaguccc

SEQ ID NO: 1900642 - RNA, 15 nt, Human
uuccugaacaggaua

SEQ ID NO: 1900643 - RNA, 15 nt, Human
uuccugaagaaccag

SEQ ID NO: 1900644 - RNA, 13 nt, Human
uuccucuuugcuu

SEQ ID NO: 1900645 - RNA, 14 nt, Human
uuccucuuugcuuu

SEQ ID NO: 1900646 - RNA, 13 nt, Human
uuccucuuuccau

SEQ ID NO: 1900647 - RNA, 17 nt, Human
uuccucuuuccaucuac

SEQ ID NO: 1900648 - RNA, 22 nt, Human
uuccucuuuccaucuacccucc

SEQ ID NO: 1900649 - RNA, 21 nt, Human
uucuuaaucuuuucacaaaua

SEQ ID NO: 1900650 - RNA, 20 nt, Human
uucuuaaucuuuucacaaau

SEQ ID NO: 1900651 - RNA, 19 nt, Human
uucuuaaucuuuucacaaa

SEQ ID NO: 1900652 - RNA, 13 nt, Human
uucuucucccuca

SEQ ID NO: 1900653 - RNA, 23 nt, Human
uucuuaagacgugauuuugcugu

SEQ ID NO: 1900654 - RNA, 21 nt, Human
uucuuaagacgugauuuugcu

SEQ ID NO: 1900655 - RNA, 15 nt, Human
uucuucugcuucagc

SEQ ID NO: 1900656 - RNA, 13 nt, Human
uucuucugcuuca

SEQ ID NO: 1900657 - RNA, 14 nt, Human
uucuucucccucag

SEQ ID NO: 1900658 - RNA, 13 nt, Human
aucccucauccuc

SEQ ID NO: 1900659 - RNA, 21 nt, Human
aucccucauccucauacccac

SEQ ID NO: 1900660 - RNA, 23 nt, Human
aucccucauccucauacccaccc

SEQ ID NO: 1900661 - RNA, 13 nt, Human
aucccaugagccu

SEQ ID NO: 1900662 - RNA, 14 nt, Human
aucccucauccuca

SEQ ID NO: 1900663 - RNA, 24 nt, Human
aucccauaugccugggcagaagga

SEQ ID NO: 1900664 - RNA, 20 nt, Human
uucuucugcuucagccuccc

SEQ ID NO: 1900665 - RNA, 21 nt, Human
uucuucuuuuugcuucaaaaa

SEQ ID NO: 1900666 - RNA, 17 nt, Human
uucuucuuuuugcuuca

SEQ ID NO: 1900667 - RNA, 13 nt, Human
uucuugaaagcug

SEQ ID NO: 1900668 - RNA, 14 nt, Human
uucuugaaagcugu

SEQ ID NO: 1900669 - RNA, 15 nt, Human
uucuugaaagcugug

SEQ ID NO: 1900670 - RNA, 15 nt, Human
uucuuuguaaugaaa

SEQ ID NO: 1900671 - RNA, 13 nt, Human
uucuuugggccag

SEQ ID NO: 1900672 - RNA, 21 nt, Human
auccuagagauuugguguaca

SEQ ID NO: 1900673 - RNA, 16 nt, Human
auccuaccuguuuugu

SEQ ID NO: 1900674 - RNA, 23 nt, Human
auccuagagauuugguguacaau

SEQ ID NO: 1900675 - RNA, 16 nt, Human
auccuccucagaucuu

SEQ ID NO: 1900676 - RNA, 16 nt, Human
auccuaggcauuugcu

SEQ ID NO: 1900677 - RNA, 21 nt, Human
auccuaagcuauucaguaaua

SEQ ID NO: 1900678 - RNA, 12 nt, Human
auccuaagcuau

SEQ ID NO: 1900679 - RNA, 16 nt, Human
auccguauauaucccc

SEQ ID NO: 1900680 - RNA, 22 nt, Human
auccggcaacaucaacccgagu

SEQ ID NO: 1900681 - RNA, 17 nt, Human
uugaaauuguauuacaa

SEQ ID NO: 1900682 - RNA, 19 nt, Human
uugaacccgggaggcagag

SEQ ID NO: 1900683 - RNA, 19 nt, Human
uugaaccuauuucucuuuc

SEQ ID NO: 1900684 - RNA, 15 nt, Human
uugaaccuauuucuc

SEQ ID NO: 1900685 - RNA, 16 nt, Human
uugaaccuauuucucu

SEQ ID NO: 1900686 - RNA, 13 nt, Human
uugaaccuauuuc

SEQ ID NO: 1900687 - RNA, 22 nt, Human
uugaacgcccccccccaccccu

SEQ ID NO: 1900688 - RNA, 19 nt, Human
uugaaagccccagaaauca

SEQ ID NO: 1900689 - RNA, 12 nt, Human
uugaaagcugug

SEQ ID NO: 1900690 - RNA, 22 nt, Human
uugaaagcuguggccagcuugu

SEQ ID NO: 1900691 - RNA, 20 nt, Human
uugaaauuaagaaggcaaaa

SEQ ID NO: 1900692 - RNA, 19 nt, Human
uucugggcacccucccacc

SEQ ID NO: 1900693 - RNA, 20 nt, Human
aucauuuuaccuuugacaaa

SEQ ID NO: 1900694 - RNA, 18 nt, Human
auccaagcaaaugugaau

SEQ ID NO: 1900695 - RNA, 16 nt, Human
auccaagcaagacuga

SEQ ID NO: 1900696 - RNA, 21 nt, Human
auccaagcuggucccacucag

SEQ ID NO: 1900697 - RNA, 18 nt, Human
auccaagcuggucccacu

SEQ ID NO: 1900698 - RNA, 16 nt, Human
auccacccaccucagc

SEQ ID NO: 1900699 - RNA, 16 nt, Human
auccaguaucuugaag

SEQ ID NO: 1900700 - RNA, 15 nt, Human
auccacccaccucag

SEQ ID NO: 1900701 - RNA, 13 nt, Human
auccacccaccuc

SEQ ID NO: 1900702 - RNA, 18 nt, Human
auccauauugagucaaau

SEQ ID NO: 1900703 - RNA, 20 nt, Human
auccauauugagucaaaugg

SEQ ID NO: 1900704 - RNA, 21 nt, Human
auccaguaucuugaagacuuu

SEQ ID NO: 1900705 - RNA, 19 nt, Human
auccauagcaccuccacau

SEQ ID NO: 1900706 - RNA, 18 nt, Human
aucccauaugccugggca

SEQ ID NO: 1900707 - RNA, 22 nt, Human
aucccagcuacuugggaggcug

SEQ ID NO: 1900708 - RNA, 19 nt, Human
aucccaaacccuucagugc

SEQ ID NO: 1900709 - RNA, 20 nt, Human
aucccaaacccuucagugcc

SEQ ID NO: 1900710 - RNA, 14 nt, Human
aucaggugcugcca

SEQ ID NO: 1900711 - RNA, 18 nt, Human
aucaguagccagcaucug

SEQ ID NO: 1900712 - RNA, 21 nt, Human
uucuccuuguguuacuaaguu

SEQ ID NO: 1900713 - RNA, 20 nt, Human
uucuccuucagcccucaccc

SEQ ID NO: 1900714 - RNA, 15 nt, Human
uucuccuucagcccu

SEQ ID NO: 1900715 - RNA, 14 nt, Human
aucaguauaaacaa

SEQ ID NO: 1900716 - RNA, 16 nt, Human
aucaguauaaacaaag

SEQ ID NO: 1900717 - RNA, 20 nt, Human
uucucuaguuugauuaaauu

SEQ ID NO: 1900718 - RNA, 17 nt, Human
uucucuaguuugauuaa

SEQ ID NO: 1900719 - RNA, 15 nt, Human
uucucuaguuugauu

SEQ ID NO: 1900720 - RNA, 16 nt, Human
uucuggcucuuccagg

SEQ ID NO: 1900721 - RNA, 17 nt, Human
uucuggcucuuccaggc

SEQ ID NO: 1900722 - RNA, 18 nt, Human
uucugccugcccaggccc

SEQ ID NO: 1900723 - RNA, 17 nt, Human
uucugccugcccaggcc

SEQ ID NO: 1900724 - RNA, 21 nt, Human
uucugccugcccaggccccug

SEQ ID NO: 1900725 - RNA, 15 nt, Human
uucugccauauucug

SEQ ID NO: 1900726 - RNA, 23 nt, Human
uucugaacuuggcgcugccccug

SEQ ID NO: 1900727 - RNA, 19 nt, Human
uucugaacuuggcgcugcc

SEQ ID NO: 1900728 - RNA, 22 nt, Human
uucugaacuuggcgcugccccu

SEQ ID NO: 1900729 - RNA, 17 nt, Human
uucucuugggaacugaa

SEQ ID NO: 1900730 - RNA, 22 nt, Human
uucucuugggaacugaacucac

SEQ ID NO: 1900731 - RNA, 20 nt, Human
auggcaggacgugggcuggg

SEQ ID NO: 1900732 - RNA, 21 nt, Human
auggcaggacgugggcugggc

SEQ ID NO: 1900733 - RNA, 14 nt, Human
auggcagcugccac

SEQ ID NO: 1900734 - RNA, 13 nt, Human
auggagagaaaac

SEQ ID NO: 1900735 - RNA, 15 nt, Human
auggcagugucuuuc

SEQ ID NO: 1900736 - RNA, 15 nt, Human
auggcccauucuacu

SEQ ID NO: 1900737 - RNA, 17 nt, Human
auggcccauucuacuug

SEQ ID NO: 1900738 - RNA, 19 nt, Human
auggcccauucuacuugcu

SEQ ID NO: 1900739 - RNA, 23 nt, Human
auggcccauucuacuugcucugg

SEQ ID NO: 1900740 - RNA, 24 nt, Human
auggcccauucuacuugcucugga

SEQ ID NO: 1900741 - RNA, 19 nt, Human
augggagagaagagaaugc

SEQ ID NO: 1900742 - RNA, 18 nt, Human
augggagggaggcucagg

SEQ ID NO: 1900743 - RNA, 15 nt, Human
augggagagaagaga

SEQ ID NO: 1900744 - RNA, 18 nt, Human
auggcuaauguacugcau

SEQ ID NO: 1900745 - RNA, 19 nt, Human
auggcuaagcaaaauguga

SEQ ID NO: 1900746 - RNA, 15 nt, Human
auggacucugcacau

SEQ ID NO: 1900747 - RNA, 11 nt, Human
auggacuuugu

SEQ ID NO: 1900748 - RNA, 12 nt, Human
auggacuuuguu

SEQ ID NO: 1900749 - RNA, 19 nt, Human
auggacuaacuugucuuug

SEQ ID NO: 1900750 - RNA, 21 nt, Human
uuucauuaauacagggcauuu

SEQ ID NO: 1900751 - RNA, 17 nt, Human
uuuccaugaguccccug

SEQ ID NO: 1900752 - RNA, 18 nt, Human
uuuccaugaguccccugu

SEQ ID NO: 1900753 - RNA, 12 nt, Human
uuuccaucuuua

SEQ ID NO: 1900754 - RNA, 14 nt, Human
uuuccccuuuugca

SEQ ID NO: 1900755 - RNA, 17 nt, Human
uuuccaugaaaaugcaa

SEQ ID NO: 1900756 - RNA, 20 nt, Human
augcuaagggcaggcccaaa

SEQ ID NO: 1900757 - RNA, 18 nt, Human
uuuaucaugugaaaucau

SEQ ID NO: 1900758 - RNA, 17 nt, Human
uuuaucaugugaaauca

SEQ ID NO: 1900759 - RNA, 22 nt, Human
augcuagaacucccuuucaaca

SEQ ID NO: 1900760 - RNA, 21 nt, Human
augcuagaacucccuuucaac

SEQ ID NO: 1900761 - RNA, 20 nt, Human
augcuagaacucccuuucaa

SEQ ID NO: 1900762 - RNA, 17 nt, Human
uuuauuaauugcuuuga

SEQ ID NO: 1900763 - RNA, 21 nt, Human
augcuauuugcaauuccugcu

SEQ ID NO: 1900764 - RNA, 14 nt, Human
augcuauuugcaau

SEQ ID NO: 1900765 - RNA, 16 nt, Human
uuuauuuuguguuuag

SEQ ID NO: 1900766 - RNA, 21 nt, Human
auggaaccugacguagcugca

SEQ ID NO: 1900767 - RNA, 20 nt, Human
uuuauuuuguguuuaggaac

SEQ ID NO: 1900768 - RNA, 22 nt, Human
uuucaaacuuuacuauggcccu

SEQ ID NO: 1900769 - RNA, 16 nt, Human
uuucaaacuuuacuau

SEQ ID NO: 1900770 - RNA, 22 nt, Human
uuucaaaauuguuacaaauugu

SEQ ID NO: 1900771 - RNA, 12 nt, Human
uuucaaaaugcu

SEQ ID NO: 1900772 - RNA, 13 nt, Human
uuucaaaaugcuu

SEQ ID NO: 1900773 - RNA, 15 nt, Human
uuucaaaaugcuuuu

SEQ ID NO: 1900774 - RNA, 13 nt, Human
augcugcuuuuuc

SEQ ID NO: 1900775 - RNA, 17 nt, Human
augcuguucaugaaaga

SEQ ID NO: 1900776 - RNA, 22 nt, Human
augcugugcccuaaaguguauu

SEQ ID NO: 1900777 - RNA, 13 nt, Human
augcugcuggaca

SEQ ID NO: 1900778 - RNA, 13 nt, Human
augcuucucacug

SEQ ID NO: 1900779 - RNA, 18 nt, Human
auggaaccugacguagcu

SEQ ID NO: 1900780 - RNA, 19 nt, Human
augcuguucaugaaagauu

SEQ ID NO: 1900781 - RNA, 20 nt, Human
uuuaaaacaagaaaguuucc

SEQ ID NO: 1900782 - RNA, 15 nt, Human
uuuaaaacaagaaag

SEQ ID NO: 1900783 - RNA, 14 nt, Human
uuuaaaaauauuuu

SEQ ID NO: 1900784 - RNA, 17 nt, Human
uuuaaaaauagacacuc

SEQ ID NO: 1900785 - RNA, 24 nt, Human
augcaccugaauguuagauaguua

SEQ ID NO: 1900786 - RNA, 13 nt, Human
uuuaaagaaugcu

SEQ ID NO: 1900787 - RNA, 22 nt, Human
augcaccagcccuuagcaggga

SEQ ID NO: 1900788 - RNA, 13 nt, Human
augcaccuggaau

SEQ ID NO: 1900789 - RNA, 17 nt, Human
augcacuuuguucuggc

SEQ ID NO: 1900790 - RNA, 19 nt, Human
augcacuuuguucuggcuc

SEQ ID NO: 1900791 - RNA, 20 nt, Human
augcacuuuguucuggcucu

SEQ ID NO: 1900792 - RNA, 22 nt, Human
augauucuauuuauauguacau

SEQ ID NO: 1900793 - RNA, 23 nt, Human
augauucuauuuauauguacaug

SEQ ID NO: 1900794 - RNA, 15 nt, Human
augauccaagcaaga

SEQ ID NO: 1900795 - RNA, 17 nt, Human
augauccaagcaagacu

SEQ ID NO: 1900796 - RNA, 21 nt, Human
augauacuugaaaauuaacau

SEQ ID NO: 1900797 - RNA, 17 nt, Human
augauacuugaaaauua

SEQ ID NO: 1900798 - RNA, 15 nt, Human
augauacauccaaag

SEQ ID NO: 1900799 - RNA, 17 nt, Human
augaucuaggaagacuu

SEQ ID NO: 1900800 - RNA, 20 nt, Human
augaucuaggaagacuuugg

SEQ ID NO: 1900801 - RNA, 15 nt, Human
augaucuaggaagac

SEQ ID NO: 1900802 - RNA, 19 nt, Human
augauuaauuaaauagcuu

SEQ ID NO: 1900803 - RNA, 16 nt, Human
augauuaauucaccuu

SEQ ID NO: 1900804 - RNA, 22 nt, Human
uuggugccuggccuggcacaca

SEQ ID NO: 1900805 - RNA, 20 nt, Human
uuggugccuggccuggcaca

SEQ ID NO: 1900806 - RNA, 13 nt, Human
uuguguuacuaag

SEQ ID NO: 1900807 - RNA, 20 nt, Human
uuguguuacuaaguuuuuau

SEQ ID NO: 1900808 - RNA, 15 nt, Human
uuguguuacuaaguu

SEQ ID NO: 1900809 - RNA, 13 nt, Human
uuguguucaccuu

SEQ ID NO: 1900810 - RNA, 21 nt, Human
uuguuccacaaguuaaauaaa

SEQ ID NO: 1900811 - RNA, 18 nt, Human
uuguugagcuauugcugu

SEQ ID NO: 1900812 - RNA, 21 nt, Human
uuguucccauccucuucuuuu

SEQ ID NO: 1900813 - RNA, 15 nt, Human
uuguucuuuguucuu

SEQ ID NO: 1900814 - RNA, 13 nt, Human
uuguucuuuuuau

SEQ ID NO: 1900815 - RNA, 22 nt, Human
augcccuuucuugaauugcauu

SEQ ID NO: 1900816 - RNA, 16 nt, Human
augcccuggagguggc

SEQ ID NO: 1900817 - RNA, 19 nt, Human
augccgauauacucuagau

SEQ ID NO: 1900818 - RNA, 20 nt, Human
augccucagcccugacccug

SEQ ID NO: 1900819 - RNA, 12 nt, Human
augcccugugca

SEQ ID NO: 1900820 - RNA, 14 nt, Human
augcccuggaggug

SEQ ID NO: 1900821 - RNA, 15 nt, Human
augcccuggaggugg

SEQ ID NO: 1900822 - RNA, 13 nt, Human
augcccugugcaa

SEQ ID NO: 1900823 - RNA, 23 nt, Human
augcccugugcaaccucuuggcc

SEQ ID NO: 1900824 - RNA, 12 nt, Human
augcccagcccc

SEQ ID NO: 1900825 - RNA, 13 nt, Human
augcccagccccu

SEQ ID NO: 1900826 - RNA, 14 nt, Human
augcccagccccuu

SEQ ID NO: 1900827 - RNA, 14 nt, Human
augcccuccucucc

SEQ ID NO: 1900828 - RNA, 15 nt, Human
augcccuccucuccc

SEQ ID NO: 1900829 - RNA, 23 nt, Human
augcccuccucucccauuguccc

SEQ ID NO: 1900830 - RNA, 21 nt, Human
augcgggccagugcuccagcc

SEQ ID NO: 1900831 - RNA, 20 nt, Human
augccucccccuagccauuu

SEQ ID NO: 1900832 - RNA, 24 nt, Human
augccucagcccugacccugugga

SEQ ID NO: 1900833 - RNA, 16 nt, Human
augcgggccagugcuc

SEQ ID NO: 1900834 - RNA, 20 nt, Human
augcgguagccagcacacag

SEQ ID NO: 1900835 - RNA, 21 nt, Human
augcgguagccagcacacagg

SEQ ID NO: 1900836 - RNA, 14 nt, Human
augcgguagccagc

SEQ ID NO: 1900837 - RNA, 15 nt, Human
augcgguagccagca

SEQ ID NO: 1900838 - RNA, 18 nt, Human
augcgguagccagcacac

SEQ ID NO: 1900839 - RNA, 23 nt, Human
augcuaaagguuguauugcauau

SEQ ID NO: 1900840 - RNA, 11 nt, Human
augcccagccc

SEQ ID NO: 1900841 - RNA, 19 nt, Human
augccauggacagaagaag

SEQ ID NO: 1900842 - RNA, 18 nt, Human
augccauggacagaagaa

SEQ ID NO: 1900843 - RNA, 17 nt, Human
augccauggacagaaga

SEQ ID NO: 1900844 - RNA, 16 nt, Human
augccacaaggacuuc

SEQ ID NO: 1900845 - RNA, 19 nt, Human
augccacaaggacuuccug

SEQ ID NO: 1900846 - RNA, 23 nt, Human
augcagugguaugaucacggcuc

SEQ ID NO: 1900847 - RNA, 13 nt, Human
augcagugcuucc

SEQ ID NO: 1900848 - RNA, 18 nt, Human
augccaaaaaaagacagg

SEQ ID NO: 1900849 - RNA, 17 nt, Human
augccaauauuaaaucu

SEQ ID NO: 1900850 - RNA, 23 nt, Human
uuuaauuauuauucuucauaaca

SEQ ID NO: 1900851 - RNA, 14 nt, Human
uuuaauuauuauuc

SEQ ID NO: 1900852 - RNA, 23 nt, Human
uuuaauuauuauuuauauaugua

SEQ ID NO: 1900853 - RNA, 12 nt, Human
uuuaauucaguu

SEQ ID NO: 1900854 - RNA, 13 nt, Human
uuuaauuaaauaa

SEQ ID NO: 1900855 - RNA, 18 nt, Human
uuuaaauauaugcuaagu

SEQ ID NO: 1900856 - RNA, 15 nt, Human
uuuaaguaacuuuaa

SEQ ID NO: 1900857 - RNA, 19 nt, Human
uuuaauuuuuuugagacag

SEQ ID NO: 1900858 - RNA, 21 nt, Human
uuuaauuuauuaauugcuuug

SEQ ID NO: 1900859 - RNA, 22 nt, Human
uuuaauuuauuaauugcuuuga

SEQ ID NO: 1900860 - RNA, 13 nt, Human
uuuaauuuaaagc

SEQ ID NO: 1900861 - RNA, 19 nt, Human
uuuacaaaacuacaugaga

SEQ ID NO: 1900862 - RNA, 19 nt, Human
augcagcagggaugcccug

SEQ ID NO: 1900863 - RNA, 20 nt, Human
augcagcagggaugcccugg

SEQ ID NO: 1900864 - RNA, 22 nt, Human
augcagauuuugcccuugacaa

SEQ ID NO: 1900865 - RNA, 18 nt, Human
augcagccucacaguccu

SEQ ID NO: 1900866 - RNA, 12 nt, Human
uuugacucuuuu

SEQ ID NO: 1900867 - RNA, 19 nt, Human
uuugacuagaugauggaug

SEQ ID NO: 1900868 - RNA, 19 nt, Human
uuugacucuggcaaagcuu

SEQ ID NO: 1900869 - RNA, 20 nt, Human
uuugacucuggcaaagcuuu

SEQ ID NO: 1900870 - RNA, 21 nt, Human
uuugacucuggcaaagcuuuu

SEQ ID NO: 1900871 - RNA, 20 nt, Human
uuugacgccaucccagcccc

SEQ ID NO: 1900872 - RNA, 19 nt, Human
uuugacgggaaacaaaacu

SEQ ID NO: 1900873 - RNA, 19 nt, Human
uuugaccuuuuauguagua

SEQ ID NO: 1900874 - RNA, 13 nt, Human
uuugacgccaucc

SEQ ID NO: 1900875 - RNA, 14 nt, Human
uuugacgccauccc

SEQ ID NO: 1900876 - RNA, 16 nt, Human
uuugacgccaucccag

SEQ ID NO: 1900877 - RNA, 19 nt, Human
uuugacgccaucccagccc

SEQ ID NO: 1900878 - RNA, 23 nt, Human
uuugauuaaauucuugcaaagua

SEQ ID NO: 1900879 - RNA, 21 nt, Human
uuugauucagacagcugccug

SEQ ID NO: 1900880 - RNA, 21 nt, Human
uuugauuaaauucuugcaaag

SEQ ID NO: 1900881 - RNA, 18 nt, Human
uuugauuaaauucuugca

SEQ ID NO: 1900882 - RNA, 13 nt, Human
uuugauuaaauuc

SEQ ID NO: 1900883 - RNA, 22 nt, Human
uuugauguucuuucacccuuuu

SEQ ID NO: 1900884 - RNA, 19 nt, Human
uuugcugagcauguacuga

SEQ ID NO: 1900885 - RNA, 23 nt, Human
uuuggcaaacucuccaccacacg

SEQ ID NO: 1900886 - RNA, 13 nt, Human
uuugccucugccu

SEQ ID NO: 1900887 - RNA, 15 nt, Human
uuugccguuauuaaa

SEQ ID NO: 1900888 - RNA, 21 nt, Human
uuugcaaggaagccacagcug

SEQ ID NO: 1900889 - RNA, 14 nt, Human
uuugcaaggaagcc

SEQ ID NO: 1900890 - RNA, 12 nt, Human
uuugcaaggaag

SEQ ID NO: 1900891 - RNA, 22 nt, Human
uuugauucagacagcugccugg

SEQ ID NO: 1900892 - RNA, 15 nt, Human
uuugauucauaguaa

SEQ ID NO: 1900893 - RNA, 20 nt, Human
uuugauucauaguaacuucu

SEQ ID NO: 1900894 - RNA, 21 nt, Human
uuugauucuccuucagcccuc

SEQ ID NO: 1900895 - RNA, 16 nt, Human
uuugauucuccuucag

SEQ ID NO: 1900896 - RNA, 14 nt, Human
uuugauucuccuuc

SEQ ID NO: 1900897 - RNA, 13 nt, Human
uuugauucuccuu

SEQ ID NO: 1900898 - RNA, 12 nt, Human
uuugauucuccu

SEQ ID NO: 1900899 - RNA, 18 nt, Human
auguacugagccuuguaa

SEQ ID NO: 1900900 - RNA, 21 nt, Human
auguaccauguacaugaagaa

SEQ ID NO: 1900901 - RNA, 15 nt, Human
auguaccauguacau

SEQ ID NO: 1900902 - RNA, 20 nt, Human
auguacgaugagaaauucaa

SEQ ID NO: 1900903 - RNA, 20 nt, Human
auguacuaggauacugcugc

SEQ ID NO: 1900904 - RNA, 13 nt, Human
auguagaggagaa

SEQ ID NO: 1900905 - RNA, 12 nt, Human
auguagaggaga

SEQ ID NO: 1900906 - RNA, 19 nt, Human
auguagaggagaaacugga

SEQ ID NO: 1900907 - RNA, 17 nt, Human
auguagaggagaaacug

SEQ ID NO: 1900908 - RNA, 19 nt, Human
auguagaggggaaaagaga

SEQ ID NO: 1900909 - RNA, 19 nt, Human
auguagccccucuccugga

SEQ ID NO: 1900910 - RNA, 23 nt, Human
auguaggagcugccuuggcucag

SEQ ID NO: 1900911 - RNA, 18 nt, Human
auguagcccccuggccuc

SEQ ID NO: 1900912 - RNA, 19 nt, Human
auguagcccccuggccucu

SEQ ID NO: 1900913 - RNA, 21 nt, Human
auguagcccccuggccucugu

SEQ ID NO: 1900914 - RNA, 23 nt, Human
auguagcccccuggccucugugc

SEQ ID NO: 1900915 - RNA, 12 nt, Human
uuugaccucugc

SEQ ID NO: 1900916 - RNA, 20 nt, Human
uuugacauugcguuugaccu

SEQ ID NO: 1900917 - RNA, 13 nt, Human
auguaguaauuga

SEQ ID NO: 1900918 - RNA, 16 nt, Human
auguaguaauugacau

SEQ ID NO: 1900919 - RNA, 17 nt, Human
auguaguaauugacaug

SEQ ID NO: 1900920 - RNA, 18 nt, Human
auguaguaauugacaugu

SEQ ID NO: 1900921 - RNA, 19 nt, Human
auguaugaggaauuucugu

SEQ ID NO: 1900922 - RNA, 13 nt, Human
uuuggcagaguuc

SEQ ID NO: 1900923 - RNA, 15 nt, Human
auguauguguaagua

SEQ ID NO: 1900924 - RNA, 16 nt, Human
auguaugcuucauaca

SEQ ID NO: 1900925 - RNA, 15 nt, Human
auguaugcuucauac

SEQ ID NO: 1900926 - RNA, 14 nt, Human
auguaugauuacau

SEQ ID NO: 1900927 - RNA, 14 nt, Human
auguaugcuucaua

SEQ ID NO: 1900928 - RNA, 16 nt, Human
auguauguguaaguau

SEQ ID NO: 1900929 - RNA, 19 nt, Human
auguauguucagaagaaau

SEQ ID NO: 1900930 - RNA, 20 nt, Human
auguauguucagaagaaauu

SEQ ID NO: 1900931 - RNA, 22 nt, Human
auguauuacaguggggaaugaa

SEQ ID NO: 1900932 - RNA, 16 nt, Human
augucaguauguggaa

SEQ ID NO: 1900933 - RNA, 12 nt, Human
augucaguguga

SEQ ID NO: 1900934 - RNA, 13 nt, Human
augucagugugac

SEQ ID NO: 1900935 - RNA, 17 nt, Human
auguccacugguucuuc

SEQ ID NO: 1900936 - RNA, 19 nt, Human
augucucgugguaggacug

SEQ ID NO: 1900937 - RNA, 23 nt, Human
augucucugugagacucgagaac

SEQ ID NO: 1900938 - RNA, 21 nt, Human
augucucugugagacucgaga

SEQ ID NO: 1900939 - RNA, 16 nt, Human
augucucgugguagga

SEQ ID NO: 1900940 - RNA, 15 nt, Human
augucucgugguagg

SEQ ID NO: 1900941 - RNA, 20 nt, Human
uuugugaagguggaaauaaa

SEQ ID NO: 1900942 - RNA, 24 nt, Human
uuugugaaggccucgcaggaagac

SEQ ID NO: 1900943 - RNA, 16 nt, Human
uuugugaaucuuugug

SEQ ID NO: 1900944 - RNA, 19 nt, Human
uuugucuuuggugaacauu

SEQ ID NO: 1900945 - RNA, 21 nt, Human
uuugucuuguguuucuuuagu

SEQ ID NO: 1900946 - RNA, 17 nt, Human
uuugucuuuaacuguca

SEQ ID NO: 1900947 - RNA, 13 nt, Human
uuuguaaugaaaa

SEQ ID NO: 1900948 - RNA, 14 nt, Human
uuuguaaugaaaac

SEQ ID NO: 1900949 - RNA, 12 nt, Human
uuuguauaaaag

SEQ ID NO: 1900950 - RNA, 23 nt, Human
augugcacaugcacgugugugca

SEQ ID NO: 1900951 - RNA, 14 nt, Human
augugauuguggaa

SEQ ID NO: 1900952 - RNA, 15 nt, Human
augugauuguggaau

SEQ ID NO: 1900953 - RNA, 17 nt, Human
augugauuguggaaugg

SEQ ID NO: 1900954 - RNA, 22 nt, Human
augugauuguggaauggagauu

SEQ ID NO: 1900955 - RNA, 15 nt, Human
augugauuuaaacaa

SEQ ID NO: 1900956 - RNA, 23 nt, Human
augucucuuuaaugucacaggca

SEQ ID NO: 1900957 - RNA, 16 nt, Human
augugaugagaggaaa

SEQ ID NO: 1900958 - RNA, 17 nt, Human
augugaugagaggaaau

SEQ ID NO: 1900959 - RNA, 19 nt, Human
augugaugagaggaaauca

SEQ ID NO: 1900960 - RNA, 14 nt, Human
auguacauuaauua

SEQ ID NO: 1900961 - RNA, 20 nt, Human
auguaaaggagucaaaacua

SEQ ID NO: 1900962 - RNA, 17 nt, Human
auguaaaagacuuuuuu

SEQ ID NO: 1900963 - RNA, 13 nt, Human
augguuguacaua

SEQ ID NO: 1900964 - RNA, 21 nt, Human
augguuugaauauaaacacua

SEQ ID NO: 1900965 - RNA, 16 nt, Human
augguucucaggccug

SEQ ID NO: 1900966 - RNA, 16 nt, Human
augguuuucaaaauaa

SEQ ID NO: 1900967 - RNA, 14 nt, Human
augguuuucuugug

SEQ ID NO: 1900968 - RNA, 14 nt, Human
augguuuucaaaau

SEQ ID NO: 1900969 - RNA, 15 nt, Human
augguuuucaaaaua

SEQ ID NO: 1900970 - RNA, 18 nt, Human
augguuugcaaggaagcc

SEQ ID NO: 1900971 - RNA, 17 nt, Human
augguuugcaaggaagc

SEQ ID NO: 1900972 - RNA, 16 nt, Human
augguuugcaaggaag

SEQ ID NO: 1900973 - RNA, 22 nt, Human
augguuugaauauaaacacuau

SEQ ID NO: 1900974 - RNA, 17 nt, Human
augguggcuggguugga

SEQ ID NO: 1900975 - RNA, 16 nt, Human
augguggcgcgcaccu

SEQ ID NO: 1900976 - RNA, 15 nt, Human
augguggcuggguug

SEQ ID NO: 1900977 - RNA, 13 nt, Human
augguggcugggu

SEQ ID NO: 1900978 - RNA, 12 nt, Human
augguggcuggg

SEQ ID NO: 1900979 - RNA, 16 nt, Human
auggugcugagaagcu

SEQ ID NO: 1900980 - RNA, 23 nt, Human
auggugcuuguuaaugcuuucug

SEQ ID NO: 1900981 - RNA, 12 nt, Human
auggugcugaga

SEQ ID NO: 1900982 - RNA, 13 nt, Human
auggugcugagaa

SEQ ID NO: 1900983 - RNA, 14 nt, Human
auggugcugagaag

SEQ ID NO: 1900984 - RNA, 19 nt, Human
augguguucaaaaaacuug

SEQ ID NO: 1900985 - RNA, 15 nt, Human
augggugcuuggagg

SEQ ID NO: 1900986 - RNA, 20 nt, Human
auggugagggauacccaucc

SEQ ID NO: 1900987 - RNA, 12 nt, Human
auggugcaauga

SEQ ID NO: 1900988 - RNA, 13 nt, Human
auggugcaaugac

SEQ ID NO: 1900989 - RNA, 15 nt, Human
auggugcaaugaccu

SEQ ID NO: 1900990 - RNA, 19 nt, Human
auggugcaaugaccuuuca

SEQ ID NO: 1900991 - RNA, 14 nt, Human
auggugccccagga

SEQ ID NO: 1900992 - RNA, 16 nt, Human
auggugcaaugaccuu

SEQ ID NO: 1900993 - RNA, 17 nt, Human
auggugcaaugaccuuu

SEQ ID NO: 1900994 - RNA, 15 nt, Human
auggugccccaggac

SEQ ID NO: 1900995 - RNA, 16 nt, Human
auggugccccaggacc

SEQ ID NO: 1900996 - RNA, 17 nt, Human
auggugccccaggacca

SEQ ID NO: 1900997 - RNA, 18 nt, Human
auggugccccaggaccag

SEQ ID NO: 1900998 - RNA, 19 nt, Human
auggugccccaggaccagc

SEQ ID NO: 1900999 - RNA, 20 nt, Human
auggugccccaggaccagcu

SEQ ID NO: 1901000 - RNA, 21 nt, Human
auggugccccaggaccagcuc

SEQ ID NO: 1901001 - RNA, 22 nt, Human
auggugccccaggaccagcuca

SEQ ID NO: 1901002 - RNA, 16 nt, Human
uuucugggauaaguaa

SEQ ID NO: 1901003 - RNA, 21 nt, Human
uuucugcagccacuauuguua

SEQ ID NO: 1901004 - RNA, 17 nt, Human
uuucuguauauacuuuu

SEQ ID NO: 1901005 - RNA, 15 nt, Human
augggauccuggagu

SEQ ID NO: 1901006 - RNA, 19 nt, Human
uuucuggcuaugcauuuga

SEQ ID NO: 1901007 - RNA, 18 nt, Human
uuucuggcuaugcauuug

SEQ ID NO: 1901008 - RNA, 16 nt, Human
uuucuggcuaugcauu

SEQ ID NO: 1901009 - RNA, 15 nt, Human
uuucuggcuaugcau

SEQ ID NO: 1901010 - RNA, 19 nt, Human
uuucugcagccacuauugu

SEQ ID NO: 1901011 - RNA, 14 nt, Human
uuucugcagaaaca

SEQ ID NO: 1901012 - RNA, 20 nt, Human
uuucuccccugcccccagga

SEQ ID NO: 1901013 - RNA, 17 nt, Human
uuucuccccugccccca

SEQ ID NO: 1901014 - RNA, 16 nt, Human
uuucuccccugccccc

SEQ ID NO: 1901015 - RNA, 14 nt, Human
uuucuccccugccc

SEQ ID NO: 1901016 - RNA, 13 nt, Human
uuucuccccugcc

SEQ ID NO: 1901017 - RNA, 14 nt, Human
augggugaaggcug

SEQ ID NO: 1901018 - RNA, 19 nt, Human
auggguccaggauuccucu

SEQ ID NO: 1901019 - RNA, 21 nt, Human
auggguccaggauuccucuuu

SEQ ID NO: 1901020 - RNA, 15 nt, Human
augggugaaggcugg

SEQ ID NO: 1901021 - RNA, 16 nt, Human
augggugaaggcuggc

SEQ ID NO: 1901022 - RNA, 17 nt, Human
augggugaaggcuggca

SEQ ID NO: 1901023 - RNA, 18 nt, Human
augggugaaggcuggcau

SEQ ID NO: 1901024 - RNA, 15 nt, Human
augggggugcauuug

SEQ ID NO: 1901025 - RNA, 16 nt, Human
augggguccuggccau

SEQ ID NO: 1901026 - RNA, 17 nt, Human
augggguccuggccauc

SEQ ID NO: 1901027 - RNA, 14 nt, Human
augggggugcauuu

SEQ ID NO: 1901028 - RNA, 18 nt, Human
augggggaacucagaucc

SEQ ID NO: 1901029 - RNA, 19 nt, Human
augggggaacucagaucca

SEQ ID NO: 1901030 - RNA, 21 nt, Human
augggggaacucagauccagg

SEQ ID NO: 1901031 - RNA, 24 nt, Human
auggggcugcaccggcuggccugg

SEQ ID NO: 1901032 - RNA, 21 nt, Human
auggggccagauccagccugg

SEQ ID NO: 1901033 - RNA, 22 nt, Human
auggggccagauccagccuggg

SEQ ID NO: 1901034 - RNA, 12 nt, Human
auggggcugcac

SEQ ID NO: 1901035 - RNA, 13 nt, Human
auggggccagauc

SEQ ID NO: 1901036 - RNA, 14 nt, Human
auggggccagaucc

SEQ ID NO: 1901037 - RNA, 15 nt, Human
auggggccagaucca

SEQ ID NO: 1901038 - RNA, 19 nt, Human
auggggccagauccagccu

SEQ ID NO: 1901039 - RNA, 15 nt, Human
uuugaaaucagcaua

SEQ ID NO: 1901040 - RNA, 20 nt, Human
uuugaaaaagaaaacacuua

SEQ ID NO: 1901041 - RNA, 20 nt, Human
augggcuggguucuacccag

SEQ ID NO: 1901042 - RNA, 12 nt, Human
auggggaugcag

SEQ ID NO: 1901043 - RNA, 20 nt, Human
auggggauagauguguggac

SEQ ID NO: 1901044 - RNA, 18 nt, Human
augggccuccugugugug

SEQ ID NO: 1901045 - RNA, 18 nt, Human
auucuaggccuccuggcc

SEQ ID NO: 1901046 - RNA, 19 nt, Human
auucuaggccuccuggccc

SEQ ID NO: 1901047 - RNA, 20 nt, Human
auucuaggccuccuggccca

SEQ ID NO: 1901048 - RNA, 17 nt, Human
auucucauuugucacac

SEQ ID NO: 1901049 - RNA, 13 nt, Human
auucuccacagca

SEQ ID NO: 1901050 - RNA, 14 nt, Human
auucuccacagcaa

SEQ ID NO: 1901051 - RNA, 19 nt, Human
auucugccugcccaggccc

SEQ ID NO: 1901052 - RNA, 18 nt, Human
auucugccugcccaggcc

SEQ ID NO: 1901053 - RNA, 17 nt, Human
auucugccugcccaggc

SEQ ID NO: 1901054 - RNA, 16 nt, Human
auucugccugcccagg

SEQ ID NO: 1901055 - RNA, 15 nt, Human
auucugccugcccag

SEQ ID NO: 1901056 - RNA, 14 nt, Human
auucugccugccca

SEQ ID NO: 1901057 - RNA, 13 nt, Human
auucugccugccc

SEQ ID NO: 1901058 - RNA, 11 nt, Human
auucugccugc

SEQ ID NO: 1901059 - RNA, 14 nt, Human
auucuguuggccag

SEQ ID NO: 1901060 - RNA, 21 nt, Human
auucuguuggccagugugaca

SEQ ID NO: 1901061 - RNA, 19 nt, Human
auucuguuggccaguguga

SEQ ID NO: 1901062 - RNA, 14 nt, Human
auucuguacucuua

SEQ ID NO: 1901063 - RNA, 22 nt, Human
auucugcucacauaucugucau

SEQ ID NO: 1901064 - RNA, 21 nt, Human
auucugcucacauaucuguca

SEQ ID NO: 1901065 - RNA, 20 nt, Human
auucugcucacauaucuguc

SEQ ID NO: 1901066 - RNA, 19 nt, Human
auucugcucacauaucugu

SEQ ID NO: 1901067 - RNA, 21 nt, Human
auucugccugcccaggccccu

SEQ ID NO: 1901068 - RNA, 20 nt, Human
auucugccugcccaggcccc

SEQ ID NO: 1901069 - RNA, 18 nt, Human
auucugcucacauaucug

SEQ ID NO: 1901070 - RNA, 17 nt, Human
auugacacuuaaaaaug

SEQ ID NO: 1901071 - RNA, 15 nt, Human
auugacacuuaaaaa

SEQ ID NO: 1901072 - RNA, 12 nt, Human
auugacacagaa

SEQ ID NO: 1901073 - RNA, 14 nt, Human
auugacacagaaaa

SEQ ID NO: 1901074 - RNA, 13 nt, Human
auugacuuugucu

SEQ ID NO: 1901075 - RNA, 17 nt, Human
auugaccugaggcccuu

SEQ ID NO: 1901076 - RNA, 19 nt, Human
auugacacuuaaaaauggu

SEQ ID NO: 1901077 - RNA, 17 nt, Human
auugacacagaaaaugu

SEQ ID NO: 1901078 - RNA, 15 nt, Human
auugaaaaaccauuu

SEQ ID NO: 1901079 - RNA, 22 nt, Human
auucuucccauucuccauuugu

SEQ ID NO: 1901080 - RNA, 20 nt, Human
auugaaaucuuuuugcuuug

SEQ ID NO: 1901081 - RNA, 17 nt, Human
auugaaaucuuuuugcu

SEQ ID NO: 1901082 - RNA, 18 nt, Human
auugaaaucuuuuugcuu

SEQ ID NO: 1901083 - RNA, 13 nt, Human
auucuuccucccu

SEQ ID NO: 1901084 - RNA, 17 nt, Human
auucuuacaaacaugug

SEQ ID NO: 1901085 - RNA, 16 nt, Human
auucuucccauucucc

SEQ ID NO: 1901086 - RNA, 17 nt, Human
auucuucccauucucca

SEQ ID NO: 1901087 - RNA, 18 nt, Human
auucuucccauucuccau

SEQ ID NO: 1901088 - RNA, 14 nt, Human
auucuuaaauaugu

SEQ ID NO: 1901089 - RNA, 21 nt, Human
auucuuacaaacaugugguua

SEQ ID NO: 1901090 - RNA, 16 nt, Human
auucuuacaaacaugu

SEQ ID NO: 1901091 - RNA, 21 nt, Human
auucuuaagacuugcauuuaa

SEQ ID NO: 1901092 - RNA, 16 nt, Human
auuauuauucuucaua

SEQ ID NO: 1901093 - RNA, 15 nt, Human
auuauuuauuuauuu

SEQ ID NO: 1901094 - RNA, 23 nt, Human
auucacaguucuuugggccagac

SEQ ID NO: 1901095 - RNA, 14 nt, Human
auuaucaagcuaau

SEQ ID NO: 1901096 - RNA, 13 nt, Human
auuaucaagcuaa

SEQ ID NO: 1901097 - RNA, 19 nt, Human
auuaucuaaaaucugcuag

SEQ ID NO: 1901098 - RNA, 22 nt, Human
auuaucuauacauaucuuuauu

SEQ ID NO: 1901099 - RNA, 20 nt, Human
auuaucuauacauaucuuua

SEQ ID NO: 1901100 - RNA, 14 nt, Human
auuaucuauacaua

SEQ ID NO: 1901101 - RNA, 19 nt, Human
auuaucuauacauaucuuu

SEQ ID NO: 1901102 - RNA, 14 nt, Human
auuaucuaauuuau

SEQ ID NO: 1901103 - RNA, 13 nt, Human
auuaucuaauuua

SEQ ID NO: 1901104 - RNA, 18 nt, Human
auuaucuagauacuguau

SEQ ID NO: 1901105 - RNA, 14 nt, Human
auuaucuagauacu

SEQ ID NO: 1901106 - RNA, 15 nt, Human
auuauuauucuucau

SEQ ID NO: 1901107 - RNA, 15 nt, Human
auuauuauuuggccc

SEQ ID NO: 1901108 - RNA, 11 nt, Human
auucagacagc

SEQ ID NO: 1901109 - RNA, 12 nt, Human
auucagacagcu

SEQ ID NO: 1901110 - RNA, 13 nt, Human
auucagacagcug

SEQ ID NO: 1901111 - RNA, 13 nt, Human
auucacauuguau

SEQ ID NO: 1901112 - RNA, 20 nt, Human
auucacauuguauucagagu

SEQ ID NO: 1901113 - RNA, 18 nt, Human
auucagacagcugccugg

SEQ ID NO: 1901114 - RNA, 12 nt, Human
auucaggaagcu

SEQ ID NO: 1901115 - RNA, 14 nt, Human
auucagacagcugc

SEQ ID NO: 1901116 - RNA, 15 nt, Human
auucagacagcugcc

SEQ ID NO: 1901117 - RNA, 16 nt, Human
auucagacagcugccu

SEQ ID NO: 1901118 - RNA, 17 nt, Human
auucagacagcugccug

SEQ ID NO: 1901119 - RNA, 19 nt, Human
auucuaacuuuuuugcuau

SEQ ID NO: 1901120 - RNA, 17 nt, Human
auucuaaugauggccca

SEQ ID NO: 1901121 - RNA, 18 nt, Human
auucuaaugauggcccau

SEQ ID NO: 1901122 - RNA, 23 nt, Human
auucuaaugauggcccauucuac

SEQ ID NO: 1901123 - RNA, 21 nt, Human
auucuaaugauggcccauucu

SEQ ID NO: 1901124 - RNA, 19 nt, Human
auuccagagcguguaguga

SEQ ID NO: 1901125 - RNA, 12 nt, Human
auuccagaggaa

SEQ ID NO: 1901126 - RNA, 13 nt, Human
auucaggaagcuc

SEQ ID NO: 1901127 - RNA, 21 nt, Human
auucccaggaguucugcucau

SEQ ID NO: 1901128 - RNA, 11 nt, Human
auucccaggag

SEQ ID NO: 1901129 - RNA, 12 nt, Human
auucccaggagu

SEQ ID NO: 1901130 - RNA, 18 nt, Human
auucccaggaguucugcu

SEQ ID NO: 1901131 - RNA, 20 nt, Human
auucccaggaguucugcuca

SEQ ID NO: 1901132 - RNA, 15 nt, Human
auuauauuuacaaau

SEQ ID NO: 1901133 - RNA, 14 nt, Human
auuauauuaugaag

SEQ ID NO: 1901134 - RNA, 11 nt, Human
uuuguggccaa

SEQ ID NO: 1901135 - RNA, 18 nt, Human
uuuguggccaaggagcug

SEQ ID NO: 1901136 - RNA, 20 nt, Human
uuuguggccaaggagcugcu

SEQ ID NO: 1901137 - RNA, 21 nt, Human
uuuguggccaaggagcugcua

SEQ ID NO: 1901138 - RNA, 22 nt, Human
uuuguggccaaggagcugcuau

SEQ ID NO: 1901139 - RNA, 22 nt, Human
auuauaauuuuuuucaauauuu

SEQ ID NO: 1901140 - RNA, 23 nt, Human
auuauaauuuuuuucaauauuua

SEQ ID NO: 1901141 - RNA, 19 nt, Human
auucagacagcugccuggg

SEQ ID NO: 1901142 - RNA, 20 nt, Human
auuuuuuaauuauuauuuau

SEQ ID NO: 1901143 - RNA, 15 nt, Human
auuuuuuaauuauua

SEQ ID NO: 1901144 - RNA, 18 nt, Human
auuuuuuguuaaaugauu

SEQ ID NO: 1901145 - RNA, 21 nt, Human
auuuuuugguuaagcuuugac

SEQ ID NO: 1901146 - RNA, 18 nt, Human
auuuuuuuaaaauguuaa

SEQ ID NO: 1901147 - RNA, 17 nt, Human
auuuuuuaaaacaagaa

SEQ ID NO: 1901148 - RNA, 15 nt, Human
auuuuuuaaaacaag

SEQ ID NO: 1901149 - RNA, 12 nt, Human
auuuuuuaaagc

SEQ ID NO: 1901150 - RNA, 23 nt, Human
auuuuuuaaaaaucuauauuuug

SEQ ID NO: 1901151 - RNA, 15 nt, Human
auuuuuuaaaaacua

SEQ ID NO: 1901152 - RNA, 21 nt, Human
auuuuuuaaccccgucaacaa

SEQ ID NO: 1901153 - RNA, 23 nt, Human
auuuuuuaaccccgucaacaaau

SEQ ID NO: 1901154 - RNA, 22 nt, Human
auuuuuuaaccccgucaacaaa

SEQ ID NO: 1901155 - RNA, 14 nt, Human
auuuuuuaaaugca

SEQ ID NO: 1901156 - RNA, 13 nt, Human
auuuuuuaaaugc

SEQ ID NO: 1901157 - RNA, 22 nt, Human
auuuuugugauuuugugauuga

SEQ ID NO: 1901158 - RNA, 14 nt, Human
auuuuugucuugug

SEQ ID NO: 1901159 - RNA, 19 nt, Human
auuuuuguagagccagggu

SEQ ID NO: 1901160 - RNA, 12 nt, Human
auuuuuguaauu

SEQ ID NO: 1901161 - RNA, 21 nt, Human
auuuuguuuuugucuuaaaaa

SEQ ID NO: 1901162 - RNA, 16 nt, Human
auuuuucaauaaagca

SEQ ID NO: 1901163 - RNA, 17 nt, Human
auuuuucaauaaagcau

SEQ ID NO: 1901164 - RNA, 21 nt, Human
auuuuucaauaaagcauuuau

SEQ ID NO: 1901165 - RNA, 21 nt, Human
auuuuucuuagggaaggauac

SEQ ID NO: 1901166 - RNA, 12 nt, Human
auuuuucucaug

SEQ ID NO: 1901167 - RNA, 16 nt, Human
auuuuucagauauaaa

SEQ ID NO: 1901168 - RNA, 20 nt, Human
auuuuucagaccuuuuaacu

SEQ ID NO: 1901169 - RNA, 22 nt, Human
auuuuucuuagggaaggauaca

SEQ ID NO: 1901170 - RNA, 15 nt, Human
auuuucuauaauuua

SEQ ID NO: 1901171 - RNA, 14 nt, Human
auuuucuauaauuu

SEQ ID NO: 1901172 - RNA, 16 nt, Human
auuuuccugccaggca

SEQ ID NO: 1901173 - RNA, 19 nt, Human
auuuucccuauuagagaag

SEQ ID NO: 1901174 - RNA, 15 nt, Human
auuuuaauaaacacu

SEQ ID NO: 1901175 - RNA, 19 nt, Human
auuuuaagacguguuugug

SEQ ID NO: 1901176 - RNA, 16 nt, Human
auuuuaauaaacacuc

SEQ ID NO: 1901177 - RNA, 17 nt, Human
auuuuaauaaacacucu

SEQ ID NO: 1901178 - RNA, 15 nt, Human
auuuuccaugaaaau

SEQ ID NO: 1901179 - RNA, 19 nt, Human
auuuugauccaagcugguc

SEQ ID NO: 1901180 - RNA, 13 nt, Human
auuuugaucuuca

SEQ ID NO: 1901181 - RNA, 16 nt, Human
auuuugaucuucaaca

SEQ ID NO: 1901182 - RNA, 17 nt, Human
auuuugauguuuuaagg

SEQ ID NO: 1901183 - RNA, 15 nt, Human
auuuugauguuuuaa

SEQ ID NO: 1901184 - RNA, 17 nt, Human
auuuugaucuucaacaa

SEQ ID NO: 1901185 - RNA, 19 nt, Human
auuuugaucuucaacaaau

SEQ ID NO: 1901186 - RNA, 20 nt, Human
auuuugaucuucaacaaauu

SEQ ID NO: 1901187 - RNA, 23 nt, Human
auuuugcccuugacaaagucaag

SEQ ID NO: 1901188 - RNA, 15 nt, Human
auuuugcccuugaca

SEQ ID NO: 1901189 - RNA, 15 nt, Human
auuuugcauaauaaa

SEQ ID NO: 1901190 - RNA, 19 nt, Human
auuuugcauaauaaaugcu

SEQ ID NO: 1901191 - RNA, 21 nt, Human
auuuugcugucccuuuuccuu

SEQ ID NO: 1901192 - RNA, 20 nt, Human
auuuugcuaaaugugaauga

SEQ ID NO: 1901193 - RNA, 17 nt, Human
auuuuguguuuaggaac

SEQ ID NO: 1901194 - RNA, 16 nt, Human
auuuuguuucagugca

SEQ ID NO: 1901195 - RNA, 23 nt, Human
auuuugucauauaagauucauau

SEQ ID NO: 1901196 - RNA, 12 nt, Human
auuuugucuuua

SEQ ID NO: 1901197 - RNA, 19 nt, Human
auuuugugcccccauguaa

SEQ ID NO: 1901198 - RNA, 18 nt, Human
auuuuguauauuuguauu

SEQ ID NO: 1901199 - RNA, 19 nt, Human
auuuuguaacuuccaugug

SEQ ID NO: 1901200 - RNA, 17 nt, Human
auuuuguaacaaaugaa

SEQ ID NO: 1901201 - RNA, 20 nt, Human
auuuugcuuugugauuuuug

SEQ ID NO: 1901202 - RNA, 18 nt, Human
auuuugcuuugugauuuu

SEQ ID NO: 1901203 - RNA, 20 nt, Human
auuuugcuguagaagauggc

SEQ ID NO: 1901204 - RNA, 12 nt, Human
auuuugcuguau

SEQ ID NO: 1901205 - RNA, 14 nt, Human
auuuugcuguauau

SEQ ID NO: 1901206 - RNA, 12 nt, Human
auuuugcuuugu

SEQ ID NO: 1901207 - RNA, 14 nt, Human
auuuuggaaaauaa

SEQ ID NO: 1901208 - RNA, 19 nt, Human
auuuuggaaaauaaauuau

SEQ ID NO: 1901209 - RNA, 20 nt, Human
auuuuggaaaauaaauuauu

SEQ ID NO: 1901210 - RNA, 19 nt, Human
auuuaaagaacacccuaua

SEQ ID NO: 1901211 - RNA, 21 nt, Human
auuguuuggggaugagaaagg

SEQ ID NO: 1901212 - RNA, 20 nt, Human
auuguuugucugucuucaua

SEQ ID NO: 1901213 - RNA, 16 nt, Human
auuguuugucuuuaac

SEQ ID NO: 1901214 - RNA, 13 nt, Human
auuuaaaagauac

SEQ ID NO: 1901215 - RNA, 21 nt, Human
auuguuugucuuuaacuguca

SEQ ID NO: 1901216 - RNA, 17 nt, Human
auuuaaaagauacaguu

SEQ ID NO: 1901217 - RNA, 16 nt, Human
auuuaaaagauacagu

SEQ ID NO: 1901218 - RNA, 14 nt, Human
auuuaaaagauaca

SEQ ID NO: 1901219 - RNA, 21 nt, Human
auuguacaguuuuuauugcuu

SEQ ID NO: 1901220 - RNA, 12 nt, Human
auuguaccucuc

SEQ ID NO: 1901221 - RNA, 18 nt, Human
auuguaccucucuuauag

SEQ ID NO: 1901222 - RNA, 19 nt, Human
auuguaccucucuuauaga

SEQ ID NO: 1901223 - RNA, 15 nt, Human
auuguacaguuuuua

SEQ ID NO: 1901224 - RNA, 14 nt, Human
auuguacaguuuuu

SEQ ID NO: 1901225 - RNA, 23 nt, Human
auugucaaaguggugagaggcau

SEQ ID NO: 1901226 - RNA, 16 nt, Human
auugucaaagugguga

SEQ ID NO: 1901227 - RNA, 14 nt, Human
auugugggaagggg

SEQ ID NO: 1901228 - RNA, 13 nt, Human
auugugggaaggg

SEQ ID NO: 1901229 - RNA, 12 nt, Human
auugucccucug

SEQ ID NO: 1901230 - RNA, 17 nt, Human
auugucccucugcccca

SEQ ID NO: 1901231 - RNA, 23 nt, Human
auugucccucugccccauccucc

SEQ ID NO: 1901232 - RNA, 19 nt, Human
auuggacaguaaaauccac

SEQ ID NO: 1901233 - RNA, 21 nt, Human
auugauuuccguuaaaauacc

SEQ ID NO: 1901234 - RNA, 12 nt, Human
auugauuagaaa

SEQ ID NO: 1901235 - RNA, 16 nt, Human
auuggauuugucuuug

SEQ ID NO: 1901236 - RNA, 22 nt, Human
auuggauucugagagcugugca

SEQ ID NO: 1901237 - RNA, 19 nt, Human
auuggauucugagagcugu

SEQ ID NO: 1901238 - RNA, 20 nt, Human
auuggcaccuaauccaggca

SEQ ID NO: 1901239 - RNA, 18 nt, Human
auuggguuccauucucac

SEQ ID NO: 1901240 - RNA, 23 nt, Human
auuggguggggggcuucauacac

SEQ ID NO: 1901241 - RNA, 20 nt, Human
auugggaaggggacccccgc

SEQ ID NO: 1901242 - RNA, 16 nt, Human
auuugaaaauuuugau

SEQ ID NO: 1901243 - RNA, 18 nt, Human
auuugaaacacuuugcau

SEQ ID NO: 1901244 - RNA, 20 nt, Human
auuucuuccacaagagccca

SEQ ID NO: 1901245 - RNA, 23 nt, Human
auuucuuccacaagagcccaggc

SEQ ID NO: 1901246 - RNA, 23 nt, Human
auuucuaggacugaauuaugaaa

SEQ ID NO: 1901247 - RNA, 20 nt, Human
auuucuaggacugaauuaug

SEQ ID NO: 1901248 - RNA, 23 nt, Human
auuucccugaaggaaccaaagcg

SEQ ID NO: 1901249 - RNA, 17 nt, Human
auuucccugaaggaacc

SEQ ID NO: 1901250 - RNA, 18 nt, Human
auuucuaggacugaauua

SEQ ID NO: 1901251 - RNA, 17 nt, Human
auuucuaggacugaauu

SEQ ID NO: 1901252 - RNA, 12 nt, Human
auuuauuuaaau

SEQ ID NO: 1901253 - RNA, 14 nt, Human
auuuauuuaaauuu

SEQ ID NO: 1901254 - RNA, 22 nt, Human
auuuccacucaggucuguuuuc

SEQ ID NO: 1901255 - RNA, 12 nt, Human
auuucccaggac

SEQ ID NO: 1901256 - RNA, 13 nt, Human
auuucccaggacc

SEQ ID NO: 1901257 - RNA, 14 nt, Human
auuucccaggaccc

SEQ ID NO: 1901258 - RNA, 16 nt, Human
auuucccaggacccug

SEQ ID NO: 1901259 - RNA, 19 nt, Human
auuucccaggacccugaag

SEQ ID NO: 1901260 - RNA, 21 nt, Human
auuucccauccccugugggaa

SEQ ID NO: 1901261 - RNA, 22 nt, Human
auuuccccuuuugcauucuccc

SEQ ID NO: 1901262 - RNA, 21 nt, Human
auuuccccuuuugcauucucc

SEQ ID NO: 1901263 - RNA, 16 nt, Human
auuuccacucaggucu

SEQ ID NO: 1901264 - RNA, 16 nt, Human
auuuccaagagcugag

SEQ ID NO: 1901265 - RNA, 19 nt, Human
auuucccaaagcagugcau

SEQ ID NO: 1901266 - RNA, 15 nt, Human
auuuccaagagcuga

SEQ ID NO: 1901267 - RNA, 13 nt, Human
auuugucaacaaa

SEQ ID NO: 1901268 - RNA, 15 nt, Human
auuugucaacaaagu

SEQ ID NO: 1901269 - RNA, 17 nt, Human
auuuggcuucuguuguc

SEQ ID NO: 1901270 - RNA, 14 nt, Human
auuugggaagugaa

SEQ ID NO: 1901271 - RNA, 18 nt, Human
auuugggaagugaagacu

SEQ ID NO: 1901272 - RNA, 19 nt, Human
auuuguaaauuuaugugau

SEQ ID NO: 1901273 - RNA, 18 nt, Human
auuuguaaauuuauguga

SEQ ID NO: 1901274 - RNA, 19 nt, Human
auuugggccugcuccagac

SEQ ID NO: 1901275 - RNA, 21 nt, Human
auuugggccugcuccagaccu

SEQ ID NO: 1901276 - RNA, 22 nt, Human
auuugggccugcuccagaccug

SEQ ID NO: 1901277 - RNA, 23 nt, Human
auuugggccugcuccagaccuga

SEQ ID NO: 1901278 - RNA, 18 nt, Human
auuugugaagguggaaau

SEQ ID NO: 1901279 - RNA, 21 nt, Human
auuugugaagguggaaauaaa

SEQ ID NO: 1901280 - RNA, 20 nt, Human
auuuguccucuuuacaugaa

SEQ ID NO: 1901281 - RNA, 22 nt, Human
auuuuaaaaauacagauagaua

SEQ ID NO: 1901282 - RNA, 20 nt, Human
auuuuaaaagaugcaaugua

SEQ ID NO: 1901283 - RNA, 20 nt, Human
auuuuaaaagauaaauauua

SEQ ID NO: 1901284 - RNA, 20 nt, Human
auuuuaagacguguuugugu

SEQ ID NO: 1901285 - RNA, 19 nt, Human
cacccacaugugacacaua

SEQ ID NO: 1901286 - RNA, 13 nt, Human
cacccacauguga

SEQ ID NO: 1901287 - RNA, 12 nt, Human
cacccacaugug

SEQ ID NO: 1901288 - RNA, 21 nt, Human
cacccacaugugacacauaug

SEQ ID NO: 1901289 - RNA, 14 nt, Human
caccagacacccag

SEQ ID NO: 1901290 - RNA, 19 nt, Human
cacccaagggccuggccug

SEQ ID NO: 1901291 - RNA, 20 nt, Human
cacccaagggccuggccuga

SEQ ID NO: 1901292 - RNA, 21 nt, Human
cacccaagggccuggccugag

SEQ ID NO: 1901293 - RNA, 23 nt, Human
cacccaagggccuggccugagcu

SEQ ID NO: 1901294 - RNA, 16 nt, Human
cacccaagggccuggc

SEQ ID NO: 1901295 - RNA, 17 nt, Human
caccagaagcccagaau

SEQ ID NO: 1901296 - RNA, 16 nt, Human
caccagaagcccagaa

SEQ ID NO: 1901297 - RNA, 17 nt, Human
cacccaagggccuggcc

SEQ ID NO: 1901298 - RNA, 18 nt, Human
cacccaagggccuggccu

SEQ ID NO: 1901299 - RNA, 15 nt, Human
caccagaagcccaga

SEQ ID NO: 1901300 - RNA, 14 nt, Human
caccagaagcccag

SEQ ID NO: 1901301 - RNA, 13 nt, Human
caccagaagccca

SEQ ID NO: 1901302 - RNA, 22 nt, Human
cacccaccaucaugucuggcua

SEQ ID NO: 1901303 - RNA, 20 nt, Human
cacccaccaucaugucuggc

SEQ ID NO: 1901304 - RNA, 13 nt, Human
cacccacccuggg

SEQ ID NO: 1901305 - RNA, 14 nt, Human
cacccacccuggga

SEQ ID NO: 1901306 - RNA, 16 nt, Human
cacccaccucagccuc

SEQ ID NO: 1901307 - RNA, 14 nt, Human
cacccaccucagcc

SEQ ID NO: 1901308 - RNA, 13 nt, Human
cacccaccucagc

SEQ ID NO: 1901309 - RNA, 12 nt, Human
cacccaccucag

SEQ ID NO: 1901310 - RNA, 12 nt, Human
caccccagcccc

SEQ ID NO: 1901311 - RNA, 13 nt, Human
caccccagcccca

SEQ ID NO: 1901312 - RNA, 22 nt, Human
cacccccacccaagggccuggc

SEQ ID NO: 1901313 - RNA, 16 nt, Human
cacccccuccccgccc

SEQ ID NO: 1901314 - RNA, 14 nt, Human
caccccggccaccu

SEQ ID NO: 1901315 - RNA, 15 nt, Human
caccccggccaccug

SEQ ID NO: 1901316 - RNA, 16 nt, Human
caccccggccaccugc

SEQ ID NO: 1901317 - RNA, 17 nt, Human
caccccggccaccugcg

SEQ ID NO: 1901318 - RNA, 15 nt, Human
cacaugugacacaua

SEQ ID NO: 1901319 - RNA, 17 nt, Human
cacaugugcacaugcac

SEQ ID NO: 1901320 - RNA, 13 nt, Human
cacaugugacaca

SEQ ID NO: 1901321 - RNA, 20 nt, Human
cacaugucuuguacaugugu

SEQ ID NO: 1901322 - RNA, 15 nt, Human
cacaugucuuguaca

SEQ ID NO: 1901323 - RNA, 15 nt, Human
cacaugugcacaugc

SEQ ID NO: 1901324 - RNA, 14 nt, Human
cacaugugcacaug

SEQ ID NO: 1901325 - RNA, 16 nt, Human
cacauuccugaugcuu

SEQ ID NO: 1901326 - RNA, 16 nt, Human
cacauuccugaacagg

SEQ ID NO: 1901327 - RNA, 17 nt, Human
cacauuagacuauccau

SEQ ID NO: 1901328 - RNA, 23 nt, Human
cacauuaagccuuccacacucac

SEQ ID NO: 1901329 - RNA, 15 nt, Human
cacauggccuaugca

SEQ ID NO: 1901330 - RNA, 18 nt, Human
cacauggcuauguuuuag

SEQ ID NO: 1901331 - RNA, 19 nt, Human
cacaugccucucucaggcc

SEQ ID NO: 1901332 - RNA, 13 nt, Human
cacaucaaagagg

SEQ ID NO: 1901333 - RNA, 22 nt, Human
cacauggugacuuuugaaaaga

SEQ ID NO: 1901334 - RNA, 14 nt, Human
cacauaucugucau

SEQ ID NO: 1901335 - RNA, 12 nt, Human
cacauaucuguc

SEQ ID NO: 1901336 - RNA, 18 nt, Human
cacaucagcacgauuucu

SEQ ID NO: 1901337 - RNA, 19 nt, Human
cacaucagcacgauuucug

SEQ ID NO: 1901338 - RNA, 13 nt, Human
cacaugccucucu

SEQ ID NO: 1901339 - RNA, 17 nt, Human
cacaugccucucucagg

SEQ ID NO: 1901340 - RNA, 18 nt, Human
cacaugccucucucaggc

SEQ ID NO: 1901341 - RNA, 15 nt, Human
caccacgucacuuca

SEQ ID NO: 1901342 - RNA, 18 nt, Human
caccacucaaaggccaga

SEQ ID NO: 1901343 - RNA, 22 nt, Human
caccacucaaaggccagaccug

SEQ ID NO: 1901344 - RNA, 20 nt, Human
caccacuacauucuguuaau

SEQ ID NO: 1901345 - RNA, 19 nt, Human
caccacuacauucuguuaa

SEQ ID NO: 1901346 - RNA, 18 nt, Human
caccacuacauucuguua

SEQ ID NO: 1901347 - RNA, 17 nt, Human
caccacuacauucuguu

SEQ ID NO: 1901348 - RNA, 16 nt, Human
caccacuacauucugu

SEQ ID NO: 1901349 - RNA, 14 nt, Human
caccaccucuuugg

SEQ ID NO: 1901350 - RNA, 18 nt, Human
caccacaugugcacaugc

SEQ ID NO: 1901351 - RNA, 15 nt, Human
caccacaugugcaca

SEQ ID NO: 1901352 - RNA, 19 nt, Human
caccacaugugcacaugca

SEQ ID NO: 1901353 - RNA, 14 nt, Human
caccacaucuaagc

SEQ ID NO: 1901354 - RNA, 15 nt, Human
caccaagcccaguua

SEQ ID NO: 1901355 - RNA, 21 nt, Human
caccaagccuggucagcccaa

SEQ ID NO: 1901356 - RNA, 20 nt, Human
caccaagccuggucagccca

SEQ ID NO: 1901357 - RNA, 19 nt, Human
caccaagccuggucagccc

SEQ ID NO: 1901358 - RNA, 18 nt, Human
cacauuggagauguuuag

SEQ ID NO: 1901359 - RNA, 17 nt, Human
cacauuggaaacaaguc

SEQ ID NO: 1901360 - RNA, 17 nt, Human
caccacacccagcccac

SEQ ID NO: 1901361 - RNA, 15 nt, Human
caccacacccagccc

SEQ ID NO: 1901362 - RNA, 13 nt, Human
caccacacccagc

SEQ ID NO: 1901363 - RNA, 22 nt, Human
caccaagccuggucagcccaaa

SEQ ID NO: 1901364 - RNA, 12 nt, Human
cacagcagccug

SEQ ID NO: 1901365 - RNA, 20 nt, Human
cacagaugggugcuuggagg

SEQ ID NO: 1901366 - RNA, 20 nt, Human
cacagaguuguuacauuuuu

SEQ ID NO: 1901367 - RNA, 14 nt, Human
cacagaugggugcu

SEQ ID NO: 1901368 - RNA, 18 nt, Human
cacagaugggugcuugga

SEQ ID NO: 1901369 - RNA, 22 nt, Human
cacagccaacacgcaccugccu

SEQ ID NO: 1901370 - RNA, 14 nt, Human
cacagcagccuggg

SEQ ID NO: 1901371 - RNA, 15 nt, Human
cacaggaaguagagg

SEQ ID NO: 1901372 - RNA, 16 nt, Human
cacaggaucagucuga

SEQ ID NO: 1901373 - RNA, 15 nt, Human
cacaggaucagucug

SEQ ID NO: 1901374 - RNA, 12 nt, Human
cacaggaucagu

SEQ ID NO: 1901375 - RNA, 19 nt, Human
cacaggcccggcuccaggc

SEQ ID NO: 1901376 - RNA, 18 nt, Human
cacaggcccggcuccagg

SEQ ID NO: 1901377 - RNA, 17 nt, Human
cacaggcccggcuccag

SEQ ID NO: 1901378 - RNA, 16 nt, Human
cacaggcccggcucca

SEQ ID NO: 1901379 - RNA, 10 nt, Human
cacaggcagg

SEQ ID NO: 1901380 - RNA, 17 nt, Human
cacauacacacacacgc

SEQ ID NO: 1901381 - RNA, 13 nt, Human
cacauacaacaca

SEQ ID NO: 1901382 - RNA, 22 nt, Human
cacauacaacacaaagagaaaa

SEQ ID NO: 1901383 - RNA, 23 nt, Human
cacaggcccggcuccaggcuccu

SEQ ID NO: 1901384 - RNA, 20 nt, Human
cacaggcccggcuccaggcu

SEQ ID NO: 1901385 - RNA, 18 nt, Human
cacagugagucgaggaca

SEQ ID NO: 1901386 - RNA, 20 nt, Human
cacagugagucgaggacagg

SEQ ID NO: 1901387 - RNA, 19 nt, Human
cacagugagucgaggacag

SEQ ID NO: 1901388 - RNA, 23 nt, Human
cacaguucuuugggccagacaug

SEQ ID NO: 1901389 - RNA, 13 nt, Human
cacaggcccuccc

SEQ ID NO: 1901390 - RNA, 22 nt, Human
cacaaagaugggugaaggcugg

SEQ ID NO: 1901391 - RNA, 19 nt, Human
cacaaacuuuuauacucuu

SEQ ID NO: 1901392 - RNA, 18 nt, Human
cacaaagagaaaaagaaa

SEQ ID NO: 1901393 - RNA, 15 nt, Human
cacaaacuguaaaua

SEQ ID NO: 1901394 - RNA, 23 nt, Human
cacaaacuguaaauaaaaagaaa

SEQ ID NO: 1901395 - RNA, 14 nt, Human
cacaaacuguaaau

SEQ ID NO: 1901396 - RNA, 16 nt, Human
cacaaaacccagaccu

SEQ ID NO: 1901397 - RNA, 18 nt, Human
cacaaaaguuucucuuuu

SEQ ID NO: 1901398 - RNA, 16 nt, Human
cacaaaaguuucucuu

SEQ ID NO: 1901399 - RNA, 12 nt, Human
cacaaaaaagaa

SEQ ID NO: 1901400 - RNA, 13 nt, Human
cacaaaaaagaag

SEQ ID NO: 1901401 - RNA, 21 nt, Human
cacaaauucugucucuggauu

SEQ ID NO: 1901402 - RNA, 20 nt, Human
cacaaagagaaaaagaaaug

SEQ ID NO: 1901403 - RNA, 11 nt, Human
cacaaagccca

SEQ ID NO: 1901404 - RNA, 12 nt, Human
cacaaagcccaa

SEQ ID NO: 1901405 - RNA, 14 nt, Human
cacaaagcccaagg

SEQ ID NO: 1901406 - RNA, 22 nt, Human
caaugccaaaaaaagacagggc

SEQ ID NO: 1901407 - RNA, 15 nt, Human
caaugucugagugaa

SEQ ID NO: 1901408 - RNA, 16 nt, Human
caaugucugagugaac

SEQ ID NO: 1901409 - RNA, 20 nt, Human
caaugucugagugaaccugu

SEQ ID NO: 1901410 - RNA, 13 nt, Human
caauucagacagg

SEQ ID NO: 1901411 - RNA, 14 nt, Human
caauucagacaggc

SEQ ID NO: 1901412 - RNA, 15 nt, Human
caauucagacaggca

SEQ ID NO: 1901413 - RNA, 23 nt, Human
caauucagacaggcaaauaaaag

SEQ ID NO: 1901414 - RNA, 21 nt, Human
caauaggaaaaacugauuuuu

SEQ ID NO: 1901415 - RNA, 15 nt, Human
caauaggcuguuccc

SEQ ID NO: 1901416 - RNA, 20 nt, Human
caauaggaaaaacugauuuu

SEQ ID NO: 1901417 - RNA, 23 nt, Human
caaugcacuuuguucuggcucuu

SEQ ID NO: 1901418 - RNA, 19 nt, Human
caaugcaaaccaucauuga

SEQ ID NO: 1901419 - RNA, 20 nt, Human
caaugcaaaccaucauugaa

SEQ ID NO: 1901420 - RNA, 17 nt, Human
caaugcaaaccaucauu

SEQ ID NO: 1901421 - RNA, 18 nt, Human
caaugcaaaccaucauug

SEQ ID NO: 1901422 - RNA, 21 nt, Human
caaugaugaaugagaaucuac

SEQ ID NO: 1901423 - RNA, 13 nt, Human
caaugaugcuauu

SEQ ID NO: 1901424 - RNA, 17 nt, Human
caaugaugcuauuugca

SEQ ID NO: 1901425 - RNA, 18 nt, Human
caaugaugcuauuugcaa

SEQ ID NO: 1901426 - RNA, 19 nt, Human
caaugaugcuauuugcaau

SEQ ID NO: 1901427 - RNA, 13 nt, Human
caaugaccuuuca

SEQ ID NO: 1901428 - RNA, 14 nt, Human
caaugaugaaugag

SEQ ID NO: 1901429 - RNA, 21 nt, Human
caaugacacagucuuggcuca

SEQ ID NO: 1901430 - RNA, 19 nt, Human
caaugacacagucuuggcu

SEQ ID NO: 1901431 - RNA, 14 nt, Human
caaugacacagucu

SEQ ID NO: 1901432 - RNA, 22 nt, Human
caaugaaugaaugaauggcuaa

SEQ ID NO: 1901433 - RNA, 19 nt, Human
caaugugaaaagaaaaaug

SEQ ID NO: 1901434 - RNA, 17 nt, Human
cacaccgggcacucaga

SEQ ID NO: 1901435 - RNA, 22 nt, Human
cacaccuguaaucccagcacuu

SEQ ID NO: 1901436 - RNA, 23 nt, Human
cacaccuuuuauugacacagaaa

SEQ ID NO: 1901437 - RNA, 22 nt, Human
cacaccuuuuauugacacagaa

SEQ ID NO: 1901438 - RNA, 13 nt, Human
cacaccagagccc

SEQ ID NO: 1901439 - RNA, 12 nt, Human
cacaccagagcc

SEQ ID NO: 1901440 - RNA, 15 nt, Human
cacaccagagcccac

SEQ ID NO: 1901441 - RNA, 16 nt, Human
cacaccacaucuaagc

SEQ ID NO: 1901442 - RNA, 13 nt, Human
cacacccagccca

SEQ ID NO: 1901443 - RNA, 22 nt, Human
cacaccaggcuugccugcaggc

SEQ ID NO: 1901444 - RNA, 21 nt, Human
cacaccaggcuugccugcagg

SEQ ID NO: 1901445 - RNA, 14 nt, Human
cacacaccagagcc

SEQ ID NO: 1901446 - RNA, 14 nt, Human
cacaaccugaaccu

SEQ ID NO: 1901447 - RNA, 12 nt, Human
cacacagcucug

SEQ ID NO: 1901448 - RNA, 19 nt, Human
cacacagaggcugccucuc

SEQ ID NO: 1901449 - RNA, 22 nt, Human
cacacagacuguugucccugca

SEQ ID NO: 1901450 - RNA, 20 nt, Human
cacacagacucauauuacug

SEQ ID NO: 1901451 - RNA, 15 nt, Human
cacacagacuguugu

SEQ ID NO: 1901452 - RNA, 18 nt, Human
cacagacucaaaugcuca

SEQ ID NO: 1901453 - RNA, 14 nt, Human
cacagacucauauu

SEQ ID NO: 1901454 - RNA, 22 nt, Human
cacagacuguugucccugcacu

SEQ ID NO: 1901455 - RNA, 23 nt, Human
cacagacuguugucccugcacuc

SEQ ID NO: 1901456 - RNA, 17 nt, Human
cacagaguuguuacauu

SEQ ID NO: 1901457 - RNA, 16 nt, Human
cacagaguuguuacau

SEQ ID NO: 1901458 - RNA, 21 nt, Human
cacacuugacaucaacugcau

SEQ ID NO: 1901459 - RNA, 14 nt, Human
cacacucauccccu

SEQ ID NO: 1901460 - RNA, 14 nt, Human
cacacugaugcuua

SEQ ID NO: 1901461 - RNA, 18 nt, Human
cacacugaugcuuagaug

SEQ ID NO: 1901462 - RNA, 13 nt, Human
cacacuggacucc

SEQ ID NO: 1901463 - RNA, 19 nt, Human
cacacuggacuccggcccu

SEQ ID NO: 1901464 - RNA, 20 nt, Human
cacacuggacuccggcccuc

SEQ ID NO: 1901465 - RNA, 15 nt, Human
caaauagcauaaguu

SEQ ID NO: 1901466 - RNA, 15 nt, Human
caaauagcacuugac

SEQ ID NO: 1901467 - RNA, 12 nt, Human
caaauauauuca

SEQ ID NO: 1901468 - RNA, 23 nt, Human
caaauaaugucucugugagacuc

SEQ ID NO: 1901469 - RNA, 20 nt, Human
caaauaaugucucugugaga

SEQ ID NO: 1901470 - RNA, 16 nt, Human
caaauaaugucucugu

SEQ ID NO: 1901471 - RNA, 13 nt, Human
caaauaaugucuc

SEQ ID NO: 1901472 - RNA, 21 nt, Human
caaaggaugcccaaagaugca

SEQ ID NO: 1901473 - RNA, 22 nt, Human
caaauucugcuugcuugcuuuu

SEQ ID NO: 1901474 - RNA, 20 nt, Human
caaauguucaucaaugaaug

SEQ ID NO: 1901475 - RNA, 21 nt, Human
caaauguucaucaaugaauga

SEQ ID NO: 1901476 - RNA, 13 nt, Human
caaaucagcugcu

SEQ ID NO: 1901477 - RNA, 16 nt, Human
caaaucagcugcuacu

SEQ ID NO: 1901478 - RNA, 18 nt, Human
auuuuuuuacuaauagac

SEQ ID NO: 1901479 - RNA, 15 nt, Human
auuuuuuucaauauu

SEQ ID NO: 1901480 - RNA, 23 nt, Human
caaacuuccagugcaacacugaa

SEQ ID NO: 1901481 - RNA, 17 nt, Human
caaacuuggauuuuuga

SEQ ID NO: 1901482 - RNA, 18 nt, Human
caaacuuuuauacucuuu

SEQ ID NO: 1901483 - RNA, 19 nt, Human
caaagaggccuuuaaccau

SEQ ID NO: 1901484 - RNA, 20 nt, Human
caaagaggcugaggcuggca

SEQ ID NO: 1901485 - RNA, 22 nt, Human
caaagaggcugaggcuggcaca

SEQ ID NO: 1901486 - RNA, 18 nt, Human
caaagcuaggccuggcca

SEQ ID NO: 1901487 - RNA, 17 nt, Human
caaagcuaggccuggcc

SEQ ID NO: 1901488 - RNA, 16 nt, Human
caaagcuaggccuggc

SEQ ID NO: 1901489 - RNA, 21 nt, Human
caaagccaaagcuaggccugg

SEQ ID NO: 1901490 - RNA, 20 nt, Human
caaagccaaagcuaggccug

SEQ ID NO: 1901491 - RNA, 16 nt, Human
caaagcuuguuaagau

SEQ ID NO: 1901492 - RNA, 16 nt, Human
caaaggaguagaaaga

SEQ ID NO: 1901493 - RNA, 16 nt, Human
caaagcuuuuagaaau

SEQ ID NO: 1901494 - RNA, 20 nt, Human
caaagcuuuuagaaauacug

SEQ ID NO: 1901495 - RNA, 17 nt, Human
caagcacuaaacaaaga

SEQ ID NO: 1901496 - RNA, 18 nt, Human
caagcaccuccugccucg

SEQ ID NO: 1901497 - RNA, 16 nt, Human
caagcgugagccacug

SEQ ID NO: 1901498 - RNA, 21 nt, Human
caagccaccaacauacuccca

SEQ ID NO: 1901499 - RNA, 18 nt, Human
caagcccccccuuccacu

SEQ ID NO: 1901500 - RNA, 21 nt, Human
caagccccugcuccagaagau

SEQ ID NO: 1901501 - RNA, 16 nt, Human
caaggaagccacagcu

SEQ ID NO: 1901502 - RNA, 18 nt, Human
caagcgugagccacugca

SEQ ID NO: 1901503 - RNA, 17 nt, Human
caagcgugagccacugc

SEQ ID NO: 1901504 - RNA, 15 nt, Human
caaggaaaaacaggu

SEQ ID NO: 1901505 - RNA, 15 nt, Human
caaggauagaugcug

SEQ ID NO: 1901506 - RNA, 16 nt, Human
caaggauagaugcugg

SEQ ID NO: 1901507 - RNA, 17 nt, Human
caaggauagaugcuggc

SEQ ID NO: 1901508 - RNA, 13 nt, Human
caaggauccugag

SEQ ID NO: 1901509 - RNA, 20 nt, Human
caaggauagaugcuggccca

SEQ ID NO: 1901510 - RNA, 21 nt, Human
caaggauagaugcuggcccag

SEQ ID NO: 1901511 - RNA, 22 nt, Human
caaggauagaugcuggcccagg

SEQ ID NO: 1901512 - RNA, 23 nt, Human
caaggauagaugcuggcccaggg

SEQ ID NO: 1901513 - RNA, 21 nt, Human
caaggaugaucuaggaagacu

SEQ ID NO: 1901514 - RNA, 17 nt, Human
caagugauucuccugcc

SEQ ID NO: 1901515 - RNA, 16 nt, Human
caagugauucuccugc

SEQ ID NO: 1901516 - RNA, 19 nt, Human
caagugaaaaaggaggaag

SEQ ID NO: 1901517 - RNA, 22 nt, Human
caagugauucuccugccucagc

SEQ ID NO: 1901518 - RNA, 21 nt, Human
caagugauucuccugccucag

SEQ ID NO: 1901519 - RNA, 14 nt, Human
caagugauucuccu

SEQ ID NO: 1901520 - RNA, 22 nt, Human
caagugugguagagugugccug

SEQ ID NO: 1901521 - RNA, 18 nt, Human
caaguggugguaacccug

SEQ ID NO: 1901522 - RNA, 19 nt, Human
caaguggugguaacccugg

SEQ ID NO: 1901523 - RNA, 20 nt, Human
caaguggugguaacccuggu

SEQ ID NO: 1901524 - RNA, 22 nt, Human
caaguggugguaacccuggugg

SEQ ID NO: 1901525 - RNA, 15 nt, Human
caaggauugcuacug

SEQ ID NO: 1901526 - RNA, 19 nt, Human
caagggccuggccugagcu

SEQ ID NO: 1901527 - RNA, 12 nt, Human
caaggugggagg

SEQ ID NO: 1901528 - RNA, 23 nt, Human
caaggugggaggauugcuugagc

SEQ ID NO: 1901529 - RNA, 14 nt, Human
caaauuuacagaga

SEQ ID NO: 1901530 - RNA, 23 nt, Human
caaauugugugugcucugcuuca

SEQ ID NO: 1901531 - RNA, 15 nt, Human
caaauucugucucug

SEQ ID NO: 1901532 - RNA, 24 nt, Human
caacaggcugggcuucaguggcag

SEQ ID NO: 1901533 - RNA, 23 nt, Human
caacaggcugggcuucaguggca

SEQ ID NO: 1901534 - RNA, 15 nt, Human
caaauuuacagagac

SEQ ID NO: 1901535 - RNA, 22 nt, Human
caacaucuuggucagauuugaa

SEQ ID NO: 1901536 - RNA, 19 nt, Human
caacagguuuuccugaaga

SEQ ID NO: 1901537 - RNA, 18 nt, Human
caacaggguuuuuuucca

SEQ ID NO: 1901538 - RNA, 15 nt, Human
caacagguuuuccug

SEQ ID NO: 1901539 - RNA, 19 nt, Human
caaccccuucgcuccugug

SEQ ID NO: 1901540 - RNA, 18 nt, Human
caaccccuucgcuccugu

SEQ ID NO: 1901541 - RNA, 21 nt, Human
caaccccuucgcuccuguguc

SEQ ID NO: 1901542 - RNA, 22 nt, Human
caaccacauacaacacaaagag

SEQ ID NO: 1901543 - RNA, 23 nt, Human
caacauguauaauauuuuuaauu

SEQ ID NO: 1901544 - RNA, 19 nt, Human
caacauguauaauauuuuu

SEQ ID NO: 1901545 - RNA, 18 nt, Human
caacauguauaauauuuu

SEQ ID NO: 1901546 - RNA, 17 nt, Human
caacauguauaauauuu

SEQ ID NO: 1901547 - RNA, 14 nt, Human
caacauucuuugca

SEQ ID NO: 1901548 - RNA, 13 nt, Human
caacauguauaau

SEQ ID NO: 1901549 - RNA, 18 nt, Human
caacauggugaaaccccg

SEQ ID NO: 1901550 - RNA, 13 nt, Human
caacaucuuuucu

SEQ ID NO: 1901551 - RNA, 14 nt, Human
caacaucugagugc

SEQ ID NO: 1901552 - RNA, 11 nt, Human
caacuuuguau

SEQ ID NO: 1901553 - RNA, 12 nt, Human
caacuuuguaua

SEQ ID NO: 1901554 - RNA, 16 nt, Human
caacuuuaagaggaca

SEQ ID NO: 1901555 - RNA, 16 nt, Human
caacugcauuggcuuu

SEQ ID NO: 1901556 - RNA, 20 nt, Human
caacucuccuccagagucag

SEQ ID NO: 1901557 - RNA, 21 nt, Human
caacucugaaggguaauuaua

SEQ ID NO: 1901558 - RNA, 21 nt, Human
caacugccucgaaacacagaa

SEQ ID NO: 1901559 - RNA, 23 nt, Human
caacugccucgaaacacagaaac

SEQ ID NO: 1901560 - RNA, 15 nt, Human
caacuuaacaugaaa

SEQ ID NO: 1901561 - RNA, 12 nt, Human
caacccucauca

SEQ ID NO: 1901562 - RNA, 15 nt, Human
caacccucaucacca

SEQ ID NO: 1901563 - RNA, 17 nt, Human
caacccuucccucaccu

SEQ ID NO: 1901564 - RNA, 18 nt, Human
caacccuucccucaccuu

SEQ ID NO: 1901565 - RNA, 10 nt, Human
caacccuucu

SEQ ID NO: 1901566 - RNA, 20 nt, Human
caacccuucuccucuuguaa

SEQ ID NO: 1901567 - RNA, 21 nt, Human
caacccuucuccucuuguaaa

SEQ ID NO: 1901568 - RNA, 23 nt, Human
caacccuucuccucuuguaaaua

SEQ ID NO: 1901569 - RNA, 16 nt, Human
caaccucuucuggcuc

SEQ ID NO: 1901570 - RNA, 19 nt, Human
caacucuccuccagaguca

SEQ ID NO: 1901571 - RNA, 16 nt, Human
caaccugauugugucu

SEQ ID NO: 1901572 - RNA, 13 nt, Human
caaccucuuggcc

SEQ ID NO: 1901573 - RNA, 15 nt, Human
caaccucuuggccug

SEQ ID NO: 1901574 - RNA, 17 nt, Human
caaccucuucuggcuca

SEQ ID NO: 1901575 - RNA, 18 nt, Human
caaccucuucuggcucaa

SEQ ID NO: 1901576 - RNA, 16 nt, Human
caaccugaaccuagga

SEQ ID NO: 1901577 - RNA, 12 nt, Human
caaccugaaccu

SEQ ID NO: 1901578 - RNA, 13 nt, Human
caaccugaaccua

SEQ ID NO: 1901579 - RNA, 16 nt, Human
cccacaugugacacau

SEQ ID NO: 1901580 - RNA, 15 nt, Human
cccaccgugggcagg

SEQ ID NO: 1901581 - RNA, 17 nt, Human
cccaccgugggcaggga

SEQ ID NO: 1901582 - RNA, 15 nt, Human
cccaccucagccucc

SEQ ID NO: 1901583 - RNA, 14 nt, Human
cccaccucagccuc

SEQ ID NO: 1901584 - RNA, 12 nt, Human
cccaccucagcc

SEQ ID NO: 1901585 - RNA, 19 nt, Human
cccaccgugggcagggagc

SEQ ID NO: 1901586 - RNA, 21 nt, Human
cccaccucagccucccaaagu

SEQ ID NO: 1901587 - RNA, 13 nt, Human
cccaccucucuca

SEQ ID NO: 1901588 - RNA, 14 nt, Human
cccaccucucucac

SEQ ID NO: 1901589 - RNA, 17 nt, Human
cccaccucucucacucc

SEQ ID NO: 1901590 - RNA, 12 nt, Human
cccaccuuggcu

SEQ ID NO: 1901591 - RNA, 19 nt, Human
cccaccucucucacuccuu

SEQ ID NO: 1901592 - RNA, 15 nt, Human
cccaccuuggcugca

SEQ ID NO: 1901593 - RNA, 14 nt, Human
cccaccuuggcugc

SEQ ID NO: 1901594 - RNA, 22 nt, Human
cccaccuuggcucaaguccucu

SEQ ID NO: 1901595 - RNA, 15 nt, Human
cccaccuuggcucaa

SEQ ID NO: 1901596 - RNA, 17 nt, Human
cccacgcccccacuggu

SEQ ID NO: 1901597 - RNA, 19 nt, Human
cccacgcccccacugguga

SEQ ID NO: 1901598 - RNA, 14 nt, Human
cccacgcuggagug

SEQ ID NO: 1901599 - RNA, 16 nt, Human
cccagaaugaggcugc

SEQ ID NO: 1901600 - RNA, 24 nt, Human
cccagaauaaacuggcagcucagc

SEQ ID NO: 1901601 - RNA, 22 nt, Human
cccagaauaaacuggcagcuca

SEQ ID NO: 1901602 - RNA, 12 nt, Human
cccacagagaca

SEQ ID NO: 1901603 - RNA, 13 nt, Human
cccacagacucaa

SEQ ID NO: 1901604 - RNA, 23 nt, Human
cccacagacucaaaugcucagac

SEQ ID NO: 1901605 - RNA, 13 nt, Human
cccacagcgcugg

SEQ ID NO: 1901606 - RNA, 13 nt, Human
cccacaggaucag

SEQ ID NO: 1901607 - RNA, 17 nt, Human
cccacaggaucagucug

SEQ ID NO: 1901608 - RNA, 23 nt, Human
cccaagggaucugguccuaccca

SEQ ID NO: 1901609 - RNA, 16 nt, Human
cccaagggccuggccu

SEQ ID NO: 1901610 - RNA, 20 nt, Human
ccauuuugcugucccuuuuc

SEQ ID NO: 1901611 - RNA, 21 nt, Human
ccauuuuguauuuuacuaaua

SEQ ID NO: 1901612 - RNA, 15 nt, Human
ccauuuuuacuguua

SEQ ID NO: 1901613 - RNA, 19 nt, Human
cccaaaacaccggguucca

SEQ ID NO: 1901614 - RNA, 12 nt, Human
cccaagggccug

SEQ ID NO: 1901615 - RNA, 14 nt, Human
cccaagggccuggc

SEQ ID NO: 1901616 - RNA, 18 nt, Human
ccauguuuuguuuacggu

SEQ ID NO: 1901617 - RNA, 15 nt, Human
ccauucugccugccc

SEQ ID NO: 1901618 - RNA, 13 nt, Human
ccauuugcuccuu

SEQ ID NO: 1901619 - RNA, 14 nt, Human
ccauucuccaccug

SEQ ID NO: 1901620 - RNA, 20 nt, Human
ccauucuacuugcucuggac

SEQ ID NO: 1901621 - RNA, 19 nt, Human
ccauucucaccuauccaca

SEQ ID NO: 1901622 - RNA, 13 nt, Human
ccauucuccacag

SEQ ID NO: 1901623 - RNA, 15 nt, Human
ccauucuccacagca

SEQ ID NO: 1901624 - RNA, 16 nt, Human
ccauucuccacagcaa

SEQ ID NO: 1901625 - RNA, 18 nt, Human
ccauucuccacagcaacc

SEQ ID NO: 1901626 - RNA, 17 nt, Human
ccauuaugaagaagaga

SEQ ID NO: 1901627 - RNA, 15 nt, Human
ccauuauguccuagu

SEQ ID NO: 1901628 - RNA, 12 nt, Human
ccauucuacuug

SEQ ID NO: 1901629 - RNA, 13 nt, Human
ccauucuacuugc

SEQ ID NO: 1901630 - RNA, 17 nt, Human
ccauucuacuugcucug

SEQ ID NO: 1901631 - RNA, 18 nt, Human
ccauucuacuugcucugg

SEQ ID NO: 1901632 - RNA, 19 nt, Human
ccauucuacuugcucugga

SEQ ID NO: 1901633 - RNA, 22 nt, Human
ccauucuacuugcucuggaccu

SEQ ID NO: 1901634 - RNA, 14 nt, Human
ccaggugcagccag

SEQ ID NO: 1901635 - RNA, 15 nt, Human
ccaggugcagccaga

SEQ ID NO: 1901636 - RNA, 14 nt, Human
ccagguagaacaca

SEQ ID NO: 1901637 - RNA, 16 nt, Human
ccaggugcagccagag

SEQ ID NO: 1901638 - RNA, 21 nt, Human
ccaggugcuaggaacacuccu

SEQ ID NO: 1901639 - RNA, 16 nt, Human
ccagguuucuaugugu

SEQ ID NO: 1901640 - RNA, 13 nt, Human
ccagguuuaagcu

SEQ ID NO: 1901641 - RNA, 22 nt, Human
ccaguaaaugggggugcauuug

SEQ ID NO: 1901642 - RNA, 21 nt, Human
ccaguaaaugggggugcauuu

SEQ ID NO: 1901643 - RNA, 20 nt, Human
ccaguaaaugggggugcauu

SEQ ID NO: 1901644 - RNA, 23 nt, Human
ccaguaaaugggggugcauuuga

SEQ ID NO: 1901645 - RNA, 13 nt, Human
ccagugaggcucu

SEQ ID NO: 1901646 - RNA, 21 nt, Human
ccagugaugcuaaagguugua

SEQ ID NO: 1901647 - RNA, 14 nt, Human
ccagugcaacacug

SEQ ID NO: 1901648 - RNA, 23 nt, Human
ccagugugacaaggauugcuacu

SEQ ID NO: 1901649 - RNA, 14 nt, Human
ccagugugacaagg

SEQ ID NO: 1901650 - RNA, 13 nt, Human
ccauaugccuggg

SEQ ID NO: 1901651 - RNA, 12 nt, Human
ccaucaagccac

SEQ ID NO: 1901652 - RNA, 15 nt, Human
ccauaugccugggca

SEQ ID NO: 1901653 - RNA, 13 nt, Human
ccaucaugucugg

SEQ ID NO: 1901654 - RNA, 12 nt, Human
ccaucauugaaa

SEQ ID NO: 1901655 - RNA, 12 nt, Human
ccaucaugucug

SEQ ID NO: 1901656 - RNA, 13 nt, Human
ccaucauccuacu

SEQ ID NO: 1901657 - RNA, 16 nt, Human
ccaucaagccaccaac

SEQ ID NO: 1901658 - RNA, 13 nt, Human
ccaucaagccacc

SEQ ID NO: 1901659 - RNA, 14 nt, Human
ccaucaagccacca

SEQ ID NO: 1901660 - RNA, 14 nt, Human
ccaucucacacaug

SEQ ID NO: 1901661 - RNA, 15 nt, Human
ccaucucacacauga

SEQ ID NO: 1901662 - RNA, 17 nt, Human
ccaucucacacaugagc

SEQ ID NO: 1901663 - RNA, 18 nt, Human
ccaucucacacaugagca

SEQ ID NO: 1901664 - RNA, 20 nt, Human
ccaucucacacaugagcauc

SEQ ID NO: 1901665 - RNA, 21 nt, Human
ccaucucacacaugagcauca

SEQ ID NO: 1901666 - RNA, 17 nt, Human
ccaucucaccuccugcu

SEQ ID NO: 1901667 - RNA, 15 nt, Human
ccaucucuccuccuu

SEQ ID NO: 1901668 - RNA, 14 nt, Human
ccaucauugaaauc

SEQ ID NO: 1901669 - RNA, 16 nt, Human
ccaucauugaaaucuu

SEQ ID NO: 1901670 - RNA, 17 nt, Human
ccaucauugaaaucuuu

SEQ ID NO: 1901671 - RNA, 18 nt, Human
ccauccugaggcuccacu

SEQ ID NO: 1901672 - RNA, 20 nt, Human
ccauccugaggcuccacuug

SEQ ID NO: 1901673 - RNA, 23 nt, Human
ccagugcccacaggaucagucug

SEQ ID NO: 1901674 - RNA, 17 nt, Human
ccagggcccccaucuca

SEQ ID NO: 1901675 - RNA, 19 nt, Human
ccagggagcugcaggggca

SEQ ID NO: 1901676 - RNA, 13 nt, Human
ccagggagcugca

SEQ ID NO: 1901677 - RNA, 15 nt, Human
ccagggagcugcagg

SEQ ID NO: 1901678 - RNA, 22 nt, Human
ccagggagccuuugguucuggc

SEQ ID NO: 1901679 - RNA, 14 nt, Human
ccagggccugcgag

SEQ ID NO: 1901680 - RNA, 13 nt, Human
ccagggccugcga

SEQ ID NO: 1901681 - RNA, 14 nt, Human
ccagggugugugcu

SEQ ID NO: 1901682 - RNA, 16 nt, Human
ccaggccccugccacc

SEQ ID NO: 1901683 - RNA, 15 nt, Human
ccaggccccugccac

SEQ ID NO: 1901684 - RNA, 14 nt, Human
ccaggccccugcca

SEQ ID NO: 1901685 - RNA, 12 nt, Human
ccaggccagagg

SEQ ID NO: 1901686 - RNA, 13 nt, Human
ccaggcccucugc

SEQ ID NO: 1901687 - RNA, 14 nt, Human
ccaggcccucugcc

SEQ ID NO: 1901688 - RNA, 23 nt, Human
ccaggccacuggccccugagauc

SEQ ID NO: 1901689 - RNA, 15 nt, Human
ccaggaggccagccu

SEQ ID NO: 1901690 - RNA, 18 nt, Human
ccaggaggccagccuuga

SEQ ID NO: 1901691 - RNA, 20 nt, Human
ccaggaggccagccuugacc

SEQ ID NO: 1901692 - RNA, 21 nt, Human
ccaggccacaagacccuugug

SEQ ID NO: 1901693 - RNA, 16 nt, Human
ccaggccacuggcccc

SEQ ID NO: 1901694 - RNA, 14 nt, Human
ccaggcuggucuca

SEQ ID NO: 1901695 - RNA, 21 nt, Human
ccaggcuuagucacugagaca

SEQ ID NO: 1901696 - RNA, 22 nt, Human
ccaggcuuagucacugagacag

SEQ ID NO: 1901697 - RNA, 23 nt, Human
ccaggcuuagucacugagacagc

SEQ ID NO: 1901698 - RNA, 21 nt, Human
ccaggcugggucgcccuggac

SEQ ID NO: 1901699 - RNA, 22 nt, Human
ccaggcugggucgcccuggacu

SEQ ID NO: 1901700 - RNA, 23 nt, Human
ccaggcugggucgcccuggacug

SEQ ID NO: 1901701 - RNA, 24 nt, Human
ccaggcugggucgcccuggacugu

SEQ ID NO: 1901702 - RNA, 12 nt, Human
ccaggcuggguc

SEQ ID NO: 1901703 - RNA, 16 nt, Human
ccaggcugggucgccc

SEQ ID NO: 1901704 - RNA, 15 nt, Human
ccaggcccucugccc

SEQ ID NO: 1901705 - RNA, 16 nt, Human
ccaggcccucugccca

SEQ ID NO: 1901706 - RNA, 23 nt, Human
ccaggcugggagagccuuccagg

SEQ ID NO: 1901707 - RNA, 14 nt, Human
ccacuguuaucaaa

SEQ ID NO: 1901708 - RNA, 16 nt, Human
ccacugugccaugugc

SEQ ID NO: 1901709 - RNA, 15 nt, Human
ccacugugccaugug

SEQ ID NO: 1901710 - RNA, 19 nt, Human
ccacugugccaugugccag

SEQ ID NO: 1901711 - RNA, 18 nt, Human
ccagaaaccuuuguuugc

SEQ ID NO: 1901712 - RNA, 22 nt, Human
ccagaagaaaauagugguguga

SEQ ID NO: 1901713 - RNA, 24 nt, Human
ccagaaacuguucccaccugcugg

SEQ ID NO: 1901714 - RNA, 19 nt, Human
ccagaacucacuggggccu

SEQ ID NO: 1901715 - RNA, 21 nt, Human
ccagaaugcuguacaucuauu

SEQ ID NO: 1901716 - RNA, 13 nt, Human
ccacuggacugac

SEQ ID NO: 1901717 - RNA, 22 nt, Human
ccacugcuuuuggucuguguga

SEQ ID NO: 1901718 - RNA, 20 nt, Human
ccacugcuuuuggucugugu

SEQ ID NO: 1901719 - RNA, 15 nt, Human
ccacugcucugguua

SEQ ID NO: 1901720 - RNA, 13 nt, Human
ccacugcucuggu

SEQ ID NO: 1901721 - RNA, 12 nt, Human
ccacugcucugg

SEQ ID NO: 1901722 - RNA, 11 nt, Human
ccacugcucug

SEQ ID NO: 1901723 - RNA, 14 nt, Human
ccacugugaagaga

SEQ ID NO: 1901724 - RNA, 15 nt, Human
ccacugugaagagaa

SEQ ID NO: 1901725 - RNA, 15 nt, Human
ccacuguccugggcc

SEQ ID NO: 1901726 - RNA, 19 nt, Human
ccacuguccugggccugca

SEQ ID NO: 1901727 - RNA, 20 nt, Human
ccacuguccugggccugcag

SEQ ID NO: 1901728 - RNA, 21 nt, Human
ccacuguccugggccugcaga

SEQ ID NO: 1901729 - RNA, 23 nt, Human
ccacuggugacaugucuuuucuu

SEQ ID NO: 1901730 - RNA, 18 nt, Human
ccacugggguccagggag

SEQ ID NO: 1901731 - RNA, 19 nt, Human
ccacugggguccagggagc

SEQ ID NO: 1901732 - RNA, 22 nt, Human
ccacugggguccagggagcagg

SEQ ID NO: 1901733 - RNA, 15 nt, Human
ccacugguucuucuu

SEQ ID NO: 1901734 - RNA, 19 nt, Human
ccacugcauaccaaccugg

SEQ ID NO: 1901735 - RNA, 18 nt, Human
ccacugcauaccaaccug

SEQ ID NO: 1901736 - RNA, 21 nt, Human
ccacugcaucguuucaucuuc

SEQ ID NO: 1901737 - RNA, 23 nt, Human
ccacugcaucguuucaucuucca

SEQ ID NO: 1901738 - RNA, 14 nt, Human
ccagaaggagacag

SEQ ID NO: 1901739 - RNA, 17 nt, Human
ccagaaggagacaggca

SEQ ID NO: 1901740 - RNA, 18 nt, Human
ccagaaggagacaggcag

SEQ ID NO: 1901741 - RNA, 16 nt, Human
ccagaaugcuguacau

SEQ ID NO: 1901742 - RNA, 17 nt, Human
ccagaaugcuguacauc

SEQ ID NO: 1901743 - RNA, 19 nt, Human
ccagacacaggcccucccu

SEQ ID NO: 1901744 - RNA, 15 nt, Human
ccagaaugaggcugc

SEQ ID NO: 1901745 - RNA, 14 nt, Human
ccagacaucaacag

SEQ ID NO: 1901746 - RNA, 14 nt, Human
ccagacaugccaca

SEQ ID NO: 1901747 - RNA, 20 nt, Human
ccagacaugccacaaggacu

SEQ ID NO: 1901748 - RNA, 22 nt, Human
ccagacacauguccaagaagcc

SEQ ID NO: 1901749 - RNA, 13 nt, Human
ccagacacccagg

SEQ ID NO: 1901750 - RNA, 15 nt, Human
ccagacacaggcccu

SEQ ID NO: 1901751 - RNA, 17 nt, Human
ccagacacauguccaag

SEQ ID NO: 1901752 - RNA, 20 nt, Human
ccagacacauguccaagaag

SEQ ID NO: 1901753 - RNA, 15 nt, Human
ccagacccggcugcg

SEQ ID NO: 1901754 - RNA, 14 nt, Human
ccagacccggcugc

SEQ ID NO: 1901755 - RNA, 16 nt, Human
ccagacccggcugcgu

SEQ ID NO: 1901756 - RNA, 13 nt, Human
ccagagauccaaa

SEQ ID NO: 1901757 - RNA, 11 nt, Human
ccagagccagg

SEQ ID NO: 1901758 - RNA, 12 nt, Human
ccagagccaggg

SEQ ID NO: 1901759 - RNA, 22 nt, Human
ccagagccaggggggugaggag

SEQ ID NO: 1901760 - RNA, 23 nt, Human
ccagagccaggggggugaggagc

SEQ ID NO: 1901761 - RNA, 12 nt, Human
ccacccugcucu

SEQ ID NO: 1901762 - RNA, 11 nt, Human
ccacccugcuc

SEQ ID NO: 1901763 - RNA, 14 nt, Human
ccaccucccugccu

SEQ ID NO: 1901764 - RNA, 16 nt, Human
ccaccucccugccucc

SEQ ID NO: 1901765 - RNA, 18 nt, Human
ccaccucccugccuccag

SEQ ID NO: 1901766 - RNA, 14 nt, Human
ccaccucucucacu

SEQ ID NO: 1901767 - RNA, 16 nt, Human
ccaccucucucacucc

SEQ ID NO: 1901768 - RNA, 19 nt, Human
ccaccucucucacuccuug

SEQ ID NO: 1901769 - RNA, 20 nt, Human
ccaccucucucacuccuuga

SEQ ID NO: 1901770 - RNA, 16 nt, Human
ccaccucucccugacc

SEQ ID NO: 1901771 - RNA, 17 nt, Human
ccaccucucccugaccc

SEQ ID NO: 1901772 - RNA, 18 nt, Human
ccaccucucccugacccu

SEQ ID NO: 1901773 - RNA, 13 nt, Human
ccaccuggccucu

SEQ ID NO: 1901774 - RNA, 18 nt, Human
ccaccuggccucugcacu

SEQ ID NO: 1901775 - RNA, 20 nt, Human
ccaccuggccucugcacucc

SEQ ID NO: 1901776 - RNA, 13 nt, Human
ccaccugccaggg

SEQ ID NO: 1901777 - RNA, 14 nt, Human
ccaccugccaggga

SEQ ID NO: 1901778 - RNA, 15 nt, Human
ccaccugccagggac

SEQ ID NO: 1901779 - RNA, 14 nt, Human
ccacccuccuuuca

SEQ ID NO: 1901780 - RNA, 17 nt, Human
ccaccccugggggcucu

SEQ ID NO: 1901781 - RNA, 20 nt, Human
ccaccccugggggcucucau

SEQ ID NO: 1901782 - RNA, 19 nt, Human
ccacccccacccaagggcc

SEQ ID NO: 1901783 - RNA, 19 nt, Human
ccacccccaggaccccuga

SEQ ID NO: 1901784 - RNA, 18 nt, Human
ccacccccaggaccccug

SEQ ID NO: 1901785 - RNA, 16 nt, Human
ccacccccaggacccc

SEQ ID NO: 1901786 - RNA, 13 nt, Human
ccaccuuggcuca

SEQ ID NO: 1901787 - RNA, 20 nt, Human
ccagccgugagugcagaccc

SEQ ID NO: 1901788 - RNA, 17 nt, Human
ccagccgagauagccaa

SEQ ID NO: 1901789 - RNA, 20 nt, Human
ccagccgagauagccaaggc

SEQ ID NO: 1901790 - RNA, 22 nt, Human
ccagccgagauagccaaggcca

SEQ ID NO: 1901791 - RNA, 19 nt, Human
ccagccccaaaacucuccu

SEQ ID NO: 1901792 - RNA, 18 nt, Human
ccagcccugaguuccuag

SEQ ID NO: 1901793 - RNA, 14 nt, Human
ccagcccugaguuc

SEQ ID NO: 1901794 - RNA, 17 nt, Human
ccagcccacuucugcca

SEQ ID NO: 1901795 - RNA, 16 nt, Human
ccagcccacuucugcc

SEQ ID NO: 1901796 - RNA, 11 nt, Human
ccagcccagag

SEQ ID NO: 1901797 - RNA, 12 nt, Human
ccagcccagaga

SEQ ID NO: 1901798 - RNA, 13 nt, Human
ccagcccagagac

SEQ ID NO: 1901799 - RNA, 14 nt, Human
ccagcccagagaca

SEQ ID NO: 1901800 - RNA, 22 nt, Human
ccagcccagagacauacuugaa

SEQ ID NO: 1901801 - RNA, 23 nt, Human
ccagcccagagacauacuugaag

SEQ ID NO: 1901802 - RNA, 19 nt, Human
ccagcaggcucucaggcca

SEQ ID NO: 1901803 - RNA, 20 nt, Human
ccagcaggcucucaggccag

SEQ ID NO: 1901804 - RNA, 21 nt, Human
ccagcaggcucucaggccagc

SEQ ID NO: 1901805 - RNA, 23 nt, Human
ccagcaggcucucaggccagcug

SEQ ID NO: 1901806 - RNA, 16 nt, Human
ccagccaucaaaaugc

SEQ ID NO: 1901807 - RNA, 18 nt, Human
ccagccaucaaaaugcuu

SEQ ID NO: 1901808 - RNA, 14 nt, Human
ccagccaugucugc

SEQ ID NO: 1901809 - RNA, 16 nt, Human
ccagccaugucugcau

SEQ ID NO: 1901810 - RNA, 17 nt, Human
ccagccaugucugcauu

SEQ ID NO: 1901811 - RNA, 18 nt, Human
ccagccaugucugcauuu

SEQ ID NO: 1901812 - RNA, 18 nt, Human
ccagcuccucacucaccu

SEQ ID NO: 1901813 - RNA, 20 nt, Human
ccagcuccggccuguccucc

SEQ ID NO: 1901814 - RNA, 18 nt, Human
ccagcuccggccuguccu

SEQ ID NO: 1901815 - RNA, 19 nt, Human
ccagcuccggccuguccuc

SEQ ID NO: 1901816 - RNA, 13 nt, Human
ccagcgagcccug

SEQ ID NO: 1901817 - RNA, 16 nt, Human
ccagcucccucuauuu

SEQ ID NO: 1901818 - RNA, 23 nt, Human
ccagccuugaccauucuccaccu

SEQ ID NO: 1901819 - RNA, 13 nt, Human
ccagccugggguc

SEQ ID NO: 1901820 - RNA, 13 nt, Human
ccagccuggguga

SEQ ID NO: 1901821 - RNA, 19 nt, Human
ccagccugagcgacaguga

SEQ ID NO: 1901822 - RNA, 10 nt, Human
ccagccugcc

SEQ ID NO: 1901823 - RNA, 17 nt, Human
ccagcaccaucucuccu

SEQ ID NO: 1901824 - RNA, 18 nt, Human
ccagcaccaucucuccuc

SEQ ID NO: 1901825 - RNA, 16 nt, Human
ccagcaggcucucagg

SEQ ID NO: 1901826 - RNA, 17 nt, Human
ccagcaggcucucaggc

SEQ ID NO: 1901827 - RNA, 18 nt, Human
ccagcaggcucucaggcc

SEQ ID NO: 1901828 - RNA, 19 nt, Human
ccagcaagugagagcuggg

SEQ ID NO: 1901829 - RNA, 18 nt, Human
ccagcaagugagagcugg

SEQ ID NO: 1901830 - RNA, 17 nt, Human
ccagcaagugagagcug

SEQ ID NO: 1901831 - RNA, 16 nt, Human
ccagcacacagggcag

SEQ ID NO: 1901832 - RNA, 15 nt, Human
ccagauuuugcugua

SEQ ID NO: 1901833 - RNA, 14 nt, Human
ccagauuuaaauaa

SEQ ID NO: 1901834 - RNA, 18 nt, Human
ccagauuuugcuguauau

SEQ ID NO: 1901835 - RNA, 22 nt, Human
ccagauugcaacaggcugggcu

SEQ ID NO: 1901836 - RNA, 18 nt, Human
ccagauugcaacaggcug

SEQ ID NO: 1901837 - RNA, 23 nt, Human
ccagauugcaacaggcugggcuu

SEQ ID NO: 1901838 - RNA, 16 nt, Human
ccagauuggcucacac

SEQ ID NO: 1901839 - RNA, 18 nt, Human
ccagauuucacucuccuu

SEQ ID NO: 1901840 - RNA, 19 nt, Human
ccagauuucacucuccuug

SEQ ID NO: 1901841 - RNA, 15 nt, Human
ccagauuucacucuc

SEQ ID NO: 1901842 - RNA, 22 nt, Human
ccagauuggcucacacugagaa

SEQ ID NO: 1901843 - RNA, 21 nt, Human
ccagauuggcucacacugaga

SEQ ID NO: 1901844 - RNA, 20 nt, Human
ccagauuggcucacacugag

SEQ ID NO: 1901845 - RNA, 19 nt, Human
ccagauuggcucacacuga

SEQ ID NO: 1901846 - RNA, 16 nt, Human
ccagauugcaacaggc

SEQ ID NO: 1901847 - RNA, 14 nt, Human
ccagauugcaacag

SEQ ID NO: 1901848 - RNA, 14 nt, Human
ccagagcccaccuu

SEQ ID NO: 1901849 - RNA, 17 nt, Human
ccagagcccagcuccaa

SEQ ID NO: 1901850 - RNA, 18 nt, Human
ccagagcccagcuccaag

SEQ ID NO: 1901851 - RNA, 23 nt, Human
ccagagccucaaaugagaaaaug

SEQ ID NO: 1901852 - RNA, 20 nt, Human
ccagagccucaaaugagaaa

SEQ ID NO: 1901853 - RNA, 16 nt, Human
ccagagcccagcucca

SEQ ID NO: 1901854 - RNA, 16 nt, Human
ccccuucauccucuga

SEQ ID NO: 1901855 - RNA, 13 nt, Human
ccccuuccaugga

SEQ ID NO: 1901856 - RNA, 20 nt, Human
ccccuuccauggacuuuguu

SEQ ID NO: 1901857 - RNA, 22 nt, Human
ccccuggcugggacguggcuca

SEQ ID NO: 1901858 - RNA, 23 nt, Human
ccccuggcugggacguggcucag

SEQ ID NO: 1901859 - RNA, 20 nt, Human
ccccuggcuccaggccaggg

SEQ ID NO: 1901860 - RNA, 14 nt, Human
ccccuggccucugu

SEQ ID NO: 1901861 - RNA, 12 nt, Human
ccccuggugguu

SEQ ID NO: 1901862 - RNA, 18 nt, Human
cccgacgccacagcccag

SEQ ID NO: 1901863 - RNA, 23 nt, Human
cccgacgccacagcccagccacg

SEQ ID NO: 1901864 - RNA, 15 nt, Human
cccgacgccacagcc

SEQ ID NO: 1901865 - RNA, 13 nt, Human
cccgagccuggcu

SEQ ID NO: 1901866 - RNA, 15 nt, Human
cccgagccuggcucc

SEQ ID NO: 1901867 - RNA, 20 nt, Human
cccgcccaggcuuagucacu

SEQ ID NO: 1901868 - RNA, 22 nt, Human
cccgcccaggcuuagucacuga

SEQ ID NO: 1901869 - RNA, 23 nt, Human
cccgcuaagagggagggagggcu

SEQ ID NO: 1901870 - RNA, 19 nt, Human
cccgcagugugcacuaagg

SEQ ID NO: 1901871 - RNA, 22 nt, Human
cccgcagugugcacuaaggggc

SEQ ID NO: 1901872 - RNA, 14 nt, Human
cccgcauccccugc

SEQ ID NO: 1901873 - RNA, 15 nt, Human
cccgcauccccugcc

SEQ ID NO: 1901874 - RNA, 16 nt, Human
cccgcauccccugccu

SEQ ID NO: 1901875 - RNA, 17 nt, Human
cccgcauccccugccuc

SEQ ID NO: 1901876 - RNA, 18 nt, Human
cccgcauccccugccucc

SEQ ID NO: 1901877 - RNA, 19 nt, Human
cccgcauccccugccucca

SEQ ID NO: 1901878 - RNA, 20 nt, Human
cccgcauccccugccuccau

SEQ ID NO: 1901879 - RNA, 18 nt, Human
ccccuggaugcagccuca

SEQ ID NO: 1901880 - RNA, 19 nt, Human
ccccuggaugcagccucac

SEQ ID NO: 1901881 - RNA, 12 nt, Human
ccccuggccucu

SEQ ID NO: 1901882 - RNA, 15 nt, Human
ccccuggaugcagcc

SEQ ID NO: 1901883 - RNA, 20 nt, Human
ccccugcugguucaggguug

SEQ ID NO: 1901884 - RNA, 15 nt, Human
ccccugcugguucag

SEQ ID NO: 1901885 - RNA, 13 nt, Human
ccccugcugguuc

SEQ ID NO: 1901886 - RNA, 11 nt, Human
ccccugcuggu

SEQ ID NO: 1901887 - RNA, 14 nt, Human
ccccugcugggugu

SEQ ID NO: 1901888 - RNA, 17 nt, Human
ccccugcuggguguggc

SEQ ID NO: 1901889 - RNA, 19 nt, Human
ccccugcccggcugcggaa

SEQ ID NO: 1901890 - RNA, 17 nt, Human
ccccugcccggcugcgg

SEQ ID NO: 1901891 - RNA, 23 nt, Human
ccccugcccuccccucucugcac

SEQ ID NO: 1901892 - RNA, 14 nt, Human
ccccugccucucug

SEQ ID NO: 1901893 - RNA, 15 nt, Human
ccccugccucucugc

SEQ ID NO: 1901894 - RNA, 16 nt, Human
ccccugccucucugca

SEQ ID NO: 1901895 - RNA, 17 nt, Human
ccccugccucucugcag

SEQ ID NO: 1901896 - RNA, 19 nt, Human
ccccugccucucugcaggu

SEQ ID NO: 1901897 - RNA, 15 nt, Human
ccccugccuccaucc

SEQ ID NO: 1901898 - RNA, 16 nt, Human
ccccugccuccauccu

SEQ ID NO: 1901899 - RNA, 15 nt, Human
cccgccaaaagcugc

SEQ ID NO: 1901900 - RNA, 18 nt, Human
ccccuccuccacucuccc

SEQ ID NO: 1901901 - RNA, 15 nt, Human
ccccuccuccacucu

SEQ ID NO: 1901902 - RNA, 12 nt, Human
ccccuccuccac

SEQ ID NO: 1901903 - RNA, 19 nt, Human
ccccucuccuuccugugug

SEQ ID NO: 1901904 - RNA, 14 nt, Human
ccccucuccuuccu

SEQ ID NO: 1901905 - RNA, 21 nt, Human
ccccucgcuuggacggcuggg

SEQ ID NO: 1901906 - RNA, 13 nt, Human
ccccuccuucaga

SEQ ID NO: 1901907 - RNA, 12 nt, Human
ccccuccaugug

SEQ ID NO: 1901908 - RNA, 12 nt, Human
ccccucccuuuc

SEQ ID NO: 1901909 - RNA, 15 nt, Human
ccccucccuuucucc

SEQ ID NO: 1901910 - RNA, 16 nt, Human
ccccucagggucccug

SEQ ID NO: 1901911 - RNA, 20 nt, Human
ccccucaucucucugcccaa

SEQ ID NO: 1901912 - RNA, 14 nt, Human
ccccuccaaccugg

SEQ ID NO: 1901913 - RNA, 13 nt, Human
ccccuccaccugc

SEQ ID NO: 1901914 - RNA, 17 nt, Human
cccccugacaacacuca

SEQ ID NO: 1901915 - RNA, 19 nt, Human
cccccugacaacacucauu

SEQ ID NO: 1901916 - RNA, 12 nt, Human
cccccagccugc

SEQ ID NO: 1901917 - RNA, 13 nt, Human
cccccagcuaaga

SEQ ID NO: 1901918 - RNA, 18 nt, Human
cccccagcuaagaaccug

SEQ ID NO: 1901919 - RNA, 21 nt, Human
cccccagcuaagaaccuggaa

SEQ ID NO: 1901920 - RNA, 15 nt, Human
cccccagcuccggcc

SEQ ID NO: 1901921 - RNA, 16 nt, Human
ccccucaacaccucug

SEQ ID NO: 1901922 - RNA, 23 nt, Human
ccccucaacucuccuccagaguc

SEQ ID NO: 1901923 - RNA, 15 nt, Human
ccccucaacaccucu

SEQ ID NO: 1901924 - RNA, 20 nt, Human
ccccagugcccacaggauca

SEQ ID NO: 1901925 - RNA, 16 nt, Human
ccccagugcccacagg

SEQ ID NO: 1901926 - RNA, 15 nt, Human
ccccagugcccacag

SEQ ID NO: 1901927 - RNA, 14 nt, Human
ccccagugcccaca

SEQ ID NO: 1901928 - RNA, 13 nt, Human
ccccaggcugaag

SEQ ID NO: 1901929 - RNA, 15 nt, Human
cccccacuggugaca

SEQ ID NO: 1901930 - RNA, 11 nt, Human
cccccacuggu

SEQ ID NO: 1901931 - RNA, 13 nt, Human
cccccacugguga

SEQ ID NO: 1901932 - RNA, 12 nt, Human
cccccacccccu

SEQ ID NO: 1901933 - RNA, 22 nt, Human
cccccaccucucccugacccug

SEQ ID NO: 1901934 - RNA, 17 nt, Human
ccccaucauugguaccc

SEQ ID NO: 1901935 - RNA, 12 nt, Human
ccccauccucca

SEQ ID NO: 1901936 - RNA, 14 nt, Human
ccccauccucugua

SEQ ID NO: 1901937 - RNA, 15 nt, Human
ccccauccuccagca

SEQ ID NO: 1901938 - RNA, 24 nt, Human
cccccacccaagggccuggccuga

SEQ ID NO: 1901939 - RNA, 13 nt, Human
cccccacccaagg

SEQ ID NO: 1901940 - RNA, 20 nt, Human
ccccagacuccaccaagccu

SEQ ID NO: 1901941 - RNA, 14 nt, Human
cccaugagccucag

SEQ ID NO: 1901942 - RNA, 12 nt, Human
cccaucugugaa

SEQ ID NO: 1901943 - RNA, 22 nt, Human
cccaugagccucagcauccugg

SEQ ID NO: 1901944 - RNA, 23 nt, Human
cccaugaguuggggucuggcagc

SEQ ID NO: 1901945 - RNA, 12 nt, Human
cccaugcacugu

SEQ ID NO: 1901946 - RNA, 14 nt, Human
cccaugcacuguga

SEQ ID NO: 1901947 - RNA, 16 nt, Human
cccaugcacugugaag

SEQ ID NO: 1901948 - RNA, 18 nt, Human
cccaugcacugugaagga

SEQ ID NO: 1901949 - RNA, 19 nt, Human
cccaugcacugugaaggac

SEQ ID NO: 1901950 - RNA, 20 nt, Human
cccaugcacugugaaggacc

SEQ ID NO: 1901951 - RNA, 22 nt, Human
cccaugcacugugaaggacccu

SEQ ID NO: 1901952 - RNA, 15 nt, Human
cccauggacaggcug

SEQ ID NO: 1901953 - RNA, 20 nt, Human
cccauggacaggcuggcucc

SEQ ID NO: 1901954 - RNA, 22 nt, Human
cccauggacaggcuggcuccag

SEQ ID NO: 1901955 - RNA, 19 nt, Human
cccaucucuacaaaaagca

SEQ ID NO: 1901956 - RNA, 14 nt, Human
cccaguugggugga

SEQ ID NO: 1901957 - RNA, 22 nt, Human
cccaucucaugccccuggcugg

SEQ ID NO: 1901958 - RNA, 21 nt, Human
cccaucucaugccccuggcug

SEQ ID NO: 1901959 - RNA, 18 nt, Human
cccagaaugccuccugca

SEQ ID NO: 1901960 - RNA, 17 nt, Human
cccagaaugaggcugcu

SEQ ID NO: 1901961 - RNA, 22 nt, Human
cccagagaaaggggagcccacu

SEQ ID NO: 1901962 - RNA, 21 nt, Human
cccagagaaagcgcagaugcu

SEQ ID NO: 1901963 - RNA, 18 nt, Human
cccagagacauacuugaa

SEQ ID NO: 1901964 - RNA, 21 nt, Human
cccagagacauacuugaaggg

SEQ ID NO: 1901965 - RNA, 22 nt, Human
cccagagacauacuugaagggc

SEQ ID NO: 1901966 - RNA, 23 nt, Human
cccagagacauacuugaagggcc

SEQ ID NO: 1901967 - RNA, 15 nt, Human
ccccaccgcagacag

SEQ ID NO: 1901968 - RNA, 20 nt, Human
ccccacccuggugggccaac

SEQ ID NO: 1901969 - RNA, 19 nt, Human
ccccaccgcagacaggacc

SEQ ID NO: 1901970 - RNA, 12 nt, Human
ccccaccucucc

SEQ ID NO: 1901971 - RNA, 17 nt, Human
ccccaccucucccugac

SEQ ID NO: 1901972 - RNA, 21 nt, Human
ccccacccaagggccuggccu

SEQ ID NO: 1901973 - RNA, 13 nt, Human
ccccaccccauuu

SEQ ID NO: 1901974 - RNA, 12 nt, Human
ccccacccucau

SEQ ID NO: 1901975 - RNA, 12 nt, Human
cccauuccugaa

SEQ ID NO: 1901976 - RNA, 13 nt, Human
cccauuccugaag

SEQ ID NO: 1901977 - RNA, 18 nt, Human
cccauuccugaagaacca

SEQ ID NO: 1901978 - RNA, 13 nt, Human
ccccaaucccagc

SEQ ID NO: 1901979 - RNA, 15 nt, Human
ccccaauaauugcag

SEQ ID NO: 1901980 - RNA, 21 nt, Human
ccgacgccacagcccagccac

SEQ ID NO: 1901981 - RNA, 18 nt, Human
ccgacgccacagcccagc

SEQ ID NO: 1901982 - RNA, 21 nt, Human
ccgagauugcaccacugcacu

SEQ ID NO: 1901983 - RNA, 15 nt, Human
ccgagauugcaccac

SEQ ID NO: 1901984 - RNA, 19 nt, Human
ccgagauugcaccacugca

SEQ ID NO: 1901985 - RNA, 21 nt, Human
ccgaggaaacgaaacccacuc

SEQ ID NO: 1901986 - RNA, 19 nt, Human
ccgagcuuugaaaauucag

SEQ ID NO: 1901987 - RNA, 16 nt, Human
ccgaguagcugggacu

SEQ ID NO: 1901988 - RNA, 14 nt, Human
ccgaguagcuggga

SEQ ID NO: 1901989 - RNA, 15 nt, Human
ccgcagacaggacca

SEQ ID NO: 1901990 - RNA, 23 nt, Human
ccgcacugggcuuggggaccaga

SEQ ID NO: 1901991 - RNA, 15 nt, Human
ccgaguccaagcugg

SEQ ID NO: 1901992 - RNA, 20 nt, Human
ccgggcagggcucccacaga

SEQ ID NO: 1901993 - RNA, 12 nt, Human
ccgggcagaggg

SEQ ID NO: 1901994 - RNA, 15 nt, Human
ccgggcagaggggca

SEQ ID NO: 1901995 - RNA, 13 nt, Human
ccgggccacagag

SEQ ID NO: 1901996 - RNA, 22 nt, Human
ccgggcacucagaagacacuga

SEQ ID NO: 1901997 - RNA, 21 nt, Human
ccggcuccaggcuccuuuagc

SEQ ID NO: 1901998 - RNA, 16 nt, Human
ccggcuccaggcuccu

SEQ ID NO: 1901999 - RNA, 18 nt, Human
ccgugaggccagagacac

SEQ ID NO: 1902000 - RNA, 20 nt, Human
ccggggugcccacaggccgc

SEQ ID NO: 1902001 - RNA, 18 nt, Human
ccgggcucugccucccau

SEQ ID NO: 1902002 - RNA, 13 nt, Human
ccgggcucugccu

SEQ ID NO: 1902003 - RNA, 14 nt, Human
ccgggcucugccuc

SEQ ID NO: 1902004 - RNA, 15 nt, Human
ccgggcucugccucc

SEQ ID NO: 1902005 - RNA, 14 nt, Human
ccgcuggggccagu

SEQ ID NO: 1902006 - RNA, 11 nt, Human
ccgcuggggcc

SEQ ID NO: 1902007 - RNA, 17 nt, Human
ccgccuccuacagccca

SEQ ID NO: 1902008 - RNA, 14 nt, Human
ccgccugguacuca

SEQ ID NO: 1902009 - RNA, 22 nt, Human
ccgccuggaugcggauggccgg

SEQ ID NO: 1902010 - RNA, 20 nt, Human
ccuacaguguacagucuugu

SEQ ID NO: 1902011 - RNA, 16 nt, Human
ccuacaguguacaguc

SEQ ID NO: 1902012 - RNA, 21 nt, Human
ccuacaguugaaaaacagcug

SEQ ID NO: 1902013 - RNA, 18 nt, Human
ccuaggugacagagugag

SEQ ID NO: 1902014 - RNA, 15 nt, Human
ccuaggccaggugca

SEQ ID NO: 1902015 - RNA, 18 nt, Human
ccuaggccucagccagag

SEQ ID NO: 1902016 - RNA, 19 nt, Human
ccuaggccucagccagaga

SEQ ID NO: 1902017 - RNA, 20 nt, Human
ccuaggccucagccagagaa

SEQ ID NO: 1902018 - RNA, 14 nt, Human
ccuaggccucagcc

SEQ ID NO: 1902019 - RNA, 11 nt, Human
ccuaggccagg

SEQ ID NO: 1902020 - RNA, 12 nt, Human
ccuaggccaggu

SEQ ID NO: 1902021 - RNA, 22 nt, Human
ccgggucaucuguaccucugcc

SEQ ID NO: 1902022 - RNA, 15 nt, Human
ccuacaguguacagu

SEQ ID NO: 1902023 - RNA, 18 nt, Human
ccuacaggagugagcacu

SEQ ID NO: 1902024 - RNA, 15 nt, Human
ccuaacgaaguaucc

SEQ ID NO: 1902025 - RNA, 19 nt, Human
cccuguuuguuucugaaag

SEQ ID NO: 1902026 - RNA, 17 nt, Human
cccuuaccugccaggaa

SEQ ID NO: 1902027 - RNA, 20 nt, Human
cccuuaccugccaggaagcc

SEQ ID NO: 1902028 - RNA, 23 nt, Human
cccuuaccugccaggaagccagc

SEQ ID NO: 1902029 - RNA, 13 nt, Human
cccuguucuggca

SEQ ID NO: 1902030 - RNA, 14 nt, Human
cccuguucuggcag

SEQ ID NO: 1902031 - RNA, 14 nt, Human
cccuguuccccaga

SEQ ID NO: 1902032 - RNA, 16 nt, Human
cccuguuccccagaga

SEQ ID NO: 1902033 - RNA, 17 nt, Human
cccuguuccccagagaa

SEQ ID NO: 1902034 - RNA, 15 nt, Human
cccuguauauagccc

SEQ ID NO: 1902035 - RNA, 17 nt, Human
cccuguauauagcccag

SEQ ID NO: 1902036 - RNA, 18 nt, Human
cccuguauauagcccagc

SEQ ID NO: 1902037 - RNA, 15 nt, Human
cccugguggcagugg

SEQ ID NO: 1902038 - RNA, 14 nt, Human
cccugguggcagug

SEQ ID NO: 1902039 - RNA, 13 nt, Human
cccugguggcagu

SEQ ID NO: 1902040 - RNA, 21 nt, Human
cccugguggcagcucaccucu

SEQ ID NO: 1902041 - RNA, 21 nt, Human
cccuggugaccagcaccaucu

SEQ ID NO: 1902042 - RNA, 22 nt, Human
cccuggugagagggccgggcag

SEQ ID NO: 1902043 - RNA, 14 nt, Human
cccuuagcagggaa

SEQ ID NO: 1902044 - RNA, 15 nt, Human
cccuuacgugagucc

SEQ ID NO: 1902045 - RNA, 17 nt, Human
cccuuacgugaguccug

SEQ ID NO: 1902046 - RNA, 23 nt, Human
cccuuagcagggaaacagcuaau

SEQ ID NO: 1902047 - RNA, 12 nt, Human
cccuuccaugga

SEQ ID NO: 1902048 - RNA, 13 nt, Human
cccuuccaggggu

SEQ ID NO: 1902049 - RNA, 13 nt, Human
cccuucacaaagc

SEQ ID NO: 1902050 - RNA, 18 nt, Human
cccuucacaaagcccaag

SEQ ID NO: 1902051 - RNA, 20 nt, Human
cccuucacaaagcccaaggg

SEQ ID NO: 1902052 - RNA, 14 nt, Human
cccuugagaaaccu

SEQ ID NO: 1902053 - RNA, 22 nt, Human
cccuugagaaaccuuauuguac

SEQ ID NO: 1902054 - RNA, 22 nt, Human
cccuugaggaaacaacagcuuu

SEQ ID NO: 1902055 - RNA, 13 nt, Human
cccuucccucacc

SEQ ID NO: 1902056 - RNA, 21 nt, Human
cccugcucuccgaccagacac

SEQ ID NO: 1902057 - RNA, 22 nt, Human
cccugcucuccgaccagacacc

SEQ ID NO: 1902058 - RNA, 15 nt, Human
cccugccucucugca

SEQ ID NO: 1902059 - RNA, 22 nt, Human
cccugcgggugaacaaagcagc

SEQ ID NO: 1902060 - RNA, 17 nt, Human
cccugcgguagauggga

SEQ ID NO: 1902061 - RNA, 19 nt, Human
cccugcuccagaagauagc

SEQ ID NO: 1902062 - RNA, 12 nt, Human
cccugaggccca

SEQ ID NO: 1902063 - RNA, 20 nt, Human
cccugaggcagguccccaga

SEQ ID NO: 1902064 - RNA, 18 nt, Human
cccugaggcaggucccca

SEQ ID NO: 1902065 - RNA, 17 nt, Human
cccugaggcaggucccc

SEQ ID NO: 1902066 - RNA, 21 nt, Human
cccugaggcagguccccagac

SEQ ID NO: 1902067 - RNA, 13 nt, Human
cccugccucucug

SEQ ID NO: 1902068 - RNA, 14 nt, Human
cccugccucucugc

SEQ ID NO: 1902069 - RNA, 11 nt, Human
cccugccuccu

SEQ ID NO: 1902070 - RNA, 16 nt, Human
cccugccucaggccuc

SEQ ID NO: 1902071 - RNA, 21 nt, Human
cccugccucaggccucugugc

SEQ ID NO: 1902072 - RNA, 12 nt, Human
cccugccuccau

SEQ ID NO: 1902073 - RNA, 13 nt, Human
cccugccuccauc

SEQ ID NO: 1902074 - RNA, 18 nt, Human
cccugccuccauccuagu

SEQ ID NO: 1902075 - RNA, 21 nt, Human
cccugcaucugaccagcagcg

SEQ ID NO: 1902076 - RNA, 16 nt, Human
cccugcaucugaccag

SEQ ID NO: 1902077 - RNA, 18 nt, Human
cccugcaucugaccagca

SEQ ID NO: 1902078 - RNA, 19 nt, Human
cccugcaucugaccagcag

SEQ ID NO: 1902079 - RNA, 11 nt, Human
cccucugccca

SEQ ID NO: 1902080 - RNA, 14 nt, Human
cccucuccuuccug

SEQ ID NO: 1902081 - RNA, 15 nt, Human
cccucugcccacucc

SEQ ID NO: 1902082 - RNA, 18 nt, Human
cccucugcccacucccug

SEQ ID NO: 1902083 - RNA, 19 nt, Human
cccucugcccacucccugc

SEQ ID NO: 1902084 - RNA, 17 nt, Human
cccucuccuuccugugu

SEQ ID NO: 1902085 - RNA, 13 nt, Human
cccucugccccau

SEQ ID NO: 1902086 - RNA, 12 nt, Human
cccucuuucccu

SEQ ID NO: 1902087 - RNA, 17 nt, Human
cccucuuucccucccuu

SEQ ID NO: 1902088 - RNA, 20 nt, Human
cccucuuucccucccuuccu

SEQ ID NO: 1902089 - RNA, 18 nt, Human
cccucugccccauccucc

SEQ ID NO: 1902090 - RNA, 15 nt, Human
cccucugccccaucc

SEQ ID NO: 1902091 - RNA, 14 nt, Human
cccucccacagcgc

SEQ ID NO: 1902092 - RNA, 12 nt, Human
cccucccacagc

SEQ ID NO: 1902093 - RNA, 23 nt, Human
cccucccucuuucccucccuucc

SEQ ID NO: 1902094 - RNA, 14 nt, Human
cuaaaugaauguuu

SEQ ID NO: 1902095 - RNA, 12 nt, Human
cuaaaugaaugu

SEQ ID NO: 1902096 - RNA, 16 nt, Human
cuaaauucaugcugcu

SEQ ID NO: 1902097 - RNA, 19 nt, Human
cuaaauugacacuuaaaaa

SEQ ID NO: 1902098 - RNA, 19 nt, Human
cuaaauucuuucauuuuag

SEQ ID NO: 1902099 - RNA, 23 nt, Human
cuaacauauaauguuguuauuua

SEQ ID NO: 1902100 - RNA, 22 nt, Human
cuaacauauaauguuguuauuu

SEQ ID NO: 1902101 - RNA, 12 nt, Human
cuaacauauaau

SEQ ID NO: 1902102 - RNA, 17 nt, Human
cuaacagcucaggaucu

SEQ ID NO: 1902103 - RNA, 14 nt, Human
cuaaccacgcugga

SEQ ID NO: 1902104 - RNA, 12 nt, Human
cuaaccacgcug

SEQ ID NO: 1902105 - RNA, 13 nt, Human
cuaagagggaggg

SEQ ID NO: 1902106 - RNA, 15 nt, Human
cuaagagggagggag

SEQ ID NO: 1902107 - RNA, 22 nt, Human
cuaagagggagggagggcucca

SEQ ID NO: 1902108 - RNA, 23 nt, Human
cuaagagggagggagggcuccag

SEQ ID NO: 1902109 - RNA, 18 nt, Human
cuaagaguugagcucucg

SEQ ID NO: 1902110 - RNA, 21 nt, Human
cuaagaguugagcucucggaa

SEQ ID NO: 1902111 - RNA, 23 nt, Human
cuaaauaaagcuugcaacaaaau

SEQ ID NO: 1902112 - RNA, 22 nt, Human
cuaaaugaaaaucgugacaaca

SEQ ID NO: 1902113 - RNA, 17 nt, Human
cuaaauauauuuuaaga

SEQ ID NO: 1902114 - RNA, 21 nt, Human
cuaaaucuccaaaauaaaacu

SEQ ID NO: 1902115 - RNA, 17 nt, Human
cuaaacucauuuauaaa

SEQ ID NO: 1902116 - RNA, 22 nt, Human
cuaaacucauuuauaaagcuaa

SEQ ID NO: 1902117 - RNA, 14 nt, Human
cuaaacucauuuau

SEQ ID NO: 1902118 - RNA, 15 nt, Human
cuaaacucauuuaua

SEQ ID NO: 1902119 - RNA, 23 nt, Human
cgggaccccgagccuggcuccaa

SEQ ID NO: 1902120 - RNA, 20 nt, Human
cgggaggcagagguugcagu

SEQ ID NO: 1902121 - RNA, 23 nt, Human
cgggaggauguucugggacacag

SEQ ID NO: 1902122 - RNA, 20 nt, Human
cuaaaagugggcuugauucu

SEQ ID NO: 1902123 - RNA, 11 nt, Human
cuaaaaauaau

SEQ ID NO: 1902124 - RNA, 23 nt, Human
cuaaaagugggcuugauucugca

SEQ ID NO: 1902125 - RNA, 16 nt, Human
cuaaaaaacaaaacaa

SEQ ID NO: 1902126 - RNA, 13 nt, Human
cguuuucaaaauu

SEQ ID NO: 1902127 - RNA, 12 nt, Human
cuaauaucagca

SEQ ID NO: 1902128 - RNA, 20 nt, Human
cuaauagacuaaaugaaauc

SEQ ID NO: 1902129 - RNA, 17 nt, Human
cuaauagacuaaaugaa

SEQ ID NO: 1902130 - RNA, 18 nt, Human
cuaauagacuaaaugaaa

SEQ ID NO: 1902131 - RNA, 23 nt, Human
cuaauagacaauuuauuauggca

SEQ ID NO: 1902132 - RNA, 19 nt, Human
cuaauagacaauuuauuau

SEQ ID NO: 1902133 - RNA, 17 nt, Human
cuaauagacaauuuauu

SEQ ID NO: 1902134 - RNA, 13 nt, Human
cuaauagaacuca

SEQ ID NO: 1902135 - RNA, 20 nt, Human
cuaauagaacucaguuuuaa

SEQ ID NO: 1902136 - RNA, 17 nt, Human
cuaauaccucugugugc

SEQ ID NO: 1902137 - RNA, 16 nt, Human
cuaauaccucugugug

SEQ ID NO: 1902138 - RNA, 15 nt, Human
cuaauaccucugugu

SEQ ID NO: 1902139 - RNA, 13 nt, Human
cuaauaccucugu

SEQ ID NO: 1902140 - RNA, 12 nt, Human
cuaauacaccag

SEQ ID NO: 1902141 - RNA, 18 nt, Human
cuaauaaucauuggauuc

SEQ ID NO: 1902142 - RNA, 14 nt, Human
cuaauaaagcugug

SEQ ID NO: 1902143 - RNA, 21 nt, Human
cuaagcuucacuguaaaauaa

SEQ ID NO: 1902144 - RNA, 22 nt, Human
cuaagcuggagugcuuaucccu

SEQ ID NO: 1902145 - RNA, 22 nt, Human
cuaagcuauucaguaauaacuc

SEQ ID NO: 1902146 - RNA, 21 nt, Human
cuaaucagggaggucauuuug

SEQ ID NO: 1902147 - RNA, 20 nt, Human
cuaaucagggaggucauuuu

SEQ ID NO: 1902148 - RNA, 19 nt, Human
cuaaucagggaggucauuu

SEQ ID NO: 1902149 - RNA, 20 nt, Human
cuaauauggccacaguaguc

SEQ ID NO: 1902150 - RNA, 18 nt, Human
cuaauauguaacaagcca

SEQ ID NO: 1902151 - RNA, 13 nt, Human
cuaaugggacacu

SEQ ID NO: 1902152 - RNA, 12 nt, Human
cuaaugggacac

SEQ ID NO: 1902153 - RNA, 19 nt, Human
cuaaugcuccuuguuccua

SEQ ID NO: 1902154 - RNA, 12 nt, Human
cuaaugcuccuu

SEQ ID NO: 1902155 - RNA, 18 nt, Human
cuaaugcuccuuguuccu

SEQ ID NO: 1902156 - RNA, 23 nt, Human
cuacacgagauacagaauuuuau

SEQ ID NO: 1902157 - RNA, 18 nt, Human
cuacaccuuucuccuuug

SEQ ID NO: 1902158 - RNA, 20 nt, Human
cuacaccuuucuccuuugua

SEQ ID NO: 1902159 - RNA, 15 nt, Human
cuacaccuuucuccu

SEQ ID NO: 1902160 - RNA, 15 nt, Human
cuaauuccacaccuu

SEQ ID NO: 1902161 - RNA, 17 nt, Human
cuaauuccacaccuuuu

SEQ ID NO: 1902162 - RNA, 21 nt, Human
cuacacaggggaaaagaggag

SEQ ID NO: 1902163 - RNA, 18 nt, Human
cuaccauccccuguagag

SEQ ID NO: 1902164 - RNA, 13 nt, Human
cuaccauucagug

SEQ ID NO: 1902165 - RNA, 22 nt, Human
cuacauuauaaaugucucuuua

SEQ ID NO: 1902166 - RNA, 14 nt, Human
cuacauucuguuaa

SEQ ID NO: 1902167 - RNA, 13 nt, Human
cuacauucuguua

SEQ ID NO: 1902168 - RNA, 12 nt, Human
cuacauucauuu

SEQ ID NO: 1902169 - RNA, 17 nt, Human
cuacccagcgagcccug

SEQ ID NO: 1902170 - RNA, 15 nt, Human
cuacccagcgagccc

SEQ ID NO: 1902171 - RNA, 13 nt, Human
cuacccacccucc

SEQ ID NO: 1902172 - RNA, 18 nt, Human
cuacccagcgagcccugg

SEQ ID NO: 1902173 - RNA, 13 nt, Human
cuacccaggugcu

SEQ ID NO: 1902174 - RNA, 13 nt, Human
cuacccauccccg

SEQ ID NO: 1902175 - RNA, 15 nt, Human
cuacccauccccgca

SEQ ID NO: 1902176 - RNA, 17 nt, Human
cuacccucuuagaaaaa

SEQ ID NO: 1902177 - RNA, 13 nt, Human
cuacccucacaau

SEQ ID NO: 1902178 - RNA, 20 nt, Human
cuacagaggccaugggccuc

SEQ ID NO: 1902179 - RNA, 18 nt, Human
cuacagaggccaugggcc

SEQ ID NO: 1902180 - RNA, 22 nt, Human
cuacagaggccaugggccuccu

SEQ ID NO: 1902181 - RNA, 13 nt, Human
cuacacugugcug

SEQ ID NO: 1902182 - RNA, 14 nt, Human
cuacacugugcuga

SEQ ID NO: 1902183 - RNA, 17 nt, Human
cuacacugugcugaguc

SEQ ID NO: 1902184 - RNA, 23 nt, Human
cuacagcuugaccgugaggccag

SEQ ID NO: 1902185 - RNA, 19 nt, Human
cuacagcuuugaucccuga

SEQ ID NO: 1902186 - RNA, 19 nt, Human
cuacagcuugaccgugagg

SEQ ID NO: 1902187 - RNA, 22 nt, Human
cuacagcuugaccgugaggcca

SEQ ID NO: 1902188 - RNA, 13 nt, Human
cuacaguccuccc

SEQ ID NO: 1902189 - RNA, 18 nt, Human
cuacauggaguauauguc

SEQ ID NO: 1902190 - RNA, 20 nt, Human
cuacauggaguauaugucaa

SEQ ID NO: 1902191 - RNA, 16 nt, Human
cuacaggugugaguca

SEQ ID NO: 1902192 - RNA, 17 nt, Human
cuacagguuuggguaca

SEQ ID NO: 1902193 - RNA, 14 nt, Human
cuacaggugugagu

SEQ ID NO: 1902194 - RNA, 16 nt, Human
cuacaggagugagcac

SEQ ID NO: 1902195 - RNA, 15 nt, Human
cuacaggagugagca

SEQ ID NO: 1902196 - RNA, 14 nt, Human
cuacaggagugagc

SEQ ID NO: 1902197 - RNA, 17 nt, Human
cuacaggcacccaccau

SEQ ID NO: 1902198 - RNA, 15 nt, Human
cuacaggcacccacc

SEQ ID NO: 1902199 - RNA, 13 nt, Human
cuacaggggccag

SEQ ID NO: 1902200 - RNA, 14 nt, Human
cuacaggggccaga

SEQ ID NO: 1902201 - RNA, 16 nt, Human
cuacaggggccagaag

SEQ ID NO: 1902202 - RNA, 22 nt, Human
cuagaaaacgcgaccuuggccg

SEQ ID NO: 1902203 - RNA, 20 nt, Human
cuacuguccuacccacccuc

SEQ ID NO: 1902204 - RNA, 19 nt, Human
cuacuguaauuuuauauga

SEQ ID NO: 1902205 - RNA, 17 nt, Human
cuacuguaauuuuauau

SEQ ID NO: 1902206 - RNA, 23 nt, Human
cuacuguuuuaauuuauacuggc

SEQ ID NO: 1902207 - RNA, 23 nt, Human
cuagaaaugauccccagcuguuu

SEQ ID NO: 1902208 - RNA, 18 nt, Human
cuagaaagaauauuuggu

SEQ ID NO: 1902209 - RNA, 21 nt, Human
cuagagguucaaagauauuuu

SEQ ID NO: 1902210 - RNA, 18 nt, Human
cuagagguucaaagauau

SEQ ID NO: 1902211 - RNA, 17 nt, Human
cuagagguucaaagaua

SEQ ID NO: 1902212 - RNA, 14 nt, Human
cuagagggaccucu

SEQ ID NO: 1902213 - RNA, 15 nt, Human
cuagagggaccucuc

SEQ ID NO: 1902214 - RNA, 16 nt, Human
cuagagggaccucucc

SEQ ID NO: 1902215 - RNA, 17 nt, Human
cuagagggaccucuccc

SEQ ID NO: 1902216 - RNA, 13 nt, Human
cuagagagggagg

SEQ ID NO: 1902217 - RNA, 21 nt, Human
cuagagagggaggcaagcccu

SEQ ID NO: 1902218 - RNA, 22 nt, Human
cuagagagggaggcaagcccug

SEQ ID NO: 1902219 - RNA, 23 nt, Human
cuagagagggaggcaagcccugu

SEQ ID NO: 1902220 - RNA, 12 nt, Human
cuagagagggag

SEQ ID NO: 1902221 - RNA, 15 nt, Human
cuacucgaguuacag

SEQ ID NO: 1902222 - RNA, 16 nt, Human
cuacucgaguuacaga

SEQ ID NO: 1902223 - RNA, 19 nt, Human
cuacucgaguuacagacaa

SEQ ID NO: 1902224 - RNA, 19 nt, Human
cuacuguccuacccacccu

SEQ ID NO: 1902225 - RNA, 16 nt, Human
cuacuguaauuuuaua

SEQ ID NO: 1902226 - RNA, 18 nt, Human
cuacugggagccuaccca

SEQ ID NO: 1902227 - RNA, 15 nt, Human
cuacugggagccuac

SEQ ID NO: 1902228 - RNA, 14 nt, Human
cuacugggagccua

SEQ ID NO: 1902229 - RNA, 13 nt, Human
cuacucuguguca

SEQ ID NO: 1902230 - RNA, 12 nt, Human
cuacucuguguc

SEQ ID NO: 1902231 - RNA, 18 nt, Human
cuacugcaccauuuaaaa

SEQ ID NO: 1902232 - RNA, 14 nt, Human
cuacugcaccauuu

SEQ ID NO: 1902233 - RNA, 12 nt, Human
cuacucuccuca

SEQ ID NO: 1902234 - RNA, 13 nt, Human
cuacucuccucau

SEQ ID NO: 1902235 - RNA, 22 nt, Human
cuacucuggagguuuguuuaga

SEQ ID NO: 1902236 - RNA, 17 nt, Human
cuacucuccucaucucu

SEQ ID NO: 1902237 - RNA, 16 nt, Human
cuacucgggaagcuga

SEQ ID NO: 1902238 - RNA, 23 nt, Human
cuagccuuagaagucacacagua

SEQ ID NO: 1902239 - RNA, 22 nt, Human
cuagccuuagaagucacacagu

SEQ ID NO: 1902240 - RNA, 21 nt, Human
cuagccuuagaagucacacag

SEQ ID NO: 1902241 - RNA, 22 nt, Human
cuagccugugccucugggacug

SEQ ID NO: 1902242 - RNA, 21 nt, Human
cuagccugugccucugggacu

SEQ ID NO: 1902243 - RNA, 19 nt, Human
cuagccugugccucuggga

SEQ ID NO: 1902244 - RNA, 16 nt, Human
cuagauacuguaucau

SEQ ID NO: 1902245 - RNA, 13 nt, Human
cuagauacuguau

SEQ ID NO: 1902246 - RNA, 24 nt, Human
cuagauacuguaucaugacaaaga

SEQ ID NO: 1902247 - RNA, 19 nt, Human
cuagcucuauguuuacaaa

SEQ ID NO: 1902248 - RNA, 20 nt, Human
cuagcucuauguuuacaaau

SEQ ID NO: 1902249 - RNA, 23 nt, Human
cuagcucuauguuuacaaaugga

SEQ ID NO: 1902250 - RNA, 12 nt, Human
cuagcugggggu

SEQ ID NO: 1902251 - RNA, 18 nt, Human
cuagcugggggugggcca

SEQ ID NO: 1902252 - RNA, 19 nt, Human
cuagcugggggugggccag

SEQ ID NO: 1902253 - RNA, 20 nt, Human
cuagcugggggugggccagg

SEQ ID NO: 1902254 - RNA, 21 nt, Human
cuagcugggggugggccaggc

SEQ ID NO: 1902255 - RNA, 22 nt, Human
cuagcugggggugggccaggcu

SEQ ID NO: 1902256 - RNA, 18 nt, Human
cuagcuguugagcuguuu

SEQ ID NO: 1902257 - RNA, 16 nt, Human
cuauugauaauuuaga

SEQ ID NO: 1902258 - RNA, 21 nt, Human
cuauugauauaaauaaaacau

SEQ ID NO: 1902259 - RNA, 21 nt, Human
cuauucuuucgaaagaagaaa

SEQ ID NO: 1902260 - RNA, 23 nt, Human
cuauucaguaauaacucuacccu

SEQ ID NO: 1902261 - RNA, 19 nt, Human
cuauucaguggcgagaaau

SEQ ID NO: 1902262 - RNA, 14 nt, Human
cuauucucuccaaa

SEQ ID NO: 1902263 - RNA, 21 nt, Human
cuauucucuccaaaaaugcac

SEQ ID NO: 1902264 - RNA, 21 nt, Human
cuauggggauagaugugugga

SEQ ID NO: 1902265 - RNA, 20 nt, Human
cuauguaguccgugcugaca

SEQ ID NO: 1902266 - RNA, 20 nt, Human
cuauggggauagaugugugg

SEQ ID NO: 1902267 - RNA, 19 nt, Human
cuauggggauagaugugug

SEQ ID NO: 1902268 - RNA, 13 nt, Human
cuauguaucaaug

SEQ ID NO: 1902269 - RNA, 16 nt, Human
cuauguaucaaugagu

SEQ ID NO: 1902270 - RNA, 17 nt, Human
cuauucaguaauaacuc

SEQ ID NO: 1902271 - RNA, 12 nt, Human
cuaugcacauau

SEQ ID NO: 1902272 - RNA, 22 nt, Human
cuaugaaguuuuuuuuauacag

SEQ ID NO: 1902273 - RNA, 21 nt, Human
cuauagccuggggugggguca

SEQ ID NO: 1902274 - RNA, 19 nt, Human
cuauacuugcuuuguguuc

SEQ ID NO: 1902275 - RNA, 12 nt, Human
cuauagccuggg

SEQ ID NO: 1902276 - RNA, 13 nt, Human
cuauagccugggg

SEQ ID NO: 1902277 - RNA, 14 nt, Human
cuauagccuggggu

SEQ ID NO: 1902278 - RNA, 18 nt, Human
cuauagccuggggugggg

SEQ ID NO: 1902279 - RNA, 13 nt, Human
cuauaauuuaaau

SEQ ID NO: 1902280 - RNA, 12 nt, Human
cuauaauuuaaa

SEQ ID NO: 1902281 - RNA, 20 nt, Human
cuaggaacacuccuucacag

SEQ ID NO: 1902282 - RNA, 17 nt, Human
cuaggaaaauauuuuga

SEQ ID NO: 1902283 - RNA, 15 nt, Human
cuaggaaaauauuuu

SEQ ID NO: 1902284 - RNA, 15 nt, Human
cuaggaagacuuugg

SEQ ID NO: 1902285 - RNA, 17 nt, Human
cuaggaagacuuuggaa

SEQ ID NO: 1902286 - RNA, 21 nt, Human
cuauagccuaggugacagagu

SEQ ID NO: 1902287 - RNA, 20 nt, Human
cuauagccuaggugacagag

SEQ ID NO: 1902288 - RNA, 18 nt, Human
cuauagccuaggugacag

SEQ ID NO: 1902289 - RNA, 19 nt, Human
cuauagccuaggugacaga

SEQ ID NO: 1902290 - RNA, 14 nt, Human
cucaacucuccucc

SEQ ID NO: 1902291 - RNA, 19 nt, Human
cucaacccccauuucuauu

SEQ ID NO: 1902292 - RNA, 22 nt, Human
cucaacccccauuucuauuuau

SEQ ID NO: 1902293 - RNA, 17 nt, Human
cucaaauuucuaaaucu

SEQ ID NO: 1902294 - RNA, 15 nt, Human
cucaaauuucuaaau

SEQ ID NO: 1902295 - RNA, 21 nt, Human
cuauuugcaauuccugcuccu

SEQ ID NO: 1902296 - RNA, 14 nt, Human
cucaaauuucuaaa

SEQ ID NO: 1902297 - RNA, 16 nt, Human
cuauuugagacuccuc

SEQ ID NO: 1902298 - RNA, 11 nt, Human
cuauuugcaau

SEQ ID NO: 1902299 - RNA, 18 nt, Human
cuauuugcaauuccugcu

SEQ ID NO: 1902300 - RNA, 12 nt, Human
cuauuucucuuu

SEQ ID NO: 1902301 - RNA, 14 nt, Human
cuauuucucuuucu

SEQ ID NO: 1902302 - RNA, 17 nt, Human
cuauuucucuuucuuua

SEQ ID NO: 1902303 - RNA, 14 nt, Human
cuauuuauuuacug

SEQ ID NO: 1902304 - RNA, 15 nt, Human
cuauuuauuuacuga

SEQ ID NO: 1902305 - RNA, 18 nt, Human
cuauuuauuuacugagcu

SEQ ID NO: 1902306 - RNA, 16 nt, Human
cucaacucuccuccag

SEQ ID NO: 1902307 - RNA, 18 nt, Human
cucaacucuccuccagag

SEQ ID NO: 1902308 - RNA, 13 nt, Human
cucaagauuccca

SEQ ID NO: 1902309 - RNA, 14 nt, Human
cucaagauucccag

SEQ ID NO: 1902310 - RNA, 15 nt, Human
cucaagauucccagg

SEQ ID NO: 1902311 - RNA, 16 nt, Human
cucaagauucccagga

SEQ ID NO: 1902312 - RNA, 17 nt, Human
cucaagauucccaggag

SEQ ID NO: 1902313 - RNA, 21 nt, Human
cucaagauucccaggaguucu

SEQ ID NO: 1902314 - RNA, 17 nt, Human
cucaagcccgcggggac

SEQ ID NO: 1902315 - RNA, 14 nt, Human
cucaaguccucuuu

SEQ ID NO: 1902316 - RNA, 15 nt, Human
cucaaguagcauuua

SEQ ID NO: 1902317 - RNA, 18 nt, Human
cucaaguagcauuuacug

SEQ ID NO: 1902318 - RNA, 20 nt, Human
cucaaguagcauuuacugug

SEQ ID NO: 1902319 - RNA, 14 nt, Human
cucaaguagcauuu

SEQ ID NO: 1902320 - RNA, 23 nt, Human
cucacacggacacucaaaagcug

SEQ ID NO: 1902321 - RNA, 13 nt, Human
cucacacucaccc

SEQ ID NO: 1902322 - RNA, 13 nt, Human
cucacacugagaa

SEQ ID NO: 1902323 - RNA, 12 nt, Human
cucacacugaga

SEQ ID NO: 1902324 - RNA, 15 nt, Human
cucacaccugaacug

SEQ ID NO: 1902325 - RNA, 20 nt, Human
cucacacugagaauguaaga

SEQ ID NO: 1902326 - RNA, 14 nt, Human
cucacacugagaau

SEQ ID NO: 1902327 - RNA, 18 nt, Human
cuauuguuagucucuuga

SEQ ID NO: 1902328 - RNA, 9 nt, Human
cuauuuaag

SEQ ID NO: 1902329 - RNA, 16 nt, Human
cuauugcugcuugagg

SEQ ID NO: 1902330 - RNA, 16 nt, Human
cuauuggaaaaaccac

SEQ ID NO: 1902331 - RNA, 17 nt, Human
cucaguuuuaucauuuu

SEQ ID NO: 1902332 - RNA, 18 nt, Human
cucaguuuuaucauuuuc

SEQ ID NO: 1902333 - RNA, 14 nt, Human
cucauaaaaagcaa

SEQ ID NO: 1902334 - RNA, 17 nt, Human
cucauaaaaagcaaaac

SEQ ID NO: 1902335 - RNA, 14 nt, Human
cucauucuaaugau

SEQ ID NO: 1902336 - RNA, 18 nt, Human
cucauucuaaugauggcc

SEQ ID NO: 1902337 - RNA, 20 nt, Human
cucauucuaaugauggccca

SEQ ID NO: 1902338 - RNA, 17 nt, Human
cucaguucuugccacuu

SEQ ID NO: 1902339 - RNA, 17 nt, Human
cucaguucucuucacuc

SEQ ID NO: 1902340 - RNA, 16 nt, Human
cucaguucucuucacu

SEQ ID NO: 1902341 - RNA, 12 nt, Human
cucauucuucug

SEQ ID NO: 1902342 - RNA, 17 nt, Human
cucauugaccugaggcc

SEQ ID NO: 1902343 - RNA, 22 nt, Human
cucauucuccuuguguuacuaa

SEQ ID NO: 1902344 - RNA, 18 nt, Human
cucauucuccuuguguua

SEQ ID NO: 1902345 - RNA, 19 nt, Human
cucauugaccugaggcccu

SEQ ID NO: 1902346 - RNA, 21 nt, Human
cucauugaccugaggcccuuc

SEQ ID NO: 1902347 - RNA, 22 nt, Human
cucauuucaccccucccuuucu

SEQ ID NO: 1902348 - RNA, 19 nt, Human
cucauuucaccccucccuu

SEQ ID NO: 1902349 - RNA, 17 nt, Human
cucauuucaccccuccc

SEQ ID NO: 1902350 - RNA, 14 nt, Human
cucauuucaccccu

SEQ ID NO: 1902351 - RNA, 18 nt, Human
cucauugcugagccucug

SEQ ID NO: 1902352 - RNA, 21 nt, Human
cucauucuaaugauggcccau

SEQ ID NO: 1902353 - RNA, 16 nt, Human
cucauugcugagccuc

SEQ ID NO: 1902354 - RNA, 15 nt, Human
cucauugcugagccu

SEQ ID NO: 1902355 - RNA, 21 nt, Human
cucauuugucacacacuuugg

SEQ ID NO: 1902356 - RNA, 23 nt, Human
cucauuucaccccucccuuucuc

SEQ ID NO: 1902357 - RNA, 21 nt, Human
cuccaaacccucgaggcggau

SEQ ID NO: 1902358 - RNA, 14 nt, Human
cuccaaaccuucac

SEQ ID NO: 1902359 - RNA, 15 nt, Human
cuccaaaccuucaca

SEQ ID NO: 1902360 - RNA, 16 nt, Human
cuccaaaccuucacac

SEQ ID NO: 1902361 - RNA, 21 nt, Human
cuccaaaccuucacacacaga

SEQ ID NO: 1902362 - RNA, 17 nt, Human
cuccaagcucccaggca

SEQ ID NO: 1902363 - RNA, 15 nt, Human
cuccaaacccucgag

SEQ ID NO: 1902364 - RNA, 17 nt, Human
cuccaaacccucgaggc

SEQ ID NO: 1902365 - RNA, 16 nt, Human
cuccagagucagaagu

SEQ ID NO: 1902366 - RNA, 16 nt, Human
cuccagaugcagggca

SEQ ID NO: 1902367 - RNA, 20 nt, Human
cuccagaguggggaugacau

SEQ ID NO: 1902368 - RNA, 17 nt, Human
cuccagaugcagggcag

SEQ ID NO: 1902369 - RNA, 18 nt, Human
cuccagaugcagggcagu

SEQ ID NO: 1902370 - RNA, 21 nt, Human
cuccagaugcagggcagucau

SEQ ID NO: 1902371 - RNA, 17 nt, Human
cuccagauguuuccaga

SEQ ID NO: 1902372 - RNA, 16 nt, Human
cuccacucucccccac

SEQ ID NO: 1902373 - RNA, 11 nt, Human
cuccagaccug

SEQ ID NO: 1902374 - RNA, 12 nt, Human
cuccagaccuga

SEQ ID NO: 1902375 - RNA, 14 nt, Human
cuccagaccugauc

SEQ ID NO: 1902376 - RNA, 19 nt, Human
cuccagaccugauccugga

SEQ ID NO: 1902377 - RNA, 23 nt, Human
cuccagaccugauccuggaggcc

SEQ ID NO: 1902378 - RNA, 18 nt, Human
cuccagcucaccagcccc

SEQ ID NO: 1902379 - RNA, 16 nt, Human
cuccagcucaccagcc

SEQ ID NO: 1902380 - RNA, 15 nt, Human
cuccagcucaccagc

SEQ ID NO: 1902381 - RNA, 11 nt, Human
cuccagccccu

SEQ ID NO: 1902382 - RNA, 19 nt, Human
cuccagauguuuccagacu

SEQ ID NO: 1902383 - RNA, 13 nt, Human
cuccagccccugg

SEQ ID NO: 1902384 - RNA, 14 nt, Human
cuccagccccugga

SEQ ID NO: 1902385 - RNA, 14 nt, Human
cuccacucuccucu

SEQ ID NO: 1902386 - RNA, 15 nt, Human
cuccacucuccccca

SEQ ID NO: 1902387 - RNA, 13 nt, Human
cuccacucucccc

SEQ ID NO: 1902388 - RNA, 22 nt, Human
cuccaaguccacaguggaacca

SEQ ID NO: 1902389 - RNA, 20 nt, Human
cuccaaggggaaucagaacu

SEQ ID NO: 1902390 - RNA, 13 nt, Human
cuccaccaggaac

SEQ ID NO: 1902391 - RNA, 14 nt, Human
cuccaccaggaacc

SEQ ID NO: 1902392 - RNA, 15 nt, Human
cuccaccaggaaccu

SEQ ID NO: 1902393 - RNA, 16 nt, Human
cuccaccagucauuuu

SEQ ID NO: 1902394 - RNA, 14 nt, Human
cucccauuuccuga

SEQ ID NO: 1902395 - RNA, 22 nt, Human
cucccauugucccucugcccca

SEQ ID NO: 1902396 - RNA, 14 nt, Human
cucccauuccugaa

SEQ ID NO: 1902397 - RNA, 15 nt, Human
cucccauuccugaag

SEQ ID NO: 1902398 - RNA, 16 nt, Human
cucccauuccugaaga

SEQ ID NO: 1902399 - RNA, 17 nt, Human
cucccauuccugaagaa

SEQ ID NO: 1902400 - RNA, 19 nt, Human
cucccauuccugaagaacc

SEQ ID NO: 1902401 - RNA, 17 nt, Human
cucccauugucccucug

SEQ ID NO: 1902402 - RNA, 19 nt, Human
cucccauugucccucugcc

SEQ ID NO: 1902403 - RNA, 14 nt, Human
cucccauccagggc

SEQ ID NO: 1902404 - RNA, 15 nt, Human
cucccauccagggcc

SEQ ID NO: 1902405 - RNA, 22 nt, Human
cucccauccagggcccccaucu

SEQ ID NO: 1902406 - RNA, 13 nt, Human
cucccacagagac

SEQ ID NO: 1902407 - RNA, 15 nt, Human
cucccacagagacaa

SEQ ID NO: 1902408 - RNA, 21 nt, Human
cucccaauuucagacucccau

SEQ ID NO: 1902409 - RNA, 19 nt, Human
cucccaauuucagacuccc

SEQ ID NO: 1902410 - RNA, 12 nt, Human
cucccaggcucu

SEQ ID NO: 1902411 - RNA, 13 nt, Human
cucccaggcucuc

SEQ ID NO: 1902412 - RNA, 16 nt, Human
cucccaucacuucccu

SEQ ID NO: 1902413 - RNA, 23 nt, Human
cucccaaagugcugggauuacag

SEQ ID NO: 1902414 - RNA, 16 nt, Human
cucccaaagugcuggg

SEQ ID NO: 1902415 - RNA, 15 nt, Human
cucccaaaugagcca

SEQ ID NO: 1902416 - RNA, 15 nt, Human
cucccacaaaggaga

SEQ ID NO: 1902417 - RNA, 14 nt, Human
cucccaacucaccc

SEQ ID NO: 1902418 - RNA, 15 nt, Human
cucccaacucacccc

SEQ ID NO: 1902419 - RNA, 15 nt, Human
cuccagcucuuuccu

SEQ ID NO: 1902420 - RNA, 23 nt, Human
cucccgaauagcugggacuacag

SEQ ID NO: 1902421 - RNA, 20 nt, Human
cucccgaauagcugggacua

SEQ ID NO: 1902422 - RNA, 15 nt, Human
cucccuucauccuuc

SEQ ID NO: 1902423 - RNA, 18 nt, Human
cucccucagucuggcccu

SEQ ID NO: 1902424 - RNA, 20 nt, Human
cuccccagccccaucccaaa

SEQ ID NO: 1902425 - RNA, 18 nt, Human
cuccccagcccagagaca

SEQ ID NO: 1902426 - RNA, 14 nt, Human
cuccccagcccaga

SEQ ID NO: 1902427 - RNA, 15 nt, Human
cuccccagcccagag

SEQ ID NO: 1902428 - RNA, 16 nt, Human
cuccccagcccagaga

SEQ ID NO: 1902429 - RNA, 17 nt, Human
cuccccagcccagagac

SEQ ID NO: 1902430 - RNA, 16 nt, Human
cuccccucuccuuccu

SEQ ID NO: 1902431 - RNA, 13 nt, Human
cuccccagcccag

SEQ ID NO: 1902432 - RNA, 21 nt, Human
cuccccugcuggguguggcgc

SEQ ID NO: 1902433 - RNA, 23 nt, Human
cuccccugcuggguguggcgcag

SEQ ID NO: 1902434 - RNA, 16 nt, Human
cuccccugaccuguga

SEQ ID NO: 1902435 - RNA, 17 nt, Human
cuccccugaccugugag

SEQ ID NO: 1902436 - RNA, 22 nt, Human
cuccccugaccugugagcccag

SEQ ID NO: 1902437 - RNA, 17 nt, Human
cucagcuuccccaacac

SEQ ID NO: 1902438 - RNA, 22 nt, Human
cucagcuuccccaacacgcagg

SEQ ID NO: 1902439 - RNA, 20 nt, Human
cucagcucuuggcuccacug

SEQ ID NO: 1902440 - RNA, 14 nt, Human
cucagcucugggcc

SEQ ID NO: 1902441 - RNA, 23 nt, Human
cucagcucugggccauucuccac

SEQ ID NO: 1902442 - RNA, 17 nt, Human
cucagcucuuggcucca

SEQ ID NO: 1902443 - RNA, 18 nt, Human
cucagcucuuggcuccac

SEQ ID NO: 1902444 - RNA, 16 nt, Human
cucagcuucuccugug

SEQ ID NO: 1902445 - RNA, 12 nt, Human
cucaggaagaac

SEQ ID NO: 1902446 - RNA, 13 nt, Human
cucaggaagaaca

SEQ ID NO: 1902447 - RNA, 14 nt, Human
cucaggaagaacac

SEQ ID NO: 1902448 - RNA, 12 nt, Human
cucaggagcccu

SEQ ID NO: 1902449 - RNA, 13 nt, Human
cucaggagcccug

SEQ ID NO: 1902450 - RNA, 14 nt, Human
cucaggacugcgac

SEQ ID NO: 1902451 - RNA, 19 nt, Human
cucaggacagaugccacac

SEQ ID NO: 1902452 - RNA, 12 nt, Human
cucaggacagau

SEQ ID NO: 1902453 - RNA, 14 nt, Human
cucaggacagaugc

SEQ ID NO: 1902454 - RNA, 16 nt, Human
cucaggacagaugcca

SEQ ID NO: 1902455 - RNA, 18 nt, Human
cucaggacagaugccaca

SEQ ID NO: 1902456 - RNA, 14 nt, Human
cucaggagcccugg

SEQ ID NO: 1902457 - RNA, 15 nt, Human
cucaggagcccuggg

SEQ ID NO: 1902458 - RNA, 16 nt, Human
cucaggagcccuggga

SEQ ID NO: 1902459 - RNA, 17 nt, Human
cucaggagcccugggag

SEQ ID NO: 1902460 - RNA, 20 nt, Human
cucaggagcccugggaggcu

SEQ ID NO: 1902461 - RNA, 21 nt, Human
cucaggagcccugggaggcuc

SEQ ID NO: 1902462 - RNA, 22 nt, Human
cucaggagcccugggaggcucu

SEQ ID NO: 1902463 - RNA, 23 nt, Human
cucaggagcccugggaggcucug

SEQ ID NO: 1902464 - RNA, 24 nt, Human
cucaggagcccugggaggcucugg

SEQ ID NO: 1902465 - RNA, 18 nt, Human
cucaggaggcaggaccuu

SEQ ID NO: 1902466 - RNA, 17 nt, Human
cucaggaggcaggaccu

SEQ ID NO: 1902467 - RNA, 16 nt, Human
cucaggaggcaggacc

SEQ ID NO: 1902468 - RNA, 15 nt, Human
cucaggcagguggga

SEQ ID NO: 1902469 - RNA, 18 nt, Human
cucaggcaggugggaugg

SEQ ID NO: 1902470 - RNA, 18 nt, Human
cucagggccuggcucagg

SEQ ID NO: 1902471 - RNA, 19 nt, Human
cucagggccuggcucaggu

SEQ ID NO: 1902472 - RNA, 20 nt, Human
cucagggccuggcucaggug

SEQ ID NO: 1902473 - RNA, 20 nt, Human
cucagggcagcgccaggcug

SEQ ID NO: 1902474 - RNA, 23 nt, Human
cucaggugauccacccaccucag

SEQ ID NO: 1902475 - RNA, 22 nt, Human
cucaggugauccacccaccuca

SEQ ID NO: 1902476 - RNA, 12 nt, Human
cucagguggcca

SEQ ID NO: 1902477 - RNA, 13 nt, Human
cucagguggccau

SEQ ID NO: 1902478 - RNA, 15 nt, Human
cucagguggccaugc

SEQ ID NO: 1902479 - RNA, 18 nt, Human
cucagguggccaugccuc

SEQ ID NO: 1902480 - RNA, 19 nt, Human
cucagguggccaugccuca

SEQ ID NO: 1902481 - RNA, 20 nt, Human
cucagguggccaugccucag

SEQ ID NO: 1902482 - RNA, 19 nt, Human
cucagguggggucacucug

SEQ ID NO: 1902483 - RNA, 20 nt, Human
cucagguggggucacucugg

SEQ ID NO: 1902484 - RNA, 21 nt, Human
cucagguggggucacucuggc

SEQ ID NO: 1902485 - RNA, 21 nt, Human
cucagguggccaugccucagc

SEQ ID NO: 1902486 - RNA, 24 nt, Human
cucagggucccugguggcagcuca

SEQ ID NO: 1902487 - RNA, 14 nt, Human
cucagggccugguc

SEQ ID NO: 1902488 - RNA, 20 nt, Human
cucagggucccugguggcag

SEQ ID NO: 1902489 - RNA, 21 nt, Human
cucagggucccugguggcagc

SEQ ID NO: 1902490 - RNA, 22 nt, Human
cucagggucccugguggcagcu

SEQ ID NO: 1902491 - RNA, 23 nt, Human
cucagcggggacagcuccuucug

SEQ ID NO: 1902492 - RNA, 17 nt, Human
cucagcccugacccugu

SEQ ID NO: 1902493 - RNA, 21 nt, Human
cucagcggggacagcuccuuc

SEQ ID NO: 1902494 - RNA, 20 nt, Human
cucagcggggacagcuccuu

SEQ ID NO: 1902495 - RNA, 19 nt, Human
cucagcggggacagcuccu

SEQ ID NO: 1902496 - RNA, 18 nt, Human
cucagcggggacagcucc

SEQ ID NO: 1902497 - RNA, 16 nt, Human
cucagcggggacagcu

SEQ ID NO: 1902498 - RNA, 15 nt, Human
cucagcggggacagc

SEQ ID NO: 1902499 - RNA, 14 nt, Human
cucagcggggacag

SEQ ID NO: 1902500 - RNA, 13 nt, Human
cucagcccugacc

SEQ ID NO: 1902501 - RNA, 14 nt, Human
cucagcccugaccc

SEQ ID NO: 1902502 - RNA, 15 nt, Human
cucagcccugacccu

SEQ ID NO: 1902503 - RNA, 22 nt, Human
cucagcauccuggcacccggcc

SEQ ID NO: 1902504 - RNA, 21 nt, Human
cucagcauccuggcacccggc

SEQ ID NO: 1902505 - RNA, 13 nt, Human
cucagcauccugg

SEQ ID NO: 1902506 - RNA, 20 nt, Human
cucagcagcugguaaucuug

SEQ ID NO: 1902507 - RNA, 19 nt, Human
cucagcaaaagaugcuucu

SEQ ID NO: 1902508 - RNA, 20 nt, Human
cucagcaaaagaugcuucuc

SEQ ID NO: 1902509 - RNA, 16 nt, Human
cucagcaggggagggu

SEQ ID NO: 1902510 - RNA, 21 nt, Human
cucagcaaaagaugcuucuca

SEQ ID NO: 1902511 - RNA, 15 nt, Human
cucagcauccuggca

SEQ ID NO: 1902512 - RNA, 19 nt, Human
cucacuguugcccaggcug

SEQ ID NO: 1902513 - RNA, 18 nt, Human
cucacuguugcccaggcu

SEQ ID NO: 1902514 - RNA, 17 nt, Human
cucacuguugcccaggc

SEQ ID NO: 1902515 - RNA, 16 nt, Human
cucacuguugcccagg

SEQ ID NO: 1902516 - RNA, 23 nt, Human
cucagagagggugggagugggcc

SEQ ID NO: 1902517 - RNA, 19 nt, Human
cucagagagggugggagug

SEQ ID NO: 1902518 - RNA, 16 nt, Human
cucagaucuucugugg

SEQ ID NO: 1902519 - RNA, 19 nt, Human
cucagaggcgcacugugac

SEQ ID NO: 1902520 - RNA, 17 nt, Human
cucagaggcgcacugug

SEQ ID NO: 1902521 - RNA, 18 nt, Human
cucagaggcgcacuguga

SEQ ID NO: 1902522 - RNA, 16 nt, Human
cucacugcagccucaa

SEQ ID NO: 1902523 - RNA, 15 nt, Human
cucacugcagccuca

SEQ ID NO: 1902524 - RNA, 23 nt, Human
cucacugcuaagaauauuugaau

SEQ ID NO: 1902525 - RNA, 22 nt, Human
cucacugcuaagaauauuugaa

SEQ ID NO: 1902526 - RNA, 21 nt, Human
cucacugcuaagaauauuuga

SEQ ID NO: 1902527 - RNA, 20 nt, Human
cucacugcuaagaauauuug

SEQ ID NO: 1902528 - RNA, 15 nt, Human
cucacuguugcccag

SEQ ID NO: 1902529 - RNA, 14 nt, Human
cucacuguugccca

SEQ ID NO: 1902530 - RNA, 13 nt, Human
cucacuggggccu

SEQ ID NO: 1902531 - RNA, 16 nt, Human
cucacuggggccuaca

SEQ ID NO: 1902532 - RNA, 18 nt, Human
cucacuggggccuacagc

SEQ ID NO: 1902533 - RNA, 13 nt, Human
cgcaccuaaagca

SEQ ID NO: 1902534 - RNA, 20 nt, Human
cgcaccuaaagcagccagcc

SEQ ID NO: 1902535 - RNA, 23 nt, Human
cgcaccgaaaaacuaaaaauaau

SEQ ID NO: 1902536 - RNA, 21 nt, Human
cgaugggcccaauucuuacaa

SEQ ID NO: 1902537 - RNA, 13 nt, Human
cgcacugggcuug

SEQ ID NO: 1902538 - RNA, 14 nt, Human
cgcaccugccucag

SEQ ID NO: 1902539 - RNA, 15 nt, Human
cgcaccugccucagg

SEQ ID NO: 1902540 - RNA, 16 nt, Human
cgcaccugccucagga

SEQ ID NO: 1902541 - RNA, 23 nt, Human
cgcacuucgggaggucgaggcag

SEQ ID NO: 1902542 - RNA, 17 nt, Human
cgcacugugacccccag

SEQ ID NO: 1902543 - RNA, 12 nt, Human
cgcacugccucu

SEQ ID NO: 1902544 - RNA, 17 nt, Human
cgcacugggcuugggga

SEQ ID NO: 1902545 - RNA, 14 nt, Human
cgcagagcuggccg

SEQ ID NO: 1902546 - RNA, 22 nt, Human
cgcacugugacccccagcuccg

SEQ ID NO: 1902547 - RNA, 19 nt, Human
cgcagcauauucaggaagc

SEQ ID NO: 1902548 - RNA, 20 nt, Human
cgcagcauauucaggaagcu

SEQ ID NO: 1902549 - RNA, 15 nt, Human
cgcagcccugcagag

SEQ ID NO: 1902550 - RNA, 17 nt, Human
cgcagcccugcagaggg

SEQ ID NO: 1902551 - RNA, 16 nt, Human
cgaggacagggaggug

SEQ ID NO: 1902552 - RNA, 17 nt, Human
cgaggagguaaugaauu

SEQ ID NO: 1902553 - RNA, 19 nt, Human
cgagcccugguggcagugg

SEQ ID NO: 1902554 - RNA, 13 nt, Human
cgagccuggcucc

SEQ ID NO: 1902555 - RNA, 16 nt, Human
cgcuuugauucauagu

SEQ ID NO: 1902556 - RNA, 14 nt, Human
cgcuucugccugca

SEQ ID NO: 1902557 - RNA, 21 nt, Human
cgcugugcugcccugcccacc

SEQ ID NO: 1902558 - RNA, 23 nt, Human
cgcugugcugcccugcccaccug

SEQ ID NO: 1902559 - RNA, 19 nt, Human
cgcugugcugcccugccca

SEQ ID NO: 1902560 - RNA, 11 nt, Human
cgcugugcugc

SEQ ID NO: 1902561 - RNA, 13 nt, Human
cgcugugcugccc

SEQ ID NO: 1902562 - RNA, 14 nt, Human
cgcugugcugcccu

SEQ ID NO: 1902563 - RNA, 20 nt, Human
cgcuccugccgcagagcugg

SEQ ID NO: 1902564 - RNA, 19 nt, Human
cgcuccugccgcagagcug

SEQ ID NO: 1902565 - RNA, 18 nt, Human
cgcuccugccgcagagcu

SEQ ID NO: 1902566 - RNA, 17 nt, Human
cggaauaguuggcuagg

SEQ ID NO: 1902567 - RNA, 16 nt, Human
cggaauaguuggcuag

SEQ ID NO: 1902568 - RNA, 14 nt, Human
cgcuuucuacccag

SEQ ID NO: 1902569 - RNA, 16 nt, Human
cgcuuucuacccagcg

SEQ ID NO: 1902570 - RNA, 16 nt, Human
cgcuuucuagcuguug

SEQ ID NO: 1902571 - RNA, 22 nt, Human
cgcuuucuagcuguugagcugu

SEQ ID NO: 1902572 - RNA, 22 nt, Human
cggacagccacggccaggccag

SEQ ID NO: 1902573 - RNA, 21 nt, Human
cggacagccacggccaggcca

SEQ ID NO: 1902574 - RNA, 15 nt, Human
cggacaguggcagga

SEQ ID NO: 1902575 - RNA, 13 nt, Human
cggacaguggcag

SEQ ID NO: 1902576 - RNA, 15 nt, Human
cggagaaaggaaggg

SEQ ID NO: 1902577 - RNA, 17 nt, Human
cggagaaaggaagggcu

SEQ ID NO: 1902578 - RNA, 18 nt, Human
cgcccgggcccagaggag

SEQ ID NO: 1902579 - RNA, 17 nt, Human
cgcccgggcccagagga

SEQ ID NO: 1902580 - RNA, 16 nt, Human
cgcccgggcccagagg

SEQ ID NO: 1902581 - RNA, 14 nt, Human
cgcccgggcccaga

SEQ ID NO: 1902582 - RNA, 13 nt, Human
cgcccgggcccag

SEQ ID NO: 1902583 - RNA, 14 nt, Human
cgcgacaaugcaaa

SEQ ID NO: 1902584 - RNA, 14 nt, Human
cgccuuucccaacu

SEQ ID NO: 1902585 - RNA, 15 nt, Human
cgcgacaaugcaaac

SEQ ID NO: 1902586 - RNA, 19 nt, Human
cgcgguggcucacgccugu

SEQ ID NO: 1902587 - RNA, 18 nt, Human
cgcuacccgggaaggggg

SEQ ID NO: 1902588 - RNA, 17 nt, Human
cgcuacccgggaagggg

SEQ ID NO: 1902589 - RNA, 21 nt, Human
cgcuacccgggaagggggcug

SEQ ID NO: 1902590 - RNA, 24 nt, Human
cgcuacccgggaagggggcuggga

SEQ ID NO: 1902591 - RNA, 15 nt, Human
cgcggggacauuggg

SEQ ID NO: 1902592 - RNA, 21 nt, Human
cgcgucgcccucccaggcucu

SEQ ID NO: 1902593 - RNA, 21 nt, Human
cgcccagucuggaaugcagug

SEQ ID NO: 1902594 - RNA, 19 nt, Human
cgcccagucuggaaugcag

SEQ ID NO: 1902595 - RNA, 13 nt, Human
cgcccagucugga

SEQ ID NO: 1902596 - RNA, 12 nt, Human
cgcccaaggccc

SEQ ID NO: 1902597 - RNA, 12 nt, Human
cgcacuguggau

SEQ ID NO: 1902598 - RNA, 18 nt, Human
cgcagcccugcagagggc

SEQ ID NO: 1902599 - RNA, 19 nt, Human
cgcagcccugcagagggca

SEQ ID NO: 1902600 - RNA, 24 nt, Human
cgcaggaagacccaacacauggga

SEQ ID NO: 1902601 - RNA, 20 nt, Human
cggccaggccagagggagug

SEQ ID NO: 1902602 - RNA, 12 nt, Human
cggccaggccag

SEQ ID NO: 1902603 - RNA, 22 nt, Human
cggccagccccuggccccagga

SEQ ID NO: 1902604 - RNA, 11 nt, Human
cggccaggcca

SEQ ID NO: 1902605 - RNA, 14 nt, Human
cggcuggcagccca

SEQ ID NO: 1902606 - RNA, 15 nt, Human
cggccucccaaagug

SEQ ID NO: 1902607 - RNA, 20 nt, Human
cggcccuccuacccugcgcc

SEQ ID NO: 1902608 - RNA, 23 nt, Human
cggcccuccuacccugcgcccag

SEQ ID NO: 1902609 - RNA, 22 nt, Human
cggcccuccuacccugcgccca

SEQ ID NO: 1902610 - RNA, 14 nt, Human
cggcuggccuggcc

SEQ ID NO: 1902611 - RNA, 23 nt, Human
cggcuggcagcccaccccucaac

SEQ ID NO: 1902612 - RNA, 13 nt, Human
cggcuggccuggc

SEQ ID NO: 1902613 - RNA, 18 nt, Human
cgggaauuuucaucuagg

SEQ ID NO: 1902614 - RNA, 16 nt, Human
cgggaagggggcuggg

SEQ ID NO: 1902615 - RNA, 19 nt, Human
cgggaagggggcugggaca

SEQ ID NO: 1902616 - RNA, 20 nt, Human
cgggaagggggcugggacau

SEQ ID NO: 1902617 - RNA, 20 nt, Human
cgggaauuuucaucuaggau

SEQ ID NO: 1902618 - RNA, 19 nt, Human
ccuuguaauucuaaaugaa

SEQ ID NO: 1902619 - RNA, 16 nt, Human
ccuuguaauucuaaau

SEQ ID NO: 1902620 - RNA, 21 nt, Human
ccuuggugucgggcaugacac

SEQ ID NO: 1902621 - RNA, 19 nt, Human
ccuuggugucgggcaugac

SEQ ID NO: 1902622 - RNA, 20 nt, Human
ccuuggugucgggcaugaca

SEQ ID NO: 1902623 - RNA, 16 nt, Human
ccuuggcugcagggag

SEQ ID NO: 1902624 - RNA, 14 nt, Human
ccuuggggagcagg

SEQ ID NO: 1902625 - RNA, 23 nt, Human
ccuuggccgcaccuaaagcagcc

SEQ ID NO: 1902626 - RNA, 22 nt, Human
ccuuggcucaaguccucuuuuc

SEQ ID NO: 1902627 - RNA, 15 nt, Human
ccuuggauugucccc

SEQ ID NO: 1902628 - RNA, 18 nt, Human
ccuugaggaaacaacagc

SEQ ID NO: 1902629 - RNA, 21 nt, Human
ccuugaggaaacaacagcuuu

SEQ ID NO: 1902630 - RNA, 21 nt, Human
ccuugacagggcacaccgggc

SEQ ID NO: 1902631 - RNA, 18 nt, Human
ccuugacagggcacaccg

SEQ ID NO: 1902632 - RNA, 17 nt, Human
ccuucucuccagccccu

SEQ ID NO: 1902633 - RNA, 18 nt, Human
ccuucucuccagccccug

SEQ ID NO: 1902634 - RNA, 14 nt, Human
ccuugagaaaccuu

SEQ ID NO: 1902635 - RNA, 19 nt, Human
ccuugagaaaccuuauugu

SEQ ID NO: 1902636 - RNA, 18 nt, Human
ccuugagaagauucuucc

SEQ ID NO: 1902637 - RNA, 19 nt, Human
ccuucucuccagccccugg

SEQ ID NO: 1902638 - RNA, 14 nt, Human
ccuuccagcccaga

SEQ ID NO: 1902639 - RNA, 13 nt, Human
ccuuccagcccag

SEQ ID NO: 1902640 - RNA, 20 nt, Human
ccugugccucugggacugga

SEQ ID NO: 1902641 - RNA, 17 nt, Human
ccugugccuuuugccau

SEQ ID NO: 1902642 - RNA, 18 nt, Human
ccuguggaucaaauccag

SEQ ID NO: 1902643 - RNA, 20 nt, Human
ccuguggaugauaaaacaca

SEQ ID NO: 1902644 - RNA, 20 nt, Human
ccugugggcccccaaaugga

SEQ ID NO: 1902645 - RNA, 18 nt, Human
ccuucggccuccauccug

SEQ ID NO: 1902646 - RNA, 17 nt, Human
ccuuccuguucugaacu

SEQ ID NO: 1902647 - RNA, 16 nt, Human
ccuucgggcugugccc

SEQ ID NO: 1902648 - RNA, 15 nt, Human
ccuucgggcugugcc

SEQ ID NO: 1902649 - RNA, 17 nt, Human
ccuucggccuccauccu

SEQ ID NO: 1902650 - RNA, 16 nt, Human
ccuucggccuccaucc

SEQ ID NO: 1902651 - RNA, 15 nt, Human
ccuuccuguucugaa

SEQ ID NO: 1902652 - RNA, 21 nt, Human
ccuuccuggagcccagaggag

SEQ ID NO: 1902653 - RNA, 17 nt, Human
ccuuccauggacuuugu

SEQ ID NO: 1902654 - RNA, 13 nt, Human
ccuuccaggggug

SEQ ID NO: 1902655 - RNA, 22 nt, Human
ccuuccaguguccuuagaacau

SEQ ID NO: 1902656 - RNA, 12 nt, Human
ccuucucuccag

SEQ ID NO: 1902657 - RNA, 13 nt, Human
ccuucucuccagc

SEQ ID NO: 1902658 - RNA, 15 nt, Human
ccuucucuccagccc

SEQ ID NO: 1902659 - RNA, 16 nt, Human
ccuucucuccagcccc

SEQ ID NO: 1902660 - RNA, 21 nt, Human
ccuucucucaucucuuagcuc

SEQ ID NO: 1902661 - RNA, 17 nt, Human
ccuucucucaucucuua

SEQ ID NO: 1902662 - RNA, 16 nt, Human
ccuucucucaucucuu

SEQ ID NO: 1902663 - RNA, 17 nt, Human
ccuucuccucuuguaaa

SEQ ID NO: 1902664 - RNA, 15 nt, Human
ccuucucucaucucu

SEQ ID NO: 1902665 - RNA, 15 nt, Human
ccuucuccucuugua

SEQ ID NO: 1902666 - RNA, 16 nt, Human
ccuucuccucuuguaa

SEQ ID NO: 1902667 - RNA, 13 nt, Human
ccuucuaaaggug

SEQ ID NO: 1902668 - RNA, 14 nt, Human
ccuucuaaaggugu

SEQ ID NO: 1902669 - RNA, 22 nt, Human
ccuucuaaagguguugucccuu

SEQ ID NO: 1902670 - RNA, 23 nt, Human
cgaagucucuuuuuuuggcccag

SEQ ID NO: 1902671 - RNA, 17 nt, Human
cgaaucuacuaauucca

SEQ ID NO: 1902672 - RNA, 15 nt, Human
cgaauauugcugaug

SEQ ID NO: 1902673 - RNA, 17 nt, Human
cgaauauugcugauggu

SEQ ID NO: 1902674 - RNA, 18 nt, Human
cgaaugacaaaaucaucu

SEQ ID NO: 1902675 - RNA, 22 nt, Human
cgaaugacaaaaucaucuuugu

SEQ ID NO: 1902676 - RNA, 15 nt, Human
cgaauagcugggacu

SEQ ID NO: 1902677 - RNA, 16 nt, Human
cgaauagcugggacua

SEQ ID NO: 1902678 - RNA, 11 nt, Human
cgaauauugcu

SEQ ID NO: 1902679 - RNA, 12 nt, Human
cgaauauugcug

SEQ ID NO: 1902680 - RNA, 14 nt, Human
cgaauauugcugau

SEQ ID NO: 1902681 - RNA, 22 nt, Human
cgaaauguuauuuuuuaauuau

SEQ ID NO: 1902682 - RNA, 14 nt, Human
cgaaauguuauuuu

SEQ ID NO: 1902683 - RNA, 13 nt, Human
cgaaauguuauuu

SEQ ID NO: 1902684 - RNA, 19 nt, Human
cgaacauccaaccuuccca

SEQ ID NO: 1902685 - RNA, 21 nt, Human
cgaacauguuuuucuucuccc

SEQ ID NO: 1902686 - RNA, 23 nt, Human
cgaacauguuuuucuucucccuc

SEQ ID NO: 1902687 - RNA, 20 nt, Human
cgaagccaucuuucuuugga

SEQ ID NO: 1902688 - RNA, 23 nt, Human
cgaaagggacuuggaagcuccgc

SEQ ID NO: 1902689 - RNA, 17 nt, Human
ccuuuuuuggcugcuga

SEQ ID NO: 1902690 - RNA, 18 nt, Human
ccuuuuuuggcugcugaa

SEQ ID NO: 1902691 - RNA, 20 nt, Human
ccuuuuuuggcugcugaagg

SEQ ID NO: 1902692 - RNA, 22 nt, Human
ccuuuuuuggcugcugaaggcu

SEQ ID NO: 1902693 - RNA, 15 nt, Human
ccuuuuuuggcugcu

SEQ ID NO: 1902694 - RNA, 15 nt, Human
ccuuugugaggaagc

SEQ ID NO: 1902695 - RNA, 16 nt, Human
ccuuugugaggaagcc

SEQ ID NO: 1902696 - RNA, 17 nt, Human
ccuuugugaggaagccg

SEQ ID NO: 1902697 - RNA, 23 nt, Human
ccuuugugaggaagccgcugggg

SEQ ID NO: 1902698 - RNA, 22 nt, Human
ccuuuguccccaccgcagacag

SEQ ID NO: 1902699 - RNA, 23 nt, Human
ccuuuguccccaccgcagacagg

SEQ ID NO: 1902700 - RNA, 14 nt, Human
ccuuugugaggaag

SEQ ID NO: 1902701 - RNA, 15 nt, Human
ccuuugguucuggcc

SEQ ID NO: 1902702 - RNA, 20 nt, Human
ccuuugguucuggccagaau

SEQ ID NO: 1902703 - RNA, 14 nt, Human
ccuuugguucuggc

SEQ ID NO: 1902704 - RNA, 17 nt, Human
ccuugucugaacuggag

SEQ ID NO: 1902705 - RNA, 23 nt, Human
ccuuuguauucucuccuguaccu

SEQ ID NO: 1902706 - RNA, 22 nt, Human
ccuuuguauucucuccuguacc

SEQ ID NO: 1902707 - RNA, 24 nt, Human
ccuuuguauucucuccuguaccuc

SEQ ID NO: 1902708 - RNA, 16 nt, Human
ccuuuguccccaccgc

SEQ ID NO: 1902709 - RNA, 18 nt, Human
ccuuuguccccaccgcag

SEQ ID NO: 1902710 - RNA, 14 nt, Human
ccuuuguccccacc

SEQ ID NO: 1902711 - RNA, 14 nt, Human
ccuuugucccagaa

SEQ ID NO: 1902712 - RNA, 13 nt, Human
ccugcccuuggca

SEQ ID NO: 1902713 - RNA, 15 nt, Human
ccugcccugugggcc

SEQ ID NO: 1902714 - RNA, 19 nt, Human
ccugcccuuaccugccagg

SEQ ID NO: 1902715 - RNA, 21 nt, Human
ccugcccuuaccugccaggaa

SEQ ID NO: 1902716 - RNA, 22 nt, Human
ccugcccuuaccugccaggaag

SEQ ID NO: 1902717 - RNA, 14 nt, Human
ccugccuguugggc

SEQ ID NO: 1902718 - RNA, 17 nt, Human
ccugccgcagagcuggc

SEQ ID NO: 1902719 - RNA, 14 nt, Human
ccugccucagccuc

SEQ ID NO: 1902720 - RNA, 13 nt, Human
ccugccucagccu

SEQ ID NO: 1902721 - RNA, 12 nt, Human
ccugccucagcc

SEQ ID NO: 1902722 - RNA, 16 nt, Human
ccugccgcagagcugg

SEQ ID NO: 1902723 - RNA, 15 nt, Human
ccugccgcagagcug

SEQ ID NO: 1902724 - RNA, 14 nt, Human
ccugccgcagagcu

SEQ ID NO: 1902725 - RNA, 13 nt, Human
ccugccgcagagc

SEQ ID NO: 1902726 - RNA, 13 nt, Human
ccugcccuccccu

SEQ ID NO: 1902727 - RNA, 11 nt, Human
ccugcccugug

SEQ ID NO: 1902728 - RNA, 12 nt, Human
ccugcccugugg

SEQ ID NO: 1902729 - RNA, 14 nt, Human
ccugcccugugggc

SEQ ID NO: 1902730 - RNA, 16 nt, Human
ccugcccggcugcgga

SEQ ID NO: 1902731 - RNA, 14 nt, Human
ccugcccggcugcg

SEQ ID NO: 1902732 - RNA, 17 nt, Human
ccugccccugagcccau

SEQ ID NO: 1902733 - RNA, 22 nt, Human
ccugccagggacagagggggug

SEQ ID NO: 1902734 - RNA, 15 nt, Human
ccugccaggcauggu

SEQ ID NO: 1902735 - RNA, 19 nt, Human
ccugcccccgcauccccug

SEQ ID NO: 1902736 - RNA, 20 nt, Human
ccugcccccgcauccccugc

SEQ ID NO: 1902737 - RNA, 22 nt, Human
ccugcccccgcauccccugccu

SEQ ID NO: 1902738 - RNA, 23 nt, Human
ccugcccccgcauccccugccuc

SEQ ID NO: 1902739 - RNA, 12 nt, Human
ccugccaggcau

SEQ ID NO: 1902740 - RNA, 22 nt, Human
ccugccuguugggccaggagcc

SEQ ID NO: 1902741 - RNA, 17 nt, Human
ccugcacaagccagggu

SEQ ID NO: 1902742 - RNA, 16 nt, Human
ccugcacaagccaggg

SEQ ID NO: 1902743 - RNA, 15 nt, Human
ccugcacaagccagg

SEQ ID NO: 1902744 - RNA, 14 nt, Human
ccugaucagaccac

SEQ ID NO: 1902745 - RNA, 18 nt, Human
ccugaucagaccacggcu

SEQ ID NO: 1902746 - RNA, 19 nt, Human
ccugaucagaccacggcuc

SEQ ID NO: 1902747 - RNA, 13 nt, Human
ccugauccuggag

SEQ ID NO: 1902748 - RNA, 15 nt, Human
ccugauccuggaggc

SEQ ID NO: 1902749 - RNA, 18 nt, Human
ccugauccuggaggccca

SEQ ID NO: 1902750 - RNA, 19 nt, Human
ccugauccuggaggcccag

SEQ ID NO: 1902751 - RNA, 20 nt, Human
ccugauccuggaggcccagu

SEQ ID NO: 1902752 - RNA, 24 nt, Human
ccugccacccugggccuggcagcu

SEQ ID NO: 1902753 - RNA, 22 nt, Human
ccugccacccuggggagaaagu

SEQ ID NO: 1902754 - RNA, 16 nt, Human
ccugccacccugggga

SEQ ID NO: 1902755 - RNA, 15 nt, Human
ccugccacccugggc

SEQ ID NO: 1902756 - RNA, 21 nt, Human
ccugccacccugggccuggca

SEQ ID NO: 1902757 - RNA, 14 nt, Human
ccugccacccuggg

SEQ ID NO: 1902758 - RNA, 13 nt, Human
ccugccacccugg

SEQ ID NO: 1902759 - RNA, 12 nt, Human
ccugccacccug

SEQ ID NO: 1902760 - RNA, 19 nt, Human
ccugccaauggacuaacuu

SEQ ID NO: 1902761 - RNA, 17 nt, Human
ccugaggcuccacuugg

SEQ ID NO: 1902762 - RNA, 21 nt, Human
ccugaggccucuggaaagcaa

SEQ ID NO: 1902763 - RNA, 14 nt, Human
ccugaggcuccacu

SEQ ID NO: 1902764 - RNA, 13 nt, Human
ccugaggcuccac

SEQ ID NO: 1902765 - RNA, 13 nt, Human
ccugaggcugggc

SEQ ID NO: 1902766 - RNA, 14 nt, Human
ccugaggcugggcu

SEQ ID NO: 1902767 - RNA, 15 nt, Human
ccugaggcugggcuc

SEQ ID NO: 1902768 - RNA, 16 nt, Human
ccugaggcugggcucc

SEQ ID NO: 1902769 - RNA, 12 nt, Human
ccugagcuggga

SEQ ID NO: 1902770 - RNA, 15 nt, Human
ccugaggcccagagg

SEQ ID NO: 1902771 - RNA, 16 nt, Human
ccugaggcccagaggg

SEQ ID NO: 1902772 - RNA, 17 nt, Human
ccugaggcccagagggc

SEQ ID NO: 1902773 - RNA, 18 nt, Human
ccugaggcccagagggcc

SEQ ID NO: 1902774 - RNA, 15 nt, Human
ccugagccagauuuc

SEQ ID NO: 1902775 - RNA, 16 nt, Human
ccugagccagauuuca

SEQ ID NO: 1902776 - RNA, 18 nt, Human
ccugagccagauuucacu

SEQ ID NO: 1902777 - RNA, 19 nt, Human
ccugaagucacacagugag

SEQ ID NO: 1902778 - RNA, 20 nt, Human
ccugaagucacacagugagu

SEQ ID NO: 1902779 - RNA, 22 nt, Human
ccugaagucuuuguacagacaa

SEQ ID NO: 1902780 - RNA, 20 nt, Human
ccugagccagauuucacucu

SEQ ID NO: 1902781 - RNA, 23 nt, Human
ccugagcgcuccugccgcagagc

SEQ ID NO: 1902782 - RNA, 21 nt, Human
ccugagcgcuccugccgcaga

SEQ ID NO: 1902783 - RNA, 16 nt, Human
ccugagcgcuccugcc

SEQ ID NO: 1902784 - RNA, 12 nt, Human
ccugagcgcucc

SEQ ID NO: 1902785 - RNA, 17 nt, Human
ccugagcgccugggucc

SEQ ID NO: 1902786 - RNA, 21 nt, Human
ccugaagccaggccauggcua

SEQ ID NO: 1902787 - RNA, 14 nt, Human
ccugaaggccccgc

SEQ ID NO: 1902788 - RNA, 18 nt, Human
ccugaaggccccgcccag

SEQ ID NO: 1902789 - RNA, 19 nt, Human
ccugaaggccccgcccagg

SEQ ID NO: 1902790 - RNA, 22 nt, Human
ccugaaggccccgcccaggcuu

SEQ ID NO: 1902791 - RNA, 20 nt, Human
ccugaaggggccaugauggc

SEQ ID NO: 1902792 - RNA, 14 nt, Human
ccugaaggggcguc

SEQ ID NO: 1902793 - RNA, 16 nt, Human
ccugaaggggcgucug

SEQ ID NO: 1902794 - RNA, 22 nt, Human
ccugaaggggcgucuguucccc

SEQ ID NO: 1902795 - RNA, 20 nt, Human
ccugaaggccccgcccaggc

SEQ ID NO: 1902796 - RNA, 21 nt, Human
ccugaaggccccgcccaggcu

SEQ ID NO: 1902797 - RNA, 13 nt, Human
ccugaaagaggaa

SEQ ID NO: 1902798 - RNA, 13 nt, Human
ccugaaagcccug

SEQ ID NO: 1902799 - RNA, 14 nt, Human
ccugaaagcccuga

SEQ ID NO: 1902800 - RNA, 18 nt, Human
ccugaaagcccugagcuu

SEQ ID NO: 1902801 - RNA, 19 nt, Human
ccugaagagaagggcaggg

SEQ ID NO: 1902802 - RNA, 21 nt, Human
ccugaagaguccucugaauga

SEQ ID NO: 1902803 - RNA, 15 nt, Human
ccucuuccugccuag

SEQ ID NO: 1902804 - RNA, 15 nt, Human
ccucuuccuuuagga

SEQ ID NO: 1902805 - RNA, 15 nt, Human
ccugaaacaacuugg

SEQ ID NO: 1902806 - RNA, 18 nt, Human
ccucuucauggauggggg

SEQ ID NO: 1902807 - RNA, 15 nt, Human
ccucuuccaggcccc

SEQ ID NO: 1902808 - RNA, 15 nt, Human
ccugagcugggauga

SEQ ID NO: 1902809 - RNA, 22 nt, Human
ccuggccacgcagccaggacac

SEQ ID NO: 1902810 - RNA, 20 nt, Human
ccuggccacgcagccaggac

SEQ ID NO: 1902811 - RNA, 19 nt, Human
ccuggccacgcagccagga

SEQ ID NO: 1902812 - RNA, 17 nt, Human
ccuggccaucccacaag

SEQ ID NO: 1902813 - RNA, 19 nt, Human
ccuggccaucccacaagug

SEQ ID NO: 1902814 - RNA, 13 nt, Human
ccuggcccacugc

SEQ ID NO: 1902815 - RNA, 14 nt, Human
ccuggcccacugca

SEQ ID NO: 1902816 - RNA, 18 nt, Human
ccuggccacgcagccagg

SEQ ID NO: 1902817 - RNA, 15 nt, Human
ccuggccacgcagcc

SEQ ID NO: 1902818 - RNA, 20 nt, Human
ccuggccagaugcaccagcc

SEQ ID NO: 1902819 - RNA, 23 nt, Human
ccuggccagaugcaccagcccuu

SEQ ID NO: 1902820 - RNA, 21 nt, Human
ccuggccagaugcaccagccc

SEQ ID NO: 1902821 - RNA, 13 nt, Human
ccuggcacugcuu

SEQ ID NO: 1902822 - RNA, 16 nt, Human
ccuggcacugcuucca

SEQ ID NO: 1902823 - RNA, 13 nt, Human
ccuggcaugggaa

SEQ ID NO: 1902824 - RNA, 21 nt, Human
ccuggcacccggccccugcug

SEQ ID NO: 1902825 - RNA, 20 nt, Human
ccuggcacccggccccugcu

SEQ ID NO: 1902826 - RNA, 12 nt, Human
ccuggcacugcu

SEQ ID NO: 1902827 - RNA, 19 nt, Human
ccuggagacuaaccccacc

SEQ ID NO: 1902828 - RNA, 19 nt, Human
ccuggcacccggccccugc

SEQ ID NO: 1902829 - RNA, 21 nt, Human
ccugcuaauuccccagauugc

SEQ ID NO: 1902830 - RNA, 20 nt, Human
ccugccuguugggccaggag

SEQ ID NO: 1902831 - RNA, 18 nt, Human
ccugccuguugggccagg

SEQ ID NO: 1902832 - RNA, 19 nt, Human
ccugccuguugggccagga

SEQ ID NO: 1902833 - RNA, 17 nt, Human
ccuggcucccaggacac

SEQ ID NO: 1902834 - RNA, 16 nt, Human
ccuggcucccaggaca

SEQ ID NO: 1902835 - RNA, 15 nt, Human
ccuggcucccaggac

SEQ ID NO: 1902836 - RNA, 14 nt, Human
ccuggcucccagga

SEQ ID NO: 1902837 - RNA, 13 nt, Human
ccuggccccagga

SEQ ID NO: 1902838 - RNA, 12 nt, Human
ccuggccccagg

SEQ ID NO: 1902839 - RNA, 16 nt, Human
ccuggcccacugcauc

SEQ ID NO: 1902840 - RNA, 15 nt, Human
ccugggcagaaggaa

SEQ ID NO: 1902841 - RNA, 18 nt, Human
ccugggagugagcugguu

SEQ ID NO: 1902842 - RNA, 16 nt, Human
ccugggcagaaggaag

SEQ ID NO: 1902843 - RNA, 16 nt, Human
ccugggagugagcugg

SEQ ID NO: 1902844 - RNA, 22 nt, Human
ccugggaggucaaggcugcagu

SEQ ID NO: 1902845 - RNA, 20 nt, Human
ccugggggcugggcagagga

SEQ ID NO: 1902846 - RNA, 21 nt, Human
ccugggggcugggcagaggaa

SEQ ID NO: 1902847 - RNA, 19 nt, Human
ccugggggcugggcagagg

SEQ ID NO: 1902848 - RNA, 12 nt, Human
ccuggggggcag

SEQ ID NO: 1902849 - RNA, 14 nt, Human
ccuggggucuggag

SEQ ID NO: 1902850 - RNA, 21 nt, Human
ccugggguggggauagggagc

SEQ ID NO: 1902851 - RNA, 15 nt, Human
ccuggggugggguca

SEQ ID NO: 1902852 - RNA, 14 nt, Human
ccuggcaugggaau

SEQ ID NO: 1902853 - RNA, 21 nt, Human
ccuguaguugcguggacucug

SEQ ID NO: 1902854 - RNA, 16 nt, Human
ccuguauaaguggagg

SEQ ID NO: 1902855 - RNA, 18 nt, Human
ccuguauaaguggaggca

SEQ ID NO: 1902856 - RNA, 23 nt, Human
ccuguaguugcguggacucugca

SEQ ID NO: 1902857 - RNA, 13 nt, Human
ccuguagcccuaa

SEQ ID NO: 1902858 - RNA, 15 nt, Human
ccuguagagugggag

SEQ ID NO: 1902859 - RNA, 16 nt, Human
ccuguagagugggagc

SEQ ID NO: 1902860 - RNA, 14 nt, Human
ccugguggcagugg

SEQ ID NO: 1902861 - RNA, 13 nt, Human
ccugguggcagug

SEQ ID NO: 1902862 - RNA, 15 nt, Human
ccugguggcaguggg

SEQ ID NO: 1902863 - RNA, 12 nt, Human
ccuguaccucuu

SEQ ID NO: 1902864 - RNA, 10 nt, Human
ccuguaccuc

SEQ ID NO: 1902865 - RNA, 12 nt, Human
ccugucccccug

SEQ ID NO: 1902866 - RNA, 13 nt, Human
ccugucccccuga

SEQ ID NO: 1902867 - RNA, 14 nt, Human
ccugucccccugac

SEQ ID NO: 1902868 - RNA, 15 nt, Human
ccugucccccugaca

SEQ ID NO: 1902869 - RNA, 23 nt, Human
ccuguauauagcccagccaggcc

SEQ ID NO: 1902870 - RNA, 22 nt, Human
ccuguauaaguggaggcacuuu

SEQ ID NO: 1902871 - RNA, 23 nt, Human
ccuguauaaguggaggcacuuua

SEQ ID NO: 1902872 - RNA, 13 nt, Human
ccuguauauagcc

SEQ ID NO: 1902873 - RNA, 16 nt, Human
ccuguauauagcccag

SEQ ID NO: 1902874 - RNA, 21 nt, Human
ccuguauauagcccagccagg

SEQ ID NO: 1902875 - RNA, 18 nt, Human
ccugguggcagcugcggu

SEQ ID NO: 1902876 - RNA, 17 nt, Human
ccugguggcagcugcgg

SEQ ID NO: 1902877 - RNA, 16 nt, Human
ccugguggcagcugcg

SEQ ID NO: 1902878 - RNA, 15 nt, Human
ccugguggcagcugc

SEQ ID NO: 1902879 - RNA, 14 nt, Human
ccugguggcagcug

SEQ ID NO: 1902880 - RNA, 22 nt, Human
ccugguggcagcucaccucucc

SEQ ID NO: 1902881 - RNA, 19 nt, Human
ccugguggcagcucaccuc

SEQ ID NO: 1902882 - RNA, 21 nt, Human
ccugguggcagcucaccucuc

SEQ ID NO: 1902883 - RNA, 20 nt, Human
ccugguccucacacucaccc

SEQ ID NO: 1902884 - RNA, 23 nt, Human
ccuggguccaggggaggccuucc

SEQ ID NO: 1902885 - RNA, 18 nt, Human
gaaaaucuuauaauuuaa

SEQ ID NO: 1902886 - RNA, 22 nt, Human
gaaaaucuacacuccagugaga

SEQ ID NO: 1902887 - RNA, 20 nt, Human
gaaaaucagccugcuccagc

SEQ ID NO: 1902888 - RNA, 22 nt, Human
gaaaaucagccugcuccagcug

SEQ ID NO: 1902889 - RNA, 19 nt, Human
gaaaaguuuuguaaauuuc

SEQ ID NO: 1902890 - RNA, 17 nt, Human
gaaaauauuuugaucuu

SEQ ID NO: 1902891 - RNA, 13 nt, Human
gaaaauauuuaaa

SEQ ID NO: 1902892 - RNA, 19 nt, Human
gaaaauauuuugaucuuca

SEQ ID NO: 1902893 - RNA, 20 nt, Human
gaaaauauuuugaucuucaa

SEQ ID NO: 1902894 - RNA, 23 nt, Human
gaaaauauuuugaucuucaacaa

SEQ ID NO: 1902895 - RNA, 12 nt, Human
gaaaaggcaaaa

SEQ ID NO: 1902896 - RNA, 11 nt, Human
gaaaaggcagg

SEQ ID NO: 1902897 - RNA, 15 nt, Human
gaaaaguugaauuuu

SEQ ID NO: 1902898 - RNA, 14 nt, Human
gaaaaguugaauuu

SEQ ID NO: 1902899 - RNA, 19 nt, Human
gaaaagcugcugacagugu

SEQ ID NO: 1902900 - RNA, 20 nt, Human
gaaaacguggcugcuucaag

SEQ ID NO: 1902901 - RNA, 22 nt, Human
gaaaacguggcugcuucaagga

SEQ ID NO: 1902902 - RNA, 24 nt, Human
gaaaacacuguucucugcccucca

SEQ ID NO: 1902903 - RNA, 22 nt, Human
gaaaacacuguucucugcccuc

SEQ ID NO: 1902904 - RNA, 13 nt, Human
gaaaacagaccua

SEQ ID NO: 1902905 - RNA, 22 nt, Human
gaaaacaggacuuaaaaugaca

SEQ ID NO: 1902906 - RNA, 21 nt, Human
gaaaacagaccuaaugcuccu

SEQ ID NO: 1902907 - RNA, 20 nt, Human
gaaaacaggacuuaaaauga

SEQ ID NO: 1902908 - RNA, 18 nt, Human
cuuuuugaaaucagcaua

SEQ ID NO: 1902909 - RNA, 21 nt, Human
cuuuuucuuuuuuucuuuggu

SEQ ID NO: 1902910 - RNA, 15 nt, Human
cuuuuugaaaucagc

SEQ ID NO: 1902911 - RNA, 17 nt, Human
cuuuuuuggcugcugaa

SEQ ID NO: 1902912 - RNA, 20 nt, Human
cuuuuuuggcugcugaaggc

SEQ ID NO: 1902913 - RNA, 22 nt, Human
cuuuuuuggcugcugaaggcuc

SEQ ID NO: 1902914 - RNA, 18 nt, Human
gaaaacacuguucucugc

SEQ ID NO: 1902915 - RNA, 19 nt, Human
gaaaacacauuuuucuuag

SEQ ID NO: 1902916 - RNA, 18 nt, Human
gaaaacacauuuuucuua

SEQ ID NO: 1902917 - RNA, 12 nt, Human
gaaaaaggagga

SEQ ID NO: 1902918 - RNA, 15 nt, Human
gaaaaaggaggaaga

SEQ ID NO: 1902919 - RNA, 16 nt, Human
cuuuuuuggcugcuga

SEQ ID NO: 1902920 - RNA, 17 nt, Human
cuuuuuauggccuguga

SEQ ID NO: 1902921 - RNA, 20 nt, Human
cuuuuguucuugguuuguaa

SEQ ID NO: 1902922 - RNA, 13 nt, Human
cuuuuguucgcau

SEQ ID NO: 1902923 - RNA, 14 nt, Human
cuuuuguucccauc

SEQ ID NO: 1902924 - RNA, 15 nt, Human
cuuuuuauugaaucu

SEQ ID NO: 1902925 - RNA, 17 nt, Human
cuuuuuauugaaucuau

SEQ ID NO: 1902926 - RNA, 17 nt, Human
cuuuuguucccauccuc

SEQ ID NO: 1902927 - RNA, 13 nt, Human
cuuuuuauugaau

SEQ ID NO: 1902928 - RNA, 14 nt, Human
cuuuuuauugaauc

SEQ ID NO: 1902929 - RNA, 19 nt, Human
cuuuuuauugaaucuauuu

SEQ ID NO: 1902930 - RNA, 18 nt, Human
cuuuguuaguuucuccaa

SEQ ID NO: 1902931 - RNA, 17 nt, Human
cuuuguuaaguucuauu

SEQ ID NO: 1902932 - RNA, 19 nt, Human
cuuuguguucuuuguguca

SEQ ID NO: 1902933 - RNA, 12 nt, Human
cuuuuguucuug

SEQ ID NO: 1902934 - RNA, 11 nt, Human
cuuuuguucuu

SEQ ID NO: 1902935 - RNA, 19 nt, Human
gaaacuaggugcauauuua

SEQ ID NO: 1902936 - RNA, 16 nt, Human
gaaacgucuucuaaac

SEQ ID NO: 1902937 - RNA, 20 nt, Human
gaaaccuuauuguaccucuc

SEQ ID NO: 1902938 - RNA, 17 nt, Human
gaaaccuuauuguaccu

SEQ ID NO: 1902939 - RNA, 19 nt, Human
gaaaccuuauuguaccucu

SEQ ID NO: 1902940 - RNA, 14 nt, Human
gaaacccugucucu

SEQ ID NO: 1902941 - RNA, 16 nt, Human
gaaaccugggauucag

SEQ ID NO: 1902942 - RNA, 23 nt, Human
gaaacccagcucugguccauaga

SEQ ID NO: 1902943 - RNA, 21 nt, Human
gaaaccauuaugaagaagaga

SEQ ID NO: 1902944 - RNA, 13 nt, Human
gaaacccagcucu

SEQ ID NO: 1902945 - RNA, 14 nt, Human
gaaacccagcucug

SEQ ID NO: 1902946 - RNA, 15 nt, Human
gaaacccagcucugg

SEQ ID NO: 1902947 - RNA, 16 nt, Human
gaaacccagcucuggu

SEQ ID NO: 1902948 - RNA, 18 nt, Human
gaaacccagcucuggucc

SEQ ID NO: 1902949 - RNA, 19 nt, Human
gaaacccagcucuggucca

SEQ ID NO: 1902950 - RNA, 13 nt, Human
gaaacacagaaac

SEQ ID NO: 1902951 - RNA, 16 nt, Human
gaaaaugaaucccucu

SEQ ID NO: 1902952 - RNA, 20 nt, Human
gaaaaugcaacaacauguau

SEQ ID NO: 1902953 - RNA, 18 nt, Human
gaaaaugcaacaacaugu

SEQ ID NO: 1902954 - RNA, 23 nt, Human
gaaaaugauguguacccaaacgu

SEQ ID NO: 1902955 - RNA, 22 nt, Human
gaaaaugcagcagggaugcccu

SEQ ID NO: 1902956 - RNA, 14 nt, Human
gaaaaugcagcagg

SEQ ID NO: 1902957 - RNA, 17 nt, Human
gaaagcccugugcucca

SEQ ID NO: 1902958 - RNA, 14 nt, Human
gaaagcgcagaugc

SEQ ID NO: 1902959 - RNA, 17 nt, Human
gaaagcccugagcuuuc

SEQ ID NO: 1902960 - RNA, 15 nt, Human
gaaagccccagaaau

SEQ ID NO: 1902961 - RNA, 21 nt, Human
gaaagcccugagcuuucugcu

SEQ ID NO: 1902962 - RNA, 22 nt, Human
gaaagcccugagcuuucugcua

SEQ ID NO: 1902963 - RNA, 14 nt, Human
gaaagcagggacuu

SEQ ID NO: 1902964 - RNA, 19 nt, Human
gaaagacuuuuccaacccu

SEQ ID NO: 1902965 - RNA, 17 nt, Human
gaaagacuguacaaagu

SEQ ID NO: 1902966 - RNA, 21 nt, Human
gaaagaggaaugaaguacuca

SEQ ID NO: 1902967 - RNA, 21 nt, Human
gaaagaguacucuuguuuccu

SEQ ID NO: 1902968 - RNA, 15 nt, Human
gaaagaguaggaaga

SEQ ID NO: 1902969 - RNA, 16 nt, Human
gaaagaguaggaagac

SEQ ID NO: 1902970 - RNA, 17 nt, Human
gaaagcagaacagugau

SEQ ID NO: 1902971 - RNA, 22 nt, Human
gaaagcagaacagugauuacca

SEQ ID NO: 1902972 - RNA, 22 nt, Human
cuuuaucuaauaccucugugug

SEQ ID NO: 1902973 - RNA, 21 nt, Human
cuuuaucuaauaccucugugu

SEQ ID NO: 1902974 - RNA, 18 nt, Human
cuuuaucuugaauaaugu

SEQ ID NO: 1902975 - RNA, 21 nt, Human
cuuuaucuugaauaauguaag

SEQ ID NO: 1902976 - RNA, 23 nt, Human
cuuuaucuugaauaauguaagac

SEQ ID NO: 1902977 - RNA, 15 nt, Human
cuuuaugcacaaaau

SEQ ID NO: 1902978 - RNA, 20 nt, Human
cuuuauauggccucaagauc

SEQ ID NO: 1902979 - RNA, 15 nt, Human
cuuuagcgcccaguu

SEQ ID NO: 1902980 - RNA, 14 nt, Human
cuuuagcgcccagu

SEQ ID NO: 1902981 - RNA, 13 nt, Human
cuuuauaauucua

SEQ ID NO: 1902982 - RNA, 19 nt, Human
cuuuauaauucuacuuuga

SEQ ID NO: 1902983 - RNA, 13 nt, Human
cuuuacuauggcc

SEQ ID NO: 1902984 - RNA, 18 nt, Human
cuuuacggacacccccuc

SEQ ID NO: 1902985 - RNA, 22 nt, Human
cuuuaccuuuuuuauacauaaa

SEQ ID NO: 1902986 - RNA, 12 nt, Human
cuuguuccuaga

SEQ ID NO: 1902987 - RNA, 13 nt, Human
cuuguuauuuaua

SEQ ID NO: 1902988 - RNA, 15 nt, Human
cuuguuauuuauaac

SEQ ID NO: 1902989 - RNA, 23 nt, Human
cuuguacauguguagccugugca

SEQ ID NO: 1902990 - RNA, 22 nt, Human
cuuguacauguguagccugugc

SEQ ID NO: 1902991 - RNA, 20 nt, Human
cuuguacauguguagccugu

SEQ ID NO: 1902992 - RNA, 19 nt, Human
cuuguacauguguagccug

SEQ ID NO: 1902993 - RNA, 14 nt, Human
cuuguacaugugua

SEQ ID NO: 1902994 - RNA, 22 nt, Human
cuuguauagguuuuaaagaccu

SEQ ID NO: 1902995 - RNA, 12 nt, Human
cuuguccagcug

SEQ ID NO: 1902996 - RNA, 13 nt, Human
cuuguccagcuga

SEQ ID NO: 1902997 - RNA, 13 nt, Human
cuuguacaugugu

SEQ ID NO: 1902998 - RNA, 21 nt, Human
cuuguaaauagcucagguguc

SEQ ID NO: 1902999 - RNA, 22 nt, Human
cuuguacauaaugcgugcauac

SEQ ID NO: 1903000 - RNA, 21 nt, Human
cuuguacauaaugcgugcaua

SEQ ID NO: 1903001 - RNA, 19 nt, Human
cuuguacauaaugcgugca

SEQ ID NO: 1903002 - RNA, 18 nt, Human
cuuguaaauagcucaggu

SEQ ID NO: 1903003 - RNA, 17 nt, Human
cuuguaaauagcucagg

SEQ ID NO: 1903004 - RNA, 12 nt, Human
cuuguacauaau

SEQ ID NO: 1903005 - RNA, 15 nt, Human
cuuguacauaaugcg

SEQ ID NO: 1903006 - RNA, 19 nt, Human
cuugaguuuaaauuguaau

SEQ ID NO: 1903007 - RNA, 23 nt, Human
cuuggggggcugaggugggagga

SEQ ID NO: 1903008 - RNA, 16 nt, Human
cuuguaaauagcucag

SEQ ID NO: 1903009 - RNA, 13 nt, Human
cuuucuggcucuc

SEQ ID NO: 1903010 - RNA, 13 nt, Human
cuuucuguauaua

SEQ ID NO: 1903011 - RNA, 20 nt, Human
cuuucuggcuaugcauuuga

SEQ ID NO: 1903012 - RNA, 19 nt, Human
cuuucuggcuaugcauuug

SEQ ID NO: 1903013 - RNA, 18 nt, Human
cuuucuggcuaugcauuu

SEQ ID NO: 1903014 - RNA, 17 nt, Human
cuuucuggcuaugcauu

SEQ ID NO: 1903015 - RNA, 13 nt, Human
cuuuccugaggcu

SEQ ID NO: 1903016 - RNA, 15 nt, Human
cuuuccugaggcugg

SEQ ID NO: 1903017 - RNA, 19 nt, Human
cuuucugcucagcuucucc

SEQ ID NO: 1903018 - RNA, 16 nt, Human
cuuuaugguaaagaug

SEQ ID NO: 1903019 - RNA, 12 nt, Human
cuuuaugcugaa

SEQ ID NO: 1903020 - RNA, 15 nt, Human
cuuuaugcugaaaca

SEQ ID NO: 1903021 - RNA, 23 nt, Human
cuuuauguacaggaugcuuuggu

SEQ ID NO: 1903022 - RNA, 21 nt, Human
cuuuauguacaggaugcuuug

SEQ ID NO: 1903023 - RNA, 15 nt, Human
cuuuccaucuacccu

SEQ ID NO: 1903024 - RNA, 15 nt, Human
cuuuccaggaaggcu

SEQ ID NO: 1903025 - RNA, 22 nt, Human
cuuuccauuugguuuagaacau

SEQ ID NO: 1903026 - RNA, 12 nt, Human
cuuuccugaggc

SEQ ID NO: 1903027 - RNA, 19 nt, Human
cuuucccugcuuaaugaaa

SEQ ID NO: 1903028 - RNA, 11 nt, Human
cuuucccuccc

SEQ ID NO: 1903029 - RNA, 13 nt, Human
cuuucccucccuu

SEQ ID NO: 1903030 - RNA, 14 nt, Human
cuuucccucccuuc

SEQ ID NO: 1903031 - RNA, 16 nt, Human
cuuucccucccuuccu

SEQ ID NO: 1903032 - RNA, 19 nt, Human
cuuuggcuauuagagauca

SEQ ID NO: 1903033 - RNA, 19 nt, Human
cuuuggcuaugagggccuu

SEQ ID NO: 1903034 - RNA, 14 nt, Human
cuuuguccccaccg

SEQ ID NO: 1903035 - RNA, 15 nt, Human
cuuugugaggaagcc

SEQ ID NO: 1903036 - RNA, 15 nt, Human
cuuuguccccaccgc

SEQ ID NO: 1903037 - RNA, 20 nt, Human
cuuugcagacaggcaagcac

SEQ ID NO: 1903038 - RNA, 13 nt, Human
cuuugaccucugc

SEQ ID NO: 1903039 - RNA, 16 nt, Human
cuuugcagacaggcaa

SEQ ID NO: 1903040 - RNA, 22 nt, Human
cuuugcauaacguauaaaagcc

SEQ ID NO: 1903041 - RNA, 24 nt, Human
cuuugaccucugcagcaauaaagc

SEQ ID NO: 1903042 - RNA, 20 nt, Human
cuuugaccucugcagcaaua

SEQ ID NO: 1903043 - RNA, 18 nt, Human
cuuugaccucugcagcaa

SEQ ID NO: 1903044 - RNA, 17 nt, Human
cuuugaccucugcagca

SEQ ID NO: 1903045 - RNA, 15 nt, Human
cuuugaccucugcag

SEQ ID NO: 1903046 - RNA, 14 nt, Human
cuuugaccucugca

SEQ ID NO: 1903047 - RNA, 22 nt, Human
cuucucccugcacaagccaggg

SEQ ID NO: 1903048 - RNA, 13 nt, Human
cuucuccaggcug

SEQ ID NO: 1903049 - RNA, 12 nt, Human
cuucuccaggcu

SEQ ID NO: 1903050 - RNA, 17 nt, Human
cuuccuggagcccagag

SEQ ID NO: 1903051 - RNA, 16 nt, Human
cuuccuggagcccaga

SEQ ID NO: 1903052 - RNA, 22 nt, Human
cuuccuggagcccagaggaggg

SEQ ID NO: 1903053 - RNA, 16 nt, Human
cuuccuguccagcucc

SEQ ID NO: 1903054 - RNA, 11 nt, Human
cuucuccacuu

SEQ ID NO: 1903055 - RNA, 20 nt, Human
cuucuccacuuucuagccag

SEQ ID NO: 1903056 - RNA, 13 nt, Human
cuucucugaagga

SEQ ID NO: 1903057 - RNA, 18 nt, Human
cuucucucucuaaaauga

SEQ ID NO: 1903058 - RNA, 20 nt, Human
cuucuccugaaguucagcca

SEQ ID NO: 1903059 - RNA, 20 nt, Human
cuucuccuuagaaguggaag

SEQ ID NO: 1903060 - RNA, 19 nt, Human
cuucuccuucaccuuuguc

SEQ ID NO: 1903061 - RNA, 12 nt, Human
cuucucuccagc

SEQ ID NO: 1903062 - RNA, 14 nt, Human
cuucuccucuugua

SEQ ID NO: 1903063 - RNA, 15 nt, Human
cuucuccucuuguaa

SEQ ID NO: 1903064 - RNA, 17 nt, Human
cuucuccucuuguaaau

SEQ ID NO: 1903065 - RNA, 18 nt, Human
cuucuccucuuguaaaua

SEQ ID NO: 1903066 - RNA, 23 nt, Human
cuucuccucuuguaaauaaagcc

SEQ ID NO: 1903067 - RNA, 13 nt, Human
cuucucuccagcc

SEQ ID NO: 1903068 - RNA, 15 nt, Human
cuucucuccagcccc

SEQ ID NO: 1903069 - RNA, 17 nt, Human
cuucucuccagccccug

SEQ ID NO: 1903070 - RNA, 19 nt, Human
cuucucuccagccccugga

SEQ ID NO: 1903071 - RNA, 12 nt, Human
cuucugccugca

SEQ ID NO: 1903072 - RNA, 18 nt, Human
cuucugccuguggaacug

SEQ ID NO: 1903073 - RNA, 13 nt, Human
cuucugcuucagc

SEQ ID NO: 1903074 - RNA, 21 nt, Human
cuucuggugaccuuccaagag

SEQ ID NO: 1903075 - RNA, 20 nt, Human
cuucuggugaccuuccaaga

SEQ ID NO: 1903076 - RNA, 18 nt, Human
cuucuggugaccuuccaa

SEQ ID NO: 1903077 - RNA, 15 nt, Human
cuucuggguggggca

SEQ ID NO: 1903078 - RNA, 21 nt, Human
cuucuguccuacucuguguca

SEQ ID NO: 1903079 - RNA, 19 nt, Human
cuucuguccuacucugugu

SEQ ID NO: 1903080 - RNA, 18 nt, Human
cuucuguccuacucugug

SEQ ID NO: 1903081 - RNA, 17 nt, Human
cuucuguccuacucugu

SEQ ID NO: 1903082 - RNA, 16 nt, Human
cuucuguccuacucug

SEQ ID NO: 1903083 - RNA, 20 nt, Human
cuucuguacgucugacaggc

SEQ ID NO: 1903084 - RNA, 18 nt, Human
cuucuguacgucugacag

SEQ ID NO: 1903085 - RNA, 15 nt, Human
cuucuguacgucuga

SEQ ID NO: 1903086 - RNA, 14 nt, Human
cuucuguacgucug

SEQ ID NO: 1903087 - RNA, 21 nt, Human
cuucuguacgucugacaggca

SEQ ID NO: 1903088 - RNA, 13 nt, Human
cuucuguggguuu

SEQ ID NO: 1903089 - RNA, 14 nt, Human
cuucuguggguuuc

SEQ ID NO: 1903090 - RNA, 21 nt, Human
cuucuguggguuucuaaagcu

SEQ ID NO: 1903091 - RNA, 22 nt, Human
cuucuuuauaauucuacuuuga

SEQ ID NO: 1903092 - RNA, 12 nt, Human
cuugaaaaaugc

SEQ ID NO: 1903093 - RNA, 18 nt, Human
cuugaaaaaugcauguug

SEQ ID NO: 1903094 - RNA, 14 nt, Human
cuugaaaacacugu

SEQ ID NO: 1903095 - RNA, 23 nt, Human
cuugaaaacacuguucucugccc

SEQ ID NO: 1903096 - RNA, 16 nt, Human
cuugaaaauaagaaua

SEQ ID NO: 1903097 - RNA, 12 nt, Human
cuugaaaauuaa

SEQ ID NO: 1903098 - RNA, 13 nt, Human
cuugaaaauuaac

SEQ ID NO: 1903099 - RNA, 18 nt, Human
cuugaaaauuaacaugaa

SEQ ID NO: 1903100 - RNA, 22 nt, Human
cuugaaaauaagaauagaaaua

SEQ ID NO: 1903101 - RNA, 13 nt, Human
cuugaaagcugug

SEQ ID NO: 1903102 - RNA, 13 nt, Human
cuugaacuccugg

SEQ ID NO: 1903103 - RNA, 15 nt, Human
cuugaacccaggaga

SEQ ID NO: 1903104 - RNA, 21 nt, Human
cuugaacuuugaccucugcag

SEQ ID NO: 1903105 - RNA, 17 nt, Human
cuugaacuuugaccucu

SEQ ID NO: 1903106 - RNA, 13 nt, Human
cuugaccucaggu

SEQ ID NO: 1903107 - RNA, 21 nt, Human
cuugaccgugaggccagagac

SEQ ID NO: 1903108 - RNA, 18 nt, Human
cuugaccgugaggccaga

SEQ ID NO: 1903109 - RNA, 20 nt, Human
cuugaccgugaggccagaga

SEQ ID NO: 1903110 - RNA, 16 nt, Human
cuugaagacuuuucuu

SEQ ID NO: 1903111 - RNA, 17 nt, Human
cuugaccgugaggccag

SEQ ID NO: 1903112 - RNA, 22 nt, Human
cuugaccauucuccaccugcca

SEQ ID NO: 1903113 - RNA, 23 nt, Human
cuugaccauucuccaccugccag

SEQ ID NO: 1903114 - RNA, 20 nt, Human
cuugaggguugggcuggugu

SEQ ID NO: 1903115 - RNA, 19 nt, Human
cuugaggguugggcuggug

SEQ ID NO: 1903116 - RNA, 21 nt, Human
cuugaggguugggcugguguc

SEQ ID NO: 1903117 - RNA, 21 nt, Human
cuugaggaaacaacagcuuua

SEQ ID NO: 1903118 - RNA, 13 nt, Human
cuugaggaaacaa

SEQ ID NO: 1903119 - RNA, 18 nt, Human
cuugaggaaacaacagcu

SEQ ID NO: 1903120 - RNA, 20 nt, Human
cuugaggaaacaacagcuuu

SEQ ID NO: 1903121 - RNA, 15 nt, Human
cuugagccuugaacu

SEQ ID NO: 1903122 - RNA, 19 nt, Human
cuugacucuacugaucuga

SEQ ID NO: 1903123 - RNA, 18 nt, Human
cuugagccuugaacuuug

SEQ ID NO: 1903124 - RNA, 17 nt, Human
cuugagccuugaacuuu

SEQ ID NO: 1903125 - RNA, 16 nt, Human
cuugagccugggaggu

SEQ ID NO: 1903126 - RNA, 15 nt, Human
cuucacccuggagcc

SEQ ID NO: 1903127 - RNA, 18 nt, Human
cuucaccccaaucccagc

SEQ ID NO: 1903128 - RNA, 16 nt, Human
cuucaguaagccguga

SEQ ID NO: 1903129 - RNA, 23 nt, Human
cuucaguaagccgugauuuucau

SEQ ID NO: 1903130 - RNA, 16 nt, Human
cuucaguggcagcugc

SEQ ID NO: 1903131 - RNA, 15 nt, Human
cuucaguggcagcug

SEQ ID NO: 1903132 - RNA, 14 nt, Human
cuucaguggcagcu

SEQ ID NO: 1903133 - RNA, 13 nt, Human
cuucaguggcagc

SEQ ID NO: 1903134 - RNA, 18 nt, Human
cuucagugccuuauggaa

SEQ ID NO: 1903135 - RNA, 22 nt, Human
cuucagugccuuauggaacacu

SEQ ID NO: 1903136 - RNA, 17 nt, Human
cuucaguggcagcugcu

SEQ ID NO: 1903137 - RNA, 20 nt, Human
cuucauucaacccaccugcg

SEQ ID NO: 1903138 - RNA, 20 nt, Human
cuucauucuugaaagcugug

SEQ ID NO: 1903139 - RNA, 21 nt, Human
cuucauucuugaaagcugugg

SEQ ID NO: 1903140 - RNA, 17 nt, Human
cuuccacaagagcccag

SEQ ID NO: 1903141 - RNA, 19 nt, Human
cuuccacaagagcccaggc

SEQ ID NO: 1903142 - RNA, 21 nt, Human
cuuccacaagagcccaggccu

SEQ ID NO: 1903143 - RNA, 12 nt, Human
cuuccaggcugg

SEQ ID NO: 1903144 - RNA, 14 nt, Human
cuuccaggcuggga

SEQ ID NO: 1903145 - RNA, 17 nt, Human
cuucccuacaguugaaa

SEQ ID NO: 1903146 - RNA, 15 nt, Human
cuuccaggcugggag

SEQ ID NO: 1903147 - RNA, 16 nt, Human
cuuccaggcugggaga

SEQ ID NO: 1903148 - RNA, 19 nt, Human
cuuccaggcugggagagcc

SEQ ID NO: 1903149 - RNA, 19 nt, Human
cuuccagggacgaagaaga

SEQ ID NO: 1903150 - RNA, 14 nt, Human
cuuccagggguggg

SEQ ID NO: 1903151 - RNA, 15 nt, Human
cuuccagggguggga

SEQ ID NO: 1903152 - RNA, 17 nt, Human
cuuccaggggugggaca

SEQ ID NO: 1903153 - RNA, 21 nt, Human
cuuccaggggugggacacccu

SEQ ID NO: 1903154 - RNA, 22 nt, Human
cuuccagggacgaagaagagcc

SEQ ID NO: 1903155 - RNA, 23 nt, Human
cuucacagaugggugcuuggagg

SEQ ID NO: 1903156 - RNA, 14 nt, Human
cuucaaccagggau

SEQ ID NO: 1903157 - RNA, 22 nt, Human
cuucaaccagggauuguuucug

SEQ ID NO: 1903158 - RNA, 10 nt, Human
cuucaaggau

SEQ ID NO: 1903159 - RNA, 13 nt, Human
cuucaaggauccu

SEQ ID NO: 1903160 - RNA, 15 nt, Human
cuucaaggauccuga

SEQ ID NO: 1903161 - RNA, 16 nt, Human
cuucaaggauccugag

SEQ ID NO: 1903162 - RNA, 17 nt, Human
cuuauuuaaugaaagac

SEQ ID NO: 1903163 - RNA, 18 nt, Human
cuuauuuaaugaaagacu

SEQ ID NO: 1903164 - RNA, 21 nt, Human
cuucaaacuaggggacaaagc

SEQ ID NO: 1903165 - RNA, 21 nt, Human
cuguucucuugggaacugaac

SEQ ID NO: 1903166 - RNA, 16 nt, Human
cuguucuggcagaguu

SEQ ID NO: 1903167 - RNA, 19 nt, Human
cuuagauguauauauuucc

SEQ ID NO: 1903168 - RNA, 16 nt, Human
cuuagucacugagaca

SEQ ID NO: 1903169 - RNA, 13 nt, Human
cuuagauguauau

SEQ ID NO: 1903170 - RNA, 18 nt, Human
cuuagucacugagacagc

SEQ ID NO: 1903171 - RNA, 19 nt, Human
cuuagucacugagacagcc

SEQ ID NO: 1903172 - RNA, 16 nt, Human
cuuagauggauucucc

SEQ ID NO: 1903173 - RNA, 14 nt, Human
cuuagucacugaga

SEQ ID NO: 1903174 - RNA, 13 nt, Human
cuuauauuaugga

SEQ ID NO: 1903175 - RNA, 23 nt, Human
cuuaucacaaaaaagaaaaugaa

SEQ ID NO: 1903176 - RNA, 19 nt, Human
cuuauaucuauauuuuaca

SEQ ID NO: 1903177 - RNA, 16 nt, Human
cuuaucccuucuuuuu

SEQ ID NO: 1903178 - RNA, 17 nt, Human
cuuaucccuucuuuuuc

SEQ ID NO: 1903179 - RNA, 14 nt, Human
cuuaucauggucuc

SEQ ID NO: 1903180 - RNA, 15 nt, Human
cuuaucauggucuca

SEQ ID NO: 1903181 - RNA, 15 nt, Human
cuuauagaauauuua

SEQ ID NO: 1903182 - RNA, 16 nt, Human
cuuauagaauauuuau

SEQ ID NO: 1903183 - RNA, 13 nt, Human
cuuauagaauauu

SEQ ID NO: 1903184 - RNA, 14 nt, Human
cuuauagaauauuu

SEQ ID NO: 1903185 - RNA, 20 nt, Human
cuuauagaauauuuauuacc

SEQ ID NO: 1903186 - RNA, 17 nt, Human
cuuauaggaaagcuuga

SEQ ID NO: 1903187 - RNA, 21 nt, Human
cuuauaggaaagcuugaguaa

SEQ ID NO: 1903188 - RNA, 18 nt, Human
cuguacacguguccugua

SEQ ID NO: 1903189 - RNA, 17 nt, Human
cuguacacguguccugu

SEQ ID NO: 1903190 - RNA, 16 nt, Human
cuguacacguguccug

SEQ ID NO: 1903191 - RNA, 13 nt, Human
cuguacagagccc

SEQ ID NO: 1903192 - RNA, 16 nt, Human
cuguaucacucugugu

SEQ ID NO: 1903193 - RNA, 15 nt, Human
cuguaucaguggauu

SEQ ID NO: 1903194 - RNA, 22 nt, Human
cuguauauuugugauagcacuu

SEQ ID NO: 1903195 - RNA, 23 nt, Human
cuguauauuugugauagcacuuu

SEQ ID NO: 1903196 - RNA, 14 nt, Human
cuguaucacucugu

SEQ ID NO: 1903197 - RNA, 14 nt, Human
cuguauauacuuuu

SEQ ID NO: 1903198 - RNA, 15 nt, Human
cuguauauacuuuuu

SEQ ID NO: 1903199 - RNA, 16 nt, Human
cuguauauagcccagc

SEQ ID NO: 1903200 - RNA, 22 nt, Human
cuguauaaguggaggcacuuua

SEQ ID NO: 1903201 - RNA, 21 nt, Human
cuguauaaguggaggcacuuu

SEQ ID NO: 1903202 - RNA, 23 nt, Human
cuguaucccaugagccucagcau

SEQ ID NO: 1903203 - RNA, 20 nt, Human
cuguaucaguggauuuccca

SEQ ID NO: 1903204 - RNA, 21 nt, Human
cuguccagcuccaaccugcaa

SEQ ID NO: 1903205 - RNA, 17 nt, Human
cuguccagcuccaaccu

SEQ ID NO: 1903206 - RNA, 18 nt, Human
cuguccagcuccaaccug

SEQ ID NO: 1903207 - RNA, 12 nt, Human
cuguccagcucc

SEQ ID NO: 1903208 - RNA, 13 nt, Human
cuguccagcucca

SEQ ID NO: 1903209 - RNA, 14 nt, Human
cuguccagcuccaa

SEQ ID NO: 1903210 - RNA, 17 nt, Human
cugucaaggcugcuuag

SEQ ID NO: 1903211 - RNA, 19 nt, Human
cugucaaggcugcuuagaa

SEQ ID NO: 1903212 - RNA, 20 nt, Human
cugucaaggcugcuuagaau

SEQ ID NO: 1903213 - RNA, 12 nt, Human
cuguccaggcuc

SEQ ID NO: 1903214 - RNA, 13 nt, Human
cuguccaggcucg

SEQ ID NO: 1903215 - RNA, 17 nt, Human
cuguccccgcacugggc

SEQ ID NO: 1903216 - RNA, 18 nt, Human
cuguccccgcacugggcu

SEQ ID NO: 1903217 - RNA, 19 nt, Human
cuguccccgcacugggcuu

SEQ ID NO: 1903218 - RNA, 22 nt, Human
cuguccccgcacugggcuuggg

SEQ ID NO: 1903219 - RNA, 14 nt, Human
cuguccgagcuuug

SEQ ID NO: 1903220 - RNA, 20 nt, Human
cugucccuuacgugaguccu

SEQ ID NO: 1903221 - RNA, 23 nt, Human
cuguccccuucucucaucucuua

SEQ ID NO: 1903222 - RNA, 22 nt, Human
cuguccccuucucucaucucuu

SEQ ID NO: 1903223 - RNA, 21 nt, Human
cuguccccuucucucaucucu

SEQ ID NO: 1903224 - RNA, 20 nt, Human
cuguccccuucucucaucuc

SEQ ID NO: 1903225 - RNA, 19 nt, Human
cuguccccuucucucaucu

SEQ ID NO: 1903226 - RNA, 16 nt, Human
cuguccccuucucuca

SEQ ID NO: 1903227 - RNA, 14 nt, Human
cuguccccuucucu

SEQ ID NO: 1903228 - RNA, 22 nt, Human
cugucccuuacgugaguccugg

SEQ ID NO: 1903229 - RNA, 15 nt, Human
cuguccgagcuuuga

SEQ ID NO: 1903230 - RNA, 14 nt, Human
cuguccuacccacc

SEQ ID NO: 1903231 - RNA, 13 nt, Human
cuguccucagccu

SEQ ID NO: 1903232 - RNA, 15 nt, Human
cuguccucagguggc

SEQ ID NO: 1903233 - RNA, 16 nt, Human
cuguccucagguggcc

SEQ ID NO: 1903234 - RNA, 17 nt, Human
cuguccucagguggcca

SEQ ID NO: 1903235 - RNA, 18 nt, Human
cuguccucagguggccau

SEQ ID NO: 1903236 - RNA, 14 nt, Human
cuguccucagccuu

SEQ ID NO: 1903237 - RNA, 18 nt, Human
cuguccucagccuugcca

SEQ ID NO: 1903238 - RNA, 20 nt, Human
cuguccucagccuugccaga

SEQ ID NO: 1903239 - RNA, 21 nt, Human
cuguccucagccuugccagag

SEQ ID NO: 1903240 - RNA, 22 nt, Human
cuguccucagccuugccagaga

SEQ ID NO: 1903241 - RNA, 12 nt, Human
cuguccucaggu

SEQ ID NO: 1903242 - RNA, 23 nt, Human
cugucucaaaaaaacacaaaagu

SEQ ID NO: 1903243 - RNA, 16 nt, Human
cugucucaaaaaaaga

SEQ ID NO: 1903244 - RNA, 18 nt, Human
cugucucaaaaaaagaaa

SEQ ID NO: 1903245 - RNA, 18 nt, Human
cugucuagagagggaggc

SEQ ID NO: 1903246 - RNA, 14 nt, Human
cugucuagagaggg

SEQ ID NO: 1903247 - RNA, 16 nt, Human
cugucuagagagggag

SEQ ID NO: 1903248 - RNA, 17 nt, Human
cugucuagagagggagg

SEQ ID NO: 1903249 - RNA, 15 nt, Human
cuguccuccaagcca

SEQ ID NO: 1903250 - RNA, 13 nt, Human
cugucuagagagg

SEQ ID NO: 1903251 - RNA, 15 nt, Human
cuguccuccaacacc

SEQ ID NO: 1903252 - RNA, 23 nt, Human
cuguccuccaacaccaagcacag

SEQ ID NO: 1903253 - RNA, 12 nt, Human
cuguccuccaag

SEQ ID NO: 1903254 - RNA, 19 nt, Human
cuguaaucauauaauaaau

SEQ ID NO: 1903255 - RNA, 13 nt, Human
cuguaaucccagc

SEQ ID NO: 1903256 - RNA, 20 nt, Human
cuguaauccuagcacuuugg

SEQ ID NO: 1903257 - RNA, 20 nt, Human
cuguaaucgcccuacuauuc

SEQ ID NO: 1903258 - RNA, 13 nt, Human
cuguacaaaguag

SEQ ID NO: 1903259 - RNA, 15 nt, Human
cuguacaaaguagaa

SEQ ID NO: 1903260 - RNA, 13 nt, Human
cuguaauuuuaua

SEQ ID NO: 1903261 - RNA, 12 nt, Human
cuggugcugcug

SEQ ID NO: 1903262 - RNA, 16 nt, Human
cugguuccauggccuc

SEQ ID NO: 1903263 - RNA, 23 nt, Human
cugguucggauuugggguggauu

SEQ ID NO: 1903264 - RNA, 21 nt, Human
cugguucggauuuggggugga

SEQ ID NO: 1903265 - RNA, 20 nt, Human
cuguaauaaagaugauugug

SEQ ID NO: 1903266 - RNA, 23 nt, Human
cuguaaucacagcuacuugggag

SEQ ID NO: 1903267 - RNA, 14 nt, Human
cugguggcagcugc

SEQ ID NO: 1903268 - RNA, 13 nt, Human
cugguggcagcug

SEQ ID NO: 1903269 - RNA, 21 nt, Human
cugguggcagcucaccucucc

SEQ ID NO: 1903270 - RNA, 23 nt, Human
cugguggcagcucaccucucccu

SEQ ID NO: 1903271 - RNA, 14 nt, Human
cugguauuuuaucu

SEQ ID NO: 1903272 - RNA, 17 nt, Human
cuggucaaacaaacucu

SEQ ID NO: 1903273 - RNA, 18 nt, Human
cuggucaaacaaacucuc

SEQ ID NO: 1903274 - RNA, 23 nt, Human
cuggucaaacaaacucucugaac

SEQ ID NO: 1903275 - RNA, 13 nt, Human
cugguccuaccca

SEQ ID NO: 1903276 - RNA, 16 nt, Human
cugguccuacccaucc

SEQ ID NO: 1903277 - RNA, 22 nt, Human
cugguccuacccauccccgcag

SEQ ID NO: 1903278 - RNA, 17 nt, Human
cugguccuacccauccc

SEQ ID NO: 1903279 - RNA, 15 nt, Human
cugggggaagaagcu

SEQ ID NO: 1903280 - RNA, 20 nt, Human
cugggggacccaauguagga

SEQ ID NO: 1903281 - RNA, 19 nt, Human
cugggggcugggcagagga

SEQ ID NO: 1903282 - RNA, 22 nt, Human
cugggggggauuguaaaauggu

SEQ ID NO: 1903283 - RNA, 13 nt, Human
cuggggggcagug

SEQ ID NO: 1903284 - RNA, 16 nt, Human
cuggggggcaguggug

SEQ ID NO: 1903285 - RNA, 13 nt, Human
cugggggaagaag

SEQ ID NO: 1903286 - RNA, 15 nt, Human
cuggggcuggccucc

SEQ ID NO: 1903287 - RNA, 18 nt, Human
cuggggcuggccucccaa

SEQ ID NO: 1903288 - RNA, 14 nt, Human
cuggggcuggccuc

SEQ ID NO: 1903289 - RNA, 24 nt, Human
cugggcuucaguggcagcugcuuu

SEQ ID NO: 1903290 - RNA, 22 nt, Human
cuggguaacuagggaagauaau

SEQ ID NO: 1903291 - RNA, 20 nt, Human
cuggguaacuagggaagaua

SEQ ID NO: 1903292 - RNA, 15 nt, Human
cuggguacuucuuga

SEQ ID NO: 1903293 - RNA, 17 nt, Human
cuggguacuucuugaag

SEQ ID NO: 1903294 - RNA, 20 nt, Human
cuggguacuucuugaaggug

SEQ ID NO: 1903295 - RNA, 23 nt, Human
cuggguacuucuugaaggugcug

SEQ ID NO: 1903296 - RNA, 15 nt, Human
cugggguccagggag

SEQ ID NO: 1903297 - RNA, 16 nt, Human
cugggguccagggagc

SEQ ID NO: 1903298 - RNA, 13 nt, Human
cuggggucuggag

SEQ ID NO: 1903299 - RNA, 22 nt, Human
cuggggucuggaguugaucugg

SEQ ID NO: 1903300 - RNA, 14 nt, Human
cuggguucuaccca

SEQ ID NO: 1903301 - RNA, 15 nt, Human
cuggguucuacccag

SEQ ID NO: 1903302 - RNA, 16 nt, Human
cuggguucuacccagg

SEQ ID NO: 1903303 - RNA, 17 nt, Human
cuggguucuacccaggu

SEQ ID NO: 1903304 - RNA, 16 nt, Human
cugguaccaguugaaa

SEQ ID NO: 1903305 - RNA, 17 nt, Human
cugguaccaguugaaau

SEQ ID NO: 1903306 - RNA, 14 nt, Human
cugguacucaagcc

SEQ ID NO: 1903307 - RNA, 23 nt, Human
cugugugcuccuccuuggugccu

SEQ ID NO: 1903308 - RNA, 18 nt, Human
cugugugcuccuccuugg

SEQ ID NO: 1903309 - RNA, 23 nt, Human
cugugugcucaggagcccuggga

SEQ ID NO: 1903310 - RNA, 15 nt, Human
cuguguggcagucug

SEQ ID NO: 1903311 - RNA, 19 nt, Human
cugugugcucaggagcccu

SEQ ID NO: 1903312 - RNA, 16 nt, Human
cugugugcucaggagc

SEQ ID NO: 1903313 - RNA, 20 nt, Human
cugugugcucaggagcccug

SEQ ID NO: 1903314 - RNA, 21 nt, Human
cugugugcucaggagcccugg

SEQ ID NO: 1903315 - RNA, 16 nt, Human
cuguggggcccccaca

SEQ ID NO: 1903316 - RNA, 21 nt, Human
cuguggggaaccaauugcuuu

SEQ ID NO: 1903317 - RNA, 23 nt, Human
cugugucuugcaauggcagccuu

SEQ ID NO: 1903318 - RNA, 22 nt, Human
cugugucuugcaauggcagccu

SEQ ID NO: 1903319 - RNA, 21 nt, Human
cugugucuugcaauggcagcc

SEQ ID NO: 1903320 - RNA, 20 nt, Human
cugugugugcgccuacagga

SEQ ID NO: 1903321 - RNA, 12 nt, Human
cuguguguguga

SEQ ID NO: 1903322 - RNA, 14 nt, Human
cugugugugugaau

SEQ ID NO: 1903323 - RNA, 16 nt, Human
cugugugugugaauga

SEQ ID NO: 1903324 - RNA, 17 nt, Human
cugugugugugaaugaa

SEQ ID NO: 1903325 - RNA, 18 nt, Human
cugugugugugaaugaac

SEQ ID NO: 1903326 - RNA, 23 nt, Human
cugugugugugaaugaacacucu

SEQ ID NO: 1903327 - RNA, 21 nt, Human
cugugugugugaaugaacacu

SEQ ID NO: 1903328 - RNA, 13 nt, Human
cuguguguugcca

SEQ ID NO: 1903329 - RNA, 19 nt, Human
cuguguguugccacaggac

SEQ ID NO: 1903330 - RNA, 20 nt, Human
cuguguguugccacaggaca

SEQ ID NO: 1903331 - RNA, 17 nt, Human
cuguguguuuaugugug

SEQ ID NO: 1903332 - RNA, 16 nt, Human
cuguguguuuaugugu

SEQ ID NO: 1903333 - RNA, 21 nt, Human
cuguguguugccacaggacac

SEQ ID NO: 1903334 - RNA, 22 nt, Human
cuguguguugccacaggacaca

SEQ ID NO: 1903335 - RNA, 13 nt, Human
cuguguuuuaaua

SEQ ID NO: 1903336 - RNA, 13 nt, Human
cuguucucugccc

SEQ ID NO: 1903337 - RNA, 14 nt, Human
cuguucccccuuca

SEQ ID NO: 1903338 - RNA, 15 nt, Human
cuguucccccuucac

SEQ ID NO: 1903339 - RNA, 16 nt, Human
cuguucccccuucaca

SEQ ID NO: 1903340 - RNA, 17 nt, Human
cuguucccccuucacaa

SEQ ID NO: 1903341 - RNA, 23 nt, Human
cuguucccccuucacaaagccca

SEQ ID NO: 1903342 - RNA, 20 nt, Human
cuguucucugcccuccaaga

SEQ ID NO: 1903343 - RNA, 15 nt, Human
cuguucucuugggaa

SEQ ID NO: 1903344 - RNA, 18 nt, Human
cuguucucugcccuccaa

SEQ ID NO: 1903345 - RNA, 19 nt, Human
cuguucucugcccuccaag

SEQ ID NO: 1903346 - RNA, 14 nt, Human
cuguucucugcccu

SEQ ID NO: 1903347 - RNA, 15 nt, Human
cuguucucugcccuc

SEQ ID NO: 1903348 - RNA, 16 nt, Human
cuguucucugcccucc

SEQ ID NO: 1903349 - RNA, 17 nt, Human
cuguucucugcccucca

SEQ ID NO: 1903350 - RNA, 13 nt, Human
cuguuccccagag

SEQ ID NO: 1903351 - RNA, 20 nt, Human
cuguucccauguagcccccu

SEQ ID NO: 1903352 - RNA, 14 nt, Human
cuguuccccagaga

SEQ ID NO: 1903353 - RNA, 15 nt, Human
cuguuccccagagaa

SEQ ID NO: 1903354 - RNA, 16 nt, Human
cuguuccccagagaaa

SEQ ID NO: 1903355 - RNA, 17 nt, Human
cuguucccaccugcugg

SEQ ID NO: 1903356 - RNA, 23 nt, Human
cuguucaugaaagauucaaugcc

SEQ ID NO: 1903357 - RNA, 18 nt, Human
cuguucaugaaagauuca

SEQ ID NO: 1903358 - RNA, 17 nt, Human
cuguucaugaaagauuc

SEQ ID NO: 1903359 - RNA, 13 nt, Human
cuguuacugucuu

SEQ ID NO: 1903360 - RNA, 19 nt, Human
cuguucagcugguugaggu

SEQ ID NO: 1903361 - RNA, 21 nt, Human
cuguucagcugguugagguuu

SEQ ID NO: 1903362 - RNA, 15 nt, Human
cugugccuccaucag

SEQ ID NO: 1903363 - RNA, 16 nt, Human
cugugccuccaucagc

SEQ ID NO: 1903364 - RNA, 14 nt, Human
cugugccauuuugu

SEQ ID NO: 1903365 - RNA, 17 nt, Human
cugugcauguaugucuu

SEQ ID NO: 1903366 - RNA, 18 nt, Human
cugugccaugugccaggu

SEQ ID NO: 1903367 - RNA, 16 nt, Human
cugugccaugugccag

SEQ ID NO: 1903368 - RNA, 16 nt, Human
cugugcauguaugucu

SEQ ID NO: 1903369 - RNA, 15 nt, Human
cugugcauguauguc

SEQ ID NO: 1903370 - RNA, 22 nt, Human
cugugcacaaaacccagaccug

SEQ ID NO: 1903371 - RNA, 19 nt, Human
cugugcacaaaguggcaua

SEQ ID NO: 1903372 - RNA, 18 nt, Human
cugugcacaaaguggcau

SEQ ID NO: 1903373 - RNA, 19 nt, Human
cugugauggggcccugccu

SEQ ID NO: 1903374 - RNA, 20 nt, Human
cugugauggggcccugccuc

SEQ ID NO: 1903375 - RNA, 19 nt, Human
cugugcacaaaacccagac

SEQ ID NO: 1903376 - RNA, 20 nt, Human
cugugcacaaaacccagacc

SEQ ID NO: 1903377 - RNA, 18 nt, Human
cugugauggggcccugcc

SEQ ID NO: 1903378 - RNA, 17 nt, Human
cugugauggggcccugc

SEQ ID NO: 1903379 - RNA, 23 nt, Human
cugugaguacuacaguccuccca

SEQ ID NO: 1903380 - RNA, 20 nt, Human
cugugaguacuacaguccuc

SEQ ID NO: 1903381 - RNA, 21 nt, Human
cugugaguacuacaguccucc

SEQ ID NO: 1903382 - RNA, 18 nt, Human
cugucuccauguuugaug

SEQ ID NO: 1903383 - RNA, 13 nt, Human
cugucuccuagga

SEQ ID NO: 1903384 - RNA, 19 nt, Human
cugugaggggcucucucau

SEQ ID NO: 1903385 - RNA, 13 nt, Human
cugucucagggug

SEQ ID NO: 1903386 - RNA, 14 nt, Human
cugugccucuggga

SEQ ID NO: 1903387 - RNA, 16 nt, Human
cugugccucugggacu

SEQ ID NO: 1903388 - RNA, 22 nt, Human
cugugcugcccugcccaccugg

SEQ ID NO: 1903389 - RNA, 17 nt, Human
cugugccucugggacug

SEQ ID NO: 1903390 - RNA, 18 nt, Human
cugugccucugggacugg

SEQ ID NO: 1903391 - RNA, 19 nt, Human
cuguggaaaagaaacacgc

SEQ ID NO: 1903392 - RNA, 17 nt, Human
cuguggaugauaaaaca

SEQ ID NO: 1903393 - RNA, 22 nt, Human
cuguggaaaagaaacacgcacu

SEQ ID NO: 1903394 - RNA, 16 nt, Human
cuguggccaaguucuu

SEQ ID NO: 1903395 - RNA, 18 nt, Human
cuguggccaaguucuuag

SEQ ID NO: 1903396 - RNA, 22 nt, Human
cuguggccagcuuguuauuuau

SEQ ID NO: 1903397 - RNA, 23 nt, Human
cuguggccagcuuguuauuuaua

SEQ ID NO: 1903398 - RNA, 14 nt, Human
cugugggcccccaa

SEQ ID NO: 1903399 - RNA, 13 nt, Human
cuggacacaggcc

SEQ ID NO: 1903400 - RNA, 14 nt, Human
cuggacacaggccu

SEQ ID NO: 1903401 - RNA, 15 nt, Human
cuggacacaggccug

SEQ ID NO: 1903402 - RNA, 13 nt, Human
cuggaauuugaaa

SEQ ID NO: 1903403 - RNA, 17 nt, Human
cuggacaggcauguucu

SEQ ID NO: 1903404 - RNA, 14 nt, Human
cuggacaggcaugu

SEQ ID NO: 1903405 - RNA, 23 nt, Human
cuggacaggcauguucucugagg

SEQ ID NO: 1903406 - RNA, 21 nt, Human
cuggaccuugaacuggguacu

SEQ ID NO: 1903407 - RNA, 20 nt, Human
cuggaccuugaacuggguac

SEQ ID NO: 1903408 - RNA, 17 nt, Human
cuggaccuugaacuggg

SEQ ID NO: 1903409 - RNA, 13 nt, Human
cuggacuccggcc

SEQ ID NO: 1903410 - RNA, 15 nt, Human
cuggacuccggcccu

SEQ ID NO: 1903411 - RNA, 18 nt, Human
cuggacuccggcccuccu

SEQ ID NO: 1903412 - RNA, 15 nt, Human
cuggacccuguggau

SEQ ID NO: 1903413 - RNA, 16 nt, Human
cuggaccuugaacugg

SEQ ID NO: 1903414 - RNA, 12 nt, Human
cuggaccugccc

SEQ ID NO: 1903415 - RNA, 17 nt, Human
cuggaccugcccccgca

SEQ ID NO: 1903416 - RNA, 19 nt, Human
cuggaccugcccccgcauc

SEQ ID NO: 1903417 - RNA, 17 nt, Human
cuggagugcagugagcc

SEQ ID NO: 1903418 - RNA, 16 nt, Human
cuggagugcagugagc

SEQ ID NO: 1903419 - RNA, 15 nt, Human
cuggagugcagugag

SEQ ID NO: 1903420 - RNA, 14 nt, Human
cuggagugcaguga

SEQ ID NO: 1903421 - RNA, 15 nt, Human
cuggagugaggaaaa

SEQ ID NO: 1903422 - RNA, 18 nt, Human
cuggagucaucauucccu

SEQ ID NO: 1903423 - RNA, 17 nt, Human
cuggagguuuguuuaga

SEQ ID NO: 1903424 - RNA, 12 nt, Human
cuggagguuugu

SEQ ID NO: 1903425 - RNA, 22 nt, Human
cuggagguacgaaaagagggga

SEQ ID NO: 1903426 - RNA, 20 nt, Human
cuggagguggcugagccccu

SEQ ID NO: 1903427 - RNA, 17 nt, Human
cuggagguacgaaaaga

SEQ ID NO: 1903428 - RNA, 13 nt, Human
cuggagcucugcc

SEQ ID NO: 1903429 - RNA, 12 nt, Human
cuggagcucugc

SEQ ID NO: 1903430 - RNA, 16 nt, Human
cuggagcucugcccau

SEQ ID NO: 1903431 - RNA, 12 nt, Human
cuggaggcccag

SEQ ID NO: 1903432 - RNA, 13 nt, Human
cuggaggcccagu

SEQ ID NO: 1903433 - RNA, 14 nt, Human
cuggaggcccaguu

SEQ ID NO: 1903434 - RNA, 15 nt, Human
cuggaggcccaguuc

SEQ ID NO: 1903435 - RNA, 21 nt, Human
cuggaggcccaguucacccug

SEQ ID NO: 1903436 - RNA, 23 nt, Human
cuggagcccagaggagggcagca

SEQ ID NO: 1903437 - RNA, 21 nt, Human
cuggagcccagaggagggcag

SEQ ID NO: 1903438 - RNA, 22 nt, Human
cuggccaucugguuaggauggc

SEQ ID NO: 1903439 - RNA, 18 nt, Human
cuggccaucccacaagug

SEQ ID NO: 1903440 - RNA, 15 nt, Human
cuggcccacugcauc

SEQ ID NO: 1903441 - RNA, 21 nt, Human
cuggccaguggcuggaucugu

SEQ ID NO: 1903442 - RNA, 16 nt, Human
cuggcccagggcccag

SEQ ID NO: 1903443 - RNA, 19 nt, Human
cuggcaguggaacuaagaa

SEQ ID NO: 1903444 - RNA, 19 nt, Human
cuggcaguuuaaaaaaauu

SEQ ID NO: 1903445 - RNA, 15 nt, Human
cuggcaguuuaaaaa

SEQ ID NO: 1903446 - RNA, 14 nt, Human
cuggccagaugcac

SEQ ID NO: 1903447 - RNA, 21 nt, Human
cuggccagacacaggcccucc

SEQ ID NO: 1903448 - RNA, 13 nt, Human
cuggccagacaca

SEQ ID NO: 1903449 - RNA, 13 nt, Human
cuggccagaaugc

SEQ ID NO: 1903450 - RNA, 15 nt, Human
cuggccagacacagg

SEQ ID NO: 1903451 - RNA, 17 nt, Human
cuggccagacacaggcc

SEQ ID NO: 1903452 - RNA, 18 nt, Human
cuggccagacacaggccc

SEQ ID NO: 1903453 - RNA, 19 nt, Human
cuggccagacacaggcccu

SEQ ID NO: 1903454 - RNA, 21 nt, Human
cuggcacuggaugcagaaaca

SEQ ID NO: 1903455 - RNA, 22 nt, Human
cuggcacccggccccugcuggu

SEQ ID NO: 1903456 - RNA, 19 nt, Human
cuggcacugcuuccaguga

SEQ ID NO: 1903457 - RNA, 20 nt, Human
cuggcacugcuuccagugag

SEQ ID NO: 1903458 - RNA, 23 nt, Human
cuggcacugcuuccagugaggcu

SEQ ID NO: 1903459 - RNA, 20 nt, Human
cuggagugcagugagccgag

SEQ ID NO: 1903460 - RNA, 19 nt, Human
cuggcacccggccccugcu

SEQ ID NO: 1903461 - RNA, 21 nt, Human
cuggcacccggccccugcugg

SEQ ID NO: 1903462 - RNA, 20 nt, Human
cuggcacccggccccugcug

SEQ ID NO: 1903463 - RNA, 17 nt, Human
cuggccuggcacacauc

SEQ ID NO: 1903464 - RNA, 16 nt, Human
cuggccuggcacacau

SEQ ID NO: 1903465 - RNA, 14 nt, Human
cuggccuggcacac

SEQ ID NO: 1903466 - RNA, 13 nt, Human
cuggccuggcaca

SEQ ID NO: 1903467 - RNA, 22 nt, Human
cuggccuggcacacaucaggag

SEQ ID NO: 1903468 - RNA, 18 nt, Human
cuggccuggcacacauca

SEQ ID NO: 1903469 - RNA, 13 nt, Human
cuggccuggcccc

SEQ ID NO: 1903470 - RNA, 19 nt, Human
cuggccuggccccucaggg

SEQ ID NO: 1903471 - RNA, 24 nt, Human
cuggccuggccccucagggucccu

SEQ ID NO: 1903472 - RNA, 22 nt, Human
cuggccuucggccuccauccug

SEQ ID NO: 1903473 - RNA, 21 nt, Human
cuggccucugcacuccccugc

SEQ ID NO: 1903474 - RNA, 18 nt, Human
cuggccucugcacucccc

SEQ ID NO: 1903475 - RNA, 20 nt, Human
cuggccucugcacuccccug

SEQ ID NO: 1903476 - RNA, 13 nt, Human
cuggccccaggac

SEQ ID NO: 1903477 - RNA, 17 nt, Human
cuggcccagggcccaga

SEQ ID NO: 1903478 - RNA, 18 nt, Human
cuggcccagggcccagag

SEQ ID NO: 1903479 - RNA, 19 nt, Human
cuggcccagggcccagagc

SEQ ID NO: 1903480 - RNA, 20 nt, Human
cuggcccagggcccagagcc

SEQ ID NO: 1903481 - RNA, 21 nt, Human
cuggcccagggcccagagccc

SEQ ID NO: 1903482 - RNA, 22 nt, Human
cuggcccagggcccagagccca

SEQ ID NO: 1903483 - RNA, 23 nt, Human
cuggcccagggcccagagcccag

SEQ ID NO: 1903484 - RNA, 15 nt, Human
cuggcgugcaguggu

SEQ ID NO: 1903485 - RNA, 14 nt, Human
cuggcgugcagugg

SEQ ID NO: 1903486 - RNA, 14 nt, Human
cuggccugugucua

SEQ ID NO: 1903487 - RNA, 23 nt, Human
cuggccuucggccuccauccuga

SEQ ID NO: 1903488 - RNA, 16 nt, Human
cuggccuugggcccuc

SEQ ID NO: 1903489 - RNA, 20 nt, Human
cuggccuugggcccucuggu

SEQ ID NO: 1903490 - RNA, 21 nt, Human
cuggcucuuccaggcugggag

SEQ ID NO: 1903491 - RNA, 22 nt, Human
cuggcucuuccaggcugggaga

SEQ ID NO: 1903492 - RNA, 24 nt, Human
cuggcucuuccaggcugggagagc

SEQ ID NO: 1903493 - RNA, 23 nt, Human
cuggcugcagagcagugggccug

SEQ ID NO: 1903494 - RNA, 17 nt, Human
cugccgcaacaguuuuu

SEQ ID NO: 1903495 - RNA, 14 nt, Human
cugccgcagcccug

SEQ ID NO: 1903496 - RNA, 15 nt, Human
cugccgcagcccugc

SEQ ID NO: 1903497 - RNA, 17 nt, Human
cugccgcagcccugcag

SEQ ID NO: 1903498 - RNA, 18 nt, Human
cugccgcagcccugcaga

SEQ ID NO: 1903499 - RNA, 12 nt, Human
cugcccuccaag

SEQ ID NO: 1903500 - RNA, 14 nt, Human
cucccuucccaccu

SEQ ID NO: 1903501 - RNA, 15 nt, Human
cucccuucccaccuc

SEQ ID NO: 1903502 - RNA, 16 nt, Human
cucccuucccaccucu

SEQ ID NO: 1903503 - RNA, 17 nt, Human
cucccuucccaccucuc

SEQ ID NO: 1903504 - RNA, 15 nt, Human
cugccucuucucuac

SEQ ID NO: 1903505 - RNA, 17 nt, Human
cugccugcccaggcccc

SEQ ID NO: 1903506 - RNA, 16 nt, Human
cugccugcccaggccc

SEQ ID NO: 1903507 - RNA, 15 nt, Human
cugccugaagucaca

SEQ ID NO: 1903508 - RNA, 20 nt, Human
cugccugcccaggccccugc

SEQ ID NO: 1903509 - RNA, 21 nt, Human
cugccugggaucccucauccu

SEQ ID NO: 1903510 - RNA, 14 nt, Human
cugccuuggcucag

SEQ ID NO: 1903511 - RNA, 15 nt, Human
cugccuuggcucaga

SEQ ID NO: 1903512 - RNA, 17 nt, Human
cugccuuggcucagaca

SEQ ID NO: 1903513 - RNA, 18 nt, Human
cugccuuggcucagacau

SEQ ID NO: 1903514 - RNA, 22 nt, Human
cugccuuggcucagacauguuu

SEQ ID NO: 1903515 - RNA, 20 nt, Human
cugccucucugcaggucccu

SEQ ID NO: 1903516 - RNA, 21 nt, Human
cugccucucugcaggucccua

SEQ ID NO: 1903517 - RNA, 14 nt, Human
cugccuccauccua

SEQ ID NO: 1903518 - RNA, 23 nt, Human
cugccucugacacacagcucugu

SEQ ID NO: 1903519 - RNA, 22 nt, Human
cugccucugacacacagcucug

SEQ ID NO: 1903520 - RNA, 15 nt, Human
cugccucugacacac

SEQ ID NO: 1903521 - RNA, 22 nt, Human
cugccucucugcaggucccuaa

SEQ ID NO: 1903522 - RNA, 12 nt, Human
cugccucccauc

SEQ ID NO: 1903523 - RNA, 14 nt, Human
cugccucccaucac

SEQ ID NO: 1903524 - RNA, 16 nt, Human
cugccucccaucaccc

SEQ ID NO: 1903525 - RNA, 19 nt, Human
cugccucccaucacccgcu

SEQ ID NO: 1903526 - RNA, 11 nt, Human
cugccucccau

SEQ ID NO: 1903527 - RNA, 13 nt, Human
cugccuccauccu

SEQ ID NO: 1903528 - RNA, 19 nt, Human
cugcgaccacaagaaggau

SEQ ID NO: 1903529 - RNA, 19 nt, Human
cugcuccagcuguucagcu

SEQ ID NO: 1903530 - RNA, 15 nt, Human
cugcgagggcagcgg

SEQ ID NO: 1903531 - RNA, 20 nt, Human
cugcuccagcuguucagcug

SEQ ID NO: 1903532 - RNA, 19 nt, Human
cugcucuccgaccagacac

SEQ ID NO: 1903533 - RNA, 15 nt, Human
cugcuccuagaggga

SEQ ID NO: 1903534 - RNA, 17 nt, Human
cugcuccuagagggagg

SEQ ID NO: 1903535 - RNA, 21 nt, Human
cugcuccuagagggaggggcc

SEQ ID NO: 1903536 - RNA, 22 nt, Human
cugcuccuagagggaggggccu

SEQ ID NO: 1903537 - RNA, 15 nt, Human
cugcucuccuuccug

SEQ ID NO: 1903538 - RNA, 13 nt, Human
cugcucuccuucc

SEQ ID NO: 1903539 - RNA, 12 nt, Human
cugcucuccuuc

SEQ ID NO: 1903540 - RNA, 11 nt, Human
cugcugaaggc

SEQ ID NO: 1903541 - RNA, 23 nt, Human
cugcugguucaggguuggccccu

SEQ ID NO: 1903542 - RNA, 15 nt, Human
cugcugguucagggu

SEQ ID NO: 1903543 - RNA, 13 nt, Human
cugcugguucagg

SEQ ID NO: 1903544 - RNA, 11 nt, Human
cugcugggcuu

SEQ ID NO: 1903545 - RNA, 15 nt, Human
cugcuuccagugagg

SEQ ID NO: 1903546 - RNA, 21 nt, Human
cugcugguuuuaacaacugug

SEQ ID NO: 1903547 - RNA, 17 nt, Human
cugcuguaaauuuggcu

SEQ ID NO: 1903548 - RNA, 19 nt, Human
cugcuguaaauuuggcuuc

SEQ ID NO: 1903549 - RNA, 16 nt, Human
cugcuuccagugaggc

SEQ ID NO: 1903550 - RNA, 18 nt, Human
cugcuuccagugaggcuc

SEQ ID NO: 1903551 - RNA, 19 nt, Human
cugcuuccagugaggcucu

SEQ ID NO: 1903552 - RNA, 20 nt, Human
cugcuuccagugaggcucug

SEQ ID NO: 1903553 - RNA, 21 nt, Human
cugcuuccagugaggcucugc

SEQ ID NO: 1903554 - RNA, 23 nt, Human
cugcuuccagugaggcucugccc

SEQ ID NO: 1903555 - RNA, 15 nt, Human
cugcugcuggcuggu

SEQ ID NO: 1903556 - RNA, 20 nt, Human
cugcuggaguuucauguaca

SEQ ID NO: 1903557 - RNA, 21 nt, Human
cugcuggaguuucauguacaa

SEQ ID NO: 1903558 - RNA, 15 nt, Human
cugcuggacaguauc

SEQ ID NO: 1903559 - RNA, 20 nt, Human
cugcuggacaguaucacugu

SEQ ID NO: 1903560 - RNA, 22 nt, Human
cugcuggacaguaucacugucu

SEQ ID NO: 1903561 - RNA, 15 nt, Human
cugcuggaaacagac

SEQ ID NO: 1903562 - RNA, 12 nt, Human
gagacaggcaga

SEQ ID NO: 1903563 - RNA, 14 nt, Human
gagacaggcagagc

SEQ ID NO: 1903564 - RNA, 16 nt, Human
gagacaggcagagcug

SEQ ID NO: 1903565 - RNA, 19 nt, Human
gagacaggcagagcugcuc

SEQ ID NO: 1903566 - RNA, 22 nt, Human
gagacaggguuuugccauguug

SEQ ID NO: 1903567 - RNA, 19 nt, Human
gagacaggguuucaccaug

SEQ ID NO: 1903568 - RNA, 14 nt, Human
gagaccaucccuga

SEQ ID NO: 1903569 - RNA, 22 nt, Human
gagacaguugggugagaacaac

SEQ ID NO: 1903570 - RNA, 18 nt, Human
gagaccaucccugaaggc

SEQ ID NO: 1903571 - RNA, 21 nt, Human
gagaccaucccugaaggcccc

SEQ ID NO: 1903572 - RNA, 23 nt, Human
gagaaugcacaaacagaggccgc

SEQ ID NO: 1903573 - RNA, 20 nt, Human
gagacagcucugcauacuca

SEQ ID NO: 1903574 - RNA, 16 nt, Human
gagaauguaagaacua

SEQ ID NO: 1903575 - RNA, 15 nt, Human
gagaauguaagaacu

SEQ ID NO: 1903576 - RNA, 19 nt, Human
gagacagcuugaucaaagg

SEQ ID NO: 1903577 - RNA, 17 nt, Human
gagaaugucaguaugug

SEQ ID NO: 1903578 - RNA, 13 nt, Human
gagacucugucuc

SEQ ID NO: 1903579 - RNA, 20 nt, Human
gagacucgcgacaaugcaaa

SEQ ID NO: 1903580 - RNA, 21 nt, Human
gagacucgcgacaaugcaaac

SEQ ID NO: 1903581 - RNA, 19 nt, Human
gagacuccugcaggcagcc

SEQ ID NO: 1903582 - RNA, 23 nt, Human
gagacaguugggugagaacaacc

SEQ ID NO: 1903583 - RNA, 20 nt, Human
gagacuccugcaggcagcca

SEQ ID NO: 1903584 - RNA, 21 nt, Human
gagacuccugcaggcagccag

SEQ ID NO: 1903585 - RNA, 14 nt, Human
gagagggugggagu

SEQ ID NO: 1903586 - RNA, 20 nt, Human
gagagggugggagugggccc

SEQ ID NO: 1903587 - RNA, 16 nt, Human
gagagggugggagugg

SEQ ID NO: 1903588 - RNA, 19 nt, Human
gagaggggaacagacugga

SEQ ID NO: 1903589 - RNA, 13 nt, Human
gagaggggcacag

SEQ ID NO: 1903590 - RNA, 18 nt, Human
gagagccccucacacagc

SEQ ID NO: 1903591 - RNA, 13 nt, Human
gagagagcuggag

SEQ ID NO: 1903592 - RNA, 15 nt, Human
gagagcaacauuuua

SEQ ID NO: 1903593 - RNA, 15 nt, Human
gagagagaggcagaa

SEQ ID NO: 1903594 - RNA, 18 nt, Human
gagcccugguggcagugg

SEQ ID NO: 1903595 - RNA, 13 nt, Human
gagcccagcuggg

SEQ ID NO: 1903596 - RNA, 19 nt, Human
gagcccagcugggucaggc

SEQ ID NO: 1903597 - RNA, 21 nt, Human
gagcccagcugggucaggcag

SEQ ID NO: 1903598 - RNA, 22 nt, Human
gagcccagcugggucaggcagg

SEQ ID NO: 1903599 - RNA, 14 nt, Human
gagcccagcuccaa

SEQ ID NO: 1903600 - RNA, 12 nt, Human
gagcccagcucc

SEQ ID NO: 1903601 - RNA, 13 nt, Human
gagcccagcucca

SEQ ID NO: 1903602 - RNA, 18 nt, Human
gagcccagcccuccccau

SEQ ID NO: 1903603 - RNA, 22 nt, Human
gagcccagaggagggcagcaga

SEQ ID NO: 1903604 - RNA, 14 nt, Human
gagcccagaggagg

SEQ ID NO: 1903605 - RNA, 15 nt, Human
gagcccagcccuccc

SEQ ID NO: 1903606 - RNA, 19 nt, Human
gagccagggucucacuaug

SEQ ID NO: 1903607 - RNA, 23 nt, Human
gagcccacuguacuugcucuuga

SEQ ID NO: 1903608 - RNA, 19 nt, Human
gagcccacuguccugggcc

SEQ ID NO: 1903609 - RNA, 24 nt, Human
gagcccacuguccugggccugcag

SEQ ID NO: 1903610 - RNA, 23 nt, Human
gagccagauuucacucuccuugg

SEQ ID NO: 1903611 - RNA, 14 nt, Human
gagccagggucuca

SEQ ID NO: 1903612 - RNA, 21 nt, Human
gagccagcagccuggcucucc

SEQ ID NO: 1903613 - RNA, 12 nt, Human
gagcagagacca

SEQ ID NO: 1903614 - RNA, 16 nt, Human
gagcagagaauucucu

SEQ ID NO: 1903615 - RNA, 19 nt, Human
gagccaauuuaaagaaaac

SEQ ID NO: 1903616 - RNA, 20 nt, Human
gagccagauuucacucuccu

SEQ ID NO: 1903617 - RNA, 20 nt, Human
gagccaacagaagcuuccau

SEQ ID NO: 1903618 - RNA, 15 nt, Human
gagcacuaaggugug

SEQ ID NO: 1903619 - RNA, 21 nt, Human
gagcaccuuagacagucccug

SEQ ID NO: 1903620 - RNA, 22 nt, Human
gagcaccuuagacagucccugc

SEQ ID NO: 1903621 - RNA, 21 nt, Human
gagcacuaaggugugcucuga

SEQ ID NO: 1903622 - RNA, 20 nt, Human
gagcaccuuagacagucccu

SEQ ID NO: 1903623 - RNA, 15 nt, Human
gagcaagaggaggcc

SEQ ID NO: 1903624 - RNA, 20 nt, Human
gagcaaggguucccucaaga

SEQ ID NO: 1903625 - RNA, 12 nt, Human
gagcaagacucu

SEQ ID NO: 1903626 - RNA, 14 nt, Human
gagcaagacucugu

SEQ ID NO: 1903627 - RNA, 13 nt, Human
gagcaacauuuua

SEQ ID NO: 1903628 - RNA, 23 nt, Human
gagaucaaccccuucgcuccugu

SEQ ID NO: 1903629 - RNA, 16 nt, Human
gagauagccaaggcca

SEQ ID NO: 1903630 - RNA, 14 nt, Human
gagauagccaaggc

SEQ ID NO: 1903631 - RNA, 19 nt, Human
gagaucacgccacugcacu

SEQ ID NO: 1903632 - RNA, 21 nt, Human
gagauccaaaagaagccccca

SEQ ID NO: 1903633 - RNA, 22 nt, Human
gagauccaaaagaagcccccag

SEQ ID NO: 1903634 - RNA, 18 nt, Human
gagaucacgccacugcac

SEQ ID NO: 1903635 - RNA, 22 nt, Human
gagaugauacauccaaagcaga

SEQ ID NO: 1903636 - RNA, 19 nt, Human
gagaugaugaaaauauuua

SEQ ID NO: 1903637 - RNA, 18 nt, Human
gagaugaugaaaauauuu

SEQ ID NO: 1903638 - RNA, 19 nt, Human
gagaucccauccccuuguc

SEQ ID NO: 1903639 - RNA, 15 nt, Human
gagaugaagcaaaca

SEQ ID NO: 1903640 - RNA, 18 nt, Human
gagaugaagcaaacacau

SEQ ID NO: 1903641 - RNA, 20 nt, Human
gagaugaagcaaacacauua

SEQ ID NO: 1903642 - RNA, 22 nt, Human
gacugcagggacacgggcagcc

SEQ ID NO: 1903643 - RNA, 23 nt, Human
gacugaguacguugugcauuugg

SEQ ID NO: 1903644 - RNA, 21 nt, Human
gacugcagggacacgggcagc

SEQ ID NO: 1903645 - RNA, 13 nt, Human
gacugcccggcag

SEQ ID NO: 1903646 - RNA, 15 nt, Human
gacugcccggcaggg

SEQ ID NO: 1903647 - RNA, 22 nt, Human
gacugaguacguugugcauuug

SEQ ID NO: 1903648 - RNA, 21 nt, Human
gacugaguacguugugcauuu

SEQ ID NO: 1903649 - RNA, 17 nt, Human
gacucgcgacaaugcaa

SEQ ID NO: 1903650 - RNA, 16 nt, Human
gacucgagaacuuuca

SEQ ID NO: 1903651 - RNA, 19 nt, Human
gacucgagaacuuucauuu

SEQ ID NO: 1903652 - RNA, 18 nt, Human
gacuggaagcacagcuuc

SEQ ID NO: 1903653 - RNA, 21 nt, Human
gacuggaagcuaauuugcauu

SEQ ID NO: 1903654 - RNA, 20 nt, Human
gacuggaagcuaauuugcau

SEQ ID NO: 1903655 - RNA, 16 nt, Human
gacuggaagcacagcu

SEQ ID NO: 1903656 - RNA, 15 nt, Human
gacuggaagcacagc

SEQ ID NO: 1903657 - RNA, 14 nt, Human
gacuggaagcacag

SEQ ID NO: 1903658 - RNA, 12 nt, Human
gacuccugcagg

SEQ ID NO: 1903659 - RNA, 13 nt, Human
gacuccugcaggc

SEQ ID NO: 1903660 - RNA, 13 nt, Human
gacucgcgacaau

SEQ ID NO: 1903661 - RNA, 22 nt, Human
gacuccggcccuccuacccugc

SEQ ID NO: 1903662 - RNA, 13 nt, Human
gacuacaggugug

SEQ ID NO: 1903663 - RNA, 17 nt, Human
gaccuauaacugcccag

SEQ ID NO: 1903664 - RNA, 21 nt, Human
gacuacaggugugagucacca

SEQ ID NO: 1903665 - RNA, 18 nt, Human
gacuacaggugugaguca

SEQ ID NO: 1903666 - RNA, 15 nt, Human
gacuagagcuuucuu

SEQ ID NO: 1903667 - RNA, 18 nt, Human
gacuagagcuuucuuuca

SEQ ID NO: 1903668 - RNA, 15 nt, Human
gacucauucuucugu

SEQ ID NO: 1903669 - RNA, 14 nt, Human
gacucauucuucug

SEQ ID NO: 1903670 - RNA, 18 nt, Human
gacucagacauuggcacc

SEQ ID NO: 1903671 - RNA, 14 nt, Human
gacuagaugaugga

SEQ ID NO: 1903672 - RNA, 16 nt, Human
gacuagaugauggaug

SEQ ID NO: 1903673 - RNA, 21 nt, Human
gacuagaugauggaugccaau

SEQ ID NO: 1903674 - RNA, 17 nt, Human
gacuagagggaccucuc

SEQ ID NO: 1903675 - RNA, 19 nt, Human
gacuagagggaccucuccc

SEQ ID NO: 1903676 - RNA, 20 nt, Human
gacuagagggaccucuccca

SEQ ID NO: 1903677 - RNA, 23 nt, Human
gacuagagggaccucucccaggg

SEQ ID NO: 1903678 - RNA, 20 nt, Human
gacuuggggagauggaguuc

SEQ ID NO: 1903679 - RNA, 13 nt, Human
gacuugaccccga

SEQ ID NO: 1903680 - RNA, 13 nt, Human
gacuuggaagcuc

SEQ ID NO: 1903681 - RNA, 18 nt, Human
gacuugacagaacacugu

SEQ ID NO: 1903682 - RNA, 16 nt, Human
gacuugacagaacacu

SEQ ID NO: 1903683 - RNA, 16 nt, Human
gacuuaacuccuucca

SEQ ID NO: 1903684 - RNA, 19 nt, Human
gacuuaagcacacuugaca

SEQ ID NO: 1903685 - RNA, 15 nt, Human
gacuuccuugagaca

SEQ ID NO: 1903686 - RNA, 16 nt, Human
gacuuccuugagacac

SEQ ID NO: 1903687 - RNA, 20 nt, Human
gacuuccuugagacacggag

SEQ ID NO: 1903688 - RNA, 16 nt, Human
gagaaagguugaagca

SEQ ID NO: 1903689 - RNA, 22 nt, Human
gagaaaguacuucuccacccug

SEQ ID NO: 1903690 - RNA, 17 nt, Human
gagaaaggggagcccac

SEQ ID NO: 1903691 - RNA, 18 nt, Human
gagaaaggggagcccacu

SEQ ID NO: 1903692 - RNA, 19 nt, Human
gagaaagcgcagaugcuag

SEQ ID NO: 1903693 - RNA, 21 nt, Human
gagaaaugaaaaaauauauau

SEQ ID NO: 1903694 - RNA, 14 nt, Human
gagaaaugagcuug

SEQ ID NO: 1903695 - RNA, 12 nt, Human
gagaaaugaaaa

SEQ ID NO: 1903696 - RNA, 13 nt, Human
gagaaaugggacu

SEQ ID NO: 1903697 - RNA, 14 nt, Human
gagaagagaaugca

SEQ ID NO: 1903698 - RNA, 17 nt, Human
gagaacuuucauuuuuu

SEQ ID NO: 1903699 - RNA, 16 nt, Human
gagaacuuuauuucca

SEQ ID NO: 1903700 - RNA, 16 nt, Human
gagaacuuucauuuuu

SEQ ID NO: 1903701 - RNA, 15 nt, Human
gagaacuuucauuuu

SEQ ID NO: 1903702 - RNA, 16 nt, Human
gagaagagaaugcaca

SEQ ID NO: 1903703 - RNA, 16 nt, Human
gagaagcagaggaagg

SEQ ID NO: 1903704 - RNA, 22 nt, Human
gagaagccacaggccugagauu

SEQ ID NO: 1903705 - RNA, 20 nt, Human
gagaagccacaggccugaga

SEQ ID NO: 1903706 - RNA, 18 nt, Human
gagaagccacaggccuga

SEQ ID NO: 1903707 - RNA, 17 nt, Human
gagaagccacaggccug

SEQ ID NO: 1903708 - RNA, 13 nt, Human
gagaagccacagg

SEQ ID NO: 1903709 - RNA, 14 nt, Human
gaccacuguuauca

SEQ ID NO: 1903710 - RNA, 11 nt, Human
gaccagagcug

SEQ ID NO: 1903711 - RNA, 14 nt, Human
gaccacguuucuaa

SEQ ID NO: 1903712 - RNA, 14 nt, Human
gaccacgcuuucua

SEQ ID NO: 1903713 - RNA, 21 nt, Human
gaccacgcuuucuagcuguug

SEQ ID NO: 1903714 - RNA, 21 nt, Human
gaccacugcagaagacaguau

SEQ ID NO: 1903715 - RNA, 13 nt, Human
gaccacggcucga

SEQ ID NO: 1903716 - RNA, 18 nt, Human
gacaugggaaaggggaag

SEQ ID NO: 1903717 - RNA, 16 nt, Human
gacaugcgguagccag

SEQ ID NO: 1903718 - RNA, 17 nt, Human
gacaugcgguagccagc

SEQ ID NO: 1903719 - RNA, 19 nt, Human
gaccauucuccaccugcca

SEQ ID NO: 1903720 - RNA, 20 nt, Human
gaccauucuccaccugccag

SEQ ID NO: 1903721 - RNA, 12 nt, Human
gaccagccuggc

SEQ ID NO: 1903722 - RNA, 22 nt, Human
gaccagccuggccaacauggua

SEQ ID NO: 1903723 - RNA, 21 nt, Human
gaccauucuccaccugccagg

SEQ ID NO: 1903724 - RNA, 22 nt, Human
gaccauucuccaccugccaggg

SEQ ID NO: 1903725 - RNA, 18 nt, Human
gaccagagcugccaccug

SEQ ID NO: 1903726 - RNA, 19 nt, Human
gaccagagcugccaccugc

SEQ ID NO: 1903727 - RNA, 13 nt, Human
gaccagagcugcc

SEQ ID NO: 1903728 - RNA, 14 nt, Human
gaccagagcugcca

SEQ ID NO: 1903729 - RNA, 15 nt, Human
gaccagagcugccac

SEQ ID NO: 1903730 - RNA, 17 nt, Human
gaccagagcugccaccu

SEQ ID NO: 1903731 - RNA, 21 nt, Human
gaccccuccaugugggcuagu

SEQ ID NO: 1903732 - RNA, 22 nt, Human
gacccugaggcccagagggccu

SEQ ID NO: 1903733 - RNA, 18 nt, Human
gaccccuccaugugggcu

SEQ ID NO: 1903734 - RNA, 14 nt, Human
gaccccuccaugug

SEQ ID NO: 1903735 - RNA, 23 nt, Human
gacccugaggcccagagggccug

SEQ ID NO: 1903736 - RNA, 18 nt, Human
gacccaauguaggagcug

SEQ ID NO: 1903737 - RNA, 19 nt, Human
gacccaauguaggagcugc

SEQ ID NO: 1903738 - RNA, 22 nt, Human
gacccacaagaaaugaaagcag

SEQ ID NO: 1903739 - RNA, 15 nt, Human
gacccacaagaaaug

SEQ ID NO: 1903740 - RNA, 16 nt, Human
gacccaaaaggcagaa

SEQ ID NO: 1903741 - RNA, 12 nt, Human
gacccugucuca

SEQ ID NO: 1903742 - RNA, 11 nt, Human
gacccuguaua

SEQ ID NO: 1903743 - RNA, 17 nt, Human
gacccuguauauagccc

SEQ ID NO: 1903744 - RNA, 19 nt, Human
gacccuguauauagcccag

SEQ ID NO: 1903745 - RNA, 19 nt, Human
gacccuuguggucccaccc

SEQ ID NO: 1903746 - RNA, 20 nt, Human
gacccuuguggucccacccc

SEQ ID NO: 1903747 - RNA, 21 nt, Human
gacccuuguggucccacccca

SEQ ID NO: 1903748 - RNA, 19 nt, Human
gaccgugaggccagagaca

SEQ ID NO: 1903749 - RNA, 18 nt, Human
gaccgugaggccagagac

SEQ ID NO: 1903750 - RNA, 16 nt, Human
gaccgugaggccagag

SEQ ID NO: 1903751 - RNA, 17 nt, Human
gaccgugaggccagaga

SEQ ID NO: 1903752 - RNA, 16 nt, Human
gacagggaggugaccc

SEQ ID NO: 1903753 - RNA, 18 nt, Human
gacagggaggacgcucuc

SEQ ID NO: 1903754 - RNA, 23 nt, Human
gacagggcacaccgggcacucag

SEQ ID NO: 1903755 - RNA, 24 nt, Human
gacagggcacaccgggcacucaga

SEQ ID NO: 1903756 - RNA, 14 nt, Human
gacaguuaagagaa

SEQ ID NO: 1903757 - RNA, 15 nt, Human
gacaguggcaggaca

SEQ ID NO: 1903758 - RNA, 13 nt, Human
gacaguggcagga

SEQ ID NO: 1903759 - RNA, 18 nt, Human
gacaguggcaggacagga

SEQ ID NO: 1903760 - RNA, 14 nt, Human
gacaggaccaggga

SEQ ID NO: 1903761 - RNA, 15 nt, Human
gacaggaccagggau

SEQ ID NO: 1903762 - RNA, 23 nt, Human
gacaggaccagggauuuccauga

SEQ ID NO: 1903763 - RNA, 17 nt, Human
gacagggaggacgcucu

SEQ ID NO: 1903764 - RNA, 14 nt, Human
gacaugaucuucuu

SEQ ID NO: 1903765 - RNA, 14 nt, Human
gacaugauuuccuu

SEQ ID NO: 1903766 - RNA, 14 nt, Human
gacaugauuccuuc

SEQ ID NO: 1903767 - RNA, 16 nt, Human
gacaugauuccuuccu

SEQ ID NO: 1903768 - RNA, 16 nt, Human
gacaugauuuccuuga

SEQ ID NO: 1903769 - RNA, 17 nt, Human
gacaugauuuccuugaa

SEQ ID NO: 1903770 - RNA, 19 nt, Human
gacaugauuuccuugaaug

SEQ ID NO: 1903771 - RNA, 20 nt, Human
gacaugauuuccuugaaugu

SEQ ID NO: 1903772 - RNA, 14 nt, Human
gacaugggaaaggg

SEQ ID NO: 1903773 - RNA, 22 nt, Human
gacaugauuuccuugaaugugg

SEQ ID NO: 1903774 - RNA, 24 nt, Human
gacaugauuuccuugaauguggcu

SEQ ID NO: 1903775 - RNA, 14 nt, Human
gacaugcacucagc

SEQ ID NO: 1903776 - RNA, 22 nt, Human
gacaugauuccuuccuguucug

SEQ ID NO: 1903777 - RNA, 22 nt, Human
gacaguuaagagaaaugagcuu

SEQ ID NO: 1903778 - RNA, 14 nt, Human
gacauacuugaagg

SEQ ID NO: 1903779 - RNA, 15 nt, Human
gacauacuugaaggg

SEQ ID NO: 1903780 - RNA, 20 nt, Human
gacauagaauuaacacauga

SEQ ID NO: 1903781 - RNA, 17 nt, Human
gacauacuugaagggcc

SEQ ID NO: 1903782 - RNA, 18 nt, Human
gacauacuugaagggcca

SEQ ID NO: 1903783 - RNA, 19 nt, Human
gacauacuugaagggccag

SEQ ID NO: 1903784 - RNA, 20 nt, Human
gacauacuugaagggccaga

SEQ ID NO: 1903785 - RNA, 22 nt, Human
gacauacuugaagggccagagc

SEQ ID NO: 1903786 - RNA, 23 nt, Human
gacauacuugaagggccagagcc

SEQ ID NO: 1903787 - RNA, 23 nt, Human
gacauccccccgccaaaagcugc

SEQ ID NO: 1903788 - RNA, 14 nt, Human
gacagagucucacu

SEQ ID NO: 1903789 - RNA, 23 nt, Human
gacagaggggguggccucccaac

SEQ ID NO: 1903790 - RNA, 21 nt, Human
gacagaggggguggccuccca

SEQ ID NO: 1903791 - RNA, 22 nt, Human
gacagaggggguggccucccaa

SEQ ID NO: 1903792 - RNA, 17 nt, Human
gacagaggcagccccau

SEQ ID NO: 1903793 - RNA, 15 nt, Human
gacagaggggguggc

SEQ ID NO: 1903794 - RNA, 18 nt, Human
gacagaggggguggccuc

SEQ ID NO: 1903795 - RNA, 19 nt, Human
gacagaggggguggccucc

SEQ ID NO: 1903796 - RNA, 16 nt, Human
gacagaggcagcccca

SEQ ID NO: 1903797 - RNA, 14 nt, Human
gacagaggcagccc

SEQ ID NO: 1903798 - RNA, 21 nt, Human
gacagagcaagugagacccug

SEQ ID NO: 1903799 - RNA, 13 nt, Human
gacacccaggacu

SEQ ID NO: 1903800 - RNA, 14 nt, Human
gacacccaggacuu

SEQ ID NO: 1903801 - RNA, 19 nt, Human
gacagccacggccaggcca

SEQ ID NO: 1903802 - RNA, 18 nt, Human
gacagccacggccaggcc

SEQ ID NO: 1903803 - RNA, 17 nt, Human
gacagccacggccaggc

SEQ ID NO: 1903804 - RNA, 14 nt, Human
gacagccacggcca

SEQ ID NO: 1903805 - RNA, 22 nt, Human
gacagagugagacucugucuca

SEQ ID NO: 1903806 - RNA, 20 nt, Human
gacagagugagacucugucu

SEQ ID NO: 1903807 - RNA, 21 nt, Human
gacagccacggccaggccaga

SEQ ID NO: 1903808 - RNA, 20 nt, Human
gacagccacggccaggccag

SEQ ID NO: 1903809 - RNA, 16 nt, Human
gacagcugccugggau

SEQ ID NO: 1903810 - RNA, 17 nt, Human
gacagcugccugggauc

SEQ ID NO: 1903811 - RNA, 18 nt, Human
gacagcugccugggaucc

SEQ ID NO: 1903812 - RNA, 21 nt, Human
gacagcugccugggaucccuc

SEQ ID NO: 1903813 - RNA, 12 nt, Human
gacagcuuugcu

SEQ ID NO: 1903814 - RNA, 16 nt, Human
gacagcuuugcugcug

SEQ ID NO: 1903815 - RNA, 15 nt, Human
gacagcuuugcugcu

SEQ ID NO: 1903816 - RNA, 19 nt, Human
gaauguaaucaauguuucu

SEQ ID NO: 1903817 - RNA, 18 nt, Human
gaauguaaucaauguuuc

SEQ ID NO: 1903818 - RNA, 16 nt, Human
gaauguaaucaauguu

SEQ ID NO: 1903819 - RNA, 13 nt, Human
gaauguaaucaau

SEQ ID NO: 1903820 - RNA, 11 nt, Human
gaauguaauca

SEQ ID NO: 1903821 - RNA, 18 nt, Human
gaaugucaguauguggaa

SEQ ID NO: 1903822 - RNA, 16 nt, Human
gaaugucaguaugugg

SEQ ID NO: 1903823 - RNA, 13 nt, Human
gaaugucaguaug

SEQ ID NO: 1903824 - RNA, 13 nt, Human
gaaugucagugug

SEQ ID NO: 1903825 - RNA, 19 nt, Human
gaaugucaguauguggaag

SEQ ID NO: 1903826 - RNA, 18 nt, Human
gaauguggcuugagaaau

SEQ ID NO: 1903827 - RNA, 23 nt, Human
gaauugcauuuuuuaaaacaaga

SEQ ID NO: 1903828 - RNA, 21 nt, Human
gaauugcauuuuuuaaaacaa

SEQ ID NO: 1903829 - RNA, 14 nt, Human
gaauugcagaguac

SEQ ID NO: 1903830 - RNA, 12 nt, Human
gaauugcauuga

SEQ ID NO: 1903831 - RNA, 13 nt, Human
gaauugcauugac

SEQ ID NO: 1903832 - RNA, 22 nt, Human
gaauugauuugcauugaacaca

SEQ ID NO: 1903833 - RNA, 18 nt, Human
gaauugauuugcauugaa

SEQ ID NO: 1903834 - RNA, 21 nt, Human
gaauugacccacaagaaauga

SEQ ID NO: 1903835 - RNA, 16 nt, Human
gaauugacccacaaga

SEQ ID NO: 1903836 - RNA, 21 nt, Human
gaauguuuacacucuuuguaa

SEQ ID NO: 1903837 - RNA, 20 nt, Human
gaauguuuacacucuuugua

SEQ ID NO: 1903838 - RNA, 20 nt, Human
gaauguuacauuguuugucu

SEQ ID NO: 1903839 - RNA, 17 nt, Human
gaauguuacauuguuug

SEQ ID NO: 1903840 - RNA, 22 nt, Human
gaaucccacccacaugugacac

SEQ ID NO: 1903841 - RNA, 18 nt, Human
gaaucccacccacaugug

SEQ ID NO: 1903842 - RNA, 16 nt, Human
gaaucccaaauuugau

SEQ ID NO: 1903843 - RNA, 17 nt, Human
gaaucccaaauuugauu

SEQ ID NO: 1903844 - RNA, 19 nt, Human
gaaucccaaauuugauuga

SEQ ID NO: 1903845 - RNA, 20 nt, Human
gaauccagacccggcugcgu

SEQ ID NO: 1903846 - RNA, 18 nt, Human
gaauccagacccggcugc

SEQ ID NO: 1903847 - RNA, 18 nt, Human
gaaucuagggagggggaa

SEQ ID NO: 1903848 - RNA, 15 nt, Human
gaaucuacuaauucc

SEQ ID NO: 1903849 - RNA, 18 nt, Human
gaaucuacccccagaucc

SEQ ID NO: 1903850 - RNA, 22 nt, Human
gaaucuacccccagauccaagc

SEQ ID NO: 1903851 - RNA, 12 nt, Human
gaaaggcuccag

SEQ ID NO: 1903852 - RNA, 19 nt, Human
gaaucaguauaaacaaagu

SEQ ID NO: 1903853 - RNA, 21 nt, Human
gaaucaguauaaacaaaguua

SEQ ID NO: 1903854 - RNA, 21 nt, Human
gaaugaaagucuugugacuag

SEQ ID NO: 1903855 - RNA, 20 nt, Human
gaaugaaagucuugugacua

SEQ ID NO: 1903856 - RNA, 12 nt, Human
gaaucuggagac

SEQ ID NO: 1903857 - RNA, 23 nt, Human
gaaugaaagucuugugacuagug

SEQ ID NO: 1903858 - RNA, 20 nt, Human
gaaugaacacucuuuugcuu

SEQ ID NO: 1903859 - RNA, 20 nt, Human
gaaugcacaaacagaggccg

SEQ ID NO: 1903860 - RNA, 21 nt, Human
gaaugaaagggcccagagagg

SEQ ID NO: 1903861 - RNA, 18 nt, Human
gaaucucugaauuugaga

SEQ ID NO: 1903862 - RNA, 20 nt, Human
gaaugcagucuguccaggcu

SEQ ID NO: 1903863 - RNA, 22 nt, Human
gaaugcagucuguccaggcucg

SEQ ID NO: 1903864 - RNA, 21 nt, Human
gaaugcacaaacagaggccgc

SEQ ID NO: 1903865 - RNA, 22 nt, Human
gaauggcacagcccaaagaagg

SEQ ID NO: 1903866 - RNA, 13 nt, Human
gaauggcagcugc

SEQ ID NO: 1903867 - RNA, 16 nt, Human
gaauggcagcugccac

SEQ ID NO: 1903868 - RNA, 16 nt, Human
gacaaggaaaaaauaa

SEQ ID NO: 1903869 - RNA, 19 nt, Human
gacaaggagaagagcaagg

SEQ ID NO: 1903870 - RNA, 21 nt, Human
gacaaggauugcuacuguccu

SEQ ID NO: 1903871 - RNA, 19 nt, Human
gacaaggauugcuacuguc

SEQ ID NO: 1903872 - RNA, 18 nt, Human
gacaaggauugcuacugu

SEQ ID NO: 1903873 - RNA, 21 nt, Human
gacaaggaugaucuaggaaga

SEQ ID NO: 1903874 - RNA, 22 nt, Human
gacaaugcaaaccaucauugaa

SEQ ID NO: 1903875 - RNA, 16 nt, Human
gacaauggcagaugua

SEQ ID NO: 1903876 - RNA, 12 nt, Human
gacaaugugaaa

SEQ ID NO: 1903877 - RNA, 18 nt, Human
gacaaugugaaaagaaaa

SEQ ID NO: 1903878 - RNA, 19 nt, Human
gacaaugugaaaagaaaaa

SEQ ID NO: 1903879 - RNA, 20 nt, Human
gacaaugugaaaagaaaaau

SEQ ID NO: 1903880 - RNA, 19 nt, Human
gacacaggcccggcuccag

SEQ ID NO: 1903881 - RNA, 16 nt, Human
gacacaagccuucggc

SEQ ID NO: 1903882 - RNA, 21 nt, Human
gacacaggcccggcuccaggc

SEQ ID NO: 1903883 - RNA, 20 nt, Human
gacacaggcccggcuccagg

SEQ ID NO: 1903884 - RNA, 14 nt, Human
gacacaugcaaggu

SEQ ID NO: 1903885 - RNA, 13 nt, Human
gacacaggcccuc

SEQ ID NO: 1903886 - RNA, 19 nt, Human
gacacaugcaaggucauuu

SEQ ID NO: 1903887 - RNA, 15 nt, Human
gacacauguccaaga

SEQ ID NO: 1903888 - RNA, 20 nt, Human
gacacauguccaagaagccc

SEQ ID NO: 1903889 - RNA, 23 nt, Human
gacacauguccaagaagcccagg

SEQ ID NO: 1903890 - RNA, 11 nt, Human
gacaacaucug

SEQ ID NO: 1903891 - RNA, 15 nt, Human
gacaacuacagaaaa

SEQ ID NO: 1903892 - RNA, 22 nt, Human
gacaacacucauugaccugagg

SEQ ID NO: 1903893 - RNA, 23 nt, Human
gacaacacucauugaccugaggc

SEQ ID NO: 1903894 - RNA, 19 nt, Human
gacaacacugggaaacaga

SEQ ID NO: 1903895 - RNA, 15 nt, Human
gaauuguaaggaaug

SEQ ID NO: 1903896 - RNA, 23 nt, Human
gaauuggguggggggcuucauac

SEQ ID NO: 1903897 - RNA, 22 nt, Human
gaauuggguggggggcuucaua

SEQ ID NO: 1903898 - RNA, 20 nt, Human
gaauuggguggggggcuuca

SEQ ID NO: 1903899 - RNA, 20 nt, Human
gaauuucuaggacugaauua

SEQ ID NO: 1903900 - RNA, 19 nt, Human
gaauuucuaggacugaauu

SEQ ID NO: 1903901 - RNA, 22 nt, Human
gaauuucuuuugccguuauuaa

SEQ ID NO: 1903902 - RNA, 20 nt, Human
gaauuugauaugugaacagu

SEQ ID NO: 1903903 - RNA, 19 nt, Human
gauugauagaguguuauca

SEQ ID NO: 1903904 - RNA, 15 nt, Human
gauugauuugaagaa

SEQ ID NO: 1903905 - RNA, 17 nt, Human
gauugauuugaagaaca

SEQ ID NO: 1903906 - RNA, 22 nt, Human
gauugagaaguuacuuuccauu

SEQ ID NO: 1903907 - RNA, 14 nt, Human
gauucuccugccuc

SEQ ID NO: 1903908 - RNA, 15 nt, Human
gauugcaacaggcug

SEQ ID NO: 1903909 - RNA, 23 nt, Human
gauugcaggagucccugccauca

SEQ ID NO: 1903910 - RNA, 20 nt, Human
gauuacagggaugagccacc

SEQ ID NO: 1903911 - RNA, 18 nt, Human
gauuacagggaugagcca

SEQ ID NO: 1903912 - RNA, 20 nt, Human
gauucaaugccccugaauuu

SEQ ID NO: 1903913 - RNA, 19 nt, Human
gauucaaugccccugaauu

SEQ ID NO: 1903914 - RNA, 21 nt, Human
gauucaaugccccugaauuua

SEQ ID NO: 1903915 - RNA, 15 nt, Human
gauucuauuuauaug

SEQ ID NO: 1903916 - RNA, 20 nt, Human
gauucuauuuauauguacau

SEQ ID NO: 1903917 - RNA, 21 nt, Human
gauucuauuuauauguacaug

SEQ ID NO: 1903918 - RNA, 12 nt, Human
gauuuaaaucag

SEQ ID NO: 1903919 - RNA, 14 nt, Human
gauuuaacagaaau

SEQ ID NO: 1903920 - RNA, 13 nt, Human
gauuuaacagaaa

SEQ ID NO: 1903921 - RNA, 22 nt, Human
gauugcguggaauugugcugag

SEQ ID NO: 1903922 - RNA, 17 nt, Human
gauugggccccugccag

SEQ ID NO: 1903923 - RNA, 19 nt, Human
gauugggugggcaggaaaa

SEQ ID NO: 1903924 - RNA, 20 nt, Human
gauugggugggcaggaaaag

SEQ ID NO: 1903925 - RNA, 19 nt, Human
gauuugaagaacaugugag

SEQ ID NO: 1903926 - RNA, 20 nt, Human
gauuugaagaacaugugaga

SEQ ID NO: 1903927 - RNA, 13 nt, Human
gauuugacauugc

SEQ ID NO: 1903928 - RNA, 22 nt, Human
gauuuccguuaaaauaccagcc

SEQ ID NO: 1903929 - RNA, 15 nt, Human
gauuuaacagaaaug

SEQ ID NO: 1903930 - RNA, 13 nt, Human
gauuuccuugaau

SEQ ID NO: 1903931 - RNA, 17 nt, Human
gauuuccuugaaugugg

SEQ ID NO: 1903932 - RNA, 22 nt, Human
gauuuccuugaauguggcuuga

SEQ ID NO: 1903933 - RNA, 22 nt, Human
gauuuccugcuuugggaagccg

SEQ ID NO: 1903934 - RNA, 15 nt, Human
gcaaaccaucauuga

SEQ ID NO: 1903935 - RNA, 22 nt, Human
gcaaaccacacuggacuccggc

SEQ ID NO: 1903936 - RNA, 19 nt, Human
gcaaagaucuguccucagc

SEQ ID NO: 1903937 - RNA, 20 nt, Human
gcaaagaucuguccucagcc

SEQ ID NO: 1903938 - RNA, 21 nt, Human
gcaaagaucuguccucagccu

SEQ ID NO: 1903939 - RNA, 22 nt, Human
gcaaagaucuguccucagccuu

SEQ ID NO: 1903940 - RNA, 17 nt, Human
gcaaaggaguagaaaga

SEQ ID NO: 1903941 - RNA, 23 nt, Human
gcaaaugugaaucauuuuaccuu

SEQ ID NO: 1903942 - RNA, 22 nt, Human
gcaacaagaccaccacuucgaa

SEQ ID NO: 1903943 - RNA, 20 nt, Human
gcaacaagguccucugucag

SEQ ID NO: 1903944 - RNA, 19 nt, Human
gauuuugauccaagcuggu

SEQ ID NO: 1903945 - RNA, 21 nt, Human
gauuuugaaauuuuuauuaaa

SEQ ID NO: 1903946 - RNA, 15 nt, Human
gauuugcauugaaca

SEQ ID NO: 1903947 - RNA, 13 nt, Human
gauuuuaauuuug

SEQ ID NO: 1903948 - RNA, 18 nt, Human
gauuuuaaucaaguugaa

SEQ ID NO: 1903949 - RNA, 15 nt, Human
gauuuuaauuuugaa

SEQ ID NO: 1903950 - RNA, 17 nt, Human
gauuuuaaucaaguuga

SEQ ID NO: 1903951 - RNA, 16 nt, Human
gauuuugcuguagaag

SEQ ID NO: 1903952 - RNA, 15 nt, Human
gauuuugcuguauau

SEQ ID NO: 1903953 - RNA, 18 nt, Human
gauuuugcuguauauuug

SEQ ID NO: 1903954 - RNA, 22 nt, Human
gauuuugguuuuguuccccucc

SEQ ID NO: 1903955 - RNA, 19 nt, Human
gauuuugguuuuguucccc

SEQ ID NO: 1903956 - RNA, 16 nt, Human
gauuuuguaacccaga

SEQ ID NO: 1903957 - RNA, 13 nt, Human
gauuuuguaaccc

SEQ ID NO: 1903958 - RNA, 12 nt, Human
gcaaaccaucau

SEQ ID NO: 1903959 - RNA, 15 nt, Human
gcaaaccacacugga

SEQ ID NO: 1903960 - RNA, 17 nt, Human
gcaaaccacacuggacu

SEQ ID NO: 1903961 - RNA, 18 nt, Human
gcaaaccacacuggacuc

SEQ ID NO: 1903962 - RNA, 20 nt, Human
gcaaaccacacuggacuccg

SEQ ID NO: 1903963 - RNA, 16 nt, Human
gaugggugaaggcugg

SEQ ID NO: 1903964 - RNA, 21 nt, Human
gaugggugaaggcuggcauga

SEQ ID NO: 1903965 - RNA, 21 nt, Human
gaugggucaguuguaucagca

SEQ ID NO: 1903966 - RNA, 15 nt, Human
gaugggucaguugua

SEQ ID NO: 1903967 - RNA, 19 nt, Human
gaugggugcuuggaggaag

SEQ ID NO: 1903968 - RNA, 13 nt, Human
gauggggcugcac

SEQ ID NO: 1903969 - RNA, 19 nt, Human
gauggggcugcaccggcug

SEQ ID NO: 1903970 - RNA, 15 nt, Human
gauggggcugcaccg

SEQ ID NO: 1903971 - RNA, 21 nt, Human
gaugggcaacccccagccugc

SEQ ID NO: 1903972 - RNA, 24 nt, Human
gauggggcccugccuccuuuguga

SEQ ID NO: 1903973 - RNA, 20 nt, Human
gaugggcaacccccagccug

SEQ ID NO: 1903974 - RNA, 18 nt, Human
gauggccggagaggaccg

SEQ ID NO: 1903975 - RNA, 22 nt, Human
gauggcccauucuacuugcucu

SEQ ID NO: 1903976 - RNA, 20 nt, Human
gaugggagggaggcucaggu

SEQ ID NO: 1903977 - RNA, 22 nt, Human
gauggccgggcgcgguggcuca

SEQ ID NO: 1903978 - RNA, 18 nt, Human
gauggcccauucuacuug

SEQ ID NO: 1903979 - RNA, 19 nt, Human
gauggcccauucuacuugc

SEQ ID NO: 1903980 - RNA, 20 nt, Human
gauggcccauucuacuugcu

SEQ ID NO: 1903981 - RNA, 16 nt, Human
gaucagaccauaaugu

SEQ ID NO: 1903982 - RNA, 14 nt, Human
gaucagaucugaca

SEQ ID NO: 1903983 - RNA, 19 nt, Human
gaugcccaaagaugcagcc

SEQ ID NO: 1903984 - RNA, 20 nt, Human
gaugcccaaagaugcagccg

SEQ ID NO: 1903985 - RNA, 15 nt, Human
gaugccauuacauuu

SEQ ID NO: 1903986 - RNA, 20 nt, Human
gaugcugacauucaccugcc

SEQ ID NO: 1903987 - RNA, 21 nt, Human
gaugcugacauucaccugccc

SEQ ID NO: 1903988 - RNA, 22 nt, Human
gaugcuagaacucccuuucaac

SEQ ID NO: 1903989 - RNA, 20 nt, Human
gaugcuagaacucccuuuca

SEQ ID NO: 1903990 - RNA, 18 nt, Human
gaugcuagaacucccuuu

SEQ ID NO: 1903991 - RNA, 17 nt, Human
gaugugggucaaggaau

SEQ ID NO: 1903992 - RNA, 12 nt, Human
gauggugcaaug

SEQ ID NO: 1903993 - RNA, 14 nt, Human
gauggugcaaugac

SEQ ID NO: 1903994 - RNA, 13 nt, Human
gaugguaauucuu

SEQ ID NO: 1903995 - RNA, 17 nt, Human
gauggugcaaugaccuu

SEQ ID NO: 1903996 - RNA, 24 nt, Human
gaugguguucaaaaaacuuguaaa

SEQ ID NO: 1903997 - RNA, 15 nt, Human
gauggugcaaugacc

SEQ ID NO: 1903998 - RNA, 16 nt, Human
gauggugcaaugaccu

SEQ ID NO: 1903999 - RNA, 22 nt, Human
gauuacaagcgugagccacugc

SEQ ID NO: 1904000 - RNA, 15 nt, Human
gauuaaacuuaaucu

SEQ ID NO: 1904001 - RNA, 23 nt, Human
gauuacaagcgugagccacugca

SEQ ID NO: 1904002 - RNA, 18 nt, Human
gauuacaggcaugugcca

SEQ ID NO: 1904003 - RNA, 16 nt, Human
gauguuuaguaaucau

SEQ ID NO: 1904004 - RNA, 13 nt, Human
gcacaagccaggg

SEQ ID NO: 1904005 - RNA, 12 nt, Human
gcacaagccagg

SEQ ID NO: 1904006 - RNA, 21 nt, Human
gcacaagcuccaagcucccag

SEQ ID NO: 1904007 - RNA, 18 nt, Human
gcacaagcuccaagcucc

SEQ ID NO: 1904008 - RNA, 15 nt, Human
gcacaagcuccaagc

SEQ ID NO: 1904009 - RNA, 17 nt, Human
gcacaagcuccaagcuc

SEQ ID NO: 1904010 - RNA, 23 nt, Human
gcacaaauucugucucuggauua

SEQ ID NO: 1904011 - RNA, 14 nt, Human
gcacaaaguggcau

SEQ ID NO: 1904012 - RNA, 19 nt, Human
gcacaacuuuaagaggaca

SEQ ID NO: 1904013 - RNA, 17 nt, Human
gcacaagccagggugug

SEQ ID NO: 1904014 - RNA, 20 nt, Human
gcacaccgggcacucagaag

SEQ ID NO: 1904015 - RNA, 14 nt, Human
gcacacgccuccca

SEQ ID NO: 1904016 - RNA, 17 nt, Human
gcacacgccucccacug

SEQ ID NO: 1904017 - RNA, 19 nt, Human
gcacacgccucccacuggg

SEQ ID NO: 1904018 - RNA, 20 nt, Human
gcacacucauccccucacuu

SEQ ID NO: 1904019 - RNA, 20 nt, Human
gcacagaaaauggaagacag

SEQ ID NO: 1904020 - RNA, 23 nt, Human
gcacagaaaauggaagacagcuc

SEQ ID NO: 1904021 - RNA, 21 nt, Human
gcacagaaaauggaagacagc

SEQ ID NO: 1904022 - RNA, 22 nt, Human
gcacagaaaauggaagacagcu

SEQ ID NO: 1904023 - RNA, 14 nt, Human
gcacagacccugcc

SEQ ID NO: 1904024 - RNA, 15 nt, Human
gcacagacccugccc

SEQ ID NO: 1904025 - RNA, 16 nt, Human
gcacagacccugcccu

SEQ ID NO: 1904026 - RNA, 17 nt, Human
gcacagacccugcccug

SEQ ID NO: 1904027 - RNA, 15 nt, Human
gcacagaguuguuac

SEQ ID NO: 1904028 - RNA, 22 nt, Human
gcacagacccugcccugugggc

SEQ ID NO: 1904029 - RNA, 18 nt, Human
gcacagacccugcccugu

SEQ ID NO: 1904030 - RNA, 19 nt, Human
gcacagacccugcccugug

SEQ ID NO: 1904031 - RNA, 20 nt, Human
gcacagacccugcccugugg

SEQ ID NO: 1904032 - RNA, 21 nt, Human
gcacagacccugcccuguggg

SEQ ID NO: 1904033 - RNA, 23 nt, Human
gcacaaagaugggugaaggcugg

SEQ ID NO: 1904034 - RNA, 16 nt, Human
gcacaaagggcccaga

SEQ ID NO: 1904035 - RNA, 13 nt, Human
gcacaaaguggca

SEQ ID NO: 1904036 - RNA, 15 nt, Human
gcacaaacagaggcc

SEQ ID NO: 1904037 - RNA, 16 nt, Human
gcacaaacagaggccg

SEQ ID NO: 1904038 - RNA, 14 nt, Human
gcacaaacagaggc

SEQ ID NO: 1904039 - RNA, 13 nt, Human
gcacaaaacccag

SEQ ID NO: 1904040 - RNA, 23 nt, Human
gcacaaaacccagaccuguuagc

SEQ ID NO: 1904041 - RNA, 16 nt, Human
gcaauuccugcuccua

SEQ ID NO: 1904042 - RNA, 23 nt, Human
gcaauuucaaauuacucuuucuc

SEQ ID NO: 1904043 - RNA, 14 nt, Human
gcaaugugauaaaa

SEQ ID NO: 1904044 - RNA, 22 nt, Human
gcaauguagaggggaaaagaga

SEQ ID NO: 1904045 - RNA, 19 nt, Human
gcaaugucugagugaaccu

SEQ ID NO: 1904046 - RNA, 15 nt, Human
gcaauguuuauuuca

SEQ ID NO: 1904047 - RNA, 15 nt, Human
gcaauggcagccuug

SEQ ID NO: 1904048 - RNA, 13 nt, Human
gcaacucugaagg

SEQ ID NO: 1904049 - RNA, 19 nt, Human
gcaaugggagcugaggcca

SEQ ID NO: 1904050 - RNA, 20 nt, Human
gcaaugggagcugaggccac

SEQ ID NO: 1904051 - RNA, 14 nt, Human
gcaacucaucuuag

SEQ ID NO: 1904052 - RNA, 20 nt, Human
gcaccuugugucuguacacg

SEQ ID NO: 1904053 - RNA, 14 nt, Human
gcaccuugugucug

SEQ ID NO: 1904054 - RNA, 15 nt, Human
gcacgauuucuguuu

SEQ ID NO: 1904055 - RNA, 13 nt, Human
gcacgauuucugu

SEQ ID NO: 1904056 - RNA, 20 nt, Human
gcaccuuagacagucccugc

SEQ ID NO: 1904057 - RNA, 21 nt, Human
gcaccuuagacagucccugcc

SEQ ID NO: 1904058 - RNA, 22 nt, Human
gcaccccagcuggggccaggcu

SEQ ID NO: 1904059 - RNA, 12 nt, Human
gcaccauaacuu

SEQ ID NO: 1904060 - RNA, 21 nt, Human
gcaccuguaaucccagcuacu

SEQ ID NO: 1904061 - RNA, 22 nt, Human
gcacagaguuguuacauuuuua

SEQ ID NO: 1904062 - RNA, 16 nt, Human
gcacagugaagugcug

SEQ ID NO: 1904063 - RNA, 21 nt, Human
gcacagaguuguuacauuuuu

SEQ ID NO: 1904064 - RNA, 19 nt, Human
gcacagaguuguuacauuu

SEQ ID NO: 1904065 - RNA, 18 nt, Human
gcacagaguuguuacauu

SEQ ID NO: 1904066 - RNA, 16 nt, Human
gcacagaguuguuaca

SEQ ID NO: 1904067 - RNA, 14 nt, Human
gcagacaggcaagc

SEQ ID NO: 1904068 - RNA, 13 nt, Human
gcagacaggcaag

SEQ ID NO: 1904069 - RNA, 12 nt, Human
gcagacaggcaa

SEQ ID NO: 1904070 - RNA, 22 nt, Human
gcagaaggggguggugucucca

SEQ ID NO: 1904071 - RNA, 15 nt, Human
gcagaaggggguggu

SEQ ID NO: 1904072 - RNA, 14 nt, Human
gcagaagggggugg

SEQ ID NO: 1904073 - RNA, 18 nt, Human
gcacuguggauuauuuca

SEQ ID NO: 1904074 - RNA, 19 nt, Human
gcacugugacccccagcuc

SEQ ID NO: 1904075 - RNA, 11 nt, Human
gcacugugaag

SEQ ID NO: 1904076 - RNA, 14 nt, Human
gcacugugaaggac

SEQ ID NO: 1904077 - RNA, 16 nt, Human
gcacugugaaggaccc

SEQ ID NO: 1904078 - RNA, 17 nt, Human
gcacugugaaggacccu

SEQ ID NO: 1904079 - RNA, 18 nt, Human
gcacugugaaggacccuu

SEQ ID NO: 1904080 - RNA, 18 nt, Human
gcacugaggaagaacggg

SEQ ID NO: 1904081 - RNA, 13 nt, Human
gcacugaggaaga

SEQ ID NO: 1904082 - RNA, 11 nt, Human
gcacugaggaa

SEQ ID NO: 1904083 - RNA, 16 nt, Human
gcacgauuucuguuua

SEQ ID NO: 1904084 - RNA, 23 nt, Human
gcacugcuuccagugaggcucug

SEQ ID NO: 1904085 - RNA, 23 nt, Human
gagggagcuccaacucagaaggg

SEQ ID NO: 1904086 - RNA, 19 nt, Human
gagggagggcuccagacac

SEQ ID NO: 1904087 - RNA, 22 nt, Human
gagggagcaaguccuucccuuu

SEQ ID NO: 1904088 - RNA, 20 nt, Human
gaggcugggcucccuuccca

SEQ ID NO: 1904089 - RNA, 18 nt, Human
gagggagugacagaggca

SEQ ID NO: 1904090 - RNA, 20 nt, Human
gagggagggcuccagacaca

SEQ ID NO: 1904091 - RNA, 22 nt, Human
gagggagugacagaggcagccc

SEQ ID NO: 1904092 - RNA, 21 nt, Human
gagggagugacagaggcagcc

SEQ ID NO: 1904093 - RNA, 12 nt, Human
gagggaggggcc

SEQ ID NO: 1904094 - RNA, 21 nt, Human
gaggggucgacuucgggcugg

SEQ ID NO: 1904095 - RNA, 13 nt, Human
gaggguaaggcug

SEQ ID NO: 1904096 - RNA, 17 nt, Human
gaggggguggccuccca

SEQ ID NO: 1904097 - RNA, 16 nt, Human
gagggcagcgggagcc

SEQ ID NO: 1904098 - RNA, 18 nt, Human
gagggcagcgggagccuc

SEQ ID NO: 1904099 - RNA, 23 nt, Human
gagggcagcgggagccucccugc

SEQ ID NO: 1904100 - RNA, 14 nt, Human
gagggucugaggaa

SEQ ID NO: 1904101 - RNA, 13 nt, Human
gagggucugagga

SEQ ID NO: 1904102 - RNA, 23 nt, Human
gagggucuugguuccagccugcc

SEQ ID NO: 1904103 - RNA, 14 nt, Human
gagggucagccagg

SEQ ID NO: 1904104 - RNA, 15 nt, Human
gagggucagccaggg

SEQ ID NO: 1904105 - RNA, 16 nt, Human
gagggucagccagggc

SEQ ID NO: 1904106 - RNA, 18 nt, Human
gagggucagccagggccu

SEQ ID NO: 1904107 - RNA, 22 nt, Human
gagggugucccaaaaagaaagg

SEQ ID NO: 1904108 - RNA, 21 nt, Human
gaggguggugaccucugccug

SEQ ID NO: 1904109 - RNA, 14 nt, Human
gaggguggugaccu

SEQ ID NO: 1904110 - RNA, 15 nt, Human
gagggugggaguggg

SEQ ID NO: 1904111 - RNA, 12 nt, Human
gaggguggaaua

SEQ ID NO: 1904112 - RNA, 21 nt, Human
gagggugaagugaagacaaug

SEQ ID NO: 1904113 - RNA, 15 nt, Human
gagggugagugcaag

SEQ ID NO: 1904114 - RNA, 13 nt, Human
gaggucagagccu

SEQ ID NO: 1904115 - RNA, 12 nt, Human
gaggucagagcc

SEQ ID NO: 1904116 - RNA, 17 nt, Human
gaggucaaggcugcagu

SEQ ID NO: 1904117 - RNA, 22 nt, Human
gagguauucaauauccuuugcc

SEQ ID NO: 1904118 - RNA, 21 nt, Human
gagguagcuuugagguggaag

SEQ ID NO: 1904119 - RNA, 19 nt, Human
gagguagaaugacuccuug

SEQ ID NO: 1904120 - RNA, 15 nt, Human
gagguagaaugacuc

SEQ ID NO: 1904121 - RNA, 15 nt, Human
gaggguugggcuggu

SEQ ID NO: 1904122 - RNA, 14 nt, Human
gaggguugggcugg

SEQ ID NO: 1904123 - RNA, 24 nt, Human
gagguaaggaauaccugucccccu

SEQ ID NO: 1904124 - RNA, 21 nt, Human
gagguaaggaauaccuguccc

SEQ ID NO: 1904125 - RNA, 15 nt, Human
gaggccuugagaggc

SEQ ID NO: 1904126 - RNA, 19 nt, Human
gaggccuucucugaaggac

SEQ ID NO: 1904127 - RNA, 18 nt, Human
gaggccuucucugaagga

SEQ ID NO: 1904128 - RNA, 16 nt, Human
gaggccuucucugaag

SEQ ID NO: 1904129 - RNA, 18 nt, Human
gaggccucuggaaagcaa

SEQ ID NO: 1904130 - RNA, 22 nt, Human
gaggccucucauuccagaggaa

SEQ ID NO: 1904131 - RNA, 16 nt, Human
gaggcugggcucccuu

SEQ ID NO: 1904132 - RNA, 13 nt, Human
gaggcuggcacag

SEQ ID NO: 1904133 - RNA, 21 nt, Human
gaggcgcaugaauuugugaag

SEQ ID NO: 1904134 - RNA, 14 nt, Human
gaggccuuuaacca

SEQ ID NO: 1904135 - RNA, 11 nt, Human
gaggcccagag

SEQ ID NO: 1904136 - RNA, 13 nt, Human
gaggcccagaggg

SEQ ID NO: 1904137 - RNA, 14 nt, Human
gaggcccagagggc

SEQ ID NO: 1904138 - RNA, 19 nt, Human
gaggcccagagggccugca

SEQ ID NO: 1904139 - RNA, 15 nt, Human
gaggcccagagggcc

SEQ ID NO: 1904140 - RNA, 16 nt, Human
gaggcccagagggccu

SEQ ID NO: 1904141 - RNA, 22 nt, Human
gaggcccuucucuccagccccu

SEQ ID NO: 1904142 - RNA, 23 nt, Human
gaggccccagccucccugaagcc

SEQ ID NO: 1904143 - RNA, 18 nt, Human
gaggccguugauucacuu

SEQ ID NO: 1904144 - RNA, 21 nt, Human
gaggcccuucucuccagcccc

SEQ ID NO: 1904145 - RNA, 15 nt, Human
gaggcccuucucucc

SEQ ID NO: 1904146 - RNA, 20 nt, Human
gaggcccuucucuccagccc

SEQ ID NO: 1904147 - RNA, 13 nt, Human
gaggcccaguuca

SEQ ID NO: 1904148 - RNA, 18 nt, Human
gaggcccaguucacccug

SEQ ID NO: 1904149 - RNA, 20 nt, Human
gaggcccaguucacccugau

SEQ ID NO: 1904150 - RNA, 12 nt, Human
gaggccccagcc

SEQ ID NO: 1904151 - RNA, 13 nt, Human
gaggccccagccu

SEQ ID NO: 1904152 - RNA, 19 nt, Human
gaggccccagccucccuga

SEQ ID NO: 1904153 - RNA, 22 nt, Human
gaggccccagccucccugaagc

SEQ ID NO: 1904154 - RNA, 16 nt, Human
gaggccagugagccac

SEQ ID NO: 1904155 - RNA, 17 nt, Human
gaggccaugggccuccu

SEQ ID NO: 1904156 - RNA, 14 nt, Human
gaggccaugggccu

SEQ ID NO: 1904157 - RNA, 23 nt, Human
gaggccaugggccuccugugugu

SEQ ID NO: 1904158 - RNA, 21 nt, Human
gaggccaugggccuccugugu

SEQ ID NO: 1904159 - RNA, 20 nt, Human
gaggccaugggccuccugug

SEQ ID NO: 1904160 - RNA, 18 nt, Human
gaggccaugggccuccug

SEQ ID NO: 1904161 - RNA, 18 nt, Human
gaggcagccccauucugc

SEQ ID NO: 1904162 - RNA, 19 nt, Human
gaggcagccccauucugcc

SEQ ID NO: 1904163 - RNA, 19 nt, Human
gaggcagagguugcaguga

SEQ ID NO: 1904164 - RNA, 9 nt, Human
gaggcaggg

SEQ ID NO: 1904165 - RNA, 20 nt, Human
gaggcagccccauucugccu

SEQ ID NO: 1904166 - RNA, 21 nt, Human
gaggcagccccauucugccug

SEQ ID NO: 1904167 - RNA, 13 nt, Human
gaggaucucuuga

SEQ ID NO: 1904168 - RNA, 22 nt, Human
gaggaucucuugagccugggag

SEQ ID NO: 1904169 - RNA, 16 nt, Human
gaggaucucuugagcc

SEQ ID NO: 1904170 - RNA, 19 nt, Human
gaggaucucuugagccugg

SEQ ID NO: 1904171 - RNA, 20 nt, Human
gaggauugcuugagcucagg

SEQ ID NO: 1904172 - RNA, 13 nt, Human
gaggcaagagaau

SEQ ID NO: 1904173 - RNA, 22 nt, Human
gaggcaaugggagcugaggcca

SEQ ID NO: 1904174 - RNA, 13 nt, Human
gaggcaagcccug

SEQ ID NO: 1904175 - RNA, 18 nt, Human
gaggcaagguuauaugca

SEQ ID NO: 1904176 - RNA, 17 nt, Human
gaguccuagagcuacag

SEQ ID NO: 1904177 - RNA, 19 nt, Human
gaguccgaaagggacuugg

SEQ ID NO: 1904178 - RNA, 14 nt, Human
gagucgaggacagg

SEQ ID NO: 1904179 - RNA, 13 nt, Human
gaguccucugaau

SEQ ID NO: 1904180 - RNA, 16 nt, Human
gagucgaggacaggga

SEQ ID NO: 1904181 - RNA, 15 nt, Human
gagucgaggacaggg

SEQ ID NO: 1904182 - RNA, 18 nt, Human
gaguaggaagacuuugga

SEQ ID NO: 1904183 - RNA, 19 nt, Human
gaguaggaagacuuuggaa

SEQ ID NO: 1904184 - RNA, 11 nt, Human
gaguauauguc

SEQ ID NO: 1904185 - RNA, 16 nt, Human
gagugacagaggcagc

SEQ ID NO: 1904186 - RNA, 15 nt, Human
gagugacagaggcag

SEQ ID NO: 1904187 - RNA, 14 nt, Human
gagugacagaggca

SEQ ID NO: 1904188 - RNA, 17 nt, Human
gagugaagcugggagaa

SEQ ID NO: 1904189 - RNA, 15 nt, Human
gagucugaaggcugg

SEQ ID NO: 1904190 - RNA, 14 nt, Human
gagucugaaggcug

SEQ ID NO: 1904191 - RNA, 16 nt, Human
gagucuguuuuguaaa

SEQ ID NO: 1904192 - RNA, 17 nt, Human
gagucuguuuuguaaag

SEQ ID NO: 1904193 - RNA, 12 nt, Human
gagucugaaggc

SEQ ID NO: 1904194 - RNA, 13 nt, Human
gagucugaaggcu

SEQ ID NO: 1904195 - RNA, 21 nt, Human
gagucuauuuacggaacucaa

SEQ ID NO: 1904196 - RNA, 20 nt, Human
gaggucagagccugcaguua

SEQ ID NO: 1904197 - RNA, 17 nt, Human
gaggucagagccugcag

SEQ ID NO: 1904198 - RNA, 20 nt, Human
gagguguauggagagaaaac

SEQ ID NO: 1904199 - RNA, 15 nt, Human
gagguugggaggcca

SEQ ID NO: 1904200 - RNA, 17 nt, Human
gagguugggaggccauu

SEQ ID NO: 1904201 - RNA, 20 nt, Human
gagguugaucagaucugaca

SEQ ID NO: 1904202 - RNA, 20 nt, Human
gagguuucucaaagaaauuu

SEQ ID NO: 1904203 - RNA, 16 nt, Human
gagguuucaaaccucc

SEQ ID NO: 1904204 - RNA, 22 nt, Human
gaguagcugggacuacaggcac

SEQ ID NO: 1904205 - RNA, 12 nt, Human
gaguaggaagac

SEQ ID NO: 1904206 - RNA, 13 nt, Human
gaguaggaagacu

SEQ ID NO: 1904207 - RNA, 17 nt, Human
gaguaggaagacuuugg

SEQ ID NO: 1904208 - RNA, 19 nt, Human
gaguagcugggacuacagg

SEQ ID NO: 1904209 - RNA, 22 nt, Human
gaguagaaagacagagcuggga

SEQ ID NO: 1904210 - RNA, 14 nt, Human
gaguagaauugcau

SEQ ID NO: 1904211 - RNA, 17 nt, Human
gaguagaauugcauuga

SEQ ID NO: 1904212 - RNA, 21 nt, Human
gaguacuacaguccucccauc

SEQ ID NO: 1904213 - RNA, 23 nt, Human
gaguacuacaguccucccaucuc

SEQ ID NO: 1904214 - RNA, 20 nt, Human
gaguagaaagacagagcugg

SEQ ID NO: 1904215 - RNA, 17 nt, Human
gaguagaaagacagagc

SEQ ID NO: 1904216 - RNA, 22 nt, Human
gaguaauccaagcaaaugugaa

SEQ ID NO: 1904217 - RNA, 15 nt, Human
gaguaaucugagaaa

SEQ ID NO: 1904218 - RNA, 20 nt, Human
gaguacuacaguccucccau

SEQ ID NO: 1904219 - RNA, 15 nt, Human
gaguugaagacagag

SEQ ID NO: 1904220 - RNA, 17 nt, Human
gaguugaagacagagcu

SEQ ID NO: 1904221 - RNA, 21 nt, Human
gaguugaagacagagcuacac

SEQ ID NO: 1904222 - RNA, 23 nt, Human
gaguugacuugacagaacacugu

SEQ ID NO: 1904223 - RNA, 19 nt, Human
gauaacuagauggugcuga

SEQ ID NO: 1904224 - RNA, 20 nt, Human
gaguucauacccuguuacca

SEQ ID NO: 1904225 - RNA, 14 nt, Human
gaguucaucuugaa

SEQ ID NO: 1904226 - RNA, 19 nt, Human
gaguucaucuugaauugua

SEQ ID NO: 1904227 - RNA, 20 nt, Human
gaguucaucuugaauuguaa

SEQ ID NO: 1904228 - RNA, 13 nt, Human
gaguuacagacaa

SEQ ID NO: 1904229 - RNA, 15 nt, Human
gaguuacagacaaag

SEQ ID NO: 1904230 - RNA, 17 nt, Human
gaguuaagaccuggcag

SEQ ID NO: 1904231 - RNA, 21 nt, Human
gaguuaagaccuggcagcucu

SEQ ID NO: 1904232 - RNA, 12 nt, Human
gaguuacagaca

SEQ ID NO: 1904233 - RNA, 12 nt, Human
gaguuaagaccu

SEQ ID NO: 1904234 - RNA, 13 nt, Human
gaguuaagaccug

SEQ ID NO: 1904235 - RNA, 14 nt, Human
gaguuaagaccugg

SEQ ID NO: 1904236 - RNA, 20 nt, Human
gagugugccugaagucccag

SEQ ID NO: 1904237 - RNA, 13 nt, Human
gaguguguaauuu

SEQ ID NO: 1904238 - RNA, 17 nt, Human
gagugacagaggcagcc

SEQ ID NO: 1904239 - RNA, 15 nt, Human
gaguggguugauuuc

SEQ ID NO: 1904240 - RNA, 13 nt, Human
gagugggugaaua

SEQ ID NO: 1904241 - RNA, 15 nt, Human
gaguguacucccagg

SEQ ID NO: 1904242 - RNA, 20 nt, Human
gauacaggaaaagcugcuga

SEQ ID NO: 1904243 - RNA, 22 nt, Human
gauaagaaccuuuugagugccu

SEQ ID NO: 1904244 - RNA, 20 nt, Human
gauaacuagauggugcugag

SEQ ID NO: 1904245 - RNA, 23 nt, Human
gauacaggaaaagcugcugacag

SEQ ID NO: 1904246 - RNA, 21 nt, Human
gauacaggaaaagcugcugac

SEQ ID NO: 1904247 - RNA, 22 nt, Human
gauagauguguggacacauugg

SEQ ID NO: 1904248 - RNA, 14 nt, Human
gauagaugugugga

SEQ ID NO: 1904249 - RNA, 16 nt, Human
gauagcacagacccug

SEQ ID NO: 1904250 - RNA, 15 nt, Human
gauagcacagacccu

SEQ ID NO: 1904251 - RNA, 22 nt, Human
gauagccaaggccaaaggaagc

SEQ ID NO: 1904252 - RNA, 23 nt, Human
gauagcuucaccccaaucccagc

SEQ ID NO: 1904253 - RNA, 16 nt, Human
gaucacggcucacugc

SEQ ID NO: 1904254 - RNA, 15 nt, Human
gaucacggcucacug

SEQ ID NO: 1904255 - RNA, 18 nt, Human
gaucacggcucacugcag

SEQ ID NO: 1904256 - RNA, 15 nt, Human
gauauaagugugugu

SEQ ID NO: 1904257 - RNA, 24 nt, Human
gauaugauucaaaugucuauaaac

SEQ ID NO: 1904258 - RNA, 22 nt, Human
gauaugauucaaaugucuauaa

SEQ ID NO: 1904259 - RNA, 14 nt, Human
gauaugauucaaau

SEQ ID NO: 1904260 - RNA, 15 nt, Human
ggcucccacagagac

SEQ ID NO: 1904261 - RNA, 16 nt, Human
ggcuccaggcuccuuu

SEQ ID NO: 1904262 - RNA, 11 nt, Human
ggcuccaggcu

SEQ ID NO: 1904263 - RNA, 18 nt, Human
ggcuccaggccagggggc

SEQ ID NO: 1904264 - RNA, 16 nt, Human
ggcuccaggccagggg

SEQ ID NO: 1904265 - RNA, 14 nt, Human
ggcuccaggccagg

SEQ ID NO: 1904266 - RNA, 21 nt, Human
ggcucaaguccucuuuucuga

SEQ ID NO: 1904267 - RNA, 15 nt, Human
ggcucaaguccucuu

SEQ ID NO: 1904268 - RNA, 14 nt, Human
ggcucacacugaga

SEQ ID NO: 1904269 - RNA, 12 nt, Human
ggcucacacuga

SEQ ID NO: 1904270 - RNA, 16 nt, Human
ggcucacaccuguaau

SEQ ID NO: 1904271 - RNA, 16 nt, Human
ggcuccagaugcaggg

SEQ ID NO: 1904272 - RNA, 17 nt, Human
ggcuccagaugcagggc

SEQ ID NO: 1904273 - RNA, 18 nt, Human
ggcuccagaugcagggca

SEQ ID NO: 1904274 - RNA, 19 nt, Human
ggcuccagaugcagggcag

SEQ ID NO: 1904275 - RNA, 12 nt, Human
ggcuccaggagc

SEQ ID NO: 1904276 - RNA, 13 nt, Human
ggcuccaggagca

SEQ ID NO: 1904277 - RNA, 19 nt, Human
ggcuccaggagcagccaca

SEQ ID NO: 1904278 - RNA, 15 nt, Human
ggcuaguugggcuuc

SEQ ID NO: 1904279 - RNA, 23 nt, Human
ggcuagugugguguuuccuggca

SEQ ID NO: 1904280 - RNA, 16 nt, Human
ggcuaguugggcuucc

SEQ ID NO: 1904281 - RNA, 21 nt, Human
ggcuauggggauagaugugug

SEQ ID NO: 1904282 - RNA, 15 nt, Human
ggcuaugcauuugaa

SEQ ID NO: 1904283 - RNA, 19 nt, Human
ggcucaagcgauucuccug

SEQ ID NO: 1904284 - RNA, 16 nt, Human
ggcuaggaccccucca

SEQ ID NO: 1904285 - RNA, 22 nt, Human
ggcuaggaccccuccauguggg

SEQ ID NO: 1904286 - RNA, 14 nt, Human
ggcuagggggagcc

SEQ ID NO: 1904287 - RNA, 22 nt, Human
ggcuagagguucaaagauauuu

SEQ ID NO: 1904288 - RNA, 17 nt, Human
ggcuagagguucaaaga

SEQ ID NO: 1904289 - RNA, 18 nt, Human
ggcggcucggaggaagcc

SEQ ID NO: 1904290 - RNA, 19 nt, Human
ggccuggccugagcuggga

SEQ ID NO: 1904291 - RNA, 23 nt, Human
ggccugaagaguccucugaauga

SEQ ID NO: 1904292 - RNA, 13 nt, Human
ggccugaagaguc

SEQ ID NO: 1904293 - RNA, 19 nt, Human
ggccugaagaguccucuga

SEQ ID NO: 1904294 - RNA, 11 nt, Human
ggccugugagc

SEQ ID NO: 1904295 - RNA, 14 nt, Human
ggccuguccuccaa

SEQ ID NO: 1904296 - RNA, 14 nt, Human
ggccugggggcugg

SEQ ID NO: 1904297 - RNA, 20 nt, Human
ggccugggggcugggcagag

SEQ ID NO: 1904298 - RNA, 22 nt, Human
ggccugggggcugggcagagga

SEQ ID NO: 1904299 - RNA, 18 nt, Human
ggcgcugccccuggcagc

SEQ ID NO: 1904300 - RNA, 19 nt, Human
ggcgcugccccuggcagcc

SEQ ID NO: 1904301 - RNA, 21 nt, Human
ggcgcugccccuggcagcccc

SEQ ID NO: 1904302 - RNA, 23 nt, Human
ggcgcugccccuggcagccccug

SEQ ID NO: 1904303 - RNA, 20 nt, Human
ggcgccgcaaaccacacugg

SEQ ID NO: 1904304 - RNA, 22 nt, Human
ggcgccgcaaaccacacuggac

SEQ ID NO: 1904305 - RNA, 22 nt, Human
ggcgcgcaccuguaaucccagc

SEQ ID NO: 1904306 - RNA, 13 nt, Human
ggcggagcuggcc

SEQ ID NO: 1904307 - RNA, 14 nt, Human
ggcggagcuggccc

SEQ ID NO: 1904308 - RNA, 15 nt, Human
ggcggagcuggcccc

SEQ ID NO: 1904309 - RNA, 17 nt, Human
ggcggagcuggccccgc

SEQ ID NO: 1904310 - RNA, 20 nt, Human
ggcggagcuggccccgccgc

SEQ ID NO: 1904311 - RNA, 23 nt, Human
ggcggagcuggccccgccgccug

SEQ ID NO: 1904312 - RNA, 20 nt, Human
ggccuaugcacauauggacu

SEQ ID NO: 1904313 - RNA, 20 nt, Human
ggccuaggccucagccagag

SEQ ID NO: 1904314 - RNA, 21 nt, Human
ggccuaugcacauauggacuc

SEQ ID NO: 1904315 - RNA, 18 nt, Human
ggccucuuaugggcuggg

SEQ ID NO: 1904316 - RNA, 21 nt, Human
ggccucuggaaagcaaagggc

SEQ ID NO: 1904317 - RNA, 20 nt, Human
ggccucgguguggagaagcg

SEQ ID NO: 1904318 - RNA, 16 nt, Human
ggccucugugccuucu

SEQ ID NO: 1904319 - RNA, 17 nt, Human
ggccucuuaugggcugg

SEQ ID NO: 1904320 - RNA, 13 nt, Human
ggccucugcacuc

SEQ ID NO: 1904321 - RNA, 14 nt, Human
ggccucugcacucc

SEQ ID NO: 1904322 - RNA, 15 nt, Human
ggccucugcacuccc

SEQ ID NO: 1904323 - RNA, 16 nt, Human
ggccucugcacucccc

SEQ ID NO: 1904324 - RNA, 23 nt, Human
ggccuagcauacguacacauuuu

SEQ ID NO: 1904325 - RNA, 14 nt, Human
ggccuaggccucag

SEQ ID NO: 1904326 - RNA, 19 nt, Human
ggccuaagaguugagcucu

SEQ ID NO: 1904327 - RNA, 20 nt, Human
ggccuacagcuuugaucccu

SEQ ID NO: 1904328 - RNA, 23 nt, Human
ggccuacagcuuugaucccugac

SEQ ID NO: 1904329 - RNA, 12 nt, Human
ggcccugugccu

SEQ ID NO: 1904330 - RNA, 23 nt, Human
ggcccaaauuaucaagcuaauaa

SEQ ID NO: 1904331 - RNA, 21 nt, Human
ggcccaaauuaucaagcuaau

SEQ ID NO: 1904332 - RNA, 12 nt, Human
ggcccagagagg

SEQ ID NO: 1904333 - RNA, 11 nt, Human
ggcccagagag

SEQ ID NO: 1904334 - RNA, 21 nt, Human
ggcccucugcccacucccugc

SEQ ID NO: 1904335 - RNA, 14 nt, Human
ggcccucuggagug

SEQ ID NO: 1904336 - RNA, 18 nt, Human
ggcccucuggaguggcca

SEQ ID NO: 1904337 - RNA, 19 nt, Human
ggcccucuggaguggccac

SEQ ID NO: 1904338 - RNA, 19 nt, Human
ggcccucugcccacucccu

SEQ ID NO: 1904339 - RNA, 20 nt, Human
ggcccucugcccacucccug

SEQ ID NO: 1904340 - RNA, 13 nt, Human
ggcccucugccca

SEQ ID NO: 1904341 - RNA, 15 nt, Human
ggcccucugcccacu

SEQ ID NO: 1904342 - RNA, 16 nt, Human
ggcccucugcccacuc

SEQ ID NO: 1904343 - RNA, 17 nt, Human
ggcccucugcccacucc

SEQ ID NO: 1904344 - RNA, 14 nt, Human
ggcccugccuccuu

SEQ ID NO: 1904345 - RNA, 15 nt, Human
ggcccugccuccuuu

SEQ ID NO: 1904346 - RNA, 13 nt, Human
ggcccuggccuug

SEQ ID NO: 1904347 - RNA, 13 nt, Human
ggcccugccuccu

SEQ ID NO: 1904348 - RNA, 23 nt, Human
ggccacgugggcaaacaggcagu

SEQ ID NO: 1904349 - RNA, 11 nt, Human
ggccacuaagc

SEQ ID NO: 1904350 - RNA, 20 nt, Human
ggccacuaagcagaggaggg

SEQ ID NO: 1904351 - RNA, 21 nt, Human
ggccacuaagcagaggagggg

SEQ ID NO: 1904352 - RNA, 16 nt, Human
ggcauuccccaggagg

SEQ ID NO: 1904353 - RNA, 18 nt, Human
ggcaugggaaggugggcg

SEQ ID NO: 1904354 - RNA, 18 nt, Human
ggcauuccccaggaggcc

SEQ ID NO: 1904355 - RNA, 19 nt, Human
ggcauuccccaggaggcca

SEQ ID NO: 1904356 - RNA, 22 nt, Human
ggcaugggaaugaaugucagug

SEQ ID NO: 1904357 - RNA, 17 nt, Human
ggcauuccccaggaggc

SEQ ID NO: 1904358 - RNA, 18 nt, Human
ggcaugggaaugaauguc

SEQ ID NO: 1904359 - RNA, 16 nt, Human
ggccaugggccuccug

SEQ ID NO: 1904360 - RNA, 21 nt, Human
ggccaggcugaugggacagaa

SEQ ID NO: 1904361 - RNA, 20 nt, Human
ggccauucuccacagcaacc

SEQ ID NO: 1904362 - RNA, 21 nt, Human
ggccauguugugccucccugg

SEQ ID NO: 1904363 - RNA, 16 nt, Human
ggccauguugugccuc

SEQ ID NO: 1904364 - RNA, 22 nt, Human
ggccauguugugccucccuggu

SEQ ID NO: 1904365 - RNA, 23 nt, Human
ggccagcugcuugggcuucaucc

SEQ ID NO: 1904366 - RNA, 18 nt, Human
ggccaggcccucugccca

SEQ ID NO: 1904367 - RNA, 20 nt, Human
ggccagccuugaccauucuc

SEQ ID NO: 1904368 - RNA, 22 nt, Human
ggccagccuugaccauucucca

SEQ ID NO: 1904369 - RNA, 17 nt, Human
ggccagcugcuugggcu

SEQ ID NO: 1904370 - RNA, 17 nt, Human
ggcagcuugaggguugg

SEQ ID NO: 1904371 - RNA, 22 nt, Human
ggcagcugcuuuugucuauggg

SEQ ID NO: 1904372 - RNA, 20 nt, Human
ggcagcucuggacagcccca

SEQ ID NO: 1904373 - RNA, 16 nt, Human
ggcagcucaccucucc

SEQ ID NO: 1904374 - RNA, 13 nt, Human
ggcagcucagaga

SEQ ID NO: 1904375 - RNA, 21 nt, Human
ggcagcucagagaggguggga

SEQ ID NO: 1904376 - RNA, 12 nt, Human
ggcagcucagcu

SEQ ID NO: 1904377 - RNA, 15 nt, Human
ggcagcucuggacag

SEQ ID NO: 1904378 - RNA, 12 nt, Human
ggcagcucaccu

SEQ ID NO: 1904379 - RNA, 14 nt, Human
ggcagcucaccucu

SEQ ID NO: 1904380 - RNA, 22 nt, Human
ggcagcgccaggcugaccacag

SEQ ID NO: 1904381 - RNA, 21 nt, Human
ggcagcguacucaucaucaac

SEQ ID NO: 1904382 - RNA, 15 nt, Human
ggcaccuaauccagg

SEQ ID NO: 1904383 - RNA, 16 nt, Human
ggcaccuaauccaggc

SEQ ID NO: 1904384 - RNA, 16 nt, Human
ggcagugggagcugcc

SEQ ID NO: 1904385 - RNA, 14 nt, Human
ggcagugggagcug

SEQ ID NO: 1904386 - RNA, 13 nt, Human
ggcagugggagcu

SEQ ID NO: 1904387 - RNA, 20 nt, Human
ggcagggucucacucugucg

SEQ ID NO: 1904388 - RNA, 19 nt, Human
ggcagggucucacucuguc

SEQ ID NO: 1904389 - RNA, 13 nt, Human
ggcagcuucuuug

SEQ ID NO: 1904390 - RNA, 17 nt, Human
ggcaugcuaaagccuuc

SEQ ID NO: 1904391 - RNA, 11 nt, Human
ggcaugcuaaa

SEQ ID NO: 1904392 - RNA, 15 nt, Human
ggcaugaagacagau

SEQ ID NO: 1904393 - RNA, 18 nt, Human
ggcaugacacgaauauug

SEQ ID NO: 1904394 - RNA, 12 nt, Human
ggcacccuccca

SEQ ID NO: 1904395 - RNA, 22 nt, Human
ggcacccggccccugcugguuc

SEQ ID NO: 1904396 - RNA, 23 nt, Human
ggcacccaccaucaugucuggcu

SEQ ID NO: 1904397 - RNA, 20 nt, Human
ggcaaugggagcugaggcca

SEQ ID NO: 1904398 - RNA, 21 nt, Human
ggcaaugggagcugaggccac

SEQ ID NO: 1904399 - RNA, 13 nt, Human
ggcacccacccug

SEQ ID NO: 1904400 - RNA, 14 nt, Human
ggcacccacccugg

SEQ ID NO: 1904401 - RNA, 23 nt, Human
ggcaaugcuggcuguuggcuggg

SEQ ID NO: 1904402 - RNA, 15 nt, Human
ggcaaugcuggcugu

SEQ ID NO: 1904403 - RNA, 14 nt, Human
ggcaaugcuggcug

SEQ ID NO: 1904404 - RNA, 18 nt, Human
ggcaacccccagccugcu

SEQ ID NO: 1904405 - RNA, 19 nt, Human
ggcaaucauggugcucaga

SEQ ID NO: 1904406 - RNA, 21 nt, Human
ggcaauauagcaagaucccau

SEQ ID NO: 1904407 - RNA, 23 nt, Human
ggauuacaagcgugagccacugc

SEQ ID NO: 1904408 - RNA, 16 nt, Human
ggauucuuauggacaa

SEQ ID NO: 1904409 - RNA, 16 nt, Human
ggauucuuccucccuc

SEQ ID NO: 1904410 - RNA, 17 nt, Human
ggcaacccccagccugc

SEQ ID NO: 1904411 - RNA, 16 nt, Human
ggcaacccccagccug

SEQ ID NO: 1904412 - RNA, 15 nt, Human
ggauuguaaaauggu

SEQ ID NO: 1904413 - RNA, 16 nt, Human
ggauuggggucccucu

SEQ ID NO: 1904414 - RNA, 17 nt, Human
ggauuggggucccucua

SEQ ID NO: 1904415 - RNA, 17 nt, Human
ggauugcuacuguccua

SEQ ID NO: 1904416 - RNA, 18 nt, Human
ggauugggccccugccag

SEQ ID NO: 1904417 - RNA, 17 nt, Human
ggauugggccccugcca

SEQ ID NO: 1904418 - RNA, 19 nt, Human
ggauuacaagcgugagcca

SEQ ID NO: 1904419 - RNA, 17 nt, Human
ggauggaaugauggguc

SEQ ID NO: 1904420 - RNA, 15 nt, Human
ggaugcuuguacaua

SEQ ID NO: 1904421 - RNA, 16 nt, Human
ggaugcggauggccgg

SEQ ID NO: 1904422 - RNA, 19 nt, Human
ggaugcagccucacagucc

SEQ ID NO: 1904423 - RNA, 13 nt, Human
ggaugcagcauua

SEQ ID NO: 1904424 - RNA, 22 nt, Human
ggaugccaauauuaaaucugcu

SEQ ID NO: 1904425 - RNA, 16 nt, Human
ggaugcauggagauag

SEQ ID NO: 1904426 - RNA, 23 nt, Human
ggaugcacagaguuguuacauuu

SEQ ID NO: 1904427 - RNA, 21 nt, Human
ggaugauuggaggggggaggu

SEQ ID NO: 1904428 - RNA, 16 nt, Human
ggaugcagccucacag

SEQ ID NO: 1904429 - RNA, 17 nt, Human
ggaugcagccucacagu

SEQ ID NO: 1904430 - RNA, 12 nt, Human
ggauccuccagg

SEQ ID NO: 1904431 - RNA, 13 nt, Human
ggauccuccaggu

SEQ ID NO: 1904432 - RNA, 22 nt, Human
ggaucccucauccucauaccca

SEQ ID NO: 1904433 - RNA, 17 nt, Human
ggaucccucccccccau

SEQ ID NO: 1904434 - RNA, 13 nt, Human
ggaucccucaucc

SEQ ID NO: 1904435 - RNA, 17 nt, Human
ggaucccucauccucau

SEQ ID NO: 1904436 - RNA, 18 nt, Human
ggauacaaaagcauguga

SEQ ID NO: 1904437 - RNA, 14 nt, Human
ggauagaugcuggc

SEQ ID NO: 1904438 - RNA, 13 nt, Human
ggauagaugcugg

SEQ ID NO: 1904439 - RNA, 14 nt, Human
ggagugcagugagc

SEQ ID NO: 1904440 - RNA, 20 nt, Human
ggagugcaaugacacagucu

SEQ ID NO: 1904441 - RNA, 12 nt, Human
ggagugcaguga

SEQ ID NO: 1904442 - RNA, 13 nt, Human
gcuucugccugca

SEQ ID NO: 1904443 - RNA, 12 nt, Human
gcuucugccugc

SEQ ID NO: 1904444 - RNA, 16 nt, Human
gcuugaggguugggcu

SEQ ID NO: 1904445 - RNA, 22 nt, Human
gcuucucugugaacgauuuaga

SEQ ID NO: 1904446 - RNA, 15 nt, Human
gcuuccagugaggcu

SEQ ID NO: 1904447 - RNA, 21 nt, Human
gcuucauccuccucagaucuu

SEQ ID NO: 1904448 - RNA, 17 nt, Human
gcuucauuuccuguguc

SEQ ID NO: 1904449 - RNA, 16 nt, Human
gcuuccagugaggcuc

SEQ ID NO: 1904450 - RNA, 18 nt, Human
gcuuccagugaggcucug

SEQ ID NO: 1904451 - RNA, 22 nt, Human
gcuucucauccugcaggcagcu

SEQ ID NO: 1904452 - RNA, 16 nt, Human
gcuucauuuccugugu

SEQ ID NO: 1904453 - RNA, 13 nt, Human
gcuucauuuccug

SEQ ID NO: 1904454 - RNA, 12 nt, Human
gcuucauccucc

SEQ ID NO: 1904455 - RNA, 15 nt, Human
gcuucauccuccuca

SEQ ID NO: 1904456 - RNA, 18 nt, Human
gcuucaguggcagcugcu

SEQ ID NO: 1904457 - RNA, 17 nt, Human
gcuucaguggcagcugc

SEQ ID NO: 1904458 - RNA, 22 nt, Human
gcuucauacagggaugguguuc

SEQ ID NO: 1904459 - RNA, 11 nt, Human
gcuucauacag

SEQ ID NO: 1904460 - RNA, 16 nt, Human
gcuucaguggcagcug

SEQ ID NO: 1904461 - RNA, 12 nt, Human
gcuuauacacuu

SEQ ID NO: 1904462 - RNA, 20 nt, Human
gcuuauacacuuacacuuua

SEQ ID NO: 1904463 - RNA, 19 nt, Human
gcuuaucucaggggugugc

SEQ ID NO: 1904464 - RNA, 15 nt, Human
gcugccaaugggagc

SEQ ID NO: 1904465 - RNA, 16 nt, Human
gcugccaaugggagcu

SEQ ID NO: 1904466 - RNA, 19 nt, Human
gcugccaaugggagcucau

SEQ ID NO: 1904467 - RNA, 21 nt, Human
gcuguccucagguggccaugc

SEQ ID NO: 1904468 - RNA, 14 nt, Human
gcuguucagcuggu

SEQ ID NO: 1904469 - RNA, 12 nt, Human
gcuguucaugaa

SEQ ID NO: 1904470 - RNA, 21 nt, Human
gcuguucaugaaagauucaau

SEQ ID NO: 1904471 - RNA, 22 nt, Human
gcuguucccauguagcccccug

SEQ ID NO: 1904472 - RNA, 21 nt, Human
gcuuagucacugagacagccc

SEQ ID NO: 1904473 - RNA, 19 nt, Human
gcuuagucacugagacagc

SEQ ID NO: 1904474 - RNA, 20 nt, Human
gcuuagucacugagacagcc

SEQ ID NO: 1904475 - RNA, 15 nt, Human
gcuuagucacugaga

SEQ ID NO: 1904476 - RNA, 17 nt, Human
gcuuagucacugagaca

SEQ ID NO: 1904477 - RNA, 12 nt, Human
gcuguugagcug

SEQ ID NO: 1904478 - RNA, 15 nt, Human
gcuguugagcuguuu

SEQ ID NO: 1904479 - RNA, 16 nt, Human
gcuguugagcuguuuu

SEQ ID NO: 1904480 - RNA, 18 nt, Human
gcuguugagcuguuuucc

SEQ ID NO: 1904481 - RNA, 13 nt, Human
gcuuagagacagu

SEQ ID NO: 1904482 - RNA, 14 nt, Human
ggaaccaggcuugg

SEQ ID NO: 1904483 - RNA, 22 nt, Human
ggaaccaaagcgaauuuuaaaa

SEQ ID NO: 1904484 - RNA, 11 nt, Human
ggaacccagac

SEQ ID NO: 1904485 - RNA, 13 nt, Human
ggaacccagacuc

SEQ ID NO: 1904486 - RNA, 14 nt, Human
ggaacccagacuca

SEQ ID NO: 1904487 - RNA, 15 nt, Human
ggaacccagacucag

SEQ ID NO: 1904488 - RNA, 16 nt, Human
ggaacaggaaacugau

SEQ ID NO: 1904489 - RNA, 21 nt, Human
ggaaccaaagcgaauuuuaaa

SEQ ID NO: 1904490 - RNA, 21 nt, Human
ggaaaucaccgaaaacguggc

SEQ ID NO: 1904491 - RNA, 14 nt, Human
ggaaaucaccgaaa

SEQ ID NO: 1904492 - RNA, 23 nt, Human
ggaaaaucagccugcuccagcug

SEQ ID NO: 1904493 - RNA, 20 nt, Human
ggaaaaugcagcagggaugc

SEQ ID NO: 1904494 - RNA, 19 nt, Human
ggaaaaucagccugcucca

SEQ ID NO: 1904495 - RNA, 12 nt, Human
ggaaaggcucca

SEQ ID NO: 1904496 - RNA, 13 nt, Human
ggaaaggcuccag

SEQ ID NO: 1904497 - RNA, 14 nt, Human
ggaaaggcuccagg

SEQ ID NO: 1904498 - RNA, 22 nt, Human
ggaaaggcuccaggagcagcca

SEQ ID NO: 1904499 - RNA, 21 nt, Human
ggaaaggggcaggccagagcu

SEQ ID NO: 1904500 - RNA, 17 nt, Human
ggaaaggcuccaggagc

SEQ ID NO: 1904501 - RNA, 19 nt, Human
ggaaaggcuccaggagcag

SEQ ID NO: 1904502 - RNA, 20 nt, Human
ggaaaggcuccaggagcagc

SEQ ID NO: 1904503 - RNA, 21 nt, Human
ggaaaggcuccaggagcagcc

SEQ ID NO: 1904504 - RNA, 15 nt, Human
gcuuugugauuuuug

SEQ ID NO: 1904505 - RNA, 20 nt, Human
gcuugaggguugggcuggug

SEQ ID NO: 1904506 - RNA, 18 nt, Human
gcuugaggguugggcugg

SEQ ID NO: 1904507 - RNA, 20 nt, Human
gcuuuagaaagguuuugagc

SEQ ID NO: 1904508 - RNA, 21 nt, Human
gcuuuguuuguugucagcuga

SEQ ID NO: 1904509 - RNA, 18 nt, Human
ggaaaacaugcuacacac

SEQ ID NO: 1904510 - RNA, 20 nt, Human
ggaaaagcugcugacagugu

SEQ ID NO: 1904511 - RNA, 18 nt, Human
ggaaaagcugcugacagu

SEQ ID NO: 1904512 - RNA, 20 nt, Human
ggaaaaggcagggagcgagg

SEQ ID NO: 1904513 - RNA, 14 nt, Human
ggaaaagcugcuga

SEQ ID NO: 1904514 - RNA, 20 nt, Human
ggaaaagccaagaggcugca

SEQ ID NO: 1904515 - RNA, 19 nt, Human
ggaaaagcggacaucagcu

SEQ ID NO: 1904516 - RNA, 14 nt, Human
ggaaaagcagcucu

SEQ ID NO: 1904517 - RNA, 18 nt, Human
ggaaaagcagcucucccc

SEQ ID NO: 1904518 - RNA, 17 nt, Human
ggagagucacagaacaa

SEQ ID NO: 1904519 - RNA, 18 nt, Human
ggagaguuuccugaaaca

SEQ ID NO: 1904520 - RNA, 22 nt, Human
ggagaggcccucuggaguggcc

SEQ ID NO: 1904521 - RNA, 19 nt, Human
ggagaugaagcaaacacau

SEQ ID NO: 1904522 - RNA, 21 nt, Human
ggagauagccccacaggaggu

SEQ ID NO: 1904523 - RNA, 20 nt, Human
ggagauagccccacaggagg

SEQ ID NO: 1904524 - RNA, 22 nt, Human
ggagaaugucaguauguggaag

SEQ ID NO: 1904525 - RNA, 22 nt, Human
ggagaauuuagguuuuuauuag

SEQ ID NO: 1904526 - RNA, 15 nt, Human
ggacgcucucuggcc

SEQ ID NO: 1904527 - RNA, 14 nt, Human
ggacgcucucuggc

SEQ ID NO: 1904528 - RNA, 13 nt, Human
ggacgcucucugg

SEQ ID NO: 1904529 - RNA, 17 nt, Human
ggagaagcggcuggcag

SEQ ID NO: 1904530 - RNA, 18 nt, Human
ggagaagcggcuggcagc

SEQ ID NO: 1904531 - RNA, 19 nt, Human
ggagaaucacuugaacccg

SEQ ID NO: 1904532 - RNA, 15 nt, Human
ggagaaucacuugaa

SEQ ID NO: 1904533 - RNA, 17 nt, Human
ggacugugugcucagga

SEQ ID NO: 1904534 - RNA, 12 nt, Human
ggagaagccagg

SEQ ID NO: 1904535 - RNA, 13 nt, Human
ggagaagccagga

SEQ ID NO: 1904536 - RNA, 15 nt, Human
ggagaagccaggaau

SEQ ID NO: 1904537 - RNA, 20 nt, Human
ggacauugcggacagccacg

SEQ ID NO: 1904538 - RNA, 22 nt, Human
ggacagccacggccaggccaga

SEQ ID NO: 1904539 - RNA, 17 nt, Human
ggaccaaggagaugaag

SEQ ID NO: 1904540 - RNA, 21 nt, Human
ggacagccacggccaggccag

SEQ ID NO: 1904541 - RNA, 20 nt, Human
ggacagccacggccaggcca

SEQ ID NO: 1904542 - RNA, 19 nt, Human
ggacagccacggccaggcc

SEQ ID NO: 1904543 - RNA, 15 nt, Human
ggacagccacggcca

SEQ ID NO: 1904544 - RNA, 17 nt, Human
ggacacucaaaagcugg

SEQ ID NO: 1904545 - RNA, 22 nt, Human
ggacacucaaaagcugggcagg

SEQ ID NO: 1904546 - RNA, 23 nt, Human
ggacagauccagggacugaagcc

SEQ ID NO: 1904547 - RNA, 19 nt, Human
ggacagauccagggacuga

SEQ ID NO: 1904548 - RNA, 17 nt, Human
ggaccuugaacugggua

SEQ ID NO: 1904549 - RNA, 15 nt, Human
ggaccuugaacuggg

SEQ ID NO: 1904550 - RNA, 20 nt, Human
ggaccuucgggcugugcccg

SEQ ID NO: 1904551 - RNA, 19 nt, Human
ggaccuucgggcugugccc

SEQ ID NO: 1904552 - RNA, 18 nt, Human
ggaccuucgggcugugcc

SEQ ID NO: 1904553 - RNA, 17 nt, Human
ggaccuucgggcugugc

SEQ ID NO: 1904554 - RNA, 17 nt, Human
ggacgcuacccgggaag

SEQ ID NO: 1904555 - RNA, 19 nt, Human
ggacgcuacccgggaaggg

SEQ ID NO: 1904556 - RNA, 20 nt, Human
ggacgcuacccgggaagggg

SEQ ID NO: 1904557 - RNA, 13 nt, Human
ggaccagagcugc

SEQ ID NO: 1904558 - RNA, 19 nt, Human
ggaccucaggugagaagca

SEQ ID NO: 1904559 - RNA, 23 nt, Human
ggaccucaggugagaagcagagg

SEQ ID NO: 1904560 - RNA, 18 nt, Human
ggaaguacuggagaaaau

SEQ ID NO: 1904561 - RNA, 12 nt, Human
ggaaguacugga

SEQ ID NO: 1904562 - RNA, 16 nt, Human
ggaaguacuggagaaa

SEQ ID NO: 1904563 - RNA, 17 nt, Human
ggaaggggacccccgcc

SEQ ID NO: 1904564 - RNA, 22 nt, Human
ggaaggggacccccgcccccug

SEQ ID NO: 1904565 - RNA, 19 nt, Human
ggaaggugggcgggcaggg

SEQ ID NO: 1904566 - RNA, 14 nt, Human
ggaaugauuaauua

SEQ ID NO: 1904567 - RNA, 18 nt, Human
ggaagugcuaauuuugaa

SEQ ID NO: 1904568 - RNA, 20 nt, Human
ggaagugacgguuuaauggg

SEQ ID NO: 1904569 - RNA, 15 nt, Human
ggaaguccaaugugg

SEQ ID NO: 1904570 - RNA, 16 nt, Human
ggaaguccaauguggc

SEQ ID NO: 1904571 - RNA, 17 nt, Human
ggaaguccaauguggca

SEQ ID NO: 1904572 - RNA, 20 nt, Human
ggaagugaagacuggaagcu

SEQ ID NO: 1904573 - RNA, 18 nt, Human
ggaaccugacguagcugc

SEQ ID NO: 1904574 - RNA, 23 nt, Human
ggaagggacaccaagccuuggcu

SEQ ID NO: 1904575 - RNA, 23 nt, Human
ggaaggggagauaaggguaucug

SEQ ID NO: 1904576 - RNA, 16 nt, Human
ggaaggggacccccgc

SEQ ID NO: 1904577 - RNA, 19 nt, Human
ggaauuuucaucuaggauu

SEQ ID NO: 1904578 - RNA, 20 nt, Human
ggaauuuucuccaauuuuuu

SEQ ID NO: 1904579 - RNA, 17 nt, Human
ggacaaaauggaauacu

SEQ ID NO: 1904580 - RNA, 16 nt, Human
ggacaaaauggaauac

SEQ ID NO: 1904581 - RNA, 12 nt, Human
ggaauuguguuu

SEQ ID NO: 1904582 - RNA, 23 nt, Human
ggaauuggguggggggcuucaua

SEQ ID NO: 1904583 - RNA, 14 nt, Human
ggaauuucccagga

SEQ ID NO: 1904584 - RNA, 15 nt, Human
ggaauuucccaggac

SEQ ID NO: 1904585 - RNA, 16 nt, Human
ggaauuucccaggacc

SEQ ID NO: 1904586 - RNA, 17 nt, Human
ggaauuucccaggaccc

SEQ ID NO: 1904587 - RNA, 18 nt, Human
ggaauuucccaggacccu

SEQ ID NO: 1904588 - RNA, 19 nt, Human
ggaauuucccaggacccug

SEQ ID NO: 1904589 - RNA, 19 nt, Human
ggaauguuugccucugccu

SEQ ID NO: 1904590 - RNA, 15 nt, Human
ggaauuauuuuaaaa

SEQ ID NO: 1904591 - RNA, 14 nt, Human
ggaauuauuuuaaa

SEQ ID NO: 1904592 - RNA, 20 nt, Human
ggaauucaucucucuuuaau

SEQ ID NO: 1904593 - RNA, 15 nt, Human
ggaauugauuugcau

SEQ ID NO: 1904594 - RNA, 17 nt, Human
ggaauugauuugcauug

SEQ ID NO: 1904595 - RNA, 18 nt, Human
ggaauugauuugcauuga

SEQ ID NO: 1904596 - RNA, 19 nt, Human
ggaauugauuugcauugaa

SEQ ID NO: 1904597 - RNA, 17 nt, Human
ggaauuauuuuaaaaga

SEQ ID NO: 1904598 - RNA, 16 nt, Human
ggaauuauuuuaaaag

SEQ ID NO: 1904599 - RNA, 12 nt, Human
ggaaugcagugg

SEQ ID NO: 1904600 - RNA, 24 nt, Human
ggaaugauuaauuaaaacacaaca

SEQ ID NO: 1904601 - RNA, 15 nt, Human
ggaauggcacagccc

SEQ ID NO: 1904602 - RNA, 15 nt, Human
ggaauguguggccug

SEQ ID NO: 1904603 - RNA, 14 nt, Human
gcccuuuuuaagga

SEQ ID NO: 1904604 - RNA, 16 nt, Human
gccgagaucacgccac

SEQ ID NO: 1904605 - RNA, 19 nt, Human
gccgagaucacgccacugc

SEQ ID NO: 1904606 - RNA, 18 nt, Human
gccgagaucacgccacug

SEQ ID NO: 1904607 - RNA, 18 nt, Human
gccgagauugcaccacug

SEQ ID NO: 1904608 - RNA, 17 nt, Human
gccgagauugcaccacu

SEQ ID NO: 1904609 - RNA, 23 nt, Human
gcccuucucuccagccccuggau

SEQ ID NO: 1904610 - RNA, 21 nt, Human
gcccuucucuccagccccugg

SEQ ID NO: 1904611 - RNA, 22 nt, Human
gcccuucucuccagccccugga

SEQ ID NO: 1904612 - RNA, 19 nt, Human
gcccuucucuccagccccu

SEQ ID NO: 1904613 - RNA, 23 nt, Human
gcccugguggcagugggagcugc

SEQ ID NO: 1904614 - RNA, 22 nt, Human
gcccugguggcagugggagcug

SEQ ID NO: 1904615 - RNA, 21 nt, Human
gcccugguggcagugggagcu

SEQ ID NO: 1904616 - RNA, 20 nt, Human
gcccugguggcagugggagc

SEQ ID NO: 1904617 - RNA, 19 nt, Human
gcccugguggcagugggag

SEQ ID NO: 1904618 - RNA, 18 nt, Human
gcccugguggcaguggga

SEQ ID NO: 1904619 - RNA, 17 nt, Human
gcccugguggcaguggg

SEQ ID NO: 1904620 - RNA, 14 nt, Human
gcccugguggcagu

SEQ ID NO: 1904621 - RNA, 20 nt, Human
gcccuggccuugggcccucu

SEQ ID NO: 1904622 - RNA, 13 nt, Human
gcccugggaggcu

SEQ ID NO: 1904623 - RNA, 14 nt, Human
gcccugggaggcuc

SEQ ID NO: 1904624 - RNA, 15 nt, Human
gcccugggaggcucu

SEQ ID NO: 1904625 - RNA, 16 nt, Human
gcccugggaggcucug

SEQ ID NO: 1904626 - RNA, 17 nt, Human
gcccugggaucacugug

SEQ ID NO: 1904627 - RNA, 23 nt, Human
gcccugggaggcucuggagccca

SEQ ID NO: 1904628 - RNA, 17 nt, Human
gcccugggaggcucugg

SEQ ID NO: 1904629 - RNA, 18 nt, Human
gcccugggaggcucugga

SEQ ID NO: 1904630 - RNA, 19 nt, Human
gcccugggaggcucuggag

SEQ ID NO: 1904631 - RNA, 21 nt, Human
gcccugggaggcucuggagcc

SEQ ID NO: 1904632 - RNA, 12 nt, Human
gcccucugccca

SEQ ID NO: 1904633 - RNA, 16 nt, Human
gcccugagcuuucugc

SEQ ID NO: 1904634 - RNA, 18 nt, Human
gcccggcuccaggcuccu

SEQ ID NO: 1904635 - RNA, 17 nt, Human
gcccggcuccaggcucc

SEQ ID NO: 1904636 - RNA, 18 nt, Human
gcccugaguuccuagcca

SEQ ID NO: 1904637 - RNA, 16 nt, Human
gcccugaguuccuagc

SEQ ID NO: 1904638 - RNA, 12 nt, Human
gcccuggacugu

SEQ ID NO: 1904639 - RNA, 16 nt, Human
gcccuggacugugugc

SEQ ID NO: 1904640 - RNA, 22 nt, Human
gcccuggacugugugcucagga

SEQ ID NO: 1904641 - RNA, 14 nt, Human
gcccuggagguggc

SEQ ID NO: 1904642 - RNA, 15 nt, Human
gcccuggagguggcu

SEQ ID NO: 1904643 - RNA, 18 nt, Human
gcccuggagguggcugag

SEQ ID NO: 1904644 - RNA, 20 nt, Human
gcccuggagguggcugagcc

SEQ ID NO: 1904645 - RNA, 13 nt, Human
gcccuggaggugg

SEQ ID NO: 1904646 - RNA, 16 nt, Human
gcccggcuccaggcuc

SEQ ID NO: 1904647 - RNA, 18 nt, Human
gcccggcuaauuuuugua

SEQ ID NO: 1904648 - RNA, 12 nt, Human
gcccggccagcc

SEQ ID NO: 1904649 - RNA, 18 nt, Human
gcccggccagccaugucu

SEQ ID NO: 1904650 - RNA, 15 nt, Human
gccccugccacccug

SEQ ID NO: 1904651 - RNA, 14 nt, Human
gccccugccacccu

SEQ ID NO: 1904652 - RNA, 21 nt, Human
gccccuguucuggcagaguug

SEQ ID NO: 1904653 - RNA, 13 nt, Human
gccccugccaccc

SEQ ID NO: 1904654 - RNA, 15 nt, Human
gcagacucuacagag

SEQ ID NO: 1904655 - RNA, 13 nt, Human
gcagacgcccaga

SEQ ID NO: 1904656 - RNA, 19 nt, Human
gccuggccacgcagccagg

SEQ ID NO: 1904657 - RNA, 18 nt, Human
gccuggccacgcagccag

SEQ ID NO: 1904658 - RNA, 17 nt, Human
gccuggccacgcagcca

SEQ ID NO: 1904659 - RNA, 15 nt, Human
gccuggccacgcagc

SEQ ID NO: 1904660 - RNA, 13 nt, Human
gccuggcagcuca

SEQ ID NO: 1904661 - RNA, 23 nt, Human
gccuggccacgcagccaggacac

SEQ ID NO: 1904662 - RNA, 22 nt, Human
gccuggccacgcagccaggaca

SEQ ID NO: 1904663 - RNA, 21 nt, Human
gccuggccacgcagccaggac

SEQ ID NO: 1904664 - RNA, 20 nt, Human
gccuggccacgcagccagga

SEQ ID NO: 1904665 - RNA, 13 nt, Human
gccuggccagaca

SEQ ID NO: 1904666 - RNA, 14 nt, Human
gccuggccagacac

SEQ ID NO: 1904667 - RNA, 16 nt, Human
gccuggccagacacag

SEQ ID NO: 1904668 - RNA, 17 nt, Human
gccuggccagacacagg

SEQ ID NO: 1904669 - RNA, 20 nt, Human
gccuggcagcucagcuuccc

SEQ ID NO: 1904670 - RNA, 20 nt, Human
gccuggaugcggauggccgg

SEQ ID NO: 1904671 - RNA, 15 nt, Human
gccuggauggggcug

SEQ ID NO: 1904672 - RNA, 14 nt, Human
gccuggauggggcu

SEQ ID NO: 1904673 - RNA, 15 nt, Human
gccuggccagaugca

SEQ ID NO: 1904674 - RNA, 14 nt, Human
gccuggccagaugc

SEQ ID NO: 1904675 - RNA, 16 nt, Human
gccuggccagaugcac

SEQ ID NO: 1904676 - RNA, 20 nt, Human
gccuggccagacacaggccc

SEQ ID NO: 1904677 - RNA, 21 nt, Human
gccuggccagacacaggcccu

SEQ ID NO: 1904678 - RNA, 23 nt, Human
gccuggccagcagguccccagcu

SEQ ID NO: 1904679 - RNA, 15 nt, Human
gccugggcagaagga

SEQ ID NO: 1904680 - RNA, 21 nt, Human
gccugggggcugggcagagga

SEQ ID NO: 1904681 - RNA, 20 nt, Human
gccugggggcugggcagagg

SEQ ID NO: 1904682 - RNA, 17 nt, Human
gccuggggcuggccucc

SEQ ID NO: 1904683 - RNA, 14 nt, Human
gccuggggcuggcc

SEQ ID NO: 1904684 - RNA, 18 nt, Human
gccugggcagaaggaaga

SEQ ID NO: 1904685 - RNA, 16 nt, Human
gccugggcagaaggaa

SEQ ID NO: 1904686 - RNA, 17 nt, Human
gccugggcagaaggaag

SEQ ID NO: 1904687 - RNA, 20 nt, Human
gccugggugacagagcaaga

SEQ ID NO: 1904688 - RNA, 22 nt, Human
gccugggugacagagcaagacu

SEQ ID NO: 1904689 - RNA, 15 nt, Human
gccugcuccagcugu

SEQ ID NO: 1904690 - RNA, 15 nt, Human
gccugcagagcugcg

SEQ ID NO: 1904691 - RNA, 12 nt, Human
gccugcagagcu

SEQ ID NO: 1904692 - RNA, 16 nt, Human
gccugcagaauuuggg

SEQ ID NO: 1904693 - RNA, 16 nt, Human
gccugcuccagcuguu

SEQ ID NO: 1904694 - RNA, 18 nt, Human
gccugcuccagcuguuca

SEQ ID NO: 1904695 - RNA, 18 nt, Human
gccugcuuuuuauggccu

SEQ ID NO: 1904696 - RNA, 19 nt, Human
gccugcuuuuuauggccug

SEQ ID NO: 1904697 - RNA, 22 nt, Human
gccugcuuuuuauggccuguga

SEQ ID NO: 1904698 - RNA, 22 nt, Human
gccugaagucacacagugaguc

SEQ ID NO: 1904699 - RNA, 23 nt, Human
gccucucugcaggucccuaauaa

SEQ ID NO: 1904700 - RNA, 18 nt, Human
gccucucugcaggucccu

SEQ ID NO: 1904701 - RNA, 20 nt, Human
gccucucugcaggucccuaa

SEQ ID NO: 1904702 - RNA, 21 nt, Human
gccucucugcaggucccuaau

SEQ ID NO: 1904703 - RNA, 13 nt, Human
gccugagucaccu

SEQ ID NO: 1904704 - RNA, 20 nt, Human
gccugauaagcuucaaagcu

SEQ ID NO: 1904705 - RNA, 15 nt, Human
gccugauaagcuuca

SEQ ID NO: 1904706 - RNA, 16 nt, Human
gccugaucagaccacg

SEQ ID NO: 1904707 - RNA, 20 nt, Human
gccugaucagaccacggcuc

SEQ ID NO: 1904708 - RNA, 21 nt, Human
gccucaagugauucuccugcc

SEQ ID NO: 1904709 - RNA, 20 nt, Human
gccucaagugauucuccugc

SEQ ID NO: 1904710 - RNA, 19 nt, Human
gccucaagugauucuccug

SEQ ID NO: 1904711 - RNA, 17 nt, Human
gccucaaccuccugggc

SEQ ID NO: 1904712 - RNA, 16 nt, Human
gccucaaccuccuggg

SEQ ID NO: 1904713 - RNA, 14 nt, Human
gccucaaccuccug

SEQ ID NO: 1904714 - RNA, 17 nt, Human
gccuaagugcagccccg

SEQ ID NO: 1904715 - RNA, 22 nt, Human
gccuauauuuuuuguuaaauga

SEQ ID NO: 1904716 - RNA, 14 nt, Human
gccucagugccacu

SEQ ID NO: 1904717 - RNA, 12 nt, Human
gccucagugcca

SEQ ID NO: 1904718 - RNA, 15 nt, Human
gccucaggccucugu

SEQ ID NO: 1904719 - RNA, 23 nt, Human
gccucagccucccaaagugcugg

SEQ ID NO: 1904720 - RNA, 16 nt, Human
gccucagccucccaag

SEQ ID NO: 1904721 - RNA, 18 nt, Human
gccucagccuccugagua

SEQ ID NO: 1904722 - RNA, 16 nt, Human
gccucagccuccugag

SEQ ID NO: 1904723 - RNA, 21 nt, Human
gccucccacgacugcccggca

SEQ ID NO: 1904724 - RNA, 18 nt, Human
gccuccccucuccuuccu

SEQ ID NO: 1904725 - RNA, 12 nt, Human
gccucccacugg

SEQ ID NO: 1904726 - RNA, 13 nt, Human
gccucccacuggg

SEQ ID NO: 1904727 - RNA, 14 nt, Human
gccucccacgacug

SEQ ID NO: 1904728 - RNA, 21 nt, Human
gccucccgaauagcugggacu

SEQ ID NO: 1904729 - RNA, 21 nt, Human
gccuccccucuccuuccugug

SEQ ID NO: 1904730 - RNA, 19 nt, Human
gccuccccucuccuuccug

SEQ ID NO: 1904731 - RNA, 15 nt, Human
gccucagugccacua

SEQ ID NO: 1904732 - RNA, 21 nt, Human
gccucccaacucaccccagcc

SEQ ID NO: 1904733 - RNA, 22 nt, Human
gccucccaacucaccccagccc

SEQ ID NO: 1904734 - RNA, 23 nt, Human
gccucccaacucaccccagcccc

SEQ ID NO: 1904735 - RNA, 13 nt, Human
gccucccacagac

SEQ ID NO: 1904736 - RNA, 15 nt, Human
gccucccgaguagcu

SEQ ID NO: 1904737 - RNA, 23 nt, Human
gccucccgaauagcugggacuac

SEQ ID NO: 1904738 - RNA, 17 nt, Human
gccucccgaguagcugg

SEQ ID NO: 1904739 - RNA, 17 nt, Human
gccucggccucccaaag

SEQ ID NO: 1904740 - RNA, 19 nt, Human
gccucucugcaggucccua

SEQ ID NO: 1904741 - RNA, 16 nt, Human
gcugcauacccgggca

SEQ ID NO: 1904742 - RNA, 22 nt, Human
gcugcaucccccccaccucucc

SEQ ID NO: 1904743 - RNA, 17 nt, Human
gcugcauuuaaaagaua

SEQ ID NO: 1904744 - RNA, 18 nt, Human
gcugauggugcaaugacc

SEQ ID NO: 1904745 - RNA, 21 nt, Human
gcugauggugcaaugaccuuu

SEQ ID NO: 1904746 - RNA, 21 nt, Human
gcugcaguugccagucacccc

SEQ ID NO: 1904747 - RNA, 18 nt, Human
gcugcaguugccagucac

SEQ ID NO: 1904748 - RNA, 20 nt, Human
gcugcaguugccagucaccc

SEQ ID NO: 1904749 - RNA, 15 nt, Human
gcugauggugcaaug

SEQ ID NO: 1904750 - RNA, 16 nt, Human
gcugauggugcaauga

SEQ ID NO: 1904751 - RNA, 13 nt, Human
gcugaugacucaa

SEQ ID NO: 1904752 - RNA, 23 nt, Human
gcugaugacucaagauucccagg

SEQ ID NO: 1904753 - RNA, 22 nt, Human
gcugaugacucaagauucccag

SEQ ID NO: 1904754 - RNA, 22 nt, Human
gcugagugggggaucacagccu

SEQ ID NO: 1904755 - RNA, 23 nt, Human
gcugagugggggaucacagccuc

SEQ ID NO: 1904756 - RNA, 13 nt, Human
gcugaguuggugu

SEQ ID NO: 1904757 - RNA, 18 nt, Human
gcugaguuguugagucug

SEQ ID NO: 1904758 - RNA, 21 nt, Human
gcugaguuguugagucuguuu

SEQ ID NO: 1904759 - RNA, 15 nt, Human
gcugagucugaaggc

SEQ ID NO: 1904760 - RNA, 16 nt, Human
gcugagucugaaggcu

SEQ ID NO: 1904761 - RNA, 18 nt, Human
gcugagucugaaggcugg

SEQ ID NO: 1904762 - RNA, 19 nt, Human
gcugagucugaaggcuggg

SEQ ID NO: 1904763 - RNA, 22 nt, Human
gcugagugaaaaaucuguggaa

SEQ ID NO: 1904764 - RNA, 12 nt, Human
gcucuucuccag

SEQ ID NO: 1904765 - RNA, 20 nt, Human
gcucuucucauuucaccccu

SEQ ID NO: 1904766 - RNA, 16 nt, Human
gcucuucucauuucac

SEQ ID NO: 1904767 - RNA, 15 nt, Human
gcucuucucauuuca

SEQ ID NO: 1904768 - RNA, 14 nt, Human
gcucuucucauuuc

SEQ ID NO: 1904769 - RNA, 22 nt, Human
gcucuuccaggcugggagagcc

SEQ ID NO: 1904770 - RNA, 12 nt, Human
gcucuucucauu

SEQ ID NO: 1904771 - RNA, 20 nt, Human
gcucuuccgaaaaccaggcc

SEQ ID NO: 1904772 - RNA, 19 nt, Human
gcucuuccaggcugggaga

SEQ ID NO: 1904773 - RNA, 18 nt, Human
gcucuuccaggcugggag

SEQ ID NO: 1904774 - RNA, 20 nt, Human
gcucuggacagccccacccu

SEQ ID NO: 1904775 - RNA, 22 nt, Human
gcucuggacagccccacccugg

SEQ ID NO: 1904776 - RNA, 11 nt, Human
gcucuggaccu

SEQ ID NO: 1904777 - RNA, 12 nt, Human
gcucuggaccug

SEQ ID NO: 1904778 - RNA, 13 nt, Human
gcucuggaccugc

SEQ ID NO: 1904779 - RNA, 14 nt, Human
gcucuggaccugcc

SEQ ID NO: 1904780 - RNA, 15 nt, Human
gcucuggaccugccc

SEQ ID NO: 1904781 - RNA, 17 nt, Human
gcucuggaccugccccc

SEQ ID NO: 1904782 - RNA, 22 nt, Human
gcucuggaccugcccccgcauc

SEQ ID NO: 1904783 - RNA, 16 nt, Human
gcucuucuccaggcug

SEQ ID NO: 1904784 - RNA, 14 nt, Human
gcucuucuccaggc

SEQ ID NO: 1904785 - RNA, 23 nt, Human
gcucuucucauuucaccccuccc

SEQ ID NO: 1904786 - RNA, 22 nt, Human
gcucuucucauuucaccccucc

SEQ ID NO: 1904787 - RNA, 14 nt, Human
gcucuugaugccug

SEQ ID NO: 1904788 - RNA, 15 nt, Human
gcucuugaugccugg

SEQ ID NO: 1904789 - RNA, 16 nt, Human
gcucuugaugccuggc

SEQ ID NO: 1904790 - RNA, 21 nt, Human
gcugacagacacaggcccggc

SEQ ID NO: 1904791 - RNA, 13 nt, Human
gcugacagcugcu

SEQ ID NO: 1904792 - RNA, 14 nt, Human
gcugacagcugcuc

SEQ ID NO: 1904793 - RNA, 14 nt, Human
gcucuuuccuccuu

SEQ ID NO: 1904794 - RNA, 15 nt, Human
gcucuuuccuccuuc

SEQ ID NO: 1904795 - RNA, 17 nt, Human
gcucuuuccuccuucca

SEQ ID NO: 1904796 - RNA, 17 nt, Human
gcucuugaugccuggcg

SEQ ID NO: 1904797 - RNA, 17 nt, Human
gcugacucacaccugaa

SEQ ID NO: 1904798 - RNA, 22 nt, Human
gcugacccagccccuugagaaa

SEQ ID NO: 1904799 - RNA, 15 nt, Human
gcugacagcugcucc

SEQ ID NO: 1904800 - RNA, 17 nt, Human
gcugacagcugcuccua

SEQ ID NO: 1904801 - RNA, 18 nt, Human
gcugacagcugcuccuag

SEQ ID NO: 1904802 - RNA, 17 nt, Human
gcucucccauuuccuga

SEQ ID NO: 1904803 - RNA, 17 nt, Human
gcucgagcaugccugga

SEQ ID NO: 1904804 - RNA, 16 nt, Human
gcucgagcaugccugg

SEQ ID NO: 1904805 - RNA, 21 nt, Human
gcuccuucuguccuacucugu

SEQ ID NO: 1904806 - RNA, 19 nt, Human
gcucccuucccaccucucu

SEQ ID NO: 1904807 - RNA, 15 nt, Human
gcuccuucuguccua

SEQ ID NO: 1904808 - RNA, 15 nt, Human
gcucccuucccaccu

SEQ ID NO: 1904809 - RNA, 16 nt, Human
gcucccuucccaccuc

SEQ ID NO: 1904810 - RNA, 18 nt, Human
gcucccuucccaccucuc

SEQ ID NO: 1904811 - RNA, 17 nt, Human
gcucuccgaccagacac

SEQ ID NO: 1904812 - RNA, 13 nt, Human
gcucuccgaccag

SEQ ID NO: 1904813 - RNA, 19 nt, Human
gcucuccgaccagacaccu

SEQ ID NO: 1904814 - RNA, 13 nt, Human
gcucucuggccuu

SEQ ID NO: 1904815 - RNA, 12 nt, Human
gcucucuggccu

SEQ ID NO: 1904816 - RNA, 11 nt, Human
gcucucuggcc

SEQ ID NO: 1904817 - RNA, 22 nt, Human
gcucuccuuccuggagcccaga

SEQ ID NO: 1904818 - RNA, 12 nt, Human
gcucuccuuccu

SEQ ID NO: 1904819 - RNA, 11 nt, Human
gcucuccuucc

SEQ ID NO: 1904820 - RNA, 21 nt, Human
gcucucggaacugcaugcugc

SEQ ID NO: 1904821 - RNA, 19 nt, Human
gcucucggaacugcaugcu

SEQ ID NO: 1904822 - RNA, 14 nt, Human
gcucugcccuuggu

SEQ ID NO: 1904823 - RNA, 23 nt, Human
gcucugcccuugguuaggcauug

SEQ ID NO: 1904824 - RNA, 11 nt, Human
gcucugccucc

SEQ ID NO: 1904825 - RNA, 20 nt, Human
gcucucuggccuucggccuc

SEQ ID NO: 1904826 - RNA, 19 nt, Human
gcucucuggccuucggccu

SEQ ID NO: 1904827 - RNA, 15 nt, Human
gcucucuggccuucg

SEQ ID NO: 1904828 - RNA, 14 nt, Human
gcucucuggccuuc

SEQ ID NO: 1904829 - RNA, 14 nt, Human
gcucugcuccucuc

SEQ ID NO: 1904830 - RNA, 13 nt, Human
gcucugcuccucu

SEQ ID NO: 1904831 - RNA, 13 nt, Human
gcucugccuccca

SEQ ID NO: 1904832 - RNA, 14 nt, Human
gcucugccucccau

SEQ ID NO: 1904833 - RNA, 15 nt, Human
gcucugccucccauc

SEQ ID NO: 1904834 - RNA, 22 nt, Human
gcucugccucccaucacccgcu

SEQ ID NO: 1904835 - RNA, 23 nt, Human
gcucugcugacagacacaggccc

SEQ ID NO: 1904836 - RNA, 20 nt, Human
gcucugcugacagacacagg

SEQ ID NO: 1904837 - RNA, 19 nt, Human
gcucugcugacagacacag

SEQ ID NO: 1904838 - RNA, 18 nt, Human
gcucugcugacagacaca

SEQ ID NO: 1904839 - RNA, 14 nt, Human
gcucugcugacaga

SEQ ID NO: 1904840 - RNA, 13 nt, Human
gcucugcugacag

SEQ ID NO: 1904841 - RNA, 21 nt, Human
gcucugcuccucuccccagca

SEQ ID NO: 1904842 - RNA, 19 nt, Human
gcucugcuccucuccccag

SEQ ID NO: 1904843 - RNA, 22 nt, Human
gcucuggacaggcauguucucu

SEQ ID NO: 1904844 - RNA, 21 nt, Human
gcucuggacaggcauguucuc

SEQ ID NO: 1904845 - RNA, 16 nt, Human
gcucuggacaggcaug

SEQ ID NO: 1904846 - RNA, 15 nt, Human
gcucuggacaggcau

SEQ ID NO: 1904847 - RNA, 14 nt, Human
gcucuggacaggca

SEQ ID NO: 1904848 - RNA, 16 nt, Human
gcucuggacagcccca

SEQ ID NO: 1904849 - RNA, 19 nt, Human
gcucuggacagccccaccc

SEQ ID NO: 1904850 - RNA, 14 nt, Human
gcucugcuugacaa

SEQ ID NO: 1904851 - RNA, 21 nt, Human
gcucugcuugacaacaucuga

SEQ ID NO: 1904852 - RNA, 20 nt, Human
gcuccauuuuuagugaaaua

SEQ ID NO: 1904853 - RNA, 15 nt, Human
gcuccauggcugcca

SEQ ID NO: 1904854 - RNA, 24 nt, Human
gcuccaggcuccuuuagcgcccag

SEQ ID NO: 1904855 - RNA, 20 nt, Human
gcuccagcuguucagcuggu

SEQ ID NO: 1904856 - RNA, 23 nt, Human
gcuccaggcuccuuuagcgccca

SEQ ID NO: 1904857 - RNA, 16 nt, Human
gcuccaggcuccuuua

SEQ ID NO: 1904858 - RNA, 13 nt, Human
gcuccaggcuccu

SEQ ID NO: 1904859 - RNA, 11 nt, Human
gcuccagcugu

SEQ ID NO: 1904860 - RNA, 19 nt, Human
gcuccaaacccucgaggcg

SEQ ID NO: 1904861 - RNA, 14 nt, Human
gcuccaaaccuuca

SEQ ID NO: 1904862 - RNA, 15 nt, Human
gcuccaaaccuucac

SEQ ID NO: 1904863 - RNA, 21 nt, Human
gcuccaaaccuucacacacag

SEQ ID NO: 1904864 - RNA, 22 nt, Human
gcuccaaaccuucacacacaga

SEQ ID NO: 1904865 - RNA, 14 nt, Human
gcuccaagaauuuc

SEQ ID NO: 1904866 - RNA, 15 nt, Human
gcuccaaccugcaaa

SEQ ID NO: 1904867 - RNA, 18 nt, Human
gcuccaaccugcaaagau

SEQ ID NO: 1904868 - RNA, 21 nt, Human
gcuccaaccugcaaagaucug

SEQ ID NO: 1904869 - RNA, 13 nt, Human
gcuccaagcuccc

SEQ ID NO: 1904870 - RNA, 14 nt, Human
gcuccaagcuccca

SEQ ID NO: 1904871 - RNA, 15 nt, Human
gcuccaagcucccag

SEQ ID NO: 1904872 - RNA, 21 nt, Human
gcuccaagcucccaggcauuc

SEQ ID NO: 1904873 - RNA, 20 nt, Human
gcuccaaggggaaucagaac

SEQ ID NO: 1904874 - RNA, 21 nt, Human
gcuccaaggggaaucagaacu

SEQ ID NO: 1904875 - RNA, 23 nt, Human
gcuccaaggggaaucagaacuca

SEQ ID NO: 1904876 - RNA, 16 nt, Human
gcuccaagcucccagg

SEQ ID NO: 1904877 - RNA, 17 nt, Human
gcuccaagcucccaggc

SEQ ID NO: 1904878 - RNA, 18 nt, Human
gcuccaagcucccaggca

SEQ ID NO: 1904879 - RNA, 19 nt, Human
gcuccaagcucccaggcau

SEQ ID NO: 1904880 - RNA, 18 nt, Human
gcucaggugucccugcac

SEQ ID NO: 1904881 - RNA, 22 nt, Human
gcucagcggggacagcuccuuc

SEQ ID NO: 1904882 - RNA, 21 nt, Human
gcucagcggggacagcuccuu

SEQ ID NO: 1904883 - RNA, 20 nt, Human
gcucagcggggacagcuccu

SEQ ID NO: 1904884 - RNA, 15 nt, Human
gcucagcggggacag

SEQ ID NO: 1904885 - RNA, 19 nt, Human
gcucaggugucccugcacu

SEQ ID NO: 1904886 - RNA, 17 nt, Human
gcuccaaacccucgagg

SEQ ID NO: 1904887 - RNA, 18 nt, Human
gcuccaaacccucgaggc

SEQ ID NO: 1904888 - RNA, 16 nt, Human
gcuccaaacccucgag

SEQ ID NO: 1904889 - RNA, 22 nt, Human
gcucagugucuggcugcagagc

SEQ ID NO: 1904890 - RNA, 19 nt, Human
gcucaccagccccagugcc

SEQ ID NO: 1904891 - RNA, 17 nt, Human
gcuaugagcuggggaug

SEQ ID NO: 1904892 - RNA, 23 nt, Human
gcucaccagccccagugcccaca

SEQ ID NO: 1904893 - RNA, 20 nt, Human
gcucaccagccccagugccc

SEQ ID NO: 1904894 - RNA, 17 nt, Human
gcucagcaaaagaugcu

SEQ ID NO: 1904895 - RNA, 20 nt, Human
gcucagcaaaagaugcuucu

SEQ ID NO: 1904896 - RNA, 22 nt, Human
gcucagcaaaagaugcuucuca

SEQ ID NO: 1904897 - RNA, 23 nt, Human
gcucagcaaaagaugcuucucac

SEQ ID NO: 1904898 - RNA, 12 nt, Human
gcucagccagca

SEQ ID NO: 1904899 - RNA, 13 nt, Human
gcucagccagcac

SEQ ID NO: 1904900 - RNA, 14 nt, Human
gcucagccagcacu

SEQ ID NO: 1904901 - RNA, 19 nt, Human
gccugugcauguaugucuu

SEQ ID NO: 1904902 - RNA, 23 nt, Human
gccugugagcuaggaauuguguu

SEQ ID NO: 1904903 - RNA, 16 nt, Human
gcgguccacccaggag

SEQ ID NO: 1904904 - RNA, 13 nt, Human
gcggggacagcuc

SEQ ID NO: 1904905 - RNA, 12 nt, Human
gcggggacagcu

SEQ ID NO: 1904906 - RNA, 15 nt, Human
gcgggcuuccuccug

SEQ ID NO: 1904907 - RNA, 19 nt, Human
gcgguccacccaggagccc

SEQ ID NO: 1904908 - RNA, 18 nt, Human
gcgguccacccaggagcc

SEQ ID NO: 1904909 - RNA, 16 nt, Human
gcgucauuacagggca

SEQ ID NO: 1904910 - RNA, 22 nt, Human
gcgucauuacagggcacaggcc

SEQ ID NO: 1904911 - RNA, 23 nt, Human
gcgucauuacagggcacaggcca

SEQ ID NO: 1904912 - RNA, 19 nt, Human
gcuaaauccuuuacuguua

SEQ ID NO: 1904913 - RNA, 13 nt, Human
gcuaaaugugaau

SEQ ID NO: 1904914 - RNA, 16 nt, Human
gcuaaaugugaaugau

SEQ ID NO: 1904915 - RNA, 22 nt, Human
gcuaaauuacucaggaagaaca

SEQ ID NO: 1904916 - RNA, 21 nt, Human
gcuaagagggagggagggcuc

SEQ ID NO: 1904917 - RNA, 22 nt, Human
gcuaagagggagggagggcucc

SEQ ID NO: 1904918 - RNA, 16 nt, Human
gcuaacaccagacaga

SEQ ID NO: 1904919 - RNA, 23 nt, Human
gcgugagccacugcaccgggcca

SEQ ID NO: 1904920 - RNA, 16 nt, Human
gcuaaagcccagagac

SEQ ID NO: 1904921 - RNA, 19 nt, Human
gcgugaucaaagccacacu

SEQ ID NO: 1904922 - RNA, 15 nt, Human
gcgugaucaaagcca

SEQ ID NO: 1904923 - RNA, 14 nt, Human
gcuaaagccuuccu

SEQ ID NO: 1904924 - RNA, 18 nt, Human
gcgugagccacugcaccg

SEQ ID NO: 1904925 - RNA, 12 nt, Human
gcuagccagagg

SEQ ID NO: 1904926 - RNA, 13 nt, Human
gcuagccagagga

SEQ ID NO: 1904927 - RNA, 15 nt, Human
gcuagccagaggacu

SEQ ID NO: 1904928 - RNA, 18 nt, Human
gcuagccagaggacugug

SEQ ID NO: 1904929 - RNA, 16 nt, Human
gcuaucucccccagcc

SEQ ID NO: 1904930 - RNA, 17 nt, Human
gcuaucucccccagccc

SEQ ID NO: 1904931 - RNA, 18 nt, Human
gcuaucucccccagcccc

SEQ ID NO: 1904932 - RNA, 23 nt, Human
gcuaucucccccagccccauccu

SEQ ID NO: 1904933 - RNA, 19 nt, Human
gcuaucucccccagcccca

SEQ ID NO: 1904934 - RNA, 20 nt, Human
gcuaucucccccagccccau

SEQ ID NO: 1904935 - RNA, 21 nt, Human
gcuaucucccccagccccauc

SEQ ID NO: 1904936 - RNA, 22 nt, Human
gcuaucucccccagccccaucc

SEQ ID NO: 1904937 - RNA, 23 nt, Human
gcuaagagggagggagggcucca

SEQ ID NO: 1904938 - RNA, 17 nt, Human
gcuaagcaaaaugugau

SEQ ID NO: 1904939 - RNA, 14 nt, Human
gcuacccgggaagg

SEQ ID NO: 1904940 - RNA, 15 nt, Human
gcuacccgggaaggg

SEQ ID NO: 1904941 - RNA, 16 nt, Human
gcuacccgcagaguuc

SEQ ID NO: 1904942 - RNA, 21 nt, Human
gcuacccgggaagggggcugg

SEQ ID NO: 1904943 - RNA, 22 nt, Human
gcuacccgcagaguucucagaa

SEQ ID NO: 1904944 - RNA, 21 nt, Human
gcuagagguucaaagauauuu

SEQ ID NO: 1904945 - RNA, 19 nt, Human
gcuagagguucaaagauau

SEQ ID NO: 1904946 - RNA, 18 nt, Human
gcuagagguucaaagaua

SEQ ID NO: 1904947 - RNA, 23 nt, Human
guacuuuauuuucuauaauuuaa

SEQ ID NO: 1904948 - RNA, 21 nt, Human
guacuuguggacacagcucuu

SEQ ID NO: 1904949 - RNA, 10 nt, Human
guacuuugug

SEQ ID NO: 1904950 - RNA, 14 nt, Human
guacuuuggaggcc

SEQ ID NO: 1904951 - RNA, 20 nt, Human
guagaaaagggaacugaaca

SEQ ID NO: 1904952 - RNA, 21 nt, Human
guagaaagacagagcugggau

SEQ ID NO: 1904953 - RNA, 18 nt, Human
guagaaagacagagcugg

SEQ ID NO: 1904954 - RNA, 16 nt, Human
guagagcggagaaagg

SEQ ID NO: 1904955 - RNA, 15 nt, Human
guagaggagaaacug

SEQ ID NO: 1904956 - RNA, 19 nt, Human
guacuucuccacccugcuc

SEQ ID NO: 1904957 - RNA, 18 nt, Human
guacuucuccacccugcu

SEQ ID NO: 1904958 - RNA, 17 nt, Human
guacuucuccacccugc

SEQ ID NO: 1904959 - RNA, 16 nt, Human
guacuucuccacccug

SEQ ID NO: 1904960 - RNA, 21 nt, Human
guacuucuccacccugcucuc

SEQ ID NO: 1904961 - RNA, 20 nt, Human
guacuucuccacccugcucu

SEQ ID NO: 1904962 - RNA, 14 nt, Human
guacuugcucuuga

SEQ ID NO: 1904963 - RNA, 20 nt, Human
guacuuguggacacagcucu

SEQ ID NO: 1904964 - RNA, 16 nt, Human
guacuuguggacacag

SEQ ID NO: 1904965 - RNA, 22 nt, Human
guacuugcucuugaugccuggc

SEQ ID NO: 1904966 - RNA, 15 nt, Human
guacuugcucuugau

SEQ ID NO: 1904967 - RNA, 16 nt, Human
guacuugcucuugaug

SEQ ID NO: 1904968 - RNA, 18 nt, Human
guacuugcucuugaugcc

SEQ ID NO: 1904969 - RNA, 19 nt, Human
guacuugcucuugaugccu

SEQ ID NO: 1904970 - RNA, 15 nt, Human
guaccgcaaugugac

SEQ ID NO: 1904971 - RNA, 16 nt, Human
guacccacugcucugg

SEQ ID NO: 1904972 - RNA, 22 nt, Human
guaccucuugagccuugaacuu

SEQ ID NO: 1904973 - RNA, 21 nt, Human
guaccucuugagccuugaacu

SEQ ID NO: 1904974 - RNA, 13 nt, Human
guaccucuugagc

SEQ ID NO: 1904975 - RNA, 21 nt, Human
guaccuucagaauaagcuucc

SEQ ID NO: 1904976 - RNA, 15 nt, Human
guacgucugacaggc

SEQ ID NO: 1904977 - RNA, 14 nt, Human
guacgucugacagg

SEQ ID NO: 1904978 - RNA, 17 nt, Human
guacgucugacaggcaa

SEQ ID NO: 1904979 - RNA, 14 nt, Human
guacguugugcauu

SEQ ID NO: 1904980 - RNA, 16 nt, Human
guacguugugcauuug

SEQ ID NO: 1904981 - RNA, 15 nt, Human
guacguugugcauuu

SEQ ID NO: 1904982 - RNA, 15 nt, Human
guacuucuccacccu

SEQ ID NO: 1904983 - RNA, 14 nt, Human
guacuucuccaccc

SEQ ID NO: 1904984 - RNA, 15 nt, Human
guacuacaauuuaaa

SEQ ID NO: 1904985 - RNA, 12 nt, Human
guacuacaauuu

SEQ ID NO: 1904986 - RNA, 17 nt, Human
guacguugugcauuugg

SEQ ID NO: 1904987 - RNA, 15 nt, Human
guacuaaggaaucuu

SEQ ID NO: 1904988 - RNA, 23 nt, Human
guacuaaggaaucuuucugcuuu

SEQ ID NO: 1904989 - RNA, 15 nt, Human
guaauucuaaaugaa

SEQ ID NO: 1904990 - RNA, 14 nt, Human
guaauucuaaauga

SEQ ID NO: 1904991 - RNA, 12 nt, Human
guaauucuaaau

SEQ ID NO: 1904992 - RNA, 22 nt, Human
guaauucuaaaugaauguuuac

SEQ ID NO: 1904993 - RNA, 18 nt, Human
guaauucuaaaugaaugu

SEQ ID NO: 1904994 - RNA, 18 nt, Human
guacacuguuucaaacuu

SEQ ID NO: 1904995 - RNA, 15 nt, Human
guaauucuuauucuu

SEQ ID NO: 1904996 - RNA, 17 nt, Human
guaauucuuauucuuuc

SEQ ID NO: 1904997 - RNA, 15 nt, Human
guaauugacaugugc

SEQ ID NO: 1904998 - RNA, 21 nt, Human
guaauuaaguacuauguauca

SEQ ID NO: 1904999 - RNA, 14 nt, Human
guaauuaaguacua

SEQ ID NO: 1905000 - RNA, 17 nt, Human
guaauuaaguacuaugu

SEQ ID NO: 1905001 - RNA, 20 nt, Human
guaauuaaguacuauguauc

SEQ ID NO: 1905002 - RNA, 14 nt, Human
guaaucugagaaac

SEQ ID NO: 1905003 - RNA, 17 nt, Human
guaaucugagaaacaau

SEQ ID NO: 1905004 - RNA, 19 nt, Human
guaaucugagaaacaauga

SEQ ID NO: 1905005 - RNA, 11 nt, Human
guaaugaaaac

SEQ ID NO: 1905006 - RNA, 13 nt, Human
guaaugaaaacca

SEQ ID NO: 1905007 - RNA, 16 nt, Human
guaaugaaacuuggau

SEQ ID NO: 1905008 - RNA, 15 nt, Human
guaaugaaacuugga

SEQ ID NO: 1905009 - RNA, 15 nt, Human
guacccacugcucug

SEQ ID NO: 1905010 - RNA, 13 nt, Human
guacaguuuuuau

SEQ ID NO: 1905011 - RNA, 12 nt, Human
guacaguuuuua

SEQ ID NO: 1905012 - RNA, 20 nt, Human
guacauaaugcgugcauacc

SEQ ID NO: 1905013 - RNA, 14 nt, Human
guacagucuuguau

SEQ ID NO: 1905014 - RNA, 13 nt, Human
guacagucuugua

SEQ ID NO: 1905015 - RNA, 16 nt, Human
guacagucuuguauua

SEQ ID NO: 1905016 - RNA, 14 nt, Human
guacaguuuuauuu

SEQ ID NO: 1905017 - RNA, 16 nt, Human
guacagacaacaaacc

SEQ ID NO: 1905018 - RNA, 15 nt, Human
guacagacagaaaaa

SEQ ID NO: 1905019 - RNA, 21 nt, Human
guacacuguuucaaacuuuac

SEQ ID NO: 1905020 - RNA, 20 nt, Human
guacacuguuucaaacuuua

SEQ ID NO: 1905021 - RNA, 19 nt, Human
guacacuguuucaaacuuu

SEQ ID NO: 1905022 - RNA, 12 nt, Human
guacagagccca

SEQ ID NO: 1905023 - RNA, 18 nt, Human
guacagagcccacgcccc

SEQ ID NO: 1905024 - RNA, 22 nt, Human
guacagagcccacgcccccacu

SEQ ID NO: 1905025 - RNA, 20 nt, Human
guacagcaaggagauuuaca

SEQ ID NO: 1905026 - RNA, 18 nt, Human
guacaggaugcuuugguu

SEQ ID NO: 1905027 - RNA, 23 nt, Human
gguuuugccauguuggccaggcu

SEQ ID NO: 1905028 - RNA, 14 nt, Human
gguuuuguuccccu

SEQ ID NO: 1905029 - RNA, 22 nt, Human
gguuuuguuccccuccuccacu

SEQ ID NO: 1905030 - RNA, 19 nt, Human
gguuuuguuccccuccucc

SEQ ID NO: 1905031 - RNA, 15 nt, Human
gguuuuuauuaguac

SEQ ID NO: 1905032 - RNA, 15 nt, Human
gguuuucuguucuuu

SEQ ID NO: 1905033 - RNA, 15 nt, Human
gguuuucuguuacuu

SEQ ID NO: 1905034 - RNA, 13 nt, Human
gguuuucuguucu

SEQ ID NO: 1905035 - RNA, 12 nt, Human
gguuuucuguuc

SEQ ID NO: 1905036 - RNA, 17 nt, Human
gguuuacagucuauuug

SEQ ID NO: 1905037 - RNA, 20 nt, Human
gguuuucacauuggaaacaa

SEQ ID NO: 1905038 - RNA, 10 nt, Human
gguuuuccug

SEQ ID NO: 1905039 - RNA, 12 nt, Human
guaaaaauacaa

SEQ ID NO: 1905040 - RNA, 18 nt, Human
guaaaaacaaagaaauua

SEQ ID NO: 1905041 - RNA, 20 nt, Human
guaaaaacaaagaaauuaug

SEQ ID NO: 1905042 - RNA, 15 nt, Human
guaaaagacuuuuuu

SEQ ID NO: 1905043 - RNA, 19 nt, Human
guaaaagaaagaaagaaaa

SEQ ID NO: 1905044 - RNA, 21 nt, Human
gguucaagcgauucuucugcu

SEQ ID NO: 1905045 - RNA, 17 nt, Human
gguggccucccaacuca

SEQ ID NO: 1905046 - RNA, 13 nt, Human
gguggccucccaa

SEQ ID NO: 1905047 - RNA, 19 nt, Human
gguggccuaagaguugagc

SEQ ID NO: 1905048 - RNA, 14 nt, Human
gguugaagcaccaa

SEQ ID NO: 1905049 - RNA, 12 nt, Human
gguucagcuugu

SEQ ID NO: 1905050 - RNA, 23 nt, Human
gguucaagcgauucuucugcuuc

SEQ ID NO: 1905051 - RNA, 22 nt, Human
gguucaagcgauucuucugcuu

SEQ ID NO: 1905052 - RNA, 20 nt, Human
gguucacugcaaccuccgcc

SEQ ID NO: 1905053 - RNA, 13 nt, Human
gguuggugggggc

SEQ ID NO: 1905054 - RNA, 13 nt, Human
gguuuaagcuguu

SEQ ID NO: 1905055 - RNA, 18 nt, Human
gguuggcaaaaaggcagg

SEQ ID NO: 1905056 - RNA, 19 nt, Human
gguugcuguuuuccucccu

SEQ ID NO: 1905057 - RNA, 20 nt, Human
gguugcuguuuuccucccuu

SEQ ID NO: 1905058 - RNA, 21 nt, Human
gguugcuguuuuccucccuuc

SEQ ID NO: 1905059 - RNA, 14 nt, Human
gguugggcuggugu

SEQ ID NO: 1905060 - RNA, 18 nt, Human
gguugcuguuuuccuccc

SEQ ID NO: 1905061 - RNA, 20 nt, Human
guaaaugggggugcauuuga

SEQ ID NO: 1905062 - RNA, 19 nt, Human
guaaaugggggugcauuug

SEQ ID NO: 1905063 - RNA, 18 nt, Human
guaaaugggggugcauuu

SEQ ID NO: 1905064 - RNA, 14 nt, Human
guaaaucuuuuaca

SEQ ID NO: 1905065 - RNA, 22 nt, Human
guaaauuaacuuuuauaaacuu

SEQ ID NO: 1905066 - RNA, 21 nt, Human
guaaauuaacuuuuauaaacu

SEQ ID NO: 1905067 - RNA, 17 nt, Human
guaaauuaacuuuuaua

SEQ ID NO: 1905068 - RNA, 16 nt, Human
guaaauuaacuuuuau

SEQ ID NO: 1905069 - RNA, 15 nt, Human
guaaauuaacuuuua

SEQ ID NO: 1905070 - RNA, 16 nt, Human
guaaaguccccagaga

SEQ ID NO: 1905071 - RNA, 23 nt, Human
guaaaguccccagagaaagcgca

SEQ ID NO: 1905072 - RNA, 13 nt, Human
guaaauaaaaaga

SEQ ID NO: 1905073 - RNA, 18 nt, Human
guaaaguccccagagaaa

SEQ ID NO: 1905074 - RNA, 13 nt, Human
guaaauaaagccc

SEQ ID NO: 1905075 - RNA, 14 nt, Human
guaaauaaagcccu

SEQ ID NO: 1905076 - RNA, 15 nt, Human
guaaauaaagcccug

SEQ ID NO: 1905077 - RNA, 16 nt, Human
guaaauaaaggaacca

SEQ ID NO: 1905078 - RNA, 18 nt, Human
guaaggaauaccuguccc

SEQ ID NO: 1905079 - RNA, 20 nt, Human
guaaggaauaccuguccccc

SEQ ID NO: 1905080 - RNA, 21 nt, Human
guaaggaauaccugucccccu

SEQ ID NO: 1905081 - RNA, 23 nt, Human
guaaggaauaccugucccccuga

SEQ ID NO: 1905082 - RNA, 13 nt, Human
guaaggaaugauu

SEQ ID NO: 1905083 - RNA, 22 nt, Human
guaaguauucuuauuuaaugaa

SEQ ID NO: 1905084 - RNA, 23 nt, Human
guaaauuaacuuuuauaaacuuu

SEQ ID NO: 1905085 - RNA, 18 nt, Human
guaacuucuuauggaauu

SEQ ID NO: 1905086 - RNA, 20 nt, Human
guaacuucuuauggaauuga

SEQ ID NO: 1905087 - RNA, 21 nt, Human
guaacuucuuauggaauugau

SEQ ID NO: 1905088 - RNA, 19 nt, Human
guaagaucguucucugccu

SEQ ID NO: 1905089 - RNA, 13 nt, Human
ggugaaggcuggc

SEQ ID NO: 1905090 - RNA, 18 nt, Human
ggugaagugaagacaaug

SEQ ID NO: 1905091 - RNA, 19 nt, Human
ggucugaggaauccagacc

SEQ ID NO: 1905092 - RNA, 14 nt, Human
ggugaacauugcaa

SEQ ID NO: 1905093 - RNA, 16 nt, Human
ggugaacuugguuccc

SEQ ID NO: 1905094 - RNA, 16 nt, Human
ggucugacccacugcu

SEQ ID NO: 1905095 - RNA, 15 nt, Human
ggucugacccacugc

SEQ ID NO: 1905096 - RNA, 16 nt, Human
ggucucacucugucgc

SEQ ID NO: 1905097 - RNA, 12 nt, Human
ggucucacucug

SEQ ID NO: 1905098 - RNA, 21 nt, Human
ggucucacuauguugcccagg

SEQ ID NO: 1905099 - RNA, 22 nt, Human
ggucucacuauguugcccaggc

SEQ ID NO: 1905100 - RNA, 23 nt, Human
gguccuagaaauuccccacccug

SEQ ID NO: 1905101 - RNA, 17 nt, Human
gguccuacccauccccg

SEQ ID NO: 1905102 - RNA, 20 nt, Human
gguccuacccauccccgcag

SEQ ID NO: 1905103 - RNA, 22 nt, Human
ggucccugguggcagcucaccu

SEQ ID NO: 1905104 - RNA, 18 nt, Human
ggucccuaauaaagcugu

SEQ ID NO: 1905105 - RNA, 14 nt, Human
ggucccugguggca

SEQ ID NO: 1905106 - RNA, 12 nt, Human
ggucccuaauaa

SEQ ID NO: 1905107 - RNA, 13 nt, Human
ggucccuaauaaa

SEQ ID NO: 1905108 - RNA, 16 nt, Human
ggucccuaauaaagcu

SEQ ID NO: 1905109 - RNA, 17 nt, Human
ggucccuaauaaagcug

SEQ ID NO: 1905110 - RNA, 17 nt, Human
ggugaggggcuggcacu

SEQ ID NO: 1905111 - RNA, 21 nt, Human
ggugaccucugccugaaguca

SEQ ID NO: 1905112 - RNA, 16 nt, Human
ggugaccucugccuga

SEQ ID NO: 1905113 - RNA, 14 nt, Human
ggugaccucugccu

SEQ ID NO: 1905114 - RNA, 20 nt, Human
ggugauauccauucuuucug

SEQ ID NO: 1905115 - RNA, 15 nt, Human
ggugauauccauucu

SEQ ID NO: 1905116 - RNA, 13 nt, Human
ggugccccaggac

SEQ ID NO: 1905117 - RNA, 14 nt, Human
ggugccccaggacc

SEQ ID NO: 1905118 - RNA, 15 nt, Human
ggugccccaggacca

SEQ ID NO: 1905119 - RNA, 16 nt, Human
ggugccccaggaccag

SEQ ID NO: 1905120 - RNA, 17 nt, Human
ggugccccaggaccagc

SEQ ID NO: 1905121 - RNA, 20 nt, Human
ggugccccaggaccagcuca

SEQ ID NO: 1905122 - RNA, 21 nt, Human
ggugccccaggaccagcucag

SEQ ID NO: 1905123 - RNA, 22 nt, Human
ggugccccaggaccagcucagg

SEQ ID NO: 1905124 - RNA, 23 nt, Human
ggugccccaggaccagcucagga

SEQ ID NO: 1905125 - RNA, 13 nt, Human
gguggcagcugcg

SEQ ID NO: 1905126 - RNA, 12 nt, Human
gguggcagcugc

SEQ ID NO: 1905127 - RNA, 11 nt, Human
gguggcagcug

SEQ ID NO: 1905128 - RNA, 13 nt, Human
gguggcagcucac

SEQ ID NO: 1905129 - RNA, 23 nt, Human
gguggcagcugcgguccacccag

SEQ ID NO: 1905130 - RNA, 15 nt, Human
gguggcagcugcggu

SEQ ID NO: 1905131 - RNA, 16 nt, Human
gguggcagugggagcu

SEQ ID NO: 1905132 - RNA, 15 nt, Human
ggugcgaucuggguu

SEQ ID NO: 1905133 - RNA, 23 nt, Human
ggugcuaucucccccagccccau

SEQ ID NO: 1905134 - RNA, 22 nt, Human
ggugcuaucucccccagcccca

SEQ ID NO: 1905135 - RNA, 19 nt, Human
gguaccccuuucuggcucu

SEQ ID NO: 1905136 - RNA, 17 nt, Human
gguacccacugcucugg

SEQ ID NO: 1905137 - RNA, 20 nt, Human
ggguuucaccauguuggcca

SEQ ID NO: 1905138 - RNA, 15 nt, Human
ggguugggcuggugu

SEQ ID NO: 1905139 - RNA, 21 nt, Human
gguacuuguggacacagcucu

SEQ ID NO: 1905140 - RNA, 22 nt, Human
gguacuuguggacacagcucuu

SEQ ID NO: 1905141 - RNA, 19 nt, Human
ggguuggccccugcccggc

SEQ ID NO: 1905142 - RNA, 16 nt, Human
ggguuggccccugccc

SEQ ID NO: 1905143 - RNA, 20 nt, Human
ggguucugccugccagcugc

SEQ ID NO: 1905144 - RNA, 21 nt, Human
ggguucugccugccagcugca

SEQ ID NO: 1905145 - RNA, 23 nt, Human
ggguucccuuuuuuggcugcuga

SEQ ID NO: 1905146 - RNA, 22 nt, Human
ggguucuacccaggugcuagga

SEQ ID NO: 1905147 - RNA, 17 nt, Human
ggguucuacccaggugc

SEQ ID NO: 1905148 - RNA, 19 nt, Human
ggguuccagcaccacacuc

SEQ ID NO: 1905149 - RNA, 19 nt, Human
gggugcugggccccugccu

SEQ ID NO: 1905150 - RNA, 18 nt, Human
gggugcugggccccugcc

SEQ ID NO: 1905151 - RNA, 16 nt, Human
ggucagagccugcagu

SEQ ID NO: 1905152 - RNA, 15 nt, Human
ggucagagccugcag

SEQ ID NO: 1905153 - RNA, 14 nt, Human
ggucagagccugca

SEQ ID NO: 1905154 - RNA, 13 nt, Human
ggucagagccugc

SEQ ID NO: 1905155 - RNA, 12 nt, Human
ggucagagccug

SEQ ID NO: 1905156 - RNA, 22 nt, Human
ggucacucuggcagcucagaga

SEQ ID NO: 1905157 - RNA, 16 nt, Human
ggucacucuggcagcu

SEQ ID NO: 1905158 - RNA, 20 nt, Human
ggucacucuggcagcucaga

SEQ ID NO: 1905159 - RNA, 14 nt, Human
ggucacacacugau

SEQ ID NO: 1905160 - RNA, 14 nt, Human
gguagaccugucuc

SEQ ID NO: 1905161 - RNA, 19 nt, Human
gguagaccugucuccuggc

SEQ ID NO: 1905162 - RNA, 22 nt, Human
gguagaccugucuccuggcggu

SEQ ID NO: 1905163 - RNA, 13 nt, Human
ggucccccuucca

SEQ ID NO: 1905164 - RNA, 18 nt, Human
ggucccccuuccauggac

SEQ ID NO: 1905165 - RNA, 23 nt, Human
ggucccccuuccauggacuuugu

SEQ ID NO: 1905166 - RNA, 14 nt, Human
ggucccacucaguc

SEQ ID NO: 1905167 - RNA, 12 nt, Human
ggucccacucag

SEQ ID NO: 1905168 - RNA, 22 nt, Human
ggucccacucaguccauagcag

SEQ ID NO: 1905169 - RNA, 22 nt, Human
ggucccaccccacacacgccag

SEQ ID NO: 1905170 - RNA, 23 nt, Human
ggucagcccaaaccaccagaagc

SEQ ID NO: 1905171 - RNA, 13 nt, Human
ggucagccagggc

SEQ ID NO: 1905172 - RNA, 19 nt, Human
ggucagccagggccugcga

SEQ ID NO: 1905173 - RNA, 16 nt, Human
gggccuggcagcucag

SEQ ID NO: 1905174 - RNA, 12 nt, Human
gggccuggcuca

SEQ ID NO: 1905175 - RNA, 12 nt, Human
gggccuggccug

SEQ ID NO: 1905176 - RNA, 18 nt, Human
gggccuggucguuuucaa

SEQ ID NO: 1905177 - RNA, 14 nt, Human
gggccuggcucagg

SEQ ID NO: 1905178 - RNA, 16 nt, Human
gggccuggcucaggug

SEQ ID NO: 1905179 - RNA, 13 nt, Human
ggcucccaggaca

SEQ ID NO: 1905180 - RNA, 16 nt, Human
gggcccggccagccau

SEQ ID NO: 1905181 - RNA, 13 nt, Human
gggcccggccagc

SEQ ID NO: 1905182 - RNA, 13 nt, Human
gggcucccuuccc

SEQ ID NO: 1905183 - RNA, 16 nt, Human
gggcgcgguggcucac

SEQ ID NO: 1905184 - RNA, 14 nt, Human
gggcucccuuccca

SEQ ID NO: 1905185 - RNA, 17 nt, Human
gggcucccuucccaccu

SEQ ID NO: 1905186 - RNA, 18 nt, Human
gggcucccuucccaccuc

SEQ ID NO: 1905187 - RNA, 23 nt, Human
gggcucccuucccaccucucuca

SEQ ID NO: 1905188 - RNA, 18 nt, Human
gggcgaucgcggcggagc

SEQ ID NO: 1905189 - RNA, 22 nt, Human
gggcgaucgcggcggagcuggc

SEQ ID NO: 1905190 - RNA, 22 nt, Human
gggcgccgcaaaccacacugga

SEQ ID NO: 1905191 - RNA, 16 nt, Human
gggcugaggugggagg

SEQ ID NO: 1905192 - RNA, 14 nt, Human
gggcugcaccggcu

SEQ ID NO: 1905193 - RNA, 23 nt, Human
gggcugguucuguaauugugugu

SEQ ID NO: 1905194 - RNA, 18 nt, Human
gggcuguaaaaugcauga

SEQ ID NO: 1905195 - RNA, 16 nt, Human
gggcugucaucugugc

SEQ ID NO: 1905196 - RNA, 14 nt, Human
gggcuucaguggca

SEQ ID NO: 1905197 - RNA, 16 nt, Human
gggcuuacggcccugg

SEQ ID NO: 1905198 - RNA, 18 nt, Human
gggcuuacggcccuggcc

SEQ ID NO: 1905199 - RNA, 17 nt, Human
gggcugucaucugugca

SEQ ID NO: 1905200 - RNA, 15 nt, Human
gggcucuucucauuu

SEQ ID NO: 1905201 - RNA, 12 nt, Human
gggcucuucuca

SEQ ID NO: 1905202 - RNA, 13 nt, Human
gggcucugccucc

SEQ ID NO: 1905203 - RNA, 15 nt, Human
gggcucugccuccca

SEQ ID NO: 1905204 - RNA, 16 nt, Human
gggcucugccucccau

SEQ ID NO: 1905205 - RNA, 17 nt, Human
gggcucugccucccauc

SEQ ID NO: 1905206 - RNA, 20 nt, Human
gggcucugccucccaucacc

SEQ ID NO: 1905207 - RNA, 23 nt, Human
gggcucucauguuuucaacugcc

SEQ ID NO: 1905208 - RNA, 17 nt, Human
ggggcuggcacugacug

SEQ ID NO: 1905209 - RNA, 13 nt, Human
ggggcugggacau

SEQ ID NO: 1905210 - RNA, 16 nt, Human
ggggcugggcagagga

SEQ ID NO: 1905211 - RNA, 17 nt, Human
ggggcugggcagaggaa

SEQ ID NO: 1905212 - RNA, 17 nt, Human
gggggaacucagaucca

SEQ ID NO: 1905213 - RNA, 22 nt, Human
ggggcuuagggucggaacccaa

SEQ ID NO: 1905214 - RNA, 14 nt, Human
ggggcugccagggg

SEQ ID NO: 1905215 - RNA, 23 nt, Human
ggguacuuguggacacagcucuu

SEQ ID NO: 1905216 - RNA, 23 nt, Human
ggguagagcggagaaaggaaggg

SEQ ID NO: 1905217 - RNA, 22 nt, Human
ggguacuuguggacacagcucu

SEQ ID NO: 1905218 - RNA, 19 nt, Human
ggguacuuguggacacagc

SEQ ID NO: 1905219 - RNA, 15 nt, Human
ggguacccacugcuc

SEQ ID NO: 1905220 - RNA, 13 nt, Human
ggguacccacugc

SEQ ID NO: 1905221 - RNA, 18 nt, Human
ggguacccacugcucugg

SEQ ID NO: 1905222 - RNA, 23 nt, Human
gggguucccuuuuuuggcugcug

SEQ ID NO: 1905223 - RNA, 14 nt, Human
ggggugaggagcug

SEQ ID NO: 1905224 - RNA, 15 nt, Human
ggggugaggagcugg

SEQ ID NO: 1905225 - RNA, 16 nt, Human
ggggugcccacaggcc

SEQ ID NO: 1905226 - RNA, 17 nt, Human
ggggaucacagccucug

SEQ ID NO: 1905227 - RNA, 13 nt, Human
ggggauagaugug

SEQ ID NO: 1905228 - RNA, 21 nt, Human
ggggaucccucccccccaugc

SEQ ID NO: 1905229 - RNA, 22 nt, Human
ggggaucaucugccgugccugg

SEQ ID NO: 1905230 - RNA, 23 nt, Human
ggggaucccucccccccaugcac

SEQ ID NO: 1905231 - RNA, 21 nt, Human
gggcuuggggaccagagcugc

SEQ ID NO: 1905232 - RNA, 11 nt, Human
ggggagcccac

SEQ ID NO: 1905233 - RNA, 19 nt, Human
ggggagcccacuguccugg

SEQ ID NO: 1905234 - RNA, 13 nt, Human
ggggaguggccac

SEQ ID NO: 1905235 - RNA, 17 nt, Human
ggggaguuaagaccugg

SEQ ID NO: 1905236 - RNA, 21 nt, Human
ggggaguuaagaccuggcagc

SEQ ID NO: 1905237 - RNA, 20 nt, Human
ggggagggugacaguggccg

SEQ ID NO: 1905238 - RNA, 22 nt, Human
ggggagccccuucugcucagcu

SEQ ID NO: 1905239 - RNA, 18 nt, Human
gggcuucaguggcagcug

SEQ ID NO: 1905240 - RNA, 17 nt, Human
gggcuucaguggcagcu

SEQ ID NO: 1905241 - RNA, 16 nt, Human
gggcuucaguggcagc

SEQ ID NO: 1905242 - RNA, 15 nt, Human
gggcuucaguggcag

SEQ ID NO: 1905243 - RNA, 20 nt, Human
gggcuucaguggcagcugcu

SEQ ID NO: 1905244 - RNA, 19 nt, Human
gggcuucaguggcagcugc

SEQ ID NO: 1905245 - RNA, 19 nt, Human
gggcuucauccuccucaga

SEQ ID NO: 1905246 - RNA, 13 nt, Human
gggcuucauacac

SEQ ID NO: 1905247 - RNA, 20 nt, Human
gggcuucauccuccucagau

SEQ ID NO: 1905248 - RNA, 19 nt, Human
gggcuucauacacaugaga

SEQ ID NO: 1905249 - RNA, 20 nt, Human
gggcuuggggaccagagcug

SEQ ID NO: 1905250 - RNA, 11 nt, Human
guccagaagga

SEQ ID NO: 1905251 - RNA, 14 nt, Human
guccagaaggagac

SEQ ID NO: 1905252 - RNA, 16 nt, Human
guccagaaggagacag

SEQ ID NO: 1905253 - RNA, 17 nt, Human
guccagaaggagacagg

SEQ ID NO: 1905254 - RNA, 19 nt, Human
guccagaaggagacaggca

SEQ ID NO: 1905255 - RNA, 20 nt, Human
guccagaaggagacaggcag

SEQ ID NO: 1905256 - RNA, 17 nt, Human
guccagcugagcgccag

SEQ ID NO: 1905257 - RNA, 14 nt, Human
guccagcuccaacc

SEQ ID NO: 1905258 - RNA, 16 nt, Human
guccacccaggagccc

SEQ ID NO: 1905259 - RNA, 15 nt, Human
guccacccaggagcc

SEQ ID NO: 1905260 - RNA, 14 nt, Human
guccacccaggagc

SEQ ID NO: 1905261 - RNA, 16 nt, Human
gucaugcccuccucuc

SEQ ID NO: 1905262 - RNA, 17 nt, Human
gucaugcccuccucucc

SEQ ID NO: 1905263 - RNA, 18 nt, Human
gucaugcccuccucuccc

SEQ ID NO: 1905264 - RNA, 15 nt, Human
gucccacucagucca

SEQ ID NO: 1905265 - RNA, 14 nt, Human
gucccacucagucc

SEQ ID NO: 1905266 - RNA, 17 nt, Human
guccaggauuccucuuu

SEQ ID NO: 1905267 - RNA, 21 nt, Human
guccagggagcauuuuccucc

SEQ ID NO: 1905268 - RNA, 17 nt, Human
gucccagauacuugggg

SEQ ID NO: 1905269 - RNA, 22 nt, Human
gucccagauuggcucacacuga

SEQ ID NO: 1905270 - RNA, 21 nt, Human
gucccagauuggcucacacug

SEQ ID NO: 1905271 - RNA, 17 nt, Human
gucccagauuggcucac

SEQ ID NO: 1905272 - RNA, 20 nt, Human
gucccagaaugccuccugca

SEQ ID NO: 1905273 - RNA, 21 nt, Human
gucauauaagauucauauuua

SEQ ID NO: 1905274 - RNA, 19 nt, Human
gucauagauguuuccuugc

SEQ ID NO: 1905275 - RNA, 22 nt, Human
gucauaacuagaacugaauuuu

SEQ ID NO: 1905276 - RNA, 20 nt, Human
gucauacuaucuacucuccu

SEQ ID NO: 1905277 - RNA, 21 nt, Human
gucauacuaucuacucuccuc

SEQ ID NO: 1905278 - RNA, 22 nt, Human
gucauacuaucuacucuccuca

SEQ ID NO: 1905279 - RNA, 17 nt, Human
gucauaacuagaacuga

SEQ ID NO: 1905280 - RNA, 23 nt, Human
gucagcccaaaccaccagaagcc

SEQ ID NO: 1905281 - RNA, 22 nt, Human
gucagcccaaaccaccagaagc

SEQ ID NO: 1905282 - RNA, 14 nt, Human
gucagccagggccu

SEQ ID NO: 1905283 - RNA, 16 nt, Human
gucagccagggccugc

SEQ ID NO: 1905284 - RNA, 10 nt, Human
gucagccagg

SEQ ID NO: 1905285 - RNA, 13 nt, Human
gucagccagggcc

SEQ ID NO: 1905286 - RNA, 19 nt, Human
gucaagugaaaaaggagga

SEQ ID NO: 1905287 - RNA, 18 nt, Human
gucaaggcugcuuagaau

SEQ ID NO: 1905288 - RNA, 16 nt, Human
gucaagugaaaaagga

SEQ ID NO: 1905289 - RNA, 18 nt, Human
gucaagugaaaaaggagg

SEQ ID NO: 1905290 - RNA, 13 nt, Human
gucaagcuccucc

SEQ ID NO: 1905291 - RNA, 15 nt, Human
gucaagcuccuccuc

SEQ ID NO: 1905292 - RNA, 17 nt, Human
gucaagcuccuccuccc

SEQ ID NO: 1905293 - RNA, 19 nt, Human
gucaagcuccuccucccug

SEQ ID NO: 1905294 - RNA, 20 nt, Human
gucaagcuccuccucccugc

SEQ ID NO: 1905295 - RNA, 21 nt, Human
gucaagcuccuccucccugca

SEQ ID NO: 1905296 - RNA, 19 nt, Human
gucaagagggucugaggaa

SEQ ID NO: 1905297 - RNA, 18 nt, Human
gucaagagggucugagga

SEQ ID NO: 1905298 - RNA, 14 nt, Human
guauuuguuaaugg

SEQ ID NO: 1905299 - RNA, 20 nt, Human
guauuugggaagugaagacu

SEQ ID NO: 1905300 - RNA, 20 nt, Human
gucaccugaagacucauucu

SEQ ID NO: 1905301 - RNA, 13 nt, Human
gucaccccggcca

SEQ ID NO: 1905302 - RNA, 15 nt, Human
gucaccccggccacc

SEQ ID NO: 1905303 - RNA, 16 nt, Human
gucaauuacaggaagu

SEQ ID NO: 1905304 - RNA, 15 nt, Human
gucaauguacuagga

SEQ ID NO: 1905305 - RNA, 13 nt, Human
gucaauuacagga

SEQ ID NO: 1905306 - RNA, 15 nt, Human
gucaauuacaggaag

SEQ ID NO: 1905307 - RNA, 18 nt, Human
guauucaauauccuuugc

SEQ ID NO: 1905308 - RNA, 14 nt, Human
guauuauaccuuuu

SEQ ID NO: 1905309 - RNA, 21 nt, Human
guauuagaguuucaaccauga

SEQ ID NO: 1905310 - RNA, 15 nt, Human
guauuauguguguuu

SEQ ID NO: 1905311 - RNA, 15 nt, Human
guauuacuucugcua

SEQ ID NO: 1905312 - RNA, 14 nt, Human
guauuacuucugcu

SEQ ID NO: 1905313 - RNA, 13 nt, Human
guauuacuucugc

SEQ ID NO: 1905314 - RNA, 22 nt, Human
guauuacaguggggaaugaaga

SEQ ID NO: 1905315 - RNA, 15 nt, Human
guagagugggagcug

SEQ ID NO: 1905316 - RNA, 20 nt, Human
guauuacaguggggaaugaa

SEQ ID NO: 1905317 - RNA, 13 nt, Human
guagagugggagc

SEQ ID NO: 1905318 - RNA, 15 nt, Human
guccucccagcuccu

SEQ ID NO: 1905319 - RNA, 21 nt, Human
guccucccaauuucagacucc

SEQ ID NO: 1905320 - RNA, 12 nt, Human
guccucccaucu

SEQ ID NO: 1905321 - RNA, 13 nt, Human
guccucccaucuc

SEQ ID NO: 1905322 - RNA, 14 nt, Human
guccucccaucuca

SEQ ID NO: 1905323 - RNA, 23 nt, Human
guccucccaucucacacaugagc

SEQ ID NO: 1905324 - RNA, 17 nt, Human
guccuggcaugggaaug

SEQ ID NO: 1905325 - RNA, 15 nt, Human
guccuggccauccca

SEQ ID NO: 1905326 - RNA, 16 nt, Human
guccuggccaucccac

SEQ ID NO: 1905327 - RNA, 17 nt, Human
guccuggccaucccaca

SEQ ID NO: 1905328 - RNA, 18 nt, Human
guccuggccaucccacaa

SEQ ID NO: 1905329 - RNA, 16 nt, Human
guccugggagugagcu

SEQ ID NO: 1905330 - RNA, 15 nt, Human
guccugggagugagc

SEQ ID NO: 1905331 - RNA, 21 nt, Human
guccuguaguugcguggacuc

SEQ ID NO: 1905332 - RNA, 23 nt, Human
guccuguaguugcguggacucug

SEQ ID NO: 1905333 - RNA, 18 nt, Human
guccugggagugagcugg

SEQ ID NO: 1905334 - RNA, 17 nt, Human
guccugggagugagcug

SEQ ID NO: 1905335 - RNA, 19 nt, Human
guccugggagugagcuggu

SEQ ID NO: 1905336 - RNA, 13 nt, Human
guccugggccugc

SEQ ID NO: 1905337 - RNA, 14 nt, Human
guccugggccugca

SEQ ID NO: 1905338 - RNA, 17 nt, Human
guccugggccugcagaa

SEQ ID NO: 1905339 - RNA, 12 nt, Human
gucccagugccg

SEQ ID NO: 1905340 - RNA, 15 nt, Human
gucccuggggcuagg

SEQ ID NO: 1905341 - RNA, 13 nt, Human
guccuacucugug

SEQ ID NO: 1905342 - RNA, 17 nt, Human
gucccugguggcagcuc

SEQ ID NO: 1905343 - RNA, 16 nt, Human
gucccugguggcagcu

SEQ ID NO: 1905344 - RNA, 22 nt, Human
gucccuggggcuagggggagcc

SEQ ID NO: 1905345 - RNA, 23 nt, Human
guccuacucugugucaggugggg

SEQ ID NO: 1905346 - RNA, 15 nt, Human
guccuacucuguguc

SEQ ID NO: 1905347 - RNA, 23 nt, Human
guccuagaaauuccccacccuga

SEQ ID NO: 1905348 - RNA, 13 nt, Human
guccucacacuca

SEQ ID NO: 1905349 - RNA, 12 nt, Human
guccucagccuu

SEQ ID NO: 1905350 - RNA, 14 nt, Human
guccucagccuugc

SEQ ID NO: 1905351 - RNA, 16 nt, Human
guccucagccuugcca

SEQ ID NO: 1905352 - RNA, 20 nt, Human
guccucagccuugccagaga

SEQ ID NO: 1905353 - RNA, 21 nt, Human
guccucagccuugccagagau

SEQ ID NO: 1905354 - RNA, 14 nt, Human
guccucagguggcc

SEQ ID NO: 1905355 - RNA, 15 nt, Human
guccucagguggcca

SEQ ID NO: 1905356 - RNA, 21 nt, Human
guccuccaacaccaagcacag

SEQ ID NO: 1905357 - RNA, 22 nt, Human
guccuccaacaccaagcacagc

SEQ ID NO: 1905358 - RNA, 14 nt, Human
guccuccaagccag

SEQ ID NO: 1905359 - RNA, 16 nt, Human
guccucagguggccau

SEQ ID NO: 1905360 - RNA, 17 nt, Human
guccucagguggccaug

SEQ ID NO: 1905361 - RNA, 23 nt, Human
guccucagguggccaugccucag

SEQ ID NO: 1905362 - RNA, 22 nt, Human
gucucacuugugcaguguugac

SEQ ID NO: 1905363 - RNA, 23 nt, Human
gucucacuguugcccaggcuggc

SEQ ID NO: 1905364 - RNA, 22 nt, Human
gucucacuguugcccaggcugg

SEQ ID NO: 1905365 - RNA, 21 nt, Human
gucucacuguugcccaggcug

SEQ ID NO: 1905366 - RNA, 20 nt, Human
gucucacuguugcccaggcu

SEQ ID NO: 1905367 - RNA, 19 nt, Human
gucucacuguugcccaggc

SEQ ID NO: 1905368 - RNA, 18 nt, Human
gucucacuguugcccagg

SEQ ID NO: 1905369 - RNA, 17 nt, Human
gucucacuguugcccag

SEQ ID NO: 1905370 - RNA, 16 nt, Human
gucucacuguugccca

SEQ ID NO: 1905371 - RNA, 23 nt, Human
gucucacuauguugcccaggcag

SEQ ID NO: 1905372 - RNA, 13 nt, Human
gucucacuguugc

SEQ ID NO: 1905373 - RNA, 21 nt, Human
gucucacuauguugcccaggc

SEQ ID NO: 1905374 - RNA, 20 nt, Human
gucucacuauguugcccagg

SEQ ID NO: 1905375 - RNA, 15 nt, Human
guccuuaccagcaga

SEQ ID NO: 1905376 - RNA, 16 nt, Human
guccuuaccagcagag

SEQ ID NO: 1905377 - RNA, 17 nt, Human
guccuuaccagcagagc

SEQ ID NO: 1905378 - RNA, 16 nt, Human
gucuaaacaaugcuga

SEQ ID NO: 1905379 - RNA, 15 nt, Human
gucuacacugugcug

SEQ ID NO: 1905380 - RNA, 21 nt, Human
gucuaaacaaugcugauuugg

SEQ ID NO: 1905381 - RNA, 21 nt, Human
gucugaggaauccagacccgg

SEQ ID NO: 1905382 - RNA, 14 nt, Human
gucugagugaaccu

SEQ ID NO: 1905383 - RNA, 15 nt, Human
gucugaguggcuuca

SEQ ID NO: 1905384 - RNA, 23 nt, Human
gucugaguggcuucacuccugcu

SEQ ID NO: 1905385 - RNA, 19 nt, Human
gucugauucccaagcucug

SEQ ID NO: 1905386 - RNA, 18 nt, Human
gucugauucccaagcucu

SEQ ID NO: 1905387 - RNA, 17 nt, Human
gucugauucccaagcuc

SEQ ID NO: 1905388 - RNA, 21 nt, Human
gucugauucccaagcucugcu

SEQ ID NO: 1905389 - RNA, 20 nt, Human
gucugauucccaagcucugc

SEQ ID NO: 1905390 - RNA, 20 nt, Human
gucugcauuucgguggcuag

SEQ ID NO: 1905391 - RNA, 21 nt, Human
gucugcauuucgguggcuagu

SEQ ID NO: 1905392 - RNA, 19 nt, Human
gucugaggaauccagaccc

SEQ ID NO: 1905393 - RNA, 18 nt, Human
gucugaggaauccagacc

SEQ ID NO: 1905394 - RNA, 15 nt, Human
gucugacccacugcu

SEQ ID NO: 1905395 - RNA, 14 nt, Human
gucugacccacugc

SEQ ID NO: 1905396 - RNA, 13 nt, Human
gucugacccacug

SEQ ID NO: 1905397 - RNA, 13 nt, Human
gucucgugguagg

SEQ ID NO: 1905398 - RNA, 15 nt, Human
gucucugugagacuc

SEQ ID NO: 1905399 - RNA, 17 nt, Human
gugccauagucacaugg

SEQ ID NO: 1905400 - RNA, 20 nt, Human
gugcccacaggaucagucug

SEQ ID NO: 1905401 - RNA, 13 nt, Human
gugcccacaggcc

SEQ ID NO: 1905402 - RNA, 21 nt, Human
gugcccacaggccgcccugcg

SEQ ID NO: 1905403 - RNA, 12 nt, Human
gugccccaggac

SEQ ID NO: 1905404 - RNA, 14 nt, Human
gugccccaggacca

SEQ ID NO: 1905405 - RNA, 15 nt, Human
gugccccaggaccag

SEQ ID NO: 1905406 - RNA, 19 nt, Human
gugccccaggaccagcuca

SEQ ID NO: 1905407 - RNA, 21 nt, Human
gugccccaggaccagcucagg

SEQ ID NO: 1905408 - RNA, 19 nt, Human
gugcccccacugaccagaa

SEQ ID NO: 1905409 - RNA, 13 nt, Human
gugcccccacuga

SEQ ID NO: 1905410 - RNA, 15 nt, Human
gugcccccacugacc

SEQ ID NO: 1905411 - RNA, 18 nt, Human
gugcccccacugaccaga

SEQ ID NO: 1905412 - RNA, 19 nt, Human
gugcauaaguuaacuucca

SEQ ID NO: 1905413 - RNA, 21 nt, Human
gugcagguagaccugucuccu

SEQ ID NO: 1905414 - RNA, 15 nt, Human
gugcagguagaccug

SEQ ID NO: 1905415 - RNA, 17 nt, Human
gugcagggacaaagagg

SEQ ID NO: 1905416 - RNA, 22 nt, Human
gugcagguagaccugucuccug

SEQ ID NO: 1905417 - RNA, 22 nt, Human
gugcaguaucaugcccugugca

SEQ ID NO: 1905418 - RNA, 22 nt, Human
gugcaacaagguccucugucag

SEQ ID NO: 1905419 - RNA, 22 nt, Human
gugccagguuuuuggucugacc

SEQ ID NO: 1905420 - RNA, 20 nt, Human
gugccagguuuuuggucuga

SEQ ID NO: 1905421 - RNA, 22 nt, Human
gugcaugaagguuucugaaaau

SEQ ID NO: 1905422 - RNA, 21 nt, Human
gugcauaccacuuuuguucuu

SEQ ID NO: 1905423 - RNA, 14 nt, Human
gugcauaccacuuu

SEQ ID NO: 1905424 - RNA, 13 nt, Human
gugcauaccacuu

SEQ ID NO: 1905425 - RNA, 20 nt, Human
gugauccacccaccucagcc

SEQ ID NO: 1905426 - RNA, 18 nt, Human
gugauccacccaccucag

SEQ ID NO: 1905427 - RNA, 15 nt, Human
gugauccacccaccu

SEQ ID NO: 1905428 - RNA, 13 nt, Human
gugaggccagaga

SEQ ID NO: 1905429 - RNA, 23 nt, Human
gugaggcaaugggagcugaggcc

SEQ ID NO: 1905430 - RNA, 11 nt, Human
gugaggccaga

SEQ ID NO: 1905431 - RNA, 18 nt, Human
gugauccucccaccucag

SEQ ID NO: 1905432 - RNA, 15 nt, Human
gugauccucccaccu

SEQ ID NO: 1905433 - RNA, 14 nt, Human
gugauccucccacc

SEQ ID NO: 1905434 - RNA, 22 nt, Human
gugauccucccaccucagccuc

SEQ ID NO: 1905435 - RNA, 20 nt, Human
gugauccucccaccucagcc

SEQ ID NO: 1905436 - RNA, 23 nt, Human
gugauccucccaccucagccucc

SEQ ID NO: 1905437 - RNA, 23 nt, Human
gugauucuccugccucagccucc

SEQ ID NO: 1905438 - RNA, 13 nt, Human
gugauucuccugc

SEQ ID NO: 1905439 - RNA, 17 nt, Human
gugauugacagcuuugc

SEQ ID NO: 1905440 - RNA, 21 nt, Human
gugauugacagcuuugcugcu

SEQ ID NO: 1905441 - RNA, 22 nt, Human
gugauugacagcuuugcugcug

SEQ ID NO: 1905442 - RNA, 23 nt, Human
gugauugacagcuuugcugcuga

SEQ ID NO: 1905443 - RNA, 14 nt, Human
gugauuguggaaug

SEQ ID NO: 1905444 - RNA, 19 nt, Human
gugauuguggaauggagau

SEQ ID NO: 1905445 - RNA, 23 nt, Human
gugauuguggaauggagauucag

SEQ ID NO: 1905446 - RNA, 16 nt, Human
gugauuuugcuguaga

SEQ ID NO: 1905447 - RNA, 22 nt, Human
gugauucuccugccucagccuc

SEQ ID NO: 1905448 - RNA, 20 nt, Human
gugauucuccugccucagcc

SEQ ID NO: 1905449 - RNA, 19 nt, Human
gugauucuccugccucagc

SEQ ID NO: 1905450 - RNA, 18 nt, Human
gugauucuccugccucag

SEQ ID NO: 1905451 - RNA, 17 nt, Human
gugauucuccugccuca

SEQ ID NO: 1905452 - RNA, 16 nt, Human
gugauucuccugccuc

SEQ ID NO: 1905453 - RNA, 14 nt, Human
gugauucuccugcc

SEQ ID NO: 1905454 - RNA, 24 nt, Human
gugaaacccagucacugugagcuc

SEQ ID NO: 1905455 - RNA, 14 nt, Human
gugaaaagaaaaau

SEQ ID NO: 1905456 - RNA, 23 nt, Human
gugaaaagaaaaaugagccuggc

SEQ ID NO: 1905457 - RNA, 15 nt, Human
gugaaaacggagcug

SEQ ID NO: 1905458 - RNA, 19 nt, Human
gugaaaaguccuugauugu

SEQ ID NO: 1905459 - RNA, 19 nt, Human
gugaaagaaaauaacaaua

SEQ ID NO: 1905460 - RNA, 20 nt, Human
gugaaagcaucacuugggau

SEQ ID NO: 1905461 - RNA, 12 nt, Human
gugaaacuggau

SEQ ID NO: 1905462 - RNA, 18 nt, Human
gugaaauuauucauaauu

SEQ ID NO: 1905463 - RNA, 20 nt, Human
gugaaauuauucauaauuau

SEQ ID NO: 1905464 - RNA, 12 nt, Human
gugaaauuccca

SEQ ID NO: 1905465 - RNA, 23 nt, Human
gugaaauucccaacaaacauuga

SEQ ID NO: 1905466 - RNA, 13 nt, Human
gugaaaucauuca

SEQ ID NO: 1905467 - RNA, 19 nt, Human
gugaaaggaaagagggagg

SEQ ID NO: 1905468 - RNA, 16 nt, Human
gugaaucacguaaagc

SEQ ID NO: 1905469 - RNA, 18 nt, Human
gugaaucacguaaagcua

SEQ ID NO: 1905470 - RNA, 22 nt, Human
gugagcucccaggugcagccag

SEQ ID NO: 1905471 - RNA, 16 nt, Human
gugagcuccuaagcca

SEQ ID NO: 1905472 - RNA, 14 nt, Human
gugagcuacaaaug

SEQ ID NO: 1905473 - RNA, 14 nt, Human
gugagccacugcac

SEQ ID NO: 1905474 - RNA, 11 nt, Human
gugaggaagcc

SEQ ID NO: 1905475 - RNA, 16 nt, Human
gugaggaagccgcugg

SEQ ID NO: 1905476 - RNA, 19 nt, Human
gugaggaagccgcuggggc

SEQ ID NO: 1905477 - RNA, 13 nt, Human
gugagccacugca

SEQ ID NO: 1905478 - RNA, 17 nt, Human
gugacugaucucucgug

SEQ ID NO: 1905479 - RNA, 16 nt, Human
gugacaacacuugugu

SEQ ID NO: 1905480 - RNA, 15 nt, Human
gugacugaauuucuu

SEQ ID NO: 1905481 - RNA, 18 nt, Human
gugacugaauuucuuuug

SEQ ID NO: 1905482 - RNA, 16 nt, Human
gugacugaauuucuuu

SEQ ID NO: 1905483 - RNA, 20 nt, Human
gugaccuuccaagagccuga

SEQ ID NO: 1905484 - RNA, 19 nt, Human
gugaccuuccaagagccug

SEQ ID NO: 1905485 - RNA, 21 nt, Human
gugcugaagcuuauuaaugcu

SEQ ID NO: 1905486 - RNA, 15 nt, Human
gugcugaagcuuauu

SEQ ID NO: 1905487 - RNA, 14 nt, Human
gugcugaagcuuau

SEQ ID NO: 1905488 - RNA, 23 nt, Human
gugcugaaugguuuucaaaauaa

SEQ ID NO: 1905489 - RNA, 19 nt, Human
gugcugaaugguuuucaaa

SEQ ID NO: 1905490 - RNA, 20 nt, Human
gugcugaaugguuuucaaaa

SEQ ID NO: 1905491 - RNA, 18 nt, Human
gugcucuggacaggcaug

SEQ ID NO: 1905492 - RNA, 17 nt, Human
gugcucuggacaggcau

SEQ ID NO: 1905493 - RNA, 16 nt, Human
gugcucuggacaggca

SEQ ID NO: 1905494 - RNA, 15 nt, Human
gugcucuggacaggc

SEQ ID NO: 1905495 - RNA, 22 nt, Human
gugccgagaaggaagccuccca

SEQ ID NO: 1905496 - RNA, 21 nt, Human
gugccuuggggacaagagcag

SEQ ID NO: 1905497 - RNA, 19 nt, Human
gugcugccauccagguuca

SEQ ID NO: 1905498 - RNA, 18 nt, Human
gugcugccauccagguuc

SEQ ID NO: 1905499 - RNA, 15 nt, Human
gugcugccauccagg

SEQ ID NO: 1905500 - RNA, 20 nt, Human
gugcugcauuuaaaagauac

SEQ ID NO: 1905501 - RNA, 19 nt, Human
gugcugcauuuaaaagaua

SEQ ID NO: 1905502 - RNA, 12 nt, Human
gugcugcauuua

SEQ ID NO: 1905503 - RNA, 23 nt, Human
gugcugaguugguguugacaugu

SEQ ID NO: 1905504 - RNA, 12 nt, Human
gugcugagucug

SEQ ID NO: 1905505 - RNA, 21 nt, Human
gugcugacggccagggagaag

SEQ ID NO: 1905506 - RNA, 23 nt, Human
gugcugacggccagggagaagcu

SEQ ID NO: 1905507 - RNA, 11 nt, Human
gugcugagaag

SEQ ID NO: 1905508 - RNA, 13 nt, Human
gugcugagaagcu

SEQ ID NO: 1905509 - RNA, 14 nt, Human
gugcugagaagcuu

SEQ ID NO: 1905510 - RNA, 15 nt, Human
gugcugacggccagg

SEQ ID NO: 1905511 - RNA, 16 nt, Human
gugcugacggccaggg

SEQ ID NO: 1905512 - RNA, 18 nt, Human
gugcugacggccagggag

SEQ ID NO: 1905513 - RNA, 15 nt, Human
gugcugacagcugcu

SEQ ID NO: 1905514 - RNA, 16 nt, Human
gugcugacagcugcuc

SEQ ID NO: 1905515 - RNA, 17 nt, Human
gugcugacagcugcucc

SEQ ID NO: 1905516 - RNA, 16 nt, Human
gugcugagucugaagg

SEQ ID NO: 1905517 - RNA, 17 nt, Human
gugcugagucugaaggc

SEQ ID NO: 1905518 - RNA, 18 nt, Human
gugcugagucugaaggcu

SEQ ID NO: 1905519 - RNA, 19 nt, Human
gugcugagucugaaggcug

SEQ ID NO: 1905520 - RNA, 21 nt, Human
gugcuuaucccauagccagga

SEQ ID NO: 1905521 - RNA, 22 nt, Human
gugcugccauccagguucagcu

SEQ ID NO: 1905522 - RNA, 11 nt, Human
gugcugcccug

SEQ ID NO: 1905523 - RNA, 12 nt, Human
gugcuuggagga

SEQ ID NO: 1905524 - RNA, 13 nt, Human
gugcuuggaggaa

SEQ ID NO: 1905525 - RNA, 15 nt, Human
gugcuuggaggaagg

SEQ ID NO: 1905526 - RNA, 16 nt, Human
gugcuucaacauucuu

SEQ ID NO: 1905527 - RNA, 18 nt, Human
guggaaaaauagccugcc

SEQ ID NO: 1905528 - RNA, 23 nt, Human
guggaaaagccaagaggcugcag

SEQ ID NO: 1905529 - RNA, 18 nt, Human
guggaaaugcgcaugagu

SEQ ID NO: 1905530 - RNA, 15 nt, Human
gugcuuuaugcugaa

SEQ ID NO: 1905531 - RNA, 17 nt, Human
gugcuuuaugcugaaac

SEQ ID NO: 1905532 - RNA, 13 nt, Human
gugcuuuauauuu

SEQ ID NO: 1905533 - RNA, 14 nt, Human
gugcuuuaugcuga

SEQ ID NO: 1905534 - RNA, 18 nt, Human
guggaugccugguggcag

SEQ ID NO: 1905535 - RNA, 16 nt, Human
guggaugccugguggc

SEQ ID NO: 1905536 - RNA, 17 nt, Human
guggaguucaucuugaa

SEQ ID NO: 1905537 - RNA, 15 nt, Human
guggagucauucuca

SEQ ID NO: 1905538 - RNA, 23 nt, Human
guggagggacaaguggacucagg

SEQ ID NO: 1905539 - RNA, 23 nt, Human
guggaggagcucaggacacuaau

SEQ ID NO: 1905540 - RNA, 20 nt, Human
guggaggagcucaggacacu

SEQ ID NO: 1905541 - RNA, 13 nt, Human
guggaggcacuuu

SEQ ID NO: 1905542 - RNA, 14 nt, Human
guggaggcacuuua

SEQ ID NO: 1905543 - RNA, 16 nt, Human
guggaggagcucagga

SEQ ID NO: 1905544 - RNA, 22 nt, Human
guggaacguuuuuccuguucuu

SEQ ID NO: 1905545 - RNA, 20 nt, Human
guggagaagcggcuggcagc

SEQ ID NO: 1905546 - RNA, 22 nt, Human
guggagaagccacaggccugag

SEQ ID NO: 1905547 - RNA, 20 nt, Human
guggagaagccacaggccug

SEQ ID NO: 1905548 - RNA, 17 nt, Human
guggagaagccacaggc

SEQ ID NO: 1905549 - RNA, 19 nt, Human
guggcagcugcuuuugucu

SEQ ID NO: 1905550 - RNA, 13 nt, Human
guggcagcugcuu

SEQ ID NO: 1905551 - RNA, 12 nt, Human
guggcagcugcu

SEQ ID NO: 1905552 - RNA, 23 nt, Human
guggcagcugcgguccacccagg

SEQ ID NO: 1905553 - RNA, 22 nt, Human
guggcagcugcgguccacccag

SEQ ID NO: 1905554 - RNA, 21 nt, Human
guggcagcugcgguccaccca

SEQ ID NO: 1905555 - RNA, 20 nt, Human
guggaugccugguggcagcu

SEQ ID NO: 1905556 - RNA, 19 nt, Human
guggcagcugcgguccacc

SEQ ID NO: 1905557 - RNA, 17 nt, Human
guggcagugggagcugc

SEQ ID NO: 1905558 - RNA, 16 nt, Human
guggcagugggagcug

SEQ ID NO: 1905559 - RNA, 15 nt, Human
guggcagugggagcu

SEQ ID NO: 1905560 - RNA, 11 nt, Human
guggcagucug

SEQ ID NO: 1905561 - RNA, 21 nt, Human
guggcagugggagcugccugu

SEQ ID NO: 1905562 - RNA, 19 nt, Human
guggcagugggagcugccu

SEQ ID NO: 1905563 - RNA, 15 nt, Human
guggcaguuuggcaa

SEQ ID NO: 1905564 - RNA, 14 nt, Human
guggccaaguucuu

SEQ ID NO: 1905565 - RNA, 16 nt, Human
guggccaaggagcugc

SEQ ID NO: 1905566 - RNA, 15 nt, Human
guggccaaggagcug

SEQ ID NO: 1905567 - RNA, 17 nt, Human
guggccaaggagcugcu

SEQ ID NO: 1905568 - RNA, 18 nt, Human
guggccaaggagcugcua

SEQ ID NO: 1905569 - RNA, 19 nt, Human
guggccaaggagcugcuau

SEQ ID NO: 1905570 - RNA, 13 nt, Human
guggcccaggacc

SEQ ID NO: 1905571 - RNA, 23 nt, Human
uaucugcuuuugguuauaaugug

SEQ ID NO: 1905572 - RNA, 20 nt, Human
uaucuaauaccucugugugc

SEQ ID NO: 1905573 - RNA, 13 nt, Human
uaucuaauuuaua

SEQ ID NO: 1905574 - RNA, 13 nt, Human
uaucuacucuccu

SEQ ID NO: 1905575 - RNA, 15 nt, Human
uaucuaauaccucug

SEQ ID NO: 1905576 - RNA, 16 nt, Human
uaucuaauaccucugu

SEQ ID NO: 1905577 - RNA, 21 nt, Human
uaucuaauauguaacaagcca

SEQ ID NO: 1905578 - RNA, 16 nt, Human
uaucgucacugcuuaa

SEQ ID NO: 1905579 - RNA, 14 nt, Human
uauccuucagccug

SEQ ID NO: 1905580 - RNA, 15 nt, Human
uauccuucagccuga

SEQ ID NO: 1905581 - RNA, 15 nt, Human
uaucguaaaauuaag

SEQ ID NO: 1905582 - RNA, 18 nt, Human
uaucguaaaauuaagaaa

SEQ ID NO: 1905583 - RNA, 16 nt, Human
uaucuaaauguugaaa

SEQ ID NO: 1905584 - RNA, 19 nt, Human
uauauguuuuaagaggcag

SEQ ID NO: 1905585 - RNA, 23 nt, Human
uaucugucauuugagcagggcuc

SEQ ID NO: 1905586 - RNA, 21 nt, Human
uaucugucauuugagcagggc

SEQ ID NO: 1905587 - RNA, 20 nt, Human
uaucugucauuugagcaggg

SEQ ID NO: 1905588 - RNA, 20 nt, Human
uaugaaguuuuuuuuauaca

SEQ ID NO: 1905589 - RNA, 14 nt, Human
uaucuugaagacuu

SEQ ID NO: 1905590 - RNA, 17 nt, Human
uaucuguuuacaguguu

SEQ ID NO: 1905591 - RNA, 16 nt, Human
uaucuguuuacagugu

SEQ ID NO: 1905592 - RNA, 12 nt, Human
uaugaauaacau

SEQ ID NO: 1905593 - RNA, 12 nt, Human
uaugacacaugc

SEQ ID NO: 1905594 - RNA, 22 nt, Human
uaugacacaugcaaggucauuu

SEQ ID NO: 1905595 - RNA, 22 nt, Human
uaugcaccuugugucuguacac

SEQ ID NO: 1905596 - RNA, 20 nt, Human
uaugcaccuugugucuguac

SEQ ID NO: 1905597 - RNA, 19 nt, Human
uaugcaccuugugucugua

SEQ ID NO: 1905598 - RNA, 18 nt, Human
uaugcaccuugugucugu

SEQ ID NO: 1905599 - RNA, 20 nt, Human
uaugcacauauggacucugc

SEQ ID NO: 1905600 - RNA, 19 nt, Human
uaugcacauauggacucug

SEQ ID NO: 1905601 - RNA, 14 nt, Human
uaugcaccuugugu

SEQ ID NO: 1905602 - RNA, 20 nt, Human
uaugcauauuauuuuauguu

SEQ ID NO: 1905603 - RNA, 18 nt, Human
uaugcaugaaguaauaug

SEQ ID NO: 1905604 - RNA, 13 nt, Human
uaugcaugaagua

SEQ ID NO: 1905605 - RNA, 22 nt, Human
uaugcuuauacacuuacacuuu

SEQ ID NO: 1905606 - RNA, 16 nt, Human
uaugcuucauacaggg

SEQ ID NO: 1905607 - RNA, 14 nt, Human
uaugcuucauacag

SEQ ID NO: 1905608 - RNA, 13 nt, Human
uaugcuucauaca

SEQ ID NO: 1905609 - RNA, 12 nt, Human
uaugcuucauac

SEQ ID NO: 1905610 - RNA, 13 nt, Human
uauggaacacucu

SEQ ID NO: 1905611 - RNA, 16 nt, Human
uauggaacacucugag

SEQ ID NO: 1905612 - RNA, 17 nt, Human
uauggaacacucugaga

SEQ ID NO: 1905613 - RNA, 18 nt, Human
uauggaacacucugagac

SEQ ID NO: 1905614 - RNA, 13 nt, Human
uaugcuucuuuca

SEQ ID NO: 1905615 - RNA, 17 nt, Human
uaugcuucauacaggga

SEQ ID NO: 1905616 - RNA, 17 nt, Human
uauggacaaugacccag

SEQ ID NO: 1905617 - RNA, 18 nt, Human
uauggaauugauuugcau

SEQ ID NO: 1905618 - RNA, 11 nt, Human
uauggaauuga

SEQ ID NO: 1905619 - RNA, 19 nt, Human
uauggaauugauuugcauu

SEQ ID NO: 1905620 - RNA, 19 nt, Human
uauggaacacucugagacu

SEQ ID NO: 1905621 - RNA, 13 nt, Human
uaugcacauaugg

SEQ ID NO: 1905622 - RNA, 14 nt, Human
uaugcacacauuuu

SEQ ID NO: 1905623 - RNA, 13 nt, Human
uaugcacacauuu

SEQ ID NO: 1905624 - RNA, 18 nt, Human
uaugcaaucaaaucugcu

SEQ ID NO: 1905625 - RNA, 12 nt, Human
uaugauuuuuaa

SEQ ID NO: 1905626 - RNA, 23 nt, Human
uaugauuuuuaaagaaaaguuuu

SEQ ID NO: 1905627 - RNA, 16 nt, Human
uaugacuccagaauuu

SEQ ID NO: 1905628 - RNA, 16 nt, Human
uaugaccuucuaggaa

SEQ ID NO: 1905629 - RNA, 18 nt, Human
uaugaccuucuaggaagc

SEQ ID NO: 1905630 - RNA, 17 nt, Human
uaugacuccagaauuuc

SEQ ID NO: 1905631 - RNA, 23 nt, Human
uaugacuccagaauuucccaaag

SEQ ID NO: 1905632 - RNA, 15 nt, Human
uaugagacacaggau

SEQ ID NO: 1905633 - RNA, 23 nt, Human
uaugagcuggggaugucucucau

SEQ ID NO: 1905634 - RNA, 21 nt, Human
uaugauucaaaugucuauaaa

SEQ ID NO: 1905635 - RNA, 16 nt, Human
uaugauucaaaugucu

SEQ ID NO: 1905636 - RNA, 22 nt, Human
uaguugcguggacucugcacau

SEQ ID NO: 1905637 - RNA, 18 nt, Human
uauaaacuuuaccuuuuu

SEQ ID NO: 1905638 - RNA, 17 nt, Human
uauaauauacuauauuu

SEQ ID NO: 1905639 - RNA, 15 nt, Human
uauaauacuguauuu

SEQ ID NO: 1905640 - RNA, 16 nt, Human
uauaauaaauguacau

SEQ ID NO: 1905641 - RNA, 20 nt, Human
uauaauauacuauauuuaug

SEQ ID NO: 1905642 - RNA, 15 nt, Human
uauaauauauuugug

SEQ ID NO: 1905643 - RNA, 22 nt, Human
uauaauauuuuuaauuaaauaa

SEQ ID NO: 1905644 - RNA, 16 nt, Human
uauaauauauuugugu

SEQ ID NO: 1905645 - RNA, 22 nt, Human
uauaauauauuuguguauuuaa

SEQ ID NO: 1905646 - RNA, 14 nt, Human
uauaaauuccucuu

SEQ ID NO: 1905647 - RNA, 20 nt, Human
uauaaauuccucuuugcuuu

SEQ ID NO: 1905648 - RNA, 18 nt, Human
uauaauguuguuauuuaa

SEQ ID NO: 1905649 - RNA, 19 nt, Human
uauaauguuguuauuuaaa

SEQ ID NO: 1905650 - RNA, 17 nt, Human
uauaauguuguuauuua

SEQ ID NO: 1905651 - RNA, 15 nt, Human
uauaauucacauugu

SEQ ID NO: 1905652 - RNA, 21 nt, Human
uauaugcucugcauguuacau

SEQ ID NO: 1905653 - RNA, 20 nt, Human
uauauguauuuaaaaaaauc

SEQ ID NO: 1905654 - RNA, 23 nt, Human
uauauaaauuuuuuuuguuucau

SEQ ID NO: 1905655 - RNA, 18 nt, Human
uauacgauaaauaacuuu

SEQ ID NO: 1905656 - RNA, 13 nt, Human
uauacuggcaugc

SEQ ID NO: 1905657 - RNA, 23 nt, Human
uauacuggcaugcuaaagccuuc

SEQ ID NO: 1905658 - RNA, 14 nt, Human
uaggacccaagcag

SEQ ID NO: 1905659 - RNA, 16 nt, Human
uaggacccaagcagag

SEQ ID NO: 1905660 - RNA, 18 nt, Human
uaggccaugggacaggga

SEQ ID NO: 1905661 - RNA, 16 nt, Human
uaggccaugggacagg

SEQ ID NO: 1905662 - RNA, 18 nt, Human
uaggccuggccagaugca

SEQ ID NO: 1905663 - RNA, 21 nt, Human
uaggccuuccucucuccagau

SEQ ID NO: 1905664 - RNA, 15 nt, Human
uaggccuggccagau

SEQ ID NO: 1905665 - RNA, 12 nt, Human
uaggaauugacc

SEQ ID NO: 1905666 - RNA, 16 nt, Human
uaggaauuguguuuau

SEQ ID NO: 1905667 - RNA, 20 nt, Human
uaggacauaaauuagagguc

SEQ ID NO: 1905668 - RNA, 15 nt, Human
guggcugagccccug

SEQ ID NO: 1905669 - RNA, 17 nt, Human
guggcugagccccuguc

SEQ ID NO: 1905670 - RNA, 16 nt, Human
uaggucagugcaaaua

SEQ ID NO: 1905671 - RNA, 15 nt, Human
uaggucucaauaccu

SEQ ID NO: 1905672 - RNA, 20 nt, Human
uaggucuagccuauguggau

SEQ ID NO: 1905673 - RNA, 16 nt, Human
uagguaaauuacaguu

SEQ ID NO: 1905674 - RNA, 13 nt, Human
uagguaacuucau

SEQ ID NO: 1905675 - RNA, 11 nt, Human
uagguauuuug

SEQ ID NO: 1905676 - RNA, 19 nt, Human
uagggaaaaaccagcgugu

SEQ ID NO: 1905677 - RNA, 20 nt, Human
uagggaaaaaccagcgugug

SEQ ID NO: 1905678 - RNA, 21 nt, Human
uagggaaaaaccagcguguga

SEQ ID NO: 1905679 - RNA, 23 nt, Human
uaggccuuccucucuccagaugu

SEQ ID NO: 1905680 - RNA, 16 nt, Human
uaggcucauuuacugu

SEQ ID NO: 1905681 - RNA, 17 nt, Human
uaggcucauuuacuguu

SEQ ID NO: 1905682 - RNA, 20 nt, Human
uaggcucauuuacuguuuua

SEQ ID NO: 1905683 - RNA, 13 nt, Human
uaguguucauaaa

SEQ ID NO: 1905684 - RNA, 20 nt, Human
uaguugcaacuuuguauaaa

SEQ ID NO: 1905685 - RNA, 16 nt, Human
uagugccuucuaaagg

SEQ ID NO: 1905686 - RNA, 19 nt, Human
uagugccuucuaaaggugu

SEQ ID NO: 1905687 - RNA, 23 nt, Human
uaggugacagagugagacucugu

SEQ ID NO: 1905688 - RNA, 20 nt, Human
uaguaggugaguuuucaccu

SEQ ID NO: 1905689 - RNA, 13 nt, Human
uaguaucaaaaga

SEQ ID NO: 1905690 - RNA, 20 nt, Human
ucaaggacuuucugaagccu

SEQ ID NO: 1905691 - RNA, 13 nt, Human
ucaaggauccuga

SEQ ID NO: 1905692 - RNA, 14 nt, Human
ucaaggauccugag

SEQ ID NO: 1905693 - RNA, 15 nt, Human
ucaaggauccugagc

SEQ ID NO: 1905694 - RNA, 16 nt, Human
ucaaggauccugagcc

SEQ ID NO: 1905695 - RNA, 17 nt, Human
ucaaggauccugagcca

SEQ ID NO: 1905696 - RNA, 19 nt, Human
ucaagcgauucuucugcuu

SEQ ID NO: 1905697 - RNA, 18 nt, Human
ucaagcgauucuucugcu

SEQ ID NO: 1905698 - RNA, 21 nt, Human
ucaagcgauucuucugcuuca

SEQ ID NO: 1905699 - RNA, 12 nt, Human
ucaagccaccaa

SEQ ID NO: 1905700 - RNA, 20 nt, Human
ucaagccaccaacauacucc

SEQ ID NO: 1905701 - RNA, 19 nt, Human
ucaaccccuucgcuccugu

SEQ ID NO: 1905702 - RNA, 18 nt, Human
ucaaccccuucgcuccug

SEQ ID NO: 1905703 - RNA, 15 nt, Human
ucaaccuccugggcu

SEQ ID NO: 1905704 - RNA, 20 nt, Human
ucaaccccuucgcuccugug

SEQ ID NO: 1905705 - RNA, 16 nt, Human
ucaaccuccugggcua

SEQ ID NO: 1905706 - RNA, 17 nt, Human
ucaaccucuucuggcuc

SEQ ID NO: 1905707 - RNA, 18 nt, Human
ucaaccucuucuggcuca

SEQ ID NO: 1905708 - RNA, 20 nt, Human
ucaacucuccuccagaguca

SEQ ID NO: 1905709 - RNA, 19 nt, Human
ucaaccucuucuggcucaa

SEQ ID NO: 1905710 - RNA, 14 nt, Human
ucaaacuggggccu

SEQ ID NO: 1905711 - RNA, 16 nt, Human
ucaaacuggggccucc

SEQ ID NO: 1905712 - RNA, 19 nt, Human
ucaaacuggggccuccaga

SEQ ID NO: 1905713 - RNA, 20 nt, Human
ucaaacuggggccuccagaa

SEQ ID NO: 1905714 - RNA, 22 nt, Human
ucaaacuggggccuccagaacu

SEQ ID NO: 1905715 - RNA, 23 nt, Human
ucaaacuggggccuccagaacuc

SEQ ID NO: 1905716 - RNA, 14 nt, Human
uauuugcaauuccu

SEQ ID NO: 1905717 - RNA, 18 nt, Human
uauuugcacuaagauauu

SEQ ID NO: 1905718 - RNA, 23 nt, Human
uauuugaauguaugcuucauaca

SEQ ID NO: 1905719 - RNA, 22 nt, Human
uauuugaauguaugcuucauac

SEQ ID NO: 1905720 - RNA, 12 nt, Human
ucaaagagguuu

SEQ ID NO: 1905721 - RNA, 23 nt, Human
ucaaagagguuuuaaaaaaaucc

SEQ ID NO: 1905722 - RNA, 21 nt, Human
ucaaagaggcugaggcuggca

SEQ ID NO: 1905723 - RNA, 22 nt, Human
ucaaacuuccagugcaacacug

SEQ ID NO: 1905724 - RNA, 19 nt, Human
ucaaauggggccagaucca

SEQ ID NO: 1905725 - RNA, 20 nt, Human
ucaaauggggccagauccag

SEQ ID NO: 1905726 - RNA, 20 nt, Human
ucaaaugguaggcauuuccu

SEQ ID NO: 1905727 - RNA, 21 nt, Human
ucaaaugguaggcauuuccua

SEQ ID NO: 1905728 - RNA, 18 nt, Human
ucaauguuucuucuaggu

SEQ ID NO: 1905729 - RNA, 22 nt, Human
ucaauaaaaaaaagaaaugaaa

SEQ ID NO: 1905730 - RNA, 18 nt, Human
ucaauguuuuuaaaaauc

SEQ ID NO: 1905731 - RNA, 14 nt, Human
ucaauguuuuuaaa

SEQ ID NO: 1905732 - RNA, 19 nt, Human
ucaauuagaauaguguucu

SEQ ID NO: 1905733 - RNA, 14 nt, Human
ucaauuccaccugc

SEQ ID NO: 1905734 - RNA, 23 nt, Human
ucaauuccaacacugauuucccc

SEQ ID NO: 1905735 - RNA, 22 nt, Human
ucacaagacccaaaaggcagaa

SEQ ID NO: 1905736 - RNA, 14 nt, Human
ucaauuccucuggg

SEQ ID NO: 1905737 - RNA, 18 nt, Human
ucacaagggacgcuuugg

SEQ ID NO: 1905738 - RNA, 20 nt, Human
ucacaagggacgcuuuggga

SEQ ID NO: 1905739 - RNA, 19 nt, Human
ucacacacagacuguuguc

SEQ ID NO: 1905740 - RNA, 22 nt, Human
ucacacacagacuguugucccu

SEQ ID NO: 1905741 - RNA, 15 nt, Human
ucacacacuuuggcu

SEQ ID NO: 1905742 - RNA, 12 nt, Human
ucacacacugau

SEQ ID NO: 1905743 - RNA, 22 nt, Human
ucacacaugagcaucaggccag

SEQ ID NO: 1905744 - RNA, 23 nt, Human
ucacacaugagcaucaggccagg

SEQ ID NO: 1905745 - RNA, 23 nt, Human
ucacaccaggcuugccugcaggc

SEQ ID NO: 1905746 - RNA, 22 nt, Human
ucacaccaggcuugccugcagg

SEQ ID NO: 1905747 - RNA, 21 nt, Human
ucacaccaggcuugccugcag

SEQ ID NO: 1905748 - RNA, 14 nt, Human
ucacauuggaaaca

SEQ ID NO: 1905749 - RNA, 20 nt, Human
ucacauuccugaacaggaua

SEQ ID NO: 1905750 - RNA, 12 nt, Human
ucacauuuaaau

SEQ ID NO: 1905751 - RNA, 22 nt, Human
ucacauuguauucagaguugau

SEQ ID NO: 1905752 - RNA, 17 nt, Human
ucacauuggaaacaagu

SEQ ID NO: 1905753 - RNA, 14 nt, Human
ucacauuuauucug

SEQ ID NO: 1905754 - RNA, 21 nt, Human
ucaccaaaucagcugcuacua

SEQ ID NO: 1905755 - RNA, 17 nt, Human
ucaccaacgucugugcc

SEQ ID NO: 1905756 - RNA, 18 nt, Human
ucaccaacgucugugcca

SEQ ID NO: 1905757 - RNA, 13 nt, Human
ucaccaagcccag

SEQ ID NO: 1905758 - RNA, 20 nt, Human
ucaccacucaaaggccagac

SEQ ID NO: 1905759 - RNA, 22 nt, Human
ucaccacucaaaggccagaccu

SEQ ID NO: 1905760 - RNA, 23 nt, Human
ucaccacucaaaggccagaccug

SEQ ID NO: 1905761 - RNA, 18 nt, Human
ucacccgcuaagagggag

SEQ ID NO: 1905762 - RNA, 22 nt, Human
ucaccccugguucucaucuuuc

SEQ ID NO: 1905763 - RNA, 21 nt, Human
ucaccccugguucucaucuuu

SEQ ID NO: 1905764 - RNA, 22 nt, Human
ucaccgaaaacguggcugcuuc

SEQ ID NO: 1905765 - RNA, 23 nt, Human
ucaccgaaaacguggcugcuuca

SEQ ID NO: 1905766 - RNA, 15 nt, Human
ucaccgaaaacgugg

SEQ ID NO: 1905767 - RNA, 19 nt, Human
ucaccgaaaacguggcugc

SEQ ID NO: 1905768 - RNA, 20 nt, Human
ucaccgaaaacguggcugcu

SEQ ID NO: 1905769 - RNA, 21 nt, Human
ucaccgaaaacguggcugcuu

SEQ ID NO: 1905770 - RNA, 19 nt, Human
ucacccgcuaagagggagg

SEQ ID NO: 1905771 - RNA, 23 nt, Human
ucacccugauuuaggagaagcca

SEQ ID NO: 1905772 - RNA, 12 nt, Human
ucacccuuuucu

SEQ ID NO: 1905773 - RNA, 14 nt, Human
ucaccgaaaacgug

SEQ ID NO: 1905774 - RNA, 16 nt, Human
uauggacucugcacau

SEQ ID NO: 1905775 - RNA, 12 nt, Human
uauggacucugc

SEQ ID NO: 1905776 - RNA, 15 nt, Human
uauggacucugcaca

SEQ ID NO: 1905777 - RNA, 15 nt, Human
uauggagagaaaaca

SEQ ID NO: 1905778 - RNA, 14 nt, Human
uauggaggcaggag

SEQ ID NO: 1905779 - RNA, 13 nt, Human
uauguguguuuua

SEQ ID NO: 1905780 - RNA, 21 nt, Human
uauguugcccaggcaggucuu

SEQ ID NO: 1905781 - RNA, 12 nt, Human
uauguugaauac

SEQ ID NO: 1905782 - RNA, 15 nt, Human
uauguugaauacuuu

SEQ ID NO: 1905783 - RNA, 18 nt, Human
uauguugguagauucuaa

SEQ ID NO: 1905784 - RNA, 22 nt, Human
uauguucuuaguggauguucug

SEQ ID NO: 1905785 - RNA, 16 nt, Human
uauguucagaagaaau

SEQ ID NO: 1905786 - RNA, 17 nt, Human
uauguucuaagaaguga

SEQ ID NO: 1905787 - RNA, 16 nt, Human
uauuaagaaagacuau

SEQ ID NO: 1905788 - RNA, 17 nt, Human
uauuaaauggaaacuga

SEQ ID NO: 1905789 - RNA, 15 nt, Human
uauuaaaugcccagc

SEQ ID NO: 1905790 - RNA, 17 nt, Human
uauuaaaugcccagccc

SEQ ID NO: 1905791 - RNA, 19 nt, Human
uauuaaaugcccagccccu

SEQ ID NO: 1905792 - RNA, 15 nt, Human
uauuaucaacaauag

SEQ ID NO: 1905793 - RNA, 13 nt, Human
uauuauuuauaua

SEQ ID NO: 1905794 - RNA, 16 nt, Human
uauuauuuucaccugu

SEQ ID NO: 1905795 - RNA, 15 nt, Human
uauuauuuucaccug

SEQ ID NO: 1905796 - RNA, 20 nt, Human
uauuauggaggcaggaguuu

SEQ ID NO: 1905797 - RNA, 17 nt, Human
uauuauauuuacaaaug

SEQ ID NO: 1905798 - RNA, 14 nt, Human
uauuauaccuuuuu

SEQ ID NO: 1905799 - RNA, 19 nt, Human
uauuauaauuuuuuucaau

SEQ ID NO: 1905800 - RNA, 13 nt, Human
uauuauaccuuuu

SEQ ID NO: 1905801 - RNA, 12 nt, Human
uauuauaccuuu

SEQ ID NO: 1905802 - RNA, 15 nt, Human
uauuaaguuguuaau

SEQ ID NO: 1905803 - RNA, 14 nt, Human
uauuaaggaagaca

SEQ ID NO: 1905804 - RNA, 22 nt, Human
uauugcagcgauuaauaacagg

SEQ ID NO: 1905805 - RNA, 22 nt, Human
uauugcauuuggauuggggucc

SEQ ID NO: 1905806 - RNA, 20 nt, Human
uauugauaugcuuauacacu

SEQ ID NO: 1905807 - RNA, 16 nt, Human
uauucauuuuuguuau

SEQ ID NO: 1905808 - RNA, 15 nt, Human
uauugcccacgcugg

SEQ ID NO: 1905809 - RNA, 14 nt, Human
uauugcccacgcug

SEQ ID NO: 1905810 - RNA, 13 nt, Human
uauugcccacgcu

SEQ ID NO: 1905811 - RNA, 15 nt, Human
uauugcuugcacaaa

SEQ ID NO: 1905812 - RNA, 23 nt, Human
uauugcugauggugcaaugaccu

SEQ ID NO: 1905813 - RNA, 22 nt, Human
uauugcugauggugcaaugacc

SEQ ID NO: 1905814 - RNA, 23 nt, Human
uauuguuccagcaguuuucaagu

SEQ ID NO: 1905815 - RNA, 22 nt, Human
uauuuauuaaaugcccagcccc

SEQ ID NO: 1905816 - RNA, 13 nt, Human
uauuuauguuugc

SEQ ID NO: 1905817 - RNA, 19 nt, Human
uauuuauuauuuucaccug

SEQ ID NO: 1905818 - RNA, 14 nt, Human
uauuuauuauuuau

SEQ ID NO: 1905819 - RNA, 21 nt, Human
uauuugaauguaugcuucaua

SEQ ID NO: 1905820 - RNA, 17 nt, Human
uauuuaugggauccugg

SEQ ID NO: 1905821 - RNA, 13 nt, Human
uauuuaucuucau

SEQ ID NO: 1905822 - RNA, 15 nt, Human
uauuuaucugauuaa

SEQ ID NO: 1905823 - RNA, 16 nt, Human
uauuuaucugauuaag

SEQ ID NO: 1905824 - RNA, 21 nt, Human
uauuuaucugauuaaguuguc

SEQ ID NO: 1905825 - RNA, 15 nt, Human
uauuuauauguacau

SEQ ID NO: 1905826 - RNA, 17 nt, Human
uauuuauauguacauga

SEQ ID NO: 1905827 - RNA, 20 nt, Human
ucauuuacuguggcuucuua

SEQ ID NO: 1905828 - RNA, 15 nt, Human
ucauuuacuguggcu

SEQ ID NO: 1905829 - RNA, 13 nt, Human
ucauuuacugugg

SEQ ID NO: 1905830 - RNA, 11 nt, Human
ucauuuacugu

SEQ ID NO: 1905831 - RNA, 22 nt, Human
ucauuuauaaagcuaaaauaac

SEQ ID NO: 1905832 - RNA, 15 nt, Human
ucauuuacuguuuua

SEQ ID NO: 1905833 - RNA, 16 nt, Human
ucauuaggauggcuag

SEQ ID NO: 1905834 - RNA, 14 nt, Human
ucauggugcucaga

SEQ ID NO: 1905835 - RNA, 16 nt, Human
ucauggucucagucau

SEQ ID NO: 1905836 - RNA, 13 nt, Human
uccaaaguacacu

SEQ ID NO: 1905837 - RNA, 20 nt, Human
uccaaagaguagaauugcau

SEQ ID NO: 1905838 - RNA, 13 nt, Human
uccaaaccuucac

SEQ ID NO: 1905839 - RNA, 14 nt, Human
uccaaaccuucaca

SEQ ID NO: 1905840 - RNA, 18 nt, Human
uccaaaccuucacacaca

SEQ ID NO: 1905841 - RNA, 22 nt, Human
uccaaaccuucacacacagacu

SEQ ID NO: 1905842 - RNA, 23 nt, Human
uccaaaccuucacacacagacug

SEQ ID NO: 1905843 - RNA, 13 nt, Human
uccaaaacugccu

SEQ ID NO: 1905844 - RNA, 12 nt, Human
uccaaaacugcc

SEQ ID NO: 1905845 - RNA, 14 nt, Human
uccaaaagaagccc

SEQ ID NO: 1905846 - RNA, 15 nt, Human
uccaaaagaagcccc

SEQ ID NO: 1905847 - RNA, 18 nt, Human
uccaaaagaagcccccag

SEQ ID NO: 1905848 - RNA, 21 nt, Human
uccaaaagaagcccccagcua

SEQ ID NO: 1905849 - RNA, 14 nt, Human
ucaucauccuaagc

SEQ ID NO: 1905850 - RNA, 17 nt, Human
ucaucaaugaaugaaug

SEQ ID NO: 1905851 - RNA, 12 nt, Human
ucauagcagcuu

SEQ ID NO: 1905852 - RNA, 15 nt, Human
ucauagauguuuccu

SEQ ID NO: 1905853 - RNA, 18 nt, Human
ucauagcagauuuuaauu

SEQ ID NO: 1905854 - RNA, 11 nt, Human
ucauagcagcu

SEQ ID NO: 1905855 - RNA, 20 nt, Human
ucaguguacauggaauaaca

SEQ ID NO: 1905856 - RNA, 18 nt, Human
ucaguguaccauuugccu

SEQ ID NO: 1905857 - RNA, 19 nt, Human
ucaguguaccauuugccuc

SEQ ID NO: 1905858 - RNA, 17 nt, Human
ucauccacugugccaug

SEQ ID NO: 1905859 - RNA, 14 nt, Human
ucauccacugugcc

SEQ ID NO: 1905860 - RNA, 18 nt, Human
ucauccacugugccaugu

SEQ ID NO: 1905861 - RNA, 16 nt, Human
ucaucuccccaucauu

SEQ ID NO: 1905862 - RNA, 22 nt, Human
ucaucucccaccuagcagcacc

SEQ ID NO: 1905863 - RNA, 12 nt, Human
ucaucucccacc

SEQ ID NO: 1905864 - RNA, 17 nt, Human
ucaugcuguucaugaaa

SEQ ID NO: 1905865 - RNA, 13 nt, Human
ucauggucucagu

SEQ ID NO: 1905866 - RNA, 21 nt, Human
ucaggccugggggcugggcag

SEQ ID NO: 1905867 - RNA, 11 nt, Human
ucaggccucug

SEQ ID NO: 1905868 - RNA, 12 nt, Human
ucaggaguuccu

SEQ ID NO: 1905869 - RNA, 23 nt, Human
ucaggaucucuuagcauuuuaau

SEQ ID NO: 1905870 - RNA, 11 nt, Human
ucaggagcccu

SEQ ID NO: 1905871 - RNA, 12 nt, Human
ucaggagcccug

SEQ ID NO: 1905872 - RNA, 14 nt, Human
ucaggagcccuggg

SEQ ID NO: 1905873 - RNA, 15 nt, Human
ucaggagcccuggga

SEQ ID NO: 1905874 - RNA, 13 nt, Human
ucaggacacuaau

SEQ ID NO: 1905875 - RNA, 12 nt, Human
ucaggacacuaa

SEQ ID NO: 1905876 - RNA, 24 nt, Human
ucagcuccagcucaccagccccag

SEQ ID NO: 1905877 - RNA, 23 nt, Human
ucagcuccagcucaccagcccca

SEQ ID NO: 1905878 - RNA, 23 nt, Human
ucagcucugcaagaauugaagca

SEQ ID NO: 1905879 - RNA, 19 nt, Human
ucagcucugggccauucuc

SEQ ID NO: 1905880 - RNA, 19 nt, Human
ucagcucuuggcuccacug

SEQ ID NO: 1905881 - RNA, 23 nt, Human
ucaggaagcucagggccuggcuc

SEQ ID NO: 1905882 - RNA, 16 nt, Human
ucagcuguaguccuca

SEQ ID NO: 1905883 - RNA, 20 nt, Human
ucagguggggcagcuugagg

SEQ ID NO: 1905884 - RNA, 16 nt, Human
ucagucaauauuuuua

SEQ ID NO: 1905885 - RNA, 13 nt, Human
ucagucacagcca

SEQ ID NO: 1905886 - RNA, 14 nt, Human
ucagucacagccac

SEQ ID NO: 1905887 - RNA, 15 nt, Human
ucagucacagccacc

SEQ ID NO: 1905888 - RNA, 23 nt, Human
ucagucugauucccaagcucugc

SEQ ID NO: 1905889 - RNA, 22 nt, Human
ucagucugauucccaagcucug

SEQ ID NO: 1905890 - RNA, 21 nt, Human
ucagucugauucccaagcucu

SEQ ID NO: 1905891 - RNA, 19 nt, Human
ucagguggggcagcuugag

SEQ ID NO: 1905892 - RNA, 18 nt, Human
ucagguggggcagcuuga

SEQ ID NO: 1905893 - RNA, 23 nt, Human
ucaggugauccacccaccucagc

SEQ ID NO: 1905894 - RNA, 16 nt, Human
ucaggugauccaccca

SEQ ID NO: 1905895 - RNA, 23 nt, Human
ucaggugagaagcagaggaagga

SEQ ID NO: 1905896 - RNA, 16 nt, Human
ucaggucaggaguucg

SEQ ID NO: 1905897 - RNA, 11 nt, Human
ucccaggacac

SEQ ID NO: 1905898 - RNA, 11 nt, Human
ucccaggaccc

SEQ ID NO: 1905899 - RNA, 23 nt, Human
ucccaggcauuccccaggaggcc

SEQ ID NO: 1905900 - RNA, 12 nt, Human
ucccaggacccu

SEQ ID NO: 1905901 - RNA, 24 nt, Human
ucccaggcauuccccaggaggcca

SEQ ID NO: 1905902 - RNA, 22 nt, Human
ucccagcugugcucuggacagg

SEQ ID NO: 1905903 - RNA, 21 nt, Human
ucccagcugugcucuggacag

SEQ ID NO: 1905904 - RNA, 23 nt, Human
ucccagcugugcucuggacaggc

SEQ ID NO: 1905905 - RNA, 19 nt, Human
ucccaugagccucagcauc

SEQ ID NO: 1905906 - RNA, 18 nt, Human
ucccaugagccucagcau

SEQ ID NO: 1905907 - RNA, 21 nt, Human
ucccaucugugaaaggaaaga

SEQ ID NO: 1905908 - RNA, 15 nt, Human
ucccaucuuccaagg

SEQ ID NO: 1905909 - RNA, 18 nt, Human
ucccaccuuggcugcagg

SEQ ID NO: 1905910 - RNA, 20 nt, Human
ucccagcugugcucuggaca

SEQ ID NO: 1905911 - RNA, 17 nt, Human
ucccaccuuggcugcag

SEQ ID NO: 1905912 - RNA, 16 nt, Human
ucccaccuuggcugca

SEQ ID NO: 1905913 - RNA, 13 nt, Human
ucccaccuuggcu

SEQ ID NO: 1905914 - RNA, 22 nt, Human
uccauucacaguucuuugggcc

SEQ ID NO: 1905915 - RNA, 20 nt, Human
uccaugugggcuaguugggc

SEQ ID NO: 1905916 - RNA, 22 nt, Human
ucccaccucucucacuccuuga

SEQ ID NO: 1905917 - RNA, 18 nt, Human
uccccagauugcaacagg

SEQ ID NO: 1905918 - RNA, 13 nt, Human
uccccagauugca

SEQ ID NO: 1905919 - RNA, 22 nt, Human
uccccagagaaaggggagccca

SEQ ID NO: 1905920 - RNA, 23 nt, Human
uccccagagaaaggggagcccac

SEQ ID NO: 1905921 - RNA, 20 nt, Human
ucccaugagccucagcaucc

SEQ ID NO: 1905922 - RNA, 22 nt, Human
uccccagcaagugagagcuggg

SEQ ID NO: 1905923 - RNA, 21 nt, Human
uccccagcaagugagagcugg

SEQ ID NO: 1905924 - RNA, 20 nt, Human
uccccagcaagugagagcug

SEQ ID NO: 1905925 - RNA, 23 nt, Human
uccccagauugcaacaggcuggg

SEQ ID NO: 1905926 - RNA, 22 nt, Human
uccccagauugcaacaggcugg

SEQ ID NO: 1905927 - RNA, 20 nt, Human
uccccagauugcaacaggcu

SEQ ID NO: 1905928 - RNA, 19 nt, Human
uccccagauugcaacaggc

SEQ ID NO: 1905929 - RNA, 22 nt, Human
ucccccagccccauccucugua

SEQ ID NO: 1905930 - RNA, 20 nt, Human
ucccccagccccauccucug

SEQ ID NO: 1905931 - RNA, 21 nt, Human
ucccccagccccauccucugu

SEQ ID NO: 1905932 - RNA, 15 nt, Human
uccccaggaggccag

SEQ ID NO: 1905933 - RNA, 16 nt, Human
uccccaggaggccagc

SEQ ID NO: 1905934 - RNA, 17 nt, Human
ucccccagccccauccu

SEQ ID NO: 1905935 - RNA, 17 nt, Human
uccccaggaggccagcc

SEQ ID NO: 1905936 - RNA, 14 nt, Human
uccccaggaggcca

SEQ ID NO: 1905937 - RNA, 12 nt, Human
uccccagcccag

SEQ ID NO: 1905938 - RNA, 13 nt, Human
uccccagcccaga

SEQ ID NO: 1905939 - RNA, 14 nt, Human
uccccagcccagag

SEQ ID NO: 1905940 - RNA, 15 nt, Human
uccccagcccagaga

SEQ ID NO: 1905941 - RNA, 16 nt, Human
uccccagcccagagac

SEQ ID NO: 1905942 - RNA, 17 nt, Human
uccccagcccagagaca

SEQ ID NO: 1905943 - RNA, 12 nt, Human
uccauaaucacu

SEQ ID NO: 1905944 - RNA, 20 nt, Human
uccaguuuuuuguuauauag

SEQ ID NO: 1905945 - RNA, 20 nt, Human
uccagguuuaagcuguuacu

SEQ ID NO: 1905946 - RNA, 22 nt, Human
uccaggggugggacacccugug

SEQ ID NO: 1905947 - RNA, 17 nt, Human
uccagggugugugcucg

SEQ ID NO: 1905948 - RNA, 20 nt, Human
uccaugggccauaugaaaag

SEQ ID NO: 1905949 - RNA, 14 nt, Human
uccauagagagcaa

SEQ ID NO: 1905950 - RNA, 15 nt, Human
uccauagagagcaag

SEQ ID NO: 1905951 - RNA, 14 nt, Human
uccagcaccacacu

SEQ ID NO: 1905952 - RNA, 15 nt, Human
uccagcucuuuccuc

SEQ ID NO: 1905953 - RNA, 18 nt, Human
uccagcucuuuccuccuu

SEQ ID NO: 1905954 - RNA, 21 nt, Human
uccagcucuuuccuccuucca

SEQ ID NO: 1905955 - RNA, 16 nt, Human
uccagcugagcgccag

SEQ ID NO: 1905956 - RNA, 19 nt, Human
uccaggggugggacacccu

SEQ ID NO: 1905957 - RNA, 20 nt, Human
uccaggggugggacacccug

SEQ ID NO: 1905958 - RNA, 12 nt, Human
uccaggagcagc

SEQ ID NO: 1905959 - RNA, 13 nt, Human
uccaggagcagcc

SEQ ID NO: 1905960 - RNA, 14 nt, Human
uccaggagcagcca

SEQ ID NO: 1905961 - RNA, 15 nt, Human
uccaggagcagccac

SEQ ID NO: 1905962 - RNA, 23 nt, Human
uccagaaagaaaacuuguauuau

SEQ ID NO: 1905963 - RNA, 20 nt, Human
uccacuuuuuuuuguauguu

SEQ ID NO: 1905964 - RNA, 20 nt, Human
uccacuuucuagccagagga

SEQ ID NO: 1905965 - RNA, 21 nt, Human
uccacuuucuagccagaggag

SEQ ID NO: 1905966 - RNA, 23 nt, Human
uccacuuggucugugagaugcua

SEQ ID NO: 1905967 - RNA, 19 nt, Human
uccacuuucuagccagagg

SEQ ID NO: 1905968 - RNA, 16 nt, Human
uccaaaguacacuguu

SEQ ID NO: 1905969 - RNA, 14 nt, Human
uccaaaguacacug

SEQ ID NO: 1905970 - RNA, 17 nt, Human
uccacuuggucugugag

SEQ ID NO: 1905971 - RNA, 21 nt, Human
uccacuuggucugugagaugc

SEQ ID NO: 1905972 - RNA, 16 nt, Human
uccugagaccacagag

SEQ ID NO: 1905973 - RNA, 23 nt, Human
uccugagccagugucaggaggaa

SEQ ID NO: 1905974 - RNA, 23 nt, Human
uccugacugucucccgggacuac

SEQ ID NO: 1905975 - RNA, 13 nt, Human
uccuccucccugc

SEQ ID NO: 1905976 - RNA, 14 nt, Human
uccuccucccugca

SEQ ID NO: 1905977 - RNA, 17 nt, Human
uccuccucccugcaucu

SEQ ID NO: 1905978 - RNA, 18 nt, Human
uccuccucccugcaucug

SEQ ID NO: 1905979 - RNA, 21 nt, Human
uccugaggcuccacuuggucu

SEQ ID NO: 1905980 - RNA, 20 nt, Human
uccugaggcuccacuugguc

SEQ ID NO: 1905981 - RNA, 19 nt, Human
uccugaggcuccacuuggu

SEQ ID NO: 1905982 - RNA, 13 nt, Human
uccugccaggcau

SEQ ID NO: 1905983 - RNA, 14 nt, Human
uccugccaggcaug

SEQ ID NO: 1905984 - RNA, 18 nt, Human
uccugccccugagcccau

SEQ ID NO: 1905985 - RNA, 17 nt, Human
uccugccccugagccca

SEQ ID NO: 1905986 - RNA, 23 nt, Human
uccuggcacccggccccugcugg

SEQ ID NO: 1905987 - RNA, 13 nt, Human
uccuggcacugcu

SEQ ID NO: 1905988 - RNA, 16 nt, Human
uccuggcacugcuucc

SEQ ID NO: 1905989 - RNA, 12 nt, Human
uccuggccucaa

SEQ ID NO: 1905990 - RNA, 11 nt, Human
uccuguagccc

SEQ ID NO: 1905991 - RNA, 13 nt, Human
uccuguagcccua

SEQ ID NO: 1905992 - RNA, 14 nt, Human
uccuggaguucugg

SEQ ID NO: 1905993 - RNA, 15 nt, Human
uccuggaggcccagu

SEQ ID NO: 1905994 - RNA, 18 nt, Human
uccuggaggcccaguuca

SEQ ID NO: 1905995 - RNA, 22 nt, Human
uccuggagcccagaggagggca

SEQ ID NO: 1905996 - RNA, 13 nt, Human
uccuggaggccca

SEQ ID NO: 1905997 - RNA, 14 nt, Human
uccuggaggcccag

SEQ ID NO: 1905998 - RNA, 18 nt, Human
uccuggagcccagaggag

SEQ ID NO: 1905999 - RNA, 15 nt, Human
uccuggagcccagag

SEQ ID NO: 1906000 - RNA, 20 nt, Human
uccugcccuuaccugccagg

SEQ ID NO: 1906001 - RNA, 17 nt, Human
uccugccgcagagcugg

SEQ ID NO: 1906002 - RNA, 16 nt, Human
uccugccgcagagcug

SEQ ID NO: 1906003 - RNA, 15 nt, Human
uccugccgcagagcu

SEQ ID NO: 1906004 - RNA, 13 nt, Human
uccugccgcagag

SEQ ID NO: 1906005 - RNA, 20 nt, Human
uccugccgcagagcuggccg

SEQ ID NO: 1906006 - RNA, 18 nt, Human
uccugccgcagagcuggc

SEQ ID NO: 1906007 - RNA, 17 nt, Human
uccugcccuuaccugcc

SEQ ID NO: 1906008 - RNA, 12 nt, Human
uccuaguuccac

SEQ ID NO: 1906009 - RNA, 21 nt, Human
uccuaguuaaucaucauuuuu

SEQ ID NO: 1906010 - RNA, 23 nt, Human
uccuauauuguuuucaguguaca

SEQ ID NO: 1906011 - RNA, 19 nt, Human
uccuaucaccuauuuccau

SEQ ID NO: 1906012 - RNA, 15 nt, Human
uccuacccugcgccc

SEQ ID NO: 1906013 - RNA, 18 nt, Human
uccucauuagcauuuugc

SEQ ID NO: 1906014 - RNA, 17 nt, Human
uccuccaacaccaagca

SEQ ID NO: 1906015 - RNA, 22 nt, Human
uccuccaacaccaagcacagca

SEQ ID NO: 1906016 - RNA, 12 nt, Human
uccuccaagcca

SEQ ID NO: 1906017 - RNA, 14 nt, Human
uccuccaagccagc

SEQ ID NO: 1906018 - RNA, 10 nt, Human
uccuccaggu

SEQ ID NO: 1906019 - RNA, 13 nt, Human
uccucccaccuca

SEQ ID NO: 1906020 - RNA, 12 nt, Human
uccucccaccuc

SEQ ID NO: 1906021 - RNA, 20 nt, Human
uccucccaauuucagacucc

SEQ ID NO: 1906022 - RNA, 21 nt, Human
uccucccaauuucagacuccc

SEQ ID NO: 1906023 - RNA, 17 nt, Human
uccuccaucgcaguguu

SEQ ID NO: 1906024 - RNA, 16 nt, Human
uccgcuuucuacccag

SEQ ID NO: 1906025 - RNA, 20 nt, Human
uccgcuuucuacccagcgag

SEQ ID NO: 1906026 - RNA, 18 nt, Human
uccgcuuucuacccagcg

SEQ ID NO: 1906027 - RNA, 20 nt, Human
uccuaagcuauucaguaaua

SEQ ID NO: 1906028 - RNA, 21 nt, Human
uccuaagcuauucaguaauaa

SEQ ID NO: 1906029 - RNA, 14 nt, Human
uccgccucuugggu

SEQ ID NO: 1906030 - RNA, 15 nt, Human
ucccuuccucuuucc

SEQ ID NO: 1906031 - RNA, 16 nt, Human
ucccuuccucuuucca

SEQ ID NO: 1906032 - RNA, 22 nt, Human
ucccccuucacaaagcccaagg

SEQ ID NO: 1906033 - RNA, 14 nt, Human
ucccccuucacaaa

SEQ ID NO: 1906034 - RNA, 15 nt, Human
ucccccuucacaaag

SEQ ID NO: 1906035 - RNA, 15 nt, Human
ucccccuuccaugga

SEQ ID NO: 1906036 - RNA, 13 nt, Human
ucccccccaugca

SEQ ID NO: 1906037 - RNA, 17 nt, Human
ucccccccaugcacugu

SEQ ID NO: 1906038 - RNA, 18 nt, Human
ucccccccaugcacugug

SEQ ID NO: 1906039 - RNA, 13 nt, Human
ucgugacaacacu

SEQ ID NO: 1906040 - RNA, 16 nt, Human
ucggcagauacugucu

SEQ ID NO: 1906041 - RNA, 16 nt, Human
ucggauuuggggugga

SEQ ID NO: 1906042 - RNA, 20 nt, Human
ucggaucuggggcucuggga

SEQ ID NO: 1906043 - RNA, 14 nt, Human
uccuuagaagugga

SEQ ID NO: 1906044 - RNA, 15 nt, Human
uccuuagaacauuuu

SEQ ID NO: 1906045 - RNA, 20 nt, Human
uccuuagaacauuuuaauuc

SEQ ID NO: 1906046 - RNA, 20 nt, Human
ucgugguaggacuguagaaa

SEQ ID NO: 1906047 - RNA, 15 nt, Human
ucgugguaggacugu

SEQ ID NO: 1906048 - RNA, 14 nt, Human
ucgugguaggacug

SEQ ID NO: 1906049 - RNA, 20 nt, Human
ucuaaaggcuaccuuuguau

SEQ ID NO: 1906050 - RNA, 19 nt, Human
ucuaaaggcuaccuuugua

SEQ ID NO: 1906051 - RNA, 17 nt, Human
ucuaaaggcuaccuuug

SEQ ID NO: 1906052 - RNA, 18 nt, Human
ucuaaaggcuaccuuugu

SEQ ID NO: 1906053 - RNA, 17 nt, Human
ucuaugacacaugcaag

SEQ ID NO: 1906054 - RNA, 14 nt, Human
ucuaugacacaugc

SEQ ID NO: 1906055 - RNA, 15 nt, Human
ucuaggaagacuuug

SEQ ID NO: 1906056 - RNA, 16 nt, Human
ucuaggaagacuuugg

SEQ ID NO: 1906057 - RNA, 19 nt, Human
ucuaggaagacuuuggaaa

SEQ ID NO: 1906058 - RNA, 21 nt, Human
ucuaggaagacuuuggaaaga

SEQ ID NO: 1906059 - RNA, 18 nt, Human
ucuacuugcucuggaccu

SEQ ID NO: 1906060 - RNA, 17 nt, Human
ucuacuugcucuggacc

SEQ ID NO: 1906061 - RNA, 14 nt, Human
ucuagugccuucua

SEQ ID NO: 1906062 - RNA, 18 nt, Human
ucuagugccuucuaaagg

SEQ ID NO: 1906063 - RNA, 23 nt, Human
ucuagugccuucuaaagguguug

SEQ ID NO: 1906064 - RNA, 16 nt, Human
ucuacagaggccaugg

SEQ ID NO: 1906065 - RNA, 15 nt, Human
ucuacagaggccaug

SEQ ID NO: 1906066 - RNA, 16 nt, Human
ucuacacauacaugua

SEQ ID NO: 1906067 - RNA, 23 nt, Human
ucuacaaucucccuucacaaguu

SEQ ID NO: 1906068 - RNA, 15 nt, Human
ucuacaaugugaacu

SEQ ID NO: 1906069 - RNA, 17 nt, Human
ucuacaaugugaacuuu

SEQ ID NO: 1906070 - RNA, 19 nt, Human
ucuacaaugugaacuuuau

SEQ ID NO: 1906071 - RNA, 20 nt, Human
ucuacaaugugaacuuuauu

SEQ ID NO: 1906072 - RNA, 14 nt, Human
ucuaccuuccugca

SEQ ID NO: 1906073 - RNA, 13 nt, Human
ucuacuugcucug

SEQ ID NO: 1906074 - RNA, 14 nt, Human
ucuacuugcucugg

SEQ ID NO: 1906075 - RNA, 15 nt, Human
ucuacuugcucugga

SEQ ID NO: 1906076 - RNA, 16 nt, Human
ucuacuugcucuggac

SEQ ID NO: 1906077 - RNA, 19 nt, Human
ucuacugggagccuaccca

SEQ ID NO: 1906078 - RNA, 16 nt, Human
ucuacugggagccuac

SEQ ID NO: 1906079 - RNA, 23 nt, Human
ucucaguccaugaagauguagag

SEQ ID NO: 1906080 - RNA, 13 nt, Human
ucuaugggacuca

SEQ ID NO: 1906081 - RNA, 12 nt, Human
ucuaugggacuc

SEQ ID NO: 1906082 - RNA, 19 nt, Human
ucuaugggacucaaugcac

SEQ ID NO: 1906083 - RNA, 16 nt, Human
ucucauacucaccuca

SEQ ID NO: 1906084 - RNA, 18 nt, Human
ucucauacucaccucacc

SEQ ID NO: 1906085 - RNA, 15 nt, Human
ucucauccugcaggc

SEQ ID NO: 1906086 - RNA, 13 nt, Human
ucucauccugcag

SEQ ID NO: 1906087 - RNA, 17 nt, Human
ucucaucucuuagcucc

SEQ ID NO: 1906088 - RNA, 19 nt, Human
ucucaucgccagacaacug

SEQ ID NO: 1906089 - RNA, 20 nt, Human
ucucaucucuuagcuccccu

SEQ ID NO: 1906090 - RNA, 12 nt, Human
ucucaucuuucu

SEQ ID NO: 1906091 - RNA, 22 nt, Human
ucucaucuuucuugaucaacau

SEQ ID NO: 1906092 - RNA, 13 nt, Human
ucucaucuuucuu

SEQ ID NO: 1906093 - RNA, 16 nt, Human
ucuccacccugcucuc

SEQ ID NO: 1906094 - RNA, 14 nt, Human
ucuccacccugcuc

SEQ ID NO: 1906095 - RNA, 17 nt, Human
ucuccacccugcucucc

SEQ ID NO: 1906096 - RNA, 13 nt, Human
ucuccacccugcu

SEQ ID NO: 1906097 - RNA, 18 nt, Human
ucucaugccccuggcugg

SEQ ID NO: 1906098 - RNA, 21 nt, Human
ucucaugccccuggcugggac

SEQ ID NO: 1906099 - RNA, 15 nt, Human
ucucaugauuuacag

SEQ ID NO: 1906100 - RNA, 22 nt, Human
ucuccaccugccagggacagag

SEQ ID NO: 1906101 - RNA, 17 nt, Human
ucuccaccugccaggga

SEQ ID NO: 1906102 - RNA, 19 nt, Human
ucuccaccugccagggaca

SEQ ID NO: 1906103 - RNA, 14 nt, Human
ucuccaccugccag

SEQ ID NO: 1906104 - RNA, 15 nt, Human
ucuccaccugccagg

SEQ ID NO: 1906105 - RNA, 16 nt, Human
ucuccaccugccaggg

SEQ ID NO: 1906106 - RNA, 13 nt, Human
ucucccccagccc

SEQ ID NO: 1906107 - RNA, 18 nt, Human
ucuccccucagagugcaa

SEQ ID NO: 1906108 - RNA, 13 nt, Human
ucuccccucagag

SEQ ID NO: 1906109 - RNA, 12 nt, Human
ucucccccagcc

SEQ ID NO: 1906110 - RNA, 20 nt, Human
ucucccccacccccuccccg

SEQ ID NO: 1906111 - RNA, 19 nt, Human
ucucccccacccccucccc

SEQ ID NO: 1906112 - RNA, 11 nt, Human
ucuccaggcug

SEQ ID NO: 1906113 - RNA, 15 nt, Human
ucucccccacccccu

SEQ ID NO: 1906114 - RNA, 12 nt, Human
ucucccccaccc

SEQ ID NO: 1906115 - RNA, 18 nt, Human
ucucccucagucuggccc

SEQ ID NO: 1906116 - RNA, 23 nt, Human
ucucccucagucuggcccuuccu

SEQ ID NO: 1906117 - RNA, 15 nt, Human
ucuccccugccccca

SEQ ID NO: 1906118 - RNA, 14 nt, Human
ucuccccugccccc

SEQ ID NO: 1906119 - RNA, 12 nt, Human
ucuccccugccc

SEQ ID NO: 1906120 - RNA, 16 nt, Human
ucuccccugcccccag

SEQ ID NO: 1906121 - RNA, 22 nt, Human
ucuccagccccuggaugcagcc

SEQ ID NO: 1906122 - RNA, 16 nt, Human
ucuccagccccuggau

SEQ ID NO: 1906123 - RNA, 18 nt, Human
ucuccagccccuggaugc

SEQ ID NO: 1906124 - RNA, 17 nt, Human
ucuccacucaguugcaa

SEQ ID NO: 1906125 - RNA, 14 nt, Human
ucuccagauguuuc

SEQ ID NO: 1906126 - RNA, 15 nt, Human
ucuccagauguuucc

SEQ ID NO: 1906127 - RNA, 18 nt, Human
ucuccagauguuuccaga

SEQ ID NO: 1906128 - RNA, 19 nt, Human
ucuccagauguuuccagac

SEQ ID NO: 1906129 - RNA, 12 nt, Human
ucuccagccccu

SEQ ID NO: 1906130 - RNA, 13 nt, Human
ucuccagccccug

SEQ ID NO: 1906131 - RNA, 14 nt, Human
ucuccagccccugg

SEQ ID NO: 1906132 - RNA, 15 nt, Human
ucuccagccccugga

SEQ ID NO: 1906133 - RNA, 20 nt, Human
ugaaucccacccacauguga

SEQ ID NO: 1906134 - RNA, 13 nt, Human
ugaaucuuugugc

SEQ ID NO: 1906135 - RNA, 22 nt, Human
ugaaucauuuuaccuuugacaa

SEQ ID NO: 1906136 - RNA, 23 nt, Human
ugaaucauuuuaccuuugacaaa

SEQ ID NO: 1906137 - RNA, 21 nt, Human
ugaaugaaagucuugugacua

SEQ ID NO: 1906138 - RNA, 23 nt, Human
ugaaugaaagucuugugacuagu

SEQ ID NO: 1906139 - RNA, 20 nt, Human
ugaaugaaagucuugugacu

SEQ ID NO: 1906140 - RNA, 14 nt, Human
ugaaugagaaucua

SEQ ID NO: 1906141 - RNA, 23 nt, Human
ugaaugaugauccuaggcauuug

SEQ ID NO: 1906142 - RNA, 16 nt, Human
ugaauuauuuucucuc

SEQ ID NO: 1906143 - RNA, 17 nt, Human
ugaauuaugaaacuuuu

SEQ ID NO: 1906144 - RNA, 15 nt, Human
ugaauuaugaaacuu

SEQ ID NO: 1906145 - RNA, 13 nt, Human
ugaauuaugaaac

SEQ ID NO: 1906146 - RNA, 15 nt, Human
ugaauuaucuauaca

SEQ ID NO: 1906147 - RNA, 18 nt, Human
ugaauugagcugcagaaa

SEQ ID NO: 1906148 - RNA, 20 nt, Human
ugaauugaggggauuaauau

SEQ ID NO: 1906149 - RNA, 15 nt, Human
ugaacucuuaaucaa

SEQ ID NO: 1906150 - RNA, 23 nt, Human
ugaagauaaguguauuuuucaau

SEQ ID NO: 1906151 - RNA, 14 nt, Human
ugaagauacugaaa

SEQ ID NO: 1906152 - RNA, 14 nt, Human
ugaacucuuaauca

SEQ ID NO: 1906153 - RNA, 17 nt, Human
ugaacuccuggccucaa

SEQ ID NO: 1906154 - RNA, 18 nt, Human
ugaagauacugaaauaaa

SEQ ID NO: 1906155 - RNA, 16 nt, Human
ugaagauacugaaaua

SEQ ID NO: 1906156 - RNA, 15 nt, Human
ugaagauacugaaau

SEQ ID NO: 1906157 - RNA, 20 nt, Human
ugaaggacauugcggacagc

SEQ ID NO: 1906158 - RNA, 19 nt, Human
ugaaggacauugcggacag

SEQ ID NO: 1906159 - RNA, 22 nt, Human
ugaaggacauugcggacagcca

SEQ ID NO: 1906160 - RNA, 12 nt, Human
ugaaggacccuu

SEQ ID NO: 1906161 - RNA, 18 nt, Human
ugaaggcaaaauugcaaa

SEQ ID NO: 1906162 - RNA, 15 nt, Human
ugaaggccccgccca

SEQ ID NO: 1906163 - RNA, 16 nt, Human
ugaaggccccgcccag

SEQ ID NO: 1906164 - RNA, 17 nt, Human
ugaaggccccgcccagg

SEQ ID NO: 1906165 - RNA, 21 nt, Human
ugaauaaaaacuuugcuaaau

SEQ ID NO: 1906166 - RNA, 14 nt, Human
ugaauaaaaacuuu

SEQ ID NO: 1906167 - RNA, 20 nt, Human
ugaauaaaaacuuugcuaaa

SEQ ID NO: 1906168 - RNA, 16 nt, Human
ugaccaggcauccucc

SEQ ID NO: 1906169 - RNA, 20 nt, Human
ugaccagcaccaucucuccu

SEQ ID NO: 1906170 - RNA, 16 nt, Human
ugaccauucuccaccu

SEQ ID NO: 1906171 - RNA, 17 nt, Human
ugaccauucuccaccug

SEQ ID NO: 1906172 - RNA, 18 nt, Human
ugaccauucuccaccugc

SEQ ID NO: 1906173 - RNA, 19 nt, Human
ugaccauucuccaccugcc

SEQ ID NO: 1906174 - RNA, 17 nt, Human
ugacccuguauauagcc

SEQ ID NO: 1906175 - RNA, 18 nt, Human
ugacccuguauauagccc

SEQ ID NO: 1906176 - RNA, 19 nt, Human
ugacccuguauauagccca

SEQ ID NO: 1906177 - RNA, 20 nt, Human
ugacccuguauauagcccag

SEQ ID NO: 1906178 - RNA, 13 nt, Human
ugaccgugaggcc

SEQ ID NO: 1906179 - RNA, 14 nt, Human
ugaccgugaggcca

SEQ ID NO: 1906180 - RNA, 16 nt, Human
ugaccgugaggccaga

SEQ ID NO: 1906181 - RNA, 20 nt, Human
ugaccgugaggccagagaca

SEQ ID NO: 1906182 - RNA, 13 nt, Human
ugacaugucuuuu

SEQ ID NO: 1906183 - RNA, 15 nt, Human
ugacaugucuuuucu

SEQ ID NO: 1906184 - RNA, 15 nt, Human
ugaccacagcacagc

SEQ ID NO: 1906185 - RNA, 16 nt, Human
ugaccacagcacagcc

SEQ ID NO: 1906186 - RNA, 17 nt, Human
ugaccacagcacagcca

SEQ ID NO: 1906187 - RNA, 19 nt, Human
ugaccacagcacagccaac

SEQ ID NO: 1906188 - RNA, 21 nt, Human
ugaccacgcuuucuagcuguu

SEQ ID NO: 1906189 - RNA, 19 nt, Human
ugaccagcaccaucucucc

SEQ ID NO: 1906190 - RNA, 20 nt, Human
ugaccacugcagaagacagu

SEQ ID NO: 1906191 - RNA, 22 nt, Human
ugaccacgcuuucuagcuguug

SEQ ID NO: 1906192 - RNA, 21 nt, Human
ugaauugcauuuuuuaaaaca

SEQ ID NO: 1906193 - RNA, 22 nt, Human
ugaauugcauuuuuuaaaacaa

SEQ ID NO: 1906194 - RNA, 18 nt, Human
ugacaaggauugcuacug

SEQ ID NO: 1906195 - RNA, 21 nt, Human
ugacagaacacugucuugaag

SEQ ID NO: 1906196 - RNA, 17 nt, Human
ugacagaacacugucuu

SEQ ID NO: 1906197 - RNA, 16 nt, Human
ugacagaacacugucu

SEQ ID NO: 1906198 - RNA, 15 nt, Human
ugacagaacacuguc

SEQ ID NO: 1906199 - RNA, 14 nt, Human
ugacagaacacugu

SEQ ID NO: 1906200 - RNA, 13 nt, Human
ugacagaacacug

SEQ ID NO: 1906201 - RNA, 19 nt, Human
ugacagagugagacucugu

SEQ ID NO: 1906202 - RNA, 23 nt, Human
ugacauaaguauuuaauucaugu

SEQ ID NO: 1906203 - RNA, 17 nt, Human
ugacauacauccaacau

SEQ ID NO: 1906204 - RNA, 17 nt, Human
ugacagagugagacucu

SEQ ID NO: 1906205 - RNA, 14 nt, Human
ugacagagugagac

SEQ ID NO: 1906206 - RNA, 23 nt, Human
ugacagaggcagccccauucugc

SEQ ID NO: 1906207 - RNA, 18 nt, Human
ugacagaggcagccccau

SEQ ID NO: 1906208 - RNA, 17 nt, Human
ugacagaggcagcccca

SEQ ID NO: 1906209 - RNA, 16 nt, Human
ugacagaggcagcccc

SEQ ID NO: 1906210 - RNA, 15 nt, Human
ugacagaggcagccc

SEQ ID NO: 1906211 - RNA, 14 nt, Human
ugacagaggcagcc

SEQ ID NO: 1906212 - RNA, 23 nt, Human
ugacagacacaggcccggcucca

SEQ ID NO: 1906213 - RNA, 20 nt, Human
ugacagacacaggcccggcu

SEQ ID NO: 1906214 - RNA, 13 nt, Human
ugacagaggcagc

SEQ ID NO: 1906215 - RNA, 14 nt, Human
ucuuguuucaauuc

SEQ ID NO: 1906216 - RNA, 16 nt, Human
ucuuguguguuuauug

SEQ ID NO: 1906217 - RNA, 12 nt, Human
ucuuguguuucu

SEQ ID NO: 1906218 - RNA, 21 nt, Human
ucuuguguguuuauugucaaa

SEQ ID NO: 1906219 - RNA, 17 nt, Human
ucuuucacauuuaaaua

SEQ ID NO: 1906220 - RNA, 23 nt, Human
ucuuucacccuuuucuguuugcu

SEQ ID NO: 1906221 - RNA, 15 nt, Human
ucuugcaugaggcua

SEQ ID NO: 1906222 - RNA, 17 nt, Human
ucuugcauauuuuguaa

SEQ ID NO: 1906223 - RNA, 16 nt, Human
ucucccuucauccuuc

SEQ ID NO: 1906224 - RNA, 20 nt, Human
ucuccucugcugcuggcugg

SEQ ID NO: 1906225 - RNA, 23 nt, Human
ucuugcaauggcagccuuggcaa

SEQ ID NO: 1906226 - RNA, 12 nt, Human
ucuuugccaagu

SEQ ID NO: 1906227 - RNA, 23 nt, Human
ucuuugauucuccuucagcccuc

SEQ ID NO: 1906228 - RNA, 20 nt, Human
ucuuugauucuccuucagcc

SEQ ID NO: 1906229 - RNA, 19 nt, Human
ucuuugauucuccuucagc

SEQ ID NO: 1906230 - RNA, 16 nt, Human
ucuuugauucuccuuc

SEQ ID NO: 1906231 - RNA, 15 nt, Human
ucuuugauucuccuu

SEQ ID NO: 1906232 - RNA, 12 nt, Human
ucuuucuuugga

SEQ ID NO: 1906233 - RNA, 15 nt, Human
ucuuugauccuucuc

SEQ ID NO: 1906234 - RNA, 21 nt, Human
ucuuuggacagaagcagcucu

SEQ ID NO: 1906235 - RNA, 22 nt, Human
ucuuuggacagaagcagcucuu

SEQ ID NO: 1906236 - RNA, 19 nt, Human
ucuuuggacagaagcagcu

SEQ ID NO: 1906237 - RNA, 17 nt, Human
ucuuuggacacucacac

SEQ ID NO: 1906238 - RNA, 12 nt, Human
ucuuugcuuugc

SEQ ID NO: 1906239 - RNA, 13 nt, Human
ucuuugcuuugcu

SEQ ID NO: 1906240 - RNA, 23 nt, Human
ucuuugcuuugcuuucugcucag

SEQ ID NO: 1906241 - RNA, 18 nt, Human
ucuuugcuuugcuuucug

SEQ ID NO: 1906242 - RNA, 21 nt, Human
ucuuugccaagaccuuucaaa

SEQ ID NO: 1906243 - RNA, 17 nt, Human
ucuuuccaaaguacacu

SEQ ID NO: 1906244 - RNA, 12 nt, Human
ucuuucaugagu

SEQ ID NO: 1906245 - RNA, 14 nt, Human
ucuuucaugaguuu

SEQ ID NO: 1906246 - RNA, 22 nt, Human
ucuuuccacuccuccuagccac

SEQ ID NO: 1906247 - RNA, 21 nt, Human
ucuuuccacuccuccuagcca

SEQ ID NO: 1906248 - RNA, 14 nt, Human
ucuuuccaaaguac

SEQ ID NO: 1906249 - RNA, 13 nt, Human
ucuuuccaaagua

SEQ ID NO: 1906250 - RNA, 16 nt, Human
ucuuucagccaagaau

SEQ ID NO: 1906251 - RNA, 19 nt, Human
ucuuucagccaagaauucu

SEQ ID NO: 1906252 - RNA, 20 nt, Human
ucuuucagccaagaauucuu

SEQ ID NO: 1906253 - RNA, 21 nt, Human
ucuuucagccaagaauucuua

SEQ ID NO: 1906254 - RNA, 23 nt, Human
ugaacaagcaaacccagacggcu

SEQ ID NO: 1906255 - RNA, 18 nt, Human
ugaacacaaacuguaaau

SEQ ID NO: 1906256 - RNA, 19 nt, Human
ugaacaguuguguuugaag

SEQ ID NO: 1906257 - RNA, 22 nt, Human
ugaacagcggcuggacuuggag

SEQ ID NO: 1906258 - RNA, 21 nt, Human
ugaacagcggcuggacuugga

SEQ ID NO: 1906259 - RNA, 15 nt, Human
ugaacagcggcugga

SEQ ID NO: 1906260 - RNA, 16 nt, Human
ugaacuccuggccuca

SEQ ID NO: 1906261 - RNA, 20 nt, Human
ugaaccaccacacccagccc

SEQ ID NO: 1906262 - RNA, 17 nt, Human
ugaaccaccacacccag

SEQ ID NO: 1906263 - RNA, 23 nt, Human
ugaaccacaucuugcucugcuga

SEQ ID NO: 1906264 - RNA, 19 nt, Human
ugaaccacaucuugcucug

SEQ ID NO: 1906265 - RNA, 22 nt, Human
ugaaccaagaacuuuccaggaa

SEQ ID NO: 1906266 - RNA, 18 nt, Human
ugaacauugcaauagaaa

SEQ ID NO: 1906267 - RNA, 22 nt, Human
ugaacaguuuaucgaccaguuu

SEQ ID NO: 1906268 - RNA, 12 nt, Human
ugaaauuauuca

SEQ ID NO: 1906269 - RNA, 19 nt, Human
ugaaauuaagaaggcaaaa

SEQ ID NO: 1906270 - RNA, 21 nt, Human
ugaaauuaagaaggcaaaaau

SEQ ID NO: 1906271 - RNA, 23 nt, Human
ugaaauuaagaaggcaaaaaugu

SEQ ID NO: 1906272 - RNA, 16 nt, Human
ugaaauauuuuacagu

SEQ ID NO: 1906273 - RNA, 17 nt, Human
ugaaacaagaagccaca

SEQ ID NO: 1906274 - RNA, 16 nt, Human
ugaaacaacuuggaaa

SEQ ID NO: 1906275 - RNA, 15 nt, Human
ugaaacaacuuggaa

SEQ ID NO: 1906276 - RNA, 11 nt, Human
ugaaacccagu

SEQ ID NO: 1906277 - RNA, 20 nt, Human
ugaaacccagucacugugag

SEQ ID NO: 1906278 - RNA, 14 nt, Human
ugaaacauuuuguc

SEQ ID NO: 1906279 - RNA, 16 nt, Human
ucuuuucacaaauaaa

SEQ ID NO: 1906280 - RNA, 15 nt, Human
ucuuuucacaaauaa

SEQ ID NO: 1906281 - RNA, 14 nt, Human
ucuuuucacaaaua

SEQ ID NO: 1906282 - RNA, 13 nt, Human
ucuuuucacaaau

SEQ ID NO: 1906283 - RNA, 12 nt, Human
ucuuuucacaaa

SEQ ID NO: 1906284 - RNA, 20 nt, Human
ugaaaagcuccauuuuuagu

SEQ ID NO: 1906285 - RNA, 13 nt, Human
ugaaaauuuugau

SEQ ID NO: 1906286 - RNA, 21 nt, Human
ugaaaauuuugauguuuuaag

SEQ ID NO: 1906287 - RNA, 19 nt, Human
ugaaaauuuugauguuuua

SEQ ID NO: 1906288 - RNA, 13 nt, Human
ugaaagggcccag

SEQ ID NO: 1906289 - RNA, 23 nt, Human
ugaaagggaguauuacaaaaaca

SEQ ID NO: 1906290 - RNA, 18 nt, Human
ugaaagcccugagcuuuc

SEQ ID NO: 1906291 - RNA, 15 nt, Human
ugaaagccccagaaa

SEQ ID NO: 1906292 - RNA, 16 nt, Human
ugaaagccccagaaau

SEQ ID NO: 1906293 - RNA, 17 nt, Human
ugaaagccccagaaauc

SEQ ID NO: 1906294 - RNA, 21 nt, Human
ugagaccacagagagagggga

SEQ ID NO: 1906295 - RNA, 14 nt, Human
ugagaccacuguua

SEQ ID NO: 1906296 - RNA, 19 nt, Human
ugagacucgcgacaaugca

SEQ ID NO: 1906297 - RNA, 16 nt, Human
ugagacucgagaacuu

SEQ ID NO: 1906298 - RNA, 15 nt, Human
ugagacucgagaacu

SEQ ID NO: 1906299 - RNA, 12 nt, Human
ugagacucgaga

SEQ ID NO: 1906300 - RNA, 21 nt, Human
ugaccucaggugauccaccca

SEQ ID NO: 1906301 - RNA, 20 nt, Human
ugaccucaggugauccaccc

SEQ ID NO: 1906302 - RNA, 19 nt, Human
ugaccgcgacuaauuucaa

SEQ ID NO: 1906303 - RNA, 17 nt, Human
ugagaaauuuauaaacu

SEQ ID NO: 1906304 - RNA, 19 nt, Human
ugagaacaaccaaaaucuu

SEQ ID NO: 1906305 - RNA, 16 nt, Human
ugagagugaacaaauu

SEQ ID NO: 1906306 - RNA, 17 nt, Human
ugagacucgagaacuuu

SEQ ID NO: 1906307 - RNA, 20 nt, Human
ugagacucgcgacaaugcaa

SEQ ID NO: 1906308 - RNA, 21 nt, Human
ugagacucgcgacaaugcaaa

SEQ ID NO: 1906309 - RNA, 22 nt, Human
ugagacucgcgacaaugcaaac

SEQ ID NO: 1906310 - RNA, 23 nt, Human
ugagacucgcgacaaugcaaacc

SEQ ID NO: 1906311 - RNA, 15 nt, Human
ugagcagggcucagc

SEQ ID NO: 1906312 - RNA, 14 nt, Human
ugagcagggcucag

SEQ ID NO: 1906313 - RNA, 13 nt, Human
ugagcagggcuca

SEQ ID NO: 1906314 - RNA, 12 nt, Human
ugagcagggcuc

SEQ ID NO: 1906315 - RNA, 15 nt, Human
ugagaucaaaacggu

SEQ ID NO: 1906316 - RNA, 14 nt, Human
ugagaucagccugg

SEQ ID NO: 1906317 - RNA, 15 nt, Human
ugagaucagccuggg

SEQ ID NO: 1906318 - RNA, 16 nt, Human
ugagcaucaggccagg

SEQ ID NO: 1906319 - RNA, 17 nt, Human
ugagcagggcucagcgg

SEQ ID NO: 1906320 - RNA, 16 nt, Human
ugagcagggcucagcg

SEQ ID NO: 1906321 - RNA, 19 nt, Human
ugagcagggcucagcgggg

SEQ ID NO: 1906322 - RNA, 18 nt, Human
ugagcaucaggccaggcc

SEQ ID NO: 1906323 - RNA, 19 nt, Human
ugagcaucaggccaggccc

SEQ ID NO: 1906324 - RNA, 20 nt, Human
ugagcaucaggccaggcccu

SEQ ID NO: 1906325 - RNA, 21 nt, Human
ugagccucagcauccuggcac

SEQ ID NO: 1906326 - RNA, 18 nt, Human
ugagccucagcauccugg

SEQ ID NO: 1906327 - RNA, 22 nt, Human
ugagccucagcauccuggcacc

SEQ ID NO: 1906328 - RNA, 17 nt, Human
ugagccucagcauccug

SEQ ID NO: 1906329 - RNA, 21 nt, Human
ugagccgagaucacgccacug

SEQ ID NO: 1906330 - RNA, 19 nt, Human
ugagccgagaucacgccac

SEQ ID NO: 1906331 - RNA, 12 nt, Human
ugagccucugcu

SEQ ID NO: 1906332 - RNA, 14 nt, Human
ugagccucugcucc

SEQ ID NO: 1906333 - RNA, 16 nt, Human
ugagccucugcucccc

SEQ ID NO: 1906334 - RNA, 17 nt, Human
ugagccucugcucccca

SEQ ID NO: 1906335 - RNA, 18 nt, Human
ugagccucugcuccccag

SEQ ID NO: 1906336 - RNA, 16 nt, Human
ugagcucucggaacug

SEQ ID NO: 1906337 - RNA, 20 nt, Human
ugagcucucggaacugcaug

SEQ ID NO: 1906338 - RNA, 17 nt, Human
ugagggaacagagaggu

SEQ ID NO: 1906339 - RNA, 14 nt, Human
ugagggagauccca

SEQ ID NO: 1906340 - RNA, 13 nt, Human
ugaggcucugccc

SEQ ID NO: 1906341 - RNA, 14 nt, Human
ugaggcucugcccu

SEQ ID NO: 1906342 - RNA, 20 nt, Human
ugaggcuccacuuggucugu

SEQ ID NO: 1906343 - RNA, 18 nt, Human
ugaggcuccacuuggucu

SEQ ID NO: 1906344 - RNA, 12 nt, Human
ugaggugggagg

SEQ ID NO: 1906345 - RNA, 13 nt, Human
ugaggugggagga

SEQ ID NO: 1906346 - RNA, 14 nt, Human
ugaggugggagaug

SEQ ID NO: 1906347 - RNA, 16 nt, Human
ugaggagcuugaaacc

SEQ ID NO: 1906348 - RNA, 17 nt, Human
ugaggcagguccccaga

SEQ ID NO: 1906349 - RNA, 16 nt, Human
ugaggcagguccccag

SEQ ID NO: 1906350 - RNA, 14 nt, Human
ugaggcaggucccc

SEQ ID NO: 1906351 - RNA, 13 nt, Human
ugagcugggauga

SEQ ID NO: 1906352 - RNA, 20 nt, Human
ugagcuggggaugucucuca

SEQ ID NO: 1906353 - RNA, 12 nt, Human
ugaggagcuggg

SEQ ID NO: 1906354 - RNA, 13 nt, Human
ugaggagcugggg

SEQ ID NO: 1906355 - RNA, 20 nt, Human
ugaggagcuggggaucccuc

SEQ ID NO: 1906356 - RNA, 23 nt, Human
ugaggcauuuguuugaacugaua

SEQ ID NO: 1906357 - RNA, 23 nt, Human
ugaggcuagugugguguuuccug

SEQ ID NO: 1906358 - RNA, 21 nt, Human
ugaggcauuuguuugaacuga

SEQ ID NO: 1906359 - RNA, 17 nt, Human
ugaggcuaguguggugu

SEQ ID NO: 1906360 - RNA, 20 nt, Human
ugaggcauuuguuugaacug

SEQ ID NO: 1906361 - RNA, 19 nt, Human
ugaggcauuuguuugaacu

SEQ ID NO: 1906362 - RNA, 12 nt, Human
ugaggcauuugu

SEQ ID NO: 1906363 - RNA, 23 nt, Human
ugaguugacuugacagaacacug

SEQ ID NO: 1906364 - RNA, 19 nt, Human
ugaguuucucucacauuac

SEQ ID NO: 1906365 - RNA, 14 nt, Human
ugagugagcaugcc

SEQ ID NO: 1906366 - RNA, 16 nt, Human
ugaguugauagcacag

SEQ ID NO: 1906367 - RNA, 20 nt, Human
ugaguugauagcacagaccc

SEQ ID NO: 1906368 - RNA, 18 nt, Human
ugauaacuagauggugcu

SEQ ID NO: 1906369 - RNA, 21 nt, Human
ugauaacuagauggugcugag

SEQ ID NO: 1906370 - RNA, 22 nt, Human
ugauaacuagauggugcugaga

SEQ ID NO: 1906371 - RNA, 23 nt, Human
ugauaacuagauggugcugagaa

SEQ ID NO: 1906372 - RNA, 23 nt, Human
ugaguuuucaccucgaauuuugu

SEQ ID NO: 1906373 - RNA, 13 nt, Human
ugagucugaaggc

SEQ ID NO: 1906374 - RNA, 15 nt, Human
ugagucugaaggcug

SEQ ID NO: 1906375 - RNA, 17 nt, Human
ugagucugaaggcuggg

SEQ ID NO: 1906376 - RNA, 18 nt, Human
ugagucugaaggcugggu

SEQ ID NO: 1906377 - RNA, 17 nt, Human
ugagugaaccuguauaa

SEQ ID NO: 1906378 - RNA, 16 nt, Human
ugagucuguuuuguaa

SEQ ID NO: 1906379 - RNA, 17 nt, Human
ugagucuguuuuguaaa

SEQ ID NO: 1906380 - RNA, 18 nt, Human
ugagucuguuuuguaaag

SEQ ID NO: 1906381 - RNA, 19 nt, Human
ugagucgaggacagggagg

SEQ ID NO: 1906382 - RNA, 17 nt, Human
ugagucgcgcaccgaaa

SEQ ID NO: 1906383 - RNA, 21 nt, Human
ugaggugggaggaucucuuga

SEQ ID NO: 1906384 - RNA, 13 nt, Human
ugaguccagaagu

SEQ ID NO: 1906385 - RNA, 19 nt, Human
ugaguccagaaguuugaga

SEQ ID NO: 1906386 - RNA, 18 nt, Human
ugauccaagcaagacuga

SEQ ID NO: 1906387 - RNA, 17 nt, Human
ugauccaagcugguccc

SEQ ID NO: 1906388 - RNA, 15 nt, Human
ugauccaagcugguc

SEQ ID NO: 1906389 - RNA, 14 nt, Human
ugauccaagcuggu

SEQ ID NO: 1906390 - RNA, 13 nt, Human
ugauccaagcugg

SEQ ID NO: 1906391 - RNA, 12 nt, Human
ugaucaggaccu

SEQ ID NO: 1906392 - RNA, 20 nt, Human
ugaucaggaccuccaagcca

SEQ ID NO: 1906393 - RNA, 13 nt, Human
ugauagcacagac

SEQ ID NO: 1906394 - RNA, 14 nt, Human
ugauagcacagacc

SEQ ID NO: 1906395 - RNA, 21 nt, Human
ugauagacacauaugaggggg

SEQ ID NO: 1906396 - RNA, 22 nt, Human
ugauagacacauaugaggggga

SEQ ID NO: 1906397 - RNA, 19 nt, Human
ugauccacccaccucagcc

SEQ ID NO: 1906398 - RNA, 18 nt, Human
ugauccacccaccucagc

SEQ ID NO: 1906399 - RNA, 17 nt, Human
ugauccacccaccucag

SEQ ID NO: 1906400 - RNA, 17 nt, Human
ugaucucucgugauuga

SEQ ID NO: 1906401 - RNA, 15 nt, Human
ugaucuggaacccag

SEQ ID NO: 1906402 - RNA, 17 nt, Human
ugaucuggaacccagac

SEQ ID NO: 1906403 - RNA, 18 nt, Human
ugaucuggaacccagacu

SEQ ID NO: 1906404 - RNA, 19 nt, Human
ugaucuggaacccagacuc

SEQ ID NO: 1906405 - RNA, 19 nt, Human
ugaucugugaauugagcug

SEQ ID NO: 1906406 - RNA, 20 nt, Human
ugaucuucuuuauaauucua

SEQ ID NO: 1906407 - RNA, 14 nt, Human
ugaucuucaacaaa

SEQ ID NO: 1906408 - RNA, 15 nt, Human
ugaucuucaacaaau

SEQ ID NO: 1906409 - RNA, 21 nt, Human
ugaucuucaacaaauugcccu

SEQ ID NO: 1906410 - RNA, 22 nt, Human
ugaucuucaacaaauugcccuu

SEQ ID NO: 1906411 - RNA, 20 nt, Human
ugaugcuacaggauuugaaa

SEQ ID NO: 1906412 - RNA, 11 nt, Human
ugaugccuggc

SEQ ID NO: 1906413 - RNA, 23 nt, Human
ugaugcuacaggauuugaaauug

SEQ ID NO: 1906414 - RNA, 23 nt, Human
ugaugcgggccagugcuccagcc

SEQ ID NO: 1906415 - RNA, 16 nt, Human
ugaucuuugcagacag

SEQ ID NO: 1906416 - RNA, 18 nt, Human
ugaucuuugcagacaggc

SEQ ID NO: 1906417 - RNA, 13 nt, Human
ugaugguuguaca

SEQ ID NO: 1906418 - RNA, 14 nt, Human
ugaugguuguacau

SEQ ID NO: 1906419 - RNA, 16 nt, Human
ugaugcuucuucagag

SEQ ID NO: 1906420 - RNA, 17 nt, Human
ugaugcuucuucagaga

SEQ ID NO: 1906421 - RNA, 18 nt, Human
ugaugcuucuucagagac

SEQ ID NO: 1906422 - RNA, 18 nt, Human
ugaugugggucaaggaau

SEQ ID NO: 1906423 - RNA, 16 nt, Human
ugauguguuaucucuu

SEQ ID NO: 1906424 - RNA, 13 nt, Human
ugauuauauguca

SEQ ID NO: 1906425 - RNA, 13 nt, Human
ugauuacugucaa

SEQ ID NO: 1906426 - RNA, 24 nt, Human
ugauuacugucaaggcugcuuaga

SEQ ID NO: 1906427 - RNA, 20 nt, Human
ugauguucuuucacccuuuu

SEQ ID NO: 1906428 - RNA, 16 nt, Human
ugauuaccagggacug

SEQ ID NO: 1906429 - RNA, 20 nt, Human
ugauucaacagguuuuccug

SEQ ID NO: 1906430 - RNA, 16 nt, Human
ugauuauuuauuauuu

SEQ ID NO: 1906431 - RNA, 13 nt, Human
ugauucagacagc

SEQ ID NO: 1906432 - RNA, 14 nt, Human
ugauucagacagcu

SEQ ID NO: 1906433 - RNA, 15 nt, Human
ugauucagacagcug

SEQ ID NO: 1906434 - RNA, 16 nt, Human
ugauucagacagcugc

SEQ ID NO: 1906435 - RNA, 20 nt, Human
ugauucacuucacgcuuuca

SEQ ID NO: 1906436 - RNA, 21 nt, Human
ugauucuccugccucagccuc

SEQ ID NO: 1906437 - RNA, 23 nt, Human
ugauucagacagcugccugggau

SEQ ID NO: 1906438 - RNA, 21 nt, Human
ugauucuccuucagcccucac

SEQ ID NO: 1906439 - RNA, 19 nt, Human
ugauucuccuucagcccuc

SEQ ID NO: 1906440 - RNA, 18 nt, Human
ugauucuccuucagcccu

SEQ ID NO: 1906441 - RNA, 16 nt, Human
ugauucuccuucagcc

SEQ ID NO: 1906442 - RNA, 14 nt, Human
ugauucuccuucag

SEQ ID NO: 1906443 - RNA, 13 nt, Human
ugauucuccuuca

SEQ ID NO: 1906444 - RNA, 12 nt, Human
ugauucuccuuc

SEQ ID NO: 1906445 - RNA, 18 nt, Human
ugauucagacagcugccu

SEQ ID NO: 1906446 - RNA, 19 nt, Human
ugauucagacagcugccug

SEQ ID NO: 1906447 - RNA, 20 nt, Human
ugauucagacagcugccugg

SEQ ID NO: 1906448 - RNA, 21 nt, Human
ugauucagacagcugccuggg

SEQ ID NO: 1906449 - RNA, 17 nt, Human
ugauugacagcuuugcu

SEQ ID NO: 1906450 - RNA, 19 nt, Human
ugauugacagcuuugcugc

SEQ ID NO: 1906451 - RNA, 12 nt, Human
ugauugacagcu

SEQ ID NO: 1906452 - RNA, 13 nt, Human
ugauugacagcuu

SEQ ID NO: 1906453 - RNA, 12 nt, Human
ugauugauuuga

SEQ ID NO: 1906454 - RNA, 21 nt, Human
ugauugacagcuuugcugcug

SEQ ID NO: 1906455 - RNA, 14 nt, Human
ugauugauuugaag

SEQ ID NO: 1906456 - RNA, 23 nt, Human
ugauucuccuucagcccucaccc

SEQ ID NO: 1906457 - RNA, 16 nt, Human
ugauucugcaguaaau

SEQ ID NO: 1906458 - RNA, 22 nt, Human
ugauucugcaguaaaucuuuua

SEQ ID NO: 1906459 - RNA, 16 nt, Human
ugauugugucucuugg

SEQ ID NO: 1906460 - RNA, 18 nt, Human
ugauuguucgggugugca

SEQ ID NO: 1906461 - RNA, 19 nt, Human
ugauuguucgggugugcaa

SEQ ID NO: 1906462 - RNA, 21 nt, Human
ugauuguggaauggagauuca

SEQ ID NO: 1906463 - RNA, 14 nt, Human
ugauuguggaaugg

SEQ ID NO: 1906464 - RNA, 18 nt, Human
ugauuguggaauggagau

SEQ ID NO: 1906465 - RNA, 13 nt, Human
ugauuggaggggg

SEQ ID NO: 1906466 - RNA, 21 nt, Human
ugauuggaggggggagguggg

SEQ ID NO: 1906467 - RNA, 12 nt, Human
ugcugcugcugc

SEQ ID NO: 1906468 - RNA, 12 nt, Human
ugcugcuugagg

SEQ ID NO: 1906469 - RNA, 20 nt, Human
ugcugggauuacagguguga

SEQ ID NO: 1906470 - RNA, 19 nt, Human
ugcugcuugaggcaacuca

SEQ ID NO: 1906471 - RNA, 14 nt, Human
ugcugggccccugc

SEQ ID NO: 1906472 - RNA, 16 nt, Human
ugcugggccccugccu

SEQ ID NO: 1906473 - RNA, 17 nt, Human
ugcugggccccugccuc

SEQ ID NO: 1906474 - RNA, 18 nt, Human
ugcugggccccugccucu

SEQ ID NO: 1906475 - RNA, 19 nt, Human
ugcugggccccugccucuc

SEQ ID NO: 1906476 - RNA, 21 nt, Human
ugcugggccccugccucucug

SEQ ID NO: 1906477 - RNA, 22 nt, Human
ugcugggccccugccucucugc

SEQ ID NO: 1906478 - RNA, 23 nt, Human
ugcugggccccugccucucugca

SEQ ID NO: 1906479 - RNA, 24 nt, Human
ugcugggccccugccucucugcag

SEQ ID NO: 1906480 - RNA, 15 nt, Human
ugcugccugcuuuuu

SEQ ID NO: 1906481 - RNA, 17 nt, Human
ugcugccugcuuuuuau

SEQ ID NO: 1906482 - RNA, 14 nt, Human
ugcugcauuuaaaa

SEQ ID NO: 1906483 - RNA, 23 nt, Human
ugcugcauuuaaaagauacaguu

SEQ ID NO: 1906484 - RNA, 19 nt, Human
ugcugcauuuaaaagauac

SEQ ID NO: 1906485 - RNA, 18 nt, Human
ugcugcauuuaaaagaua

SEQ ID NO: 1906486 - RNA, 17 nt, Human
ugcugcauuuaaaagau

SEQ ID NO: 1906487 - RNA, 18 nt, Human
ugcuguaacuuucugaaa

SEQ ID NO: 1906488 - RNA, 18 nt, Human
ugcugguuuuucaguuuu

SEQ ID NO: 1906489 - RNA, 16 nt, Human
ugcugguuuuucaguu

SEQ ID NO: 1906490 - RNA, 18 nt, Human
ugcuguaaauuuggcuuc

SEQ ID NO: 1906491 - RNA, 19 nt, Human
ugcuguaaauuuggcuucu

SEQ ID NO: 1906492 - RNA, 20 nt, Human
ugcuguaaauuuggcuucug

SEQ ID NO: 1906493 - RNA, 15 nt, Human
ugcugguuuuucagu

SEQ ID NO: 1906494 - RNA, 12 nt, Human
ugcugguuuuuc

SEQ ID NO: 1906495 - RNA, 15 nt, Human
ugcugguuuuaacaa

SEQ ID NO: 1906496 - RNA, 16 nt, Human
ugcugguuuuaacaac

SEQ ID NO: 1906497 - RNA, 13 nt, Human
ugcugguuuuagu

SEQ ID NO: 1906498 - RNA, 17 nt, Human
ugcuguucaugaaagau

SEQ ID NO: 1906499 - RNA, 22 nt, Human
ugcuguucucuugggaacugaa

SEQ ID NO: 1906500 - RNA, 16 nt, Human
ugcuguucaugaaaga

SEQ ID NO: 1906501 - RNA, 16 nt, Human
ugcuguuaucccugcc

SEQ ID NO: 1906502 - RNA, 17 nt, Human
ugcugggcuugucugua

SEQ ID NO: 1906503 - RNA, 20 nt, Human
ugcugggggggauuguaaaa

SEQ ID NO: 1906504 - RNA, 13 nt, Human
ugcuggguguggc

SEQ ID NO: 1906505 - RNA, 23 nt, Human
ugcucuccgaccagacaccuuga

SEQ ID NO: 1906506 - RNA, 16 nt, Human
ugcucuagugccuucu

SEQ ID NO: 1906507 - RNA, 14 nt, Human
ugcucuagugccuu

SEQ ID NO: 1906508 - RNA, 17 nt, Human
ugcucuugaugccuggc

SEQ ID NO: 1906509 - RNA, 13 nt, Human
ugcucuagugccu

SEQ ID NO: 1906510 - RNA, 15 nt, Human
ugcucaggagcccug

SEQ ID NO: 1906511 - RNA, 17 nt, Human
ugcucacauaucuguca

SEQ ID NO: 1906512 - RNA, 18 nt, Human
ugcucaggagcccuggga

SEQ ID NO: 1906513 - RNA, 19 nt, Human
ugcucaggagcccugggag

SEQ ID NO: 1906514 - RNA, 20 nt, Human
ugcucaggagcccugggagg

SEQ ID NO: 1906515 - RNA, 14 nt, Human
ugcucagaccagcu

SEQ ID NO: 1906516 - RNA, 19 nt, Human
ugcucagggaaaagcagcu

SEQ ID NO: 1906517 - RNA, 17 nt, Human
ugcuagaacucccuuuc

SEQ ID NO: 1906518 - RNA, 15 nt, Human
ugcuagaacucccuu

SEQ ID NO: 1906519 - RNA, 14 nt, Human
ugcuagaacucccu

SEQ ID NO: 1906520 - RNA, 13 nt, Human
ugcuagaacuccc

SEQ ID NO: 1906521 - RNA, 22 nt, Human
ugcuaggaacacuccuucacag

SEQ ID NO: 1906522 - RNA, 20 nt, Human
ugcuaggcccccggguguga

SEQ ID NO: 1906523 - RNA, 21 nt, Human
ugcuaggaacacuccuucaca

SEQ ID NO: 1906524 - RNA, 20 nt, Human
ugcuaggaacacuccuucac

SEQ ID NO: 1906525 - RNA, 17 nt, Human
ugcggacagccacggcc

SEQ ID NO: 1906526 - RNA, 20 nt, Human
ugcuaacuagcuuggaaacu

SEQ ID NO: 1906527 - RNA, 22 nt, Human
ugcuaacuagcuuggaaacugg

SEQ ID NO: 1906528 - RNA, 22 nt, Human
ugcuacuguccuacccacccuc

SEQ ID NO: 1906529 - RNA, 21 nt, Human
ugcuacuguccuacccacccu

SEQ ID NO: 1906530 - RNA, 22 nt, Human
ugcuaagaauauuugaauguau

SEQ ID NO: 1906531 - RNA, 21 nt, Human
ugcuaagaauauuugaaugua

SEQ ID NO: 1906532 - RNA, 17 nt, Human
ugcuaagaauauuugaa

SEQ ID NO: 1906533 - RNA, 19 nt, Human
ugcuacucaaguagcauuu

SEQ ID NO: 1906534 - RNA, 20 nt, Human
ugccuugcauaauggucaga

SEQ ID NO: 1906535 - RNA, 13 nt, Human
ugccuuggcucag

SEQ ID NO: 1906536 - RNA, 16 nt, Human
ugccuuggcucagaca

SEQ ID NO: 1906537 - RNA, 17 nt, Human
ugccuuggcucagacau

SEQ ID NO: 1906538 - RNA, 19 nt, Human
ugccuuggcucagacaugu

SEQ ID NO: 1906539 - RNA, 17 nt, Human
ugcgccaccgcccagag

SEQ ID NO: 1906540 - RNA, 22 nt, Human
ugcauaguaccaaucauuuuaa

SEQ ID NO: 1906541 - RNA, 18 nt, Human
ugcauauuauuuuauguu

SEQ ID NO: 1906542 - RNA, 19 nt, Human
ugcauauguugaauacuuu

SEQ ID NO: 1906543 - RNA, 21 nt, Human
ugcauaguaccaaucauuuua

SEQ ID NO: 1906544 - RNA, 20 nt, Human
ugcauaguaccaaucauuuu

SEQ ID NO: 1906545 - RNA, 19 nt, Human
ugcaguuugagacaggaga

SEQ ID NO: 1906546 - RNA, 16 nt, Human
ugcaguugccagucac

SEQ ID NO: 1906547 - RNA, 21 nt, Human
ugcaguggugcgaucuggguu

SEQ ID NO: 1906548 - RNA, 21 nt, Human
ugcagggcagucauuggcugu

SEQ ID NO: 1906549 - RNA, 20 nt, Human
ugcaguggugcgaucugggu

SEQ ID NO: 1906550 - RNA, 13 nt, Human
ugcagggcaguca

SEQ ID NO: 1906551 - RNA, 14 nt, Human
ugcagggcagucau

SEQ ID NO: 1906552 - RNA, 21 nt, Human
ugcaguuacacuaaaagguga

SEQ ID NO: 1906553 - RNA, 14 nt, Human
ugcagugugaaaag

SEQ ID NO: 1906554 - RNA, 13 nt, Human
ugcagggaguccg

SEQ ID NO: 1906555 - RNA, 16 nt, Human
ugcagggacaaagagg

SEQ ID NO: 1906556 - RNA, 15 nt, Human
ugcagggacaaagag

SEQ ID NO: 1906557 - RNA, 16 nt, Human
ugccacuaaauugaca

SEQ ID NO: 1906558 - RNA, 20 nt, Human
ugccaggaagccagcaggcu

SEQ ID NO: 1906559 - RNA, 22 nt, Human
ugccaggaagccagcaggcucu

SEQ ID NO: 1906560 - RNA, 14 nt, Human
ugccaggcauggug

SEQ ID NO: 1906561 - RNA, 23 nt, Human
ugcauuuggugguuucagaaaug

SEQ ID NO: 1906562 - RNA, 18 nt, Human
ugccaaaaugcucuagug

SEQ ID NO: 1906563 - RNA, 15 nt, Human
ugcauuuguauauuu

SEQ ID NO: 1906564 - RNA, 17 nt, Human
ugccaaaaugcucuagu

SEQ ID NO: 1906565 - RNA, 21 nt, Human
ugcauuuggugguuucagaaa

SEQ ID NO: 1906566 - RNA, 21 nt, Human
ugcauggugccccaggaccag

SEQ ID NO: 1906567 - RNA, 22 nt, Human
ugcauggugccccaggaccagc

SEQ ID NO: 1906568 - RNA, 17 nt, Human
ugcauggugccccagga

SEQ ID NO: 1906569 - RNA, 18 nt, Human
ugcauggugccccaggac

SEQ ID NO: 1906570 - RNA, 19 nt, Human
ugcauggugccccaggacc

SEQ ID NO: 1906571 - RNA, 20 nt, Human
ugcauggugccccaggacca

SEQ ID NO: 1906572 - RNA, 15 nt, Human
ugccucaagagaagg

SEQ ID NO: 1906573 - RNA, 14 nt, Human
ugccucaagagaag

SEQ ID NO: 1906574 - RNA, 20 nt, Human
ugccucggccucccaaagug

SEQ ID NO: 1906575 - RNA, 15 nt, Human
ugcccugcccaccug

SEQ ID NO: 1906576 - RNA, 20 nt, Human
ugcccggcuaauuuuuguaa

SEQ ID NO: 1906577 - RNA, 16 nt, Human
ugcccugcccaccugg

SEQ ID NO: 1906578 - RNA, 20 nt, Human
ugcccugcccaccuggccuc

SEQ ID NO: 1906579 - RNA, 23 nt, Human
ugcccugugaguacuacaguccu

SEQ ID NO: 1906580 - RNA, 22 nt, Human
ugccguuacuuuucauauuugc

SEQ ID NO: 1906581 - RNA, 16 nt, Human
ugccccuggcagcccc

SEQ ID NO: 1906582 - RNA, 14 nt, Human
ugcccggcugcgga

SEQ ID NO: 1906583 - RNA, 12 nt, Human
ugcccggcugcg

SEQ ID NO: 1906584 - RNA, 20 nt, Human
ugcccaggcuggcgugcagu

SEQ ID NO: 1906585 - RNA, 19 nt, Human
ugcccaggcuggcgugcag

SEQ ID NO: 1906586 - RNA, 18 nt, Human
ugcccaggcuggcgugca

SEQ ID NO: 1906587 - RNA, 15 nt, Human
uggcucccaggacac

SEQ ID NO: 1906588 - RNA, 14 nt, Human
uggcucccaggaca

SEQ ID NO: 1906589 - RNA, 13 nt, Human
uggcucccaggac

SEQ ID NO: 1906590 - RNA, 12 nt, Human
uggcuccucuca

SEQ ID NO: 1906591 - RNA, 14 nt, Human
uggcuccucucagu

SEQ ID NO: 1906592 - RNA, 11 nt, Human
uggcugcuuca

SEQ ID NO: 1906593 - RNA, 13 nt, Human
uggcuccucucag

SEQ ID NO: 1906594 - RNA, 15 nt, Human
uggcugcuucaagga

SEQ ID NO: 1906595 - RNA, 16 nt, Human
uggcugcuucaaggau

SEQ ID NO: 1906596 - RNA, 15 nt, Human
uggcgggguggggug

SEQ ID NO: 1906597 - RNA, 23 nt, Human
uggccucccaacucaccccagcc

SEQ ID NO: 1906598 - RNA, 18 nt, Human
uggccucccacagacuca

SEQ ID NO: 1906599 - RNA, 22 nt, Human
uggcgcagcauauucaggaagc

SEQ ID NO: 1906600 - RNA, 23 nt, Human
uggcgcagcauauucaggaagcu

SEQ ID NO: 1906601 - RNA, 16 nt, Human
uggcgcugccccuggc

SEQ ID NO: 1906602 - RNA, 23 nt, Human
uggcgcugccccuggcagccccu

SEQ ID NO: 1906603 - RNA, 17 nt, Human
uggccuaugcacauaug

SEQ ID NO: 1906604 - RNA, 15 nt, Human
uggccuaugcacaua

SEQ ID NO: 1906605 - RNA, 14 nt, Human
uggccuaugcacau

SEQ ID NO: 1906606 - RNA, 13 nt, Human
uggccuaugcaca

SEQ ID NO: 1906607 - RNA, 20 nt, Human
uggccuaugcacauauggac

SEQ ID NO: 1906608 - RNA, 20 nt, Human
uggccccugcccggcugcgg

SEQ ID NO: 1906609 - RNA, 16 nt, Human
uggccccugcccggcu

SEQ ID NO: 1906610 - RNA, 15 nt, Human
uggccccugcccggc

SEQ ID NO: 1906611 - RNA, 14 nt, Human
uggccccugcccgg

SEQ ID NO: 1906612 - RNA, 21 nt, Human
uggccccgccgccugguacuc

SEQ ID NO: 1906613 - RNA, 17 nt, Human
uggcccaggugaguccu

SEQ ID NO: 1906614 - RNA, 13 nt, Human
uggccccgccgcc

SEQ ID NO: 1906615 - RNA, 15 nt, Human
uggccccgccgccug

SEQ ID NO: 1906616 - RNA, 20 nt, Human
uggccccgccgccugguacu

SEQ ID NO: 1906617 - RNA, 13 nt, Human
uggccaggcuggu

SEQ ID NO: 1906618 - RNA, 17 nt, Human
uggcccagggcccagag

SEQ ID NO: 1906619 - RNA, 18 nt, Human
uggcccagggcccagagc

SEQ ID NO: 1906620 - RNA, 20 nt, Human
uggcccagggcccagagccc

SEQ ID NO: 1906621 - RNA, 21 nt, Human
uggcccagggcccagagccca

SEQ ID NO: 1906622 - RNA, 22 nt, Human
uggcccagggcccagagcccag

SEQ ID NO: 1906623 - RNA, 23 nt, Human
uggcccagggcccagagcccagc

SEQ ID NO: 1906624 - RNA, 18 nt, Human
uggccagaugcaccagcc

SEQ ID NO: 1906625 - RNA, 17 nt, Human
uggccagaugcaccagc

SEQ ID NO: 1906626 - RNA, 17 nt, Human
uggcagaguugaagaca

SEQ ID NO: 1906627 - RNA, 19 nt, Human
uggcagaguugaagacaga

SEQ ID NO: 1906628 - RNA, 21 nt, Human
uggcagaguggauucuugaac

SEQ ID NO: 1906629 - RNA, 15 nt, Human
uggcagaguugaaga

SEQ ID NO: 1906630 - RNA, 19 nt, Human
uggccagaugcaccagccc

SEQ ID NO: 1906631 - RNA, 14 nt, Human
uggacacuguacaa

SEQ ID NO: 1906632 - RNA, 23 nt, Human
uggacacuuaauacuaccuugaa

SEQ ID NO: 1906633 - RNA, 14 nt, Human
uggacaggcuggcu

SEQ ID NO: 1906634 - RNA, 23 nt, Human
uggacaguaucacugucuuuccu

SEQ ID NO: 1906635 - RNA, 21 nt, Human
uggacaguaucacugucuuuc

SEQ ID NO: 1906636 - RNA, 17 nt, Human
uggacugaccuggucca

SEQ ID NO: 1906637 - RNA, 19 nt, Human
uggacugaccugguccaca

SEQ ID NO: 1906638 - RNA, 17 nt, Human
uggacuccggcccuccu

SEQ ID NO: 1906639 - RNA, 16 nt, Human
uggacugaggccugag

SEQ ID NO: 1906640 - RNA, 15 nt, Human
uggacugaggccuga

SEQ ID NO: 1906641 - RNA, 14 nt, Human
uggacugaggccug

SEQ ID NO: 1906642 - RNA, 11 nt, Human
uggacugaggc

SEQ ID NO: 1906643 - RNA, 14 nt, Human
uggacuccggcccu

SEQ ID NO: 1906644 - RNA, 14 nt, Human
uggacucagggcag

SEQ ID NO: 1906645 - RNA, 15 nt, Human
uggacucagggcagc

SEQ ID NO: 1906646 - RNA, 18 nt, Human
uggacucagggcagcgcc

SEQ ID NO: 1906647 - RNA, 20 nt, Human
uggacucagggcagcgccag

SEQ ID NO: 1906648 - RNA, 21 nt, Human
uggaggaaggaaacccagcuc

SEQ ID NO: 1906649 - RNA, 23 nt, Human
uggaggaaggaaacccagcucug

SEQ ID NO: 1906650 - RNA, 22 nt, Human
uggaggagcucaggacacuaau

SEQ ID NO: 1906651 - RNA, 20 nt, Human
uggaggagcucaggacacua

SEQ ID NO: 1906652 - RNA, 21 nt, Human
uggaguuucauguacaagaug

SEQ ID NO: 1906653 - RNA, 15 nt, Human
uggaucugugagggg

SEQ ID NO: 1906654 - RNA, 16 nt, Human
uggcaaaaaggcagga

SEQ ID NO: 1906655 - RNA, 20 nt, Human
uggauuuuugacucuggcaa

SEQ ID NO: 1906656 - RNA, 19 nt, Human
uggauuuuugacucuggca

SEQ ID NO: 1906657 - RNA, 17 nt, Human
uggauuuuugucuugug

SEQ ID NO: 1906658 - RNA, 19 nt, Human
uggaucugugaggggcucu

SEQ ID NO: 1906659 - RNA, 12 nt, Human
uggcaaaaaggc

SEQ ID NO: 1906660 - RNA, 17 nt, Human
uggcaaagcuuuuagaa

SEQ ID NO: 1906661 - RNA, 18 nt, Human
uggcaaagcuuuuagaaa

SEQ ID NO: 1906662 - RNA, 16 nt, Human
uggcaaagcuuuuaga

SEQ ID NO: 1906663 - RNA, 19 nt, Human
uggcaaacucuccaccaca

SEQ ID NO: 1906664 - RNA, 20 nt, Human
uggcaaaaggaucuuugugg

SEQ ID NO: 1906665 - RNA, 21 nt, Human
uggcaaaaggaucuuuguggc

SEQ ID NO: 1906666 - RNA, 15 nt, Human
uggcacuauaaugua

SEQ ID NO: 1906667 - RNA, 16 nt, Human
uggcacuauaauguaa

SEQ ID NO: 1906668 - RNA, 22 nt, Human
uggcagaauggggugcaugaag

SEQ ID NO: 1906669 - RNA, 17 nt, Human
uggcaaggguucaccug

SEQ ID NO: 1906670 - RNA, 15 nt, Human
uggucccccuuccau

SEQ ID NO: 1906671 - RNA, 16 nt, Human
uggucccccuuccaug

SEQ ID NO: 1906672 - RNA, 18 nt, Human
uggucccccuuccaugga

SEQ ID NO: 1906673 - RNA, 23 nt, Human
uggucccccuuccauggacuuug

SEQ ID NO: 1906674 - RNA, 17 nt, Human
ugguccuaaucuucuga

SEQ ID NO: 1906675 - RNA, 19 nt, Human
ugguccuaaucuucugaac

SEQ ID NO: 1906676 - RNA, 14 nt, Human
ugguccucacacuc

SEQ ID NO: 1906677 - RNA, 12 nt, Human
ugguccuaccca

SEQ ID NO: 1906678 - RNA, 13 nt, Human
ugguccugcugca

SEQ ID NO: 1906679 - RNA, 15 nt, Human
ugguccugcugcagu

SEQ ID NO: 1906680 - RNA, 23 nt, Human
ugguccugcugcaguugccaguc

SEQ ID NO: 1906681 - RNA, 14 nt, Human
uggucccccuucca

SEQ ID NO: 1906682 - RNA, 22 nt, Human
uggucacaggaaguagaggagg

SEQ ID NO: 1906683 - RNA, 22 nt, Human
uggucaaacaaacucucugaac

SEQ ID NO: 1906684 - RNA, 13 nt, Human
ugggucaaggaau

SEQ ID NO: 1906685 - RNA, 16 nt, Human
uggucaaacaaacucu

SEQ ID NO: 1906686 - RNA, 21 nt, Human
uggucaaacaaacucucugaa

SEQ ID NO: 1906687 - RNA, 22 nt, Human
uggugaccucugccugaaguca

SEQ ID NO: 1906688 - RNA, 17 nt, Human
uggugaccucugccuga

SEQ ID NO: 1906689 - RNA, 16 nt, Human
uggugaccucugccug

SEQ ID NO: 1906690 - RNA, 15 nt, Human
uggugaccucugccu

SEQ ID NO: 1906691 - RNA, 19 nt, Human
uggugacuuuccucuuugg

SEQ ID NO: 1906692 - RNA, 22 nt, Human
uggugaccuuccaagagccuga

SEQ ID NO: 1906693 - RNA, 21 nt, Human
uggugaccuuccaagagccug

SEQ ID NO: 1906694 - RNA, 21 nt, Human
uggugcaaugaccuuucaaua

SEQ ID NO: 1906695 - RNA, 21 nt, Human
uggugcagguagaccugucuc

SEQ ID NO: 1906696 - RNA, 23 nt, Human
uggugcagguagaccugucuccu

SEQ ID NO: 1906697 - RNA, 15 nt, Human
uggugcagugugaaa

SEQ ID NO: 1906698 - RNA, 14 nt, Human
uggugaccucugcc

SEQ ID NO: 1906699 - RNA, 13 nt, Human
uggugaccucugc

SEQ ID NO: 1906700 - RNA, 19 nt, Human
uggucuacacugugcugag

SEQ ID NO: 1906701 - RNA, 15 nt, Human
uggucuacacugugc

SEQ ID NO: 1906702 - RNA, 16 nt, Human
uggucuacacugugcu

SEQ ID NO: 1906703 - RNA, 17 nt, Human
uggucuacacugugcug

SEQ ID NO: 1906704 - RNA, 18 nt, Human
uggucuacacugugcuga

SEQ ID NO: 1906705 - RNA, 17 nt, Human
uggucggaaaacaugcu

SEQ ID NO: 1906706 - RNA, 14 nt, Human
uggucggaaaacau

SEQ ID NO: 1906707 - RNA, 23 nt, Human
ugggcagagcagagaccaucccu

SEQ ID NO: 1906708 - RNA, 14 nt, Human
ugggauguuucugu

SEQ ID NO: 1906709 - RNA, 13 nt, Human
ugggcagggagcg

SEQ ID NO: 1906710 - RNA, 21 nt, Human
ugggccccugccucucugcag

SEQ ID NO: 1906711 - RNA, 23 nt, Human
ugggccccugccucucugcaggu

SEQ ID NO: 1906712 - RNA, 13 nt, Human
ugggcccucuggu

SEQ ID NO: 1906713 - RNA, 14 nt, Human
ugggccuggcuccc

SEQ ID NO: 1906714 - RNA, 16 nt, Human
ugggcccucugguuug

SEQ ID NO: 1906715 - RNA, 14 nt, Human
ugggcccucugguu

SEQ ID NO: 1906716 - RNA, 20 nt, Human
uggcugggggccucagugcc

SEQ ID NO: 1906717 - RNA, 22 nt, Human
ugggagugaggaugucugggcc

SEQ ID NO: 1906718 - RNA, 17 nt, Human
uggcugggggccucagu

SEQ ID NO: 1906719 - RNA, 16 nt, Human
uggcugggggccucag

SEQ ID NO: 1906720 - RNA, 13 nt, Human
ugggaguguguaa

SEQ ID NO: 1906721 - RNA, 11 nt, Human
ugggagugugu

SEQ ID NO: 1906722 - RNA, 14 nt, Human
ugggagugggccca

SEQ ID NO: 1906723 - RNA, 16 nt, Human
ugggagugggcccaau

SEQ ID NO: 1906724 - RNA, 22 nt, Human
ugggauuacaagcgugagccac

SEQ ID NO: 1906725 - RNA, 22 nt, Human
ugggcagagcagagaccauccc

SEQ ID NO: 1906726 - RNA, 14 nt, Human
ugggauccuccagg

SEQ ID NO: 1906727 - RNA, 12 nt, Human
ugggauccucca

SEQ ID NO: 1906728 - RNA, 13 nt, Human
ugggauccuccag

SEQ ID NO: 1906729 - RNA, 18 nt, Human
uggguacuuguggacaca

SEQ ID NO: 1906730 - RNA, 17 nt, Human
uggguacuuguggacac

SEQ ID NO: 1906731 - RNA, 16 nt, Human
uggguacuucuugaag

SEQ ID NO: 1906732 - RNA, 19 nt, Human
uggguacuucuugaaggug

SEQ ID NO: 1906733 - RNA, 13 nt, Human
ugggggugggcca

SEQ ID NO: 1906734 - RNA, 16 nt, Human
ugggggugggccaggc

SEQ ID NO: 1906735 - RNA, 13 nt, Human
uggggggggugcu

SEQ ID NO: 1906736 - RNA, 16 nt, Human
ugggggaguggccaca

SEQ ID NO: 1906737 - RNA, 14 nt, Human
ugggggucugugug

SEQ ID NO: 1906738 - RNA, 23 nt, Human
uggggaugagaaagguugaagca

SEQ ID NO: 1906739 - RNA, 20 nt, Human
uggggccaggcugggucgcc

SEQ ID NO: 1906740 - RNA, 20 nt, Human
uggggaucccucccccccau

SEQ ID NO: 1906741 - RNA, 15 nt, Human
uggggaugagaaagg

SEQ ID NO: 1906742 - RNA, 15 nt, Human
uggggauauaauacu

SEQ ID NO: 1906743 - RNA, 21 nt, Human
uggggccaggcugggucgccc

SEQ ID NO: 1906744 - RNA, 22 nt, Human
uggggccaggcugggucgcccu

SEQ ID NO: 1906745 - RNA, 20 nt, Human
uggggccaguuggucccccu

SEQ ID NO: 1906746 - RNA, 13 nt, Human
ugggcuugauucu

SEQ ID NO: 1906747 - RNA, 14 nt, Human
ugggcuugauucug

SEQ ID NO: 1906748 - RNA, 20 nt, Human
uggggauagauguguggaca

SEQ ID NO: 1906749 - RNA, 18 nt, Human
uggggauagaugugugga

SEQ ID NO: 1906750 - RNA, 17 nt, Human
uggggauagaugugugg

SEQ ID NO: 1906751 - RNA, 16 nt, Human
uggggauagaugugug

SEQ ID NO: 1906752 - RNA, 12 nt, Human
uuaaagacagag

SEQ ID NO: 1906753 - RNA, 11 nt, Human
uuaaagacaga

SEQ ID NO: 1906754 - RNA, 21 nt, Human
uuaaauguuuuuuuuuaaaga

SEQ ID NO: 1906755 - RNA, 23 nt, Human
uuaaauguuuuuuuuuaaagacu

SEQ ID NO: 1906756 - RNA, 17 nt, Human
uuaaccacuucagcuga

SEQ ID NO: 1906757 - RNA, 17 nt, Human
uuaaccccgucaacaaa

SEQ ID NO: 1906758 - RNA, 18 nt, Human
uuaaccccgucaacaaau

SEQ ID NO: 1906759 - RNA, 19 nt, Human
uuaaccccgucaacaaauc

SEQ ID NO: 1906760 - RNA, 12 nt, Human
uuaacuagaauu

SEQ ID NO: 1906761 - RNA, 14 nt, Human
uuaacuagaauuua

SEQ ID NO: 1906762 - RNA, 16 nt, Human
uuaacuucacauauug

SEQ ID NO: 1906763 - RNA, 15 nt, Human
uuaacuuuuauaaac

SEQ ID NO: 1906764 - RNA, 17 nt, Human
uuaacuuuuauaaacuu

SEQ ID NO: 1906765 - RNA, 16 nt, Human
uuaacuuuuauaaacu

SEQ ID NO: 1906766 - RNA, 18 nt, Human
uuaacuuuuauaaacuuu

SEQ ID NO: 1906767 - RNA, 12 nt, Human
uuaacuucugcc

SEQ ID NO: 1906768 - RNA, 12 nt, Human
uuaacucaauau

SEQ ID NO: 1906769 - RNA, 12 nt, Human
uuaacucagucu

SEQ ID NO: 1906770 - RNA, 19 nt, Human
uuaacuauuuuauuuucua

SEQ ID NO: 1906771 - RNA, 15 nt, Human
uuaacuagaauuuau

SEQ ID NO: 1906772 - RNA, 16 nt, Human
uuaacuagaauuuauu

SEQ ID NO: 1906773 - RNA, 21 nt, Human
uuaacuagaauuuauucaauu

SEQ ID NO: 1906774 - RNA, 20 nt, Human
uuacaagcgugagccacugc

SEQ ID NO: 1906775 - RNA, 17 nt, Human
uuacaagcccccccuuc

SEQ ID NO: 1906776 - RNA, 19 nt, Human
uuacaagcccccccuucca

SEQ ID NO: 1906777 - RNA, 20 nt, Human
uuacaagcccccccuuccac

SEQ ID NO: 1906778 - RNA, 21 nt, Human
uuacaagcgugagccacugca

SEQ ID NO: 1906779 - RNA, 23 nt, Human
uuaaugccgauauacucuagaug

SEQ ID NO: 1906780 - RNA, 18 nt, Human
uuaaugcaucuagauuau

SEQ ID NO: 1906781 - RNA, 17 nt, Human
uuaagcuguuacugucu

SEQ ID NO: 1906782 - RNA, 14 nt, Human
uuaagcuguuucca

SEQ ID NO: 1906783 - RNA, 18 nt, Human
uuaauauugauaugcuua

SEQ ID NO: 1906784 - RNA, 22 nt, Human
uuaauauugauaugcuuauaca

SEQ ID NO: 1906785 - RNA, 20 nt, Human
uguuucauauugaugugugu

SEQ ID NO: 1906786 - RNA, 15 nt, Human
uguuucaaacuuuac

SEQ ID NO: 1906787 - RNA, 16 nt, Human
uguuuagauaauacac

SEQ ID NO: 1906788 - RNA, 23 nt, Human
uggugccccaggaccagcucagg

SEQ ID NO: 1906789 - RNA, 19 nt, Human
uguuuagaagaaguguguc

SEQ ID NO: 1906790 - RNA, 16 nt, Human
uguuuagaagaagugu

SEQ ID NO: 1906791 - RNA, 20 nt, Human
uggugccccaggaccagcuc

SEQ ID NO: 1906792 - RNA, 21 nt, Human
uggugccccaggaccagcuca

SEQ ID NO: 1906793 - RNA, 16 nt, Human
uggugccccaggacca

SEQ ID NO: 1906794 - RNA, 17 nt, Human
uggugccccaggaccag

SEQ ID NO: 1906795 - RNA, 18 nt, Human
uggugccccaggaccagc

SEQ ID NO: 1906796 - RNA, 19 nt, Human
uggugccccaggaccagcu

SEQ ID NO: 1906797 - RNA, 13 nt, Human
uggugccccagga

SEQ ID NO: 1906798 - RNA, 14 nt, Human
uggugccccaggac

SEQ ID NO: 1906799 - RNA, 20 nt, Human
uguuuuaagaggcagggucu

SEQ ID NO: 1906800 - RNA, 13 nt, Human
uguuugugauuga

SEQ ID NO: 1906801 - RNA, 17 nt, Human
uguuugucugucuucau

SEQ ID NO: 1906802 - RNA, 19 nt, Human
uguuugucugucuucauag

SEQ ID NO: 1906803 - RNA, 17 nt, Human
uguuuguaagugaagug

SEQ ID NO: 1906804 - RNA, 20 nt, Human
uguuuccagacuuccuugag

SEQ ID NO: 1906805 - RNA, 23 nt, Human
uguuuccuggcacugcuuccagu

SEQ ID NO: 1906806 - RNA, 23 nt, Human
uguuuccagacuuccuugagaca

SEQ ID NO: 1906807 - RNA, 18 nt, Human
uguuuuuuuuuaaagacu

SEQ ID NO: 1906808 - RNA, 17 nt, Human
uuaaaagauacaguuac

SEQ ID NO: 1906809 - RNA, 14 nt, Human
uuaaaagauacagu

SEQ ID NO: 1906810 - RNA, 19 nt, Human
uguuuuaaggaugcuugua

SEQ ID NO: 1906811 - RNA, 19 nt, Human
uguuuuguaaaguccccag

SEQ ID NO: 1906812 - RNA, 17 nt, Human
uguuuugucuuacaaag

SEQ ID NO: 1906813 - RNA, 22 nt, Human
uguuuuaagaggcagggucuca

SEQ ID NO: 1906814 - RNA, 18 nt, Human
uguuuuaaggaugcuugu

SEQ ID NO: 1906815 - RNA, 10 nt, Human
uguuuuuaaa

SEQ ID NO: 1906816 - RNA, 21 nt, Human
uuaaaauaccagccaguaaau

SEQ ID NO: 1906817 - RNA, 21 nt, Human
uuaaaagaugcaauguagagg

SEQ ID NO: 1906818 - RNA, 19 nt, Human
uuaaacugguauuuuaucu

SEQ ID NO: 1906819 - RNA, 13 nt, Human
uuaaacugguauu

SEQ ID NO: 1906820 - RNA, 22 nt, Human
uuaaacugguauuuuaucuuug

SEQ ID NO: 1906821 - RNA, 19 nt, Human
uuaaagaaguaugggaaau

SEQ ID NO: 1906822 - RNA, 22 nt, Human
uuaaacucuguugcaagugcaa

SEQ ID NO: 1906823 - RNA, 19 nt, Human
uuaaacucuucacaaaauc

SEQ ID NO: 1906824 - RNA, 14 nt, Human
uuaaaaguaaaugu

SEQ ID NO: 1906825 - RNA, 15 nt, Human
uuaggauggcaggac

SEQ ID NO: 1906826 - RNA, 18 nt, Human
uuaggauguugaaaaagu

SEQ ID NO: 1906827 - RNA, 19 nt, Human
uuaggagggaguuaucuaa

SEQ ID NO: 1906828 - RNA, 15 nt, Human
uuaggaagagaaacc

SEQ ID NO: 1906829 - RNA, 12 nt, Human
uuaggagaagcc

SEQ ID NO: 1906830 - RNA, 13 nt, Human
uuaggagaagcca

SEQ ID NO: 1906831 - RNA, 16 nt, Human
uuaggagaagccagga

SEQ ID NO: 1906832 - RNA, 17 nt, Human
uuaggagaagccaggaa

SEQ ID NO: 1906833 - RNA, 22 nt, Human
uuaggccaaaaaaauguaagau

SEQ ID NO: 1906834 - RNA, 16 nt, Human
uuaggccuuccucucu

SEQ ID NO: 1906835 - RNA, 17 nt, Human
uuaguagagacaggguu

SEQ ID NO: 1906836 - RNA, 19 nt, Human
uuaggcugguggcccagga

SEQ ID NO: 1906837 - RNA, 16 nt, Human
uuaggcugguggccca

SEQ ID NO: 1906838 - RNA, 17 nt, Human
uuaggcugguggcccag

SEQ ID NO: 1906839 - RNA, 18 nt, Human
uuaggcugguggcccagg

SEQ ID NO: 1906840 - RNA, 16 nt, Human
uuaguaugaggcauuu

SEQ ID NO: 1906841 - RNA, 18 nt, Human
uuaguaugaggcauuugu

SEQ ID NO: 1906842 - RNA, 14 nt, Human
uuaguguucauaaa

SEQ ID NO: 1906843 - RNA, 18 nt, Human
uuagucucuaaagaguuu

SEQ ID NO: 1906844 - RNA, 22 nt, Human
uuagucucuuguauuaaacucu

SEQ ID NO: 1906845 - RNA, 12 nt, Human
uuagcugcuucu

SEQ ID NO: 1906846 - RNA, 20 nt, Human
uuagcugcuucuauguuuca

SEQ ID NO: 1906847 - RNA, 18 nt, Human
uuagcuccccuccaaccu

SEQ ID NO: 1906848 - RNA, 14 nt, Human
uuagcuccccucca

SEQ ID NO: 1906849 - RNA, 13 nt, Human
uuagcuccccucc

SEQ ID NO: 1906850 - RNA, 22 nt, Human
uuagauaauacaccacuacauu

SEQ ID NO: 1906851 - RNA, 21 nt, Human
uuagcuaaacggauuccaaag

SEQ ID NO: 1906852 - RNA, 14 nt, Human
uuagaguugauacu

SEQ ID NO: 1906853 - RNA, 15 nt, Human
uuacuuuccauugcu

SEQ ID NO: 1906854 - RNA, 18 nt, Human
uuacuuuaaaaggagcca

SEQ ID NO: 1906855 - RNA, 17 nt, Human
uuacuuuaaaaggagcc

SEQ ID NO: 1906856 - RNA, 15 nt, Human
uuagacagucccugc

SEQ ID NO: 1906857 - RNA, 14 nt, Human
uuacuuuguguuca

SEQ ID NO: 1906858 - RNA, 16 nt, Human
uuacuuuucauauuug

SEQ ID NO: 1906859 - RNA, 21 nt, Human
uuacuuuucauauuugcacua

SEQ ID NO: 1906860 - RNA, 16 nt, Human
uuagacagucccugcc

SEQ ID NO: 1906861 - RNA, 17 nt, Human
uuagacagucccugcca

SEQ ID NO: 1906862 - RNA, 18 nt, Human
uuagacagucccugccaa

SEQ ID NO: 1906863 - RNA, 14 nt, Human
uuagacagucccug

SEQ ID NO: 1906864 - RNA, 19 nt, Human
uuagaaaauguuauuuaac

SEQ ID NO: 1906865 - RNA, 23 nt, Human
uuagagacaguugggugagaaca

SEQ ID NO: 1906866 - RNA, 18 nt, Human
uuacuguuagucauuugc

SEQ ID NO: 1906867 - RNA, 13 nt, Human
uuacugugucuuu

SEQ ID NO: 1906868 - RNA, 14 nt, Human
uuacugugucuuug

SEQ ID NO: 1906869 - RNA, 21 nt, Human
uuacuuaaaccgccaaggcug

SEQ ID NO: 1906870 - RNA, 16 nt, Human
uuacuguggcuucuua

SEQ ID NO: 1906871 - RNA, 17 nt, Human
uuacugucuuuuuucua

SEQ ID NO: 1906872 - RNA, 19 nt, Human
uuacuauggcccuggccua

SEQ ID NO: 1906873 - RNA, 19 nt, Human
uuacugucuuuuuucuaaa

SEQ ID NO: 1906874 - RNA, 18 nt, Human
uuacuuagguguggggga

SEQ ID NO: 1906875 - RNA, 12 nt, Human
uuacuucugcua

SEQ ID NO: 1906876 - RNA, 23 nt, Human
uuacuucuuauacauuugauaaa

SEQ ID NO: 1906877 - RNA, 11 nt, Human
uuacuucugcu

SEQ ID NO: 1906878 - RNA, 17 nt, Human
uuacuaguuucccuugc

SEQ ID NO: 1906879 - RNA, 21 nt, Human
uuacuaggugcccagaaugag

SEQ ID NO: 1906880 - RNA, 14 nt, Human
uuacuagguaacuu

SEQ ID NO: 1906881 - RNA, 16 nt, Human
uuacuagguaacuuca

SEQ ID NO: 1906882 - RNA, 17 nt, Human
uuacuagguaacuucau

SEQ ID NO: 1906883 - RNA, 19 nt, Human
uuacuagguaacuucauau

SEQ ID NO: 1906884 - RNA, 16 nt, Human
uuacuaauagacaauu

SEQ ID NO: 1906885 - RNA, 14 nt, Human
uuacuaaguuuuua

SEQ ID NO: 1906886 - RNA, 13 nt, Human
uuacuaaguuuuu

SEQ ID NO: 1906887 - RNA, 12 nt, Human
uuccuauaugca

SEQ ID NO: 1906888 - RNA, 15 nt, Human
uucccuuugugcaca

SEQ ID NO: 1906889 - RNA, 21 nt, Human
uucccuuugacgccaucccag

SEQ ID NO: 1906890 - RNA, 22 nt, Human
uucccuuugacgccaucccagc

SEQ ID NO: 1906891 - RNA, 20 nt, Human
uucccuuugacgccauccca

SEQ ID NO: 1906892 - RNA, 13 nt, Human
uuccucauuagca

SEQ ID NO: 1906893 - RNA, 21 nt, Human
uuccucacaccaggcuugccu

SEQ ID NO: 1906894 - RNA, 12 nt, Human
uucccugaggug

SEQ ID NO: 1906895 - RNA, 16 nt, Human
uucccugaaggaacca

SEQ ID NO: 1906896 - RNA, 17 nt, Human
uucccugcuuaaugaaa

SEQ ID NO: 1906897 - RNA, 19 nt, Human
uucccuucgacagcauuuu

SEQ ID NO: 1906898 - RNA, 14 nt, Human
uucgggcuggccau

SEQ ID NO: 1906899 - RNA, 13 nt, Human
uucgggcugugcc

SEQ ID NO: 1906900 - RNA, 12 nt, Human
uucgggcugugc

SEQ ID NO: 1906901 - RNA, 20 nt, Human
uucgggaggucgaggcagga

SEQ ID NO: 1906902 - RNA, 20 nt, Human
uuccuuguagccuuuugacu

SEQ ID NO: 1906903 - RNA, 18 nt, Human
uuccuuguagccuuuuga

SEQ ID NO: 1906904 - RNA, 19 nt, Human
uuccuuguagccuuuugac

SEQ ID NO: 1906905 - RNA, 16 nt, Human
uuccuuguagccuuuu

SEQ ID NO: 1906906 - RNA, 24 nt, Human
uuccuugagacacggagcccagcc

SEQ ID NO: 1906907 - RNA, 18 nt, Human
uucuaaaaauugugauca

SEQ ID NO: 1906908 - RNA, 14 nt, Human
uucgggcugugccc

SEQ ID NO: 1906909 - RNA, 12 nt, Human
uucguucugugg

SEQ ID NO: 1906910 - RNA, 15 nt, Human
uucuaaagauggaaa

SEQ ID NO: 1906911 - RNA, 13 nt, Human
uucuaaagcugcc

SEQ ID NO: 1906912 - RNA, 17 nt, Human
uucuaaagcugccagcc

SEQ ID NO: 1906913 - RNA, 20 nt, Human
uuccuugaguugauucagcu

SEQ ID NO: 1906914 - RNA, 22 nt, Human
uuccuugagacacggagcccag

SEQ ID NO: 1906915 - RNA, 14 nt, Human
uuccuggcacugcu

SEQ ID NO: 1906916 - RNA, 16 nt, Human
uuccuggagcccagag

SEQ ID NO: 1906917 - RNA, 15 nt, Human
uuccuggagcccaga

SEQ ID NO: 1906918 - RNA, 17 nt, Human
uuccugccaggcauggu

SEQ ID NO: 1906919 - RNA, 23 nt, Human
uuccugaugcuucuucagagacu

SEQ ID NO: 1906920 - RNA, 18 nt, Human
uuccugaugcuucuucag

SEQ ID NO: 1906921 - RNA, 19 nt, Human
uuccugaugcuucuucaga

SEQ ID NO: 1906922 - RNA, 15 nt, Human
uuccugaugcuucuu

SEQ ID NO: 1906923 - RNA, 13 nt, Human
uuccauucucacc

SEQ ID NO: 1906924 - RNA, 16 nt, Human
uucccauuugcuccuu

SEQ ID NO: 1906925 - RNA, 15 nt, Human
uuccccaggaggcca

SEQ ID NO: 1906926 - RNA, 16 nt, Human
uuccccaggaggccag

SEQ ID NO: 1906927 - RNA, 17 nt, Human
uucccauguagcccccu

SEQ ID NO: 1906928 - RNA, 19 nt, Human
uucccauccucuucuuuua

SEQ ID NO: 1906929 - RNA, 11 nt, Human
uucccucccuu

SEQ ID NO: 1906930 - RNA, 17 nt, Human
uucccucccuuccucuu

SEQ ID NO: 1906931 - RNA, 20 nt, Human
uucccucccuuccucuuucc

SEQ ID NO: 1906932 - RNA, 23 nt, Human
uucccccaaauuuaaagaaguau

SEQ ID NO: 1906933 - RNA, 21 nt, Human
uucccccaccccauuucucuc

SEQ ID NO: 1906934 - RNA, 17 nt, Human
uuccccaucuucuaaac

SEQ ID NO: 1906935 - RNA, 18 nt, Human
uuccccaucuucuaaacc

SEQ ID NO: 1906936 - RNA, 21 nt, Human
uuccccaggaggccagccuug

SEQ ID NO: 1906937 - RNA, 17 nt, Human
uuccccaggaggccagc

SEQ ID NO: 1906938 - RNA, 18 nt, Human
uuccccaggaggccagcc

SEQ ID NO: 1906939 - RNA, 19 nt, Human
uuccccaggaggccagccu

SEQ ID NO: 1906940 - RNA, 20 nt, Human
uuccccaggaggccagccuu

SEQ ID NO: 1906941 - RNA, 15 nt, Human
uuccaaauucugcuu

SEQ ID NO: 1906942 - RNA, 21 nt, Human
uuccaaagaguagaauugcau

SEQ ID NO: 1906943 - RNA, 18 nt, Human
uuccacucaggucuguuu

SEQ ID NO: 1906944 - RNA, 18 nt, Human
uuccacuccuccuagcca

SEQ ID NO: 1906945 - RNA, 16 nt, Human
uuccacuccuccuagc

SEQ ID NO: 1906946 - RNA, 21 nt, Human
uuccacuccuccuagccaccc

SEQ ID NO: 1906947 - RNA, 16 nt, Human
uucauuuccugugucu

SEQ ID NO: 1906948 - RNA, 15 nt, Human
uucauuuccuguguc

SEQ ID NO: 1906949 - RNA, 17 nt, Human
uucaugcaaacuuuauu

SEQ ID NO: 1906950 - RNA, 21 nt, Human
uucaucuugaauuguaaggaa

SEQ ID NO: 1906951 - RNA, 17 nt, Human
uucaugaaagauucaau

SEQ ID NO: 1906952 - RNA, 15 nt, Human
uucaugaaagauuca

SEQ ID NO: 1906953 - RNA, 11 nt, Human
uucaggaagcu

SEQ ID NO: 1906954 - RNA, 13 nt, Human
uucaggaagcuca

SEQ ID NO: 1906955 - RNA, 16 nt, Human
uuauuaaugcuaaggg

SEQ ID NO: 1906956 - RNA, 15 nt, Human
uuauuaaugcuaagg

SEQ ID NO: 1906957 - RNA, 14 nt, Human
uuauuaauugcuuu

SEQ ID NO: 1906958 - RNA, 15 nt, Human
uuauuaauugcuuug

SEQ ID NO: 1906959 - RNA, 14 nt, Human
uuauuaaugcuaag

SEQ ID NO: 1906960 - RNA, 13 nt, Human
uuauuaaugcuaa

SEQ ID NO: 1906961 - RNA, 10 nt, Human
uuauuaaagg

SEQ ID NO: 1906962 - RNA, 18 nt, Human
uuauuaaauacaaaacuu

SEQ ID NO: 1906963 - RNA, 12 nt, Human
uuaugcuuuugg

SEQ ID NO: 1906964 - RNA, 15 nt, Human
uuauugcccacgcug

SEQ ID NO: 1906965 - RNA, 19 nt, Human
uuauugcagcgauuaauaa

SEQ ID NO: 1906966 - RNA, 11 nt, Human
uuauucugcuc

SEQ ID NO: 1906967 - RNA, 14 nt, Human
uuauugacacagaa

SEQ ID NO: 1906968 - RNA, 19 nt, Human
uuauugacacagaaaaugu

SEQ ID NO: 1906969 - RNA, 23 nt, Human
uuauugacacagaaaauguugag

SEQ ID NO: 1906970 - RNA, 18 nt, Human
uuauugaaucuauuuaag

SEQ ID NO: 1906971 - RNA, 20 nt, Human
uuauugaaucuauuuaagua

SEQ ID NO: 1906972 - RNA, 16 nt, Human
uuauggaacacucuga

SEQ ID NO: 1906973 - RNA, 15 nt, Human
uuaugccuuuuauuu

SEQ ID NO: 1906974 - RNA, 13 nt, Human
uuaugcugaaaca

SEQ ID NO: 1906975 - RNA, 22 nt, Human
uuaugcaugaaguaauaugcac

SEQ ID NO: 1906976 - RNA, 17 nt, Human
uuaugcauguuuguugu

SEQ ID NO: 1906977 - RNA, 14 nt, Human
uuaugcauagauaa

SEQ ID NO: 1906978 - RNA, 20 nt, Human
uuaugcaagggacugugugu

SEQ ID NO: 1906979 - RNA, 16 nt, Human
uuaugcaugaaguaau

SEQ ID NO: 1906980 - RNA, 16 nt, Human
uuaucuugucucuggg

SEQ ID NO: 1906981 - RNA, 17 nt, Human
uuaucuugucucugggc

SEQ ID NO: 1906982 - RNA, 17 nt, Human
uuaucuagauacuguau

SEQ ID NO: 1906983 - RNA, 17 nt, Human
uuaucuauacauaucuu

SEQ ID NO: 1906984 - RNA, 20 nt, Human
uuaucuugaauaauguaaga

SEQ ID NO: 1906985 - RNA, 15 nt, Human
uuaguugcuguaugu

SEQ ID NO: 1906986 - RNA, 13 nt, Human
uuaguugcuguau

SEQ ID NO: 1906987 - RNA, 20 nt, Human
uuaguugcaacuuuguauaa

SEQ ID NO: 1906988 - RNA, 16 nt, Human
uuaucuagauacugua

SEQ ID NO: 1906989 - RNA, 16 nt, Human
uuaguuccucauuagc

SEQ ID NO: 1906990 - RNA, 14 nt, Human
uuaguuccuugagu

SEQ ID NO: 1906991 - RNA, 13 nt, Human
uuaguugcaacuu

SEQ ID NO: 1906992 - RNA, 14 nt, Human
uucaccuugaagaa

SEQ ID NO: 1906993 - RNA, 22 nt, Human
uucaccuguuuuuaagcuguuu

SEQ ID NO: 1906994 - RNA, 23 nt, Human
uucaccuguuuuuaagcuguuuc

SEQ ID NO: 1906995 - RNA, 19 nt, Human
uucaccuguuuuuaagcug

SEQ ID NO: 1906996 - RNA, 21 nt, Human
uucaccuguuuuuaagcuguu

SEQ ID NO: 1906997 - RNA, 17 nt, Human
uucacaaacagaaaaca

SEQ ID NO: 1906998 - RNA, 18 nt, Human
uucaccugccccaacucu

SEQ ID NO: 1906999 - RNA, 15 nt, Human
uucacaaacuuuuau

SEQ ID NO: 1907000 - RNA, 15 nt, Human
uucacgugguccuaa

SEQ ID NO: 1907001 - RNA, 18 nt, Human
uucacggaagagccuugc

SEQ ID NO: 1907002 - RNA, 14 nt, Human
uucacguagaacau

SEQ ID NO: 1907003 - RNA, 13 nt, Human
uucaauaggaaaa

SEQ ID NO: 1907004 - RNA, 15 nt, Human
uucaauaggaaaaac

SEQ ID NO: 1907005 - RNA, 18 nt, Human
uucaauaggaaaaacuga

SEQ ID NO: 1907006 - RNA, 20 nt, Human
uucaauaggaaaaacugauu

SEQ ID NO: 1907007 - RNA, 21 nt, Human
uucaacugccaaaaugcucua

SEQ ID NO: 1907008 - RNA, 12 nt, Human
uucaauuguaaa

SEQ ID NO: 1907009 - RNA, 14 nt, Human
uucaauuguaaauu

SEQ ID NO: 1907010 - RNA, 19 nt, Human
uucaauuuccaagagcuga

SEQ ID NO: 1907011 - RNA, 17 nt, Human
uucaauuuccaagagcu

SEQ ID NO: 1907012 - RNA, 21 nt, Human
uucagaguugaugguuguaca

SEQ ID NO: 1907013 - RNA, 22 nt, Human
uucagaguugaugguuguacau

SEQ ID NO: 1907014 - RNA, 19 nt, Human
uucagagacuccugcaggc

SEQ ID NO: 1907015 - RNA, 20 nt, Human
uucagacauagaauuaacac

SEQ ID NO: 1907016 - RNA, 21 nt, Human
uucagacagcugccugggauc

SEQ ID NO: 1907017 - RNA, 16 nt, Human
uucagacauagaauua

SEQ ID NO: 1907018 - RNA, 13 nt, Human
uucacucuccuug

SEQ ID NO: 1907019 - RNA, 14 nt, Human
uucacuccugcugu

SEQ ID NO: 1907020 - RNA, 17 nt, Human
uuauugucaaaguggug

SEQ ID NO: 1907021 - RNA, 15 nt, Human
uuauuguaccucucu

SEQ ID NO: 1907022 - RNA, 17 nt, Human
uuauuguaccucucuua

SEQ ID NO: 1907023 - RNA, 18 nt, Human
uuauugucaaagugguga

SEQ ID NO: 1907024 - RNA, 12 nt, Human
uuauugcauuug

SEQ ID NO: 1907025 - RNA, 12 nt, Human
uuauuguaccuc

SEQ ID NO: 1907026 - RNA, 14 nt, Human
uuauuguaccucuc

SEQ ID NO: 1907027 - RNA, 20 nt, Human
uuauuuuauguugcauagaa

SEQ ID NO: 1907028 - RNA, 12 nt, Human
uuauuuuaagac

SEQ ID NO: 1907029 - RNA, 13 nt, Human
uucaaagccauuu

SEQ ID NO: 1907030 - RNA, 14 nt, Human
uucaaagccauuuu

SEQ ID NO: 1907031 - RNA, 21 nt, Human
uuugaaauuguauuacaaauc

SEQ ID NO: 1907032 - RNA, 18 nt, Human
uuugaagcacagugauca

SEQ ID NO: 1907033 - RNA, 16 nt, Human
uuugaagcuacugugu

SEQ ID NO: 1907034 - RNA, 18 nt, Human
uuugaagcuacugugugu

SEQ ID NO: 1907035 - RNA, 12 nt, Human
uuugaaggcaaa

SEQ ID NO: 1907036 - RNA, 13 nt, Human
uuugaaggcaaaa

SEQ ID NO: 1907037 - RNA, 19 nt, Human
uuucuuguguguuuauugu

SEQ ID NO: 1907038 - RNA, 21 nt, Human
uuucuugccucuguccccuuc

SEQ ID NO: 1907039 - RNA, 18 nt, Human
uuucuugccucugucccc

SEQ ID NO: 1907040 - RNA, 18 nt, Human
uuucuuaaccagaucauu

SEQ ID NO: 1907041 - RNA, 16 nt, Human
uuugagaucagccugg

SEQ ID NO: 1907042 - RNA, 17 nt, Human
uuugagaucagccuggg

SEQ ID NO: 1907043 - RNA, 19 nt, Human
uuugaauauaaacacuaua

SEQ ID NO: 1907044 - RNA, 18 nt, Human
uuugaauauaaacacuau

SEQ ID NO: 1907045 - RNA, 17 nt, Human
uuugaauauaaacacua

SEQ ID NO: 1907046 - RNA, 21 nt, Human
uuugaggguguauauuuucug

SEQ ID NO: 1907047 - RNA, 20 nt, Human
uuugguaaaauacuucuuga

SEQ ID NO: 1907048 - RNA, 14 nt, Human
uuuggguucugccu

SEQ ID NO: 1907049 - RNA, 15 nt, Human
uuuggguucugccug

SEQ ID NO: 1907050 - RNA, 16 nt, Human
uuuggguucugccugc

SEQ ID NO: 1907051 - RNA, 20 nt, Human
uuugguucauuaauucuaua

SEQ ID NO: 1907052 - RNA, 13 nt, Human
uuugguucuaaua

SEQ ID NO: 1907053 - RNA, 12 nt, Human
uuugguucugug

SEQ ID NO: 1907054 - RNA, 15 nt, Human
uuuguauucucuccu

SEQ ID NO: 1907055 - RNA, 18 nt, Human
uuuguauguuuuuuuucu

SEQ ID NO: 1907056 - RNA, 10 nt, Human
uuuguauguu

SEQ ID NO: 1907057 - RNA, 12 nt, Human
uuuguauguuuu

SEQ ID NO: 1907058 - RNA, 17 nt, Human
uuuguaaaguccccaga

SEQ ID NO: 1907059 - RNA, 16 nt, Human
uuugcuugaaagaaaa

SEQ ID NO: 1907060 - RNA, 14 nt, Human
uuugcuugaaagaa

SEQ ID NO: 1907061 - RNA, 16 nt, Human
uuugcuucucucucua

SEQ ID NO: 1907062 - RNA, 15 nt, Human
uuuggacccugaggc

SEQ ID NO: 1907063 - RNA, 19 nt, Human
uuuggacccugaggcccag

SEQ ID NO: 1907064 - RNA, 15 nt, Human
uuugcuuucugcuca

SEQ ID NO: 1907065 - RNA, 16 nt, Human
uuuggacuguuuuguu

SEQ ID NO: 1907066 - RNA, 14 nt, Human
uuugauccaagcug

SEQ ID NO: 1907067 - RNA, 17 nt, Human
uuugauaugugaacagu

SEQ ID NO: 1907068 - RNA, 15 nt, Human
uuugauaugugaaca

SEQ ID NO: 1907069 - RNA, 14 nt, Human
uuugauaugugaac

SEQ ID NO: 1907070 - RNA, 15 nt, Human
uuugccaagaccuuu

SEQ ID NO: 1907071 - RNA, 20 nt, Human
uuucucuccagccugacuug

SEQ ID NO: 1907072 - RNA, 16 nt, Human
uuucuccuuuguacuu

SEQ ID NO: 1907073 - RNA, 18 nt, Human
uuucuacccagcgagccc

SEQ ID NO: 1907074 - RNA, 15 nt, Human
uuucuacccagcgag

SEQ ID NO: 1907075 - RNA, 22 nt, Human
uuucuacccagcgagcccuggu

SEQ ID NO: 1907076 - RNA, 21 nt, Human
uuucuacaaugugaacuuuau

SEQ ID NO: 1907077 - RNA, 14 nt, Human
uuucugaaauaaca

SEQ ID NO: 1907078 - RNA, 20 nt, Human
uuucugaaaauuaacacugc

SEQ ID NO: 1907079 - RNA, 19 nt, Human
uuucugaaaauuaacacug

SEQ ID NO: 1907080 - RNA, 16 nt, Human
uuucucuccucacaca

SEQ ID NO: 1907081 - RNA, 23 nt, Human
uuucugauaacuagauggugcug

SEQ ID NO: 1907082 - RNA, 12 nt, Human
uuucugaaauuu

SEQ ID NO: 1907083 - RNA, 17 nt, Human
uuucuaaaguaaaaaca

SEQ ID NO: 1907084 - RNA, 22 nt, Human
uuucuaaaguaaaaacaaagaa

SEQ ID NO: 1907085 - RNA, 19 nt, Human
uuucuaaaucuccaaaaua

SEQ ID NO: 1907086 - RNA, 17 nt, Human
uuucuacaaugugaacu

SEQ ID NO: 1907087 - RNA, 18 nt, Human
uuucuacaaugugaacuu

SEQ ID NO: 1907088 - RNA, 22 nt, Human
uuucuacaaugugaacuuuauu

SEQ ID NO: 1907089 - RNA, 19 nt, Human
uuuccuggcacugcuucca

SEQ ID NO: 1907090 - RNA, 13 nt, Human
uuuccucugcuuu

SEQ ID NO: 1907091 - RNA, 17 nt, Human
uuuccucugcuuugaaa

SEQ ID NO: 1907092 - RNA, 23 nt, Human
uuuccuggcacugcuuccaguga

SEQ ID NO: 1907093 - RNA, 22 nt, Human
uuuccuccugaggcuuuggauu

SEQ ID NO: 1907094 - RNA, 14 nt, Human
uuuccuccuuccau

SEQ ID NO: 1907095 - RNA, 21 nt, Human
uuuccuccugaggcuuuggau

SEQ ID NO: 1907096 - RNA, 20 nt, Human
uuuccucccuucugcuacug

SEQ ID NO: 1907097 - RNA, 15 nt, Human
uuuccuaaggcugca

SEQ ID NO: 1907098 - RNA, 17 nt, Human
uuuccuaaggcugcaag

SEQ ID NO: 1907099 - RNA, 22 nt, Human
uuucaauuccaccugcaaucaa

SEQ ID NO: 1907100 - RNA, 14 nt, Human
uuucaauuuccaag

SEQ ID NO: 1907101 - RNA, 17 nt, Human
uuucagccaagaauucu

SEQ ID NO: 1907102 - RNA, 22 nt, Human
uuuaugauacuugaaaauuaac

SEQ ID NO: 1907103 - RNA, 20 nt, Human
uuuaugccuuuuauuucuua

SEQ ID NO: 1907104 - RNA, 21 nt, Human
uuuaugcugaaacagaauacu

SEQ ID NO: 1907105 - RNA, 14 nt, Human
uuucauuucaacug

SEQ ID NO: 1907106 - RNA, 19 nt, Human
uuucauuugguucauuaau

SEQ ID NO: 1907107 - RNA, 21 nt, Human
uuucauuuguuuguuuuccuu

SEQ ID NO: 1907108 - RNA, 17 nt, Human
uuucagugaaagcauca

SEQ ID NO: 1907109 - RNA, 20 nt, Human
uuuccuaaauauauuuuaag

SEQ ID NO: 1907110 - RNA, 17 nt, Human
uuuccacucaggucugu

SEQ ID NO: 1907111 - RNA, 18 nt, Human
uuuccacuccuccuagcc

SEQ ID NO: 1907112 - RNA, 19 nt, Human
uuuccacuccuccuagcca

SEQ ID NO: 1907113 - RNA, 20 nt, Human
uuucauuuuuuuccaggcug

SEQ ID NO: 1907114 - RNA, 15 nt, Human
uuucauuuuuuucca

SEQ ID NO: 1907115 - RNA, 22 nt, Human
uuucauuuuguaacaaaugaac

SEQ ID NO: 1907116 - RNA, 22 nt, Human
uuuaaaacaagaaaguuucccc

SEQ ID NO: 1907117 - RNA, 21 nt, Human
uuuaaaacaagaaaguuuccc

SEQ ID NO: 1907118 - RNA, 13 nt, Human
uuguuuguuuucc

SEQ ID NO: 1907119 - RNA, 13 nt, Human
uuguuugucuuua

SEQ ID NO: 1907120 - RNA, 20 nt, Human
uuguuuggggaugagaaagg

SEQ ID NO: 1907121 - RNA, 12 nt, Human
uuguuucuguuu

SEQ ID NO: 1907122 - RNA, 19 nt, Human
uuguuuauuaguuuugcau

SEQ ID NO: 1907123 - RNA, 19 nt, Human
uugucuuuggugaacauug

SEQ ID NO: 1907124 - RNA, 20 nt, Human
uugucuuuggacccugaggc

SEQ ID NO: 1907125 - RNA, 24 nt, Human
uugucuuuggacccugaggcccag

SEQ ID NO: 1907126 - RNA, 15 nt, Human
uugucuuuggacccu

SEQ ID NO: 1907127 - RNA, 14 nt, Human
uugucuuuaacugu

SEQ ID NO: 1907128 - RNA, 13 nt, Human
uuguucaaacauu

SEQ ID NO: 1907129 - RNA, 14 nt, Human
uuguuauuuauaac

SEQ ID NO: 1907130 - RNA, 18 nt, Human
uuguuuagaagaagugug

SEQ ID NO: 1907131 - RNA, 15 nt, Human
uuguuuagaagaagu

SEQ ID NO: 1907132 - RNA, 12 nt, Human
uuuaaaaugucu

SEQ ID NO: 1907133 - RNA, 16 nt, Human
uuuaaaaugagaaauc

SEQ ID NO: 1907134 - RNA, 16 nt, Human
uuuaaaauugugaugu

SEQ ID NO: 1907135 - RNA, 13 nt, Human
uuuaacagaaaug

SEQ ID NO: 1907136 - RNA, 13 nt, Human
uuuaaaagauaca

SEQ ID NO: 1907137 - RNA, 20 nt, Human
uuuaaaagauaaauauuaua

SEQ ID NO: 1907138 - RNA, 18 nt, Human
uuuaaaagaugcaaugua

SEQ ID NO: 1907139 - RNA, 16 nt, Human
uuuaaaauauuuaucu

SEQ ID NO: 1907140 - RNA, 20 nt, Human
uuuaaaaguuacuccuuuua

SEQ ID NO: 1907141 - RNA, 17 nt, Human
uuuacagaugaauguau

SEQ ID NO: 1907142 - RNA, 16 nt, Human
uuuacauggcuggagc

SEQ ID NO: 1907143 - RNA, 19 nt, Human
uuuacccacacacagauaa

SEQ ID NO: 1907144 - RNA, 13 nt, Human
uuuacagagacag

SEQ ID NO: 1907145 - RNA, 20 nt, Human
uuuacagaggacaguauuug

SEQ ID NO: 1907146 - RNA, 22 nt, Human
uuuaauaaacacucuugaaaaa

SEQ ID NO: 1907147 - RNA, 13 nt, Human
uuuaauaaaccau

SEQ ID NO: 1907148 - RNA, 21 nt, Human
uuuaaccccgucaacaaaucu

SEQ ID NO: 1907149 - RNA, 14 nt, Human
uuuaauaaacacuc

SEQ ID NO: 1907150 - RNA, 15 nt, Human
uuuaauaaacacucu

SEQ ID NO: 1907151 - RNA, 14 nt, Human
uuuaaccucuaaau

SEQ ID NO: 1907152 - RNA, 16 nt, Human
uuuaaccccgucaaca

SEQ ID NO: 1907153 - RNA, 17 nt, Human
uuuaaccccgucaacaa

SEQ ID NO: 1907154 - RNA, 18 nt, Human
uuuaaccccgucaacaaa

SEQ ID NO: 1907155 - RNA, 21 nt, Human
uuuaaccauggugcuuguuaa

SEQ ID NO: 1907156 - RNA, 15 nt, Human
uuuaacagaaaugua

SEQ ID NO: 1907157 - RNA, 14 nt, Human
uuuaacagaaaugu

SEQ ID NO: 1907158 - RNA, 19 nt, Human
uuuagacccuauugcugcu

SEQ ID NO: 1907159 - RNA, 16 nt, Human
uuuagacagucucacu

SEQ ID NO: 1907160 - RNA, 20 nt, Human
uuuagacagucucacuuugu

SEQ ID NO: 1907161 - RNA, 17 nt, Human
uuuaguugcaacuuugu

SEQ ID NO: 1907162 - RNA, 18 nt, Human
uuuaguugcaacuuugua

SEQ ID NO: 1907163 - RNA, 22 nt, Human
uuuagacccuauugcugcuuga

SEQ ID NO: 1907164 - RNA, 18 nt, Human
uuuauaaacuuuaccuuu

SEQ ID NO: 1907165 - RNA, 20 nt, Human
uuuauacauaaacaagacca

SEQ ID NO: 1907166 - RNA, 12 nt, Human
uuuauacauaaa

SEQ ID NO: 1907167 - RNA, 16 nt, Human
uuuauacucuuucugu

SEQ ID NO: 1907168 - RNA, 18 nt, Human
uuuauacucuuucuguau

SEQ ID NO: 1907169 - RNA, 20 nt, Human
uuuauacucuuucuguauau

SEQ ID NO: 1907170 - RNA, 17 nt, Human
uuuauacuggcaugcua

SEQ ID NO: 1907171 - RNA, 13 nt, Human
uuuauacuguaua

SEQ ID NO: 1907172 - RNA, 12 nt, Human
uuuaucauuuuc

SEQ ID NO: 1907173 - RNA, 14 nt, Human
uuuaucuugucucu

SEQ ID NO: 1907174 - RNA, 13 nt, Human
uuuaucugauuaa

SEQ ID NO: 1907175 - RNA, 17 nt, Human
uugccuucuacuuuuaa

SEQ ID NO: 1907176 - RNA, 21 nt, Human
uugccauguuggccaggcugg

SEQ ID NO: 1907177 - RNA, 20 nt, Human
uugccauguuggccaggcug

SEQ ID NO: 1907178 - RNA, 14 nt, Human
uugcugcuugaggc

SEQ ID NO: 1907179 - RNA, 16 nt, Human
uugcugcuugaggcaa

SEQ ID NO: 1907180 - RNA, 13 nt, Human
uugcugcugaagg

SEQ ID NO: 1907181 - RNA, 16 nt, Human
uugcugucccuuuucc

SEQ ID NO: 1907182 - RNA, 18 nt, Human
uugcugucccuuuuccuu

SEQ ID NO: 1907183 - RNA, 15 nt, Human
uuggacacuguacaa

SEQ ID NO: 1907184 - RNA, 16 nt, Human
uuggacagaagcagcu

SEQ ID NO: 1907185 - RNA, 19 nt, Human
uuggacagaagcagcucuu

SEQ ID NO: 1907186 - RNA, 13 nt, Human
uuggaauacuuuu

SEQ ID NO: 1907187 - RNA, 18 nt, Human
uuggacaaaauggaauac

SEQ ID NO: 1907188 - RNA, 19 nt, Human
uuggaagcuccgcuuucua

SEQ ID NO: 1907189 - RNA, 15 nt, Human
uuggauuguccccga

SEQ ID NO: 1907190 - RNA, 14 nt, Human
uuggauuugacauu

SEQ ID NO: 1907191 - RNA, 22 nt, Human
uuggauuugacauugcguuuga

SEQ ID NO: 1907192 - RNA, 15 nt, Human
uuggacccugaggcc

SEQ ID NO: 1907193 - RNA, 18 nt, Human
uuggacccugaggcccag

SEQ ID NO: 1907194 - RNA, 19 nt, Human
uuggacccugaggcccaga

SEQ ID NO: 1907195 - RNA, 21 nt, Human
uuggacccugaggcccagagg

SEQ ID NO: 1907196 - RNA, 13 nt, Human
uuggcaccagaca

SEQ ID NO: 1907197 - RNA, 17 nt, Human
uuggcaccagacaccca

SEQ ID NO: 1907198 - RNA, 20 nt, Human
uuggcaccagacacccagga

SEQ ID NO: 1907199 - RNA, 21 nt, Human
uuggcaccagacacccaggac

SEQ ID NO: 1907200 - RNA, 23 nt, Human
uuggcaccagacacccaggacuu

SEQ ID NO: 1907201 - RNA, 19 nt, Human
uuggcaccuaauccaggca

SEQ ID NO: 1907202 - RNA, 21 nt, Human
uuggcaccuaauccaggcaga

SEQ ID NO: 1907203 - RNA, 16 nt, Human
uuggcagcucuacucu

SEQ ID NO: 1907204 - RNA, 20 nt, Human
uuggucugacccacugcuuu

SEQ ID NO: 1907205 - RNA, 13 nt, Human
uuguaaaauggug

SEQ ID NO: 1907206 - RNA, 12 nt, Human
uuguaaaauggu

SEQ ID NO: 1907207 - RNA, 15 nt, Human
uuggucugugagaug

SEQ ID NO: 1907208 - RNA, 13 nt, Human
uugggauuaauau

SEQ ID NO: 1907209 - RNA, 23 nt, Human
uuggcuucacggaagagccuugc

SEQ ID NO: 1907210 - RNA, 21 nt, Human
uugggaaggggacccccgccc

SEQ ID NO: 1907211 - RNA, 20 nt, Human
uugggaccccuggugguuca

SEQ ID NO: 1907212 - RNA, 16 nt, Human
uugggaccccuggugg

SEQ ID NO: 1907213 - RNA, 15 nt, Human
uugggaccccuggug

SEQ ID NO: 1907214 - RNA, 14 nt, Human
uugggaccccuggu

SEQ ID NO: 1907215 - RNA, 16 nt, Human
uuguaccgcaauguga

SEQ ID NO: 1907216 - RNA, 11 nt, Human
uuguaccucuc

SEQ ID NO: 1907217 - RNA, 20 nt, Human
uuguaaaauggugugaccac

SEQ ID NO: 1907218 - RNA, 18 nt, Human
uuguacuuuagggaagua

SEQ ID NO: 1907219 - RNA, 22 nt, Human
uuguagaagucacauuccugaa

SEQ ID NO: 1907220 - RNA, 17 nt, Human
uuguagaagucacauuc

SEQ ID NO: 1907221 - RNA, 15 nt, Human
uuguagcauccugga

SEQ ID NO: 1907222 - RNA, 17 nt, Human
uuguagcauccucuuua

SEQ ID NO: 1907223 - RNA, 14 nt, Human
uugucuaugggacu

SEQ ID NO: 1907224 - RNA, 22 nt, Human
uugucaaaguggugagaggcau

SEQ ID NO: 1907225 - RNA, 20 nt, Human
uugucuaugggacucaaugc

SEQ ID NO: 1907226 - RNA, 12 nt, Human
uugucucugggc

SEQ ID NO: 1907227 - RNA, 23 nt, Human
uugaauugcauuuuuuaaaacaa

SEQ ID NO: 1907228 - RNA, 19 nt, Human
uugagccuugaacuuugac

SEQ ID NO: 1907229 - RNA, 15 nt, Human
uugagcuauugcugu

SEQ ID NO: 1907230 - RNA, 16 nt, Human
uugagccuugaacuuu

SEQ ID NO: 1907231 - RNA, 15 nt, Human
uugagccuugaacuu

SEQ ID NO: 1907232 - RNA, 14 nt, Human
uugagccuugaacu

SEQ ID NO: 1907233 - RNA, 14 nt, Human
uugagccugggagg

SEQ ID NO: 1907234 - RNA, 19 nt, Human
uugaauuaaauguucaucu

SEQ ID NO: 1907235 - RNA, 20 nt, Human
uugaauugaggggauuaaua

SEQ ID NO: 1907236 - RNA, 18 nt, Human
uugaucccuucuguuggu

SEQ ID NO: 1907237 - RNA, 17 nt, Human
uugauccagaaagaaaa

SEQ ID NO: 1907238 - RNA, 17 nt, Human
uugauucagacagcugc

SEQ ID NO: 1907239 - RNA, 21 nt, Human
uugauucagacagcugccugg

SEQ ID NO: 1907240 - RNA, 23 nt, Human
uugauucagacagcugccuggga

SEQ ID NO: 1907241 - RNA, 16 nt, Human
uugauucagcucugca

SEQ ID NO: 1907242 - RNA, 18 nt, Human
uugauauuugugcauuuu

SEQ ID NO: 1907243 - RNA, 20 nt, Human
uugauauuugugcauuuucu

SEQ ID NO: 1907244 - RNA, 21 nt, Human
uugauauuugugcauuuucua

SEQ ID NO: 1907245 - RNA, 17 nt, Human
uugaucaacaucuuuuc

SEQ ID NO: 1907246 - RNA, 22 nt, Human
uugaucaacaucuuuucuugcc

SEQ ID NO: 1907247 - RNA, 18 nt, Human
uugaucaacaucuuuucu

SEQ ID NO: 1907248 - RNA, 18 nt, Human
uugaucagaucugacaug

SEQ ID NO: 1907249 - RNA, 16 nt, Human
uugauaugcuuauaca

SEQ ID NO: 1907250 - RNA, 16 nt, Human
uugauaugugaacagu

SEQ ID NO: 1907251 - RNA, 19 nt, Human
uugccauguuggccaggcu

SEQ ID NO: 1907252 - RNA, 18 nt, Human
uugccauguuggccaggc

SEQ ID NO: 1907253 - RNA, 17 nt, Human
uugccauguuggccagg

SEQ ID NO: 1907254 - RNA, 16 nt, Human
uugccauguuggccag

SEQ ID NO: 1907255 - RNA, 16 nt, Human
uugcauaacguauaaa

SEQ ID NO: 1907256 - RNA, 13 nt, Human
uugcauaagguuu

SEQ ID NO: 1907257 - RNA, 12 nt, Human
uugcauaauaaa

SEQ ID NO: 1907258 - RNA, 19 nt, Human
uugccagagauccaaaaga

SEQ ID NO: 1907259 - RNA, 23 nt, Human
uugcagacaggcaagcaccuccu

SEQ ID NO: 1907260 - RNA, 18 nt, Human
uugcagcgauuaauaaca

SEQ ID NO: 1907261 - RNA, 19 nt, Human
uugcagcgauuaauaacag

SEQ ID NO: 1907262 - RNA, 13 nt, Human
uugauucauaaug

SEQ ID NO: 1907263 - RNA, 17 nt, Human
uugauucauaaugacuu

SEQ ID NO: 1907264 - RNA, 20 nt, Human
uugauucuccuucagcccuc

SEQ ID NO: 1907265 - RNA, 17 nt, Human
uugauucuccuucagcc

SEQ ID NO: 1907266 - RNA, 13 nt, Human
uugauucuccuuc

SEQ ID NO: 1907267 - RNA, 12 nt, Human
uugauucuccuu

SEQ ID NO: 1907268 - RNA, 14 nt, Human
uugaucuggaaccc

SEQ ID NO: 1907269 - RNA, 19 nt, Human
uugauucauaguaacuucu

SEQ ID NO: 1907270 - RNA, 20 nt, Human
uugcacuugugauuauuuau

SEQ ID NO: 1907271 - RNA, 17 nt, Human
uugcacuugugauuauu

SEQ ID NO: 1907272 - RNA, 21 nt, Human
uucuucauaacaauuuuagga

SEQ ID NO: 1907273 - RNA, 18 nt, Human
uucuucauaacaauuuua

SEQ ID NO: 1907274 - RNA, 22 nt, Human
uucuugugccauagucacaugg

SEQ ID NO: 1907275 - RNA, 14 nt, Human
uucuuguguguuua

SEQ ID NO: 1907276 - RNA, 13 nt, Human
uucuucagagacu

SEQ ID NO: 1907277 - RNA, 15 nt, Human
uucuuauggaauuga

SEQ ID NO: 1907278 - RNA, 17 nt, Human
uucuuauggaauugauu

SEQ ID NO: 1907279 - RNA, 18 nt, Human
uucuuauggaauugauuu

SEQ ID NO: 1907280 - RNA, 22 nt, Human
uucuuauggaauugauuugcau

SEQ ID NO: 1907281 - RNA, 17 nt, Human
uucuuagggaaggauac

SEQ ID NO: 1907282 - RNA, 22 nt, Human
uucuuauaggaaagcuugagua

SEQ ID NO: 1907283 - RNA, 13 nt, Human
uucugugcagcca

SEQ ID NO: 1907284 - RNA, 15 nt, Human
uucuguauauacuuu

SEQ ID NO: 1907285 - RNA, 16 nt, Human
uucuguauauacuuuu

SEQ ID NO: 1907286 - RNA, 17 nt, Human
uucuguauauacuuuuu

SEQ ID NO: 1907287 - RNA, 17 nt, Human
uucuguaucuacuuuaa

SEQ ID NO: 1907288 - RNA, 21 nt, Human
uucuguaucuacuuuaauaaa

SEQ ID NO: 1907289 - RNA, 20 nt, Human
uucuggcagaguugaagaca

SEQ ID NO: 1907290 - RNA, 16 nt, Human
uucuggcuaugcauuu

SEQ ID NO: 1907291 - RNA, 15 nt, Human
uucuggccucccaca

SEQ ID NO: 1907292 - RNA, 14 nt, Human
uucuggccucccac

SEQ ID NO: 1907293 - RNA, 21 nt, Human
uugaaaaucuuauaauuuaaa

SEQ ID NO: 1907294 - RNA, 21 nt, Human
uucuuuccugaggcugggcuc

SEQ ID NO: 1907295 - RNA, 12 nt, Human
uucuuuaaugcu

SEQ ID NO: 1907296 - RNA, 18 nt, Human
uucuuuaaugcuuuuaua

SEQ ID NO: 1907297 - RNA, 18 nt, Human
uugaaaauuaacaugaau

SEQ ID NO: 1907298 - RNA, 21 nt, Human
uucuuucccugcuuaaugaaa

SEQ ID NO: 1907299 - RNA, 21 nt, Human
uugaaaauaagaauagaaaua

SEQ ID NO: 1907300 - RNA, 15 nt, Human
uugaacuuugaccuc

SEQ ID NO: 1907301 - RNA, 12 nt, Human
uugaaugaugcc

SEQ ID NO: 1907302 - RNA, 16 nt, Human
uugaaugaugccauga

SEQ ID NO: 1907303 - RNA, 19 nt, Human
uugaauguggcuugagaaa

SEQ ID NO: 1907304 - RNA, 21 nt, Human
uugaauguggcuugagaaaua

SEQ ID NO: 1907305 - RNA, 22 nt, Human
uugaauguggcuugagaaauau

SEQ ID NO: 1907306 - RNA, 18 nt, Human
uugaacuuugaccucugc

SEQ ID NO: 1907307 - RNA, 17 nt, Human
uugaacuuugaccucug

SEQ ID NO: 1907308 - RNA, 20 nt, Human
uugaacuuugaccucugcag

SEQ ID NO: 1907309 - RNA, 16 nt, Human
uugaagagguuuuaaa

SEQ ID NO: 1907310 - RNA, 20 nt, Human
uugaagcacagugaucaagu

SEQ ID NO: 1907311 - RNA, 21 nt, Human
uugaagagguuuuaaagcuuc

SEQ ID NO: 1907312 - RNA, 11 nt, Human
uuuguggggag

SEQ ID NO: 1907313 - RNA, 15 nt, Human
auguuucuucuaggu

SEQ ID NO: 1907314 - RNA, 14 nt, Human
auguuugccucugc

SEQ ID NO: 1907315 - RNA, 17 nt, Human
auguuugccucugccuc

SEQ ID NO: 1907316 - RNA, 15 nt, Human
auguuugccucugcc

SEQ ID NO: 1907317 - RNA, 14 nt, Human
auguucuuaauucu

SEQ ID NO: 1907318 - RNA, 13 nt, Human
auguucucugagg

SEQ ID NO: 1907319 - RNA, 17 nt, Human
auguucucucuucucca

SEQ ID NO: 1907320 - RNA, 16 nt, Human
auguucucucuucucc

SEQ ID NO: 1907321 - RNA, 14 nt, Human
auguucugggacac

SEQ ID NO: 1907322 - RNA, 17 nt, Human
auguucucugaggacac

SEQ ID NO: 1907323 - RNA, 15 nt, Human
auguucugggacaca

SEQ ID NO: 1907324 - RNA, 23 nt, Human
auguguagccugugcauguaugu

SEQ ID NO: 1907325 - RNA, 17 nt, Human
auguguagccugugcau

SEQ ID NO: 1907326 - RNA, 16 nt, Human
auguguagccugugca

SEQ ID NO: 1907327 - RNA, 15 nt, Human
auguguagccugugc

SEQ ID NO: 1907328 - RNA, 13 nt, Human
auguguaaguauu

SEQ ID NO: 1907329 - RNA, 17 nt, Human
auguguaagacaaaaag

SEQ ID NO: 1907330 - RNA, 19 nt, Human
auguguaagacaaaaagcu

SEQ ID NO: 1907331 - RNA, 17 nt, Human
auguauuuauaaauaua

SEQ ID NO: 1907332 - RNA, 13 nt, Human
augucacaggcag

SEQ ID NO: 1907333 - RNA, 23 nt, Human
auguauuguuugggauccuauug

SEQ ID NO: 1907334 - RNA, 20 nt, Human
auguaauuguuugucuuuaa

SEQ ID NO: 1907335 - RNA, 17 nt, Human
augugaaaucauucauu

SEQ ID NO: 1907336 - RNA, 18 nt, Human
augugaaaucauucauuu

SEQ ID NO: 1907337 - RNA, 16 nt, Human
augugaacagcggcug

SEQ ID NO: 1907338 - RNA, 19 nt, Human
augucacaggcagguccag

SEQ ID NO: 1907339 - RNA, 14 nt, Human
augugaaacauguu

SEQ ID NO: 1907340 - RNA, 14 nt, Human
augugaaaucauuc

SEQ ID NO: 1907341 - RNA, 18 nt, Human
augugaaaaggcaaaaag

SEQ ID NO: 1907342 - RNA, 20 nt, Human
augggugcuuggaggaagga

SEQ ID NO: 1907343 - RNA, 21 nt, Human
augggugcuuggaggaaggaa

SEQ ID NO: 1907344 - RNA, 23 nt, Human
augggugcuuggaggaaggaaac

SEQ ID NO: 1907345 - RNA, 20 nt, Human
augguaauucuuauucuuuc

SEQ ID NO: 1907346 - RNA, 17 nt, Human
augguaggcauuuccua

SEQ ID NO: 1907347 - RNA, 18 nt, Human
augguaggcauuuccuau

SEQ ID NO: 1907348 - RNA, 16 nt, Human
auggagggaauaauac

SEQ ID NO: 1907349 - RNA, 18 nt, Human
augcuuuagaaagguuuu

SEQ ID NO: 1907350 - RNA, 15 nt, Human
augcuuguacauaau

SEQ ID NO: 1907351 - RNA, 16 nt, Human
augcuuguacauaaug

SEQ ID NO: 1907352 - RNA, 18 nt, Human
auggauaggcacaggaaa

SEQ ID NO: 1907353 - RNA, 17 nt, Human
auggauaggcacaggaa

SEQ ID NO: 1907354 - RNA, 18 nt, Human
auggcuggagcuagaauu

SEQ ID NO: 1907355 - RNA, 17 nt, Human
auggcuuuugugcauua

SEQ ID NO: 1907356 - RNA, 16 nt, Human
auggcuuuugugcauu

SEQ ID NO: 1907357 - RNA, 18 nt, Human
auggcuuuugugcauuau

SEQ ID NO: 1907358 - RNA, 16 nt, Human
augcugcccugugagu

SEQ ID NO: 1907359 - RNA, 13 nt, Human
augcugcccugug

SEQ ID NO: 1907360 - RNA, 14 nt, Human
augcugcccuguga

SEQ ID NO: 1907361 - RNA, 15 nt, Human
augcugcccugugag

SEQ ID NO: 1907362 - RNA, 22 nt, Human
augcugacauucaccugcccca

SEQ ID NO: 1907363 - RNA, 19 nt, Human
augcugacauucaccugcc

SEQ ID NO: 1907364 - RNA, 20 nt, Human
augcugacauucaccugccc

SEQ ID NO: 1907365 - RNA, 18 nt, Human
augaugaaaugaggucag

SEQ ID NO: 1907366 - RNA, 15 nt, Human
augaucuuuucaagu

SEQ ID NO: 1907367 - RNA, 19 nt, Human
augaugaaaauauuuaaag

SEQ ID NO: 1907368 - RNA, 23 nt, Human
augaugaaaugaggucagagccu

SEQ ID NO: 1907369 - RNA, 12 nt, Human
augaugaaugag

SEQ ID NO: 1907370 - RNA, 15 nt, Human
augaugaaugagaau

SEQ ID NO: 1907371 - RNA, 20 nt, Human
augaugacaacuacagaaaa

SEQ ID NO: 1907372 - RNA, 15 nt, Human
augaugauccuaggc

SEQ ID NO: 1907373 - RNA, 18 nt, Human
augcacaaacagaggccg

SEQ ID NO: 1907374 - RNA, 21 nt, Human
augauggcccauucuacuugc

SEQ ID NO: 1907375 - RNA, 12 nt, Human
augauggcccau

SEQ ID NO: 1907376 - RNA, 15 nt, Human
augauggcccauucu

SEQ ID NO: 1907377 - RNA, 15 nt, Human
augauggaugccaau

SEQ ID NO: 1907378 - RNA, 19 nt, Human
augauggaugccaauauua

SEQ ID NO: 1907379 - RNA, 19 nt, Human
augauggcccauucuacuu

SEQ ID NO: 1907380 - RNA, 20 nt, Human
augauggcccauucuacuug

SEQ ID NO: 1907381 - RNA, 16 nt, Human
augaugggucaguugu

SEQ ID NO: 1907382 - RNA, 15 nt, Human
augcacaaauucugu

SEQ ID NO: 1907383 - RNA, 22 nt, Human
augcacaaauucugucucugga

SEQ ID NO: 1907384 - RNA, 23 nt, Human
augcacaaauucugucucuggau

SEQ ID NO: 1907385 - RNA, 17 nt, Human
augaucuuugcagacag

SEQ ID NO: 1907386 - RNA, 21 nt, Human
augaucuuugcagacaggcaa

SEQ ID NO: 1907387 - RNA, 15 nt, Human
augaugaaaauauuu

SEQ ID NO: 1907388 - RNA, 13 nt, Human
augaugaaaauau

SEQ ID NO: 1907389 - RNA, 19 nt, Human
augaucuuugcagacaggc

SEQ ID NO: 1907390 - RNA, 18 nt, Human
augaucuuugcagacagg

SEQ ID NO: 1907391 - RNA, 19 nt, Human
augccuggauggggcugca

SEQ ID NO: 1907392 - RNA, 20 nt, Human
augccuggauggggcugcac

SEQ ID NO: 1907393 - RNA, 23 nt, Human
augcacagaguuguuacauuuuu

SEQ ID NO: 1907394 - RNA, 22 nt, Human
augcacagaguuguuacauuuu

SEQ ID NO: 1907395 - RNA, 21 nt, Human
augcacagaguuguuacauuu

SEQ ID NO: 1907396 - RNA, 19 nt, Human
augcacagaguuguuacau

SEQ ID NO: 1907397 - RNA, 15 nt, Human
augcacacauuuuuu

SEQ ID NO: 1907398 - RNA, 14 nt, Human
augcacacauuuuu

SEQ ID NO: 1907399 - RNA, 13 nt, Human
augcacacauuuu

SEQ ID NO: 1907400 - RNA, 19 nt, Human
auccucaguuuuugugaaa

SEQ ID NO: 1907401 - RNA, 19 nt, Human
aucccaugagccucagcau

SEQ ID NO: 1907402 - RNA, 12 nt, Human
auccccaauaau

SEQ ID NO: 1907403 - RNA, 19 nt, Human
auccccaauaauugcagaa

SEQ ID NO: 1907404 - RNA, 21 nt, Human
auccccaauaauugcagaacu

SEQ ID NO: 1907405 - RNA, 22 nt, Human
auccccaauaauugcagaacua

SEQ ID NO: 1907406 - RNA, 19 nt, Human
auccagacccggcugcgug

SEQ ID NO: 1907407 - RNA, 17 nt, Human
auccucauacccacccc

SEQ ID NO: 1907408 - RNA, 19 nt, Human
auccuucccugucugccag

SEQ ID NO: 1907409 - RNA, 22 nt, Human
auccuucccugucugccagggc

SEQ ID NO: 1907410 - RNA, 19 nt, Human
aucgccagcugaugacuca

SEQ ID NO: 1907411 - RNA, 21 nt, Human
aucgccagcugaugacucaag

SEQ ID NO: 1907412 - RNA, 23 nt, Human
aucgccagcugaugacucaagau

SEQ ID NO: 1907413 - RNA, 20 nt, Human
aucgcggcggagcuggcccc

SEQ ID NO: 1907414 - RNA, 22 nt, Human
aucgcggcggagcuggccccgc

SEQ ID NO: 1907415 - RNA, 14 nt, Human
aucaugucuggcua

SEQ ID NO: 1907416 - RNA, 12 nt, Human
aucaugugaaau

SEQ ID NO: 1907417 - RNA, 14 nt, Human
aucaccuauuucca

SEQ ID NO: 1907418 - RNA, 15 nt, Human
aucaccuauuuccau

SEQ ID NO: 1907419 - RNA, 22 nt, Human
aucaccuauuuccauucaacaa

SEQ ID NO: 1907420 - RNA, 23 nt, Human
aucacccgcuaagagggagggag

SEQ ID NO: 1907421 - RNA, 13 nt, Human
aucaccagacagg

SEQ ID NO: 1907422 - RNA, 20 nt, Human
aucaccaacgucugugccau

SEQ ID NO: 1907423 - RNA, 22 nt, Human
aucaaauauauucagccuggcu

SEQ ID NO: 1907424 - RNA, 13 nt, Human
aucacagccucug

SEQ ID NO: 1907425 - RNA, 14 nt, Human
aucaaauauauuca

SEQ ID NO: 1907426 - RNA, 14 nt, Human
aucaaagccacacu

SEQ ID NO: 1907427 - RNA, 16 nt, Human
aucaaagccacacucu

SEQ ID NO: 1907428 - RNA, 20 nt, Human
aucaaagagguuuuaaaaaa

SEQ ID NO: 1907429 - RNA, 23 nt, Human
aucaaagagguuuuaaaaaaauc

SEQ ID NO: 1907430 - RNA, 12 nt, Human
aucaaaaugcuu

SEQ ID NO: 1907431 - RNA, 22 nt, Human
aucaaaaugcuuuuuauuucug

SEQ ID NO: 1907432 - RNA, 13 nt, Human
aucaaaaugcuuu

SEQ ID NO: 1907433 - RNA, 21 nt, Human
auauuucccugaaggaaccaa

SEQ ID NO: 1907434 - RNA, 18 nt, Human
aucugggggccucuucug

SEQ ID NO: 1907435 - RNA, 16 nt, Human
aucuggggcucuggga

SEQ ID NO: 1907436 - RNA, 14 nt, Human
aucuucaacaaauu

SEQ ID NO: 1907437 - RNA, 12 nt, Human
aucuucaacaaa

SEQ ID NO: 1907438 - RNA, 13 nt, Human
aucuucaacaaau

SEQ ID NO: 1907439 - RNA, 21 nt, Human
aucuuauuagggagaaaauuc

SEQ ID NO: 1907440 - RNA, 22 nt, Human
aucuuauuagggagaaaauuca

SEQ ID NO: 1907441 - RNA, 13 nt, Human
aucuuauucacau

SEQ ID NO: 1907442 - RNA, 22 nt, Human
aucucugcaggaaauggcugug

SEQ ID NO: 1907443 - RNA, 17 nt, Human
aucucucuuuaauauaa

SEQ ID NO: 1907444 - RNA, 20 nt, Human
aucuggagaccagggagccu

SEQ ID NO: 1907445 - RNA, 21 nt, Human
aucuggagaccagggagccuu

SEQ ID NO: 1907446 - RNA, 22 nt, Human
aucuggagaccagggagccuuu

SEQ ID NO: 1907447 - RNA, 14 nt, Human
aucuucccucuccc

SEQ ID NO: 1907448 - RNA, 21 nt, Human
aucuucuaaacccaauccaaa

SEQ ID NO: 1907449 - RNA, 13 nt, Human
aucuauuuaagua

SEQ ID NO: 1907450 - RNA, 16 nt, Human
aucuauuuaucuucau

SEQ ID NO: 1907451 - RNA, 14 nt, Human
aucuauuuuggauu

SEQ ID NO: 1907452 - RNA, 20 nt, Human
aucuccgucaacucauauuu

SEQ ID NO: 1907453 - RNA, 16 nt, Human
aucuauacauaucuuu

SEQ ID NO: 1907454 - RNA, 15 nt, Human
aucuauacuugcuuu

SEQ ID NO: 1907455 - RNA, 21 nt, Human
augaaguacucauacauguua

SEQ ID NO: 1907456 - RNA, 20 nt, Human
augaaaaugcaacaacaugu

SEQ ID NO: 1907457 - RNA, 15 nt, Human
augaaguuguaggua

SEQ ID NO: 1907458 - RNA, 14 nt, Human
augaccagcaaaua

SEQ ID NO: 1907459 - RNA, 22 nt, Human
augaggcauuuguuugaacuga

SEQ ID NO: 1907460 - RNA, 21 nt, Human
augaggcauuuguuugaacug

SEQ ID NO: 1907461 - RNA, 14 nt, Human
augaggcauuuguu

SEQ ID NO: 1907462 - RNA, 13 nt, Human
augaggcauuugu

SEQ ID NO: 1907463 - RNA, 19 nt, Human
augaggggacauuuuggug

SEQ ID NO: 1907464 - RNA, 20 nt, Human
augagggucuugguuccagc

SEQ ID NO: 1907465 - RNA, 13 nt, Human
augagggucuugg

SEQ ID NO: 1907466 - RNA, 15 nt, Human
augaaaacacauuuu

SEQ ID NO: 1907467 - RNA, 14 nt, Human
augaaaacacauuu

SEQ ID NO: 1907468 - RNA, 16 nt, Human
augaaaacacauuuuu

SEQ ID NO: 1907469 - RNA, 16 nt, Human
augaaaauauuuaaag

SEQ ID NO: 1907470 - RNA, 14 nt, Human
augaaaauauuuaa

SEQ ID NO: 1907471 - RNA, 13 nt, Human
augaaaauauuua

SEQ ID NO: 1907472 - RNA, 12 nt, Human
augaaaauauuu

SEQ ID NO: 1907473 - RNA, 14 nt, Human
auaucagcaagucu

SEQ ID NO: 1907474 - RNA, 18 nt, Human
auauauuuuuuucugaaa

SEQ ID NO: 1907475 - RNA, 16 nt, Human
auauggacucugcaca

SEQ ID NO: 1907476 - RNA, 15 nt, Human
auauggacucugcac

SEQ ID NO: 1907477 - RNA, 16 nt, Human
auaugcaguuuuccuu

SEQ ID NO: 1907478 - RNA, 20 nt, Human
auaugcaguaaaagaaagaa

SEQ ID NO: 1907479 - RNA, 20 nt, Human
auaugcucugcauguuacau

SEQ ID NO: 1907480 - RNA, 13 nt, Human
auauggccacagu

SEQ ID NO: 1907481 - RNA, 17 nt, Human
auaugcaccuugugucu

SEQ ID NO: 1907482 - RNA, 15 nt, Human
auaugcaccuugugu

SEQ ID NO: 1907483 - RNA, 21 nt, Human
auaugcaccuugugucuguac

SEQ ID NO: 1907484 - RNA, 20 nt, Human
auaugcaccuugugucugua

SEQ ID NO: 1907485 - RNA, 19 nt, Human
auaugcaccuugugucugu

SEQ ID NO: 1907486 - RNA, 17 nt, Human
auaugcagauuuugccc

SEQ ID NO: 1907487 - RNA, 16 nt, Human
auaugcucugcauguu

SEQ ID NO: 1907488 - RNA, 17 nt, Human
auaugcucugcauguua

SEQ ID NO: 1907489 - RNA, 19 nt, Human
auauucaggaagcucaggg

SEQ ID NO: 1907490 - RNA, 14 nt, Human
auauuauuuuaugu

SEQ ID NO: 1907491 - RNA, 15 nt, Human
auauuauuuuauguu

SEQ ID NO: 1907492 - RNA, 22 nt, Human
auauuauuuuauguugcauaga

SEQ ID NO: 1907493 - RNA, 19 nt, Human
auauuucccugaaggaacc

SEQ ID NO: 1907494 - RNA, 23 nt, Human
auauuuccaggcugcauuuguau

SEQ ID NO: 1907495 - RNA, 22 nt, Human
auauuuccaggcugcauuugua

SEQ ID NO: 1907496 - RNA, 21 nt, Human
auauaauaaauguacauuaau

SEQ ID NO: 1907497 - RNA, 21 nt, Human
auaguaccauuuauacaaauu

SEQ ID NO: 1907498 - RNA, 17 nt, Human
auaguaccaaucauuuu

SEQ ID NO: 1907499 - RNA, 14 nt, Human
auaguaccauuuau

SEQ ID NO: 1907500 - RNA, 19 nt, Human
auaguaccauuuauacaaa

SEQ ID NO: 1907501 - RNA, 17 nt, Human
auauaauauauuugugu

SEQ ID NO: 1907502 - RNA, 20 nt, Human
auauaauauauuuguguauu

SEQ ID NO: 1907503 - RNA, 17 nt, Human
auagccuaggugacaga

SEQ ID NO: 1907504 - RNA, 15 nt, Human
auagccuaggugaca

SEQ ID NO: 1907505 - RNA, 24 nt, Human
auagguuuggacaaaauggaauac

SEQ ID NO: 1907506 - RNA, 21 nt, Human
auaguaacuucuuauggaauu

SEQ ID NO: 1907507 - RNA, 19 nt, Human
auaguaacuucuuauggaa

SEQ ID NO: 1907508 - RNA, 13 nt, Human
auauacacacagc

SEQ ID NO: 1907509 - RNA, 16 nt, Human
auagcagacaguguuu

SEQ ID NO: 1907510 - RNA, 17 nt, Human
auagcacagacccugcc

SEQ ID NO: 1907511 - RNA, 18 nt, Human
auagcacagacccugccc

SEQ ID NO: 1907512 - RNA, 15 nt, Human
auagcacagacccug

SEQ ID NO: 1907513 - RNA, 22 nt, Human
auagaaauaaaggaugugauug

SEQ ID NO: 1907514 - RNA, 16 nt, Human
auagaaagugccagaa

SEQ ID NO: 1907515 - RNA, 19 nt, Human
auagaaagugccagaaagu

SEQ ID NO: 1907516 - RNA, 15 nt, Human
auagcagcuuauuca

SEQ ID NO: 1907517 - RNA, 11 nt, Human
auagcacuuuc

SEQ ID NO: 1907518 - RNA, 14 nt, Human
auagcagauuuuaa

SEQ ID NO: 1907519 - RNA, 22 nt, Human
auagcagauuuuaauuuugaau

SEQ ID NO: 1907520 - RNA, 23 nt, Human
auacuugaagggccagagccagg

SEQ ID NO: 1907521 - RNA, 12 nt, Human
auacuugcuuug

SEQ ID NO: 1907522 - RNA, 14 nt, Human
auaacaaugaaagu

SEQ ID NO: 1907523 - RNA, 14 nt, Human
auaaagcaaauaga

SEQ ID NO: 1907524 - RNA, 18 nt, Human
auaaagcaaauagacaca

SEQ ID NO: 1907525 - RNA, 12 nt, Human
auaaagcaaaua

SEQ ID NO: 1907526 - RNA, 20 nt, Human
auaaauuugguucuaauaga

SEQ ID NO: 1907527 - RNA, 20 nt, Human
auaacauguaauuaaguacu

SEQ ID NO: 1907528 - RNA, 12 nt, Human
auaacauguaau

SEQ ID NO: 1907529 - RNA, 13 nt, Human
auaacauguaauu

SEQ ID NO: 1907530 - RNA, 18 nt, Human
auaacauguaauuaagua

SEQ ID NO: 1907531 - RNA, 23 nt, Human
aguuugauuaaauucuugcaaag

SEQ ID NO: 1907532 - RNA, 11 nt, Human
aguuugcuuag

SEQ ID NO: 1907533 - RNA, 12 nt, Human
auaaaaagcaaa

SEQ ID NO: 1907534 - RNA, 18 nt, Human
aguuuggcaaacucucca

SEQ ID NO: 1907535 - RNA, 13 nt, Human
aguuugcuuagaa

SEQ ID NO: 1907536 - RNA, 14 nt, Human
aguuugcuuagaaa

SEQ ID NO: 1907537 - RNA, 16 nt, Human
aguuuggcaaacucuc

SEQ ID NO: 1907538 - RNA, 16 nt, Human
auaaaaagcaaaacaa

SEQ ID NO: 1907539 - RNA, 13 nt, Human
auaaaaagcaaaa

SEQ ID NO: 1907540 - RNA, 17 nt, Human
auaaaaagcuuccauga

SEQ ID NO: 1907541 - RNA, 21 nt, Human
auaaaaagcuuccaugauucu

SEQ ID NO: 1907542 - RNA, 18 nt, Human
auaaaacauuuucacaca

SEQ ID NO: 1907543 - RNA, 20 nt, Human
auaaaacauuuucacacaau

SEQ ID NO: 1907544 - RNA, 15 nt, Human
auaaaacuggcuuug

SEQ ID NO: 1907545 - RNA, 16 nt, Human
aguuugauuaaauucu

SEQ ID NO: 1907546 - RNA, 20 nt, Human
aguuugagaucagccugggc

SEQ ID NO: 1907547 - RNA, 18 nt, Human
aguuugagaucagccugg

SEQ ID NO: 1907548 - RNA, 19 nt, Human
aguuugagaucagccuggg

SEQ ID NO: 1907549 - RNA, 22 nt, Human
aguuugauuaaauucuugcaaa

SEQ ID NO: 1907550 - RNA, 20 nt, Human
aguuugauuaaauucuugca

SEQ ID NO: 1907551 - RNA, 18 nt, Human
aguuugauuaaauucuug

SEQ ID NO: 1907552 - RNA, 17 nt, Human
aguuugauuaaauucuu

SEQ ID NO: 1907553 - RNA, 22 nt, Human
aguuguuacauuuuuaagugcu

SEQ ID NO: 1907554 - RNA, 20 nt, Human
aguuguuacauuuuuaagug

SEQ ID NO: 1907555 - RNA, 19 nt, Human
aguuguuacauuuuuaagu

SEQ ID NO: 1907556 - RNA, 22 nt, Human
aguuugaaucuauuuaucuuca

SEQ ID NO: 1907557 - RNA, 19 nt, Human
auaauguuguuauuuaaag

SEQ ID NO: 1907558 - RNA, 16 nt, Human
auacaaugaugcuauu

SEQ ID NO: 1907559 - RNA, 21 nt, Human
auacaaugaugcuauuugcaa

SEQ ID NO: 1907560 - RNA, 22 nt, Human
auacaaugaugcuauuugcaau

SEQ ID NO: 1907561 - RNA, 17 nt, Human
auacaaugcugugcccu

SEQ ID NO: 1907562 - RNA, 14 nt, Human
auacaaugcugugc

SEQ ID NO: 1907563 - RNA, 13 nt, Human
auacacuuacacu

SEQ ID NO: 1907564 - RNA, 22 nt, Human
auacacuuacacuuuaugcaca

SEQ ID NO: 1907565 - RNA, 13 nt, Human
auacccaccccca

SEQ ID NO: 1907566 - RNA, 14 nt, Human
auacccacccccac

SEQ ID NO: 1907567 - RNA, 16 nt, Human
auacccacccccaccc

SEQ ID NO: 1907568 - RNA, 17 nt, Human
auacccacccccaccca

SEQ ID NO: 1907569 - RNA, 13 nt, Human
auacagaaaaguu

SEQ ID NO: 1907570 - RNA, 14 nt, Human
auaccugucccccu

SEQ ID NO: 1907571 - RNA, 15 nt, Human
auaccugucccccug

SEQ ID NO: 1907572 - RNA, 16 nt, Human
auaccugucccccuga

SEQ ID NO: 1907573 - RNA, 17 nt, Human
auaccugucccccugac

SEQ ID NO: 1907574 - RNA, 14 nt, Human
auaauguuguuauu

SEQ ID NO: 1907575 - RNA, 19 nt, Human
auaauguaaacaauaucag

SEQ ID NO: 1907576 - RNA, 18 nt, Human
auaaggguaucuggugac

SEQ ID NO: 1907577 - RNA, 13 nt, Human
auaauggucagag

SEQ ID NO: 1907578 - RNA, 19 nt, Human
auaaugggguccuggccau

SEQ ID NO: 1907579 - RNA, 22 nt, Human
auaagccagacaucaacagaua

SEQ ID NO: 1907580 - RNA, 21 nt, Human
auaagccagacaucaacagau

SEQ ID NO: 1907581 - RNA, 18 nt, Human
aguaacccccacuggacu

SEQ ID NO: 1907582 - RNA, 23 nt, Human
aguaaccaucacugguugcacuu

SEQ ID NO: 1907583 - RNA, 17 nt, Human
aguaacaugaggggaca

SEQ ID NO: 1907584 - RNA, 14 nt, Human
aguacguugugcau

SEQ ID NO: 1907585 - RNA, 15 nt, Human
aguacguugugcauu

SEQ ID NO: 1907586 - RNA, 16 nt, Human
aggucuguucuuucca

SEQ ID NO: 1907587 - RNA, 15 nt, Human
aggucuguucuuucc

SEQ ID NO: 1907588 - RNA, 13 nt, Human
aggucuguucuuu

SEQ ID NO: 1907589 - RNA, 18 nt, Human
aguaaaugggggugcauu

SEQ ID NO: 1907590 - RNA, 15 nt, Human
aguaaaucuuuuaca

SEQ ID NO: 1907591 - RNA, 13 nt, Human
aguacucauacau

SEQ ID NO: 1907592 - RNA, 20 nt, Human
aguacuggcugauggaguaa

SEQ ID NO: 1907593 - RNA, 12 nt, Human
aguacuauguau

SEQ ID NO: 1907594 - RNA, 14 nt, Human
aguacuauguauca

SEQ ID NO: 1907595 - RNA, 12 nt, Human
aguacuucuuuu

SEQ ID NO: 1907596 - RNA, 17 nt, Human
aguacuucuccacccug

SEQ ID NO: 1907597 - RNA, 14 nt, Human
aguacuauaauuua

SEQ ID NO: 1907598 - RNA, 19 nt, Human
aguacuacaguccucccau

SEQ ID NO: 1907599 - RNA, 22 nt, Human
aguacuacaguccucccaucuc

SEQ ID NO: 1907600 - RNA, 18 nt, Human
aguacguugugcauuugg

SEQ ID NO: 1907601 - RNA, 17 nt, Human
aguacguugugcauuug

SEQ ID NO: 1907602 - RNA, 16 nt, Human
aguacguugugcauuu

SEQ ID NO: 1907603 - RNA, 23 nt, Human
aguacuugggagaccuguaauca

SEQ ID NO: 1907604 - RNA, 17 nt, Human
aguacuuuggaggcccc

SEQ ID NO: 1907605 - RNA, 21 nt, Human
aguaugaggcauuuguuugaa

SEQ ID NO: 1907606 - RNA, 20 nt, Human
aguaugaggcauuuguuuga

SEQ ID NO: 1907607 - RNA, 15 nt, Human
aguaucucagggccu

SEQ ID NO: 1907608 - RNA, 17 nt, Human
aguaugaggcauuuguu

SEQ ID NO: 1907609 - RNA, 14 nt, Human
aguauuuuguuuca

SEQ ID NO: 1907610 - RNA, 23 nt, Human
aguaugaggcauuuguuugaacu

SEQ ID NO: 1907611 - RNA, 17 nt, Human
aguauuuuguuucagug

SEQ ID NO: 1907612 - RNA, 22 nt, Human
agucacacaguauuacuucugc

SEQ ID NO: 1907613 - RNA, 18 nt, Human
agucacaaagaacaugua

SEQ ID NO: 1907614 - RNA, 17 nt, Human
agucaaaacuacaaauc

SEQ ID NO: 1907615 - RNA, 14 nt, Human
agucaauuaacaau

SEQ ID NO: 1907616 - RNA, 19 nt, Human
aguccuuaccagcagagca

SEQ ID NO: 1907617 - RNA, 11 nt, Human
aguccuuccac

SEQ ID NO: 1907618 - RNA, 19 nt, Human
aguccucuuuucugagagg

SEQ ID NO: 1907619 - RNA, 20 nt, Human
aguccuuaccagcagagcac

SEQ ID NO: 1907620 - RNA, 22 nt, Human
aguccucuuuucugagaggacu

SEQ ID NO: 1907621 - RNA, 17 nt, Human
aguccaacaauguuguu

SEQ ID NO: 1907622 - RNA, 19 nt, Human
agugucaaugcagccccca

SEQ ID NO: 1907623 - RNA, 14 nt, Human
agugucaggaggaa

SEQ ID NO: 1907624 - RNA, 12 nt, Human
agugucuggcug

SEQ ID NO: 1907625 - RNA, 22 nt, Human
agugucucggagggauuccccu

SEQ ID NO: 1907626 - RNA, 17 nt, Human
aguggcuuuaaugaaua

SEQ ID NO: 1907627 - RNA, 14 nt, Human
agugucuggcugca

SEQ ID NO: 1907628 - RNA, 13 nt, Human
agugucuggcugc

SEQ ID NO: 1907629 - RNA, 24 nt, Human
agugauccucccaccucagccucc

SEQ ID NO: 1907630 - RNA, 18 nt, Human
agugauccucccaccuca

SEQ ID NO: 1907631 - RNA, 15 nt, Human
agugauccucccacc

SEQ ID NO: 1907632 - RNA, 14 nt, Human
agugauccucccac

SEQ ID NO: 1907633 - RNA, 17 nt, Human
agugauucuccugccuc

SEQ ID NO: 1907634 - RNA, 15 nt, Human
agugauucuccugcc

SEQ ID NO: 1907635 - RNA, 18 nt, Human
agugccuuacacaauggu

SEQ ID NO: 1907636 - RNA, 14 nt, Human
agugauucuccugc

SEQ ID NO: 1907637 - RNA, 20 nt, Human
agugaucuuuuguucccauc

SEQ ID NO: 1907638 - RNA, 18 nt, Human
agugccuuauggaacacu

SEQ ID NO: 1907639 - RNA, 16 nt, Human
agugccuuauggaaca

SEQ ID NO: 1907640 - RNA, 15 nt, Human
agugcuaauuuugaa

SEQ ID NO: 1907641 - RNA, 10 nt, Human
agugccuuau

SEQ ID NO: 1907642 - RNA, 13 nt, Human
agugccuuaugga

SEQ ID NO: 1907643 - RNA, 14 nt, Human
agugccuuauggaa

SEQ ID NO: 1907644 - RNA, 15 nt, Human
agugccuuauggaac

SEQ ID NO: 1907645 - RNA, 18 nt, Human
agugcuaauuuugaaaaa

SEQ ID NO: 1907646 - RNA, 20 nt, Human
agugcuaauuuugaaaaacu

SEQ ID NO: 1907647 - RNA, 18 nt, Human
aguucagguaacaggcag

SEQ ID NO: 1907648 - RNA, 13 nt, Human
aguucaucuugaa

SEQ ID NO: 1907649 - RNA, 15 nt, Human
aguucaucuugaauu

SEQ ID NO: 1907650 - RNA, 19 nt, Human
aguucaucuugaauuguaa

SEQ ID NO: 1907651 - RNA, 15 nt, Human
aguucagccacccug

SEQ ID NO: 1907652 - RNA, 16 nt, Human
aguucagccacccuga

SEQ ID NO: 1907653 - RNA, 13 nt, Human
aguucagcuuggg

SEQ ID NO: 1907654 - RNA, 14 nt, Human
aguucagcuugggg

SEQ ID NO: 1907655 - RNA, 16 nt, Human
aguugauacuacaguu

SEQ ID NO: 1907656 - RNA, 13 nt, Human
aguugucuaaaca

SEQ ID NO: 1907657 - RNA, 18 nt, Human
aguugugacaacuuccug

SEQ ID NO: 1907658 - RNA, 20 nt, Human
aguugugacaacuuccugag

SEQ ID NO: 1907659 - RNA, 22 nt, Human
aguucaucuugaauuguaagga

SEQ ID NO: 1907660 - RNA, 22 nt, Human
aguugacuugacagaacacugu

SEQ ID NO: 1907661 - RNA, 15 nt, Human
agacugaggggucga

SEQ ID NO: 1907662 - RNA, 22 nt, Human
agacugaguacguugugcauuu

SEQ ID NO: 1907663 - RNA, 22 nt, Human
agacugaccaauauuguacagu

SEQ ID NO: 1907664 - RNA, 20 nt, Human
agacugaccuugaugagcug

SEQ ID NO: 1907665 - RNA, 20 nt, Human
agacugaguacguugugcau

SEQ ID NO: 1907666 - RNA, 18 nt, Human
agacucugucucagucca

SEQ ID NO: 1907667 - RNA, 13 nt, Human
agacucugucuca

SEQ ID NO: 1907668 - RNA, 18 nt, Human
agacucugucucaaaaaa

SEQ ID NO: 1907669 - RNA, 16 nt, Human
agacgcugugcugccc

SEQ ID NO: 1907670 - RNA, 16 nt, Human
agagagaccacuuuuc

SEQ ID NO: 1907671 - RNA, 20 nt, Human
agacuggaagcuaauuugca

SEQ ID NO: 1907672 - RNA, 21 nt, Human
agacuggaagcuaauuugcau

SEQ ID NO: 1907673 - RNA, 13 nt, Human
agagccagggucu

SEQ ID NO: 1907674 - RNA, 13 nt, Human
agagcccaccuug

SEQ ID NO: 1907675 - RNA, 17 nt, Human
agagagggaggcaagcc

SEQ ID NO: 1907676 - RNA, 18 nt, Human
agagagggaggcaagccc

SEQ ID NO: 1907677 - RNA, 15 nt, Human
agagagaggcaaugg

SEQ ID NO: 1907678 - RNA, 14 nt, Human
agagagaggcagaa

SEQ ID NO: 1907679 - RNA, 17 nt, Human
agagccucaaaugagaa

SEQ ID NO: 1907680 - RNA, 14 nt, Human
agagccucaaauga

SEQ ID NO: 1907681 - RNA, 15 nt, Human
agagccugagaguga

SEQ ID NO: 1907682 - RNA, 20 nt, Human
agaggagcugggagccgggc

SEQ ID NO: 1907683 - RNA, 23 nt, Human
agaggagggcagcagaagggggu

SEQ ID NO: 1907684 - RNA, 12 nt, Human
agaggaggggcc

SEQ ID NO: 1907685 - RNA, 14 nt, Human
agaggaggggccgc

SEQ ID NO: 1907686 - RNA, 18 nt, Human
agaggaggggccgcugcc

SEQ ID NO: 1907687 - RNA, 20 nt, Human
agaggaggggccgcugccac

SEQ ID NO: 1907688 - RNA, 22 nt, Human
agaggaggggccgcugccaccc

SEQ ID NO: 1907689 - RNA, 23 nt, Human
agaggacuuuucuuuguggcuuc

SEQ ID NO: 1907690 - RNA, 22 nt, Human
agaggacuuuucuuuguggcuu

SEQ ID NO: 1907691 - RNA, 21 nt, Human
agaggacuuuucuuuguggcu

SEQ ID NO: 1907692 - RNA, 16 nt, Human
agaggacaagggaaau

SEQ ID NO: 1907693 - RNA, 17 nt, Human
agaggggguggccuccc

SEQ ID NO: 1907694 - RNA, 19 nt, Human
agaggggguggccucccaa

SEQ ID NO: 1907695 - RNA, 22 nt, Human
agaggggggaagaucaggucau

SEQ ID NO: 1907696 - RNA, 13 nt, Human
agagggccugcaa

SEQ ID NO: 1907697 - RNA, 16 nt, Human
agagggccugcaaggg

SEQ ID NO: 1907698 - RNA, 13 nt, Human
agaggaaugaagu

SEQ ID NO: 1907699 - RNA, 18 nt, Human
acuuuccucuuccugccu

SEQ ID NO: 1907700 - RNA, 21 nt, Human
acuuuccucuuuggucuacac

SEQ ID NO: 1907701 - RNA, 19 nt, Human
acuuuccuccugaggcuuu

SEQ ID NO: 1907702 - RNA, 21 nt, Human
agaagacacugaugggcaacc

SEQ ID NO: 1907703 - RNA, 13 nt, Human
agaagacacugau

SEQ ID NO: 1907704 - RNA, 21 nt, Human
agaagagauugugguuucauu

SEQ ID NO: 1907705 - RNA, 22 nt, Human
agaagagaguccauauuucaau

SEQ ID NO: 1907706 - RNA, 22 nt, Human
agaagguuugguccagccuggu

SEQ ID NO: 1907707 - RNA, 14 nt, Human
agaaguaacuuacu

SEQ ID NO: 1907708 - RNA, 21 nt, Human
agaagucacauuccugaacag

SEQ ID NO: 1907709 - RNA, 20 nt, Human
agaagucacauuccugaaca

SEQ ID NO: 1907710 - RNA, 18 nt, Human
agaagucacauuccugaa

SEQ ID NO: 1907711 - RNA, 18 nt, Human
agaaguaggggaagacau

SEQ ID NO: 1907712 - RNA, 19 nt, Human
agaaguaggggaagacaug

SEQ ID NO: 1907713 - RNA, 20 nt, Human
agaaggggguggugucucca

SEQ ID NO: 1907714 - RNA, 13 nt, Human
agaaggggguggu

SEQ ID NO: 1907715 - RNA, 18 nt, Human
agaaugaaagggcccaga

SEQ ID NO: 1907716 - RNA, 21 nt, Human
agaagugaaaaucuacacucc

SEQ ID NO: 1907717 - RNA, 18 nt, Human
agaagugaauaacugcaa

SEQ ID NO: 1907718 - RNA, 22 nt, Human
agaagucacauuccugaacagg

SEQ ID NO: 1907719 - RNA, 19 nt, Human
agaaugcacaaacagaggc

SEQ ID NO: 1907720 - RNA, 22 nt, Human
agaaugcacaaacagaggccgc

SEQ ID NO: 1907721 - RNA, 20 nt, Human
agaaugcuguacaucuauuu

SEQ ID NO: 1907722 - RNA, 14 nt, Human
agaaugcuguacau

SEQ ID NO: 1907723 - RNA, 15 nt, Human
agaaugcuguacauc

SEQ ID NO: 1907724 - RNA, 13 nt, Human
agaaugcuguaca

SEQ ID NO: 1907725 - RNA, 22 nt, Human
agaaugcugcaggacuugagaa

SEQ ID NO: 1907726 - RNA, 19 nt, Human
agacccaaaaggcagaagc

SEQ ID NO: 1907727 - RNA, 17 nt, Human
agacccaaaaggcagaa

SEQ ID NO: 1907728 - RNA, 13 nt, Human
agaccagccuggc

SEQ ID NO: 1907729 - RNA, 15 nt, Human
agaccagccuggcca

SEQ ID NO: 1907730 - RNA, 12 nt, Human
agaccagcucuu

SEQ ID NO: 1907731 - RNA, 13 nt, Human
agaccagcucuuc

SEQ ID NO: 1907732 - RNA, 22 nt, Human
agacccaacacaugggaccuau

SEQ ID NO: 1907733 - RNA, 21 nt, Human
agacagagucucacuguugcc

SEQ ID NO: 1907734 - RNA, 22 nt, Human
agacagauacuccuccaagguu

SEQ ID NO: 1907735 - RNA, 22 nt, Human
agacagccaacuauggccugug

SEQ ID NO: 1907736 - RNA, 15 nt, Human
agaccacguuucuaa

SEQ ID NO: 1907737 - RNA, 20 nt, Human
agacagagucucacuguugc

SEQ ID NO: 1907738 - RNA, 19 nt, Human
agacagagucucacuguug

SEQ ID NO: 1907739 - RNA, 11 nt, Human
agacagagucu

SEQ ID NO: 1907740 - RNA, 12 nt, Human
agacagagcugg

SEQ ID NO: 1907741 - RNA, 13 nt, Human
agacagagcuaca

SEQ ID NO: 1907742 - RNA, 23 nt, Human
agacaaugacuuacuguacauga

SEQ ID NO: 1907743 - RNA, 15 nt, Human
agacagagcuacaca

SEQ ID NO: 1907744 - RNA, 22 nt, Human
agacaaugacuuacuguacaug

SEQ ID NO: 1907745 - RNA, 21 nt, Human
agacaaugacuuacuguacau

SEQ ID NO: 1907746 - RNA, 20 nt, Human
agacaaugacuuacuguaca

SEQ ID NO: 1907747 - RNA, 13 nt, Human
agcaaacccagac

SEQ ID NO: 1907748 - RNA, 13 nt, Human
agcaaacacauua

SEQ ID NO: 1907749 - RNA, 15 nt, Human
agcaaacccagacgg

SEQ ID NO: 1907750 - RNA, 18 nt, Human
agcaaaagaugcuucuca

SEQ ID NO: 1907751 - RNA, 21 nt, Human
agauugcaacaggcugggcuu

SEQ ID NO: 1907752 - RNA, 20 nt, Human
agauugcaacaggcugggcu

SEQ ID NO: 1907753 - RNA, 23 nt, Human
agauugcaacaggcugggcuuca

SEQ ID NO: 1907754 - RNA, 19 nt, Human
agauucuuuccugaggcug

SEQ ID NO: 1907755 - RNA, 21 nt, Human
agauucuuuccugaggcuggg

SEQ ID NO: 1907756 - RNA, 23 nt, Human
agauucuucccauucuccauuug

SEQ ID NO: 1907757 - RNA, 20 nt, Human
agcaaaggagauuggaagga

SEQ ID NO: 1907758 - RNA, 23 nt, Human
agcaaaggaguagaaagacagag

SEQ ID NO: 1907759 - RNA, 14 nt, Human
agaugagugagcau

SEQ ID NO: 1907760 - RNA, 19 nt, Human
agaugaaguuuuacauugu

SEQ ID NO: 1907761 - RNA, 16 nt, Human
agaugauacauccaaa

SEQ ID NO: 1907762 - RNA, 20 nt, Human
agaugauacauccaaagcag

SEQ ID NO: 1907763 - RNA, 18 nt, Human
agaugaugaaaauauuua

SEQ ID NO: 1907764 - RNA, 17 nt, Human
agauggugcugagaagc

SEQ ID NO: 1907765 - RNA, 14 nt, Human
agauggugcugaga

SEQ ID NO: 1907766 - RNA, 23 nt, Human
agaugaugaaaauauuuaaaggc

SEQ ID NO: 1907767 - RNA, 19 nt, Human
agauguagaggagaaacug

SEQ ID NO: 1907768 - RNA, 16 nt, Human
agauguagaggagaaa

SEQ ID NO: 1907769 - RNA, 19 nt, Human
agauguaaaguuauucuug

SEQ ID NO: 1907770 - RNA, 19 nt, Human
agauucuucccauucucca

SEQ ID NO: 1907771 - RNA, 22 nt, Human
agauucuucccauucuccauuu

SEQ ID NO: 1907772 - RNA, 21 nt, Human
agagugcaagccccugcucca

SEQ ID NO: 1907773 - RNA, 18 nt, Human
agaugaacagacugaccu

SEQ ID NO: 1907774 - RNA, 18 nt, Human
agaucuguccucagccuu

SEQ ID NO: 1907775 - RNA, 15 nt, Human
agaucuguccucagc

SEQ ID NO: 1907776 - RNA, 17 nt, Human
agaucuguccucagccu

SEQ ID NO: 1907777 - RNA, 16 nt, Human
agaugaaggagaggca

SEQ ID NO: 1907778 - RNA, 17 nt, Human
agaugaagcaaacacau

SEQ ID NO: 1907779 - RNA, 18 nt, Human
agaugaagcaaacacauu

SEQ ID NO: 1907780 - RNA, 15 nt, Human
agaugaaguuuuaca

SEQ ID NO: 1907781 - RNA, 19 nt, Human
agaugaagcaaacacauua

SEQ ID NO: 1907782 - RNA, 13 nt, Human
agaucuggaaccu

SEQ ID NO: 1907783 - RNA, 14 nt, Human
agaucuggaaccuc

SEQ ID NO: 1907784 - RNA, 14 nt, Human
agaucuguccucag

SEQ ID NO: 1907785 - RNA, 15 nt, Human
agaucuggaaccuca

SEQ ID NO: 1907786 - RNA, 17 nt, Human
agaucuggaaccucagc

SEQ ID NO: 1907787 - RNA, 19 nt, Human
agaucuggaaccucagccu

SEQ ID NO: 1907788 - RNA, 20 nt, Human
agaucuggaaccucagccug

SEQ ID NO: 1907789 - RNA, 14 nt, Human
agcacagacccugc

SEQ ID NO: 1907790 - RNA, 15 nt, Human
agcacagacccugcc

SEQ ID NO: 1907791 - RNA, 12 nt, Human
agcacagacccu

SEQ ID NO: 1907792 - RNA, 23 nt, Human
agcacaaugucucacaugggaca

SEQ ID NO: 1907793 - RNA, 19 nt, Human
agcacaacuuuaagaggac

SEQ ID NO: 1907794 - RNA, 15 nt, Human
agcaaugccugccca

SEQ ID NO: 1907795 - RNA, 21 nt, Human
agcacgauuucuguuuagaua

SEQ ID NO: 1907796 - RNA, 19 nt, Human
agcacgauuucuguuuaga

SEQ ID NO: 1907797 - RNA, 17 nt, Human
agcacgauuucuguuua

SEQ ID NO: 1907798 - RNA, 16 nt, Human
agcacagacccugccc

SEQ ID NO: 1907799 - RNA, 14 nt, Human
agcacacagggcag

SEQ ID NO: 1907800 - RNA, 15 nt, Human
agcacuuauuuaaug

SEQ ID NO: 1907801 - RNA, 13 nt, Human
agcagccugagca

SEQ ID NO: 1907802 - RNA, 19 nt, Human
agcagccugagcaacucuu

SEQ ID NO: 1907803 - RNA, 18 nt, Human
agcauccuggcacccggc

SEQ ID NO: 1907804 - RNA, 17 nt, Human
agcauccuggcacccgg

SEQ ID NO: 1907805 - RNA, 14 nt, Human
agcauccuggcacc

SEQ ID NO: 1907806 - RNA, 18 nt, Human
agccaaagcuaggccugg

SEQ ID NO: 1907807 - RNA, 16 nt, Human
agccaaagcuaggccu

SEQ ID NO: 1907808 - RNA, 11 nt, Human
agccaaagagu

SEQ ID NO: 1907809 - RNA, 20 nt, Human
agccaaggccaaaggaagca

SEQ ID NO: 1907810 - RNA, 13 nt, Human
agccagaggagag

SEQ ID NO: 1907811 - RNA, 15 nt, Human
agccagaggagagag

SEQ ID NO: 1907812 - RNA, 14 nt, Human
agccagcaggcucu

SEQ ID NO: 1907813 - RNA, 17 nt, Human
agccagaggagagagga

SEQ ID NO: 1907814 - RNA, 18 nt, Human
agccagaggagagaggac

SEQ ID NO: 1907815 - RNA, 23 nt, Human
agcccacgcccccacuggugaca

SEQ ID NO: 1907816 - RNA, 14 nt, Human
agcccacgccccca

SEQ ID NO: 1907817 - RNA, 15 nt, Human
agcccacgcccccac

SEQ ID NO: 1907818 - RNA, 14 nt, Human
agcccaccuuggcu

SEQ ID NO: 1907819 - RNA, 16 nt, Human
agcccaccuuggcuca

SEQ ID NO: 1907820 - RNA, 15 nt, Human
agcccaccccucaac

SEQ ID NO: 1907821 - RNA, 16 nt, Human
agccagcaggcucuca

SEQ ID NO: 1907822 - RNA, 15 nt, Human
agcccaauauuauaa

SEQ ID NO: 1907823 - RNA, 16 nt, Human
agcccaauauuauaau

SEQ ID NO: 1907824 - RNA, 20 nt, Human
agcccaauauuauaauuuuu

SEQ ID NO: 1907825 - RNA, 13 nt, Human
agcauccuggcac

SEQ ID NO: 1907826 - RNA, 12 nt, Human
agcccuccccau

SEQ ID NO: 1907827 - RNA, 19 nt, Human
agcccuccccauggagcca

SEQ ID NO: 1907828 - RNA, 20 nt, Human
agcccuccccauggagccag

SEQ ID NO: 1907829 - RNA, 21 nt, Human
agcccuccccauggagccagc

SEQ ID NO: 1907830 - RNA, 17 nt, Human
agcccgggcucugccuc

SEQ ID NO: 1907831 - RNA, 18 nt, Human
agcccgggcucugccucc

SEQ ID NO: 1907832 - RNA, 20 nt, Human
agcccgggcucugccuccca

SEQ ID NO: 1907833 - RNA, 21 nt, Human
agcccgggcucugccucccau

SEQ ID NO: 1907834 - RNA, 19 nt, Human
agccccauucugccugccc

SEQ ID NO: 1907835 - RNA, 18 nt, Human
agccccauucugccugcc

SEQ ID NO: 1907836 - RNA, 17 nt, Human
agccccauucugccugc

SEQ ID NO: 1907837 - RNA, 15 nt, Human
agccccauccucugu

SEQ ID NO: 1907838 - RNA, 17 nt, Human
agccccauccucuguac

SEQ ID NO: 1907839 - RNA, 23 nt, Human
agccccauccucuguacagagcc

SEQ ID NO: 1907840 - RNA, 14 nt, Human
aggccagugagcca

SEQ ID NO: 1907841 - RNA, 18 nt, Human
aggccaggugcaaccagg

SEQ ID NO: 1907842 - RNA, 16 nt, Human
aggccauaaaacaggu

SEQ ID NO: 1907843 - RNA, 21 nt, Human
aggccauccuucccugucugc

SEQ ID NO: 1907844 - RNA, 15 nt, Human
aggccaggcccucug

SEQ ID NO: 1907845 - RNA, 12 nt, Human
aggccaggugca

SEQ ID NO: 1907846 - RNA, 13 nt, Human
aggccaggccagc

SEQ ID NO: 1907847 - RNA, 15 nt, Human
aggccaggccagcug

SEQ ID NO: 1907848 - RNA, 21 nt, Human
aggccaucugggcuccuccag

SEQ ID NO: 1907849 - RNA, 22 nt, Human
aggccaucugggcuccuccagg

SEQ ID NO: 1907850 - RNA, 19 nt, Human
aggcauuccccaggaggcc

SEQ ID NO: 1907851 - RNA, 20 nt, Human
aggcauuccccaggaggcca

SEQ ID NO: 1907852 - RNA, 23 nt, Human
aggccagcugcuugggcuucauc

SEQ ID NO: 1907853 - RNA, 13 nt, Human
aggccaggcccuc

SEQ ID NO: 1907854 - RNA, 14 nt, Human
aggccaggcccucu

SEQ ID NO: 1907855 - RNA, 22 nt, Human
aggcccucugcccacucccugc

SEQ ID NO: 1907856 - RNA, 23 nt, Human
aggcccucugcccacucccugca

SEQ ID NO: 1907857 - RNA, 13 nt, Human
aggcccucuggag

SEQ ID NO: 1907858 - RNA, 15 nt, Human
aggcccucuggagug

SEQ ID NO: 1907859 - RNA, 20 nt, Human
aggcccucuggaguggccac

SEQ ID NO: 1907860 - RNA, 21 nt, Human
aggcccucuggaguggccacu

SEQ ID NO: 1907861 - RNA, 22 nt, Human
aggcccucuggaguggccacua

SEQ ID NO: 1907862 - RNA, 12 nt, Human
aggcccuucucu

SEQ ID NO: 1907863 - RNA, 15 nt, Human
aggcccuucucucca

SEQ ID NO: 1907864 - RNA, 19 nt, Human
aggcccuucucuccagccc

SEQ ID NO: 1907865 - RNA, 19 nt, Human
aggcauguucucugaggac

SEQ ID NO: 1907866 - RNA, 18 nt, Human
aggcauguucucugagga

SEQ ID NO: 1907867 - RNA, 18 nt, Human
aggcauuccccaggaggc

SEQ ID NO: 1907868 - RNA, 17 nt, Human
aggcauuccccaggagg

SEQ ID NO: 1907869 - RNA, 17 nt, Human
aggcauguucucugagg

SEQ ID NO: 1907870 - RNA, 21 nt, Human
aggcaugugaugagaggaaau

SEQ ID NO: 1907871 - RNA, 19 nt, Human
aggcaugugaugagaggaa

SEQ ID NO: 1907872 - RNA, 20 nt, Human
aggcaugugaugagaggaaa

SEQ ID NO: 1907873 - RNA, 17 nt, Human
aggcaugugaugagagg

SEQ ID NO: 1907874 - RNA, 15 nt, Human
aggcaugguggccca

SEQ ID NO: 1907875 - RNA, 21 nt, Human
aggagaggcaacauccaaaau

SEQ ID NO: 1907876 - RNA, 20 nt, Human
aggagaggcaacauccaaaa

SEQ ID NO: 1907877 - RNA, 22 nt, Human
aggcuguaucccaugagccuca

SEQ ID NO: 1907878 - RNA, 13 nt, Human
aggcugguggccc

SEQ ID NO: 1907879 - RNA, 14 nt, Human
aggcugguggccca

SEQ ID NO: 1907880 - RNA, 17 nt, Human
aggcuuagucacugaga

SEQ ID NO: 1907881 - RNA, 15 nt, Human
aggcugguggcccag

SEQ ID NO: 1907882 - RNA, 21 nt, Human
aggcuguaucccaugagccuc

SEQ ID NO: 1907883 - RNA, 20 nt, Human
aggcuguaucccaugagccu

SEQ ID NO: 1907884 - RNA, 22 nt, Human
aggcuggucucaaacuccugac

SEQ ID NO: 1907885 - RNA, 18 nt, Human
aggcuuagucacugagac

SEQ ID NO: 1907886 - RNA, 15 nt, Human
agggacccuccacca

SEQ ID NO: 1907887 - RNA, 15 nt, Human
agggacugaggggag

SEQ ID NO: 1907888 - RNA, 14 nt, Human
aggcuaccuuugua

SEQ ID NO: 1907889 - RNA, 13 nt, Human
aggcuaccuuugu

SEQ ID NO: 1907890 - RNA, 15 nt, Human
aggcuaccuuuguau

SEQ ID NO: 1907891 - RNA, 13 nt, Human
aggcugaccacag

SEQ ID NO: 1907892 - RNA, 14 nt, Human
aggcugaccacagc

SEQ ID NO: 1907893 - RNA, 19 nt, Human
aggcuaaauuacucaggaa

SEQ ID NO: 1907894 - RNA, 18 nt, Human
aggcuggguucugauccu

SEQ ID NO: 1907895 - RNA, 14 nt, Human
aggcugaggcuggc

SEQ ID NO: 1907896 - RNA, 15 nt, Human
aggcugaggcuggca

SEQ ID NO: 1907897 - RNA, 16 nt, Human
aggcugaggcuggcac

SEQ ID NO: 1907898 - RNA, 17 nt, Human
aggcugaggcuggcaca

SEQ ID NO: 1907899 - RNA, 16 nt, Human
aggcugaccacagcac

SEQ ID NO: 1907900 - RNA, 17 nt, Human
aggcugaccacagcaca

SEQ ID NO: 1907901 - RNA, 18 nt, Human
aggcugaccacagcacag

SEQ ID NO: 1907902 - RNA, 21 nt, Human
aggcugaccacagcacagcca

SEQ ID NO: 1907903 - RNA, 21 nt, Human
aggcuaaagcccagagacagc

SEQ ID NO: 1907904 - RNA, 18 nt, Human
aggcuaaagcccagagac

SEQ ID NO: 1907905 - RNA, 14 nt, Human
aggcggugggcacc

SEQ ID NO: 1907906 - RNA, 21 nt, Human
aggcggugggcacccacccug

SEQ ID NO: 1907907 - RNA, 15 nt, Human
agggucagaaacagg

SEQ ID NO: 1907908 - RNA, 19 nt, Human
agggucagaaacaggaccg

SEQ ID NO: 1907909 - RNA, 12 nt, Human
agggucccuggu

SEQ ID NO: 1907910 - RNA, 14 nt, Human
agggucccuggugg

SEQ ID NO: 1907911 - RNA, 21 nt, Human
aggguaucuggugacuuuccu

SEQ ID NO: 1907912 - RNA, 13 nt, Human
aggguauuccaga

SEQ ID NO: 1907913 - RNA, 16 nt, Human
agggucccugguggca

SEQ ID NO: 1907914 - RNA, 17 nt, Human
agggucccugguggcag

SEQ ID NO: 1907915 - RNA, 20 nt, Human
agggucccugguggcagcuc

SEQ ID NO: 1907916 - RNA, 22 nt, Human
agggucccugguggcagcucac

SEQ ID NO: 1907917 - RNA, 17 nt, Human
agggucggaacccaagc

SEQ ID NO: 1907918 - RNA, 22 nt, Human
agggucggaacccaagcuuaga

SEQ ID NO: 1907919 - RNA, 22 nt, Human
aggggcccaaauucuuucagug

SEQ ID NO: 1907920 - RNA, 14 nt, Human
agggccuggccuga

SEQ ID NO: 1907921 - RNA, 18 nt, Human
aggggcaggaggaagggg

SEQ ID NO: 1907922 - RNA, 13 nt, Human
aggggcaggagga

SEQ ID NO: 1907923 - RNA, 12 nt, Human
aggggcaggagg

SEQ ID NO: 1907924 - RNA, 14 nt, Human
agggccugcaaggg

SEQ ID NO: 1907925 - RNA, 15 nt, Human
agggccugcaaggga

SEQ ID NO: 1907926 - RNA, 17 nt, Human
agggccugcgagggcag

SEQ ID NO: 1907927 - RNA, 12 nt, Human
agggccuggccu

SEQ ID NO: 1907928 - RNA, 13 nt, Human
agggccuggccug

SEQ ID NO: 1907929 - RNA, 22 nt, Human
agggaucaaccagcuaagaaaa

SEQ ID NO: 1907930 - RNA, 16 nt, Human
agggaugguguucaaa

SEQ ID NO: 1907931 - RNA, 16 nt, Human
agggauacccauccca

SEQ ID NO: 1907932 - RNA, 21 nt, Human
agggaucaaccagcuaagaaa

SEQ ID NO: 1907933 - RNA, 14 nt, Human
aggguuuuccaaug

SEQ ID NO: 1907934 - RNA, 23 nt, Human
aggguuuugccauguuggccagg

SEQ ID NO: 1907935 - RNA, 22 nt, Human
aggguuuugccauguuggccag

SEQ ID NO: 1907936 - RNA, 14 nt, Human
agguaacaggcaga

SEQ ID NO: 1907937 - RNA, 13 nt, Human
agguaacaggcag

SEQ ID NO: 1907938 - RNA, 22 nt, Human
agguacgaaaagaggggaagag

SEQ ID NO: 1907939 - RNA, 16 nt, Human
agguaacaggcagaua

SEQ ID NO: 1907940 - RNA, 13 nt, Human
agguacucuccug

SEQ ID NO: 1907941 - RNA, 14 nt, Human
agguacucuccugg

SEQ ID NO: 1907942 - RNA, 23 nt, Human
aggucccuaauaaagcugugugg

SEQ ID NO: 1907943 - RNA, 11 nt, Human
aggucuagccu

SEQ ID NO: 1907944 - RNA, 13 nt, Human
agguccucuguca

SEQ ID NO: 1907945 - RNA, 14 nt, Human
agguccucugucag

SEQ ID NO: 1907946 - RNA, 19 nt, Human
agguccucugucagucaca

SEQ ID NO: 1907947 - RNA, 23 nt, Human
agguccucugucagucacagcca

SEQ ID NO: 1907948 - RNA, 20 nt, Human
agggucucacuauguugccc

SEQ ID NO: 1907949 - RNA, 19 nt, Human
agccuggcucccaggacac

SEQ ID NO: 1907950 - RNA, 18 nt, Human
agccuggcucccaggaca

SEQ ID NO: 1907951 - RNA, 17 nt, Human
agccuggcucccaggac

SEQ ID NO: 1907952 - RNA, 18 nt, Human
agccuggcuucaaauugu

SEQ ID NO: 1907953 - RNA, 22 nt, Human
agccuggcuccaaacccucgag

SEQ ID NO: 1907954 - RNA, 17 nt, Human
agccuggcuucaaauug

SEQ ID NO: 1907955 - RNA, 13 nt, Human
agccuggcuccaa

SEQ ID NO: 1907956 - RNA, 20 nt, Human
agccuggcuccaaacccucg

SEQ ID NO: 1907957 - RNA, 12 nt, Human
agccugggaggu

SEQ ID NO: 1907958 - RNA, 20 nt, Human
agccugggaggucaaggcug

SEQ ID NO: 1907959 - RNA, 19 nt, Human
agcgagcccugguggcagu

SEQ ID NO: 1907960 - RNA, 13 nt, Human
agcgagcccuggu

SEQ ID NO: 1907961 - RNA, 14 nt, Human
agccuggggcuggc

SEQ ID NO: 1907962 - RNA, 18 nt, Human
agccuuugguucuggcca

SEQ ID NO: 1907963 - RNA, 19 nt, Human
agccuuugguucuggccag

SEQ ID NO: 1907964 - RNA, 16 nt, Human
agcuaauaaaauauca

SEQ ID NO: 1907965 - RNA, 15 nt, Human
agcuaauaaaauauc

SEQ ID NO: 1907966 - RNA, 14 nt, Human
agcuaauaaaauau

SEQ ID NO: 1907967 - RNA, 20 nt, Human
agcuaauaaaauaucauuca

SEQ ID NO: 1907968 - RNA, 19 nt, Human
agcuaauaaaauaucauuc

SEQ ID NO: 1907969 - RNA, 18 nt, Human
agcuaauaaaauaucauu

SEQ ID NO: 1907970 - RNA, 17 nt, Human
agcuaauaaaauaucau

SEQ ID NO: 1907971 - RNA, 23 nt, Human
agcuaauaaaauaucauucagca

SEQ ID NO: 1907972 - RNA, 21 nt, Human
agcuaauaaaauaucauucag

SEQ ID NO: 1907973 - RNA, 17 nt, Human
agcuaaacggauuccaa

SEQ ID NO: 1907974 - RNA, 16 nt, Human
agcucaccagccccag

SEQ ID NO: 1907975 - RNA, 20 nt, Human
agcuaauuugcauuaaauuc

SEQ ID NO: 1907976 - RNA, 22 nt, Human
agcuaauuugcauuaaauucac

SEQ ID NO: 1907977 - RNA, 13 nt, Human
agcuaauuugcau

SEQ ID NO: 1907978 - RNA, 14 nt, Human
agcuaauuugcauu

SEQ ID NO: 1907979 - RNA, 19 nt, Human
agcuaauucuuugaccugu

SEQ ID NO: 1907980 - RNA, 20 nt, Human
agcucaccagccccagugcc

SEQ ID NO: 1907981 - RNA, 19 nt, Human
agcucaccagccccagugc

SEQ ID NO: 1907982 - RNA, 12 nt, Human
agcucaccucuc

SEQ ID NO: 1907983 - RNA, 15 nt, Human
agcucaccucucccu

SEQ ID NO: 1907984 - RNA, 18 nt, Human
agcucaccucucccuugg

SEQ ID NO: 1907985 - RNA, 19 nt, Human
agcucaccucucccuugga

SEQ ID NO: 1907986 - RNA, 12 nt, Human
agcucagagagg

SEQ ID NO: 1907987 - RNA, 18 nt, Human
agcucagagaggguggga

SEQ ID NO: 1907988 - RNA, 19 nt, Human
agcucagaggcgcacugug

SEQ ID NO: 1907989 - RNA, 22 nt, Human
agcucagaggcgcacugugacc

SEQ ID NO: 1907990 - RNA, 14 nt, Human
agcucagagagggu

SEQ ID NO: 1907991 - RNA, 15 nt, Human
agcugaaccugggua

SEQ ID NO: 1907992 - RNA, 13 nt, Human
agcugaggccaca

SEQ ID NO: 1907993 - RNA, 17 nt, Human
agcugaggccacacuca

SEQ ID NO: 1907994 - RNA, 17 nt, Human
agcugaggcaauucuaa

SEQ ID NO: 1907995 - RNA, 12 nt, Human
agcugagcgcca

SEQ ID NO: 1907996 - RNA, 14 nt, Human
agcugagcgccagg

SEQ ID NO: 1907997 - RNA, 15 nt, Human
agcugagcgccagga

SEQ ID NO: 1907998 - RNA, 17 nt, Human
agcugagcgccaggaug

SEQ ID NO: 1907999 - RNA, 18 nt, Human
agcugcgguccacccagg

SEQ ID NO: 1908000 - RNA, 17 nt, Human
agcugcgguccacccag

SEQ ID NO: 1908001 - RNA, 16 nt, Human
agcugcgguccaccca

SEQ ID NO: 1908002 - RNA, 13 nt, Human
agcugcgguccac

SEQ ID NO: 1908003 - RNA, 20 nt, Human
agcugcgguccacccaggag

SEQ ID NO: 1908004 - RNA, 19 nt, Human
agcugcgguccacccagga

SEQ ID NO: 1908005 - RNA, 12 nt, Human
agcugcugacag

SEQ ID NO: 1908006 - RNA, 21 nt, Human
agcugcgguccacccaggagc

SEQ ID NO: 1908007 - RNA, 17 nt, Human
agcuggucccacucagu

SEQ ID NO: 1908008 - RNA, 16 nt, Human
agcuggucccacucag

SEQ ID NO: 1908009 - RNA, 14 nt, Human
agcugcugacagug

SEQ ID NO: 1908010 - RNA, 13 nt, Human
agcugcugacagu

SEQ ID NO: 1908011 - RNA, 19 nt, Human
agcuggucccacucagucc

SEQ ID NO: 1908012 - RNA, 18 nt, Human
agcuggucccacucaguc

SEQ ID NO: 1908013 - RNA, 22 nt, Human
agcugguuuuuagcggagacgg

SEQ ID NO: 1908014 - RNA, 18 nt, Human
agcuucacuguaaaauaa

SEQ ID NO: 1908015 - RNA, 12 nt, Human
agcuucaaagcu

SEQ ID NO: 1908016 - RNA, 18 nt, Human
agcuucaccccaauccca

SEQ ID NO: 1908017 - RNA, 20 nt, Human
agcuucaccccaaucccagc

SEQ ID NO: 1908018 - RNA, 18 nt, Human
agcuucauuuccuguguc

SEQ ID NO: 1908019 - RNA, 21 nt, Human
agcuucaccccaaucccagcu

SEQ ID NO: 1908020 - RNA, 19 nt, Human
agcuucauuuccugugucu

SEQ ID NO: 1908021 - RNA, 14 nt, Human
agcuucucugugaa

SEQ ID NO: 1908022 - RNA, 12 nt, Human
agcuucuccugu

SEQ ID NO: 1908023 - RNA, 16 nt, Human
agcuucuccuguguga

SEQ ID NO: 1908024 - RNA, 21 nt, Human
agcuucuccugugugauugac

SEQ ID NO: 1908025 - RNA, 13 nt, Human
agcuucucuguga

SEQ ID NO: 1908026 - RNA, 23 nt, Human
agcuuuguuuguugucagcugaa

SEQ ID NO: 1908027 - RNA, 23 nt, Human
aggaacuuaaauaaugugaaacu

SEQ ID NO: 1908028 - RNA, 22 nt, Human
aggaauaccugucccccugaca

SEQ ID NO: 1908029 - RNA, 15 nt, Human
aggaauaccuguccc

SEQ ID NO: 1908030 - RNA, 18 nt, Human
aggaauaccugucccccu

SEQ ID NO: 1908031 - RNA, 21 nt, Human
aggaacuuaaauaaugugaaa

SEQ ID NO: 1908032 - RNA, 22 nt, Human
aggaacugcugggcuuggcagc

SEQ ID NO: 1908033 - RNA, 20 nt, Human
aggaacaaggcaaggcuguc

SEQ ID NO: 1908034 - RNA, 23 nt, Human
aggaacaaggcaaggcugucaau

SEQ ID NO: 1908035 - RNA, 15 nt, Human
aggaaccacaccaca

SEQ ID NO: 1908036 - RNA, 17 nt, Human
aggaaccacaccacauc

SEQ ID NO: 1908037 - RNA, 16 nt, Human
aggaaccauaaucaau

SEQ ID NO: 1908038 - RNA, 15 nt, Human
aggaaccaaagcgaa

SEQ ID NO: 1908039 - RNA, 13 nt, Human
aggaaccaaagcg

SEQ ID NO: 1908040 - RNA, 15 nt, Human
agcuuuuaugugaaa

SEQ ID NO: 1908041 - RNA, 12 nt, Human
aggaacaaggca

SEQ ID NO: 1908042 - RNA, 13 nt, Human
aggaacaaggcaa

SEQ ID NO: 1908043 - RNA, 16 nt, Human
aggaacaaggcaaggc

SEQ ID NO: 1908044 - RNA, 17 nt, Human
aggaacaaggcaaggcu

SEQ ID NO: 1908045 - RNA, 19 nt, Human
aggaacaaggcaaggcugu

SEQ ID NO: 1908046 - RNA, 12 nt, Human
aggacccaagca

SEQ ID NO: 1908047 - RNA, 15 nt, Human
aggacccugaagggg

SEQ ID NO: 1908048 - RNA, 19 nt, Human
aggacccugaaggggccau

SEQ ID NO: 1908049 - RNA, 15 nt, Human
aggagaggagagggg

SEQ ID NO: 1908050 - RNA, 16 nt, Human
aggaccuguggccaag

SEQ ID NO: 1908051 - RNA, 17 nt, Human
aggaccuggcugccaua

SEQ ID NO: 1908052 - RNA, 13 nt, Human
aggaccuggcugc

SEQ ID NO: 1908053 - RNA, 16 nt, Human
aggaccuggcugccau

SEQ ID NO: 1908054 - RNA, 24 nt, Human
aggaccagcucaggacagaugcca

SEQ ID NO: 1908055 - RNA, 21 nt, Human
aaacaggcaguuggccagaga

SEQ ID NO: 1908056 - RNA, 11 nt, Human
aaacaggcagu

SEQ ID NO: 1908057 - RNA, 12 nt, Human
aaacaggcagcu

SEQ ID NO: 1908058 - RNA, 14 nt, Human
aaacagcugccucu

SEQ ID NO: 1908059 - RNA, 17 nt, Human
aaacagcuaaugggaca

SEQ ID NO: 1908060 - RNA, 21 nt, Human
aaacaggacuuaaaaugacau

SEQ ID NO: 1908061 - RNA, 15 nt, Human
aaacagccugugucu

SEQ ID NO: 1908062 - RNA, 15 nt, Human
aaaauuagccaagug

SEQ ID NO: 1908063 - RNA, 13 nt, Human
aaaauuaagaaag

SEQ ID NO: 1908064 - RNA, 20 nt, Human
aaaauuaagaaaggauaaag

SEQ ID NO: 1908065 - RNA, 14 nt, Human
aaaauuaacacugc

SEQ ID NO: 1908066 - RNA, 22 nt, Human
aaaauuaacaugaauauuuagu

SEQ ID NO: 1908067 - RNA, 12 nt, Human
aaaauuaagaaa

SEQ ID NO: 1908068 - RNA, 21 nt, Human
aaaauccacuuuaucuugaau

SEQ ID NO: 1908069 - RNA, 18 nt, Human
aaaaucaaaacaaaaaaa

SEQ ID NO: 1908070 - RNA, 15 nt, Human
aaaaucaaaacaaaa

SEQ ID NO: 1908071 - RNA, 21 nt, Human
aaaauauuuugaucuucaaca

SEQ ID NO: 1908072 - RNA, 15 nt, Human
aaaauaaaaaacacu

SEQ ID NO: 1908073 - RNA, 21 nt, Human
aaagaaccaagaaaaaggaau

SEQ ID NO: 1908074 - RNA, 19 nt, Human
aaagaggcugaggcuggca

SEQ ID NO: 1908075 - RNA, 20 nt, Human
aaacugauuuuuuuuuccuu

SEQ ID NO: 1908076 - RNA, 13 nt, Human
aaacugauuuuuu

SEQ ID NO: 1908077 - RNA, 19 nt, Human
aaacugauuuuuuuuuccu

SEQ ID NO: 1908078 - RNA, 17 nt, Human
aaacucuugaccucagg

SEQ ID NO: 1908079 - RNA, 14 nt, Human
aaacccuucagugc

SEQ ID NO: 1908080 - RNA, 21 nt, Human
aaacccugucucuacuaaaaa

SEQ ID NO: 1908081 - RNA, 17 nt, Human
aaaccccaucucuacaa

SEQ ID NO: 1908082 - RNA, 22 nt, Human
aaacccauauuguaaaacaggu

SEQ ID NO: 1908083 - RNA, 18 nt, Human
aaacccagcucuggucca

SEQ ID NO: 1908084 - RNA, 15 nt, Human
aaagauacaguuacu

SEQ ID NO: 1908085 - RNA, 16 nt, Human
aaagauaaauauuaua

SEQ ID NO: 1908086 - RNA, 11 nt, Human
aaagagguuuu

SEQ ID NO: 1908087 - RNA, 13 nt, Human
aaagauaaauauu

SEQ ID NO: 1908088 - RNA, 15 nt, Human
aaagauaaauauuau

SEQ ID NO: 1908089 - RNA, 14 nt, Human
aaagauaaauauua

SEQ ID NO: 1908090 - RNA, 13 nt, Human
aaagaggugugca

SEQ ID NO: 1908091 - RNA, 11 nt, Human
aaauaaauuau

SEQ ID NO: 1908092 - RNA, 16 nt, Human
aaagugccagaaagug

SEQ ID NO: 1908093 - RNA, 19 nt, Human
aaaguauuuuauucuuauu

SEQ ID NO: 1908094 - RNA, 16 nt, Human
aaauaaacgucuuaaa

SEQ ID NO: 1908095 - RNA, 15 nt, Human
aaauaaacgucuuaa

SEQ ID NO: 1908096 - RNA, 22 nt, Human
aaauaaaacauuuucacacaau

SEQ ID NO: 1908097 - RNA, 18 nt, Human
aaauaaaacauuuucaca

SEQ ID NO: 1908098 - RNA, 12 nt, Human
aaauaaaacauu

SEQ ID NO: 1908099 - RNA, 19 nt, Human
aaaggcagaagcaacccaa

SEQ ID NO: 1908100 - RNA, 18 nt, Human
aaagcccaaagugguaua

SEQ ID NO: 1908101 - RNA, 15 nt, Human
aaagccaagaggcug

SEQ ID NO: 1908102 - RNA, 15 nt, Human
aaagcccagagacag

SEQ ID NO: 1908103 - RNA, 18 nt, Human
aaagcccaagggaucugg

SEQ ID NO: 1908104 - RNA, 14 nt, Human
aaagccccagaaau

SEQ ID NO: 1908105 - RNA, 23 nt, Human
aaagcccaagggaucugguccua

SEQ ID NO: 1908106 - RNA, 14 nt, Human
aaaggcuccaggag

SEQ ID NO: 1908107 - RNA, 14 nt, Human
aaaggcuaccuuug

SEQ ID NO: 1908108 - RNA, 17 nt, Human
aaaggcuaccuuuguau

SEQ ID NO: 1908109 - RNA, 22 nt, Human
aaaggcuccaggagcagccaca

SEQ ID NO: 1908110 - RNA, 21 nt, Human
aaaggcuccaggagcagccac

SEQ ID NO: 1908111 - RNA, 15 nt, Human
aaagccaaagcuagg

SEQ ID NO: 1908112 - RNA, 12 nt, Human
aaagcauuuaua

SEQ ID NO: 1908113 - RNA, 15 nt, Human
aaagcauuuauaaau

SEQ ID NO: 1908114 - RNA, 14 nt, Human
aacgaaacccacuc

SEQ ID NO: 1908115 - RNA, 15 nt, Human
aacguauaaaagccu

SEQ ID NO: 1908116 - RNA, 18 nt, Human
aacggggcucuucucauu

SEQ ID NO: 1908117 - RNA, 16 nt, Human
aacggggcucuucuca

SEQ ID NO: 1908118 - RNA, 17 nt, Human
aacucaaacucuuaaaa

SEQ ID NO: 1908119 - RNA, 18 nt, Human
aacucaaauggggccaga

SEQ ID NO: 1908120 - RNA, 21 nt, Human
aacucaaauggggccagaucc

SEQ ID NO: 1908121 - RNA, 22 nt, Human
aacucaaauggggccagaucca

SEQ ID NO: 1908122 - RNA, 23 nt, Human
aacucaaauggggccagauccag

SEQ ID NO: 1908123 - RNA, 16 nt, Human
aacucaccccagcccc

SEQ ID NO: 1908124 - RNA, 17 nt, Human
aacucaccccagcccca

SEQ ID NO: 1908125 - RNA, 18 nt, Human
aacucaccccagccccaa

SEQ ID NO: 1908126 - RNA, 18 nt, Human
aacucauauuuucaugcu

SEQ ID NO: 1908127 - RNA, 16 nt, Human
aacucauauuuucaug

SEQ ID NO: 1908128 - RNA, 15 nt, Human
aacucauauuuucau

SEQ ID NO: 1908129 - RNA, 13 nt, Human
aacuguucccacc

SEQ ID NO: 1908130 - RNA, 15 nt, Human
aacuguucccaccug

SEQ ID NO: 1908131 - RNA, 18 nt, Human
aacuguucccaccugcug

SEQ ID NO: 1908132 - RNA, 19 nt, Human
aacuguguuucaaguucaa

SEQ ID NO: 1908133 - RNA, 22 nt, Human
aacuguguuucaaguucaaucc

SEQ ID NO: 1908134 - RNA, 17 nt, Human
aacugagcuuggaagcu

SEQ ID NO: 1908135 - RNA, 13 nt, Human
aacugagcuugga

SEQ ID NO: 1908136 - RNA, 21 nt, Human
aacugagcuuggaagcuucug

SEQ ID NO: 1908137 - RNA, 12 nt, Human
aacaggaccggg

SEQ ID NO: 1908138 - RNA, 10 nt, Human
aacagcucag

SEQ ID NO: 1908139 - RNA, 17 nt, Human
aacaggaccggguggaa

SEQ ID NO: 1908140 - RNA, 19 nt, Human
aacaggacuuaaaaugaca

SEQ ID NO: 1908141 - RNA, 14 nt, Human
aacagcucaggauc

SEQ ID NO: 1908142 - RNA, 15 nt, Human
aacaucccuccuggg

SEQ ID NO: 1908143 - RNA, 16 nt, Human
aacagcuaaugggaca

SEQ ID NO: 1908144 - RNA, 15 nt, Human
aacagccugugucuu

SEQ ID NO: 1908145 - RNA, 20 nt, Human
aacagcggcuggacuuggag

SEQ ID NO: 1908146 - RNA, 21 nt, Human
aacacuauauggcagugucuu

SEQ ID NO: 1908147 - RNA, 20 nt, Human
aacacuauauggcagugucu

SEQ ID NO: 1908148 - RNA, 18 nt, Human
aacacuauauggcagugu

SEQ ID NO: 1908149 - RNA, 14 nt, Human
aacacuauauggca

SEQ ID NO: 1908150 - RNA, 13 nt, Human
aacccuucagugc

SEQ ID NO: 1908151 - RNA, 19 nt, Human
aaccaguguuguggauuua

SEQ ID NO: 1908152 - RNA, 15 nt, Human
aacauggaaguacua

SEQ ID NO: 1908153 - RNA, 21 nt, Human
aaccagggagccccuuugaug

SEQ ID NO: 1908154 - RNA, 15 nt, Human
aaccagggagcugca

SEQ ID NO: 1908155 - RNA, 15 nt, Human
aaccagggauuguuu

SEQ ID NO: 1908156 - RNA, 16 nt, Human
aaccagggauuguuuc

SEQ ID NO: 1908157 - RNA, 19 nt, Human
aaccagggauuguuucugu

SEQ ID NO: 1908158 - RNA, 22 nt, Human
aacaugcuacacacugcauguu

SEQ ID NO: 1908159 - RNA, 14 nt, Human
aacaucuauucucu

SEQ ID NO: 1908160 - RNA, 11 nt, Human
aacccuucucc

SEQ ID NO: 1908161 - RNA, 18 nt, Human
aacccuucuccucuugua

SEQ ID NO: 1908162 - RNA, 20 nt, Human
aacccuucuccucuuguaaa

SEQ ID NO: 1908163 - RNA, 21 nt, Human
aacccuucuccucuuguaaau

SEQ ID NO: 1908164 - RNA, 16 nt, Human
aacacccuauauuuug

SEQ ID NO: 1908165 - RNA, 17 nt, Human
aacacuaacaugauuug

SEQ ID NO: 1908166 - RNA, 19 nt, Human
aacaccucugcacaagcug

SEQ ID NO: 1908167 - RNA, 18 nt, Human
aacacuaacuaugcaugg

SEQ ID NO: 1908168 - RNA, 22 nt, Human
aacaaaccuguuucugcagcca

SEQ ID NO: 1908169 - RNA, 16 nt, Human
aacaaacucucugaac

SEQ ID NO: 1908170 - RNA, 23 nt, Human
aacaaaguuacuagguaacuuca

SEQ ID NO: 1908171 - RNA, 13 nt, Human
aacaaaguuacua

SEQ ID NO: 1908172 - RNA, 21 nt, Human
aacacauacaggaagguagaa

SEQ ID NO: 1908173 - RNA, 19 nt, Human
aacaaaugaacgauaugua

SEQ ID NO: 1908174 - RNA, 19 nt, Human
aacaaaucuaggaaaauau

SEQ ID NO: 1908175 - RNA, 20 nt, Human
aacaaaucuaggaaaauauu

SEQ ID NO: 1908176 - RNA, 21 nt, Human
aacaaaucuaggaaaauauuu

SEQ ID NO: 1908177 - RNA, 23 nt, Human
aacaaaucuaggaaaauauuuug

SEQ ID NO: 1908178 - RNA, 22 nt, Human
aaauguuuuuuuuuaaagacuu

SEQ ID NO: 1908179 - RNA, 12 nt, Human
aaauuaacuuuu

SEQ ID NO: 1908180 - RNA, 22 nt, Human
aaauugacacuuaaaaaugguu

SEQ ID NO: 1908181 - RNA, 14 nt, Human
aaauuaacuuuuau

SEQ ID NO: 1908182 - RNA, 13 nt, Human
aaauuaacuuuua

SEQ ID NO: 1908183 - RNA, 18 nt, Human
aaauugaugggauuuggu

SEQ ID NO: 1908184 - RNA, 15 nt, Human
aacaaaauuucuauu

SEQ ID NO: 1908185 - RNA, 13 nt, Human
aacaaaauuucua

SEQ ID NO: 1908186 - RNA, 14 nt, Human
aacaaacaaacaaa

SEQ ID NO: 1908187 - RNA, 18 nt, Human
aacaaacauugaugcuga

SEQ ID NO: 1908188 - RNA, 22 nt, Human
aaauugguuggagaauuuaggu

SEQ ID NO: 1908189 - RNA, 16 nt, Human
aaauugguucuuuauu

SEQ ID NO: 1908190 - RNA, 18 nt, Human
aaauguuuuuuuuuaaag

SEQ ID NO: 1908191 - RNA, 21 nt, Human
aaauguuuuuuuuuaaagacu

SEQ ID NO: 1908192 - RNA, 15 nt, Human
aaauguucuuugggg

SEQ ID NO: 1908193 - RNA, 20 nt, Human
aaauguucaucaaugaauga

SEQ ID NO: 1908194 - RNA, 18 nt, Human
aaaucugcuuuuuaaaga

SEQ ID NO: 1908195 - RNA, 20 nt, Human
aaaucugcuggaguuucaug

SEQ ID NO: 1908196 - RNA, 18 nt, Human
aaaucugacccagugccc

SEQ ID NO: 1908197 - RNA, 22 nt, Human
aaaucugcuggaguuucaugua

SEQ ID NO: 1908198 - RNA, 19 nt, Human
aaaugcuaaugucaaacuu

SEQ ID NO: 1908199 - RNA, 21 nt, Human
aaaugcuaaugucaaacuuga

SEQ ID NO: 1908200 - RNA, 22 nt, Human
aaaucuccaaaauaaaacuuuu

SEQ ID NO: 1908201 - RNA, 14 nt, Human
aaaucugacccagu

SEQ ID NO: 1908202 - RNA, 20 nt, Human
aaaucugacccagugccccc

SEQ ID NO: 1908203 - RNA, 15 nt, Human
aaauggacguguuau

SEQ ID NO: 1908204 - RNA, 17 nt, Human
aaauggacguguuauga

SEQ ID NO: 1908205 - RNA, 19 nt, Human
aaauggacauaggacucaa

SEQ ID NO: 1908206 - RNA, 14 nt, Human
aaauggacguguua

SEQ ID NO: 1908207 - RNA, 17 nt, Human
aaauggaauacucuuau

SEQ ID NO: 1908208 - RNA, 18 nt, Human
aauaauaccuaagccuuc

SEQ ID NO: 1908209 - RNA, 15 nt, Human
aauaauaaauauuua

SEQ ID NO: 1908210 - RNA, 13 nt, Human
aagugcugcauuu

SEQ ID NO: 1908211 - RNA, 14 nt, Human
aagugcugcauuua

SEQ ID NO: 1908212 - RNA, 15 nt, Human
aaguucuuaguugcu

SEQ ID NO: 1908213 - RNA, 22 nt, Human
aaguucuuaguugcuguauguc

SEQ ID NO: 1908214 - RNA, 22 nt, Human
aagugggcuugauucugcagua

SEQ ID NO: 1908215 - RNA, 12 nt, Human
aagugggcuuga

SEQ ID NO: 1908216 - RNA, 16 nt, Human
aagugggcuugauucu

SEQ ID NO: 1908217 - RNA, 11 nt, Human
aauaaagcugu

SEQ ID NO: 1908218 - RNA, 19 nt, Human
aauaaagcuguguggcagu

SEQ ID NO: 1908219 - RNA, 18 nt, Human
aauaaagccuucaaacuc

SEQ ID NO: 1908220 - RNA, 15 nt, Human
aauaaacgucuuaaa

SEQ ID NO: 1908221 - RNA, 16 nt, Human
aauaaaggaugugauu

SEQ ID NO: 1908222 - RNA, 14 nt, Human
aauaauaaauauuu

SEQ ID NO: 1908223 - RNA, 10 nt, Human
aauaaaccau

SEQ ID NO: 1908224 - RNA, 12 nt, Human
aauaaaauuuuu

SEQ ID NO: 1908225 - RNA, 16 nt, Human
aaguugcagugagcug

SEQ ID NO: 1908226 - RNA, 16 nt, Human
aauagaaauccaauug

SEQ ID NO: 1908227 - RNA, 22 nt, Human
aauagaaauaaaggaugugauu

SEQ ID NO: 1908228 - RNA, 17 nt, Human
aauagaaauggggaacu

SEQ ID NO: 1908229 - RNA, 20 nt, Human
aauacgugggcauucaaaug

SEQ ID NO: 1908230 - RNA, 19 nt, Human
aauacgugggcauucaaau

SEQ ID NO: 1908231 - RNA, 14 nt, Human
aauacuaccuugaa

SEQ ID NO: 1908232 - RNA, 15 nt, Human
aauacuaccuugaaa

SEQ ID NO: 1908233 - RNA, 16 nt, Human
aauacuaccuugaaaa

SEQ ID NO: 1908234 - RNA, 16 nt, Human
aauauaggaacuuaaa

SEQ ID NO: 1908235 - RNA, 14 nt, Human
aauauaaacacuau

SEQ ID NO: 1908236 - RNA, 13 nt, Human
aauauaaacacua

SEQ ID NO: 1908237 - RNA, 12 nt, Human
aauauaaauguu

SEQ ID NO: 1908238 - RNA, 19 nt, Human
aauauaaauguuaagaaaa

SEQ ID NO: 1908239 - RNA, 14 nt, Human
aauaugcuggcugg

SEQ ID NO: 1908240 - RNA, 16 nt, Human
aauaugcuggcuggag

SEQ ID NO: 1908241 - RNA, 14 nt, Human
aauauggaacuuac

SEQ ID NO: 1908242 - RNA, 15 nt, Human
aauauggaacuuaca

SEQ ID NO: 1908243 - RNA, 16 nt, Human
aauauggaacuuacau

SEQ ID NO: 1908244 - RNA, 17 nt, Human
aauauggaacuuacauu

SEQ ID NO: 1908245 - RNA, 20 nt, Human
aauauggaacuuacauuguu

SEQ ID NO: 1908246 - RNA, 24 nt, Human
aauauggaacuuacauuguucaau

SEQ ID NO: 1908247 - RNA, 17 nt, Human
aaugcuaagggcaggcc

SEQ ID NO: 1908248 - RNA, 23 nt, Human
aaugcgugcauaccacuuuuguu

SEQ ID NO: 1908249 - RNA, 21 nt, Human
aaugcgugcauaccacuuuug

SEQ ID NO: 1908250 - RNA, 23 nt, Human
aaugcucuuuacuucauggacuu

SEQ ID NO: 1908251 - RNA, 15 nt, Human
aaugcucagaccagc

SEQ ID NO: 1908252 - RNA, 19 nt, Human
aaugcuccuuguuccuaga

SEQ ID NO: 1908253 - RNA, 11 nt, Human
aaugcucuagu

SEQ ID NO: 1908254 - RNA, 13 nt, Human
aaugggacacuaa

SEQ ID NO: 1908255 - RNA, 14 nt, Human
aaugggagcucaug

SEQ ID NO: 1908256 - RNA, 21 nt, Human
aaugggagcugaggccacacu

SEQ ID NO: 1908257 - RNA, 17 nt, Human
aauggggccagauccag

SEQ ID NO: 1908258 - RNA, 17 nt, Human
aaugggggugcauuuga

SEQ ID NO: 1908259 - RNA, 15 nt, Human
aaugggggugcauuu

SEQ ID NO: 1908260 - RNA, 22 nt, Human
aauggggccagauccagccugg

SEQ ID NO: 1908261 - RNA, 17 nt, Human
aaugggguccuggccau

SEQ ID NO: 1908262 - RNA, 18 nt, Human
aaugggguccuggccauc

SEQ ID NO: 1908263 - RNA, 22 nt, Human
aaugguauuugaauuaaauguu

SEQ ID NO: 1908264 - RNA, 15 nt, Human
aaugucacaggcagg

SEQ ID NO: 1908265 - RNA, 22 nt, Human
aaucauuuuaauuauuauucuu

SEQ ID NO: 1908266 - RNA, 20 nt, Human
aaucauuuuaauuauuauuc

SEQ ID NO: 1908267 - RNA, 19 nt, Human
aaucauuuuaauuauuauu

SEQ ID NO: 1908268 - RNA, 17 nt, Human
aaucauuuuaauuauua

SEQ ID NO: 1908269 - RNA, 16 nt, Human
aaucauuuuaauuauu

SEQ ID NO: 1908270 - RNA, 15 nt, Human
aaucauuuuaauuau

SEQ ID NO: 1908271 - RNA, 19 nt, Human
aauccaccugccucggccu

SEQ ID NO: 1908272 - RNA, 18 nt, Human
aauccaccugccucggcc

SEQ ID NO: 1908273 - RNA, 20 nt, Human
aauccaaauggcgucuggaa

SEQ ID NO: 1908274 - RNA, 13 nt, Human
aauccaaauggcg

SEQ ID NO: 1908275 - RNA, 14 nt, Human
aauccaaacuugga

SEQ ID NO: 1908276 - RNA, 21 nt, Human
aauccaaacuuggauuuuuga

SEQ ID NO: 1908277 - RNA, 14 nt, Human
aaucuggagaccag

SEQ ID NO: 1908278 - RNA, 18 nt, Human
aaucucccuucacaaguu

SEQ ID NO: 1908279 - RNA, 21 nt, Human
aaucuccaccagucauuuuuc

SEQ ID NO: 1908280 - RNA, 22 nt, Human
aaucuccaccagucauuuuuca

SEQ ID NO: 1908281 - RNA, 15 nt, Human
aaugauagcuacugu

SEQ ID NO: 1908282 - RNA, 16 nt, Human
aaugauuaauuaaaac

SEQ ID NO: 1908283 - RNA, 21 nt, Human
aaugauguguacccaaacgug

SEQ ID NO: 1908284 - RNA, 12 nt, Human
aaugauuaauua

SEQ ID NO: 1908285 - RNA, 13 nt, Human
aaugauuaauuaa

SEQ ID NO: 1908286 - RNA, 21 nt, Human
aaugaacacucuuuugcuuua

SEQ ID NO: 1908287 - RNA, 15 nt, Human
aaugaacacucuuuu

SEQ ID NO: 1908288 - RNA, 18 nt, Human
aaugaacacucuuuugcu

SEQ ID NO: 1908289 - RNA, 20 nt, Human
aaggcaaagcacgaaauguu

SEQ ID NO: 1908290 - RNA, 21 nt, Human
aaggcaaaggguccagaagga

SEQ ID NO: 1908291 - RNA, 14 nt, Human
aaggcaaaauugca

SEQ ID NO: 1908292 - RNA, 15 nt, Human
aaggcaaaauugcaa

SEQ ID NO: 1908293 - RNA, 19 nt, Human
aaggcaaaauugcaaaucu

SEQ ID NO: 1908294 - RNA, 12 nt, Human
aaggaauuuuau

SEQ ID NO: 1908295 - RNA, 12 nt, Human
aaggcaaaauug

SEQ ID NO: 1908296 - RNA, 14 nt, Human
aagcugcugacagu

SEQ ID NO: 1908297 - RNA, 22 nt, Human
aagcugccagccgagauagcca

SEQ ID NO: 1908298 - RNA, 11 nt, Human
aagcugccagc

SEQ ID NO: 1908299 - RNA, 12 nt, Human
aagcugccagcc

SEQ ID NO: 1908300 - RNA, 20 nt, Human
aagcgugagccacugcaccg

SEQ ID NO: 1908301 - RNA, 17 nt, Human
aagcgugagccacugca

SEQ ID NO: 1908302 - RNA, 21 nt, Human
aagcgugagccacugcaccgg

SEQ ID NO: 1908303 - RNA, 23 nt, Human
aaggaaugauuaauuaaaacaca

SEQ ID NO: 1908304 - RNA, 16 nt, Human
aagcugcugacagugu

SEQ ID NO: 1908305 - RNA, 14 nt, Human
aagcugcuuuauuc

SEQ ID NO: 1908306 - RNA, 17 nt, Human
aagcgauucuucugcuu

SEQ ID NO: 1908307 - RNA, 16 nt, Human
aagcgauucuucugcu

SEQ ID NO: 1908308 - RNA, 14 nt, Human
aagcgauucuucug

SEQ ID NO: 1908309 - RNA, 15 nt, Human
aagcgauucuucugc

SEQ ID NO: 1908310 - RNA, 15 nt, Human
aagccagcaggcucu

SEQ ID NO: 1908311 - RNA, 19 nt, Human
aagccagcaggcucucagg

SEQ ID NO: 1908312 - RNA, 18 nt, Human
aagccagcaggcucucag

SEQ ID NO: 1908313 - RNA, 21 nt, Human
aagccaccaacauacucccau

SEQ ID NO: 1908314 - RNA, 18 nt, Human
aagcagguucccaagcuc

SEQ ID NO: 1908315 - RNA, 19 nt, Human
aagcagguucccaagcuca

SEQ ID NO: 1908316 - RNA, 22 nt, Human
aagggcaggcccaaauuaucaa

SEQ ID NO: 1908317 - RNA, 20 nt, Human
aagggacuuggaagcuccgc

SEQ ID NO: 1908318 - RNA, 15 nt, Human
aagggaucugguccu

SEQ ID NO: 1908319 - RNA, 19 nt, Human
aagggaguguacucccagg

SEQ ID NO: 1908320 - RNA, 15 nt, Human
aagggauaugugaaa

SEQ ID NO: 1908321 - RNA, 15 nt, Human
aagggacugagaaau

SEQ ID NO: 1908322 - RNA, 17 nt, Human
aagggacugagaaauuu

SEQ ID NO: 1908323 - RNA, 12 nt, Human
aaguagaggagg

SEQ ID NO: 1908324 - RNA, 17 nt, Human
aaguagcauuuacugug

SEQ ID NO: 1908325 - RNA, 11 nt, Human
aaguagcauuu

SEQ ID NO: 1908326 - RNA, 16 nt, Human
aaguagcauuuacugu

SEQ ID NO: 1908327 - RNA, 19 nt, Human
aacuuaccugggcauucuu

SEQ ID NO: 1908328 - RNA, 14 nt, Human
aacuuacuuagugu

SEQ ID NO: 1908329 - RNA, 22 nt, Human
aagacagcuucucauccugcag

SEQ ID NO: 1908330 - RNA, 19 nt, Human
aacuuacauuguucaauua

SEQ ID NO: 1908331 - RNA, 20 nt, Human
aacuuacauuguucaauuag

SEQ ID NO: 1908332 - RNA, 21 nt, Human
aacuuacauuguucaauuaga

SEQ ID NO: 1908333 - RNA, 22 nt, Human
aacuuacauuguucaauuagaa

SEQ ID NO: 1908334 - RNA, 23 nt, Human
aagacagugaaagaaaauaacaa

SEQ ID NO: 1908335 - RNA, 14 nt, Human
aagacaugcagccu

SEQ ID NO: 1908336 - RNA, 21 nt, Human
aagacagggcugauaagcuaa

SEQ ID NO: 1908337 - RNA, 16 nt, Human
aagacuuuggaaagag

SEQ ID NO: 1908338 - RNA, 15 nt, Human
aagacuuuuaugaua

SEQ ID NO: 1908339 - RNA, 18 nt, Human
aagagaagggcagggcug

SEQ ID NO: 1908340 - RNA, 13 nt, Human
aagagagaaacaa

SEQ ID NO: 1908341 - RNA, 19 nt, Human
aagauugagaaguuacuuu

SEQ ID NO: 1908342 - RNA, 14 nt, Human
aagauugagaaguu

SEQ ID NO: 1908343 - RNA, 22 nt, Human
aagauugagaaguuacuuucca

SEQ ID NO: 1908344 - RNA, 22 nt, Human
aagauucuucccauucuccauu

SEQ ID NO: 1908345 - RNA, 15 nt, Human
aagauucuucccauu

SEQ ID NO: 1908346 - RNA, 19 nt, Human
aagauucuucccauucucc

SEQ ID NO: 1908347 - RNA, 20 nt, Human
aagauucuucccauucucca

SEQ ID NO: 1908348 - RNA, 21 nt, Human
aagauucuucccauucuccau

SEQ ID NO: 1908349 - RNA, 23 nt, Human
aagauucuucccauucuccauuu

SEQ ID NO: 1908350 - RNA, 20 nt, Human
aagauucauauuuacuucuu

SEQ ID NO: 1908351 - RNA, 21 nt, Human
aagauucaaugccccugaauu

SEQ ID NO: 1908352 - RNA, 20 nt, Human
aagauucaaugccccugaau

SEQ ID NO: 1908353 - RNA, 20 nt, Human
aagauacugaaauaaacguc

SEQ ID NO: 1908354 - RNA, 16 nt, Human
aagauacugaaauaaa

SEQ ID NO: 1908355 - RNA, 14 nt, Human
aagauacugaaaua

SEQ ID NO: 1908356 - RNA, 19 nt, Human
aagauuuugaaauuuuuau

SEQ ID NO: 1908357 - RNA, 19 nt, Human
aagccaccaacauacuccc

SEQ ID NO: 1908358 - RNA, 22 nt, Human
aagcagaggaggggccgcugcc

SEQ ID NO: 1908359 - RNA, 15 nt, Human
aagcagggacuugaa

SEQ ID NO: 1908360 - RNA, 15 nt, Human
aagcagaggaggggc

SEQ ID NO: 1908361 - RNA, 20 nt, Human
aagcagaggaggggccgcug

SEQ ID NO: 1908362 - RNA, 21 nt, Human
aagcagaggaaggagaggaga

SEQ ID NO: 1908363 - RNA, 12 nt, Human
aagcagaggagg

SEQ ID NO: 1908364 - RNA, 14 nt, Human
aagcagaggagggg

SEQ ID NO: 1908365 - RNA, 16 nt, Human
acccacaugugacaca

SEQ ID NO: 1908366 - RNA, 15 nt, Human
acccacaugugacac

SEQ ID NO: 1908367 - RNA, 17 nt, Human
acccacccccacccaag

SEQ ID NO: 1908368 - RNA, 15 nt, Human
acccacccccaccca

SEQ ID NO: 1908369 - RNA, 15 nt, Human
acccacccuccuuuc

SEQ ID NO: 1908370 - RNA, 13 nt, Human
acccaugcugccc

SEQ ID NO: 1908371 - RNA, 17 nt, Human
acccauccccgcagugu

SEQ ID NO: 1908372 - RNA, 23 nt, Human
acccaugccucccccuagccauu

SEQ ID NO: 1908373 - RNA, 20 nt, Human
acccauauuguaaaacaggu

SEQ ID NO: 1908374 - RNA, 16 nt, Human
acccauauuguaaaac

SEQ ID NO: 1908375 - RNA, 23 nt, Human
acccauauccuuacccuccuugg

SEQ ID NO: 1908376 - RNA, 20 nt, Human
accauaguaccauuuauaca

SEQ ID NO: 1908377 - RNA, 14 nt, Human
accaucaagccacc

SEQ ID NO: 1908378 - RNA, 21 nt, Human
accauaguaccauuuauacaa

SEQ ID NO: 1908379 - RNA, 23 nt, Human
accauaguaccauuuauacaaau

SEQ ID NO: 1908380 - RNA, 12 nt, Human
accaucauugaa

SEQ ID NO: 1908381 - RNA, 15 nt, Human
accaucauugaaauc

SEQ ID NO: 1908382 - RNA, 15 nt, Human
accaucaagccacca

SEQ ID NO: 1908383 - RNA, 16 nt, Human
accaucccugaaggcc

SEQ ID NO: 1908384 - RNA, 23 nt, Human
accaucauugaaaucuuuuugcu

SEQ ID NO: 1908385 - RNA, 14 nt, Human
accaucucuuuacc

SEQ ID NO: 1908386 - RNA, 12 nt, Human
acaugugacaca

SEQ ID NO: 1908387 - RNA, 15 nt, Human
acaugugacacauau

SEQ ID NO: 1908388 - RNA, 14 nt, Human
acaugugacacaua

SEQ ID NO: 1908389 - RNA, 23 nt, Human
acaugucuuuucuugcaugaggc

SEQ ID NO: 1908390 - RNA, 19 nt, Human
acaugccucucucaggcca

SEQ ID NO: 1908391 - RNA, 16 nt, Human
acauuuccuaaauaua

SEQ ID NO: 1908392 - RNA, 17 nt, Human
acauuuccuaaauauau

SEQ ID NO: 1908393 - RNA, 15 nt, Human
acauuuaccaaucau

SEQ ID NO: 1908394 - RNA, 18 nt, Human
acauuuaccaaucauauu

SEQ ID NO: 1908395 - RNA, 16 nt, Human
acauuuaccuuuuuga

SEQ ID NO: 1908396 - RNA, 19 nt, Human
accaaggcugauuaaacca

SEQ ID NO: 1908397 - RNA, 17 nt, Human
accaaggagaugaagca

SEQ ID NO: 1908398 - RNA, 20 nt, Human
accaaggcugauuaaaccaa

SEQ ID NO: 1908399 - RNA, 20 nt, Human
accagccccagugcccacag

SEQ ID NO: 1908400 - RNA, 19 nt, Human
accagccccagugcccaca

SEQ ID NO: 1908401 - RNA, 18 nt, Human
accagccccagugcccac

SEQ ID NO: 1908402 - RNA, 17 nt, Human
accagccccagugccca

SEQ ID NO: 1908403 - RNA, 16 nt, Human
accagccccagugccc

SEQ ID NO: 1908404 - RNA, 14 nt, Human
accagcagaaaugc

SEQ ID NO: 1908405 - RNA, 12 nt, Human
accagcagagca

SEQ ID NO: 1908406 - RNA, 13 nt, Human
accagcagagcac

SEQ ID NO: 1908407 - RNA, 14 nt, Human
acaucaggaguuca

SEQ ID NO: 1908408 - RNA, 22 nt, Human
acaucagcuggucaaacaaacu

SEQ ID NO: 1908409 - RNA, 17 nt, Human
acauacaacacaaagag

SEQ ID NO: 1908410 - RNA, 18 nt, Human
acauacaacacaaagaga

SEQ ID NO: 1908411 - RNA, 16 nt, Human
acauaagauaaaugug

SEQ ID NO: 1908412 - RNA, 16 nt, Human
acaugcaaggucauuu

SEQ ID NO: 1908413 - RNA, 21 nt, Human
acaugauuuccuugaaugugg

SEQ ID NO: 1908414 - RNA, 17 nt, Human
acaugcaaggucauuuu

SEQ ID NO: 1908415 - RNA, 18 nt, Human
acaugcaaggucauuuuu

SEQ ID NO: 1908416 - RNA, 23 nt, Human
acaugauuuccuugaauguggcu

SEQ ID NO: 1908417 - RNA, 14 nt, Human
acaugccacaagga

SEQ ID NO: 1908418 - RNA, 15 nt, Human
acaugccucucucag

SEQ ID NO: 1908419 - RNA, 16 nt, Human
acaugccucucucagg

SEQ ID NO: 1908420 - RNA, 17 nt, Human
acaugccucucucaggc

SEQ ID NO: 1908421 - RNA, 18 nt, Human
acaugccucucucaggcc

SEQ ID NO: 1908422 - RNA, 23 nt, Human
acagugagucgaggacagggagg

SEQ ID NO: 1908423 - RNA, 20 nt, Human
acagugauuaccagggacug

SEQ ID NO: 1908424 - RNA, 21 nt, Human
acagugauuaccagggacuga

SEQ ID NO: 1908425 - RNA, 13 nt, Human
acaguguacaguc

SEQ ID NO: 1908426 - RNA, 12 nt, Human
acaguguacagu

SEQ ID NO: 1908427 - RNA, 15 nt, Human
acaguggggaaugaa

SEQ ID NO: 1908428 - RNA, 19 nt, Human
acaguggggaaugaagaua

SEQ ID NO: 1908429 - RNA, 18 nt, Human
acaguguacagucuugua

SEQ ID NO: 1908430 - RNA, 17 nt, Human
acaguguacagucuugu

SEQ ID NO: 1908431 - RNA, 15 nt, Human
acaguguacagucuu

SEQ ID NO: 1908432 - RNA, 16 nt, Human
acaguguagcuugccc

SEQ ID NO: 1908433 - RNA, 14 nt, Human
acaggcaaugcugg

SEQ ID NO: 1908434 - RNA, 21 nt, Human
acagggcugauaagcuaacac

SEQ ID NO: 1908435 - RNA, 16 nt, Human
acaggucuucaucgaa

SEQ ID NO: 1908436 - RNA, 21 nt, Human
acaggucuuuccuaaggcugc

SEQ ID NO: 1908437 - RNA, 23 nt, Human
acaggugugagucaccaagccca

SEQ ID NO: 1908438 - RNA, 22 nt, Human
acaggugugagucaccaagccc

SEQ ID NO: 1908439 - RNA, 19 nt, Human
acaggugugaaccaccaca

SEQ ID NO: 1908440 - RNA, 22 nt, Human
acagugagucgaggacagggag

SEQ ID NO: 1908441 - RNA, 18 nt, Human
acagugagggagauccca

SEQ ID NO: 1908442 - RNA, 14 nt, Human
acagcucuguccug

SEQ ID NO: 1908443 - RNA, 23 nt, Human
acagcuccuucuguccuacucug

SEQ ID NO: 1908444 - RNA, 18 nt, Human
acagcuccuucuguccua

SEQ ID NO: 1908445 - RNA, 16 nt, Human
acagcuccuucugucc

SEQ ID NO: 1908446 - RNA, 17 nt, Human
acagaggggguggccuc

SEQ ID NO: 1908447 - RNA, 18 nt, Human
acagaggggguggccucc

SEQ ID NO: 1908448 - RNA, 19 nt, Human
acagaggggguggccuccc

SEQ ID NO: 1908449 - RNA, 21 nt, Human
acagaggggguggccucccaa

SEQ ID NO: 1908450 - RNA, 17 nt, Human
acagcucuguccuggga

SEQ ID NO: 1908451 - RNA, 16 nt, Human
acagcucuguccuggg

SEQ ID NO: 1908452 - RNA, 13 nt, Human
acagcucuguccu

SEQ ID NO: 1908453 - RNA, 17 nt, Human
acagcugaguuguugag

SEQ ID NO: 1908454 - RNA, 23 nt, Human
acaggcaagcaccuccugccucg

SEQ ID NO: 1908455 - RNA, 20 nt, Human
acaggcaagcaccuccugcc

SEQ ID NO: 1908456 - RNA, 13 nt, Human
acagcugccuggg

SEQ ID NO: 1908457 - RNA, 14 nt, Human
acacugggaggcca

SEQ ID NO: 1908458 - RNA, 15 nt, Human
acacugggaggccag

SEQ ID NO: 1908459 - RNA, 20 nt, Human
acacugggaggccagugagc

SEQ ID NO: 1908460 - RNA, 20 nt, Human
acacugggagaaaugaaaaa

SEQ ID NO: 1908461 - RNA, 22 nt, Human
acacugugcugagucugaaggc

SEQ ID NO: 1908462 - RNA, 17 nt, Human
acacugugcugagucug

SEQ ID NO: 1908463 - RNA, 14 nt, Human
acagacaaagcgug

SEQ ID NO: 1908464 - RNA, 13 nt, Human
acagaagcuucca

SEQ ID NO: 1908465 - RNA, 23 nt, Human
acagaggccaugggccuccugug

SEQ ID NO: 1908466 - RNA, 21 nt, Human
acagaggccaugggccuccug

SEQ ID NO: 1908467 - RNA, 17 nt, Human
acagaggccaugggccu

SEQ ID NO: 1908468 - RNA, 13 nt, Human
acagaggcagccc

SEQ ID NO: 1908469 - RNA, 23 nt, Human
acagaggacaguauuugugggga

SEQ ID NO: 1908470 - RNA, 19 nt, Human
acacgggcagccuggcucc

SEQ ID NO: 1908471 - RNA, 16 nt, Human
acacgggcagccuggc

SEQ ID NO: 1908472 - RNA, 20 nt, Human
acacggccacaucaaagagg

SEQ ID NO: 1908473 - RNA, 20 nt, Human
acacguaaugaaacuuggau

SEQ ID NO: 1908474 - RNA, 12 nt, Human
acacggccacau

SEQ ID NO: 1908475 - RNA, 14 nt, Human
acacggccacauca

SEQ ID NO: 1908476 - RNA, 15 nt, Human
acacgaauauugcug

SEQ ID NO: 1908477 - RNA, 21 nt, Human
acacgaauauugcugauggug

SEQ ID NO: 1908478 - RNA, 21 nt, Human
acacagcucuucuccaggcug

SEQ ID NO: 1908479 - RNA, 20 nt, Human
acacagcucuucuccaggcu

SEQ ID NO: 1908480 - RNA, 22 nt, Human
acacagcucuucuccaggcugu

SEQ ID NO: 1908481 - RNA, 14 nt, Human
acacauuuuuuaaa

SEQ ID NO: 1908482 - RNA, 19 nt, Human
acacaaaaguuucucuuuu

SEQ ID NO: 1908483 - RNA, 19 nt, Human
acacagcucuucuccaggc

SEQ ID NO: 1908484 - RNA, 20 nt, Human
acaccacuacauucuguuaa

SEQ ID NO: 1908485 - RNA, 17 nt, Human
acaccacuacauucugu

SEQ ID NO: 1908486 - RNA, 12 nt, Human
acacgaauauug

SEQ ID NO: 1908487 - RNA, 14 nt, Human
acacgaauauugcu

SEQ ID NO: 1908488 - RNA, 15 nt, Human
acaccacuacauucu

SEQ ID NO: 1908489 - RNA, 19 nt, Human
acacauuuuuuaaaugcac

SEQ ID NO: 1908490 - RNA, 18 nt, Human
acacauuuuuuaaaugca

SEQ ID NO: 1908491 - RNA, 16 nt, Human
acacauuuuuuaaaug

SEQ ID NO: 1908492 - RNA, 13 nt, Human
acaauuuauuaug

SEQ ID NO: 1908493 - RNA, 14 nt, Human
acaauuuauuaugg

SEQ ID NO: 1908494 - RNA, 13 nt, Human
acaauuuaaagca

SEQ ID NO: 1908495 - RNA, 20 nt, Human
acaauuuaaagcaaaggagu

SEQ ID NO: 1908496 - RNA, 14 nt, Human
acaauuuaaagcaa

SEQ ID NO: 1908497 - RNA, 16 nt, Human
acaaggauugcuacug

SEQ ID NO: 1908498 - RNA, 20 nt, Human
acaaggaugaucuaggaaga

SEQ ID NO: 1908499 - RNA, 22 nt, Human
acaaggauagaugcuggcccag

SEQ ID NO: 1908500 - RNA, 16 nt, Human
aauuuugugcccccau

SEQ ID NO: 1908501 - RNA, 14 nt, Human
aauuuugauguuuu

SEQ ID NO: 1908502 - RNA, 18 nt, Human
aauuuucaucuaggauuu

SEQ ID NO: 1908503 - RNA, 12 nt, Human
acaaagaaauua

SEQ ID NO: 1908504 - RNA, 13 nt, Human
acaaacuuuuaua

SEQ ID NO: 1908505 - RNA, 14 nt, Human
acaaagaaauuaug

SEQ ID NO: 1908506 - RNA, 16 nt, Human
acaaagaaauuaugug

SEQ ID NO: 1908507 - RNA, 13 nt, Human
acaaaaugaaacg

SEQ ID NO: 1908508 - RNA, 22 nt, Human
acaaaaugaaacgcaaccacca

SEQ ID NO: 1908509 - RNA, 14 nt, Human
acaaaauggaauac

SEQ ID NO: 1908510 - RNA, 13 nt, Human
acaaaauggaaua

SEQ ID NO: 1908511 - RNA, 13 nt, Human
acaaccugaaccu

SEQ ID NO: 1908512 - RNA, 14 nt, Human
acaaccugaaccua

SEQ ID NO: 1908513 - RNA, 18 nt, Human
acaaccugaaccuaggag

SEQ ID NO: 1908514 - RNA, 16 nt, Human
acaagaaaugaaagca

SEQ ID NO: 1908515 - RNA, 15 nt, Human
acaagaaaugaaagc

SEQ ID NO: 1908516 - RNA, 20 nt, Human
aauuuauuuaugggauccug

SEQ ID NO: 1908517 - RNA, 12 nt, Human
aauuuauucaau

SEQ ID NO: 1908518 - RNA, 21 nt, Human
aauuuauucaauuccucuggg

SEQ ID NO: 1908519 - RNA, 15 nt, Human
aauugugaugugucc

SEQ ID NO: 1908520 - RNA, 14 nt, Human
aauugugauguguc

SEQ ID NO: 1908521 - RNA, 11 nt, Human
aauugugaugu

SEQ ID NO: 1908522 - RNA, 17 nt, Human
aauuuauuauggcacau

SEQ ID NO: 1908523 - RNA, 19 nt, Human
aaugucacaggcaggucca

SEQ ID NO: 1908524 - RNA, 16 nt, Human
aaugucacaggcaggu

SEQ ID NO: 1908525 - RNA, 23 nt, Human
aauuggguggggggcuucauaca

SEQ ID NO: 1908526 - RNA, 15 nt, Human
aauugguucuuuauu

SEQ ID NO: 1908527 - RNA, 21 nt, Human
aauugguuggagaauuuaggu

SEQ ID NO: 1908528 - RNA, 22 nt, Human
aauuggguggggggcuucauac

SEQ ID NO: 1908529 - RNA, 21 nt, Human
aauuggguggggggcuucaua

SEQ ID NO: 1908530 - RNA, 16 nt, Human
aauuguaaggaaugau

SEQ ID NO: 1908531 - RNA, 24 nt, Human
aauuguaaauugaaucaguauaaa

SEQ ID NO: 1908532 - RNA, 12 nt, Human
aauuguaaggaa

SEQ ID NO: 1908533 - RNA, 17 nt, Human
aauuguaaauugaauca

SEQ ID NO: 1908534 - RNA, 16 nt, Human
aauuguauuuuaguaa

SEQ ID NO: 1908535 - RNA, 17 nt, Human
aauuuccugggagcuuu

SEQ ID NO: 1908536 - RNA, 21 nt, Human
aauuuccugggagcuuuugua

SEQ ID NO: 1908537 - RNA, 18 nt, Human
aauuuccugggagcuuuu

SEQ ID NO: 1908538 - RNA, 13 nt, Human
aauuucagacucc

SEQ ID NO: 1908539 - RNA, 23 nt, Human
aauuucagacucccauuccugaa

SEQ ID NO: 1908540 - RNA, 21 nt, Human
aauuucagcuucuauauauug

SEQ ID NO: 1908541 - RNA, 16 nt, Human
aauuucaaaaugcuuu

SEQ ID NO: 1908542 - RNA, 23 nt, Human
aauuuauuuuuaccuucacugug

SEQ ID NO: 1908543 - RNA, 12 nt, Human
aauuucaaaaug

SEQ ID NO: 1908544 - RNA, 23 nt, Human
acucuagaaaacgcgaccuuggc

SEQ ID NO: 1908545 - RNA, 19 nt, Human
acucuagaaaacgcgaccu

SEQ ID NO: 1908546 - RNA, 21 nt, Human
acucuagaugaaguuuuacau

SEQ ID NO: 1908547 - RNA, 22 nt, Human
acucuagaugaaguuuuacauu

SEQ ID NO: 1908548 - RNA, 19 nt, Human
acucugucucaaaaaaaca

SEQ ID NO: 1908549 - RNA, 19 nt, Human
acucugugucagguggggc

SEQ ID NO: 1908550 - RNA, 21 nt, Human
acucugugucagguggggcag

SEQ ID NO: 1908551 - RNA, 17 nt, Human
acucugucucaguccau

SEQ ID NO: 1908552 - RNA, 15 nt, Human
acucugucucagucc

SEQ ID NO: 1908553 - RNA, 21 nt, Human
acucugucuaaaaaacaaaac

SEQ ID NO: 1908554 - RNA, 15 nt, Human
acucugugucugagu

SEQ ID NO: 1908555 - RNA, 16 nt, Human
acucugugucugagug

SEQ ID NO: 1908556 - RNA, 22 nt, Human
acucugugucugaguggcuuca

SEQ ID NO: 1908557 - RNA, 11 nt, Human
acuauuuuauu

SEQ ID NO: 1908558 - RNA, 17 nt, Human
acuauuuuauuuucuaa

SEQ ID NO: 1908559 - RNA, 22 nt, Human
acugaugggcaacccccagccu

SEQ ID NO: 1908560 - RNA, 12 nt, Human
acugaugggcaa

SEQ ID NO: 1908561 - RNA, 22 nt, Human
acugauggcuaauguacugcau

SEQ ID NO: 1908562 - RNA, 13 nt, Human
acugaucucucgu

SEQ ID NO: 1908563 - RNA, 11 nt, Human
acugaugcugc

SEQ ID NO: 1908564 - RNA, 12 nt, Human
acugaugcugcc

SEQ ID NO: 1908565 - RNA, 14 nt, Human
acugaugcugcccc

SEQ ID NO: 1908566 - RNA, 15 nt, Human
acugaugcugccccu

SEQ ID NO: 1908567 - RNA, 19 nt, Human
acugaugcugccccucauc

SEQ ID NO: 1908568 - RNA, 20 nt, Human
acugaugcugccccucaucu

SEQ ID NO: 1908569 - RNA, 15 nt, Human
acugaugcuuagaug

SEQ ID NO: 1908570 - RNA, 23 nt, Human
acugacauuguuggccaaagcca

SEQ ID NO: 1908571 - RNA, 22 nt, Human
acugacauuguuggccaaagcc

SEQ ID NO: 1908572 - RNA, 21 nt, Human
acugaccaauauuguacaguu

SEQ ID NO: 1908573 - RNA, 20 nt, Human
acugaccaauauuguacagu

SEQ ID NO: 1908574 - RNA, 22 nt, Human
acugaccaauauuguacaguuu

SEQ ID NO: 1908575 - RNA, 12 nt, Human
acugaccagaac

SEQ ID NO: 1908576 - RNA, 14 nt, Human
acugaccagaacua

SEQ ID NO: 1908577 - RNA, 23 nt, Human
acugauuuuuuuuuccuucagug

SEQ ID NO: 1908578 - RNA, 21 nt, Human
acugauuuuuuuuuccuucag

SEQ ID NO: 1908579 - RNA, 22 nt, Human
acugauuuuuuuuuccuucagu

SEQ ID NO: 1908580 - RNA, 15 nt, Human
acugcuuuuggucug

SEQ ID NO: 1908581 - RNA, 22 nt, Human
acugcccggcaggguccuagaa

SEQ ID NO: 1908582 - RNA, 20 nt, Human
acugcuuuuggucuguguga

SEQ ID NO: 1908583 - RNA, 16 nt, Human
acugcuuuuggucugu

SEQ ID NO: 1908584 - RNA, 20 nt, Human
acuggaagcuaauuugcauu

SEQ ID NO: 1908585 - RNA, 20 nt, Human
acugcccuccagcucuuucc

SEQ ID NO: 1908586 - RNA, 23 nt, Human
acugcccuccagcucuuuccucc

SEQ ID NO: 1908587 - RNA, 15 nt, Human
acugcccggcagggu

SEQ ID NO: 1908588 - RNA, 20 nt, Human
acuugggagaccuguaauca

SEQ ID NO: 1908589 - RNA, 16 nt, Human
acuugggaggcugagg

SEQ ID NO: 1908590 - RNA, 22 nt, Human
acuugggaggcugagaugggag

SEQ ID NO: 1908591 - RNA, 15 nt, Human
acuuuauuuuguguu

SEQ ID NO: 1908592 - RNA, 17 nt, Human
acuuuaugcuaagugaa

SEQ ID NO: 1908593 - RNA, 12 nt, Human
acuuuaugcuaa

SEQ ID NO: 1908594 - RNA, 20 nt, Human
acuuuauuaaauacaaaacu

SEQ ID NO: 1908595 - RNA, 12 nt, Human
acuuuauuaaau

SEQ ID NO: 1908596 - RNA, 15 nt, Human
acuuuauuaaauaca

SEQ ID NO: 1908597 - RNA, 20 nt, Human
acuucugccauauucuguug

SEQ ID NO: 1908598 - RNA, 13 nt, Human
acuucugccucuu

SEQ ID NO: 1908599 - RNA, 12 nt, Human
acuucugccugu

SEQ ID NO: 1908600 - RNA, 17 nt, Human
acuucuuauacauuuga

SEQ ID NO: 1908601 - RNA, 18 nt, Human
acuucuuauacauuugau

SEQ ID NO: 1908602 - RNA, 14 nt, Human
acuuaaaaaugguu

SEQ ID NO: 1908603 - RNA, 13 nt, Human
acuuaaaaauggu

SEQ ID NO: 1908604 - RNA, 21 nt, Human
acuuaaaaaugguuuaaaugg

SEQ ID NO: 1908605 - RNA, 14 nt, Human
acuuaaauaaugug

SEQ ID NO: 1908606 - RNA, 18 nt, Human
accucaguuuuaucauuu

SEQ ID NO: 1908607 - RNA, 17 nt, Human
accucaguuuuaucauu

SEQ ID NO: 1908608 - RNA, 15 nt, Human
accucaggugaucca

SEQ ID NO: 1908609 - RNA, 18 nt, Human
accucaggugagaagcag

SEQ ID NO: 1908610 - RNA, 12 nt, Human
accucagggcac

SEQ ID NO: 1908611 - RNA, 14 nt, Human
accucaggccuggg

SEQ ID NO: 1908612 - RNA, 22 nt, Human
accucaggccugggggcugggc

SEQ ID NO: 1908613 - RNA, 16 nt, Human
accgugaggccagaga

SEQ ID NO: 1908614 - RNA, 17 nt, Human
accgugaggccagagac

SEQ ID NO: 1908615 - RNA, 12 nt, Human
accucaggccug

SEQ ID NO: 1908616 - RNA, 13 nt, Human
accucaggccugg

SEQ ID NO: 1908617 - RNA, 15 nt, Human
accgggcagggccgc

SEQ ID NO: 1908618 - RNA, 19 nt, Human
accgggccacagagaaagu

SEQ ID NO: 1908619 - RNA, 15 nt, Human
accgggccacagaga

SEQ ID NO: 1908620 - RNA, 14 nt, Human
accgugaggccaga

SEQ ID NO: 1908621 - RNA, 14 nt, Human
accgguggggcugg

SEQ ID NO: 1908622 - RNA, 20 nt, Human
accgggcacucagaagacac

SEQ ID NO: 1908623 - RNA, 19 nt, Human
accggcuggccuggccccu

SEQ ID NO: 1908624 - RNA, 17 nt, Human
accggcuggccuggccc

SEQ ID NO: 1908625 - RNA, 18 nt, Human
accggcuggccuggcccc

SEQ ID NO: 1908626 - RNA, 14 nt, Human
accggcuggccugg

SEQ ID NO: 1908627 - RNA, 15 nt, Human
accggcuggccuggc

SEQ ID NO: 1908628 - RNA, 17 nt, Human
acccuguuaccauuuug

SEQ ID NO: 1908629 - RNA, 14 nt, Human
acccaugcugcccu

SEQ ID NO: 1908630 - RNA, 15 nt, Human
acccaugcugcccug

SEQ ID NO: 1908631 - RNA, 22 nt, Human
acccugugauggggcccugccu

SEQ ID NO: 1908632 - RNA, 16 nt, Human
accccacacacgccag

SEQ ID NO: 1908633 - RNA, 14 nt, Human
accccaaucccagc

SEQ ID NO: 1908634 - RNA, 15 nt, Human
accugccagggacag

SEQ ID NO: 1908635 - RNA, 16 nt, Human
accugccagggacaga

SEQ ID NO: 1908636 - RNA, 18 nt, Human
accugccagggacagagg

SEQ ID NO: 1908637 - RNA, 12 nt, Human
accugccaggga

SEQ ID NO: 1908638 - RNA, 13 nt, Human
accugccagggac

SEQ ID NO: 1908639 - RNA, 11 nt, Human
accugccaggg

SEQ ID NO: 1908640 - RNA, 21 nt, Human
accucuugagccuugaacuuu

SEQ ID NO: 1908641 - RNA, 20 nt, Human
accucuugagccuugaacuu

SEQ ID NO: 1908642 - RNA, 19 nt, Human
accucuugagccuugaacu

SEQ ID NO: 1908643 - RNA, 17 nt, Human
accucuugagccuugaa

SEQ ID NO: 1908644 - RNA, 22 nt, Human
acuaaugaccacaccugccucu

SEQ ID NO: 1908645 - RNA, 14 nt, Human
acuaaucuuucugc

SEQ ID NO: 1908646 - RNA, 17 nt, Human
acuauugcuugcacaaa

SEQ ID NO: 1908647 - RNA, 15 nt, Human
acuauugcauuuuac

SEQ ID NO: 1908648 - RNA, 16 nt, Human
acuauuguuagucucu

SEQ ID NO: 1908649 - RNA, 18 nt, Human
acuagguaacuucauauu

SEQ ID NO: 1908650 - RNA, 22 nt, Human
acuaggugcccagaaugaggcu

SEQ ID NO: 1908651 - RNA, 17 nt, Human
acuagggaagauaauau

SEQ ID NO: 1908652 - RNA, 13 nt, Human
acgcagccaggac

SEQ ID NO: 1908653 - RNA, 12 nt, Human
acgcagccagga

SEQ ID NO: 1908654 - RNA, 19 nt, Human
acgcuggagugcagugagc

SEQ ID NO: 1908655 - RNA, 17 nt, Human
acgcaccugccucagga

SEQ ID NO: 1908656 - RNA, 14 nt, Human
acgcagccaggaca

SEQ ID NO: 1908657 - RNA, 18 nt, Human
acgcuggcuccccaaagg

SEQ ID NO: 1908658 - RNA, 11 nt, Human
acgcuggcucc

SEQ ID NO: 1908659 - RNA, 23 nt, Human
acgcugucccuaguaaaaauaca

SEQ ID NO: 1908660 - RNA, 15 nt, Human
acggaagagccuugc

SEQ ID NO: 1908661 - RNA, 16 nt, Human
acggaagagccuugcg

SEQ ID NO: 1908662 - RNA, 15 nt, Human
acggacgcuggcucc

SEQ ID NO: 1908663 - RNA, 19 nt, Human
acggacgaaccuugaaaac

SEQ ID NO: 1908664 - RNA, 15 nt, Human
acggaauaguuggcu

SEQ ID NO: 1908665 - RNA, 23 nt, Human
acgucugacaggcaaugcuggcu

SEQ ID NO: 1908666 - RNA, 15 nt, Human
acgucugacaggcaa

SEQ ID NO: 1908667 - RNA, 14 nt, Human
acguggcucagcca

SEQ ID NO: 1908668 - RNA, 15 nt, Human
acuaauagacaauuu

SEQ ID NO: 1908669 - RNA, 15 nt, Human
acuaacuaugcaugg

SEQ ID NO: 1908670 - RNA, 17 nt, Human
acuaacuaucaaauaga

SEQ ID NO: 1908671 - RNA, 23 nt, Human
acuaacuaugcauggugccccag

SEQ ID NO: 1908672 - RNA, 11 nt, Human
acguggcugcu

SEQ ID NO: 1908673 - RNA, 17 nt, Human
acguggcucagccagca

SEQ ID NO: 1908674 - RNA, 19 nt, Human
acguggcucagccagcacu

SEQ ID NO: 1908675 - RNA, 19 nt, Human
accuguggccaaguucuua

SEQ ID NO: 1908676 - RNA, 18 nt, Human
accuguggccaaguucuu

SEQ ID NO: 1908677 - RNA, 15 nt, Human
accugugagcccagc

SEQ ID NO: 1908678 - RNA, 17 nt, Human
accugugagcccagcug

SEQ ID NO: 1908679 - RNA, 18 nt, Human
accugugagcccagcugg

SEQ ID NO: 1908680 - RNA, 11 nt, Human
accugugucuc

SEQ ID NO: 1908681 - RNA, 18 nt, Human
accuguguauuuuuuaaa

SEQ ID NO: 1908682 - RNA, 21 nt, Human
gccucauuuagagaggaaaag

SEQ ID NO: 1908683 - RNA, 19 nt, Human
gccuccagaacucacuggg

SEQ ID NO: 1908684 - RNA, 14 nt, Human
gccuccagggcugg

SEQ ID NO: 1908685 - RNA, 13 nt, Human
gccuccagggcug

SEQ ID NO: 1908686 - RNA, 12 nt, Human
gccuccagggcu

SEQ ID NO: 1908687 - RNA, 19 nt, Human
gccuccaggaaccacacca

SEQ ID NO: 1908688 - RNA, 19 nt, Human
gccuccuuugugaggaagc

SEQ ID NO: 1908689 - RNA, 20 nt, Human
gccuccuuugugaggaagcc

SEQ ID NO: 1908690 - RNA, 21 nt, Human
gccuccuuugugaggaagccg

SEQ ID NO: 1908691 - RNA, 20 nt, Human
gccuccauccugaggcucca

SEQ ID NO: 1908692 - RNA, 16 nt, Human
gccuccauccugaggc

SEQ ID NO: 1908693 - RNA, 20 nt, Human
gccuccagggcuggacugag

SEQ ID NO: 1908694 - RNA, 19 nt, Human
gccuccagggcuggacuga

SEQ ID NO: 1908695 - RNA, 18 nt, Human
gccuccagggcuggacug

SEQ ID NO: 1908696 - RNA, 17 nt, Human
gccuccagggcuggacu

SEQ ID NO: 1908697 - RNA, 16 nt, Human
gccuccagggcuggac

SEQ ID NO: 1908698 - RNA, 13 nt, Human
gccugcuccagcu

SEQ ID NO: 1908699 - RNA, 17 nt, Human
gccugcuccagaccuga

SEQ ID NO: 1908700 - RNA, 21 nt, Human
gccugcuccagaccugauccu

SEQ ID NO: 1908701 - RNA, 23 nt, Human
gccugcuaauuccccagauugca

SEQ ID NO: 1908702 - RNA, 17 nt, Human
gccugcuaauuccccag

SEQ ID NO: 1908703 - RNA, 12 nt, Human
gccugcuccaga

SEQ ID NO: 1908704 - RNA, 13 nt, Human
gccugcuccagac

SEQ ID NO: 1908705 - RNA, 14 nt, Human
gccugcuccagacc

SEQ ID NO: 1908706 - RNA, 15 nt, Human
gccugcuccagaccu

SEQ ID NO: 1908707 - RNA, 16 nt, Human
gccugcuccagaccug

SEQ ID NO: 1908708 - RNA, 14 nt, Human
gccucgcaggaaga

SEQ ID NO: 1908709 - RNA, 14 nt, Human
gcgauucuucugcu

SEQ ID NO: 1908710 - RNA, 17 nt, Human
gcgauucuucugcuuca

SEQ ID NO: 1908711 - RNA, 13 nt, Human
gcgauucuucugc

SEQ ID NO: 1908712 - RNA, 17 nt, Human
gcgauucuccugccuca

SEQ ID NO: 1908713 - RNA, 17 nt, Human
gcggagcaagaggaggc

SEQ ID NO: 1908714 - RNA, 18 nt, Human
gcggagcaagaggaggcc

SEQ ID NO: 1908715 - RNA, 12 nt, Human
gcggagcuggcc

SEQ ID NO: 1908716 - RNA, 16 nt, Human
gcggaggagagagagg

SEQ ID NO: 1908717 - RNA, 14 nt, Human
gcggagcuggcccc

SEQ ID NO: 1908718 - RNA, 17 nt, Human
gcggagcuggccccgcc

SEQ ID NO: 1908719 - RNA, 21 nt, Human
gcguggcgcaguggcccugag

SEQ ID NO: 1908720 - RNA, 20 nt, Human
gcguggcgcaguggcccuga

SEQ ID NO: 1908721 - RNA, 20 nt, Human
gcgugguggacaugcacagc

SEQ ID NO: 1908722 - RNA, 14 nt, Human
gcgugcacacacca

SEQ ID NO: 1908723 - RNA, 20 nt, Human
gcgugaucaaagccacacuc

SEQ ID NO: 1908724 - RNA, 18 nt, Human
gcgugcacacaccagagc

SEQ ID NO: 1908725 - RNA, 13 nt, Human
gcggccggccagc

SEQ ID NO: 1908726 - RNA, 16 nt, Human
gcuaauuuuucauuuu

SEQ ID NO: 1908727 - RNA, 18 nt, Human
gcuaauuuugaaaaacug

SEQ ID NO: 1908728 - RNA, 12 nt, Human
gcuaauuugcau

SEQ ID NO: 1908729 - RNA, 13 nt, Human
gcuaauuugcauu

SEQ ID NO: 1908730 - RNA, 15 nt, Human
gcuaauuugcauuaa

SEQ ID NO: 1908731 - RNA, 17 nt, Human
gcguuucuaugacacau

SEQ ID NO: 1908732 - RNA, 15 nt, Human
gcuaauuuuuguaau

SEQ ID NO: 1908733 - RNA, 16 nt, Human
gcuaauuuuuguaauu

SEQ ID NO: 1908734 - RNA, 17 nt, Human
gcuaauuuuuguaauuu

SEQ ID NO: 1908735 - RNA, 23 nt, Human
gcuacuggcaaaaggaucuuugu

SEQ ID NO: 1908736 - RNA, 20 nt, Human
gcuacaaauacucuuaggaa

SEQ ID NO: 1908737 - RNA, 20 nt, Human
gcuacuguccuacccacccu

SEQ ID NO: 1908738 - RNA, 19 nt, Human
gcuacuguccuacccaccc

SEQ ID NO: 1908739 - RNA, 15 nt, Human
gcuacugugugugug

SEQ ID NO: 1908740 - RNA, 18 nt, Human
gcuacugugugugugaau

SEQ ID NO: 1908741 - RNA, 19 nt, Human
gcuacugugugugugaaug

SEQ ID NO: 1908742 - RNA, 21 nt, Human
gcuacugugugugugaaugaa

SEQ ID NO: 1908743 - RNA, 18 nt, Human
gcuacuguaaggcaauca

SEQ ID NO: 1908744 - RNA, 19 nt, Human
gcuacuguaaggcaaucau

SEQ ID NO: 1908745 - RNA, 18 nt, Human
gcuacuguaauuuuauau

SEQ ID NO: 1908746 - RNA, 22 nt, Human
gcuacuguaauuuuauaugaag

SEQ ID NO: 1908747 - RNA, 11 nt, Human
gcuagaaauga

SEQ ID NO: 1908748 - RNA, 17 nt, Human
gcuacuugggaggcuga

SEQ ID NO: 1908749 - RNA, 13 nt, Human
gcuacuugggagg

SEQ ID NO: 1908750 - RNA, 18 nt, Human
gcccaggccccugccacc

SEQ ID NO: 1908751 - RNA, 17 nt, Human
gcccaggccccugccac

SEQ ID NO: 1908752 - RNA, 14 nt, Human
gccaugugccaggu

SEQ ID NO: 1908753 - RNA, 19 nt, Human
gccaucaaaaugcuuuuua

SEQ ID NO: 1908754 - RNA, 14 nt, Human
gccaucaaaaugcu

SEQ ID NO: 1908755 - RNA, 15 nt, Human
gccaucaaaaugcuu

SEQ ID NO: 1908756 - RNA, 16 nt, Human
gccaucaaaaugcuuu

SEQ ID NO: 1908757 - RNA, 18 nt, Human
gccaucaaaaugcuuuuu

SEQ ID NO: 1908758 - RNA, 16 nt, Human
gccauguguuccaagg

SEQ ID NO: 1908759 - RNA, 15 nt, Human
gccauguguuccaag

SEQ ID NO: 1908760 - RNA, 13 nt, Human
gcccaggccccug

SEQ ID NO: 1908761 - RNA, 15 nt, Human
gcccaggccccugcc

SEQ ID NO: 1908762 - RNA, 16 nt, Human
gcccaggcaggucuug

SEQ ID NO: 1908763 - RNA, 14 nt, Human
gcccaggcaggucu

SEQ ID NO: 1908764 - RNA, 12 nt, Human
gcccaggcaggu

SEQ ID NO: 1908765 - RNA, 13 nt, Human
gcccaggcagguc

SEQ ID NO: 1908766 - RNA, 15 nt, Human
gccccuggaugcagc

SEQ ID NO: 1908767 - RNA, 11 nt, Human
gcccuaucugu

SEQ ID NO: 1908768 - RNA, 13 nt, Human
gcccauucuacuu

SEQ ID NO: 1908769 - RNA, 14 nt, Human
gcccauucuacuug

SEQ ID NO: 1908770 - RNA, 15 nt, Human
gcccauucuacuugc

SEQ ID NO: 1908771 - RNA, 17 nt, Human
gcccauucuacuugcuc

SEQ ID NO: 1908772 - RNA, 18 nt, Human
gcccauucuacuugcucu

SEQ ID NO: 1908773 - RNA, 19 nt, Human
gcccauucuacuugcucug

SEQ ID NO: 1908774 - RNA, 20 nt, Human
gcccauucuacuugcucugg

SEQ ID NO: 1908775 - RNA, 21 nt, Human
gccccaacucuccccugaccu

SEQ ID NO: 1908776 - RNA, 21 nt, Human
gcccauucuacuugcucugga

SEQ ID NO: 1908777 - RNA, 22 nt, Human
gcccauucuacuugcucuggac

SEQ ID NO: 1908778 - RNA, 22 nt, Human
gccccugcugguucaggguugg

SEQ ID NO: 1908779 - RNA, 17 nt, Human
gccccugccucucugca

SEQ ID NO: 1908780 - RNA, 18 nt, Human
gccccugccucucugcag

SEQ ID NO: 1908781 - RNA, 15 nt, Human
gccccugccucucug

SEQ ID NO: 1908782 - RNA, 16 nt, Human
gccccugccucucugc

SEQ ID NO: 1908783 - RNA, 16 nt, Human
gcccccgcauccccug

SEQ ID NO: 1908784 - RNA, 18 nt, Human
gcccccgcauccccugcc

SEQ ID NO: 1908785 - RNA, 20 nt, Human
gcccccgcauccccugccuc

SEQ ID NO: 1908786 - RNA, 19 nt, Human
gccccaaucccuuuauuac

SEQ ID NO: 1908787 - RNA, 18 nt, Human
gccccaaucccuuuauua

SEQ ID NO: 1908788 - RNA, 13 nt, Human
gccagccaugucu

SEQ ID NO: 1908789 - RNA, 14 nt, Human
gccaggauggaaug

SEQ ID NO: 1908790 - RNA, 22 nt, Human
gccaggccagagggagugacag

SEQ ID NO: 1908791 - RNA, 12 nt, Human
gccaggccagcu

SEQ ID NO: 1908792 - RNA, 15 nt, Human
gccaggccagaggga

SEQ ID NO: 1908793 - RNA, 21 nt, Human
gccaggccacaagacccuugu

SEQ ID NO: 1908794 - RNA, 13 nt, Human
gccaggccacaag

SEQ ID NO: 1908795 - RNA, 18 nt, Human
gccaggccacaagacccu

SEQ ID NO: 1908796 - RNA, 13 nt, Human
gccaggcccucug

SEQ ID NO: 1908797 - RNA, 14 nt, Human
gccaggcccucugc

SEQ ID NO: 1908798 - RNA, 13 nt, Human
gccaggccccagg

SEQ ID NO: 1908799 - RNA, 13 nt, Human
gccaggccagcug

SEQ ID NO: 1908800 - RNA, 14 nt, Human
gccaggccccaggc

SEQ ID NO: 1908801 - RNA, 15 nt, Human
gccagugcuccagcc

SEQ ID NO: 1908802 - RNA, 23 nt, Human
gccaguggcuggaucugugaggg

SEQ ID NO: 1908803 - RNA, 14 nt, Human
gccaguggcuggau

SEQ ID NO: 1908804 - RNA, 13 nt, Human
gccagugugacaa

SEQ ID NO: 1908805 - RNA, 13 nt, Human
gccaguugguccc

SEQ ID NO: 1908806 - RNA, 19 nt, Human
gccauauacucuucaagga

SEQ ID NO: 1908807 - RNA, 16 nt, Human
gccauagucacauggc

SEQ ID NO: 1908808 - RNA, 16 nt, Human
gccauaugaaaaggcu

SEQ ID NO: 1908809 - RNA, 22 nt, Human
gccaguuggucccccuuccaug

SEQ ID NO: 1908810 - RNA, 23 nt, Human
gccaguuggucccccuuccaugg

SEQ ID NO: 1908811 - RNA, 22 nt, Human
gccauaaaacagguaauauaaa

SEQ ID NO: 1908812 - RNA, 16 nt, Human
gccaguuggucccccu

SEQ ID NO: 1908813 - RNA, 18 nt, Human
gccaguuggucccccuuc

SEQ ID NO: 1908814 - RNA, 20 nt, Human
gccaguuggucccccuucca

SEQ ID NO: 1908815 - RNA, 21 nt, Human
gccaguuggucccccuuccau

SEQ ID NO: 1908816 - RNA, 14 nt, Human
gcuuugaucccuuc

SEQ ID NO: 1908817 - RNA, 17 nt, Human
gcuuugaucccuucuua

SEQ ID NO: 1908818 - RNA, 14 nt, Human
gcuuugaucccuga

SEQ ID NO: 1908819 - RNA, 15 nt, Human
gcuuugaucccugac

SEQ ID NO: 1908820 - RNA, 18 nt, Human
gcuuuugucuaugggacu

SEQ ID NO: 1908821 - RNA, 15 nt, Human
gcuuuuggucugugu

SEQ ID NO: 1908822 - RNA, 18 nt, Human
ggaaaauuuuaaaaauac

SEQ ID NO: 1908823 - RNA, 22 nt, Human
gcuuuuuucucugauacagaaa

SEQ ID NO: 1908824 - RNA, 13 nt, Human
ggaaacaacagcu

SEQ ID NO: 1908825 - RNA, 16 nt, Human
ggaaacaacagcuuua

SEQ ID NO: 1908826 - RNA, 16 nt, Human
ggaaacccagcucugg

SEQ ID NO: 1908827 - RNA, 13 nt, Human
ggaaacagacucg

SEQ ID NO: 1908828 - RNA, 22 nt, Human
ggaaacagacucgauucauauu

SEQ ID NO: 1908829 - RNA, 15 nt, Human
gcuuuuuuaucaugu

SEQ ID NO: 1908830 - RNA, 18 nt, Human
gcuuuuuuaucaugugaa

SEQ ID NO: 1908831 - RNA, 20 nt, Human
gcuuuuuuaucaugugaaau

SEQ ID NO: 1908832 - RNA, 12 nt, Human
gcuuuugugcau

SEQ ID NO: 1908833 - RNA, 17 nt, Human
gcuuuuuauuucugcau

SEQ ID NO: 1908834 - RNA, 21 nt, Human
gcuuuuuauuucugcauaugu

SEQ ID NO: 1908835 - RNA, 15 nt, Human
gcuuuuuauuucugc

SEQ ID NO: 1908836 - RNA, 18 nt, Human
ggaagacccaacacaugg

SEQ ID NO: 1908837 - RNA, 20 nt, Human
ggaagacccaacacauggga

SEQ ID NO: 1908838 - RNA, 17 nt, Human
ggaagacuucaucccuc

SEQ ID NO: 1908839 - RNA, 20 nt, Human
ggaagacuucaucccucugg

SEQ ID NO: 1908840 - RNA, 18 nt, Human
ggaaacgaaacccacucu

SEQ ID NO: 1908841 - RNA, 14 nt, Human
ggaaaugggcagag

SEQ ID NO: 1908842 - RNA, 16 nt, Human
ggaaaugggcagagca

SEQ ID NO: 1908843 - RNA, 17 nt, Human
ggaaaugggcagagcag

SEQ ID NO: 1908844 - RNA, 18 nt, Human
ggaaaugggcagagcaga

SEQ ID NO: 1908845 - RNA, 22 nt, Human
ggaaaugggcagagcagagacc

SEQ ID NO: 1908846 - RNA, 15 nt, Human
ggaacaaggcaaggc

SEQ ID NO: 1908847 - RNA, 17 nt, Human
ggaacaaggcaaggcug

SEQ ID NO: 1908848 - RNA, 21 nt, Human
ggaacaaggcaaggcugucaa

SEQ ID NO: 1908849 - RNA, 14 nt, Human
ggaagacaauguga

SEQ ID NO: 1908850 - RNA, 16 nt, Human
ggaagacaaugugaaa

SEQ ID NO: 1908851 - RNA, 21 nt, Human
ggaagaacggggcucuucuca

SEQ ID NO: 1908852 - RNA, 11 nt, Human
ggaagaacacc

SEQ ID NO: 1908853 - RNA, 23 nt, Human
ggaacuuggggaguuaagaccug

SEQ ID NO: 1908854 - RNA, 15 nt, Human
ggaacugcugggcuu

SEQ ID NO: 1908855 - RNA, 14 nt, Human
ggaacugcugggcu

SEQ ID NO: 1908856 - RNA, 14 nt, Human
ggaacacggccaca

SEQ ID NO: 1908857 - RNA, 13 nt, Human
ggaacaccuccuc

SEQ ID NO: 1908858 - RNA, 23 nt, Human
ggaacaaggcaaggcugucaauu

SEQ ID NO: 1908859 - RNA, 15 nt, Human
ggaacacuccuucac

SEQ ID NO: 1908860 - RNA, 17 nt, Human
ggaacugaacauuccag

SEQ ID NO: 1908861 - RNA, 19 nt, Human
ggaacacuccuucacagau

SEQ ID NO: 1908862 - RNA, 16 nt, Human
ggaacugcaugcugcu

SEQ ID NO: 1908863 - RNA, 15 nt, Human
ggaacugcaugcugc

SEQ ID NO: 1908864 - RNA, 23 nt, Human
gcugguucaggguuggccccugc

SEQ ID NO: 1908865 - RNA, 21 nt, Human
gcugguucggauuuggggugg

SEQ ID NO: 1908866 - RNA, 20 nt, Human
gcugguucggauuuggggug

SEQ ID NO: 1908867 - RNA, 12 nt, Human
gcugguucugua

SEQ ID NO: 1908868 - RNA, 21 nt, Human
gcugugcacaaaguggcauaa

SEQ ID NO: 1908869 - RNA, 19 nt, Human
gcugugcacaaaguggcau

SEQ ID NO: 1908870 - RNA, 23 nt, Human
gcuguacaucuauuuuggauugu

SEQ ID NO: 1908871 - RNA, 20 nt, Human
gcuguagacauuugcuauga

SEQ ID NO: 1908872 - RNA, 12 nt, Human
gcuguacaucua

SEQ ID NO: 1908873 - RNA, 16 nt, Human
gcuguacaucuauuuu

SEQ ID NO: 1908874 - RNA, 20 nt, Human
gcuguacaucuauuuuggau

SEQ ID NO: 1908875 - RNA, 22 nt, Human
gcuguacaucuauuuuggauug

SEQ ID NO: 1908876 - RNA, 13 nt, Human
gcuggaucuguga

SEQ ID NO: 1908877 - RNA, 20 nt, Human
gcuggagugcagugguguga

SEQ ID NO: 1908878 - RNA, 16 nt, Human
gcuggaguuucaugua

SEQ ID NO: 1908879 - RNA, 15 nt, Human
gcuucaguggcagcu

SEQ ID NO: 1908880 - RNA, 14 nt, Human
gcuucaguggcagc

SEQ ID NO: 1908881 - RNA, 16 nt, Human
gcuucaaauuguaagc

SEQ ID NO: 1908882 - RNA, 22 nt, Human
gcuucaacauucuuugcaagau

SEQ ID NO: 1908883 - RNA, 14 nt, Human
gcuucaaggauccu

SEQ ID NO: 1908884 - RNA, 14 nt, Human
gcuguuggcugggg

SEQ ID NO: 1908885 - RNA, 13 nt, Human
gcuguuggcuggg

SEQ ID NO: 1908886 - RNA, 22 nt, Human
gcuuacaagccagcuggagaaa

SEQ ID NO: 1908887 - RNA, 19 nt, Human
gcuuacaagccagcuggag

SEQ ID NO: 1908888 - RNA, 13 nt, Human
gcuuacaagccag

SEQ ID NO: 1908889 - RNA, 17 nt, Human
gcuguuuucccugaccu

SEQ ID NO: 1908890 - RNA, 15 nt, Human
gcuguuuuccucccu

SEQ ID NO: 1908891 - RNA, 16 nt, Human
gcuguuuuccucccuu

SEQ ID NO: 1908892 - RNA, 18 nt, Human
gcuguuuuccucccuucu

SEQ ID NO: 1908893 - RNA, 20 nt, Human
gcuguuuuccucccuucugc

SEQ ID NO: 1908894 - RNA, 21 nt, Human
gcuguuuuccucccuucugcu

SEQ ID NO: 1908895 - RNA, 22 nt, Human
gcuguuuuccucccuucugcua

SEQ ID NO: 1908896 - RNA, 22 nt, Human
gcuuccagugaggcucugcccu

SEQ ID NO: 1908897 - RNA, 23 nt, Human
gcuuccagugaggcucugcccuu

SEQ ID NO: 1908898 - RNA, 14 nt, Human
gcuuccaugauucu

SEQ ID NO: 1908899 - RNA, 15 nt, Human
gcuuccaugauucua

SEQ ID NO: 1908900 - RNA, 18 nt, Human
gcuuccaugauucuauuu

SEQ ID NO: 1908901 - RNA, 19 nt, Human
gcuuccaugauucuauuua

SEQ ID NO: 1908902 - RNA, 12 nt, Human
gcuuccauucca

SEQ ID NO: 1908903 - RNA, 16 nt, Human
gcuuccuguccuccca

SEQ ID NO: 1908904 - RNA, 21 nt, Human
gcuuccuguccucccagcucc

SEQ ID NO: 1908905 - RNA, 21 nt, Human
gcuucuuaaucuuuucacaaa

SEQ ID NO: 1908906 - RNA, 19 nt, Human
gcuucuuaaucuuuucaca

SEQ ID NO: 1908907 - RNA, 12 nt, Human
gcuucuucagag

SEQ ID NO: 1908908 - RNA, 23 nt, Human
gcuucuuaaucuuuucacaaaua

SEQ ID NO: 1908909 - RNA, 22 nt, Human
gcuucuuaaucuuuucacaaau

SEQ ID NO: 1908910 - RNA, 15 nt, Human
gcuucuucagagacu

SEQ ID NO: 1908911 - RNA, 20 nt, Human
gcuugaccgugaggccagag

SEQ ID NO: 1908912 - RNA, 15 nt, Human
gcuugacaacaucug

SEQ ID NO: 1908913 - RNA, 13 nt, Human
gcuugaacccagg

SEQ ID NO: 1908914 - RNA, 17 nt, Human
gcuuguaaauagcucag

SEQ ID NO: 1908915 - RNA, 16 nt, Human
gcuugaccgugaggcc

SEQ ID NO: 1908916 - RNA, 22 nt, Human
gcuugaccuuuaagagaaauga

SEQ ID NO: 1908917 - RNA, 23 nt, Human
gcuugaccgugaggccagagaca

SEQ ID NO: 1908918 - RNA, 18 nt, Human
gcuugaccuuuaagagaa

SEQ ID NO: 1908919 - RNA, 19 nt, Human
gcuuguaaauagcucaggu

SEQ ID NO: 1908920 - RNA, 18 nt, Human
gcuuguaaauagcucagg

SEQ ID NO: 1908921 - RNA, 19 nt, Human
gcuuuccucaucaggccau

SEQ ID NO: 1908922 - RNA, 13 nt, Human
gcuuucugcucag

SEQ ID NO: 1908923 - RNA, 19 nt, Human
gcuuucugaagcuuuacca

SEQ ID NO: 1908924 - RNA, 18 nt, Human
gcuuucugcucagcuucu

SEQ ID NO: 1908925 - RNA, 19 nt, Human
gcuuucugcucagcuucuc

SEQ ID NO: 1908926 - RNA, 21 nt, Human
gcuuucugcucagcuucuccu

SEQ ID NO: 1908927 - RNA, 22 nt, Human
gcuuugagguggaagagggcug

SEQ ID NO: 1908928 - RNA, 19 nt, Human
gcuuugagguggaagaggg

SEQ ID NO: 1908929 - RNA, 12 nt, Human
gcugcugacagu

SEQ ID NO: 1908930 - RNA, 18 nt, Human
gcugcuccuagagggagg

SEQ ID NO: 1908931 - RNA, 16 nt, Human
gcugcuccuagaggga

SEQ ID NO: 1908932 - RNA, 17 nt, Human
gcugccauccagguuca

SEQ ID NO: 1908933 - RNA, 13 nt, Human
gcugccccuggca

SEQ ID NO: 1908934 - RNA, 15 nt, Human
gcugccccuggcagc

SEQ ID NO: 1908935 - RNA, 16 nt, Human
gcugccccuggcagcc

SEQ ID NO: 1908936 - RNA, 17 nt, Human
gcugccccuggcagccc

SEQ ID NO: 1908937 - RNA, 15 nt, Human
gcugcuccuagaggg

SEQ ID NO: 1908938 - RNA, 13 nt, Human
gcugcacccucag

SEQ ID NO: 1908939 - RNA, 15 nt, Human
gcugcacccucaggc

SEQ ID NO: 1908940 - RNA, 16 nt, Human
gcugcacccucaggca

SEQ ID NO: 1908941 - RNA, 20 nt, Human
gcugcacugaugcugccccu

SEQ ID NO: 1908942 - RNA, 20 nt, Human
gcugcagagcagugggccug

SEQ ID NO: 1908943 - RNA, 21 nt, Human
gcugcagagcagugggccugg

SEQ ID NO: 1908944 - RNA, 13 nt, Human
gcugccauccagg

SEQ ID NO: 1908945 - RNA, 12 nt, Human
gcugccauccag

SEQ ID NO: 1908946 - RNA, 17 nt, Human
gcugcaggggcauggga

SEQ ID NO: 1908947 - RNA, 21 nt, Human
gcugcagccugcgccaccgcc

SEQ ID NO: 1908948 - RNA, 16 nt, Human
gcugcagccugcgcca

SEQ ID NO: 1908949 - RNA, 17 nt, Human
gcugcaggacuugagaa

SEQ ID NO: 1908950 - RNA, 15 nt, Human
gcugaggugggagga

SEQ ID NO: 1908951 - RNA, 13 nt, Human
gcugaggcuggca

SEQ ID NO: 1908952 - RNA, 17 nt, Human
gcucucaggccagcugc

SEQ ID NO: 1908953 - RNA, 18 nt, Human
gcucucaggccagcugcu

SEQ ID NO: 1908954 - RNA, 19 nt, Human
gcucucaggccagcugcuu

SEQ ID NO: 1908955 - RNA, 20 nt, Human
gcucucaggccagcugcuug

SEQ ID NO: 1908956 - RNA, 19 nt, Human
gcuccucuccccagcaagu

SEQ ID NO: 1908957 - RNA, 16 nt, Human
gcuccucuccccagca

SEQ ID NO: 1908958 - RNA, 16 nt, Human
gcuccucuccccagcc

SEQ ID NO: 1908959 - RNA, 18 nt, Human
gcuccucuccccagccca

SEQ ID NO: 1908960 - RNA, 19 nt, Human
gcuccucuccccagcccag

SEQ ID NO: 1908961 - RNA, 20 nt, Human
gcuccucuccccagcccaga

SEQ ID NO: 1908962 - RNA, 21 nt, Human
gcuccucuccccagcccagag

SEQ ID NO: 1908963 - RNA, 22 nt, Human
gcuccucuccccagcccagaga

SEQ ID NO: 1908964 - RNA, 23 nt, Human
gcuccucuccccagcccagagac

SEQ ID NO: 1908965 - RNA, 19 nt, Human
gcucuacugaggugcuaug

SEQ ID NO: 1908966 - RNA, 17 nt, Human
gcuccucuccagucuga

SEQ ID NO: 1908967 - RNA, 18 nt, Human
gcucucaaguuaucaggg

SEQ ID NO: 1908968 - RNA, 15 nt, Human
gcucuauguuuacaa

SEQ ID NO: 1908969 - RNA, 16 nt, Human
gcucuauguuuacaaa

SEQ ID NO: 1908970 - RNA, 12 nt, Human
gcucuagugccu

SEQ ID NO: 1908971 - RNA, 15 nt, Human
gcucuagugccuucu

SEQ ID NO: 1908972 - RNA, 9 nt, Human
gcuccagac

SEQ ID NO: 1908973 - RNA, 20 nt, Human
gcuccacuuggucugugaga

SEQ ID NO: 1908974 - RNA, 23 nt, Human
gcuccagacacauguccaagaag

SEQ ID NO: 1908975 - RNA, 18 nt, Human
gcuccagacacaugucca

SEQ ID NO: 1908976 - RNA, 21 nt, Human
gcuccagacacauguccaaga

SEQ ID NO: 1908977 - RNA, 17 nt, Human
gcuccagaugcagggca

SEQ ID NO: 1908978 - RNA, 18 nt, Human
gcuccagaugcagggcag

SEQ ID NO: 1908979 - RNA, 19 nt, Human
gcuccagaugcagggcagu

SEQ ID NO: 1908980 - RNA, 21 nt, Human
gcuccagaugcagggcaguca

SEQ ID NO: 1908981 - RNA, 22 nt, Human
gcuccagaugcagggcagucau

SEQ ID NO: 1908982 - RNA, 23 nt, Human
gcuccagaccugauccuggaggc

SEQ ID NO: 1908983 - RNA, 21 nt, Human
gcuccagaccugauccuggag

SEQ ID NO: 1908984 - RNA, 22 nt, Human
gcuccagaccugauccuggagg

SEQ ID NO: 1908985 - RNA, 12 nt, Human
gcuccagaccug

SEQ ID NO: 1908986 - RNA, 13 nt, Human
gcuccagaccuga

SEQ ID NO: 1908987 - RNA, 20 nt, Human
gcuccagaccugauccugga

SEQ ID NO: 1908988 - RNA, 14 nt, Human
gcucccaggugcag

SEQ ID NO: 1908989 - RNA, 19 nt, Human
gcucccaggugcagccaga

SEQ ID NO: 1908990 - RNA, 20 nt, Human
gcucccaggugcagccagag

SEQ ID NO: 1908991 - RNA, 22 nt, Human
gcucccaggugcagccagaggc

SEQ ID NO: 1908992 - RNA, 17 nt, Human
gcuccagcucaccagcc

SEQ ID NO: 1908993 - RNA, 23 nt, Human
gcucccaggcauuccccaggagg

SEQ ID NO: 1908994 - RNA, 14 nt, Human
gcuccagcucacca

SEQ ID NO: 1908995 - RNA, 13 nt, Human
gcuccagcucacc

SEQ ID NO: 1908996 - RNA, 15 nt, Human
gcuccucuccccagc

SEQ ID NO: 1908997 - RNA, 12 nt, Human
gcuccucucagu

SEQ ID NO: 1908998 - RNA, 20 nt, Human
gcuccuccucccugcaucug

SEQ ID NO: 1908999 - RNA, 16 nt, Human
gcuccuccucccugca

SEQ ID NO: 1909000 - RNA, 18 nt, Human
gcuccuccucccugcauc

SEQ ID NO: 1909001 - RNA, 14 nt, Human
gcuccuccucccug

SEQ ID NO: 1909002 - RNA, 15 nt, Human
gcuccuccucccugc

SEQ ID NO: 1909003 - RNA, 22 nt, Human
gcucucuuuuucuccaggguca

SEQ ID NO: 1909004 - RNA, 23 nt, Human
gcucucuuuuucuccagggucag

SEQ ID NO: 1909005 - RNA, 20 nt, Human
gcucugaucauccacugugc

SEQ ID NO: 1909006 - RNA, 22 nt, Human
gcucugaucauccacugugcca

SEQ ID NO: 1909007 - RNA, 21 nt, Human
gcucugaucauccacugugcc

SEQ ID NO: 1909008 - RNA, 15 nt, Human
gcucugcccauccug

SEQ ID NO: 1909009 - RNA, 15 nt, Human
gcucuggagcccacu

SEQ ID NO: 1909010 - RNA, 16 nt, Human
gcucuggagcccacug

SEQ ID NO: 1909011 - RNA, 21 nt, Human
gcucugcccauccugccccug

SEQ ID NO: 1909012 - RNA, 17 nt, Human
gcucugugcccacccuc

SEQ ID NO: 1909013 - RNA, 17 nt, Human
gcucuggagcccacugu

SEQ ID NO: 1909014 - RNA, 14 nt, Human
gcugaaaaaaaauu

SEQ ID NO: 1909015 - RNA, 16 nt, Human
gcugaaacagaauacu

SEQ ID NO: 1909016 - RNA, 13 nt, Human
gcugacagacaca

SEQ ID NO: 1909017 - RNA, 14 nt, Human
gcugaggccucuca

SEQ ID NO: 1909018 - RNA, 13 nt, Human
gcugagccucugc

SEQ ID NO: 1909019 - RNA, 19 nt, Human
gcugagccucugcucccca

SEQ ID NO: 1909020 - RNA, 20 nt, Human
gcugagccucugcuccccag

SEQ ID NO: 1909021 - RNA, 23 nt, Human
gcugaaggcucgagcaugccugg

SEQ ID NO: 1909022 - RNA, 17 nt, Human
gcugaauacagaggcaa

SEQ ID NO: 1909023 - RNA, 12 nt, Human
ggccugagcugg

SEQ ID NO: 1909024 - RNA, 15 nt, Human
ggccugagcugggau

SEQ ID NO: 1909025 - RNA, 13 nt, Human
ggccuccauccug

SEQ ID NO: 1909026 - RNA, 15 nt, Human
ggccuccagaacuca

SEQ ID NO: 1909027 - RNA, 20 nt, Human
ggccuccagaacucacuggg

SEQ ID NO: 1909028 - RNA, 23 nt, Human
ggccuccaaguccacaguggaac

SEQ ID NO: 1909029 - RNA, 22 nt, Human
ggccgcugccacccaccucccu

SEQ ID NO: 1909030 - RNA, 23 nt, Human
ggccgcugccacccaccucccug

SEQ ID NO: 1909031 - RNA, 15 nt, Human
ggccggccagccccu

SEQ ID NO: 1909032 - RNA, 12 nt, Human
ggccuucucuga

SEQ ID NO: 1909033 - RNA, 23 nt, Human
ggccuucggccuccauccugagg

SEQ ID NO: 1909034 - RNA, 20 nt, Human
ggccuguggaucaaauccag

SEQ ID NO: 1909035 - RNA, 21 nt, Human
ggccugugucuaguuguuuga

SEQ ID NO: 1909036 - RNA, 21 nt, Human
ggccuggccagaugcaccagc

SEQ ID NO: 1909037 - RNA, 15 nt, Human
ggccugaucagacca

SEQ ID NO: 1909038 - RNA, 18 nt, Human
ggccugaucagaccacgg

SEQ ID NO: 1909039 - RNA, 20 nt, Human
ggccugaucagaccacggcu

SEQ ID NO: 1909040 - RNA, 14 nt, Human
ggccuuuggcuuca

SEQ ID NO: 1909041 - RNA, 21 nt, Human
ggcggugggcacccacccugg

SEQ ID NO: 1909042 - RNA, 22 nt, Human
ggcggugggcacccacccuggg

SEQ ID NO: 1909043 - RNA, 13 nt, Human
ggccuuuggcuuc

SEQ ID NO: 1909044 - RNA, 19 nt, Human
ggccuugggcccucugguu

SEQ ID NO: 1909045 - RNA, 16 nt, Human
ggccuucucugaagga

SEQ ID NO: 1909046 - RNA, 15 nt, Human
ggccuucucugaagg

SEQ ID NO: 1909047 - RNA, 16 nt, Human
ggccuugaguccccca

SEQ ID NO: 1909048 - RNA, 23 nt, Human
ggcucagcggggacagcuccuuc

SEQ ID NO: 1909049 - RNA, 22 nt, Human
ggcucagcggggacagcuccuu

SEQ ID NO: 1909050 - RNA, 21 nt, Human
ggcucagcggggacagcuccu

SEQ ID NO: 1909051 - RNA, 23 nt, Human
ggcucagcaaaagaugcuucuca

SEQ ID NO: 1909052 - RNA, 19 nt, Human
ggcucagcaaaagaugcuu

SEQ ID NO: 1909053 - RNA, 15 nt, Human
ggcucagccagcacu

SEQ ID NO: 1909054 - RNA, 19 nt, Human
ggcgugcaguggugcgauc

SEQ ID NO: 1909055 - RNA, 16 nt, Human
ggcgucuguucccccu

SEQ ID NO: 1909056 - RNA, 14 nt, Human
ggcgugcaguggug

SEQ ID NO: 1909057 - RNA, 16 nt, Human
ggcucacugcagccuc

SEQ ID NO: 1909058 - RNA, 17 nt, Human
ggcucacugcagccuca

SEQ ID NO: 1909059 - RNA, 17 nt, Human
ggcagugggagcugccu

SEQ ID NO: 1909060 - RNA, 24 nt, Human
ggcacugcuuccagugaggcucug

SEQ ID NO: 1909061 - RNA, 15 nt, Human
ggcaccagcagccug

SEQ ID NO: 1909062 - RNA, 17 nt, Human
ggcaccagacacccagg

SEQ ID NO: 1909063 - RNA, 18 nt, Human
ggcaccagacacccagga

SEQ ID NO: 1909064 - RNA, 19 nt, Human
ggcaccagacacccaggac

SEQ ID NO: 1909065 - RNA, 20 nt, Human
ggcaccagacacccaggacu

SEQ ID NO: 1909066 - RNA, 16 nt, Human
ggcaccagcagccugg

SEQ ID NO: 1909067 - RNA, 21 nt, Human
ggcauagcuccccgcuucugc

SEQ ID NO: 1909068 - RNA, 19 nt, Human
ggcagugggagcugccugu

SEQ ID NO: 1909069 - RNA, 18 nt, Human
ggcagugggagcugccug

SEQ ID NO: 1909070 - RNA, 18 nt, Human
ggcauccaguaucuugaa

SEQ ID NO: 1909071 - RNA, 22 nt, Human
ggcauauauuggguuccauucu

SEQ ID NO: 1909072 - RNA, 18 nt, Human
ggcauuuuacuguacaga

SEQ ID NO: 1909073 - RNA, 20 nt, Human
ggcauccuuccucacaccag

SEQ ID NO: 1909074 - RNA, 15 nt, Human
ggccaugauggcaac

SEQ ID NO: 1909075 - RNA, 18 nt, Human
ggccaugauggcaacaga

SEQ ID NO: 1909076 - RNA, 22 nt, Human
ggccaugauggcaacagaucug

SEQ ID NO: 1909077 - RNA, 14 nt, Human
ggccaugccucagc

SEQ ID NO: 1909078 - RNA, 21 nt, Human
ggccaucugguuaggauggca

SEQ ID NO: 1909079 - RNA, 22 nt, Human
ggccaucugggcuccuccaggg

SEQ ID NO: 1909080 - RNA, 22 nt, Human
ggccaucugguuaggauggcag

SEQ ID NO: 1909081 - RNA, 20 nt, Human
ggccauccuucccugucugc

SEQ ID NO: 1909082 - RNA, 13 nt, Human
ggccagugcucca

SEQ ID NO: 1909083 - RNA, 15 nt, Human
ggccagugcuccagc

SEQ ID NO: 1909084 - RNA, 16 nt, Human
ggccagugugacaagg

SEQ ID NO: 1909085 - RNA, 19 nt, Human
ggccaguggcuggaucugu

SEQ ID NO: 1909086 - RNA, 14 nt, Human
ggccaucccacaag

SEQ ID NO: 1909087 - RNA, 23 nt, Human
ggccagagagccuggugcugcug

SEQ ID NO: 1909088 - RNA, 21 nt, Human
ggccaaacucaccugccccuc

SEQ ID NO: 1909089 - RNA, 11 nt, Human
ggccagagcca

SEQ ID NO: 1909090 - RNA, 12 nt, Human
ggccagagccag

SEQ ID NO: 1909091 - RNA, 13 nt, Human
ggccagagccagg

SEQ ID NO: 1909092 - RNA, 17 nt, Human
ggccaaacucaccugcc

SEQ ID NO: 1909093 - RNA, 14 nt, Human
ggccaaacaagugu

SEQ ID NO: 1909094 - RNA, 22 nt, Human
ggccagagcuacccgcagaguu

SEQ ID NO: 1909095 - RNA, 14 nt, Human
ggccagagccaggg

SEQ ID NO: 1909096 - RNA, 14 nt, Human
ggccaggcuggucu

SEQ ID NO: 1909097 - RNA, 14 nt, Human
ggccagccaugucu

SEQ ID NO: 1909098 - RNA, 15 nt, Human
ggccagccaugucug

SEQ ID NO: 1909099 - RNA, 18 nt, Human
ggccaggcuggucucaaa

SEQ ID NO: 1909100 - RNA, 16 nt, Human
ggccaggcuggucuca

SEQ ID NO: 1909101 - RNA, 15 nt, Human
ggccagggagaagcu

SEQ ID NO: 1909102 - RNA, 16 nt, Human
ggccagggagaagcuc

SEQ ID NO: 1909103 - RNA, 17 nt, Human
ggccagggagaagcucc

SEQ ID NO: 1909104 - RNA, 18 nt, Human
ggccagggagaagcuccu

SEQ ID NO: 1909105 - RNA, 15 nt, Human
ggcccaggugagucc

SEQ ID NO: 1909106 - RNA, 19 nt, Human
ggcccagggcccagagccc

SEQ ID NO: 1909107 - RNA, 21 nt, Human
ggcccagggcccagagcccag

SEQ ID NO: 1909108 - RNA, 22 nt, Human
ggcccagggcccagagcccagc

SEQ ID NO: 1909109 - RNA, 16 nt, Human
ggcccagggcccagag

SEQ ID NO: 1909110 - RNA, 15 nt, Human
ggcccagggcccaga

SEQ ID NO: 1909111 - RNA, 17 nt, Human
ggcccagggcccagagc

SEQ ID NO: 1909112 - RNA, 18 nt, Human
ggcccagggcccagagcc

SEQ ID NO: 1909113 - RNA, 22 nt, Human
ggcccaggaccaucauccuacu

SEQ ID NO: 1909114 - RNA, 22 nt, Human
ggccgcaccuaaagcagccagc

SEQ ID NO: 1909115 - RNA, 21 nt, Human
ggccgcaccuaaagcagccag

SEQ ID NO: 1909116 - RNA, 12 nt, Human
ggccgcugccac

SEQ ID NO: 1909117 - RNA, 13 nt, Human
ggccgcugccacc

SEQ ID NO: 1909118 - RNA, 15 nt, Human
ggccgcugccaccca

SEQ ID NO: 1909119 - RNA, 19 nt, Human
ggccgcugccacccaccuc

SEQ ID NO: 1909120 - RNA, 21 nt, Human
ggccgcugccacccaccuccc

SEQ ID NO: 1909121 - RNA, 18 nt, Human
ggcccuucucuccagccc

SEQ ID NO: 1909122 - RNA, 13 nt, Human
ggccgaguccaag

SEQ ID NO: 1909123 - RNA, 16 nt, Human
ggccgaguccaagcug

SEQ ID NO: 1909124 - RNA, 16 nt, Human
ggcccuucucuccagc

SEQ ID NO: 1909125 - RNA, 17 nt, Human
ggcccuucucuccagcc

SEQ ID NO: 1909126 - RNA, 17 nt, Human
ggcccugugccuuggug

SEQ ID NO: 1909127 - RNA, 15 nt, Human
ggagcauugggaccu

SEQ ID NO: 1909128 - RNA, 20 nt, Human
ggagguggagguugcaguga

SEQ ID NO: 1909129 - RNA, 23 nt, Human
ggaggugaacaagcaaacccaga

SEQ ID NO: 1909130 - RNA, 19 nt, Human
ggagguggagguugcagug

SEQ ID NO: 1909131 - RNA, 14 nt, Human
ggaggugaccccag

SEQ ID NO: 1909132 - RNA, 14 nt, Human
ggaggucgaggcag

SEQ ID NO: 1909133 - RNA, 20 nt, Human
ggaggucaaggcugcaguga

SEQ ID NO: 1909134 - RNA, 16 nt, Human
ggaggggggagguggg

SEQ ID NO: 1909135 - RNA, 17 nt, Human
ggaggccuuccagggac

SEQ ID NO: 1909136 - RNA, 21 nt, Human
ggagguagcuuugagguggaa

SEQ ID NO: 1909137 - RNA, 21 nt, Human
ggagcugccuguucagcucca

SEQ ID NO: 1909138 - RNA, 20 nt, Human
ggagcuggccccgccgccug

SEQ ID NO: 1909139 - RNA, 12 nt, Human
ggagcugccugu

SEQ ID NO: 1909140 - RNA, 14 nt, Human
ggagcugcaggggc

SEQ ID NO: 1909141 - RNA, 20 nt, Human
ggagcugcaggggcauggga

SEQ ID NO: 1909142 - RNA, 12 nt, Human
ggagcugcaggg

SEQ ID NO: 1909143 - RNA, 22 nt, Human
ggagccccgaggccuucucuga

SEQ ID NO: 1909144 - RNA, 16 nt, Human
ggagccccgaggccuu

SEQ ID NO: 1909145 - RNA, 20 nt, Human
ggagccaacagaagcuucca

SEQ ID NO: 1909146 - RNA, 21 nt, Human
ggagccagcucccucuauuua

SEQ ID NO: 1909147 - RNA, 16 nt, Human
ggagcccagcccuccc

SEQ ID NO: 1909148 - RNA, 19 nt, Human
ggagcccagcccuccccau

SEQ ID NO: 1909149 - RNA, 14 nt, Human
ggagcccacugucc

SEQ ID NO: 1909150 - RNA, 17 nt, Human
ggagcccacuguccugg

SEQ ID NO: 1909151 - RNA, 18 nt, Human
ggagcccacuguccuggg

SEQ ID NO: 1909152 - RNA, 20 nt, Human
ggagcccacuguccugggcc

SEQ ID NO: 1909153 - RNA, 22 nt, Human
ggagcccacuguccugggccug

SEQ ID NO: 1909154 - RNA, 23 nt, Human
ggagcccacuguccugggccugc

SEQ ID NO: 1909155 - RNA, 20 nt, Human
ggaggaaggaaacccagcuc

SEQ ID NO: 1909156 - RNA, 23 nt, Human
ggaggaaggaaacccagcucugg

SEQ ID NO: 1909157 - RNA, 21 nt, Human
ggaggaaggcuuacacccaca

SEQ ID NO: 1909158 - RNA, 19 nt, Human
ggaggaaggaaacccagcu

SEQ ID NO: 1909159 - RNA, 17 nt, Human
ggagcuggggaucccuc

SEQ ID NO: 1909160 - RNA, 12 nt, Human
ggaggccagccu

SEQ ID NO: 1909161 - RNA, 11 nt, Human
ggaggccagcc

SEQ ID NO: 1909162 - RNA, 15 nt, Human
ggauguucugggaca

SEQ ID NO: 1909163 - RNA, 13 nt, Human
ggaugucugggcc

SEQ ID NO: 1909164 - RNA, 16 nt, Human
ggauguucugggacac

SEQ ID NO: 1909165 - RNA, 22 nt, Human
ggauguugaaaaaguucugcag

SEQ ID NO: 1909166 - RNA, 13 nt, Human
ggcaccagacacc

SEQ ID NO: 1909167 - RNA, 16 nt, Human
ggcaccagacacccag

SEQ ID NO: 1909168 - RNA, 17 nt, Human
ggcacaggccauggaug

SEQ ID NO: 1909169 - RNA, 23 nt, Human
ggcacaggccauggauggaaaac

SEQ ID NO: 1909170 - RNA, 17 nt, Human
ggcacaaagggcccaga

SEQ ID NO: 1909171 - RNA, 24 nt, Human
ggcacagaaaauggaagacagcuc

SEQ ID NO: 1909172 - RNA, 15 nt, Human
ggagugcagugagcc

SEQ ID NO: 1909173 - RNA, 22 nt, Human
ggagugcuuaucccuucuuuuu

SEQ ID NO: 1909174 - RNA, 14 nt, Human
ggaguggccacaga

SEQ ID NO: 1909175 - RNA, 15 nt, Human
ggaguucugguuccu

SEQ ID NO: 1909176 - RNA, 14 nt, Human
ggaguucugcucau

SEQ ID NO: 1909177 - RNA, 14 nt, Human
ggaguugaucugga

SEQ ID NO: 1909178 - RNA, 17 nt, Human
ggaguugaucuggaacc

SEQ ID NO: 1909179 - RNA, 21 nt, Human
ggaguugaucuggaacccaga

SEQ ID NO: 1909180 - RNA, 22 nt, Human
ggaguugaucuggaacccagac

SEQ ID NO: 1909181 - RNA, 14 nt, Human
ggauaauuagcauc

SEQ ID NO: 1909182 - RNA, 21 nt, Human
ggauggcaggacgugggcugg

SEQ ID NO: 1909183 - RNA, 22 nt, Human
ggauggcaggacgugggcuggg

SEQ ID NO: 1909184 - RNA, 18 nt, Human
ggauggauuuccagccaa

SEQ ID NO: 1909185 - RNA, 16 nt, Human
ggauggggcugcaccg

SEQ ID NO: 1909186 - RNA, 15 nt, Human
ggauccuccaggugc

SEQ ID NO: 1909187 - RNA, 14 nt, Human
ggauccuccaggug

SEQ ID NO: 1909188 - RNA, 13 nt, Human
ggauccugagcca

SEQ ID NO: 1909189 - RNA, 14 nt, Human
ggauccugagccag

SEQ ID NO: 1909190 - RNA, 19 nt, Human
ggauaauuagcaucucagg

SEQ ID NO: 1909191 - RNA, 18 nt, Human
ggaucuggggcucuggga

SEQ ID NO: 1909192 - RNA, 17 nt, Human
ggaucugguccuaccca

SEQ ID NO: 1909193 - RNA, 14 nt, Human
gggaagagggggcg

SEQ ID NO: 1909194 - RNA, 16 nt, Human
gggaaggauacaaaag

SEQ ID NO: 1909195 - RNA, 13 nt, Human
gggaaggauacaa

SEQ ID NO: 1909196 - RNA, 13 nt, Human
gggacagaggggg

SEQ ID NO: 1909197 - RNA, 22 nt, Human
gggacagaggggguggccuccc

SEQ ID NO: 1909198 - RNA, 23 nt, Human
gggacagaggggguggccuccca

SEQ ID NO: 1909199 - RNA, 16 nt, Human
gggacagcuccuucug

SEQ ID NO: 1909200 - RNA, 21 nt, Human
gggacagcuccuucuguccua

SEQ ID NO: 1909201 - RNA, 14 nt, Human
aaaaaucuauauuu

SEQ ID NO: 1909202 - RNA, 14 nt, Human
aaaaaucucaaauu

SEQ ID NO: 1909203 - RNA, 22 nt, Human
aaaacagguagaauuaucuaau

SEQ ID NO: 1909204 - RNA, 21 nt, Human
aaaacaggucuucaucgaauc

SEQ ID NO: 1909205 - RNA, 15 nt, Human
aaaacaugcuacaca

SEQ ID NO: 1909206 - RNA, 20 nt, Human
aaaacaguccuucaaacuuc

SEQ ID NO: 1909207 - RNA, 21 nt, Human
aaaaccaauguucucucuucu

SEQ ID NO: 1909208 - RNA, 15 nt, Human
aaaacccagauaaag

SEQ ID NO: 1909209 - RNA, 21 nt, Human
aaaacccagcaacagaaaaau

SEQ ID NO: 1909210 - RNA, 19 nt, Human
aaaaccaauguuuugcagu

SEQ ID NO: 1909211 - RNA, 22 nt, Human
aaaacugcugacuguuuucucu

SEQ ID NO: 1909212 - RNA, 23 nt, Human
aaaacugcugacuguuuucucuu

SEQ ID NO: 1909213 - RNA, 13 nt, Human
aaaagaugcuucu

SEQ ID NO: 1909214 - RNA, 23 nt, Human
gggcagccuggcucccaggacac

SEQ ID NO: 1909215 - RNA, 22 nt, Human
gggcagccuggcucccaggaca

SEQ ID NO: 1909216 - RNA, 13 nt, Human
gggcagcgccagg

SEQ ID NO: 1909217 - RNA, 15 nt, Human
gggcagcgccaggcu

SEQ ID NO: 1909218 - RNA, 16 nt, Human
gggcagcgccaggcug

SEQ ID NO: 1909219 - RNA, 20 nt, Human
gggcagccuggcucccagga

SEQ ID NO: 1909220 - RNA, 18 nt, Human
gggcagccuggcucccag

SEQ ID NO: 1909221 - RNA, 15 nt, Human
gggcagccuggcucc

SEQ ID NO: 1909222 - RNA, 21 nt, Human
gggcagcgggagccucccugc

SEQ ID NO: 1909223 - RNA, 12 nt, Human
gggcagggcagc

SEQ ID NO: 1909224 - RNA, 19 nt, Human
aaaagggacugagaaauuu

SEQ ID NO: 1909225 - RNA, 12 nt, Human
gggcagggagcg

SEQ ID NO: 1909226 - RNA, 19 nt, Human
aaaagguaugcaaucaaau

SEQ ID NO: 1909227 - RNA, 14 nt, Human
aaaagguaaaacuu

SEQ ID NO: 1909228 - RNA, 23 nt, Human
aaaagguaaaacuuuuuauauuu

SEQ ID NO: 1909229 - RNA, 15 nt, Human
gggcaggccagagcu

SEQ ID NO: 1909230 - RNA, 16 nt, Human
gggcagagcagagacc

SEQ ID NO: 1909231 - RNA, 18 nt, Human
gggcaacccccagccugc

SEQ ID NO: 1909232 - RNA, 16 nt, Human
gggcaacccccagccu

SEQ ID NO: 1909233 - RNA, 17 nt, Human
gggcagagcagagacca

SEQ ID NO: 1909234 - RNA, 22 nt, Human
gggcagagcagagaccaucccu

SEQ ID NO: 1909235 - RNA, 14 nt, Human
gggcagaggaaagc

SEQ ID NO: 1909236 - RNA, 17 nt, Human
gggauuguaaaauggug

SEQ ID NO: 1909237 - RNA, 16 nt, Human
gggauuguaaaauggu

SEQ ID NO: 1909238 - RNA, 15 nt, Human
gggauugggccccug

SEQ ID NO: 1909239 - RNA, 15 nt, Human
gggauuacaggugug

SEQ ID NO: 1909240 - RNA, 17 nt, Human
gggaggccagugagcca

SEQ ID NO: 1909241 - RNA, 21 nt, Human
gggagcaggcggugggcaccc

SEQ ID NO: 1909242 - RNA, 15 nt, Human
gggagcaggcggugg

SEQ ID NO: 1909243 - RNA, 13 nt, Human
gggaggcucaggu

SEQ ID NO: 1909244 - RNA, 19 nt, Human
gggagauggaguucuugug

SEQ ID NO: 1909245 - RNA, 17 nt, Human
gggagauucaagggacc

SEQ ID NO: 1909246 - RNA, 15 nt, Human
aaaagaugcaaugua

SEQ ID NO: 1909247 - RNA, 21 nt, Human
aaaagcacacucauccccuca

SEQ ID NO: 1909248 - RNA, 17 nt, Human
aaaagcagcucuccccu

SEQ ID NO: 1909249 - RNA, 16 nt, Human
aaaagcagcucucccc

SEQ ID NO: 1909250 - RNA, 12 nt, Human
gggagaagcucc

SEQ ID NO: 1909251 - RNA, 22 nt, Human
gggagaaugucaguauguggaa

SEQ ID NO: 1909252 - RNA, 19 nt, Human
gggagaaugucaguaugug

SEQ ID NO: 1909253 - RNA, 22 nt, Human
gggaggcucuggagcccacugu

SEQ ID NO: 1909254 - RNA, 14 nt, Human
gggagggcuccaga

SEQ ID NO: 1909255 - RNA, 15 nt, Human
gggagggcuccagac

SEQ ID NO: 1909256 - RNA, 17 nt, Human
gggagggcuccagacac

SEQ ID NO: 1909257 - RNA, 18 nt, Human
gggagggcuccagacaca

SEQ ID NO: 1909258 - RNA, 17 nt, Human
gggaggucgaggcagga

SEQ ID NO: 1909259 - RNA, 18 nt, Human
gggaggucgaggcaggag

SEQ ID NO: 1909260 - RNA, 19 nt, Human
gggaggucgaggcaggagg

SEQ ID NO: 1909261 - RNA, 16 nt, Human
gggaugguguucaaaa

SEQ ID NO: 1909262 - RNA, 14 nt, Human
gggaugucucucau

SEQ ID NO: 1909263 - RNA, 20 nt, Human
gggauuaauaugaaaacuua

SEQ ID NO: 1909264 - RNA, 15 nt, Human
gggaggcucaggucc

SEQ ID NO: 1909265 - RNA, 16 nt, Human
gggaugcccuggaggu

SEQ ID NO: 1909266 - RNA, 14 nt, Human
gggccgccagggag

SEQ ID NO: 1909267 - RNA, 17 nt, Human
gggccuaggccucagcc

SEQ ID NO: 1909268 - RNA, 18 nt, Human
gggccagugcuccagcca

SEQ ID NO: 1909269 - RNA, 22 nt, Human
gggccaugauggcaacagaucu

SEQ ID NO: 1909270 - RNA, 23 nt, Human
gggccaugauggcaacagaucug

SEQ ID NO: 1909271 - RNA, 14 nt, Human
gggccaguuggucc

SEQ ID NO: 1909272 - RNA, 18 nt, Human
gggccaguuggucccccu

SEQ ID NO: 1909273 - RNA, 22 nt, Human
gggccaguuggucccccuucca

SEQ ID NO: 1909274 - RNA, 23 nt, Human
gggccaguuggucccccuuccau

SEQ ID NO: 1909275 - RNA, 20 nt, Human
gggccucuuaugggcugggu

SEQ ID NO: 1909276 - RNA, 19 nt, Human
gggccucuuaugggcuggg

SEQ ID NO: 1909277 - RNA, 13 nt, Human
gggccuccugugu

SEQ ID NO: 1909278 - RNA, 15 nt, Human
gggccuccugugugu

SEQ ID NO: 1909279 - RNA, 14 nt, Human
gggccuccagaacu

SEQ ID NO: 1909280 - RNA, 15 nt, Human
gggcgggaggauguu

SEQ ID NO: 1909281 - RNA, 14 nt, Human
gggccagugcucca

SEQ ID NO: 1909282 - RNA, 18 nt, Human
gggccagucccugaggca

SEQ ID NO: 1909283 - RNA, 21 nt, Human
gggccagucccugaggcaggu

SEQ ID NO: 1909284 - RNA, 14 nt, Human
gggccaggcugggu

SEQ ID NO: 1909285 - RNA, 15 nt, Human
gggccaggcuggguc

SEQ ID NO: 1909286 - RNA, 21 nt, Human
gggccaggcugggucgcccug

SEQ ID NO: 1909287 - RNA, 13 nt, Human
gggccaggcuggg

SEQ ID NO: 1909288 - RNA, 11 nt, Human
gggccaggagc

SEQ ID NO: 1909289 - RNA, 19 nt, Human
gggccagauccagccuggg

SEQ ID NO: 1909290 - RNA, 14 nt, Human
aaaaugagccuggc

SEQ ID NO: 1909291 - RNA, 21 nt, Human
aaaaugagccuggcaagaaug

SEQ ID NO: 1909292 - RNA, 21 nt, Human
aaaaugaguuaccuacauuuu

SEQ ID NO: 1909293 - RNA, 16 nt, Human
aaaaucuguggugguc

SEQ ID NO: 1909294 - RNA, 20 nt, Human
aaacaagcacuaaacaaaga

SEQ ID NO: 1909295 - RNA, 16 nt, Human
aaacacauuuuucuua

SEQ ID NO: 1909296 - RNA, 20 nt, Human
aaacaagaccacguuucuaa

SEQ ID NO: 1909297 - RNA, 16 nt, Human
aaacaaaacaaaacaa

SEQ ID NO: 1909298 - RNA, 21 nt, Human
aaacaaaaauuagguauuuug

SEQ ID NO: 1909299 - RNA, 17 nt, Human
aaacaccggguuccagc

SEQ ID NO: 1909300 - RNA, 20 nt, Human
ggggacagcuccuucugucc

SEQ ID NO: 1909301 - RNA, 14 nt, Human
ggggacagcuccuu

SEQ ID NO: 1909302 - RNA, 12 nt, Human
ggggacagcucc

SEQ ID NO: 1909303 - RNA, 17 nt, Human
aaacauccaauauuuuc

SEQ ID NO: 1909304 - RNA, 19 nt, Human
aaacauccaauauuuucuu

SEQ ID NO: 1909305 - RNA, 15 nt, Human
aaacaucuauucucu

SEQ ID NO: 1909306 - RNA, 20 nt, Human
aaacaucuauucucuccaaa

SEQ ID NO: 1909307 - RNA, 13 nt, Human
ggggccagaucca

SEQ ID NO: 1909308 - RNA, 14 nt, Human
ggggccagauccag

SEQ ID NO: 1909309 - RNA, 17 nt, Human
ggggccagauccagccu

SEQ ID NO: 1909310 - RNA, 19 nt, Human
ggggccagauccagccugg

SEQ ID NO: 1909311 - RNA, 15 nt, Human
aaaauuucuauuaaa

SEQ ID NO: 1909312 - RNA, 13 nt, Human
aaaaugucuuuau

SEQ ID NO: 1909313 - RNA, 14 nt, Human
gggcugguucugua

SEQ ID NO: 1909314 - RNA, 22 nt, Human
gggcuggguucuacccaggugc

SEQ ID NO: 1909315 - RNA, 15 nt, Human
aaaaugugauaugua

SEQ ID NO: 1909316 - RNA, 18 nt, Human
aaaaugugccauuuugca

SEQ ID NO: 1909317 - RNA, 21 nt, Human
gggcugcaugcgggcuuccuc

SEQ ID NO: 1909318 - RNA, 18 nt, Human
gggcugcaugcgggcuuc

SEQ ID NO: 1909319 - RNA, 18 nt, Human
gggcucagagugggguag

SEQ ID NO: 1909320 - RNA, 10 nt, Human
gggcucagca

SEQ ID NO: 1909321 - RNA, 22 nt, Human
gggcugcaccggcuggccuggc

SEQ ID NO: 1909322 - RNA, 18 nt, Human
gggcucagcaaaagaugc

SEQ ID NO: 1909323 - RNA, 12 nt, Human
gggcugggcaga

SEQ ID NO: 1909324 - RNA, 20 nt, Human
gggcuggguucuacccaggu

SEQ ID NO: 1909325 - RNA, 22 nt, Human
aaaguuuccccaccagugaaug

SEQ ID NO: 1909326 - RNA, 16 nt, Human
aaaguuuguugaaaca

SEQ ID NO: 1909327 - RNA, 16 nt, Human
aaaguuugcuuagaaa

SEQ ID NO: 1909328 - RNA, 15 nt, Human
aaaguuugcuuagaa

SEQ ID NO: 1909329 - RNA, 23 nt, Human
aaaguuucucuuuucaaaacauu

SEQ ID NO: 1909330 - RNA, 21 nt, Human
aaaguuucucuuuucaaaaca

SEQ ID NO: 1909331 - RNA, 16 nt, Human
aaaguugaauuuuaca

SEQ ID NO: 1909332 - RNA, 12 nt, Human
aaaguggugaga

SEQ ID NO: 1909333 - RNA, 14 nt, Human
gguuugggaccccu

SEQ ID NO: 1909334 - RNA, 20 nt, Human
gguuuggacaaaauggaaua

SEQ ID NO: 1909335 - RNA, 14 nt, Human
gguuugcaaggaag

SEQ ID NO: 1909336 - RNA, 17 nt, Human
gguuugccgguggugca

SEQ ID NO: 1909337 - RNA, 21 nt, Human
gguuugccgguggugcaggua

SEQ ID NO: 1909338 - RNA, 18 nt, Human
gguuugaauauaaacacu

SEQ ID NO: 1909339 - RNA, 15 nt, Human
gguuugaauauaaac

SEQ ID NO: 1909340 - RNA, 19 nt, Human
aaaguuauugugauauccu

SEQ ID NO: 1909341 - RNA, 13 nt, Human
aaagugugcuuua

SEQ ID NO: 1909342 - RNA, 14 nt, Human
aaagugugcuuuau

SEQ ID NO: 1909343 - RNA, 19 nt, Human
aaagugugcuuuaugcuga

SEQ ID NO: 1909344 - RNA, 22 nt, Human
aaagugugcuuuaugcugaaac

SEQ ID NO: 1909345 - RNA, 23 nt, Human
aaagugugcuuuaugcugaaaca

SEQ ID NO: 1909346 - RNA, 12 nt, Human
aaauaaugugaa

SEQ ID NO: 1909347 - RNA, 13 nt, Human
aaauaaugucucu

SEQ ID NO: 1909348 - RNA, 12 nt, Human
aaauaaugucuc

SEQ ID NO: 1909349 - RNA, 13 nt, Human
aaauaaugugaaa

SEQ ID NO: 1909350 - RNA, 15 nt, Human
aaaguuuucccuuga

SEQ ID NO: 1909351 - RNA, 19 nt, Human
guaaaauaaauauugucuu

SEQ ID NO: 1909352 - RNA, 20 nt, Human
guaaaauaaauauugucuuu

SEQ ID NO: 1909353 - RNA, 17 nt, Human
guaaauuuaugugaugg

SEQ ID NO: 1909354 - RNA, 16 nt, Human
guaaauuuaugugaug

SEQ ID NO: 1909355 - RNA, 19 nt, Human
guaaauugaaucaguauaa

SEQ ID NO: 1909356 - RNA, 18 nt, Human
gguucucccccuuucucu

SEQ ID NO: 1909357 - RNA, 12 nt, Human
gguucucaucuu

SEQ ID NO: 1909358 - RNA, 19 nt, Human
gguuccucguucucccugg

SEQ ID NO: 1909359 - RNA, 16 nt, Human
gguuuagaaagcuugc

SEQ ID NO: 1909360 - RNA, 17 nt, Human
gguuuaggcugguggcc

SEQ ID NO: 1909361 - RNA, 20 nt, Human
gguuuaggcugguggcccag

SEQ ID NO: 1909362 - RNA, 22 nt, Human
gguuuaggcugguggcccagga

SEQ ID NO: 1909363 - RNA, 19 nt, Human
gguucugccugccagcugc

SEQ ID NO: 1909364 - RNA, 20 nt, Human
gguucugccugccagcugca

SEQ ID NO: 1909365 - RNA, 19 nt, Human
gguuucaccauguuggcca

SEQ ID NO: 1909366 - RNA, 19 nt, Human
gguuucaccauguugccca

SEQ ID NO: 1909367 - RNA, 13 nt, Human
gguuucagaaaug

SEQ ID NO: 1909368 - RNA, 12 nt, Human
gguuucagaaau

SEQ ID NO: 1909369 - RNA, 14 nt, Human
gguuucagaaaugu

SEQ ID NO: 1909370 - RNA, 13 nt, Human
gguuucugaaaau

SEQ ID NO: 1909371 - RNA, 21 nt, Human
gguucccuuugacgccauccc

SEQ ID NO: 1909372 - RNA, 22 nt, Human
gguucccuuugacgccauccca

SEQ ID NO: 1909373 - RNA, 14 nt, Human
gguuccagccugcc

SEQ ID NO: 1909374 - RNA, 21 nt, Human
gguucaggguuggccccugcc

SEQ ID NO: 1909375 - RNA, 18 nt, Human
gguucaggguuggccccu

SEQ ID NO: 1909376 - RNA, 22 nt, Human
gguucaggguuggccccugccc

SEQ ID NO: 1909377 - RNA, 13 nt, Human
ggugugcucugau

SEQ ID NO: 1909378 - RNA, 21 nt, Human
ggugugcggccuuuggcuuca

SEQ ID NO: 1909379 - RNA, 12 nt, Human
gguguggaagag

SEQ ID NO: 1909380 - RNA, 18 nt, Human
ggugugagucaccaagcc

SEQ ID NO: 1909381 - RNA, 20 nt, Human
ggugugcaaugucugaguga

SEQ ID NO: 1909382 - RNA, 15 nt, Human
ggugugcacaucucu

SEQ ID NO: 1909383 - RNA, 16 nt, Human
ggugugcacaucucug

SEQ ID NO: 1909384 - RNA, 18 nt, Human
ggugugcacaucucugcu

SEQ ID NO: 1909385 - RNA, 23 nt, Human
ggugugcacaucucugcuugagu

SEQ ID NO: 1909386 - RNA, 16 nt, Human
ggugugacugaauuuc

SEQ ID NO: 1909387 - RNA, 16 nt, Human
ggugugaccacugcag

SEQ ID NO: 1909388 - RNA, 23 nt, Human
ggugucuccaaccccccagcacu

SEQ ID NO: 1909389 - RNA, 19 nt, Human
ggugucuccaaccccccag

SEQ ID NO: 1909390 - RNA, 13 nt, Human
ggugucgggcaug

SEQ ID NO: 1909391 - RNA, 15 nt, Human
gguggggucaugccc

SEQ ID NO: 1909392 - RNA, 19 nt, Human
gguggggucaugcccuccu

SEQ ID NO: 1909393 - RNA, 16 nt, Human
ggugucgggcaugaca

SEQ ID NO: 1909394 - RNA, 17 nt, Human
gguggggggggugcugg

SEQ ID NO: 1909395 - RNA, 15 nt, Human
gguggggucacucug

SEQ ID NO: 1909396 - RNA, 23 nt, Human
gguggggucacucuggcagcuca

SEQ ID NO: 1909397 - RNA, 17 nt, Human
gguggggcagcuugagg

SEQ ID NO: 1909398 - RNA, 13 nt, Human
gguggggcagcuu

SEQ ID NO: 1909399 - RNA, 19 nt, Human
ggugggauccuccaggugc

SEQ ID NO: 1909400 - RNA, 17 nt, Human
ggugggcacccacccug

SEQ ID NO: 1909401 - RNA, 18 nt, Human
ggugggcacccacccugg

SEQ ID NO: 1909402 - RNA, 14 nt, Human
ggugggcaggaaaa

SEQ ID NO: 1909403 - RNA, 12 nt, Human
ggugggccaggc

SEQ ID NO: 1909404 - RNA, 14 nt, Human
ggugggccaggcug

SEQ ID NO: 1909405 - RNA, 16 nt, Human
aaagccuguuuaagag

SEQ ID NO: 1909406 - RNA, 18 nt, Human
aaagccuguuuaagagac

SEQ ID NO: 1909407 - RNA, 20 nt, Human
ggugggaggauugcuugagc

SEQ ID NO: 1909408 - RNA, 14 nt, Human
aaagcgaauuuuaa

SEQ ID NO: 1909409 - RNA, 14 nt, Human
ggugggauccucca

SEQ ID NO: 1909410 - RNA, 15 nt, Human
ggugggauccuccag

SEQ ID NO: 1909411 - RNA, 14 nt, Human
gguccacagggcac

SEQ ID NO: 1909412 - RNA, 22 nt, Human
gguaugaucacggcucacugca

SEQ ID NO: 1909413 - RNA, 14 nt, Human
gguaugcaaucaaa

SEQ ID NO: 1909414 - RNA, 16 nt, Human
gguaggaacugcuggg

SEQ ID NO: 1909415 - RNA, 21 nt, Human
gguaugaccuucuaggaagcu

SEQ ID NO: 1909416 - RNA, 17 nt, Human
gguagcuuugaggugga

SEQ ID NO: 1909417 - RNA, 15 nt, Human
gguccacagggcacc

SEQ ID NO: 1909418 - RNA, 17 nt, Human
gguccacccaggagccc

SEQ ID NO: 1909419 - RNA, 12 nt, Human
gguccagggagc

SEQ ID NO: 1909420 - RNA, 16 nt, Human
gguccagggagcaggc

SEQ ID NO: 1909421 - RNA, 16 nt, Human
gguccacccaggagcc

SEQ ID NO: 1909422 - RNA, 15 nt, Human
gguccacccaggagc

SEQ ID NO: 1909423 - RNA, 13 nt, Human
gguccacccagga

SEQ ID NO: 1909424 - RNA, 12 nt, Human
gguccacccagg

SEQ ID NO: 1909425 - RNA, 15 nt, Human
gguccauagagagca

SEQ ID NO: 1909426 - RNA, 22 nt, Human
aaacuuuaccuuuuuuauacau

SEQ ID NO: 1909427 - RNA, 17 nt, Human
aaacuuuaccuuuuuua

SEQ ID NO: 1909428 - RNA, 18 nt, Human
aaacuuuacuauggcccu

SEQ ID NO: 1909429 - RNA, 12 nt, Human
aaacuuuacuau

SEQ ID NO: 1909430 - RNA, 17 nt, Human
aaagacuaucuaaaugu

SEQ ID NO: 1909431 - RNA, 20 nt, Human
gguaacaggcagauacagga

SEQ ID NO: 1909432 - RNA, 14 nt, Human
gguaacaggcagau

SEQ ID NO: 1909433 - RNA, 18 nt, Human
gguaacuagggaagauaa

SEQ ID NO: 1909434 - RNA, 17 nt, Human
ggguuucuaaagcugcc

SEQ ID NO: 1909435 - RNA, 20 nt, Human
gguaaucuugcucugcuuga

SEQ ID NO: 1909436 - RNA, 17 nt, Human
ggguggaugccuggugg

SEQ ID NO: 1909437 - RNA, 15 nt, Human
ggguggcaccagcag

SEQ ID NO: 1909438 - RNA, 13 nt, Human
ggguggaugccug

SEQ ID NO: 1909439 - RNA, 19 nt, Human
ggguggcaccagcagccug

SEQ ID NO: 1909440 - RNA, 20 nt, Human
ggguggggaccucaggccug

SEQ ID NO: 1909441 - RNA, 15 nt, Human
gggugggcaggaaaa

SEQ ID NO: 1909442 - RNA, 13 nt, Human
gggugggccaggc

SEQ ID NO: 1909443 - RNA, 19 nt, Human
gggugggccaggcugaugg

SEQ ID NO: 1909444 - RNA, 17 nt, Human
ggguguggcgcagcaua

SEQ ID NO: 1909445 - RNA, 21 nt, Human
gggugugcaaugucugaguga

SEQ ID NO: 1909446 - RNA, 17 nt, Human
gggugugcacaucucug

SEQ ID NO: 1909447 - RNA, 21 nt, Human
ggguggggucaugcccuccuc

SEQ ID NO: 1909448 - RNA, 12 nt, Human
ggguggugaccu

SEQ ID NO: 1909449 - RNA, 17 nt, Human
ggguggggucaugcccu

SEQ ID NO: 1909450 - RNA, 15 nt, Human
ggguggggggggugc

SEQ ID NO: 1909451 - RNA, 14 nt, Human
gggugggccaggcu

SEQ ID NO: 1909452 - RNA, 18 nt, Human
ggguggggggggugcugg

SEQ ID NO: 1909453 - RNA, 21 nt, Human
gguccugcugcaguugccagu

SEQ ID NO: 1909454 - RNA, 23 nt, Human
gguccugcugcaguugccaguca

SEQ ID NO: 1909455 - RNA, 13 nt, Human
gguccucugucag

SEQ ID NO: 1909456 - RNA, 21 nt, Human
gguccucugucagucacagcc

SEQ ID NO: 1909457 - RNA, 23 nt, Human
gguccucugucagucacagccac

SEQ ID NO: 1909458 - RNA, 13 nt, Human
aaagcaaaggaga

SEQ ID NO: 1909459 - RNA, 14 nt, Human
aaagcaaaacaaaa

SEQ ID NO: 1909460 - RNA, 14 nt, Human
aaagauuuuaauca

SEQ ID NO: 1909461 - RNA, 15 nt, Human
aaagauuuuaaucaa

SEQ ID NO: 1909462 - RNA, 18 nt, Human
aaagauuuuaaucaaguu

SEQ ID NO: 1909463 - RNA, 13 nt, Human
ggucggaaaacau

SEQ ID NO: 1909464 - RNA, 21 nt, Human
gguccuggccaucccacaagu

SEQ ID NO: 1909465 - RNA, 12 nt, Human
gguccuggccau

SEQ ID NO: 1909466 - RNA, 13 nt, Human
gguccuggccauc

SEQ ID NO: 1909467 - RNA, 14 nt, Human
gguccuggccaucc

SEQ ID NO: 1909468 - RNA, 16 nt, Human
gguccuggccauccca

SEQ ID NO: 1909469 - RNA, 17 nt, Human
ggucuacacugugcuga

SEQ ID NO: 1909470 - RNA, 17 nt, Human
ggucuguguguguguau

SEQ ID NO: 1909471 - RNA, 11 nt, Human
ggucugugugu

SEQ ID NO: 1909472 - RNA, 14 nt, Human
ggucggaaaacaug

SEQ ID NO: 1909473 - RNA, 15 nt, Human
ggucggaacccaagc

SEQ ID NO: 1909474 - RNA, 21 nt, Human
gguggaugccugguggcagcu

SEQ ID NO: 1909475 - RNA, 14 nt, Human
gguggaugccuggu

SEQ ID NO: 1909476 - RNA, 22 nt, Human
aaagcagcguuucuaugacaca

SEQ ID NO: 1909477 - RNA, 18 nt, Human
aaagcagcguuucuauga

SEQ ID NO: 1909478 - RNA, 16 nt, Human
aaagcagcguuucuau

SEQ ID NO: 1909479 - RNA, 17 nt, Human
aaagcaggcagaacuca

SEQ ID NO: 1909480 - RNA, 15 nt, Human
aaagcagcucucccc

SEQ ID NO: 1909481 - RNA, 19 nt, Human
aaagcaggcagaacucauc

SEQ ID NO: 1909482 - RNA, 17 nt, Human
aaagcagggacuugaac

SEQ ID NO: 1909483 - RNA, 16 nt, Human
aaagcaucacuuggga

SEQ ID NO: 1909484 - RNA, 18 nt, Human
aaagcagcucuccccuca

SEQ ID NO: 1909485 - RNA, 19 nt, Human
ggugcugggccccugccuc

SEQ ID NO: 1909486 - RNA, 15 nt, Human
ggugcuguccucagg

SEQ ID NO: 1909487 - RNA, 19 nt, Human
ggugcuguccucagguggc

SEQ ID NO: 1909488 - RNA, 20 nt, Human
ggugcuguccucagguggcc

SEQ ID NO: 1909489 - RNA, 23 nt, Human
ggugcuguccucagguggccaug

SEQ ID NO: 1909490 - RNA, 20 nt, Human
ggugcugggccccugccucu

SEQ ID NO: 1909491 - RNA, 18 nt, Human
ggugcaaugaccuuucaa

SEQ ID NO: 1909492 - RNA, 19 nt, Human
ggugcaaugaccuuucaau

SEQ ID NO: 1909493 - RNA, 20 nt, Human
ggugcaaugaccuuucaaua

SEQ ID NO: 1909494 - RNA, 21 nt, Human
ggucuguguguguguaugugg

SEQ ID NO: 1909495 - RNA, 20 nt, Human
ggucuguguguguguaugug

SEQ ID NO: 1909496 - RNA, 12 nt, Human
gauucuccuuca

SEQ ID NO: 1909497 - RNA, 17 nt, Human
gauucuccuucagcccu

SEQ ID NO: 1909498 - RNA, 13 nt, Human
gauucuccuucag

SEQ ID NO: 1909499 - RNA, 18 nt, Human
gauucuccuucagcccuc

SEQ ID NO: 1909500 - RNA, 14 nt, Human
gauuaccagggacu

SEQ ID NO: 1909501 - RNA, 18 nt, Human
gauuacugccuauuuuaa

SEQ ID NO: 1909502 - RNA, 20 nt, Human
gauuacaggugugaaccacc

SEQ ID NO: 1909503 - RNA, 12 nt, Human
gaugugaagcca

SEQ ID NO: 1909504 - RNA, 13 nt, Human
gaugugaagccaa

SEQ ID NO: 1909505 - RNA, 14 nt, Human
gaugugaagccaau

SEQ ID NO: 1909506 - RNA, 23 nt, Human
gaugugaagccaauucagacagg

SEQ ID NO: 1909507 - RNA, 16 nt, Human
gaugcuggcccagggc

SEQ ID NO: 1909508 - RNA, 17 nt, Human
gaugcuggcccagggcc

SEQ ID NO: 1909509 - RNA, 19 nt, Human
gaugcuggcccagggccca

SEQ ID NO: 1909510 - RNA, 21 nt, Human
gaugcuggcccagggcccaga

SEQ ID NO: 1909511 - RNA, 22 nt, Human
gaugcuggcccagggcccagag

SEQ ID NO: 1909512 - RNA, 23 nt, Human
gaugcuggcccagggcccagagc

SEQ ID NO: 1909513 - RNA, 21 nt, Human
gauuauuuucuacacauacau

SEQ ID NO: 1909514 - RNA, 12 nt, Human
gaucucuugagc

SEQ ID NO: 1909515 - RNA, 16 nt, Human
gaucucuugagccugg

SEQ ID NO: 1909516 - RNA, 17 nt, Human
gaucucuugagccuggg

SEQ ID NO: 1909517 - RNA, 15 nt, Human
gaucucuaacuucac

SEQ ID NO: 1909518 - RNA, 15 nt, Human
gauauuuuuuucuuu

SEQ ID NO: 1909519 - RNA, 16 nt, Human
gauauuuugcuuugug

SEQ ID NO: 1909520 - RNA, 13 nt, Human
gauccagccuggg

SEQ ID NO: 1909521 - RNA, 21 nt, Human
gauccagccuggggucuggag

SEQ ID NO: 1909522 - RNA, 12 nt, Human
gauccaggacua

SEQ ID NO: 1909523 - RNA, 12 nt, Human
gauccagggaca

SEQ ID NO: 1909524 - RNA, 13 nt, Human
gauccagggacag

SEQ ID NO: 1909525 - RNA, 14 nt, Human
gauccagggacaga

SEQ ID NO: 1909526 - RNA, 15 nt, Human
gauccagggacagag

SEQ ID NO: 1909527 - RNA, 18 nt, Human
gauccagggacagaggcc

SEQ ID NO: 1909528 - RNA, 22 nt, Human
gauccagggacagaggccccag

SEQ ID NO: 1909529 - RNA, 16 nt, Human
gauccagggacugaag

SEQ ID NO: 1909530 - RNA, 14 nt, Human
gaugaucuuugcag

SEQ ID NO: 1909531 - RNA, 21 nt, Human
gaugaucuuugcagacaggca

SEQ ID NO: 1909532 - RNA, 20 nt, Human
gaugaucuuugcagacaggc

SEQ ID NO: 1909533 - RNA, 21 nt, Human
gaugaugaaaugaggucagag

SEQ ID NO: 1909534 - RNA, 12 nt, Human
gaugcuggccca

SEQ ID NO: 1909535 - RNA, 13 nt, Human
gaugcuggcccag

SEQ ID NO: 1909536 - RNA, 14 nt, Human
gaugcuggcccagg

SEQ ID NO: 1909537 - RNA, 15 nt, Human
gaugcuggcccaggg

SEQ ID NO: 1909538 - RNA, 17 nt, Human
gauacgacaacuugcac

SEQ ID NO: 1909539 - RNA, 11 nt, Human
gauacuacagu

SEQ ID NO: 1909540 - RNA, 16 nt, Human
gauacuacaguuuguu

SEQ ID NO: 1909541 - RNA, 13 nt, Human
gauacccauccca

SEQ ID NO: 1909542 - RNA, 14 nt, Human
gauacccaucccau

SEQ ID NO: 1909543 - RNA, 20 nt, Human
gauauguaccuaacgaagua

SEQ ID NO: 1909544 - RNA, 14 nt, Human
gauaugugaacagu

SEQ ID NO: 1909545 - RNA, 13 nt, Human
gauaugugaacag

SEQ ID NO: 1909546 - RNA, 15 nt, Human
gauaugugaaacaau

SEQ ID NO: 1909547 - RNA, 17 nt, Human
gauaugugaaacaaugu

SEQ ID NO: 1909548 - RNA, 16 nt, Human
gauacuugaaaauuaa

SEQ ID NO: 1909549 - RNA, 18 nt, Human
gauaugcaguuuuccuua

SEQ ID NO: 1909550 - RNA, 15 nt, Human
gauaugcaaaagcug

SEQ ID NO: 1909551 - RNA, 17 nt, Human
gauacuugaaaauuaac

SEQ ID NO: 1909552 - RNA, 14 nt, Human
gauaugcaaaagcu

SEQ ID NO: 1909553 - RNA, 20 nt, Human
gaguuugggguaugggagag

SEQ ID NO: 1909554 - RNA, 18 nt, Human
gagugccuuacacaaugg

SEQ ID NO: 1909555 - RNA, 20 nt, Human
gaguuguuacauuuuuaagu

SEQ ID NO: 1909556 - RNA, 16 nt, Human
gaguuguuacauuuuu

SEQ ID NO: 1909557 - RNA, 19 nt, Human
gaguggacuguucccugag

SEQ ID NO: 1909558 - RNA, 15 nt, Human
gaguuucauguacaa

SEQ ID NO: 1909559 - RNA, 18 nt, Human
gaguuucauguacaagau

SEQ ID NO: 1909560 - RNA, 14 nt, Human
gaggucuguucuuu

SEQ ID NO: 1909561 - RNA, 13 nt, Human
gaggucuguucuu

SEQ ID NO: 1909562 - RNA, 12 nt, Human
gaggugggaucc

SEQ ID NO: 1909563 - RNA, 20 nt, Human
gaggugggaggaucuuuuga

SEQ ID NO: 1909564 - RNA, 18 nt, Human
gagucaauuggaaagacu

SEQ ID NO: 1909565 - RNA, 11 nt, Human
gaggugggagg

SEQ ID NO: 1909566 - RNA, 12 nt, Human
gagugagcuggu

SEQ ID NO: 1909567 - RNA, 13 nt, Human
gagucccaccuug

SEQ ID NO: 1909568 - RNA, 21 nt, Human
gagucccaccuuggcugcagg

SEQ ID NO: 1909569 - RNA, 24 nt, Human
gagugagcacuaaggugugcucug

SEQ ID NO: 1909570 - RNA, 12 nt, Human
gagugcagugag

SEQ ID NO: 1909571 - RNA, 11 nt, Human
gagugcaguga

SEQ ID NO: 1909572 - RNA, 18 nt, Human
gagugaggaugucugggc

SEQ ID NO: 1909573 - RNA, 14 nt, Human
gagucaccaagccc

SEQ ID NO: 1909574 - RNA, 13 nt, Human
gagucaccaagcc

SEQ ID NO: 1909575 - RNA, 15 nt, Human
gagucaccaagccca

SEQ ID NO: 1909576 - RNA, 22 nt, Human
gagucacaaagaacauguagaa

SEQ ID NO: 1909577 - RNA, 20 nt, Human
gagucccaccuuggcugcag

SEQ ID NO: 1909578 - RNA, 16 nt, Human
gagucccaccuuggcu

SEQ ID NO: 1909579 - RNA, 14 nt, Human
gcauacguacacau

SEQ ID NO: 1909580 - RNA, 20 nt, Human
gcauaccacuuuuguucuug

SEQ ID NO: 1909581 - RNA, 17 nt, Human
gcauaccacuuuuguuc

SEQ ID NO: 1909582 - RNA, 11 nt, Human
gcauaauaaau

SEQ ID NO: 1909583 - RNA, 14 nt, Human
gcauaauaaaugcu

SEQ ID NO: 1909584 - RNA, 20 nt, Human
gcauaauaaaugcuucagug

SEQ ID NO: 1909585 - RNA, 22 nt, Human
gcauaacguauaaaagccuguu

SEQ ID NO: 1909586 - RNA, 17 nt, Human
gcaguuuucaagucaaa

SEQ ID NO: 1909587 - RNA, 13 nt, Human
gcagggaaacagc

SEQ ID NO: 1909588 - RNA, 19 nt, Human
gcagggacuugaacccaua

SEQ ID NO: 1909589 - RNA, 15 nt, Human
gcaggcuucaaacua

SEQ ID NO: 1909590 - RNA, 19 nt, Human
gcagggagcggccggccag

SEQ ID NO: 1909591 - RNA, 13 nt, Human
gcagucacugaau

SEQ ID NO: 1909592 - RNA, 21 nt, Human
gcaguaucaugcccugugcaa

SEQ ID NO: 1909593 - RNA, 19 nt, Human
gcagcugcgguccacccag

SEQ ID NO: 1909594 - RNA, 17 nt, Human
gcagcugcgguccaccc

SEQ ID NO: 1909595 - RNA, 20 nt, Human
gcaggcucucaggccagcug

SEQ ID NO: 1909596 - RNA, 22 nt, Human
gcaggcucucaggccagcugcu

SEQ ID NO: 1909597 - RNA, 23 nt, Human
gcaggcucucaggccagcugcuu

SEQ ID NO: 1909598 - RNA, 13 nt, Human
gcagccaggacac

SEQ ID NO: 1909599 - RNA, 12 nt, Human
gcagccagaggc

SEQ ID NO: 1909600 - RNA, 14 nt, Human
gcagccagaggcac

SEQ ID NO: 1909601 - RNA, 12 nt, Human
gcagccaggcca

SEQ ID NO: 1909602 - RNA, 14 nt, Human
gcagccacuauugu

SEQ ID NO: 1909603 - RNA, 16 nt, Human
gcagccacauuccuga

SEQ ID NO: 1909604 - RNA, 19 nt, Human
gcagccaggacaccgggca

SEQ ID NO: 1909605 - RNA, 16 nt, Human
gcagccaggccacaag

SEQ ID NO: 1909606 - RNA, 13 nt, Human
gcagccaggccac

SEQ ID NO: 1909607 - RNA, 14 nt, Human
gcagccaggccaca

SEQ ID NO: 1909608 - RNA, 14 nt, Human
gauucugagagcug

SEQ ID NO: 1909609 - RNA, 13 nt, Human
gauucugagagcu

SEQ ID NO: 1909610 - RNA, 19 nt, Human
gcaagucucuuuauauggc

SEQ ID NO: 1909611 - RNA, 13 nt, Human
gcaagugagagcu

SEQ ID NO: 1909612 - RNA, 23 nt, Human
gcaauaaggggagaguaacccug

SEQ ID NO: 1909613 - RNA, 22 nt, Human
gcacaagcuccaagcucccagg

SEQ ID NO: 1909614 - RNA, 23 nt, Human
gcacaagcuccaagcucccaggc

SEQ ID NO: 1909615 - RNA, 14 nt, Human
gcacaagcugcacc

SEQ ID NO: 1909616 - RNA, 16 nt, Human
gcaauaaaucugaccc

SEQ ID NO: 1909617 - RNA, 18 nt, Human
gcaauaaaucugacccag

SEQ ID NO: 1909618 - RNA, 19 nt, Human
gcaauaaaucugacccagu

SEQ ID NO: 1909619 - RNA, 21 nt, Human
gcaauaaaucugacccagugc

SEQ ID NO: 1909620 - RNA, 18 nt, Human
gcacauauggacucugca

SEQ ID NO: 1909621 - RNA, 13 nt, Human
gcacauauggacu

SEQ ID NO: 1909622 - RNA, 13 nt, Human
gcacaugccucuc

SEQ ID NO: 1909623 - RNA, 16 nt, Human
gcacaucucugcuuga

SEQ ID NO: 1909624 - RNA, 21 nt, Human
gcacaucagcacgauuucugu

SEQ ID NO: 1909625 - RNA, 20 nt, Human
gcacaucagcacgauuucug

SEQ ID NO: 1909626 - RNA, 19 nt, Human
gcacaucagcacgauuucu

SEQ ID NO: 1909627 - RNA, 22 nt, Human
gcacaugccucucucaggccaa

SEQ ID NO: 1909628 - RNA, 20 nt, Human
gcacaugccucucucaggcc

SEQ ID NO: 1909629 - RNA, 21 nt, Human
gcacaugccucucucaggcca

SEQ ID NO: 1909630 - RNA, 14 nt, Human
gcacaugccucucu

SEQ ID NO: 1909631 - RNA, 17 nt, Human
gcacaugccucucucag

SEQ ID NO: 1909632 - RNA, 18 nt, Human
gcacaugccucucucagg

SEQ ID NO: 1909633 - RNA, 19 nt, Human
gcacaugccucucucaggc

SEQ ID NO: 1909634 - RNA, 18 nt, Human
gcaccggcuggccuggcc

SEQ ID NO: 1909635 - RNA, 14 nt, Human
gcaccguacugugg

SEQ ID NO: 1909636 - RNA, 21 nt, Human
gcaccggcuggccuggccccu

SEQ ID NO: 1909637 - RNA, 23 nt, Human
gcaccggcuggccuggccccuca

SEQ ID NO: 1909638 - RNA, 19 nt, Human
gcaccggcuggccuggccc

SEQ ID NO: 1909639 - RNA, 15 nt, Human
gcaccuaauccaggc

SEQ ID NO: 1909640 - RNA, 16 nt, Human
gcaccuaauccaggca

SEQ ID NO: 1909641 - RNA, 14 nt, Human
gcaccuaaagcagc

SEQ ID NO: 1909642 - RNA, 18 nt, Human
gcaccuaaagcagccagc

SEQ ID NO: 1909643 - RNA, 17 nt, Human
gcaccuaaagcagccag

SEQ ID NO: 1909644 - RNA, 16 nt, Human
gcaccuaaagcagcca

SEQ ID NO: 1909645 - RNA, 14 nt, Human
gcaccguucugugc

SEQ ID NO: 1909646 - RNA, 15 nt, Human
gcaccguucugugca

SEQ ID NO: 1909647 - RNA, 12 nt, Human
gcacugacauug

SEQ ID NO: 1909648 - RNA, 17 nt, Human
gcacugacugggcauag

SEQ ID NO: 1909649 - RNA, 16 nt, Human
gcacuuguccagcuga

SEQ ID NO: 1909650 - RNA, 17 nt, Human
gcacuugugauuauuua

SEQ ID NO: 1909651 - RNA, 20 nt, Human
gcacuugugauuauuuauua

SEQ ID NO: 1909652 - RNA, 21 nt, Human
gcacuugugauuauuuauuau

SEQ ID NO: 1909653 - RNA, 23 nt, Human
gcacuugugauuauuuauuauuu

SEQ ID NO: 1909654 - RNA, 16 nt, Human
gcacugacugggcaua

SEQ ID NO: 1909655 - RNA, 22 nt, Human
gcacuuucuacaaugugaacuu

SEQ ID NO: 1909656 - RNA, 20 nt, Human
gcacuuuagggcuguaaaau

SEQ ID NO: 1909657 - RNA, 21 nt, Human
gcacuuucuacaaugugaacu

SEQ ID NO: 1909658 - RNA, 19 nt, Human
gcagagcagagaccauccc

SEQ ID NO: 1909659 - RNA, 20 nt, Human
gcagagcagagaccaucccu

SEQ ID NO: 1909660 - RNA, 21 nt, Human
gcagagcagugggccuggcca

SEQ ID NO: 1909661 - RNA, 24 nt, Human
gcagagcaccuuagacagucccug

SEQ ID NO: 1909662 - RNA, 12 nt, Human
gcagagcagaga

SEQ ID NO: 1909663 - RNA, 14 nt, Human
gcagagcagagacc

SEQ ID NO: 1909664 - RNA, 15 nt, Human
gcagagcagagacca

SEQ ID NO: 1909665 - RNA, 19 nt, Human
gcagagcaccuuagacagu

SEQ ID NO: 1909666 - RNA, 22 nt, Human
gcagagcaccuuagacaguccc

SEQ ID NO: 1909667 - RNA, 23 nt, Human
gcagagcaccuuagacagucccu

SEQ ID NO: 1909668 - RNA, 11 nt, Human
gaaugaauguc

SEQ ID NO: 1909669 - RNA, 14 nt, Human
gaaugaaugucagu

SEQ ID NO: 1909670 - RNA, 18 nt, Human
gaaugaaugucaguguga

SEQ ID NO: 1909671 - RNA, 22 nt, Human
gaaugaaugucagugugacuga

SEQ ID NO: 1909672 - RNA, 12 nt, Human
gaaugacuccuu

SEQ ID NO: 1909673 - RNA, 20 nt, Human
gaaugagauuaauuccuuuc

SEQ ID NO: 1909674 - RNA, 19 nt, Human
gaagugugggucugugugu

SEQ ID NO: 1909675 - RNA, 18 nt, Human
gaagugugggucugugug

SEQ ID NO: 1909676 - RNA, 17 nt, Human
gaagugugggucugugu

SEQ ID NO: 1909677 - RNA, 14 nt, Human
gaaauccauucaca

SEQ ID NO: 1909678 - RNA, 14 nt, Human
gaagcuaauuugca

SEQ ID NO: 1909679 - RNA, 15 nt, Human
gaagcuaauuugcau

SEQ ID NO: 1909680 - RNA, 16 nt, Human
gaagcuaauuugcauu

SEQ ID NO: 1909681 - RNA, 17 nt, Human
gaagcuaauuugcauua

SEQ ID NO: 1909682 - RNA, 14 nt, Human
gaagcucagggccu

SEQ ID NO: 1909683 - RNA, 15 nt, Human
gaagcucagggccug

SEQ ID NO: 1909684 - RNA, 15 nt, Human
gaagcuacugugugu

SEQ ID NO: 1909685 - RNA, 20 nt, Human
gaagcuacugugugugugaa

SEQ ID NO: 1909686 - RNA, 22 nt, Human
gaagcuacugugugugugaaug

SEQ ID NO: 1909687 - RNA, 23 nt, Human
gaagcuacugugugugugaauga

SEQ ID NO: 1909688 - RNA, 23 nt, Human
gaagcucagggccuggcucaggu

SEQ ID NO: 1909689 - RNA, 20 nt, Human
gaagcucagggccuggcuca

SEQ ID NO: 1909690 - RNA, 21 nt, Human
gaagcucagggccuggcucag

SEQ ID NO: 1909691 - RNA, 16 nt, Human
gaagcucagggccugg

SEQ ID NO: 1909692 - RNA, 17 nt, Human
gaagcucagggccuggc

SEQ ID NO: 1909693 - RNA, 18 nt, Human
gaagcucagggccuggcu

SEQ ID NO: 1909694 - RNA, 19 nt, Human
gaagcucagggccuggcuc

SEQ ID NO: 1909695 - RNA, 17 nt, Human
gaagggagcuagccaga

SEQ ID NO: 1909696 - RNA, 18 nt, Human
gaagggauaugugaaaca

SEQ ID NO: 1909697 - RNA, 19 nt, Human
gaaggcucgagcaugccug

SEQ ID NO: 1909698 - RNA, 15 nt, Human
gaaggcuauggggau

SEQ ID NO: 1909699 - RNA, 16 nt, Human
gaaggcucgagcaugc

SEQ ID NO: 1909700 - RNA, 17 nt, Human
gaaggcucgagcaugcc

SEQ ID NO: 1909701 - RNA, 17 nt, Human
gaagcugggguucauga

SEQ ID NO: 1909702 - RNA, 21 nt, Human
gaagcugucauaaaaagacaa

SEQ ID NO: 1909703 - RNA, 19 nt, Human
gaagucuuuguacagacaa

SEQ ID NO: 1909704 - RNA, 20 nt, Human
gaagucuuuguacagacaac

SEQ ID NO: 1909705 - RNA, 18 nt, Human
gaagucuuuguacagaca

SEQ ID NO: 1909706 - RNA, 19 nt, Human
gaagggcagggcugaggcc

SEQ ID NO: 1909707 - RNA, 17 nt, Human
gaagugaauaacugcaa

SEQ ID NO: 1909708 - RNA, 14 nt, Human
gaagucuuuuguuc

SEQ ID NO: 1909709 - RNA, 13 nt, Human
gaagggccagagc

SEQ ID NO: 1909710 - RNA, 20 nt, Human
gaagugcuggcaaccacuaa

SEQ ID NO: 1909711 - RNA, 21 nt, Human
gacacacagcucuguccuggg

SEQ ID NO: 1909712 - RNA, 14 nt, Human
gacacacagcucug

SEQ ID NO: 1909713 - RNA, 18 nt, Human
gacaaaaucaucuuugug

SEQ ID NO: 1909714 - RNA, 15 nt, Human
gacaaaauggaauac

SEQ ID NO: 1909715 - RNA, 19 nt, Human
gacacacagcucuguccug

SEQ ID NO: 1909716 - RNA, 18 nt, Human
gacacacagcucuguccu

SEQ ID NO: 1909717 - RNA, 17 nt, Human
gacacacagcucugucc

SEQ ID NO: 1909718 - RNA, 15 nt, Human
gacacacagcucugu

SEQ ID NO: 1909719 - RNA, 23 nt, Human
gaauuuuggcugugucucccuuc

SEQ ID NO: 1909720 - RNA, 20 nt, Human
gaauuuugugcccccaugua

SEQ ID NO: 1909721 - RNA, 21 nt, Human
gaauuuugugcccccauguaa

SEQ ID NO: 1909722 - RNA, 19 nt, Human
gaauuuuguuuucuugauu

SEQ ID NO: 1909723 - RNA, 20 nt, Human
gaauuugugaagguggaaau

SEQ ID NO: 1909724 - RNA, 22 nt, Human
gaauuaucuauacauaucuuua

SEQ ID NO: 1909725 - RNA, 12 nt, Human
gaauuaugaaac

SEQ ID NO: 1909726 - RNA, 14 nt, Human
gaauuaucuaauuu

SEQ ID NO: 1909727 - RNA, 16 nt, Human
gaauuauaaaagccag

SEQ ID NO: 1909728 - RNA, 19 nt, Human
gaauuuuggcugugucucc

SEQ ID NO: 1909729 - RNA, 23 nt, Human
gaauuuuaaaagaugcaauguag

SEQ ID NO: 1909730 - RNA, 21 nt, Human
gaauuuuaaaagaugcaaugu

SEQ ID NO: 1909731 - RNA, 15 nt, Human
gaauuuuaaaagaug

SEQ ID NO: 1909732 - RNA, 12 nt, Human
gaauuuuaaaag

SEQ ID NO: 1909733 - RNA, 15 nt, Human
gacauucaccugccc

SEQ ID NO: 1909734 - RNA, 16 nt, Human
gacauucaccugcccc

SEQ ID NO: 1909735 - RNA, 17 nt, Human
gacauucaccugcccca

SEQ ID NO: 1909736 - RNA, 14 nt, Human
gacauucaccugcc

SEQ ID NO: 1909737 - RNA, 13 nt, Human
gacacuguacaag

SEQ ID NO: 1909738 - RNA, 12 nt, Human
gacacuguacaa

SEQ ID NO: 1909739 - RNA, 15 nt, Human
gacacugaugggcaa

SEQ ID NO: 1909740 - RNA, 16 nt, Human
gacacuuaaaaauggu

SEQ ID NO: 1909741 - RNA, 13 nt, Human
gacacugaugggc

SEQ ID NO: 1909742 - RNA, 23 nt, Human
gacacugaaauauacacacagca

SEQ ID NO: 1909743 - RNA, 12 nt, Human
gacagacacagg

SEQ ID NO: 1909744 - RNA, 21 nt, Human
gacagcccgggcucugccucc

SEQ ID NO: 1909745 - RNA, 22 nt, Human
gacagcccgggcucugccuccc

SEQ ID NO: 1909746 - RNA, 23 nt, Human
gacagcccgggcucugccuccca

SEQ ID NO: 1909747 - RNA, 23 nt, Human
gacagacaacacugggaaacaga

SEQ ID NO: 1909748 - RNA, 20 nt, Human
gacacuuaauacuaccuuga

SEQ ID NO: 1909749 - RNA, 14 nt, Human
gacagugaaagaaa

SEQ ID NO: 1909750 - RNA, 13 nt, Human
gacagucucacuu

SEQ ID NO: 1909751 - RNA, 15 nt, Human
gacaguauuuguggg

SEQ ID NO: 1909752 - RNA, 11 nt, Human
gacagcuccuu

SEQ ID NO: 1909753 - RNA, 12 nt, Human
gacagcuccacc

SEQ ID NO: 1909754 - RNA, 22 nt, Human
gacaggguuuugccauguuggc

SEQ ID NO: 1909755 - RNA, 20 nt, Human
gacaggguuuugccauguug

SEQ ID NO: 1909756 - RNA, 18 nt, Human
gacagcuccacccuggcc

SEQ ID NO: 1909757 - RNA, 21 nt, Human
gagaagcuuuugaauaaaaac

SEQ ID NO: 1909758 - RNA, 22 nt, Human
gagaagcuuuugaauaaaaacu

SEQ ID NO: 1909759 - RNA, 12 nt, Human
gagaaggaagcc

SEQ ID NO: 1909760 - RNA, 16 nt, Human
gagaagcggcuggcag

SEQ ID NO: 1909761 - RNA, 13 nt, Human
gagaagcggcugg

SEQ ID NO: 1909762 - RNA, 15 nt, Human
gagaagcggcuggca

SEQ ID NO: 1909763 - RNA, 15 nt, Human
gagaaucacuugaac

SEQ ID NO: 1909764 - RNA, 14 nt, Human
gagaaucacuugaa

SEQ ID NO: 1909765 - RNA, 19 nt, Human
gagaagugaauaacugcaa

SEQ ID NO: 1909766 - RNA, 21 nt, Human
gagacccugucucaaaaaaag

SEQ ID NO: 1909767 - RNA, 23 nt, Human
gagacuaaccccaccacacccuc

SEQ ID NO: 1909768 - RNA, 21 nt, Human
gacuuuucuuuguggcuuccu

SEQ ID NO: 1909769 - RNA, 23 nt, Human
gacuuuucuuucagccaagaauu

SEQ ID NO: 1909770 - RNA, 18 nt, Human
gacuuuugaaaagaggug

SEQ ID NO: 1909771 - RNA, 22 nt, Human
gacuauauuugggccugcucca

SEQ ID NO: 1909772 - RNA, 22 nt, Human
gacuaucuaaauguugaaagau

SEQ ID NO: 1909773 - RNA, 17 nt, Human
gacucuuuugccauuaa

SEQ ID NO: 1909774 - RNA, 16 nt, Human
gacugaaaaccucucc

SEQ ID NO: 1909775 - RNA, 17 nt, Human
gacugaaaaccucuccu

SEQ ID NO: 1909776 - RNA, 18 nt, Human
gacugaaaaccucuccuc

SEQ ID NO: 1909777 - RNA, 20 nt, Human
gacugaaaaccucuccucau

SEQ ID NO: 1909778 - RNA, 12 nt, Human
gacucugcacau

SEQ ID NO: 1909779 - RNA, 19 nt, Human
gacucugcacaugucuugu

SEQ ID NO: 1909780 - RNA, 15 nt, Human
gacucugcacauguc

SEQ ID NO: 1909781 - RNA, 14 nt, Human
gacucugcacauga

SEQ ID NO: 1909782 - RNA, 16 nt, Human
gacucuggcaaagcuu

SEQ ID NO: 1909783 - RNA, 12 nt, Human
gacucugucuca

SEQ ID NO: 1909784 - RNA, 14 nt, Human
gagcagggcucagc

SEQ ID NO: 1909785 - RNA, 22 nt, Human
gagcauguacugagccuuguaa

SEQ ID NO: 1909786 - RNA, 17 nt, Human
gagcauggguucauccu

SEQ ID NO: 1909787 - RNA, 22 nt, Human
gagcaugccuggauggggcugc

SEQ ID NO: 1909788 - RNA, 21 nt, Human
gagcagggcucagcggggaca

SEQ ID NO: 1909789 - RNA, 12 nt, Human
gagcaucaggcc

SEQ ID NO: 1909790 - RNA, 22 nt, Human
gagcugggagccgggccgcaga

SEQ ID NO: 1909791 - RNA, 16 nt, Human
gagcugggagccgggc

SEQ ID NO: 1909792 - RNA, 14 nt, Human
gagcugggagccgg

SEQ ID NO: 1909793 - RNA, 13 nt, Human
gagcugggagccg

SEQ ID NO: 1909794 - RNA, 18 nt, Human
gagcugggugucaagagg

SEQ ID NO: 1909795 - RNA, 19 nt, Human
gagcuggggaugucucuca

SEQ ID NO: 1909796 - RNA, 22 nt, Human
gagcugccuguucagcuccagc

SEQ ID NO: 1909797 - RNA, 21 nt, Human
gagcugccuguucagcuccag

SEQ ID NO: 1909798 - RNA, 15 nt, Human
gagcugccuuggcuc

SEQ ID NO: 1909799 - RNA, 18 nt, Human
gagcggagaaaggaaggg

SEQ ID NO: 1909800 - RNA, 21 nt, Human
gagcggagaaaggaagggcug

SEQ ID NO: 1909801 - RNA, 19 nt, Human
gagccuugaacuuugaccu

SEQ ID NO: 1909802 - RNA, 22 nt, Human
gagccuugaacuuugaccucug

SEQ ID NO: 1909803 - RNA, 18 nt, Human
gagccuuugguucuggcc

SEQ ID NO: 1909804 - RNA, 23 nt, Human
gagccuuugguucuggccagaau

SEQ ID NO: 1909805 - RNA, 14 nt, Human
gagccuuccagggg

SEQ ID NO: 1909806 - RNA, 15 nt, Human
gagccuuccaggggu

SEQ ID NO: 1909807 - RNA, 16 nt, Human
gagccuuccaggggug

SEQ ID NO: 1909808 - RNA, 17 nt, Human
gagccuuccaggggugg

SEQ ID NO: 1909809 - RNA, 23 nt, Human
gagauuucaucugcucuccuucc

SEQ ID NO: 1909810 - RNA, 13 nt, Human
gagauuuacaacu

SEQ ID NO: 1909811 - RNA, 22 nt, Human
gagauuucaucugcucuccuuc

SEQ ID NO: 1909812 - RNA, 21 nt, Human
gagauuucaucugcucuccuu

SEQ ID NO: 1909813 - RNA, 20 nt, Human
gagauuucaucugcucuccu

SEQ ID NO: 1909814 - RNA, 19 nt, Human
gagauuucaucugcucucc

SEQ ID NO: 1909815 - RNA, 17 nt, Human
gagauuucaucugcucu

SEQ ID NO: 1909816 - RNA, 13 nt, Human
gagauuucaucug

SEQ ID NO: 1909817 - RNA, 21 nt, Human
gagauugcaccacugcacucc

SEQ ID NO: 1909818 - RNA, 18 nt, Human
gagauugcaccacugcac

SEQ ID NO: 1909819 - RNA, 14 nt, Human
gagauguagccccu

SEQ ID NO: 1909820 - RNA, 18 nt, Human
gagauggaguucuugugc

SEQ ID NO: 1909821 - RNA, 20 nt, Human
gagauggaaguugcagugag

SEQ ID NO: 1909822 - RNA, 21 nt, Human
gagaugaugccaugggcccuc

SEQ ID NO: 1909823 - RNA, 22 nt, Human
gagaggcauccaguaucuugaa

SEQ ID NO: 1909824 - RNA, 20 nt, Human
gagaugaugaaaauauuuaa

SEQ ID NO: 1909825 - RNA, 14 nt, Human
gagaggcauccagu

SEQ ID NO: 1909826 - RNA, 17 nt, Human
gagacuccugcaggcag

SEQ ID NO: 1909827 - RNA, 18 nt, Human
gagacuccugcaggcagc

SEQ ID NO: 1909828 - RNA, 20 nt, Human
gagaggcagaagaacccugg

SEQ ID NO: 1909829 - RNA, 15 nt, Human
gagacuccugcaggc

SEQ ID NO: 1909830 - RNA, 16 nt, Human
gagacuccugcaggca

SEQ ID NO: 1909831 - RNA, 22 nt, Human
cuuuccugaggcugggcucccu

SEQ ID NO: 1909832 - RNA, 23 nt, Human
cuuucagccaagaauucuuaaau

SEQ ID NO: 1909833 - RNA, 20 nt, Human
cuuucagccaagaauucuua

SEQ ID NO: 1909834 - RNA, 15 nt, Human
cuuucacaaaaaaga

SEQ ID NO: 1909835 - RNA, 16 nt, Human
cuuucacaaaaaagaa

SEQ ID NO: 1909836 - RNA, 14 nt, Human
cuuucacaaaaaag

SEQ ID NO: 1909837 - RNA, 22 nt, Human
cuuucaaugguuugcaaggaag

SEQ ID NO: 1909838 - RNA, 21 nt, Human
cuuucaaugguuugcaaggaa

SEQ ID NO: 1909839 - RNA, 23 nt, Human
cuuucaauaggaaaaacugauuu

SEQ ID NO: 1909840 - RNA, 20 nt, Human
cuuucaaugguuugcaagga

SEQ ID NO: 1909841 - RNA, 15 nt, Human
cuuugaucccuucug

SEQ ID NO: 1909842 - RNA, 21 nt, Human
cuuugaugauuaauucaccuu

SEQ ID NO: 1909843 - RNA, 14 nt, Human
cuuugauguauuuu

SEQ ID NO: 1909844 - RNA, 17 nt, Human
cuuugauguauuuuccc

SEQ ID NO: 1909845 - RNA, 16 nt, Human
cuuucuagccagagga

SEQ ID NO: 1909846 - RNA, 14 nt, Human
cuuucuagcuguug

SEQ ID NO: 1909847 - RNA, 17 nt, Human
cuuucuacccagcgagc

SEQ ID NO: 1909848 - RNA, 15 nt, Human
cuuucuagccagagg

SEQ ID NO: 1909849 - RNA, 13 nt, Human
cuuuguaaugaaa

SEQ ID NO: 1909850 - RNA, 18 nt, Human
cuuuuaugugaaacaugu

SEQ ID NO: 1909851 - RNA, 14 nt, Human
cuuuuaugugaaac

SEQ ID NO: 1909852 - RNA, 15 nt, Human
cuuuuauguaguaau

SEQ ID NO: 1909853 - RNA, 18 nt, Human
cuuuuauguaguaauuga

SEQ ID NO: 1909854 - RNA, 22 nt, Human
cuuuuauguaguaauugacaug

SEQ ID NO: 1909855 - RNA, 23 nt, Human
cuuuuauguaguaauugacaugu

SEQ ID NO: 1909856 - RNA, 12 nt, Human
cuuuuauacucu

SEQ ID NO: 1909857 - RNA, 17 nt, Human
cuuuuauacucuuucug

SEQ ID NO: 1909858 - RNA, 19 nt, Human
cuuuuauacucuuucugua

SEQ ID NO: 1909859 - RNA, 20 nt, Human
cuuuuauacucuuucuguau

SEQ ID NO: 1909860 - RNA, 14 nt, Human
cuuuuauaaacuuu

SEQ ID NO: 1909861 - RNA, 13 nt, Human
cuuuuauaaacuu

SEQ ID NO: 1909862 - RNA, 14 nt, Human
cuuuguacuuugug

SEQ ID NO: 1909863 - RNA, 15 nt, Human
gaaacuuuuggaagg

SEQ ID NO: 1909864 - RNA, 13 nt, Human
gaaacuuuuggaa

SEQ ID NO: 1909865 - RNA, 21 nt, Human
gaaagaaaauaccaaggaaca

SEQ ID NO: 1909866 - RNA, 20 nt, Human
gaaagacuaucuaaauguug

SEQ ID NO: 1909867 - RNA, 21 nt, Human
gaaaggcuccaggagcagcca

SEQ ID NO: 1909868 - RNA, 20 nt, Human
gaaaggcuccaggagcagcc

SEQ ID NO: 1909869 - RNA, 22 nt, Human
gaaaggcuccaggagcagccac

SEQ ID NO: 1909870 - RNA, 22 nt, Human
gaaagggacuuggaagcuccgc

SEQ ID NO: 1909871 - RNA, 19 nt, Human
gaaagggacuuggaagcuc

SEQ ID NO: 1909872 - RNA, 20 nt, Human
gaaagggacgcuacccggga

SEQ ID NO: 1909873 - RNA, 19 nt, Human
gaaaucaccgaaaacgugg

SEQ ID NO: 1909874 - RNA, 18 nt, Human
gaaaauggaaccaggcuu

SEQ ID NO: 1909875 - RNA, 19 nt, Human
gaaaauggacguguuauga

SEQ ID NO: 1909876 - RNA, 23 nt, Human
gaaaauggacguguuaugacucc

SEQ ID NO: 1909877 - RNA, 15 nt, Human
gaaaauguaugugua

SEQ ID NO: 1909878 - RNA, 15 nt, Human
gaaaauggaaccagg

SEQ ID NO: 1909879 - RNA, 21 nt, Human
gaaaauggaagacagcucuua

SEQ ID NO: 1909880 - RNA, 18 nt, Human
gaaaagaaaaaugagccu

SEQ ID NO: 1909881 - RNA, 23 nt, Human
gaaaaugcagcagggaugcccug

SEQ ID NO: 1909882 - RNA, 14 nt, Human
gaaaaacugauuuu

SEQ ID NO: 1909883 - RNA, 17 nt, Human
cuuuugccauuaaacuu

SEQ ID NO: 1909884 - RNA, 23 nt, Human
cuuuugcccacacuugggagcaa

SEQ ID NO: 1909885 - RNA, 16 nt, Human
cuuuugccguuauuaa

SEQ ID NO: 1909886 - RNA, 18 nt, Human
cuuuuggaagguauuuaa

SEQ ID NO: 1909887 - RNA, 13 nt, Human
cuuuugcauucuc

SEQ ID NO: 1909888 - RNA, 14 nt, Human
cuuuugcauucucc

SEQ ID NO: 1909889 - RNA, 15 nt, Human
cuuuugcauucuccc

SEQ ID NO: 1909890 - RNA, 18 nt, Human
cuuuugucuaugggacuc

SEQ ID NO: 1909891 - RNA, 19 nt, Human
cuuuuguagaagucacauu

SEQ ID NO: 1909892 - RNA, 12 nt, Human
cuuuuguaauuu

SEQ ID NO: 1909893 - RNA, 15 nt, Human
cuuuuggcauuuuac

SEQ ID NO: 1909894 - RNA, 15 nt, Human
cuuuuuuucuacugu

SEQ ID NO: 1909895 - RNA, 19 nt, Human
cuuuuuuuccaucuuuaca

SEQ ID NO: 1909896 - RNA, 13 nt, Human
cuuuugugcauua

SEQ ID NO: 1909897 - RNA, 12 nt, Human
cuuuugugcauu

SEQ ID NO: 1909898 - RNA, 23 nt, Human
cuuuuuuggcugcugaaggcucg

SEQ ID NO: 1909899 - RNA, 20 nt, Human
cuuuuuuguguuuuuaaaag

SEQ ID NO: 1909900 - RNA, 23 nt, Human
cuuuuuuuuuuuuuaaagacaga

SEQ ID NO: 1909901 - RNA, 22 nt, Human
cuuuuuuuuuuuuuaaagacag

SEQ ID NO: 1909902 - RNA, 11 nt, Human
gaaaaacaggu

SEQ ID NO: 1909903 - RNA, 18 nt, Human
gaaaaaccagaggcagcu

SEQ ID NO: 1909904 - RNA, 19 nt, Human
gaaaaaaaucguccaggga

SEQ ID NO: 1909905 - RNA, 20 nt, Human
gaaaaaaaauguucuuuggg

SEQ ID NO: 1909906 - RNA, 23 nt, Human
cuucuucagagacuccugcaggc

SEQ ID NO: 1909907 - RNA, 15 nt, Human
cuucuguugucaccu

SEQ ID NO: 1909908 - RNA, 19 nt, Human
cuucuguugucaccuucac

SEQ ID NO: 1909909 - RNA, 20 nt, Human
cuucuguugucaccuucacc

SEQ ID NO: 1909910 - RNA, 21 nt, Human
cuucuguugucaccuucaccu

SEQ ID NO: 1909911 - RNA, 20 nt, Human
cuucugacccaugcugcccu

SEQ ID NO: 1909912 - RNA, 21 nt, Human
cuucugacccaugcugcccug

SEQ ID NO: 1909913 - RNA, 22 nt, Human
cuucugacccaugcugcccugu

SEQ ID NO: 1909914 - RNA, 23 nt, Human
cuucugacccaugcugcccugug

SEQ ID NO: 1909915 - RNA, 21 nt, Human
cuucuacuuuuaaguugcuga

SEQ ID NO: 1909916 - RNA, 13 nt, Human
cuucuacuuuuaa

SEQ ID NO: 1909917 - RNA, 13 nt, Human
cuucuaggaagcu

SEQ ID NO: 1909918 - RNA, 19 nt, Human
cuucuaggguuauugcauu

SEQ ID NO: 1909919 - RNA, 15 nt, Human
cuucucaagauacug

SEQ ID NO: 1909920 - RNA, 17 nt, Human
cuuccugcaacaccuug

SEQ ID NO: 1909921 - RNA, 20 nt, Human
cuugacagggcacaccgggc

SEQ ID NO: 1909922 - RNA, 22 nt, Human
cuugacaaagucaagccacaug

SEQ ID NO: 1909923 - RNA, 13 nt, Human
cuugacagggcac

SEQ ID NO: 1909924 - RNA, 19 nt, Human
cuugacaaagucaagccac

SEQ ID NO: 1909925 - RNA, 16 nt, Human
cuugacaaagucaagc

SEQ ID NO: 1909926 - RNA, 15 nt, Human
cuugacagggcacac

SEQ ID NO: 1909927 - RNA, 14 nt, Human
cuugacagggcaca

SEQ ID NO: 1909928 - RNA, 18 nt, Human
cuugaauuguaaggaaug

SEQ ID NO: 1909929 - RNA, 19 nt, Human
cuugaauuguaaggaauga

SEQ ID NO: 1909930 - RNA, 20 nt, Human
cuuggcgcugccccuggcag

SEQ ID NO: 1909931 - RNA, 12 nt, Human
cuuggcgcugcc

SEQ ID NO: 1909932 - RNA, 14 nt, Human
cuuggcgcugcccc

SEQ ID NO: 1909933 - RNA, 17 nt, Human
cuuggcgcugccccugg

SEQ ID NO: 1909934 - RNA, 21 nt, Human
cuuggcacccaagaccucagg

SEQ ID NO: 1909935 - RNA, 20 nt, Human
cuuggcaccagacacccagg

SEQ ID NO: 1909936 - RNA, 21 nt, Human
cuuggcaccagacacccagga

SEQ ID NO: 1909937 - RNA, 16 nt, Human
cuuggcaccagacacc

SEQ ID NO: 1909938 - RNA, 19 nt, Human
cuuggcaccagacacccag

SEQ ID NO: 1909939 - RNA, 12 nt, Human
cuugaugccugg

SEQ ID NO: 1909940 - RNA, 21 nt, Human
cuugaugagcugugcacaaag

SEQ ID NO: 1909941 - RNA, 18 nt, Human
cuugaugaccaaaguccu

SEQ ID NO: 1909942 - RNA, 21 nt, Human
cuugaugaccaaaguccuuuu

SEQ ID NO: 1909943 - RNA, 13 nt, Human
cuugaugccuggc

SEQ ID NO: 1909944 - RNA, 13 nt, Human
cuugccugcaggc

SEQ ID NO: 1909945 - RNA, 12 nt, Human
cuugccugcagg

SEQ ID NO: 1909946 - RNA, 12 nt, Human
cugugcugaguc

SEQ ID NO: 1909947 - RNA, 14 nt, Human
cugugcugagucug

SEQ ID NO: 1909948 - RNA, 19 nt, Human
cugugcugagucugaaggc

SEQ ID NO: 1909949 - RNA, 13 nt, Human
cuuauggaacacu

SEQ ID NO: 1909950 - RNA, 16 nt, Human
cuuauggaacacucug

SEQ ID NO: 1909951 - RNA, 17 nt, Human
cuuauggaacacucuga

SEQ ID NO: 1909952 - RNA, 19 nt, Human
cuuauggaacacucugaga

SEQ ID NO: 1909953 - RNA, 20 nt, Human
cuuauggaacacucugagac

SEQ ID NO: 1909954 - RNA, 21 nt, Human
cuuauggaacacucugagacu

SEQ ID NO: 1909955 - RNA, 17 nt, Human
cuuauuagggagaaaau

SEQ ID NO: 1909956 - RNA, 21 nt, Human
cuucaccuuuguccccaccgc

SEQ ID NO: 1909957 - RNA, 23 nt, Human
cuuauuguagcauccuggaauau

SEQ ID NO: 1909958 - RNA, 13 nt, Human
cuuauuguaccuc

SEQ ID NO: 1909959 - RNA, 14 nt, Human
cuuauuguaccucu

SEQ ID NO: 1909960 - RNA, 15 nt, Human
cuuauuguaccucuc

SEQ ID NO: 1909961 - RNA, 18 nt, Human
cuuauuggcagcucuacu

SEQ ID NO: 1909962 - RNA, 22 nt, Human
cuucaccuuuguccccaccgca

SEQ ID NO: 1909963 - RNA, 20 nt, Human
cuuauuguagcauccuggaa

SEQ ID NO: 1909964 - RNA, 18 nt, Human
cuuauuguaccucucuua

SEQ ID NO: 1909965 - RNA, 15 nt, Human
cuucacggaagagcc

SEQ ID NO: 1909966 - RNA, 19 nt, Human
cuucacggaagagccuugc

SEQ ID NO: 1909967 - RNA, 11 nt, Human
cuucccaccuc

SEQ ID NO: 1909968 - RNA, 21 nt, Human
cuucccaccucucucacuccu

SEQ ID NO: 1909969 - RNA, 23 nt, Human
cuucccaccucucucacuccuug

SEQ ID NO: 1909970 - RNA, 22 nt, Human
cuucaugcaggugaaacccagu

SEQ ID NO: 1909971 - RNA, 21 nt, Human
cuuccagugaggcucugcccu

SEQ ID NO: 1909972 - RNA, 22 nt, Human
cuuccagugaggcucugcccuu

SEQ ID NO: 1909973 - RNA, 23 nt, Human
cuuccagugaggcucugcccuug

SEQ ID NO: 1909974 - RNA, 18 nt, Human
cuuccaguguccuuagaa

SEQ ID NO: 1909975 - RNA, 19 nt, Human
cuuccaguguccuuagaac

SEQ ID NO: 1909976 - RNA, 15 nt, Human
cuucauauugcugag

SEQ ID NO: 1909977 - RNA, 18 nt, Human
cuucauagcagauuuuaa

SEQ ID NO: 1909978 - RNA, 22 nt, Human
cuucauacagggaugguguuca

SEQ ID NO: 1909979 - RNA, 13 nt, Human
cuucauacaggga

SEQ ID NO: 1909980 - RNA, 12 nt, Human
cuucauacaggg

SEQ ID NO: 1909981 - RNA, 19 nt, Human
cuucauaacaauuuuagga

SEQ ID NO: 1909982 - RNA, 15 nt, Human
cuucauaacaauuuu

SEQ ID NO: 1909983 - RNA, 10 nt, Human
cuucauacac

SEQ ID NO: 1909984 - RNA, 9 nt, Human
cuucauaca

SEQ ID NO: 1909985 - RNA, 20 nt, Human
cuucagagacuccugcaggc

SEQ ID NO: 1909986 - RNA, 17 nt, Human
cuucacuguccuccaag

SEQ ID NO: 1909987 - RNA, 18 nt, Human
cuucagagacuccugcag

SEQ ID NO: 1909988 - RNA, 19 nt, Human
cuucagagacuccugcagg

SEQ ID NO: 1909989 - RNA, 15 nt, Human
cuucacuguaaaaua

SEQ ID NO: 1909990 - RNA, 17 nt, Human
cuucagagacuccugca

SEQ ID NO: 1909991 - RNA, 21 nt, Human
cuucacguagaacauugguau

SEQ ID NO: 1909992 - RNA, 13 nt, Human
cuucacuccugcu

SEQ ID NO: 1909993 - RNA, 14 nt, Human
cuucacuccugcug

SEQ ID NO: 1909994 - RNA, 15 nt, Human
cuucacuccugcugu

SEQ ID NO: 1909995 - RNA, 20 nt, Human
cugagacucgcgacaaugca

SEQ ID NO: 1909996 - RNA, 17 nt, Human
cugagacucgcgacaau

SEQ ID NO: 1909997 - RNA, 19 nt, Human
cugagacucgcgacaaugc

SEQ ID NO: 1909998 - RNA, 17 nt, Human
cugaccuugaugagcug

SEQ ID NO: 1909999 - RNA, 16 nt, Human
cugaccuugaugagcu

SEQ ID NO: 1910000 - RNA, 15 nt, Human
cugcauguuugugau

SEQ ID NO: 1910001 - RNA, 13 nt, Human
cugcauguuacau

SEQ ID NO: 1910002 - RNA, 17 nt, Human
cugcauuucgguggcua

SEQ ID NO: 1910003 - RNA, 18 nt, Human
cugcauuucgguggcuag

SEQ ID NO: 1910004 - RNA, 22 nt, Human
cugcauuuaaaagauacaguua

SEQ ID NO: 1910005 - RNA, 20 nt, Human
cugcauuuaaaagauacagu

SEQ ID NO: 1910006 - RNA, 16 nt, Human
cugcauuuguauauuu

SEQ ID NO: 1910007 - RNA, 22 nt, Human
cugccaaaaugcucuagugccu

SEQ ID NO: 1910008 - RNA, 15 nt, Human
cugccaaaaugcucu

SEQ ID NO: 1910009 - RNA, 16 nt, Human
cugccaaaaugcucua

SEQ ID NO: 1910010 - RNA, 15 nt, Human
cugccaaugggagcu

SEQ ID NO: 1910011 - RNA, 17 nt, Human
cugccaaugggagcuca

SEQ ID NO: 1910012 - RNA, 23 nt, Human
cugccauauucuguuggccagug

SEQ ID NO: 1910013 - RNA, 22 nt, Human
cugccauauucuguuggccagu

SEQ ID NO: 1910014 - RNA, 21 nt, Human
cugccauauucuguuggccag

SEQ ID NO: 1910015 - RNA, 20 nt, Human
cugccauauucuguuggcca

SEQ ID NO: 1910016 - RNA, 11 nt, Human
cugccagggac

SEQ ID NO: 1910017 - RNA, 12 nt, Human
cugccagggaca

SEQ ID NO: 1910018 - RNA, 15 nt, Human
cugccagggacagag

SEQ ID NO: 1910019 - RNA, 12 nt, Human
cugccauccagg

SEQ ID NO: 1910020 - RNA, 22 nt, Human
cugccaucauguuuacagagga

SEQ ID NO: 1910021 - RNA, 17 nt, Human
cugccaucauguuuaca

SEQ ID NO: 1910022 - RNA, 23 nt, Human
cugccaucauguuuacagaggac

SEQ ID NO: 1910023 - RNA, 22 nt, Human
cugccccauccuccagcaggga

SEQ ID NO: 1910024 - RNA, 13 nt, Human
cugccccauccuc

SEQ ID NO: 1910025 - RNA, 16 nt, Human
cugccccauccuccag

SEQ ID NO: 1910026 - RNA, 17 nt, Human
cugccccauccuccagc

SEQ ID NO: 1910027 - RNA, 18 nt, Human
cugccccauccuccagca

SEQ ID NO: 1910028 - RNA, 21 nt, Human
cugccccauccuccagcaggg

SEQ ID NO: 1910029 - RNA, 14 nt, Human
cugccccucaacuc

SEQ ID NO: 1910030 - RNA, 22 nt, Human
cugccccucaacucuccuccag

SEQ ID NO: 1910031 - RNA, 12 nt, Human
cugcccugugag

SEQ ID NO: 1910032 - RNA, 13 nt, Human
cugcccugugagu

SEQ ID NO: 1910033 - RNA, 15 nt, Human
cugcccugugggccc

SEQ ID NO: 1910034 - RNA, 16 nt, Human
cugcccugugggcccc

SEQ ID NO: 1910035 - RNA, 18 nt, Human
cugcccugugggccccca

SEQ ID NO: 1910036 - RNA, 13 nt, Human
cugcuuaacuuca

SEQ ID NO: 1910037 - RNA, 13 nt, Human
cugcuucagccuc

SEQ ID NO: 1910038 - RNA, 17 nt, Human
cugcuuaacuucacaua

SEQ ID NO: 1910039 - RNA, 15 nt, Human
cugcuuaacuucaca

SEQ ID NO: 1910040 - RNA, 16 nt, Human
cugcuucagccucccg

SEQ ID NO: 1910041 - RNA, 14 nt, Human
cugcuucagccucc

SEQ ID NO: 1910042 - RNA, 17 nt, Human
cugcuuuuuauggccug

SEQ ID NO: 1910043 - RNA, 22 nt, Human
cugcuuuuuaaagaaugcucuu

SEQ ID NO: 1910044 - RNA, 18 nt, Human
cugcuuuuuauggccugu

SEQ ID NO: 1910045 - RNA, 16 nt, Human
cuggaaauauuaagaa

SEQ ID NO: 1910046 - RNA, 17 nt, Human
cuggaacacuaaugagg

SEQ ID NO: 1910047 - RNA, 13 nt, Human
cuggaacccagac

SEQ ID NO: 1910048 - RNA, 13 nt, Human
cuggacugugugc

SEQ ID NO: 1910049 - RNA, 14 nt, Human
cuggaacccagacu

SEQ ID NO: 1910050 - RNA, 16 nt, Human
cuggaacccagacuca

SEQ ID NO: 1910051 - RNA, 18 nt, Human
cuggaacccagacucaga

SEQ ID NO: 1910052 - RNA, 19 nt, Human
cuggaacccagacucagac

SEQ ID NO: 1910053 - RNA, 22 nt, Human
cuggaacccagacucagacauu

SEQ ID NO: 1910054 - RNA, 12 nt, Human
cuggaaccucag

SEQ ID NO: 1910055 - RNA, 15 nt, Human
cuggaaccucagccu

SEQ ID NO: 1910056 - RNA, 16 nt, Human
cuggaaccucagccug

SEQ ID NO: 1910057 - RNA, 17 nt, Human
cuggaaccucagccugg

SEQ ID NO: 1910058 - RNA, 18 nt, Human
cuggaaccucagccuggc

SEQ ID NO: 1910059 - RNA, 20 nt, Human
cuggaaccucagccuggcca

SEQ ID NO: 1910060 - RNA, 22 nt, Human
cuggaaccucagccuggccaga

SEQ ID NO: 1910061 - RNA, 23 nt, Human
cuggaaccucagccuggccagac

SEQ ID NO: 1910062 - RNA, 11 nt, Human
cugcugacagu

SEQ ID NO: 1910063 - RNA, 23 nt, Human
cugcugacagacacaggcccggc

SEQ ID NO: 1910064 - RNA, 21 nt, Human
cugcugacagacacaggcccg

SEQ ID NO: 1910065 - RNA, 20 nt, Human
cugcugacagacacaggccc

SEQ ID NO: 1910066 - RNA, 19 nt, Human
cugcugacagacacaggcc

SEQ ID NO: 1910067 - RNA, 18 nt, Human
cugcugacagacacaggc

SEQ ID NO: 1910068 - RNA, 15 nt, Human
cugcugacagacaca

SEQ ID NO: 1910069 - RNA, 22 nt, Human
cugccugggaucccucauccuc

SEQ ID NO: 1910070 - RNA, 18 nt, Human
cugccucgaacuggcugc

SEQ ID NO: 1910071 - RNA, 17 nt, Human
cugccucgaacuggcug

SEQ ID NO: 1910072 - RNA, 15 nt, Human
cugccucgaacuggc

SEQ ID NO: 1910073 - RNA, 23 nt, Human
cugccugggaucccucauccuca

SEQ ID NO: 1910074 - RNA, 15 nt, Human
cugccuguucagcuc

SEQ ID NO: 1910075 - RNA, 14 nt, Human
cugccuguucagcu

SEQ ID NO: 1910076 - RNA, 16 nt, Human
cugccugguccucaca

SEQ ID NO: 1910077 - RNA, 16 nt, Human
cugcuaauuccccaga

SEQ ID NO: 1910078 - RNA, 23 nt, Human
cugcuacaaauacucuuaggaag

SEQ ID NO: 1910079 - RNA, 16 nt, Human
cugccuguugggccag

SEQ ID NO: 1910080 - RNA, 14 nt, Human
cugccuguugggcc

SEQ ID NO: 1910081 - RNA, 18 nt, Human
cugccuguugggccagga

SEQ ID NO: 1910082 - RNA, 19 nt, Human
cugccuguugggccaggag

SEQ ID NO: 1910083 - RNA, 15 nt, Human
cugcuacagagcaga

SEQ ID NO: 1910084 - RNA, 13 nt, Human
cugcucagcucug

SEQ ID NO: 1910085 - RNA, 14 nt, Human
cugcucagcucugg

SEQ ID NO: 1910086 - RNA, 16 nt, Human
cugcucagcucugggc

SEQ ID NO: 1910087 - RNA, 22 nt, Human
cugcucagcucugggccauucu

SEQ ID NO: 1910088 - RNA, 13 nt, Human
cugcucagcuucu

SEQ ID NO: 1910089 - RNA, 19 nt, Human
cugguuugccgguggugca

SEQ ID NO: 1910090 - RNA, 21 nt, Human
cuguaggaagguuaauguuca

SEQ ID NO: 1910091 - RNA, 14 nt, Human
cugucacucauugc

SEQ ID NO: 1910092 - RNA, 21 nt, Human
cugucacucauugcugagccu

SEQ ID NO: 1910093 - RNA, 22 nt, Human
cuguacuugcucuugaugccug

SEQ ID NO: 1910094 - RNA, 21 nt, Human
cuguacuugcucuugaugccu

SEQ ID NO: 1910095 - RNA, 23 nt, Human
cuguacuugcucuugaugccugg

SEQ ID NO: 1910096 - RNA, 22 nt, Human
cuguaaaaugcaugauuuugua

SEQ ID NO: 1910097 - RNA, 16 nt, Human
cugucauuugagcagg

SEQ ID NO: 1910098 - RNA, 18 nt, Human
cugucauuugagcagggc

SEQ ID NO: 1910099 - RNA, 17 nt, Human
cugucauuugagcaggg

SEQ ID NO: 1910100 - RNA, 20 nt, Human
cugucauuugagcagggcuc

SEQ ID NO: 1910101 - RNA, 18 nt, Human
cugucagccauuccuguu

SEQ ID NO: 1910102 - RNA, 22 nt, Human
cugucacucauugcugagccuc

SEQ ID NO: 1910103 - RNA, 23 nt, Human
cugucacucauugcugagccucu

SEQ ID NO: 1910104 - RNA, 17 nt, Human
cugucacugcucuggac

SEQ ID NO: 1910105 - RNA, 24 nt, Human
cugucacugcucuggacugugugg

SEQ ID NO: 1910106 - RNA, 13 nt, Human
cugucacuguggg

SEQ ID NO: 1910107 - RNA, 15 nt, Human
cugugaagagaacca

SEQ ID NO: 1910108 - RNA, 14 nt, Human
cugugaaggacccu

SEQ ID NO: 1910109 - RNA, 19 nt, Human
cugugcuccauggcugcca

SEQ ID NO: 1910110 - RNA, 15 nt, Human
cugugcucuggacag

SEQ ID NO: 1910111 - RNA, 14 nt, Human
cugugcucuggaca

SEQ ID NO: 1910112 - RNA, 21 nt, Human
cugugagaugcuagaacuccc

SEQ ID NO: 1910113 - RNA, 16 nt, Human
cugugagaugcuagaa

SEQ ID NO: 1910114 - RNA, 20 nt, Human
cugugagacucgagaacuuu

SEQ ID NO: 1910115 - RNA, 18 nt, Human
cugugagacucgagaacu

SEQ ID NO: 1910116 - RNA, 19 nt, Human
cugucgagaaacagccugu

SEQ ID NO: 1910117 - RNA, 13 nt, Human
cugucgcccaguc

SEQ ID NO: 1910118 - RNA, 23 nt, Human
cuggugacuuuccucuuuggucu

SEQ ID NO: 1910119 - RNA, 21 nt, Human
cuggugagagggccgggcaga

SEQ ID NO: 1910120 - RNA, 22 nt, Human
cuggugagagggccgggcagag

SEQ ID NO: 1910121 - RNA, 23 nt, Human
cuggugagagggccgggcagagg

SEQ ID NO: 1910122 - RNA, 14 nt, Human
cuggguucacugca

SEQ ID NO: 1910123 - RNA, 15 nt, Human
cuggugacuuuccuc

SEQ ID NO: 1910124 - RNA, 20 nt, Human
cuggugacuuuccucuuugg

SEQ ID NO: 1910125 - RNA, 21 nt, Human
cuggugacuuuccucuuuggu

SEQ ID NO: 1910126 - RNA, 23 nt, Human
cuggguggcaccagcagccugga

SEQ ID NO: 1910127 - RNA, 22 nt, Human
cuggguggcaccagcagccugg

SEQ ID NO: 1910128 - RNA, 11 nt, Human
cuggggccucc

SEQ ID NO: 1910129 - RNA, 12 nt, Human
cuggggccucca

SEQ ID NO: 1910130 - RNA, 15 nt, Human
cuggggccuccagaa

SEQ ID NO: 1910131 - RNA, 17 nt, Human
cuggggccuccagaacu

SEQ ID NO: 1910132 - RNA, 16 nt, Human
cuggguguggcgcagc

SEQ ID NO: 1910133 - RNA, 17 nt, Human
cuggguguggcgcagca

SEQ ID NO: 1910134 - RNA, 17 nt, Human
cugggcagaaggaagac

SEQ ID NO: 1910135 - RNA, 18 nt, Human
cuggggccaggcuggguc

SEQ ID NO: 1910136 - RNA, 16 nt, Human
cuggggccgaaagaac

SEQ ID NO: 1910137 - RNA, 22 nt, Human
cuggggaugucucucaugacca

SEQ ID NO: 1910138 - RNA, 16 nt, Human
cuggggauugggcccc

SEQ ID NO: 1910139 - RNA, 22 nt, Human
cuggggauugggccccugccag

SEQ ID NO: 1910140 - RNA, 18 nt, Human
cuggggauugggccccug

SEQ ID NO: 1910141 - RNA, 18 nt, Human
cugggcagaaggaagacu

SEQ ID NO: 1910142 - RNA, 16 nt, Human
cugggcagaaggaaga

SEQ ID NO: 1910143 - RNA, 15 nt, Human
cugggacguggcuca

SEQ ID NO: 1910144 - RNA, 16 nt, Human
cugggacguggcucag

SEQ ID NO: 1910145 - RNA, 17 nt, Human
cugggacguggcucagc

SEQ ID NO: 1910146 - RNA, 18 nt, Human
cugggacguggcucagcc

SEQ ID NO: 1910147 - RNA, 20 nt, Human
cuggacugucuucucccugc

SEQ ID NO: 1910148 - RNA, 16 nt, Human
cuggacugugugcuca

SEQ ID NO: 1910149 - RNA, 17 nt, Human
cuggagaccagggagcc

SEQ ID NO: 1910150 - RNA, 18 nt, Human
cuggagaccagggagccu

SEQ ID NO: 1910151 - RNA, 19 nt, Human
cuggagaccagggagccuu

SEQ ID NO: 1910152 - RNA, 12 nt, Human
cuggcagcucag

SEQ ID NO: 1910153 - RNA, 17 nt, Human
cuggagacuaaccccac

SEQ ID NO: 1910154 - RNA, 13 nt, Human
cuggcagcucaga

SEQ ID NO: 1910155 - RNA, 14 nt, Human
cuggcagcucagag

SEQ ID NO: 1910156 - RNA, 13 nt, Human
cuggccccucagg

SEQ ID NO: 1910157 - RNA, 23 nt, Human
cuggccccgccgccugguacuca

SEQ ID NO: 1910158 - RNA, 12 nt, Human
cuggccccgccg

SEQ ID NO: 1910159 - RNA, 14 nt, Human
cuggccccgccgcc

SEQ ID NO: 1910160 - RNA, 16 nt, Human
cuggccccgccgccug

SEQ ID NO: 1910161 - RNA, 22 nt, Human
cuggccccgccgccugguacuc

SEQ ID NO: 1910162 - RNA, 15 nt, Human
cuggcagcucagaga

SEQ ID NO: 1910163 - RNA, 12 nt, Human
cuggcagcucug

SEQ ID NO: 1910164 - RNA, 17 nt, Human
cuggcagcucuggacag

SEQ ID NO: 1910165 - RNA, 18 nt, Human
cuggcagcucuggacagc

SEQ ID NO: 1910166 - RNA, 20 nt, Human
cuggcagcucuggacagccc

SEQ ID NO: 1910167 - RNA, 21 nt, Human
cuggcagcucuggacagcccc

SEQ ID NO: 1910168 - RNA, 13 nt, Human
cugggacacaguu

SEQ ID NO: 1910169 - RNA, 12 nt, Human
cugggacacagu

SEQ ID NO: 1910170 - RNA, 16 nt, Human
cuggcuccaggccagg

SEQ ID NO: 1910171 - RNA, 13 nt, Human
cuggcucaucucu

SEQ ID NO: 1910172 - RNA, 19 nt, Human
cuggcuccaaacccucgag

SEQ ID NO: 1910173 - RNA, 20 nt, Human
cuggcuccaaacccucgagg

SEQ ID NO: 1910174 - RNA, 14 nt, Human
cuggcuccagaugc

SEQ ID NO: 1910175 - RNA, 20 nt, Human
cuggcuccagaugcagggca

SEQ ID NO: 1910176 - RNA, 21 nt, Human
cuggcuccagaugcagggcag

SEQ ID NO: 1910177 - RNA, 17 nt, Human
cuggccccucagggucc

SEQ ID NO: 1910178 - RNA, 18 nt, Human
cuggccccucaggguccc

SEQ ID NO: 1910179 - RNA, 20 nt, Human
cuggccccucagggucccug

SEQ ID NO: 1910180 - RNA, 21 nt, Human
cuggccccucagggucccugg

SEQ ID NO: 1910181 - RNA, 17 nt, Human
auugcuaucuauugaua

SEQ ID NO: 1910182 - RNA, 21 nt, Human
auugcuaucuauugauaauuu

SEQ ID NO: 1910183 - RNA, 22 nt, Human
auugcuacuguccuacccaccc

SEQ ID NO: 1910184 - RNA, 20 nt, Human
auugcuacuguccuacccac

SEQ ID NO: 1910185 - RNA, 18 nt, Human
auugauagaguguuauca

SEQ ID NO: 1910186 - RNA, 18 nt, Human
auugauauaaauaaaaca

SEQ ID NO: 1910187 - RNA, 19 nt, Human
auugauauaaauaaaacau

SEQ ID NO: 1910188 - RNA, 17 nt, Human
auugauaugcuuauaca

SEQ ID NO: 1910189 - RNA, 15 nt, Human
auugcuacuguccua

SEQ ID NO: 1910190 - RNA, 21 nt, Human
auugauaagaaccuuuugagu

SEQ ID NO: 1910191 - RNA, 15 nt, Human
auugagucaaauggu

SEQ ID NO: 1910192 - RNA, 23 nt, Human
auugagguguauggagagaaaac

SEQ ID NO: 1910193 - RNA, 14 nt, Human
auucuucugcuuca

SEQ ID NO: 1910194 - RNA, 16 nt, Human
auucuugaaagcugug

SEQ ID NO: 1910195 - RNA, 14 nt, Human
auucuugaagucag

SEQ ID NO: 1910196 - RNA, 11 nt, Human
auucuuuccug

SEQ ID NO: 1910197 - RNA, 12 nt, Human
auucuucugcuu

SEQ ID NO: 1910198 - RNA, 11 nt, Human
auucuucugcu

SEQ ID NO: 1910199 - RNA, 16 nt, Human
auucauaguaacuucu

SEQ ID NO: 1910200 - RNA, 17 nt, Human
auucauaguaacuucuu

SEQ ID NO: 1910201 - RNA, 18 nt, Human
auucauaguaacuucuua

SEQ ID NO: 1910202 - RNA, 13 nt, Human
auucuuuccugag

SEQ ID NO: 1910203 - RNA, 23 nt, Human
auuguaauaggcguaacuaauuu

SEQ ID NO: 1910204 - RNA, 18 nt, Human
auugcuugagcucaggag

SEQ ID NO: 1910205 - RNA, 14 nt, Human
auuguaaaauggug

SEQ ID NO: 1910206 - RNA, 16 nt, Human
auuguuagucucuuga

SEQ ID NO: 1910207 - RNA, 19 nt, Human
auugugugugcucugcuuc

SEQ ID NO: 1910208 - RNA, 22 nt, Human
auugugugugcagacuucagga

SEQ ID NO: 1910209 - RNA, 19 nt, Human
auugugugugcagacuuca

SEQ ID NO: 1910210 - RNA, 21 nt, Human
auugugucucuugguccugcu

SEQ ID NO: 1910211 - RNA, 23 nt, Human
auugugucucuugguccugcugc

SEQ ID NO: 1910212 - RNA, 12 nt, Human
auugcugcuuga

SEQ ID NO: 1910213 - RNA, 23 nt, Human
auugcugauggugcaaugaccuu

SEQ ID NO: 1910214 - RNA, 23 nt, Human
auugcugagccucugcuccccag

SEQ ID NO: 1910215 - RNA, 14 nt, Human
auugcuugagcuca

SEQ ID NO: 1910216 - RNA, 21 nt, Human
auugcugagagaaauauggaa

SEQ ID NO: 1910217 - RNA, 22 nt, Human
auugcugagagaaauauggaac

SEQ ID NO: 1910218 - RNA, 23 nt, Human
auugcugagagaaauauggaacu

SEQ ID NO: 1910219 - RNA, 14 nt, Human
auugcugagccucu

SEQ ID NO: 1910220 - RNA, 16 nt, Human
auugcugagccucugc

SEQ ID NO: 1910221 - RNA, 22 nt, Human
auugcugagccucugcucccca

SEQ ID NO: 1910222 - RNA, 15 nt, Human
auugcugauggugca

SEQ ID NO: 1910223 - RNA, 16 nt, Human
auugcugauggugcaa

SEQ ID NO: 1910224 - RNA, 18 nt, Human
auugcugauggugcaaug

SEQ ID NO: 1910225 - RNA, 19 nt, Human
auugcugauggugcaauga

SEQ ID NO: 1910226 - RNA, 16 nt, Human
auuguugagcuauugc

SEQ ID NO: 1910227 - RNA, 19 nt, Human
auuguugagcuauugcugu

SEQ ID NO: 1910228 - RNA, 22 nt, Human
auguuucuucuagguucuaaaa

SEQ ID NO: 1910229 - RNA, 18 nt, Human
auguuugccucugccucu

SEQ ID NO: 1910230 - RNA, 21 nt, Human
auuacagaugggcaaauuaag

SEQ ID NO: 1910231 - RNA, 20 nt, Human
auuacaggcaccugccacca

SEQ ID NO: 1910232 - RNA, 22 nt, Human
auuacaggcaccugccaccaug

SEQ ID NO: 1910233 - RNA, 16 nt, Human
auuacaggugugaacc

SEQ ID NO: 1910234 - RNA, 19 nt, Human
auuacagaugggcaaauua

SEQ ID NO: 1910235 - RNA, 17 nt, Human
auuacaggaaguacugg

SEQ ID NO: 1910236 - RNA, 19 nt, Human
auuacaguggggaaugaag

SEQ ID NO: 1910237 - RNA, 19 nt, Human
auuagcauuugucaacaaa

SEQ ID NO: 1910238 - RNA, 18 nt, Human
auuagccgggcauggugg

SEQ ID NO: 1910239 - RNA, 12 nt, Human
auuagcugcuuc

SEQ ID NO: 1910240 - RNA, 13 nt, Human
auuaauucuauaa

SEQ ID NO: 1910241 - RNA, 19 nt, Human
auuaauucaccuuccagug

SEQ ID NO: 1910242 - RNA, 14 nt, Human
auuaauucuauaag

SEQ ID NO: 1910243 - RNA, 12 nt, Human
auuaauugcuuu

SEQ ID NO: 1910244 - RNA, 13 nt, Human
auuaauugcuuug

SEQ ID NO: 1910245 - RNA, 14 nt, Human
auuaauugcuuuga

SEQ ID NO: 1910246 - RNA, 18 nt, Human
auuaggugugacugaauu

SEQ ID NO: 1910247 - RNA, 16 nt, Human
auuaggugugacugaa

SEQ ID NO: 1910248 - RNA, 18 nt, Human
auuagggagaaaauucaa

SEQ ID NO: 1910249 - RNA, 20 nt, Human
auuagggagaaaauucaauu

SEQ ID NO: 1910250 - RNA, 23 nt, Human
auuagggagaaaauucaauugua

SEQ ID NO: 1910251 - RNA, 13 nt, Human
auuagguauuuug

SEQ ID NO: 1910252 - RNA, 13 nt, Human
auuagcugcuucu

SEQ ID NO: 1910253 - RNA, 21 nt, Human
auuagcugcuucuauguuuca

SEQ ID NO: 1910254 - RNA, 21 nt, Human
auuaggugugacugaauuucu

SEQ ID NO: 1910255 - RNA, 18 nt, Human
auuaugaaacuuuuggaa

SEQ ID NO: 1910256 - RNA, 19 nt, Human
auucacaagacccaaaagg

SEQ ID NO: 1910257 - RNA, 17 nt, Human
auucaauuccucuggga

SEQ ID NO: 1910258 - RNA, 18 nt, Human
auucaauuccucugggaa

SEQ ID NO: 1910259 - RNA, 13 nt, Human
auucaauuguaaa

SEQ ID NO: 1910260 - RNA, 14 nt, Human
auucaauuguaaau

SEQ ID NO: 1910261 - RNA, 18 nt, Human
auucaauuguaaauugaa

SEQ ID NO: 1910262 - RNA, 20 nt, Human
auucaaugccccugaauuua

SEQ ID NO: 1910263 - RNA, 18 nt, Human
auucaaugccccugaauu

SEQ ID NO: 1910264 - RNA, 16 nt, Human
auucaaauguauuaca

SEQ ID NO: 1910265 - RNA, 14 nt, Human
auucaauuccucug

SEQ ID NO: 1910266 - RNA, 16 nt, Human
auucaauuccucuggg

SEQ ID NO: 1910267 - RNA, 23 nt, Human
auuaugcaugaaguaauaugcac

SEQ ID NO: 1910268 - RNA, 21 nt, Human
auuaugaugugggucaaggaa

SEQ ID NO: 1910269 - RNA, 23 nt, Human
auuaugagacacaggaugaagca

SEQ ID NO: 1910270 - RNA, 14 nt, Human
auucauaaugacuu

SEQ ID NO: 1910271 - RNA, 15 nt, Human
auucauaaugacuua

SEQ ID NO: 1910272 - RNA, 21 nt, Human
auucauaauuauuauuuggcc

SEQ ID NO: 1910273 - RNA, 19 nt, Human
auucauaaugacuuaagca

SEQ ID NO: 1910274 - RNA, 22 nt, Human
auucauagcagcuuauucacaa

SEQ ID NO: 1910275 - RNA, 19 nt, Human
auucauagcagcuuauuca

SEQ ID NO: 1910276 - RNA, 22 nt, Human
auucacaguucuuugggccaga

SEQ ID NO: 1910277 - RNA, 19 nt, Human
auuuuauagcuacuaauuu

SEQ ID NO: 1910278 - RNA, 17 nt, Human
auuuguuuguuuuccuu

SEQ ID NO: 1910279 - RNA, 17 nt, Human
auuuuauagcuacuaau

SEQ ID NO: 1910280 - RNA, 23 nt, Human
auuuguuugaacugauaaagaug

SEQ ID NO: 1910281 - RNA, 22 nt, Human
auuuguuugaacugauaaagau

SEQ ID NO: 1910282 - RNA, 22 nt, Human
auuuguggggagggauuugggg

SEQ ID NO: 1910283 - RNA, 14 nt, Human
auuuguguauuuaa

SEQ ID NO: 1910284 - RNA, 22 nt, Human
auuuguguauuuaacagggagg

SEQ ID NO: 1910285 - RNA, 13 nt, Human
auuugcuccuuuc

SEQ ID NO: 1910286 - RNA, 18 nt, Human
auuugugauagcacuuuc

SEQ ID NO: 1910287 - RNA, 16 nt, Human
auuugugcauuuucua

SEQ ID NO: 1910288 - RNA, 20 nt, Human
auuugugauacaaugcugug

SEQ ID NO: 1910289 - RNA, 15 nt, Human
auuugugauagcacu

SEQ ID NO: 1910290 - RNA, 17 nt, Human
auuugugauagcacuuu

SEQ ID NO: 1910291 - RNA, 17 nt, Human
auuugugauacaaugcu

SEQ ID NO: 1910292 - RNA, 15 nt, Human
auuugugauacaaug

SEQ ID NO: 1910293 - RNA, 21 nt, Human
auuuuaugccuuuuauuucuu

SEQ ID NO: 1910294 - RNA, 20 nt, Human
auuuuaugccuuuuauuucu

SEQ ID NO: 1910295 - RNA, 16 nt, Human
auuugcauugaacaca

SEQ ID NO: 1910296 - RNA, 21 nt, Human
auuugcauugaacacaaacug

SEQ ID NO: 1910297 - RNA, 22 nt, Human
auuugcauugaacacaaacugu

SEQ ID NO: 1910298 - RNA, 20 nt, Human
auuugcuaugagcuggggau

SEQ ID NO: 1910299 - RNA, 16 nt, Human
auuugcuaugagcugg

SEQ ID NO: 1910300 - RNA, 13 nt, Human
auuugauugauuu

SEQ ID NO: 1910301 - RNA, 16 nt, Human
auuugauugauuugaa

SEQ ID NO: 1910302 - RNA, 18 nt, Human
auuugcauuaaauucaca

SEQ ID NO: 1910303 - RNA, 19 nt, Human
auuugcauuaaauucacaa

SEQ ID NO: 1910304 - RNA, 23 nt, Human
auuugcauuaaauucacaaacuu

SEQ ID NO: 1910305 - RNA, 22 nt, Human
caaagcacgaaauguuauuuuu

SEQ ID NO: 1910306 - RNA, 20 nt, Human
caaagcacgaaauguuauuu

SEQ ID NO: 1910307 - RNA, 12 nt, Human
caaagcagacag

SEQ ID NO: 1910308 - RNA, 13 nt, Human
caaagcagacagc

SEQ ID NO: 1910309 - RNA, 15 nt, Human
caaagcagacagcuc

SEQ ID NO: 1910310 - RNA, 16 nt, Human
caaagcagacagcucc

SEQ ID NO: 1910311 - RNA, 17 nt, Human
caaagcagacagcucca

SEQ ID NO: 1910312 - RNA, 19 nt, Human
caaagcagacagcuccacc

SEQ ID NO: 1910313 - RNA, 12 nt, Human
caaagcagccac

SEQ ID NO: 1910314 - RNA, 13 nt, Human
caaagcagccacg

SEQ ID NO: 1910315 - RNA, 20 nt, Human
caaagaugggugaaggcugg

SEQ ID NO: 1910316 - RNA, 21 nt, Human
caaagaugggugaaggcuggc

SEQ ID NO: 1910317 - RNA, 22 nt, Human
caaagaugggugaaggcuggca

SEQ ID NO: 1910318 - RNA, 23 nt, Human
caaagauauuuugcuuugugauu

SEQ ID NO: 1910319 - RNA, 22 nt, Human
caaagauauuuugcuuugugau

SEQ ID NO: 1910320 - RNA, 21 nt, Human
caaagucucuggaauuugaaa

SEQ ID NO: 1910321 - RNA, 14 nt, Human
caaaguagaagucu

SEQ ID NO: 1910322 - RNA, 21 nt, Human
caaaguagaagucuuagaugu

SEQ ID NO: 1910323 - RNA, 22 nt, Human
caaaguacacuguuucaaacuu

SEQ ID NO: 1910324 - RNA, 15 nt, Human
caaagcagugcaugc

SEQ ID NO: 1910325 - RNA, 17 nt, Human
caaagcagugcaugcug

SEQ ID NO: 1910326 - RNA, 15 nt, Human
caacacgcaggagca

SEQ ID NO: 1910327 - RNA, 19 nt, Human
caacacgcaccugccucag

SEQ ID NO: 1910328 - RNA, 16 nt, Human
caacacgcaggagcac

SEQ ID NO: 1910329 - RNA, 14 nt, Human
caacacuaacauga

SEQ ID NO: 1910330 - RNA, 20 nt, Human
caaauggaaaugggcagagc

SEQ ID NO: 1910331 - RNA, 21 nt, Human
caaauggaaaugggcagagca

SEQ ID NO: 1910332 - RNA, 22 nt, Human
caaauggaaaugggcagagcag

SEQ ID NO: 1910333 - RNA, 20 nt, Human
caacaccucugcacaagcug

SEQ ID NO: 1910334 - RNA, 15 nt, Human
caacacgcaccugcc

SEQ ID NO: 1910335 - RNA, 17 nt, Human
caacacgcaccugccuc

SEQ ID NO: 1910336 - RNA, 17 nt, Human
caacaaucccaaggccc

SEQ ID NO: 1910337 - RNA, 15 nt, Human
caacaccaagcacag

SEQ ID NO: 1910338 - RNA, 22 nt, Human
caacaccaagcacagcagccug

SEQ ID NO: 1910339 - RNA, 24 nt, Human
caaacccagacggcuccacuagga

SEQ ID NO: 1910340 - RNA, 20 nt, Human
caaacccagacggcuccacu

SEQ ID NO: 1910341 - RNA, 21 nt, Human
caaaccaucauugaaaucuuu

SEQ ID NO: 1910342 - RNA, 19 nt, Human
caaaccaucauugaaaucu

SEQ ID NO: 1910343 - RNA, 16 nt, Human
caaaagaugcuucuca

SEQ ID NO: 1910344 - RNA, 20 nt, Human
caaaaaaaaaaaaaaauuag

SEQ ID NO: 1910345 - RNA, 18 nt, Human
caaaagaugcuucucacu

SEQ ID NO: 1910346 - RNA, 19 nt, Human
caaaaggaucuuuguggcc

SEQ ID NO: 1910347 - RNA, 20 nt, Human
caaaaggaucuuuguggcca

SEQ ID NO: 1910348 - RNA, 15 nt, Human
caaaaggcagaagca

SEQ ID NO: 1910349 - RNA, 21 nt, Human
caaaaggaucuuuguggccaa

SEQ ID NO: 1910350 - RNA, 22 nt, Human
caaaaggaucuuuguggccaag

SEQ ID NO: 1910351 - RNA, 24 nt, Human
caaaaggaucuuuguggccaagga

SEQ ID NO: 1910352 - RNA, 20 nt, Human
caaagauauuuugcuuugug

SEQ ID NO: 1910353 - RNA, 18 nt, Human
caaagauauuuugcuuug

SEQ ID NO: 1910354 - RNA, 16 nt, Human
cacccucccacccggc

SEQ ID NO: 1910355 - RNA, 17 nt, Human
cacccucauucuacuga

SEQ ID NO: 1910356 - RNA, 14 nt, Human
cacccucaggcagg

SEQ ID NO: 1910357 - RNA, 16 nt, Human
cacccuggggagaaag

SEQ ID NO: 1910358 - RNA, 15 nt, Human
cacccuggggagaaa

SEQ ID NO: 1910359 - RNA, 17 nt, Human
cacccugaaagcccuga

SEQ ID NO: 1910360 - RNA, 16 nt, Human
cacccucuaaauggga

SEQ ID NO: 1910361 - RNA, 13 nt, Human
caccucagccucc

SEQ ID NO: 1910362 - RNA, 23 nt, Human
caccuacaguguacagucuugua

SEQ ID NO: 1910363 - RNA, 20 nt, Human
caccuacaguguacagucuu

SEQ ID NO: 1910364 - RNA, 14 nt, Human
caccucagccuccc

SEQ ID NO: 1910365 - RNA, 17 nt, Human
cacccuggggagaaagu

SEQ ID NO: 1910366 - RNA, 20 nt, Human
caccuaauccaggcagaucc

SEQ ID NO: 1910367 - RNA, 21 nt, Human
caccuaauccaggcagaucca

SEQ ID NO: 1910368 - RNA, 22 nt, Human
caccuaauccaggcagauccag

SEQ ID NO: 1910369 - RNA, 17 nt, Human
caccuacaguguacagu

SEQ ID NO: 1910370 - RNA, 16 nt, Human
caccuacaguguacag

SEQ ID NO: 1910371 - RNA, 13 nt, Human
caccuacagugua

SEQ ID NO: 1910372 - RNA, 23 nt, Human
caccugccucggccucccaaagu

SEQ ID NO: 1910373 - RNA, 14 nt, Human
caccugccccucaa

SEQ ID NO: 1910374 - RNA, 15 nt, Human
caccugccccucaac

SEQ ID NO: 1910375 - RNA, 16 nt, Human
caccugccccucaacu

SEQ ID NO: 1910376 - RNA, 13 nt, Human
caccuuggcugca

SEQ ID NO: 1910377 - RNA, 15 nt, Human
caccuuggcucaagu

SEQ ID NO: 1910378 - RNA, 14 nt, Human
caccuuggcugcag

SEQ ID NO: 1910379 - RNA, 17 nt, Human
caccugccuguugggcc

SEQ ID NO: 1910380 - RNA, 13 nt, Human
caccugccucagg

SEQ ID NO: 1910381 - RNA, 14 nt, Human
caccugccucagga

SEQ ID NO: 1910382 - RNA, 20 nt, Human
caccugccucaggacugcga

SEQ ID NO: 1910383 - RNA, 19 nt, Human
caccugccuguugggccag

SEQ ID NO: 1910384 - RNA, 24 nt, Human
caccugccuguugggccaggagcc

SEQ ID NO: 1910385 - RNA, 11 nt, Human
caccccagccc

SEQ ID NO: 1910386 - RNA, 12 nt, Human
cacucuuuguaa

SEQ ID NO: 1910387 - RNA, 15 nt, Human
cacucuuuugcuuua

SEQ ID NO: 1910388 - RNA, 23 nt, Human
cacucuuuugcuuuauuccagaa

SEQ ID NO: 1910389 - RNA, 15 nt, Human
cacucuuuguaagag

SEQ ID NO: 1910390 - RNA, 23 nt, Human
cacucuuggagccugcagagcug

SEQ ID NO: 1910391 - RNA, 22 nt, Human
cacucuuggagccugcagagcu

SEQ ID NO: 1910392 - RNA, 21 nt, Human
cacucuuggagccugcagagc

SEQ ID NO: 1910393 - RNA, 12 nt, Human
cacuccccugcu

SEQ ID NO: 1910394 - RNA, 13 nt, Human
cacuccccugcug

SEQ ID NO: 1910395 - RNA, 14 nt, Human
cacuccccugcugg

SEQ ID NO: 1910396 - RNA, 15 nt, Human
cacuccccugcuggg

SEQ ID NO: 1910397 - RNA, 17 nt, Human
cacugaauuccauuuuu

SEQ ID NO: 1910398 - RNA, 16 nt, Human
cacuccagccugggug

SEQ ID NO: 1910399 - RNA, 16 nt, Human
cacucauugcugagcc

SEQ ID NO: 1910400 - RNA, 19 nt, Human
cacucauugcugagccucu

SEQ ID NO: 1910401 - RNA, 21 nt, Human
cacucauugcugagccucugc

SEQ ID NO: 1910402 - RNA, 23 nt, Human
cacucauugcugagccucugcuc

SEQ ID NO: 1910403 - RNA, 17 nt, Human
cacuuauucucaagaag

SEQ ID NO: 1910404 - RNA, 12 nt, Human
cacuuaugauuu

SEQ ID NO: 1910405 - RNA, 14 nt, Human
cacuuguccagcug

SEQ ID NO: 1910406 - RNA, 15 nt, Human
cacuuguccagcuga

SEQ ID NO: 1910407 - RNA, 16 nt, Human
cacuuacacuuuaugc

SEQ ID NO: 1910408 - RNA, 18 nt, Human
cacuuacacuuuaugcac

SEQ ID NO: 1910409 - RNA, 20 nt, Human
cacugguugcacuuaugauu

SEQ ID NO: 1910410 - RNA, 15 nt, Human
cacugguugcacuua

SEQ ID NO: 1910411 - RNA, 19 nt, Human
cacugggguccagggagca

SEQ ID NO: 1910412 - RNA, 22 nt, Human
cacugguucuucuuggucucag

SEQ ID NO: 1910413 - RNA, 12 nt, Human
cacugcagccuc

SEQ ID NO: 1910414 - RNA, 21 nt, Human
cacugcagaagacaguauggc

SEQ ID NO: 1910415 - RNA, 20 nt, Human
cacugcacuccagccugggu

SEQ ID NO: 1910416 - RNA, 15 nt, Human
cacugcacuccagcc

SEQ ID NO: 1910417 - RNA, 16 nt, Human
cacugcacuccagccu

SEQ ID NO: 1910418 - RNA, 18 nt, Human
cacugcacuccagccugg

SEQ ID NO: 1910419 - RNA, 19 nt, Human
cacugcacuccagccuggg

SEQ ID NO: 1910420 - RNA, 19 nt, Human
cacugcacuauagccuagg

SEQ ID NO: 1910421 - RNA, 13 nt, Human
cacugcagccuca

SEQ ID NO: 1910422 - RNA, 16 nt, Human
cacugcauaccaaccu

SEQ ID NO: 1910423 - RNA, 16 nt, Human
cacugcauguuuguga

SEQ ID NO: 1910424 - RNA, 18 nt, Human
cacugggagaaaugaaaa

SEQ ID NO: 1910425 - RNA, 14 nt, Human
cacuggggccuaca

SEQ ID NO: 1910426 - RNA, 16 nt, Human
cacuggggccuacagc

SEQ ID NO: 1910427 - RNA, 13 nt, Human
cacugggaaacag

SEQ ID NO: 1910428 - RNA, 18 nt, Human
cacugggaaacagaggcu

SEQ ID NO: 1910429 - RNA, 21 nt, Human
caagcuaauaaaauaucauuc

SEQ ID NO: 1910430 - RNA, 19 nt, Human
caagcuaauaaaauaucau

SEQ ID NO: 1910431 - RNA, 17 nt, Human
caagcuaauaaaauauc

SEQ ID NO: 1910432 - RNA, 16 nt, Human
caagcuaauaaaauau

SEQ ID NO: 1910433 - RNA, 22 nt, Human
caagcuaauaaaauaucauuca

SEQ ID NO: 1910434 - RNA, 23 nt, Human
caagcuaauaaaauaucauucag

SEQ ID NO: 1910435 - RNA, 21 nt, Human
caagcucagaggcgcacugug

SEQ ID NO: 1910436 - RNA, 13 nt, Human
caagcucugcucc

SEQ ID NO: 1910437 - RNA, 12 nt, Human
caagcuccaagc

SEQ ID NO: 1910438 - RNA, 14 nt, Human
caagcucugcuccu

SEQ ID NO: 1910439 - RNA, 13 nt, Human
caagcugcacccu

SEQ ID NO: 1910440 - RNA, 14 nt, Human
caagcugcacccuc

SEQ ID NO: 1910441 - RNA, 18 nt, Human
caagcugcacccucaggc

SEQ ID NO: 1910442 - RNA, 20 nt, Human
caagcugcacccucaggcag

SEQ ID NO: 1910443 - RNA, 17 nt, Human
caaguccacaguggaac

SEQ ID NO: 1910444 - RNA, 14 nt, Human
caagucaaauuaau

SEQ ID NO: 1910445 - RNA, 15 nt, Human
caagucaaauuaaua

SEQ ID NO: 1910446 - RNA, 16 nt, Human
caagucaaauuaauaa

SEQ ID NO: 1910447 - RNA, 13 nt, Human
caagucaagugaa

SEQ ID NO: 1910448 - RNA, 17 nt, Human
caagucaagugaaaaag

SEQ ID NO: 1910449 - RNA, 17 nt, Human
caaggccaaaggaagca

SEQ ID NO: 1910450 - RNA, 18 nt, Human
caaggccaaaggaagcac

SEQ ID NO: 1910451 - RNA, 15 nt, Human
caaggccaaaggaag

SEQ ID NO: 1910452 - RNA, 16 nt, Human
caaggccaaaggaagc

SEQ ID NO: 1910453 - RNA, 19 nt, Human
caauaaagcagcguuucua

SEQ ID NO: 1910454 - RNA, 14 nt, Human
caauaaagcauuua

SEQ ID NO: 1910455 - RNA, 15 nt, Human
caauaaagcauuuau

SEQ ID NO: 1910456 - RNA, 16 nt, Human
caauaaagcauuuaua

SEQ ID NO: 1910457 - RNA, 19 nt, Human
caauaaagcauuuauaaau

SEQ ID NO: 1910458 - RNA, 13 nt, Human
cacacaucaggag

SEQ ID NO: 1910459 - RNA, 20 nt, Human
cacacaugagcaucaggcca

SEQ ID NO: 1910460 - RNA, 23 nt, Human
cacacagugagucgaggacaggg

SEQ ID NO: 1910461 - RNA, 21 nt, Human
cacacagugagucgaggacag

SEQ ID NO: 1910462 - RNA, 15 nt, Human
cacacauacacacac

SEQ ID NO: 1910463 - RNA, 23 nt, Human
cacacaguauuacuucugcuaca

SEQ ID NO: 1910464 - RNA, 20 nt, Human
cacacaguauuacuucugcu

SEQ ID NO: 1910465 - RNA, 18 nt, Human
cacacagugagucgagga

SEQ ID NO: 1910466 - RNA, 12 nt, Human
cacacagggcag

SEQ ID NO: 1910467 - RNA, 21 nt, Human
cacagacauacuaaccagcag

SEQ ID NO: 1910468 - RNA, 19 nt, Human
cacagacauacuaaccagc

SEQ ID NO: 1910469 - RNA, 11 nt, Human
cacagccucug

SEQ ID NO: 1910470 - RNA, 13 nt, Human
cacagacccugcc

SEQ ID NO: 1910471 - RNA, 23 nt, Human
cacagaaaauggaagacagcucu

SEQ ID NO: 1910472 - RNA, 19 nt, Human
cacagaaaauucuucucca

SEQ ID NO: 1910473 - RNA, 18 nt, Human
cacagacauacuaaccag

SEQ ID NO: 1910474 - RNA, 21 nt, Human
cacacaugagcaucaggccag

SEQ ID NO: 1910475 - RNA, 22 nt, Human
cacacaugagcaucaggccagg

SEQ ID NO: 1910476 - RNA, 18 nt, Human
cacagaaaauggaagaca

SEQ ID NO: 1910477 - RNA, 19 nt, Human
cacagaaaauggaagacag

SEQ ID NO: 1910478 - RNA, 20 nt, Human
cacagaaaauggaagacagc

SEQ ID NO: 1910479 - RNA, 22 nt, Human
cacagaaaauggaagacagcuc

SEQ ID NO: 1910480 - RNA, 21 nt, Human
cacaguauuacuucugcuaca

SEQ ID NO: 1910481 - RNA, 20 nt, Human
cacaguauuacuucugcuac

SEQ ID NO: 1910482 - RNA, 19 nt, Human
cacaggggaaaagaggagu

SEQ ID NO: 1910483 - RNA, 23 nt, Human
cacaggccugagauuucaucugc

SEQ ID NO: 1910484 - RNA, 22 nt, Human
cacaggccugagauuucaucug

SEQ ID NO: 1910485 - RNA, 18 nt, Human
cacaggucuuuccuaagg

SEQ ID NO: 1910486 - RNA, 20 nt, Human
cacaggucuuuccuaaggcu

SEQ ID NO: 1910487 - RNA, 17 nt, Human
cacaggggaaaagagga

SEQ ID NO: 1910488 - RNA, 18 nt, Human
cacaggggaaaagaggag

SEQ ID NO: 1910489 - RNA, 20 nt, Human
cacaggccugagauuucauc

SEQ ID NO: 1910490 - RNA, 19 nt, Human
cacaggccugagauuucau

SEQ ID NO: 1910491 - RNA, 15 nt, Human
cacaggccugagauu

SEQ ID NO: 1910492 - RNA, 14 nt, Human
cacaggccugagau

SEQ ID NO: 1910493 - RNA, 13 nt, Human
cacaggccugaga

SEQ ID NO: 1910494 - RNA, 19 nt, Human
cacagcgcuggccgggacc

SEQ ID NO: 1910495 - RNA, 22 nt, Human
cacagcgcuggccgggaccccg

SEQ ID NO: 1910496 - RNA, 15 nt, Human
caauucuugccaaau

SEQ ID NO: 1910497 - RNA, 12 nt, Human
caauggcagccu

SEQ ID NO: 1910498 - RNA, 11 nt, Human
caauggcagcc

SEQ ID NO: 1910499 - RNA, 14 nt, Human
caauggcagaugua

SEQ ID NO: 1910500 - RNA, 13 nt, Human
caauuuaaagcaa

SEQ ID NO: 1910501 - RNA, 17 nt, Human
cacaagagcccaggccu

SEQ ID NO: 1910502 - RNA, 17 nt, Human
cacaagcuccaagcucc

SEQ ID NO: 1910503 - RNA, 23 nt, Human
cacaagcuccaagcucccaggca

SEQ ID NO: 1910504 - RNA, 17 nt, Human
cacaagcugcacccuca

SEQ ID NO: 1910505 - RNA, 23 nt, Human
cacaagcugcacccucaggcagg

SEQ ID NO: 1910506 - RNA, 16 nt, Human
cacaagagcccaggcc

SEQ ID NO: 1910507 - RNA, 13 nt, Human
cacaagcuccaag

SEQ ID NO: 1910508 - RNA, 14 nt, Human
cacaagcuccaagc

SEQ ID NO: 1910509 - RNA, 15 nt, Human
cacaagcuccaagcu

SEQ ID NO: 1910510 - RNA, 14 nt, Human
cacaagagcccagg

SEQ ID NO: 1910511 - RNA, 20 nt, Human
cacacagcucuguccuggga

SEQ ID NO: 1910512 - RNA, 17 nt, Human
cacacagcucuguccug

SEQ ID NO: 1910513 - RNA, 15 nt, Human
cauagccaggaaacu

SEQ ID NO: 1910514 - RNA, 15 nt, Human
cauagcaugacauuu

SEQ ID NO: 1910515 - RNA, 17 nt, Human
cauagcaugacauuucu

SEQ ID NO: 1910516 - RNA, 18 nt, Human
cauagcaugacauuucuu

SEQ ID NO: 1910517 - RNA, 21 nt, Human
cauaaugcgugcauaccacuu

SEQ ID NO: 1910518 - RNA, 15 nt, Human
cauacaauuccaaac

SEQ ID NO: 1910519 - RNA, 16 nt, Human
cauacaacacaaagag

SEQ ID NO: 1910520 - RNA, 15 nt, Human
cauacaacacaaaga

SEQ ID NO: 1910521 - RNA, 17 nt, Human
cauacaacacaaagaga

SEQ ID NO: 1910522 - RNA, 21 nt, Human
cauauuaccacagacauacua

SEQ ID NO: 1910523 - RNA, 20 nt, Human
cauauuaccacagacauacu

SEQ ID NO: 1910524 - RNA, 17 nt, Human
cauauuaccacagacau

SEQ ID NO: 1910525 - RNA, 23 nt, Human
cauaggacucaaaguuucagaga

SEQ ID NO: 1910526 - RNA, 17 nt, Human
cauaggaggcuucuguu

SEQ ID NO: 1910527 - RNA, 17 nt, Human
caguuuggcaaacucuc

SEQ ID NO: 1910528 - RNA, 17 nt, Human
cauaaugcgugcauacc

SEQ ID NO: 1910529 - RNA, 14 nt, Human
cauaaugcgugcau

SEQ ID NO: 1910530 - RNA, 12 nt, Human
caguuuaaagca

SEQ ID NO: 1910531 - RNA, 16 nt, Human
caguuuaaaaaaauug

SEQ ID NO: 1910532 - RNA, 18 nt, Human
caguuuaaaaaaauuggu

SEQ ID NO: 1910533 - RNA, 18 nt, Human
cagucaccccggccaccu

SEQ ID NO: 1910534 - RNA, 19 nt, Human
cauccugugccuccaucag

SEQ ID NO: 1910535 - RNA, 21 nt, Human
caucgaaucuacuaauuccac

SEQ ID NO: 1910536 - RNA, 18 nt, Human
caucugugaaaggaaaga

SEQ ID NO: 1910537 - RNA, 19 nt, Human
caucugugaaaggaaagag

SEQ ID NO: 1910538 - RNA, 21 nt, Human
caucuuagguuggcaaaaagg

SEQ ID NO: 1910539 - RNA, 22 nt, Human
caucuuagguuggcaaaaaggc

SEQ ID NO: 1910540 - RNA, 17 nt, Human
caucccagccccaauga

SEQ ID NO: 1910541 - RNA, 16 nt, Human
caucccagccccaaug

SEQ ID NO: 1910542 - RNA, 13 nt, Human
caucccagcccca

SEQ ID NO: 1910543 - RNA, 14 nt, Human
caucccagccccaa

SEQ ID NO: 1910544 - RNA, 14 nt, Human
caucaggccaggcc

SEQ ID NO: 1910545 - RNA, 20 nt, Human
caucaggccaggcccucugc

SEQ ID NO: 1910546 - RNA, 21 nt, Human
caucaggccaggcccucugcc

SEQ ID NO: 1910547 - RNA, 22 nt, Human
caucaggccaggcccucugccc

SEQ ID NO: 1910548 - RNA, 23 nt, Human
caucaggccaggcccucugccca

SEQ ID NO: 1910549 - RNA, 23 nt, Human
cauccuggcacccggccccugcu

SEQ ID NO: 1910550 - RNA, 18 nt, Human
caucagcacgauuucugu

SEQ ID NO: 1910551 - RNA, 17 nt, Human
caucagcacgauuucug

SEQ ID NO: 1910552 - RNA, 13 nt, Human
caucaggccaggc

SEQ ID NO: 1910553 - RNA, 19 nt, Human
caucagcacgauuucuguu

SEQ ID NO: 1910554 - RNA, 22 nt, Human
caugcaaggucauuuuuuuuaa

SEQ ID NO: 1910555 - RNA, 16 nt, Human
caugauuuacagagaa

SEQ ID NO: 1910556 - RNA, 18 nt, Human
caugcaaggucauuuuuu

SEQ ID NO: 1910557 - RNA, 17 nt, Human
caugcaaggucauuuuu

SEQ ID NO: 1910558 - RNA, 14 nt, Human
caugauuccuuccu

SEQ ID NO: 1910559 - RNA, 16 nt, Human
caugauuccuuccugu

SEQ ID NO: 1910560 - RNA, 19 nt, Human
caugauuccuuccuguucu

SEQ ID NO: 1910561 - RNA, 14 nt, Human
caugauucuauuua

SEQ ID NO: 1910562 - RNA, 19 nt, Human
caugcugcuggacaguauc

SEQ ID NO: 1910563 - RNA, 22 nt, Human
cauggccuuugcuugaaagaaa

SEQ ID NO: 1910564 - RNA, 19 nt, Human
cauggccuuugcuugaaag

SEQ ID NO: 1910565 - RNA, 16 nt, Human
caugcugcccugugag

SEQ ID NO: 1910566 - RNA, 18 nt, Human
caugcugcccugugagua

SEQ ID NO: 1910567 - RNA, 17 nt, Human
caugacacgaauauugc

SEQ ID NO: 1910568 - RNA, 18 nt, Human
caugacacgaauauugcu

SEQ ID NO: 1910569 - RNA, 13 nt, Human
caugacauuucuu

SEQ ID NO: 1910570 - RNA, 12 nt, Human
caugaccagcaa

SEQ ID NO: 1910571 - RNA, 15 nt, Human
caugaccagcaaaua

SEQ ID NO: 1910572 - RNA, 14 nt, Human
caugaauuugugaa

SEQ ID NO: 1910573 - RNA, 14 nt, Human
caugacacgaauau

SEQ ID NO: 1910574 - RNA, 23 nt, Human
ccaccuacuuuucuuuccucaga

SEQ ID NO: 1910575 - RNA, 15 nt, Human
ccaccuuggcucaag

SEQ ID NO: 1910576 - RNA, 14 nt, Human
ccaccuuggcucaa

SEQ ID NO: 1910577 - RNA, 19 nt, Human
ccaccgcagacaggaccag

SEQ ID NO: 1910578 - RNA, 18 nt, Human
ccaccgcagacaggacca

SEQ ID NO: 1910579 - RNA, 13 nt, Human
ccacccugcucuc

SEQ ID NO: 1910580 - RNA, 18 nt, Human
ccaccaucaccagacagg

SEQ ID NO: 1910581 - RNA, 20 nt, Human
ccaccaucaagccaccaaca

SEQ ID NO: 1910582 - RNA, 14 nt, Human
ccaccgcagacagg

SEQ ID NO: 1910583 - RNA, 17 nt, Human
ccaccgcagacaggacc

SEQ ID NO: 1910584 - RNA, 20 nt, Human
ccacccuggccgaguccaag

SEQ ID NO: 1910585 - RNA, 21 nt, Human
ccacccuggccgaguccaagc

SEQ ID NO: 1910586 - RNA, 22 nt, Human
ccacccuggccgaguccaagcu

SEQ ID NO: 1910587 - RNA, 13 nt, Human
ccacccugggacc

SEQ ID NO: 1910588 - RNA, 12 nt, Human
ccacccugggac

SEQ ID NO: 1910589 - RNA, 23 nt, Human
ccacagaaaagaaaguucaugcu

SEQ ID NO: 1910590 - RNA, 13 nt, Human
ccaccagaagccc

SEQ ID NO: 1910591 - RNA, 12 nt, Human
ccaccagaagcc

SEQ ID NO: 1910592 - RNA, 11 nt, Human
ccaccagaagc

SEQ ID NO: 1910593 - RNA, 16 nt, Human
ccaccaucaagccacc

SEQ ID NO: 1910594 - RNA, 17 nt, Human
ccaccaucaagccacca

SEQ ID NO: 1910595 - RNA, 14 nt, Human
ccaccaggaaccuc

SEQ ID NO: 1910596 - RNA, 16 nt, Human
ccaccaggaaccucuu

SEQ ID NO: 1910597 - RNA, 18 nt, Human
ccaccaggaaccucuuca

SEQ ID NO: 1910598 - RNA, 18 nt, Human
ccaccagaagcccagaau

SEQ ID NO: 1910599 - RNA, 16 nt, Human
ccaccagaagcccaga

SEQ ID NO: 1910600 - RNA, 15 nt, Human
ccaccagaagcccag

SEQ ID NO: 1910601 - RNA, 14 nt, Human
ccaccagaagccca

SEQ ID NO: 1910602 - RNA, 19 nt, Human
ccaaauuaucaagcuaaua

SEQ ID NO: 1910603 - RNA, 23 nt, Human
ccaacuuguauuaaagacagagg

SEQ ID NO: 1910604 - RNA, 22 nt, Human
ccaaauuaucaagcuaauaaaa

SEQ ID NO: 1910605 - RNA, 18 nt, Human
ccaaauuaucaagcuaau

SEQ ID NO: 1910606 - RNA, 12 nt, Human
ccaaauuaagag

SEQ ID NO: 1910607 - RNA, 22 nt, Human
ccaaaugagggucuugguucca

SEQ ID NO: 1910608 - RNA, 22 nt, Human
ccaaagugguauagaaaugcug

SEQ ID NO: 1910609 - RNA, 19 nt, Human
ccaaagugguauagaaaug

SEQ ID NO: 1910610 - RNA, 22 nt, Human
ccaaagugcugggauuacaggg

SEQ ID NO: 1910611 - RNA, 20 nt, Human
ccaagcuggucccacucagu

SEQ ID NO: 1910612 - RNA, 23 nt, Human
ccaaugcacuuuguucuggcucu

SEQ ID NO: 1910613 - RNA, 20 nt, Human
ccaaugcacuuuguucuggc

SEQ ID NO: 1910614 - RNA, 22 nt, Human
ccaaugcacuuuguucuggcuc

SEQ ID NO: 1910615 - RNA, 20 nt, Human
ccaauguucucucuucucca

SEQ ID NO: 1910616 - RNA, 13 nt, Human
ccaaugccaaaaa

SEQ ID NO: 1910617 - RNA, 15 nt, Human
cauuucaacuguuug

SEQ ID NO: 1910618 - RNA, 16 nt, Human
cauuucaccccucccu

SEQ ID NO: 1910619 - RNA, 15 nt, Human
cauuucaccccuccc

SEQ ID NO: 1910620 - RNA, 14 nt, Human
cauuucaccccucc

SEQ ID NO: 1910621 - RNA, 13 nt, Human
cauuucaccccuc

SEQ ID NO: 1910622 - RNA, 23 nt, Human
cauuucaccccucccuuucuccc

SEQ ID NO: 1910623 - RNA, 22 nt, Human
cauuucaccccucccuuucucc

SEQ ID NO: 1910624 - RNA, 21 nt, Human
cauuucaccccucccuuucuc

SEQ ID NO: 1910625 - RNA, 20 nt, Human
cauuucaccccucccuuucu

SEQ ID NO: 1910626 - RNA, 19 nt, Human
cauuucaccccucccuuuc

SEQ ID NO: 1910627 - RNA, 18 nt, Human
cauuucaccccucccuuu

SEQ ID NO: 1910628 - RNA, 17 nt, Human
cauuucaccccucccuu

SEQ ID NO: 1910629 - RNA, 16 nt, Human
cauuuauucugcucac

SEQ ID NO: 1910630 - RNA, 23 nt, Human
cauugggaaggggacccccgccc

SEQ ID NO: 1910631 - RNA, 22 nt, Human
cauuggcucuugaacugagcuu

SEQ ID NO: 1910632 - RNA, 20 nt, Human
cauuggcaccuaauccaggc

SEQ ID NO: 1910633 - RNA, 21 nt, Human
cauuggcaccuaauccaggca

SEQ ID NO: 1910634 - RNA, 17 nt, Human
ccaaaaaaugcuugcuu

SEQ ID NO: 1910635 - RNA, 17 nt, Human
ccaaaacucuccucugc

SEQ ID NO: 1910636 - RNA, 16 nt, Human
cauuugguucauuaau

SEQ ID NO: 1910637 - RNA, 20 nt, Human
cauuugguucauuaauucua

SEQ ID NO: 1910638 - RNA, 21 nt, Human
cauuugguucauuaauucuau

SEQ ID NO: 1910639 - RNA, 23 nt, Human
cauuuggugguuucagaaaugug

SEQ ID NO: 1910640 - RNA, 22 nt, Human
cauuuggugguuucagaaaugu

SEQ ID NO: 1910641 - RNA, 21 nt, Human
cauugcggacagccacggcca

SEQ ID NO: 1910642 - RNA, 17 nt, Human
cauugcggacagccacg

SEQ ID NO: 1910643 - RNA, 15 nt, Human
cauugcggacagcca

SEQ ID NO: 1910644 - RNA, 14 nt, Human
cauugcggacagcc

SEQ ID NO: 1910645 - RNA, 18 nt, Human
cauugcugggcuugucug

SEQ ID NO: 1910646 - RNA, 16 nt, Human
cauugcugagccucug

SEQ ID NO: 1910647 - RNA, 17 nt, Human
cauugcugagccucugc

SEQ ID NO: 1910648 - RNA, 18 nt, Human
cauugcugagccucugcu

SEQ ID NO: 1910649 - RNA, 21 nt, Human
cauugcugagccucugcuccc

SEQ ID NO: 1910650 - RNA, 23 nt, Human
cauugcguuugaccuuuuaugua

SEQ ID NO: 1910651 - RNA, 14 nt, Human
cauugcugagccuc

SEQ ID NO: 1910652 - RNA, 15 nt, Human
cauugcugagccucu

SEQ ID NO: 1910653 - RNA, 13 nt, Human
cauucucauugaa

SEQ ID NO: 1910654 - RNA, 18 nt, Human
cauuaucuagauacugua

SEQ ID NO: 1910655 - RNA, 23 nt, Human
cauuaugaugugggucaaggaau

SEQ ID NO: 1910656 - RNA, 22 nt, Human
cauuaugaugugggucaaggaa

SEQ ID NO: 1910657 - RNA, 16 nt, Human
cauucuccuuguguua

SEQ ID NO: 1910658 - RNA, 12 nt, Human
cauucuccauuu

SEQ ID NO: 1910659 - RNA, 14 nt, Human
cauucuccacagca

SEQ ID NO: 1910660 - RNA, 17 nt, Human
cauucuccauuuguuau

SEQ ID NO: 1910661 - RNA, 15 nt, Human
cauguucucugagga

SEQ ID NO: 1910662 - RNA, 17 nt, Human
cauuaucuagauacugu

SEQ ID NO: 1910663 - RNA, 16 nt, Human
cauuaucuagauacug

SEQ ID NO: 1910664 - RNA, 12 nt, Human
cauuaucuagau

SEQ ID NO: 1910665 - RNA, 15 nt, Human
cauuaggauggcuag

SEQ ID NO: 1910666 - RNA, 22 nt, Human
cauggcugccaaugggagcuca

SEQ ID NO: 1910667 - RNA, 22 nt, Human
cauggcuggagcuagaauuuga

SEQ ID NO: 1910668 - RNA, 13 nt, Human
cagccagaggcac

SEQ ID NO: 1910669 - RNA, 16 nt, Human
cagcauauucaggaag

SEQ ID NO: 1910670 - RNA, 17 nt, Human
cagcauauucaggaagc

SEQ ID NO: 1910671 - RNA, 18 nt, Human
cagcauauucaggaagcu

SEQ ID NO: 1910672 - RNA, 17 nt, Human
cagcacugaggaagaac

SEQ ID NO: 1910673 - RNA, 15 nt, Human
cagcacugaggaaga

SEQ ID NO: 1910674 - RNA, 13 nt, Human
cagcacugaggaa

SEQ ID NO: 1910675 - RNA, 12 nt, Human
cagcacugagga

SEQ ID NO: 1910676 - RNA, 11 nt, Human
cagcacugagg

SEQ ID NO: 1910677 - RNA, 21 nt, Human
cagauugcaacaggcugggcu

SEQ ID NO: 1910678 - RNA, 17 nt, Human
cagauuggcucacacug

SEQ ID NO: 1910679 - RNA, 20 nt, Human
cagauuggcucacacugaga

SEQ ID NO: 1910680 - RNA, 18 nt, Human
cagauuggcucacacuga

SEQ ID NO: 1910681 - RNA, 15 nt, Human
cagauuucacucucc

SEQ ID NO: 1910682 - RNA, 16 nt, Human
cagauuucacucuccu

SEQ ID NO: 1910683 - RNA, 18 nt, Human
cagauuucacucuccuug

SEQ ID NO: 1910684 - RNA, 17 nt, Human
cagcccccacauccugu

SEQ ID NO: 1910685 - RNA, 24 nt, Human
cagccccauucugccugcccaggc

SEQ ID NO: 1910686 - RNA, 23 nt, Human
cagccccauucugccugcccagg

SEQ ID NO: 1910687 - RNA, 22 nt, Human
cagccccauucugccugcccag

SEQ ID NO: 1910688 - RNA, 20 nt, Human
cagccccauucugccugccc

SEQ ID NO: 1910689 - RNA, 19 nt, Human
cagccccauucugccugcc

SEQ ID NO: 1910690 - RNA, 19 nt, Human
cagccccgugggguuccuc

SEQ ID NO: 1910691 - RNA, 23 nt, Human
cagccgccaugcuccuggcccac

SEQ ID NO: 1910692 - RNA, 13 nt, Human
cagcccuuagcag

SEQ ID NO: 1910693 - RNA, 23 nt, Human
cagccugagcgacagugagacuc

SEQ ID NO: 1910694 - RNA, 14 nt, Human
cagcggggacagcu

SEQ ID NO: 1910695 - RNA, 20 nt, Human
cagcgggagccucccugccu

SEQ ID NO: 1910696 - RNA, 18 nt, Human
cagcgggagccucccugc

SEQ ID NO: 1910697 - RNA, 23 nt, Human
cagcgggaauggcagcugccacg

SEQ ID NO: 1910698 - RNA, 22 nt, Human
cagcgggaauggcagcugccac

SEQ ID NO: 1910699 - RNA, 16 nt, Human
cagcgggaauggcagc

SEQ ID NO: 1910700 - RNA, 18 nt, Human
cagcggcuggacuuggag

SEQ ID NO: 1910701 - RNA, 16 nt, Human
cagcggcuggacuugg

SEQ ID NO: 1910702 - RNA, 17 nt, Human
cagcggcuggaauuggg

SEQ ID NO: 1910703 - RNA, 17 nt, Human
cagccugccacucaggc

SEQ ID NO: 1910704 - RNA, 16 nt, Human
cagccugccacucagg

SEQ ID NO: 1910705 - RNA, 12 nt, Human
cagccugccacu

SEQ ID NO: 1910706 - RNA, 11 nt, Human
cagccugccac

SEQ ID NO: 1910707 - RNA, 14 nt, Human
cagcguuucuauga

SEQ ID NO: 1910708 - RNA, 19 nt, Human
cagcgggagccucccugcc

SEQ ID NO: 1910709 - RNA, 16 nt, Human
cagcguuucuaugaca

SEQ ID NO: 1910710 - RNA, 19 nt, Human
cagcguuucuaugacacau

SEQ ID NO: 1910711 - RNA, 20 nt, Human
cagagagccuggugcugcug

SEQ ID NO: 1910712 - RNA, 19 nt, Human
cagagagccuggugcugcu

SEQ ID NO: 1910713 - RNA, 22 nt, Human
cagagagaggggagaagccugg

SEQ ID NO: 1910714 - RNA, 23 nt, Human
cagagacuccugcaggcagccag

SEQ ID NO: 1910715 - RNA, 21 nt, Human
cagagacuccugcaggcagcc

SEQ ID NO: 1910716 - RNA, 22 nt, Human
cagagacuccugcaggcagcca

SEQ ID NO: 1910717 - RNA, 20 nt, Human
cagagacuccugcaggcagc

SEQ ID NO: 1910718 - RNA, 14 nt, Human
cagagccugcaguu

SEQ ID NO: 1910719 - RNA, 20 nt, Human
cagagagggugggagugggc

SEQ ID NO: 1910720 - RNA, 22 nt, Human
cagagagggugggagugggccc

SEQ ID NO: 1910721 - RNA, 16 nt, Human
cagagagggugggagu

SEQ ID NO: 1910722 - RNA, 17 nt, Human
cagagcuacacagggga

SEQ ID NO: 1910723 - RNA, 22 nt, Human
cagagcuacacaggggaaaaga

SEQ ID NO: 1910724 - RNA, 9 nt, Human
cagagcugg

SEQ ID NO: 1910725 - RNA, 20 nt, Human
cagagcuacccgcagaguuc

SEQ ID NO: 1910726 - RNA, 16 nt, Human
cagagcugcgggcugg

SEQ ID NO: 1910727 - RNA, 23 nt, Human
cagauacaggaaaagcugcugac

SEQ ID NO: 1910728 - RNA, 22 nt, Human
cagaucauugugaaauuauuca

SEQ ID NO: 1910729 - RNA, 12 nt, Human
cagauccagccu

SEQ ID NO: 1910730 - RNA, 18 nt, Human
cagauccagccugggguc

SEQ ID NO: 1910731 - RNA, 13 nt, Human
cagauccagccug

SEQ ID NO: 1910732 - RNA, 14 nt, Human
cagauccagccugg

SEQ ID NO: 1910733 - RNA, 15 nt, Human
cagauccagccuggg

SEQ ID NO: 1910734 - RNA, 17 nt, Human
cagauccagccuggggu

SEQ ID NO: 1910735 - RNA, 16 nt, Human
cagaucauugugaaau

SEQ ID NO: 1910736 - RNA, 15 nt, Human
caggacaccgggcag

SEQ ID NO: 1910737 - RNA, 13 nt, Human
caggacagaugcc

SEQ ID NO: 1910738 - RNA, 14 nt, Human
caggacagaugcca

SEQ ID NO: 1910739 - RNA, 17 nt, Human
caggacagaugccacac

SEQ ID NO: 1910740 - RNA, 13 nt, Human
caggaccucaggu

SEQ ID NO: 1910741 - RNA, 18 nt, Human
caggaggcaggaccuucg

SEQ ID NO: 1910742 - RNA, 15 nt, Human
caggaggcaggaccu

SEQ ID NO: 1910743 - RNA, 13 nt, Human
caggaccagggau

SEQ ID NO: 1910744 - RNA, 21 nt, Human
caggaccagggauuuccauga

SEQ ID NO: 1910745 - RNA, 17 nt, Human
caggacccugaaggggc

SEQ ID NO: 1910746 - RNA, 18 nt, Human
caggacccugaaggggcc

SEQ ID NO: 1910747 - RNA, 14 nt, Human
caggacaggaaaaa

SEQ ID NO: 1910748 - RNA, 18 nt, Human
caggacaugcgguagcca

SEQ ID NO: 1910749 - RNA, 20 nt, Human
caggacaugcgguagccagc

SEQ ID NO: 1910750 - RNA, 21 nt, Human
caggacaugcgguagccagca

SEQ ID NO: 1910751 - RNA, 22 nt, Human
caggacaugcgguagccagcac

SEQ ID NO: 1910752 - RNA, 23 nt, Human
caggacaugcgguagccagcaca

SEQ ID NO: 1910753 - RNA, 15 nt, Human
caggaccagcucagg

SEQ ID NO: 1910754 - RNA, 16 nt, Human
caggaccagcucagga

SEQ ID NO: 1910755 - RNA, 17 nt, Human
caggaccagcucaggac

SEQ ID NO: 1910756 - RNA, 19 nt, Human
caggaccagcucaggacag

SEQ ID NO: 1910757 - RNA, 20 nt, Human
caggaccagcucaggacaga

SEQ ID NO: 1910758 - RNA, 20 nt, Human
caggcaaugcuggcuguugg

SEQ ID NO: 1910759 - RNA, 19 nt, Human
caggcaaugcuggcuguug

SEQ ID NO: 1910760 - RNA, 12 nt, Human
caggaggccagc

SEQ ID NO: 1910761 - RNA, 13 nt, Human
caggaggccagcc

SEQ ID NO: 1910762 - RNA, 21 nt, Human
caggcaaugcuggcuguuggc

SEQ ID NO: 1910763 - RNA, 13 nt, Human
caggccagcugcu

SEQ ID NO: 1910764 - RNA, 15 nt, Human
caggccagcugcuug

SEQ ID NO: 1910765 - RNA, 13 nt, Human
caggccaggcccu

SEQ ID NO: 1910766 - RNA, 14 nt, Human
caggccaggcccuc

SEQ ID NO: 1910767 - RNA, 15 nt, Human
caggccaggcccucu

SEQ ID NO: 1910768 - RNA, 16 nt, Human
caggccaggcccucug

SEQ ID NO: 1910769 - RNA, 15 nt, Human
caggccagcugccuc

SEQ ID NO: 1910770 - RNA, 19 nt, Human
cagcuguucagcugguuga

SEQ ID NO: 1910771 - RNA, 16 nt, Human
cagcuguucagcuggu

SEQ ID NO: 1910772 - RNA, 15 nt, Human
cagcuguucagcugg

SEQ ID NO: 1910773 - RNA, 17 nt, Human
cagcuuauucacaagac

SEQ ID NO: 1910774 - RNA, 16 nt, Human
cagcuuauucacaaga

SEQ ID NO: 1910775 - RNA, 20 nt, Human
caggaaaagcugcugacagu

SEQ ID NO: 1910776 - RNA, 19 nt, Human
caggaaaagcugcugacag

SEQ ID NO: 1910777 - RNA, 23 nt, Human
caggaaaggcuccaggagcagcc

SEQ ID NO: 1910778 - RNA, 21 nt, Human
caggaaaggcuccaggagcag

SEQ ID NO: 1910779 - RNA, 22 nt, Human
caggaaaggcuccaggagcagc

SEQ ID NO: 1910780 - RNA, 16 nt, Human
cagggaggucauuuug

SEQ ID NO: 1910781 - RNA, 16 nt, Human
cagggaggggaagagg

SEQ ID NO: 1910782 - RNA, 16 nt, Human
cagggagggcuucugc

SEQ ID NO: 1910783 - RNA, 15 nt, Human
cagggcucagcgggg

SEQ ID NO: 1910784 - RNA, 12 nt, Human
cagggcucagcg

SEQ ID NO: 1910785 - RNA, 20 nt, Human
cagggcucagcggggacagc

SEQ ID NO: 1910786 - RNA, 21 nt, Human
cagggcuggacugaggccuga

SEQ ID NO: 1910787 - RNA, 20 nt, Human
cagggcuggacugaggccug

SEQ ID NO: 1910788 - RNA, 15 nt, Human
caggcugggcuucag

SEQ ID NO: 1910789 - RNA, 22 nt, Human
cagggaggacgcucucuggccu

SEQ ID NO: 1910790 - RNA, 14 nt, Human
caggcugggcuuca

SEQ ID NO: 1910791 - RNA, 19 nt, Human
caggcuggcgugcaguggu

SEQ ID NO: 1910792 - RNA, 18 nt, Human
caggcuggcgugcagugg

SEQ ID NO: 1910793 - RNA, 17 nt, Human
caggcuggcgugcagug

SEQ ID NO: 1910794 - RNA, 23 nt, Human
caggccugggggcugggcagagg

SEQ ID NO: 1910795 - RNA, 16 nt, Human
caggcugggagagccu

SEQ ID NO: 1910796 - RNA, 18 nt, Human
caggcugggagagccuuc

SEQ ID NO: 1910797 - RNA, 19 nt, Human
caggcugggagagccuucc

SEQ ID NO: 1910798 - RNA, 20 nt, Human
caggcugggagagccuucca

SEQ ID NO: 1910799 - RNA, 20 nt, Human
caggccugggggcugggcag

SEQ ID NO: 1910800 - RNA, 22 nt, Human
caggccugggggcugggcagag

SEQ ID NO: 1910801 - RNA, 23 nt, Human
cagggcuggacugaggccugagc

SEQ ID NO: 1910802 - RNA, 22 nt, Human
cagggcuggacugaggccugag

SEQ ID NO: 1910803 - RNA, 23 nt, Human
cagguuuuuggucugacccacug

SEQ ID NO: 1910804 - RNA, 19 nt, Human
caguaaaaaaaaaaaaugg

SEQ ID NO: 1910805 - RNA, 20 nt, Human
caggugcugacuucaucucc

SEQ ID NO: 1910806 - RNA, 21 nt, Human
caggugcugacuucaucuccc

SEQ ID NO: 1910807 - RNA, 23 nt, Human
caggugcugacuucaucucccac

SEQ ID NO: 1910808 - RNA, 21 nt, Human
caggguuggccccugcccggc

SEQ ID NO: 1910809 - RNA, 17 nt, Human
caggguuggccccugcc

SEQ ID NO: 1910810 - RNA, 14 nt, Human
caggugcugccauc

SEQ ID NO: 1910811 - RNA, 13 nt, Human
caggugcugccau

SEQ ID NO: 1910812 - RNA, 19 nt, Human
caggguuucaccauguugc

SEQ ID NO: 1910813 - RNA, 18 nt, Human
caguaaaugggggugcau

SEQ ID NO: 1910814 - RNA, 12 nt, Human
caguaaaucuuu

SEQ ID NO: 1910815 - RNA, 20 nt, Human
caguaaaucuuuuacaacug

SEQ ID NO: 1910816 - RNA, 14 nt, Human
caguaaaauagcug

SEQ ID NO: 1910817 - RNA, 20 nt, Human
caguaaaauagcugagggaa

SEQ ID NO: 1910818 - RNA, 20 nt, Human
caguaaaugggggugcauuu

SEQ ID NO: 1910819 - RNA, 19 nt, Human
caguaaaugggggugcauu

SEQ ID NO: 1910820 - RNA, 14 nt, Human
cagucaccccggcc

SEQ ID NO: 1910821 - RNA, 16 nt, Human
cagucaccccggccac

SEQ ID NO: 1910822 - RNA, 17 nt, Human
cagucaccccggccacc

SEQ ID NO: 1910823 - RNA, 15 nt, Human
caguauuugugggga

SEQ ID NO: 1910824 - RNA, 23 nt, Human
cagggucucacucugucgcccag

SEQ ID NO: 1910825 - RNA, 16 nt, Human
caggguuggccccugc

SEQ ID NO: 1910826 - RNA, 15 nt, Human
caggguuggccccug

SEQ ID NO: 1910827 - RNA, 20 nt, Human
cagggugcaguaucaugccc

SEQ ID NO: 1910828 - RNA, 21 nt, Human
cagggucucuaccauccccug

SEQ ID NO: 1910829 - RNA, 23 nt, Human
ccaggaaacucugcauucuagua

SEQ ID NO: 1910830 - RNA, 16 nt, Human
ccagcuuaucucaggg

SEQ ID NO: 1910831 - RNA, 19 nt, Human
ccagcuuaaaggggcuaga

SEQ ID NO: 1910832 - RNA, 17 nt, Human
ccagcuguucagcuggu

SEQ ID NO: 1910833 - RNA, 22 nt, Human
ccagcucaccagccccagugcc

SEQ ID NO: 1910834 - RNA, 16 nt, Human
ccagcuguucagcugg

SEQ ID NO: 1910835 - RNA, 16 nt, Human
ccagcucaccagcccc

SEQ ID NO: 1910836 - RNA, 15 nt, Human
ccagcucaccagccc

SEQ ID NO: 1910837 - RNA, 11 nt, Human
ccagccccugg

SEQ ID NO: 1910838 - RNA, 12 nt, Human
ccagccccugga

SEQ ID NO: 1910839 - RNA, 18 nt, Human
ccagcuacaccuuucucc

SEQ ID NO: 1910840 - RNA, 19 nt, Human
ccagcuacaccuuucuccu

SEQ ID NO: 1910841 - RNA, 20 nt, Human
ccagcuacaccuuucuccuu

SEQ ID NO: 1910842 - RNA, 16 nt, Human
ccaggaaaggcuccag

SEQ ID NO: 1910843 - RNA, 24 nt, Human
ccaggaaccacaccacaucuaagc

SEQ ID NO: 1910844 - RNA, 14 nt, Human
ccaggaaaggcucc

SEQ ID NO: 1910845 - RNA, 15 nt, Human
ccaggaaaggcucca

SEQ ID NO: 1910846 - RNA, 12 nt, Human
ccaggaagccag

SEQ ID NO: 1910847 - RNA, 14 nt, Human
ccaggaagccagca

SEQ ID NO: 1910848 - RNA, 13 nt, Human
ccaggaagccagc

SEQ ID NO: 1910849 - RNA, 13 nt, Human
ccagcaggcucuc

SEQ ID NO: 1910850 - RNA, 15 nt, Human
ccagcaggcucucag

SEQ ID NO: 1910851 - RNA, 19 nt, Human
ccagcagcgccuuucccaa

SEQ ID NO: 1910852 - RNA, 17 nt, Human
ccagcagcgccuuuccc

SEQ ID NO: 1910853 - RNA, 18 nt, Human
ccagcagcgccuuuccca

SEQ ID NO: 1910854 - RNA, 12 nt, Human
ccagcagcgccu

SEQ ID NO: 1910855 - RNA, 16 nt, Human
ccaccuuggcucaagu

SEQ ID NO: 1910856 - RNA, 17 nt, Human
ccagagggccugcaagg

SEQ ID NO: 1910857 - RNA, 18 nt, Human
ccagagggccugcaaggg

SEQ ID NO: 1910858 - RNA, 19 nt, Human
ccagagggccugcaaggga

SEQ ID NO: 1910859 - RNA, 20 nt, Human
ccagagggccugcaagggag

SEQ ID NO: 1910860 - RNA, 13 nt, Human
ccagauccagccu

SEQ ID NO: 1910861 - RNA, 14 nt, Human
ccagauccagccug

SEQ ID NO: 1910862 - RNA, 15 nt, Human
ccagauccagccugg

SEQ ID NO: 1910863 - RNA, 16 nt, Human
ccagauccagccuggg

SEQ ID NO: 1910864 - RNA, 21 nt, Human
ccagaguggggaugacaugca

SEQ ID NO: 1910865 - RNA, 15 nt, Human
ccagaugcaccagcc

SEQ ID NO: 1910866 - RNA, 17 nt, Human
ccagaugcaccagcccu

SEQ ID NO: 1910867 - RNA, 18 nt, Human
ccagaugcaccagcccuu

SEQ ID NO: 1910868 - RNA, 23 nt, Human
ccagaugcaccagcccuuagcag

SEQ ID NO: 1910869 - RNA, 10 nt, Human
ccagggucag

SEQ ID NO: 1910870 - RNA, 17 nt, Human
ccagggucagaaacagg

SEQ ID NO: 1910871 - RNA, 18 nt, Human
ccagggucagaaacagga

SEQ ID NO: 1910872 - RNA, 19 nt, Human
ccagggucagaaacaggac

SEQ ID NO: 1910873 - RNA, 13 nt, Human
ccagggucccugg

SEQ ID NO: 1910874 - RNA, 18 nt, Human
ccaggcuggcgugcagug

SEQ ID NO: 1910875 - RNA, 17 nt, Human
ccaggcuggcgugcagu

SEQ ID NO: 1910876 - RNA, 19 nt, Human
ccaggcuggcgugcagugg

SEQ ID NO: 1910877 - RNA, 22 nt, Human
ccagggcuggacugaggccuga

SEQ ID NO: 1910878 - RNA, 21 nt, Human
ccaggcuccuuuagcgcccag

SEQ ID NO: 1910879 - RNA, 20 nt, Human
ccaggcuccuuuagcgccca

SEQ ID NO: 1910880 - RNA, 19 nt, Human
ccaggggaaaaucagccug

SEQ ID NO: 1910881 - RNA, 21 nt, Human
ccagggcuuacggcccuggcc

SEQ ID NO: 1910882 - RNA, 22 nt, Human
ccagggcuuacggcccuggccu

SEQ ID NO: 1910883 - RNA, 20 nt, Human
ccaggggaaaaucagccugc

SEQ ID NO: 1910884 - RNA, 13 nt, Human
ccaggggugggac

SEQ ID NO: 1910885 - RNA, 23 nt, Human
ccaggggugggacacccugugau

SEQ ID NO: 1910886 - RNA, 19 nt, Human
ccaggggugggacacccug

SEQ ID NO: 1910887 - RNA, 14 nt, Human
ccaggggugggaca

SEQ ID NO: 1910888 - RNA, 17 nt, Human
ccaggggugggacaccc

SEQ ID NO: 1910889 - RNA, 13 nt, Human
ccaggcagaucca

SEQ ID NO: 1910890 - RNA, 15 nt, Human
ccaggcagauccagg

SEQ ID NO: 1910891 - RNA, 16 nt, Human
ccaggcagauccagga

SEQ ID NO: 1910892 - RNA, 17 nt, Human
ccaggcagauccaggac

SEQ ID NO: 1910893 - RNA, 18 nt, Human
ccaggcagauccaggacu

SEQ ID NO: 1910894 - RNA, 19 nt, Human
ccaggcagauccaggacua

SEQ ID NO: 1910895 - RNA, 20 nt, Human
ccauggucggaaaacaugcu

SEQ ID NO: 1910896 - RNA, 14 nt, Human
ccauggugcuuguu

SEQ ID NO: 1910897 - RNA, 23 nt, Human
ccaugagccucagcauccuggca

SEQ ID NO: 1910898 - RNA, 21 nt, Human
ccaugagccucagcauccugg

SEQ ID NO: 1910899 - RNA, 23 nt, Human
ccaguuggucccccuuccaugga

SEQ ID NO: 1910900 - RNA, 23 nt, Human
ccaguuccuuucaaugguuugca

SEQ ID NO: 1910901 - RNA, 22 nt, Human
ccaguuccuuucaaugguuugc

SEQ ID NO: 1910902 - RNA, 21 nt, Human
ccaguuccuuucaaugguuug

SEQ ID NO: 1910903 - RNA, 14 nt, Human
ccaucccagcccca

SEQ ID NO: 1910904 - RNA, 15 nt, Human
ccaucccagccccaa

SEQ ID NO: 1910905 - RNA, 13 nt, Human
ccaucccagcccc

SEQ ID NO: 1910906 - RNA, 14 nt, Human
ccaucccugaaggc

SEQ ID NO: 1910907 - RNA, 15 nt, Human
ccaucccugaaggcc

SEQ ID NO: 1910908 - RNA, 17 nt, Human
ccaucccugaaggcccc

SEQ ID NO: 1910909 - RNA, 20 nt, Human
ccaucccugaaggccccgcc

SEQ ID NO: 1910910 - RNA, 20 nt, Human
ccaguuggguggaugccugg

SEQ ID NO: 1910911 - RNA, 19 nt, Human
ccaguuggguggaugccug

SEQ ID NO: 1910912 - RNA, 17 nt, Human
ccaguuggguggaugcc

SEQ ID NO: 1910913 - RNA, 13 nt, Human
ccaguucacccug

SEQ ID NO: 1910914 - RNA, 15 nt, Human
ccaguucagcuuggg

SEQ ID NO: 1910915 - RNA, 14 nt, Human
cccacccacaugug

SEQ ID NO: 1910916 - RNA, 12 nt, Human
cccacccccacc

SEQ ID NO: 1910917 - RNA, 15 nt, Human
cccacccccacccaa

SEQ ID NO: 1910918 - RNA, 17 nt, Human
cccacccccacccaagg

SEQ ID NO: 1910919 - RNA, 18 nt, Human
cccacccugaaagcccug

SEQ ID NO: 1910920 - RNA, 20 nt, Human
cccacccaagggccuggccu

SEQ ID NO: 1910921 - RNA, 21 nt, Human
cccacccaagggccuggccug

SEQ ID NO: 1910922 - RNA, 22 nt, Human
cccacccaagggccuggccuga

SEQ ID NO: 1910923 - RNA, 14 nt, Human
cccacccugggacc

SEQ ID NO: 1910924 - RNA, 13 nt, Human
cccacugcucugg

SEQ ID NO: 1910925 - RNA, 12 nt, Human
cccacugcucug

SEQ ID NO: 1910926 - RNA, 19 nt, Human
cccacugcuuuuggucugu

SEQ ID NO: 1910927 - RNA, 22 nt, Human
cccacugcuuuuggucugugug

SEQ ID NO: 1910928 - RNA, 22 nt, Human
cccagccacggacgcuggcucc

SEQ ID NO: 1910929 - RNA, 23 nt, Human
cccagcucugguccauagagagc

SEQ ID NO: 1910930 - RNA, 20 nt, Human
cccauauuuguacaccaaua

SEQ ID NO: 1910931 - RNA, 19 nt, Human
cccauauuguaaaacaggu

SEQ ID NO: 1910932 - RNA, 18 nt, Human
cccauauuguaaaacagg

SEQ ID NO: 1910933 - RNA, 15 nt, Human
cccauauuguaaaac

SEQ ID NO: 1910934 - RNA, 22 nt, Human
cccagggcccagagcccagcuc

SEQ ID NO: 1910935 - RNA, 13 nt, Human
cccagggcccaga

SEQ ID NO: 1910936 - RNA, 14 nt, Human
cccagggcccagag

SEQ ID NO: 1910937 - RNA, 15 nt, Human
cccagggcccagagc

SEQ ID NO: 1910938 - RNA, 16 nt, Human
cccagggcccagagcc

SEQ ID NO: 1910939 - RNA, 17 nt, Human
cccagggcccagagccc

SEQ ID NO: 1910940 - RNA, 19 nt, Human
cccagggcccagagcccag

SEQ ID NO: 1910941 - RNA, 20 nt, Human
cccagggcccagagcccagc

SEQ ID NO: 1910942 - RNA, 17 nt, Human
cccaggcuggcgugcag

SEQ ID NO: 1910943 - RNA, 13 nt, Human
cccaggcuggcgu

SEQ ID NO: 1910944 - RNA, 19 nt, Human
cccaggcuggagugcagug

SEQ ID NO: 1910945 - RNA, 16 nt, Human
cccaggaaaggcccag

SEQ ID NO: 1910946 - RNA, 13 nt, Human
cccauccucugua

SEQ ID NO: 1910947 - RNA, 14 nt, Human
cccauccuccagca

SEQ ID NO: 1910948 - RNA, 15 nt, Human
cccauccuccagcag

SEQ ID NO: 1910949 - RNA, 16 nt, Human
cccauccuccagcagg

SEQ ID NO: 1910950 - RNA, 18 nt, Human
cccauccuccagcaggga

SEQ ID NO: 1910951 - RNA, 14 nt, Human
ccccgcuucugccu

SEQ ID NO: 1910952 - RNA, 21 nt, Human
ccccgacgccacagcccagcc

SEQ ID NO: 1910953 - RNA, 18 nt, Human
ccccgacgccacagccca

SEQ ID NO: 1910954 - RNA, 14 nt, Human
ccccgacgccacag

SEQ ID NO: 1910955 - RNA, 23 nt, Human
ccccgaggccuucucugaaggac

SEQ ID NO: 1910956 - RNA, 22 nt, Human
ccccagcaagugagagcugggu

SEQ ID NO: 1910957 - RNA, 16 nt, Human
ccccagcacugaggaa

SEQ ID NO: 1910958 - RNA, 15 nt, Human
ccccagcacugagga

SEQ ID NO: 1910959 - RNA, 13 nt, Human
ccccagcacugag

SEQ ID NO: 1910960 - RNA, 12 nt, Human
ccccagcacuga

SEQ ID NO: 1910961 - RNA, 21 nt, Human
ccccagcaagugagagcuggg

SEQ ID NO: 1910962 - RNA, 22 nt, Human
ccccagagaaagcgcagaugcu

SEQ ID NO: 1910963 - RNA, 23 nt, Human
ccccgacccuugccgucuaccug

SEQ ID NO: 1910964 - RNA, 17 nt, Human
ccccauuucuauuuauu

SEQ ID NO: 1910965 - RNA, 20 nt, Human
ccccauuucuauuuauuuac

SEQ ID NO: 1910966 - RNA, 22 nt, Human
cccccaaauggaaaugggcaga

SEQ ID NO: 1910967 - RNA, 13 nt, Human
ccccauuucuauu

SEQ ID NO: 1910968 - RNA, 21 nt, Human
ccccaucucaugccccuggcu

SEQ ID NO: 1910969 - RNA, 23 nt, Human
ccccaucucaugccccuggcugg

SEQ ID NO: 1910970 - RNA, 23 nt, Human
ccccaucgccagcugaugacuca

SEQ ID NO: 1910971 - RNA, 19 nt, Human
ccccaucgccagcugauga

SEQ ID NO: 1910972 - RNA, 22 nt, Human
ccccaucgccagcugaugacuc

SEQ ID NO: 1910973 - RNA, 22 nt, Human
ccccaaaacucuccucugcugc

SEQ ID NO: 1910974 - RNA, 23 nt, Human
cccauuguggucacaggaaguag

SEQ ID NO: 1910975 - RNA, 22 nt, Human
cccauuguggucacaggaagua

SEQ ID NO: 1910976 - RNA, 15 nt, Human
cccauugucccucug

SEQ ID NO: 1910977 - RNA, 18 nt, Human
cccauugucccucugccc

SEQ ID NO: 1910978 - RNA, 23 nt, Human
ccccaaaacucuccucugcugcu

SEQ ID NO: 1910979 - RNA, 20 nt, Human
cccauugucccucugcccca

SEQ ID NO: 1910980 - RNA, 21 nt, Human
ccccagacuccaccaagccug

SEQ ID NO: 1910981 - RNA, 18 nt, Human
cccuauuagagaagagau

SEQ ID NO: 1910982 - RNA, 23 nt, Human
cccgggaggcagagguugcagug

SEQ ID NO: 1910983 - RNA, 17 nt, Human
cccggccaccugcggug

SEQ ID NO: 1910984 - RNA, 16 nt, Human
cccggcuccaggcucc

SEQ ID NO: 1910985 - RNA, 15 nt, Human
cccggcuccaggcuc

SEQ ID NO: 1910986 - RNA, 14 nt, Human
cccggcuccaggcu

SEQ ID NO: 1910987 - RNA, 13 nt, Human
cccggcuccaggc

SEQ ID NO: 1910988 - RNA, 12 nt, Human
cccggcuccagg

SEQ ID NO: 1910989 - RNA, 11 nt, Human
cccggcuccag

SEQ ID NO: 1910990 - RNA, 13 nt, Human
cccggccaccugc

SEQ ID NO: 1910991 - RNA, 14 nt, Human
cccggccaccugcg

SEQ ID NO: 1910992 - RNA, 14 nt, Human
cccgaauagcuggg

SEQ ID NO: 1910993 - RNA, 20 nt, Human
ccccuuugaugauuaauuca

SEQ ID NO: 1910994 - RNA, 12 nt, Human
ccccuuuugcau

SEQ ID NO: 1910995 - RNA, 21 nt, Human
ccccuuuauguacaggaugcu

SEQ ID NO: 1910996 - RNA, 19 nt, Human
ccugacuuggggagaugga

SEQ ID NO: 1910997 - RNA, 13 nt, Human
ccugacugucucc

SEQ ID NO: 1910998 - RNA, 23 nt, Human
ccugacuuggggagauggaguuc

SEQ ID NO: 1910999 - RNA, 14 nt, Human
ccugacucucagca

SEQ ID NO: 1911000 - RNA, 13 nt, Human
ccucuuggguuca

SEQ ID NO: 1911001 - RNA, 12 nt, Human
ccucuuguaaau

SEQ ID NO: 1911002 - RNA, 13 nt, Human
ccucuuguaaaua

SEQ ID NO: 1911003 - RNA, 14 nt, Human
ccucuuguaaauaa

SEQ ID NO: 1911004 - RNA, 17 nt, Human
ccucuuguaaauaaagc

SEQ ID NO: 1911005 - RNA, 18 nt, Human
ccucuuguaaauaaagcc

SEQ ID NO: 1911006 - RNA, 20 nt, Human
ccucuuguaaauaaagcccu

SEQ ID NO: 1911007 - RNA, 17 nt, Human
ccugacccuguauauag

SEQ ID NO: 1911008 - RNA, 19 nt, Human
ccugacccuguauauagcc

SEQ ID NO: 1911009 - RNA, 16 nt, Human
ccugaccucccucuaa

SEQ ID NO: 1911010 - RNA, 19 nt, Human
ccucuugagccuugaacuu

SEQ ID NO: 1911011 - RNA, 13 nt, Human
ccucuugagccuu

SEQ ID NO: 1911012 - RNA, 18 nt, Human
ccugagaccacagagaga

SEQ ID NO: 1911013 - RNA, 12 nt, Human
ccugagaccaca

SEQ ID NO: 1911014 - RNA, 17 nt, Human
ccugagaucucugcagg

SEQ ID NO: 1911015 - RNA, 22 nt, Human
ccugaguaaaaaagcugugugc

SEQ ID NO: 1911016 - RNA, 22 nt, Human
ccugcacuugcagacucuacag

SEQ ID NO: 1911017 - RNA, 19 nt, Human
ccugaguagcuggauuaca

SEQ ID NO: 1911018 - RNA, 15 nt, Human
ccugaguagcuggau

SEQ ID NO: 1911019 - RNA, 20 nt, Human
ccugaguagcuggauuacag

SEQ ID NO: 1911020 - RNA, 16 nt, Human
ccugcagaauuugggu

SEQ ID NO: 1911021 - RNA, 22 nt, Human
ccucugccugaagucacacagu

SEQ ID NO: 1911022 - RNA, 14 nt, Human
ccucugcuccccag

SEQ ID NO: 1911023 - RNA, 23 nt, Human
ccucucugcaggucccuaauaaa

SEQ ID NO: 1911024 - RNA, 21 nt, Human
ccucucugcaggucccuaaua

SEQ ID NO: 1911025 - RNA, 22 nt, Human
ccucucugcaggucccuaauaa

SEQ ID NO: 1911026 - RNA, 13 nt, Human
ccucugcugcugg

SEQ ID NO: 1911027 - RNA, 14 nt, Human
ccucugcugcuggc

SEQ ID NO: 1911028 - RNA, 15 nt, Human
ccucugcugcuggcu

SEQ ID NO: 1911029 - RNA, 16 nt, Human
ccucugcugcuggcug

SEQ ID NO: 1911030 - RNA, 17 nt, Human
ccucugcugcuggcugg

SEQ ID NO: 1911031 - RNA, 18 nt, Human
ccucugcugcuggcuggu

SEQ ID NO: 1911032 - RNA, 13 nt, Human
ccucucugcaggu

SEQ ID NO: 1911033 - RNA, 15 nt, Human
ccucucugcaggucc

SEQ ID NO: 1911034 - RNA, 20 nt, Human
ccucucugcaggucccuaau

SEQ ID NO: 1911035 - RNA, 12 nt, Human
ccucucugcacc

SEQ ID NO: 1911036 - RNA, 14 nt, Human
ccucucucaggcca

SEQ ID NO: 1911037 - RNA, 13 nt, Human
ccucucucacucc

SEQ ID NO: 1911038 - RNA, 14 nt, Human
ccucucucacuccu

SEQ ID NO: 1911039 - RNA, 15 nt, Human
ccucucucacuccuu

SEQ ID NO: 1911040 - RNA, 17 nt, Human
ccucucucacuccuuga

SEQ ID NO: 1911041 - RNA, 12 nt, Human
ccucucucaggc

SEQ ID NO: 1911042 - RNA, 18 nt, Human
ccuggcacccggccccug

SEQ ID NO: 1911043 - RNA, 15 nt, Human
ccuggaguucugguu

SEQ ID NO: 1911044 - RNA, 22 nt, Human
ccuggagguggcugagccccug

SEQ ID NO: 1911045 - RNA, 23 nt, Human
ccuggagguggcugagccccugu

SEQ ID NO: 1911046 - RNA, 16 nt, Human
ccuggaguucugguuc

SEQ ID NO: 1911047 - RNA, 17 nt, Human
ccuggaguucugguucc

SEQ ID NO: 1911048 - RNA, 14 nt, Human
ccuggagguggcug

SEQ ID NO: 1911049 - RNA, 21 nt, Human
ccuggagguggcugagccccu

SEQ ID NO: 1911050 - RNA, 19 nt, Human
ccuggaugcagccucacag

SEQ ID NO: 1911051 - RNA, 14 nt, Human
ccuggaugcagccu

SEQ ID NO: 1911052 - RNA, 17 nt, Human
ccuggaugcagccucac

SEQ ID NO: 1911053 - RNA, 13 nt, Human
ccuggaugcagcc

SEQ ID NO: 1911054 - RNA, 16 nt, Human
ccugcccaggccccug

SEQ ID NO: 1911055 - RNA, 15 nt, Human
ccugcccaggccccu

SEQ ID NO: 1911056 - RNA, 14 nt, Human
ccugcccaggcccc

SEQ ID NO: 1911057 - RNA, 12 nt, Human
ccugcugggugu

SEQ ID NO: 1911058 - RNA, 16 nt, Human
ccugcccauuggagag

SEQ ID NO: 1911059 - RNA, 21 nt, Human
ccugccccaacucuccccuga

SEQ ID NO: 1911060 - RNA, 21 nt, Human
ccugcuggguguggcgcagca

SEQ ID NO: 1911061 - RNA, 14 nt, Human
ccugcugggugugg

SEQ ID NO: 1911062 - RNA, 20 nt, Human
ccugcuggguguggcgcagc

SEQ ID NO: 1911063 - RNA, 15 nt, Human
ccuggaggagcagag

SEQ ID NO: 1911064 - RNA, 12 nt, Human
ccuggaggccca

SEQ ID NO: 1911065 - RNA, 13 nt, Human
ccuggaggcccag

SEQ ID NO: 1911066 - RNA, 14 nt, Human
ccuggaggcccagu

SEQ ID NO: 1911067 - RNA, 16 nt, Human
ccuggaggcccaguuc

SEQ ID NO: 1911068 - RNA, 12 nt, Human
ccuggccucugc

SEQ ID NO: 1911069 - RNA, 18 nt, Human
ccuggccgaguccaagcu

SEQ ID NO: 1911070 - RNA, 19 nt, Human
ccuggccgaguccaagcug

SEQ ID NO: 1911071 - RNA, 16 nt, Human
ccuggccucugcacuc

SEQ ID NO: 1911072 - RNA, 13 nt, Human
ccuggccugagcu

SEQ ID NO: 1911073 - RNA, 14 nt, Human
ccuggccucugcac

SEQ ID NO: 1911074 - RNA, 15 nt, Human
ccuggccucugcacu

SEQ ID NO: 1911075 - RNA, 20 nt, Human
ccgccagggagaccuggaca

SEQ ID NO: 1911076 - RNA, 21 nt, Human
ccgccaaaagcugcucaggga

SEQ ID NO: 1911077 - RNA, 16 nt, Human
ccgacccuugccgucu

SEQ ID NO: 1911078 - RNA, 17 nt, Human
ccgccaaggcuggggga

SEQ ID NO: 1911079 - RNA, 20 nt, Human
ccgaauguugagguggacuc

SEQ ID NO: 1911080 - RNA, 20 nt, Human
ccgaauagcugggacuacag

SEQ ID NO: 1911081 - RNA, 13 nt, Human
cccuucugcuacu

SEQ ID NO: 1911082 - RNA, 14 nt, Human
cccuucugcucagc

SEQ ID NO: 1911083 - RNA, 23 nt, Human
cccuucugcucagcucugggcca

SEQ ID NO: 1911084 - RNA, 16 nt, Human
ccgccaugcuccuggc

SEQ ID NO: 1911085 - RNA, 20 nt, Human
ccgcccaggcuuagucacug

SEQ ID NO: 1911086 - RNA, 11 nt, Human
ccgcccccugc

SEQ ID NO: 1911087 - RNA, 16 nt, Human
ccgcccccugcccucc

SEQ ID NO: 1911088 - RNA, 17 nt, Human
ccgcccccugcccuccc

SEQ ID NO: 1911089 - RNA, 18 nt, Human
cccuucgcuccugugucu

SEQ ID NO: 1911090 - RNA, 16 nt, Human
cccuucgcuccugugu

SEQ ID NO: 1911091 - RNA, 16 nt, Human
cccuucuaccuuccug

SEQ ID NO: 1911092 - RNA, 21 nt, Human
cccuucugacccaugcugccc

SEQ ID NO: 1911093 - RNA, 22 nt, Human
cccuucugacccaugcugcccu

SEQ ID NO: 1911094 - RNA, 23 nt, Human
cccuucugacccaugcugcccug

SEQ ID NO: 1911095 - RNA, 24 nt, Human
cccugugccuuggugugcuguauc

SEQ ID NO: 1911096 - RNA, 14 nt, Human
cccuggcagccccu

SEQ ID NO: 1911097 - RNA, 16 nt, Human
cccuggcagccccugu

SEQ ID NO: 1911098 - RNA, 13 nt, Human
cccuggccccagg

SEQ ID NO: 1911099 - RNA, 14 nt, Human
cccuggccccagga

SEQ ID NO: 1911100 - RNA, 21 nt, Human
cccuggccuugggcccucugg

SEQ ID NO: 1911101 - RNA, 22 nt, Human
cccuggccuugggcccucuggu

SEQ ID NO: 1911102 - RNA, 11 nt, Human
cccuggccuga

SEQ ID NO: 1911103 - RNA, 16 nt, Human
cccuggcuccaggcca

SEQ ID NO: 1911104 - RNA, 13 nt, Human
cccuggcuccagg

SEQ ID NO: 1911105 - RNA, 23 nt, Human
cccuggcugggacguggcucagc

SEQ ID NO: 1911106 - RNA, 13 nt, Human
cccugcccugugg

SEQ ID NO: 1911107 - RNA, 12 nt, Human
cccugcccugug

SEQ ID NO: 1911108 - RNA, 11 nt, Human
cccugcccugu

SEQ ID NO: 1911109 - RNA, 22 nt, Human
cccucaccccugguucucaucu

SEQ ID NO: 1911110 - RNA, 20 nt, Human
cccucaccccugguucucau

SEQ ID NO: 1911111 - RNA, 13 nt, Human
cccucaccccugg

SEQ ID NO: 1911112 - RNA, 14 nt, Human
cccugcccuguggg

SEQ ID NO: 1911113 - RNA, 15 nt, Human
cccugcccugugggc

SEQ ID NO: 1911114 - RNA, 16 nt, Human
cccugcccugugggcc

SEQ ID NO: 1911115 - RNA, 20 nt, Human
cccugcccugugggccccca

SEQ ID NO: 1911116 - RNA, 21 nt, Human
cccugcccugugggcccccaa

SEQ ID NO: 1911117 - RNA, 12 nt, Human
cccuggcagccc

SEQ ID NO: 1911118 - RNA, 13 nt, Human
cccuggcagcccc

SEQ ID NO: 1911119 - RNA, 17 nt, Human
ccucaagaugaaggcaa

SEQ ID NO: 1911120 - RNA, 15 nt, Human
ccucaacucuccucc

SEQ ID NO: 1911121 - RNA, 15 nt, Human
ccucaagagaaggca

SEQ ID NO: 1911122 - RNA, 22 nt, Human
ccucagccucccaaagugcugg

SEQ ID NO: 1911123 - RNA, 11 nt, Human
ccucagccucc

SEQ ID NO: 1911124 - RNA, 15 nt, Human
ccuauuuuaauaaac

SEQ ID NO: 1911125 - RNA, 18 nt, Human
ccuauuuccauucaacaa

SEQ ID NO: 1911126 - RNA, 12 nt, Human
ccuauuucucuu

SEQ ID NO: 1911127 - RNA, 12 nt, Human
ccucaaccucuu

SEQ ID NO: 1911128 - RNA, 17 nt, Human
ccucaaccucuucuggc

SEQ ID NO: 1911129 - RNA, 20 nt, Human
ccucaaccucuucuggcuca

SEQ ID NO: 1911130 - RNA, 18 nt, Human
ccucaacguauuguuucg

SEQ ID NO: 1911131 - RNA, 13 nt, Human
ccuauuucucuuu

SEQ ID NO: 1911132 - RNA, 15 nt, Human
ccuauuucucuuucu

SEQ ID NO: 1911133 - RNA, 16 nt, Human
ccuauuucucuuucuu

SEQ ID NO: 1911134 - RNA, 16 nt, Human
ccucaaccuccugggc

SEQ ID NO: 1911135 - RNA, 22 nt, Human
ccucagccucccgaauagcugg

SEQ ID NO: 1911136 - RNA, 23 nt, Human
ccucagccucccaaagugcuggg

SEQ ID NO: 1911137 - RNA, 22 nt, Human
ccucagccucccaaguagcugg

SEQ ID NO: 1911138 - RNA, 15 nt, Human
ccucauguccacugg

SEQ ID NO: 1911139 - RNA, 13 nt, Human
ccucauguucuua

SEQ ID NO: 1911140 - RNA, 14 nt, Human
ccucagccuccuga

SEQ ID NO: 1911141 - RNA, 20 nt, Human
ccucauguccacugguucuu

SEQ ID NO: 1911142 - RNA, 19 nt, Human
ccucauguucuuaauucuu

SEQ ID NO: 1911143 - RNA, 18 nt, Human
ccucauuagcauuuugcu

SEQ ID NO: 1911144 - RNA, 21 nt, Human
ccuccaaguccacaguggaac

SEQ ID NO: 1911145 - RNA, 18 nt, Human
ccuccaaguccacagugg

SEQ ID NO: 1911146 - RNA, 22 nt, Human
ccucccaaggggcccaaauucu

SEQ ID NO: 1911147 - RNA, 15 nt, Human
ccucccaggcucuca

SEQ ID NO: 1911148 - RNA, 20 nt, Human
ccucccaauuucagacuccc

SEQ ID NO: 1911149 - RNA, 19 nt, Human
ccucccaauuucagacucc

SEQ ID NO: 1911150 - RNA, 17 nt, Human
ccguaggacccaagcag

SEQ ID NO: 1911151 - RNA, 18 nt, Human
ccggcuaauuuuuguaau

SEQ ID NO: 1911152 - RNA, 22 nt, Human
ccguaguagauguucuacuuug

SEQ ID NO: 1911153 - RNA, 11 nt, Human
ccgucaacaaa

SEQ ID NO: 1911154 - RNA, 16 nt, Human
ccguagguuauuuuca

SEQ ID NO: 1911155 - RNA, 23 nt, Human
ccuaauaaagcuguguggcaguc

SEQ ID NO: 1911156 - RNA, 13 nt, Human
ccuaauccaggca

SEQ ID NO: 1911157 - RNA, 14 nt, Human
ccuaauccaggcag

SEQ ID NO: 1911158 - RNA, 15 nt, Human
ccuaauccaggcaga

SEQ ID NO: 1911159 - RNA, 18 nt, Human
ccuagagggaggggccua

SEQ ID NO: 1911160 - RNA, 18 nt, Human
ccuagaguagaguggagg

SEQ ID NO: 1911161 - RNA, 22 nt, Human
ccuagaguagaguggagggagg

SEQ ID NO: 1911162 - RNA, 14 nt, Human
ccuaauaaagcugu

SEQ ID NO: 1911163 - RNA, 18 nt, Human
ccuaagaguugagcucuc

SEQ ID NO: 1911164 - RNA, 23 nt, Human
ccuaagcaaacccagugucagga

SEQ ID NO: 1911165 - RNA, 12 nt, Human
ccuaaggcugca

SEQ ID NO: 1911166 - RNA, 22 nt, Human
ccuaaggcugcaagguuuaggc

SEQ ID NO: 1911167 - RNA, 23 nt, Human
ccuaggcauuugcugaauacaga

SEQ ID NO: 1911168 - RNA, 20 nt, Human
ccuaggagugccccauucuu

SEQ ID NO: 1911169 - RNA, 23 nt, Human
ccuagauggcagucacugaauuc

SEQ ID NO: 1911170 - RNA, 16 nt, Human
cgaguagcugggacua

SEQ ID NO: 1911171 - RNA, 15 nt, Human
cgaguagcugggacu

SEQ ID NO: 1911172 - RNA, 14 nt, Human
cgaguagcugggac

SEQ ID NO: 1911173 - RNA, 13 nt, Human
cgaguagcuggga

SEQ ID NO: 1911174 - RNA, 17 nt, Human
cgaguuacagacaaagc

SEQ ID NO: 1911175 - RNA, 18 nt, Human
cgaguuacagacaaagcg

SEQ ID NO: 1911176 - RNA, 22 nt, Human
cgagugugaagcuuccuuggcu

SEQ ID NO: 1911177 - RNA, 14 nt, Human
cgccuacaggagug

SEQ ID NO: 1911178 - RNA, 16 nt, Human
cgccucccacuggggu

SEQ ID NO: 1911179 - RNA, 19 nt, Human
cgccucccacuggggucca

SEQ ID NO: 1911180 - RNA, 20 nt, Human
cgccgccugguacucaagcc

SEQ ID NO: 1911181 - RNA, 14 nt, Human
cgccgccugguacu

SEQ ID NO: 1911182 - RNA, 15 nt, Human
cgccgccugguacuc

SEQ ID NO: 1911183 - RNA, 21 nt, Human
cgccgcaaaccacacuggacu

SEQ ID NO: 1911184 - RNA, 22 nt, Human
cgccgcaaaccacacuggacuc

SEQ ID NO: 1911185 - RNA, 23 nt, Human
cgccgcaaaccacacuggacucc

SEQ ID NO: 1911186 - RNA, 23 nt, Human
cgccaaggcugggggaagaagcu

SEQ ID NO: 1911187 - RNA, 19 nt, Human
cgccgcaaaccacacugga

SEQ ID NO: 1911188 - RNA, 20 nt, Human
cgccgcaaaccacacuggac

SEQ ID NO: 1911189 - RNA, 13 nt, Human
cgccaaggcuggg

SEQ ID NO: 1911190 - RNA, 16 nt, Human
cgccaaggcuggggga

SEQ ID NO: 1911191 - RNA, 12 nt, Human
cgccaaggcugg

SEQ ID NO: 1911192 - RNA, 14 nt, Human
cgccuccgagggac

SEQ ID NO: 1911193 - RNA, 16 nt, Human
cgccuccccugcccca

SEQ ID NO: 1911194 - RNA, 18 nt, Human
cggcucacugcagccuca

SEQ ID NO: 1911195 - RNA, 19 nt, Human
cggcucacugcagccucaa

SEQ ID NO: 1911196 - RNA, 16 nt, Human
cggcucggaggaagcc

SEQ ID NO: 1911197 - RNA, 20 nt, Human
cggcucggaggaagccccca

SEQ ID NO: 1911198 - RNA, 14 nt, Human
cggagucccaccuu

SEQ ID NO: 1911199 - RNA, 13 nt, Human
cggcggagcuggc

SEQ ID NO: 1911200 - RNA, 19 nt, Human
cggcggagcuggccccgcc

SEQ ID NO: 1911201 - RNA, 21 nt, Human
cggcggagcuggccccgccgc

SEQ ID NO: 1911202 - RNA, 14 nt, Human
cggagcaagaggag

SEQ ID NO: 1911203 - RNA, 12 nt, Human
ccuuuuuuauac

SEQ ID NO: 1911204 - RNA, 13 nt, Human
ccuuuugcauucu

SEQ ID NO: 1911205 - RNA, 23 nt, Human
cgaccagacaccuugacagggca

SEQ ID NO: 1911206 - RNA, 19 nt, Human
ccuuuuuuauacauaaaca

SEQ ID NO: 1911207 - RNA, 18 nt, Human
ccuuuuuuauacauaaac

SEQ ID NO: 1911208 - RNA, 17 nt, Human
ccuuuuuuauacauaaa

SEQ ID NO: 1911209 - RNA, 16 nt, Human
cgacagugagacucug

SEQ ID NO: 1911210 - RNA, 15 nt, Human
cgacagugagacucu

SEQ ID NO: 1911211 - RNA, 20 nt, Human
ccuuuagcgcccaguugggu

SEQ ID NO: 1911212 - RNA, 14 nt, Human
ccuuuagcgcccag

SEQ ID NO: 1911213 - RNA, 23 nt, Human
ccuuuugaacgcccccccccacc

SEQ ID NO: 1911214 - RNA, 12 nt, Human
ccuuuucuauuc

SEQ ID NO: 1911215 - RNA, 17 nt, Human
ccuugccgucuaccuga

SEQ ID NO: 1911216 - RNA, 20 nt, Human
ccuugccgucuaccugaggg

SEQ ID NO: 1911217 - RNA, 20 nt, Human
ccuucugaaaaaguauccug

SEQ ID NO: 1911218 - RNA, 20 nt, Human
ccuggccugagcugggauga

SEQ ID NO: 1911219 - RNA, 14 nt, Human
ccuggccugagcug

SEQ ID NO: 1911220 - RNA, 15 nt, Human
ccuggccugagcugg

SEQ ID NO: 1911221 - RNA, 12 nt, Human
ccuucugaccca

SEQ ID NO: 1911222 - RNA, 16 nt, Human
ccuucugacccaugcu

SEQ ID NO: 1911223 - RNA, 17 nt, Human
ccuucugacccaugcug

SEQ ID NO: 1911224 - RNA, 20 nt, Human
ccuucugacccaugcugccc

SEQ ID NO: 1911225 - RNA, 22 nt, Human
ccuucuggaauaaggagaauga

SEQ ID NO: 1911226 - RNA, 17 nt, Human
ccuucuggccucccaca

SEQ ID NO: 1911227 - RNA, 12 nt, Human
ccuucugcucag

SEQ ID NO: 1911228 - RNA, 13 nt, Human
ccuucugcuacug

SEQ ID NO: 1911229 - RNA, 17 nt, Human
ccuucugcucagcucug

SEQ ID NO: 1911230 - RNA, 23 nt, Human
ccuucugacccaugcugcccugu

SEQ ID NO: 1911231 - RNA, 21 nt, Human
ccuucugacccaugcugcccu

SEQ ID NO: 1911232 - RNA, 22 nt, Human
ccuucugacccaugcugcccug

SEQ ID NO: 1911233 - RNA, 20 nt, Human
ccuucuggccucccacagac

SEQ ID NO: 1911234 - RNA, 18 nt, Human
ccuucuggccucccacag

SEQ ID NO: 1911235 - RNA, 22 nt, Human
cuaguuccaccaucaagccacc

SEQ ID NO: 1911236 - RNA, 15 nt, Human
cuauaaauuccucuu

SEQ ID NO: 1911237 - RNA, 17 nt, Human
cuauaaauuccucuuug

SEQ ID NO: 1911238 - RNA, 15 nt, Human
cuaguuguuaucaau

SEQ ID NO: 1911239 - RNA, 23 nt, Human
cuauaaauuccucuuugcuuugc

SEQ ID NO: 1911240 - RNA, 19 nt, Human
cuauaaauuccucuuugcu

SEQ ID NO: 1911241 - RNA, 22 nt, Human
cuauaaauuccucuuugcuuug

SEQ ID NO: 1911242 - RNA, 18 nt, Human
cuaguuccaccaucaagc

SEQ ID NO: 1911243 - RNA, 20 nt, Human
cuaguuccaccaucaagcca

SEQ ID NO: 1911244 - RNA, 21 nt, Human
cuagggaaaaaccagcgugug

SEQ ID NO: 1911245 - RNA, 19 nt, Human
cuagggaaaaaccagcgug

SEQ ID NO: 1911246 - RNA, 16 nt, Human
cuagccuauguggauu

SEQ ID NO: 1911247 - RNA, 18 nt, Human
cuagccggccacuuugga

SEQ ID NO: 1911248 - RNA, 15 nt, Human
cuaccugaggggccu

SEQ ID NO: 1911249 - RNA, 11 nt, Human
cuaccugaggg

SEQ ID NO: 1911250 - RNA, 14 nt, Human
cuaccugaggggcc

SEQ ID NO: 1911251 - RNA, 19 nt, Human
cuagaaauuccccacccug

SEQ ID NO: 1911252 - RNA, 16 nt, Human
cuagaaauugacacaa

SEQ ID NO: 1911253 - RNA, 20 nt, Human
cuagaaauugacacaagugg

SEQ ID NO: 1911254 - RNA, 23 nt, Human
cuagcagcagggagggcuucugc

SEQ ID NO: 1911255 - RNA, 17 nt, Human
cuagcauggcugccaau

SEQ ID NO: 1911256 - RNA, 23 nt, Human
cuagccaaaugguuuaacuucug

SEQ ID NO: 1911257 - RNA, 18 nt, Human
cuagccaccgccuccuac

SEQ ID NO: 1911258 - RNA, 15 nt, Human
cuagaacugaauuuu

SEQ ID NO: 1911259 - RNA, 22 nt, Human
cuagcagcagggagggcuucug

SEQ ID NO: 1911260 - RNA, 19 nt, Human
cuagaacucccuuucaaca

SEQ ID NO: 1911261 - RNA, 18 nt, Human
cuagaacucccuuucaac

SEQ ID NO: 1911262 - RNA, 17 nt, Human
cuagaacucccuuucaa

SEQ ID NO: 1911263 - RNA, 16 nt, Human
cuagaacucccuuuca

SEQ ID NO: 1911264 - RNA, 22 nt, Human
cuaagugauccucccaccucag

SEQ ID NO: 1911265 - RNA, 20 nt, Human
cuaagugauccucccaccuc

SEQ ID NO: 1911266 - RNA, 18 nt, Human
cuaagugaggaugaaaaa

SEQ ID NO: 1911267 - RNA, 12 nt, Human
cuaauuuauaaa

SEQ ID NO: 1911268 - RNA, 14 nt, Human
cuaauuuuuguaau

SEQ ID NO: 1911269 - RNA, 20 nt, Human
cuaauuuuuguaauuuuagu

SEQ ID NO: 1911270 - RNA, 21 nt, Human
cuacaaacaaaauuucuauua

SEQ ID NO: 1911271 - RNA, 10 nt, Human
cuacaaauca

SEQ ID NO: 1911272 - RNA, 15 nt, Human
cuacaguccucccau

SEQ ID NO: 1911273 - RNA, 16 nt, Human
cuacaguccucccauc

SEQ ID NO: 1911274 - RNA, 17 nt, Human
cuacaguccucccaucu

SEQ ID NO: 1911275 - RNA, 18 nt, Human
cuacaguccucccaucuc

SEQ ID NO: 1911276 - RNA, 17 nt, Human
cuacaguguacagucuu

SEQ ID NO: 1911277 - RNA, 16 nt, Human
cuacaguguacagucu

SEQ ID NO: 1911278 - RNA, 15 nt, Human
cuacaguguacaguc

SEQ ID NO: 1911279 - RNA, 13 nt, Human
cuacaguugaaaa

SEQ ID NO: 1911280 - RNA, 20 nt, Human
cuacaguguacagucuugua

SEQ ID NO: 1911281 - RNA, 15 nt, Human
cuacaugagguacug

SEQ ID NO: 1911282 - RNA, 13 nt, Human
cuacaugagaaca

SEQ ID NO: 1911283 - RNA, 14 nt, Human
cuacaugagaacaa

SEQ ID NO: 1911284 - RNA, 17 nt, Human
cuacaugagaacaaaca

SEQ ID NO: 1911285 - RNA, 18 nt, Human
cuacauacaauuccaaac

SEQ ID NO: 1911286 - RNA, 23 nt, Human
cuaagugaaauaagccagacauc

SEQ ID NO: 1911287 - RNA, 20 nt, Human
cuaagugaaauaagccagac

SEQ ID NO: 1911288 - RNA, 16 nt, Human
cuaaacuuccccaucu

SEQ ID NO: 1911289 - RNA, 20 nt, Human
cuaaacuuccccaucuucua

SEQ ID NO: 1911290 - RNA, 17 nt, Human
cggcucuggccuccaag

SEQ ID NO: 1911291 - RNA, 16 nt, Human
cuaacuucaccauauu

SEQ ID NO: 1911292 - RNA, 14 nt, Human
cuaagaaaagauuu

SEQ ID NO: 1911293 - RNA, 15 nt, Human
cuaagaaaagauuuu

SEQ ID NO: 1911294 - RNA, 21 nt, Human
cuaagaaaagauuuuaaucaa

SEQ ID NO: 1911295 - RNA, 20 nt, Human
cuaagaaaagauuuuaauca

SEQ ID NO: 1911296 - RNA, 15 nt, Human
cuaacuucaccauau

SEQ ID NO: 1911297 - RNA, 19 nt, Human
cuaaagaguuuauuuuaag

SEQ ID NO: 1911298 - RNA, 18 nt, Human
cuaaagaguuuauuuuaa

SEQ ID NO: 1911299 - RNA, 20 nt, Human
cucccugcacaagccagggu

SEQ ID NO: 1911300 - RNA, 19 nt, Human
cucccugcacaagccaggg

SEQ ID NO: 1911301 - RNA, 20 nt, Human
cucccugcaucugaccagca

SEQ ID NO: 1911302 - RNA, 12 nt, Human
cucccugacccu

SEQ ID NO: 1911303 - RNA, 14 nt, Human
cucccugacccugu

SEQ ID NO: 1911304 - RNA, 16 nt, Human
cucccugacccuguau

SEQ ID NO: 1911305 - RNA, 17 nt, Human
cucccugacccuguaua

SEQ ID NO: 1911306 - RNA, 23 nt, Human
cucccugacccuguauauagccc

SEQ ID NO: 1911307 - RNA, 14 nt, Human
cuccccgcuucugc

SEQ ID NO: 1911308 - RNA, 13 nt, Human
cuccccucagagu

SEQ ID NO: 1911309 - RNA, 16 nt, Human
cuccccucagagugca

SEQ ID NO: 1911310 - RNA, 15 nt, Human
cuccccuccaaccug

SEQ ID NO: 1911311 - RNA, 21 nt, Human
cuccagugagacagcucugca

SEQ ID NO: 1911312 - RNA, 19 nt, Human
cuccagucugaucugugaa

SEQ ID NO: 1911313 - RNA, 13 nt, Human
cucccaccucagc

SEQ ID NO: 1911314 - RNA, 12 nt, Human
cucccaccucag

SEQ ID NO: 1911315 - RNA, 18 nt, Human
cucccaccuagcagcacc

SEQ ID NO: 1911316 - RNA, 19 nt, Human
cuccgcuuucuacccagcg

SEQ ID NO: 1911317 - RNA, 20 nt, Human
cuccagggucagaaacagga

SEQ ID NO: 1911318 - RNA, 21 nt, Human
cuccagggucagaaacaggac

SEQ ID NO: 1911319 - RNA, 16 nt, Human
cuccagggugugugcu

SEQ ID NO: 1911320 - RNA, 11 nt, Human
cuccaggugca

SEQ ID NO: 1911321 - RNA, 16 nt, Human
cuccaagaccuucucc

SEQ ID NO: 1911322 - RNA, 13 nt, Human
cuccaaccugcaa

SEQ ID NO: 1911323 - RNA, 17 nt, Human
cuccaagaccuucuccu

SEQ ID NO: 1911324 - RNA, 18 nt, Human
cuccaagaccuucuccuu

SEQ ID NO: 1911325 - RNA, 21 nt, Human
cuccaagaccuucuccuucac

SEQ ID NO: 1911326 - RNA, 22 nt, Human
cuccacuuucuagccagaggag

SEQ ID NO: 1911327 - RNA, 14 nt, Human
cuccagaagauagc

SEQ ID NO: 1911328 - RNA, 15 nt, Human
cuccagaagauagcu

SEQ ID NO: 1911329 - RNA, 15 nt, Human
cuccagaauuuccca

SEQ ID NO: 1911330 - RNA, 18 nt, Human
cuccagaauuucccaaag

SEQ ID NO: 1911331 - RNA, 23 nt, Human
cuccagaagauagcuucacccca

SEQ ID NO: 1911332 - RNA, 17 nt, Human
cuccagacacaugucca

SEQ ID NO: 1911333 - RNA, 19 nt, Human
cuccagacacauguccaag

SEQ ID NO: 1911334 - RNA, 13 nt, Human
cucagcggggaca

SEQ ID NO: 1911335 - RNA, 22 nt, Human
cucagccuugccagagauccaa

SEQ ID NO: 1911336 - RNA, 13 nt, Human
cucaggccagcug

SEQ ID NO: 1911337 - RNA, 14 nt, Human
cucaggccagcugc

SEQ ID NO: 1911338 - RNA, 15 nt, Human
cucaggccagcugcu

SEQ ID NO: 1911339 - RNA, 20 nt, Human
cucaggccagcugcuugggc

SEQ ID NO: 1911340 - RNA, 21 nt, Human
cucaggccagcugcuugggcu

SEQ ID NO: 1911341 - RNA, 22 nt, Human
cucaggccagcugcuugggcuu

SEQ ID NO: 1911342 - RNA, 22 nt, Human
cucagccuccugaguagcugga

SEQ ID NO: 1911343 - RNA, 14 nt, Human
cucagccuccugag

SEQ ID NO: 1911344 - RNA, 15 nt, Human
cucagccuugccaga

SEQ ID NO: 1911345 - RNA, 16 nt, Human
cucagccuugccagag

SEQ ID NO: 1911346 - RNA, 17 nt, Human
cucagccuugccagaga

SEQ ID NO: 1911347 - RNA, 18 nt, Human
cucagccuugccagagau

SEQ ID NO: 1911348 - RNA, 19 nt, Human
cucagccuugccagagauc

SEQ ID NO: 1911349 - RNA, 20 nt, Human
cucagccuugccagagaucc

SEQ ID NO: 1911350 - RNA, 21 nt, Human
cucagccuugccagagaucca

SEQ ID NO: 1911351 - RNA, 13 nt, Human
cucagccucccaa

SEQ ID NO: 1911352 - RNA, 22 nt, Human
cuauccaucaugaccagcaaau

SEQ ID NO: 1911353 - RNA, 16 nt, Human
cucagccucccaaagu

SEQ ID NO: 1911354 - RNA, 14 nt, Human
cucagccucccaaa

SEQ ID NO: 1911355 - RNA, 21 nt, Human
cucagccucccaaagugcugg

SEQ ID NO: 1911356 - RNA, 23 nt, Human
cucagccucccgaauagcuggga

SEQ ID NO: 1911357 - RNA, 13 nt, Human
cucagccucccga

SEQ ID NO: 1911358 - RNA, 22 nt, Human
cucagccucccaaagugcuggg

SEQ ID NO: 1911359 - RNA, 13 nt, Human
cucaggccugggg

SEQ ID NO: 1911360 - RNA, 16 nt, Human
cucaggcccaaagccu

SEQ ID NO: 1911361 - RNA, 14 nt, Human
cucaggccuggggg

SEQ ID NO: 1911362 - RNA, 20 nt, Human
cucaggccugggggcugggc

SEQ ID NO: 1911363 - RNA, 21 nt, Human
cucaggccugggggcugggca

SEQ ID NO: 1911364 - RNA, 17 nt, Human
cucagucuggcccuucc

SEQ ID NO: 1911365 - RNA, 18 nt, Human
cucagucuggcccuuccu

SEQ ID NO: 1911366 - RNA, 13 nt, Human
cucagugccacua

SEQ ID NO: 1911367 - RNA, 12 nt, Human
cucaucuuucuu

SEQ ID NO: 1911368 - RNA, 15 nt, Human
cucaucuuucuugau

SEQ ID NO: 1911369 - RNA, 13 nt, Human
cucaucuuucuug

SEQ ID NO: 1911370 - RNA, 16 nt, Human
cuccaaagucucugga

SEQ ID NO: 1911371 - RNA, 15 nt, Human
cuccaacaccaagca

SEQ ID NO: 1911372 - RNA, 16 nt, Human
cuccaacaccaagcac

SEQ ID NO: 1911373 - RNA, 18 nt, Human
cuccaacaccaagcacag

SEQ ID NO: 1911374 - RNA, 22 nt, Human
cuccaacaccaagcacagcagc

SEQ ID NO: 1911375 - RNA, 19 nt, Human
cuccaaccccccagcacug

SEQ ID NO: 1911376 - RNA, 18 nt, Human
cuccaaccccccagcacu

SEQ ID NO: 1911377 - RNA, 17 nt, Human
cuccaaccccccagcac

SEQ ID NO: 1911378 - RNA, 15 nt, Human
cuccaaccccccagc

SEQ ID NO: 1911379 - RNA, 14 nt, Human
cuccaaccccccag

SEQ ID NO: 1911380 - RNA, 23 nt, Human
cuccaacaccaagcacagcagcc

SEQ ID NO: 1911381 - RNA, 23 nt, Human
cuccaaccccccagcacugagga

SEQ ID NO: 1911382 - RNA, 22 nt, Human
cuccaaccccccagcacugagg

SEQ ID NO: 1911383 - RNA, 21 nt, Human
cuccaaccccccagcacugag

SEQ ID NO: 1911384 - RNA, 20 nt, Human
cuccaaccccccagcacuga

SEQ ID NO: 1911385 - RNA, 19 nt, Human
cucauguucuuaauucuua

SEQ ID NO: 1911386 - RNA, 18 nt, Human
cucauguucuuaauucuu

SEQ ID NO: 1911387 - RNA, 14 nt, Human
cucauguucuuaau

SEQ ID NO: 1911388 - RNA, 12 nt, Human
cucauguucuua

SEQ ID NO: 1911389 - RNA, 23 nt, Human
cugaagcuuauuaaugcuaaggg

SEQ ID NO: 1911390 - RNA, 18 nt, Human
cugaagcuuauuaaugcu

SEQ ID NO: 1911391 - RNA, 17 nt, Human
cugaagcuuauuaaugc

SEQ ID NO: 1911392 - RNA, 16 nt, Human
cugaagcuuauuaaug

SEQ ID NO: 1911393 - RNA, 14 nt, Human
cugaagcuuauuaa

SEQ ID NO: 1911394 - RNA, 12 nt, Human
cugaagcuuauu

SEQ ID NO: 1911395 - RNA, 21 nt, Human
cugaagcuuauuaaugcuaag

SEQ ID NO: 1911396 - RNA, 20 nt, Human
cugaagcuuauuaaugcuaa

SEQ ID NO: 1911397 - RNA, 18 nt, Human
cugaagcuuuaccagcug

SEQ ID NO: 1911398 - RNA, 14 nt, Human
cugaagcuuuacca

SEQ ID NO: 1911399 - RNA, 16 nt, Human
cugaaaauguaugugu

SEQ ID NO: 1911400 - RNA, 17 nt, Human
cugaaaauuaacacugc

SEQ ID NO: 1911401 - RNA, 16 nt, Human
cugaaaauuaacacug

SEQ ID NO: 1911402 - RNA, 21 nt, Human
cugaaggacauugcggacagc

SEQ ID NO: 1911403 - RNA, 20 nt, Human
cugaaggacauugcggacag

SEQ ID NO: 1911404 - RNA, 19 nt, Human
cugaaggacauugcggaca

SEQ ID NO: 1911405 - RNA, 13 nt, Human
cugaaggccccgc

SEQ ID NO: 1911406 - RNA, 14 nt, Human
cugaaggccccgcc

SEQ ID NO: 1911407 - RNA, 17 nt, Human
cugaaggccccgcccag

SEQ ID NO: 1911408 - RNA, 18 nt, Human
cugaaggccccgcccagg

SEQ ID NO: 1911409 - RNA, 15 nt, Human
cucuuggagccugca

SEQ ID NO: 1911410 - RNA, 14 nt, Human
cugaaaaccucucc

SEQ ID NO: 1911411 - RNA, 15 nt, Human
cugaaaaccucuccu

SEQ ID NO: 1911412 - RNA, 17 nt, Human
cugaaaaccucuccuca

SEQ ID NO: 1911413 - RNA, 20 nt, Human
cugaaaaccucuccucaugu

SEQ ID NO: 1911414 - RNA, 14 nt, Human
cucuuggagccugc

SEQ ID NO: 1911415 - RNA, 23 nt, Human
cugacccugcuucaaauauuucc

SEQ ID NO: 1911416 - RNA, 12 nt, Human
cugacccuguau

SEQ ID NO: 1911417 - RNA, 13 nt, Human
cugacccuguaua

SEQ ID NO: 1911418 - RNA, 15 nt, Human
cugacccuguauaua

SEQ ID NO: 1911419 - RNA, 18 nt, Human
cugacccuguauauagcc

SEQ ID NO: 1911420 - RNA, 19 nt, Human
cugacccuguauauagccc

SEQ ID NO: 1911421 - RNA, 20 nt, Human
cugacccuguauauagccca

SEQ ID NO: 1911422 - RNA, 21 nt, Human
cugacccuguauauagcccag

SEQ ID NO: 1911423 - RNA, 22 nt, Human
cugacccuguauauagcccagc

SEQ ID NO: 1911424 - RNA, 13 nt, Human
cugacccugugga

SEQ ID NO: 1911425 - RNA, 18 nt, Human
cugacccaugcugcccug

SEQ ID NO: 1911426 - RNA, 17 nt, Human
cugacccaugcugcccu

SEQ ID NO: 1911427 - RNA, 19 nt, Human
cugacccaugcugcccugu

SEQ ID NO: 1911428 - RNA, 20 nt, Human
cugacccaugcugcccugug

SEQ ID NO: 1911429 - RNA, 21 nt, Human
cugaccugugagcccagcugg

SEQ ID NO: 1911430 - RNA, 21 nt, Human
cugaccucccucuaauuuauc

SEQ ID NO: 1911431 - RNA, 17 nt, Human
cugaccugugagcccag

SEQ ID NO: 1911432 - RNA, 18 nt, Human
cugaccugugagcccagc

SEQ ID NO: 1911433 - RNA, 20 nt, Human
cugaccugugagcccagcug

SEQ ID NO: 1911434 - RNA, 18 nt, Human
cugaccucccucuaauuu

SEQ ID NO: 1911435 - RNA, 20 nt, Human
cugaccucccucuaauuuau

SEQ ID NO: 1911436 - RNA, 20 nt, Human
cugaaggggcgucuguuccc

SEQ ID NO: 1911437 - RNA, 23 nt, Human
cugaaggggccaugauggcaaca

SEQ ID NO: 1911438 - RNA, 15 nt, Human
cugaaggggccauga

SEQ ID NO: 1911439 - RNA, 19 nt, Human
cugaaggggccaugauggc

SEQ ID NO: 1911440 - RNA, 19 nt, Human
cugaagggauaugugaaac

SEQ ID NO: 1911441 - RNA, 21 nt, Human
cugaagggauaugugaaacaa

SEQ ID NO: 1911442 - RNA, 14 nt, Human
cugacagacacagg

SEQ ID NO: 1911443 - RNA, 12 nt, Human
cugacagacaca

SEQ ID NO: 1911444 - RNA, 15 nt, Human
cugacagacacaggc

SEQ ID NO: 1911445 - RNA, 18 nt, Human
cucugcacaugucuugua

SEQ ID NO: 1911446 - RNA, 18 nt, Human
cucugcaccguacugugg

SEQ ID NO: 1911447 - RNA, 14 nt, Human
cucugcacuccccu

SEQ ID NO: 1911448 - RNA, 16 nt, Human
cucugcacaugucuug

SEQ ID NO: 1911449 - RNA, 15 nt, Human
cucugcacaugucuu

SEQ ID NO: 1911450 - RNA, 19 nt, Human
cucugcagcaauaaagcag

SEQ ID NO: 1911451 - RNA, 18 nt, Human
cucugcagcaauaaagca

SEQ ID NO: 1911452 - RNA, 23 nt, Human
cucugcagcaauaaagcagcguu

SEQ ID NO: 1911453 - RNA, 22 nt, Human
cucugcgugcagggacaaagag

SEQ ID NO: 1911454 - RNA, 23 nt, Human
cucugcgugcagggacaaagagg

SEQ ID NO: 1911455 - RNA, 17 nt, Human
cucuguacagagcccac

SEQ ID NO: 1911456 - RNA, 21 nt, Human
cucuguacagagcccacgccc

SEQ ID NO: 1911457 - RNA, 15 nt, Human
cucugguccauagag

SEQ ID NO: 1911458 - RNA, 19 nt, Human
cucugcugacagacacagg

SEQ ID NO: 1911459 - RNA, 18 nt, Human
cucugcugacagacacag

SEQ ID NO: 1911460 - RNA, 17 nt, Human
cucugcugacagacaca

SEQ ID NO: 1911461 - RNA, 15 nt, Human
cucugguuaucuaau

SEQ ID NO: 1911462 - RNA, 19 nt, Human
cucugguccauagagagca

SEQ ID NO: 1911463 - RNA, 16 nt, Human
cucugguccauagaga

SEQ ID NO: 1911464 - RNA, 18 nt, Human
cucugguccauagagagc

SEQ ID NO: 1911465 - RNA, 21 nt, Human
cucuccgaccagacaccuuga

SEQ ID NO: 1911466 - RNA, 16 nt, Human
cucuccucacacacag

SEQ ID NO: 1911467 - RNA, 13 nt, Human
cucuccccagccc

SEQ ID NO: 1911468 - RNA, 15 nt, Human
cucuccccagcccag

SEQ ID NO: 1911469 - RNA, 16 nt, Human
cucuccccagcccaga

SEQ ID NO: 1911470 - RNA, 17 nt, Human
cucuccccagcccagag

SEQ ID NO: 1911471 - RNA, 18 nt, Human
cucuccccagcccagaga

SEQ ID NO: 1911472 - RNA, 19 nt, Human
cucuccccagcccagagac

SEQ ID NO: 1911473 - RNA, 20 nt, Human
cucuccccagcccagagaca

SEQ ID NO: 1911474 - RNA, 15 nt, Human
cucugaaggacauug

SEQ ID NO: 1911475 - RNA, 11 nt, Human
cucucuggccu

SEQ ID NO: 1911476 - RNA, 23 nt, Human
cucuccucaucucuaacagcuca

SEQ ID NO: 1911477 - RNA, 12 nt, Human
cucuccucaucu

SEQ ID NO: 1911478 - RNA, 14 nt, Human
cucuccucaucucu

SEQ ID NO: 1911479 - RNA, 20 nt, Human
cucuccucauguucugcuuu

SEQ ID NO: 1911480 - RNA, 12 nt, Human
cucucuggccuu

SEQ ID NO: 1911481 - RNA, 15 nt, Human
cucucacuccuugaa

SEQ ID NO: 1911482 - RNA, 21 nt, Human
cucucacuuguuuuauuuaac

SEQ ID NO: 1911483 - RNA, 19 nt, Human
cucucagauuguaccauug

SEQ ID NO: 1911484 - RNA, 12 nt, Human
cucucacuccuu

SEQ ID NO: 1911485 - RNA, 14 nt, Human
cucucacuccuuga

SEQ ID NO: 1911486 - RNA, 16 nt, Human
cucuauuuauguuugc

SEQ ID NO: 1911487 - RNA, 17 nt, Human
cucuauuuauguuugca

SEQ ID NO: 1911488 - RNA, 20 nt, Human
cucuauguuuacaaauggac

SEQ ID NO: 1911489 - RNA, 15 nt, Human
cucuauguuuacaaa

SEQ ID NO: 1911490 - RNA, 16 nt, Human
gugaugcccugcccuu

SEQ ID NO: 1911491 - RNA, 22 nt, Human
gugaugcuaaagguuguauugc

SEQ ID NO: 1911492 - RNA, 22 nt, Human
gugaugcgcaugucacggaggg

SEQ ID NO: 1911493 - RNA, 14 nt, Human
gugauggggcccug

SEQ ID NO: 1911494 - RNA, 16 nt, Human
gugauggggcccugcc

SEQ ID NO: 1911495 - RNA, 17 nt, Human
gugauggggcccugccu

SEQ ID NO: 1911496 - RNA, 18 nt, Human
gugauggggcccugccuc

SEQ ID NO: 1911497 - RNA, 16 nt, Human
gugaugagaggaaauc

SEQ ID NO: 1911498 - RNA, 14 nt, Human
gugaugagaggaaa

SEQ ID NO: 1911499 - RNA, 22 nt, Human
aacuucuuauaggaaagcuuga

SEQ ID NO: 1911500 - RNA, 15 nt, Human
aacuucuuauggaau

SEQ ID NO: 1911501 - RNA, 13 nt, Human
aacuucugccugu

SEQ ID NO: 1911502 - RNA, 16 nt, Human
aacuucuuauggaauu

SEQ ID NO: 1911503 - RNA, 17 nt, Human
aacuucuuauggaauug

SEQ ID NO: 1911504 - RNA, 19 nt, Human
aacuucuuauggaauugau

SEQ ID NO: 1911505 - RNA, 24 nt, Human
aacuucuuauggaauugauuugca

SEQ ID NO: 1911506 - RNA, 22 nt, Human
aacuucuccccugguagaaaga

SEQ ID NO: 1911507 - RNA, 22 nt, Human
aacuuccagguguuacuguaau

SEQ ID NO: 1911508 - RNA, 17 nt, Human
aacuuccccaucuucua

SEQ ID NO: 1911509 - RNA, 18 nt, Human
aacuuccccaucuucuaa

SEQ ID NO: 1911510 - RNA, 19 nt, Human
aacuuccagguguuacugu

SEQ ID NO: 1911511 - RNA, 13 nt, Human
aacuuccaauuua

SEQ ID NO: 1911512 - RNA, 16 nt, Human
aacuguaccaugugcu

SEQ ID NO: 1911513 - RNA, 22 nt, Human
aacuguaccaugugcuacaggg

SEQ ID NO: 1911514 - RNA, 14 nt, Human
aacuguacugggcc

SEQ ID NO: 1911515 - RNA, 22 nt, Human
aacugguauuuuaucuuugauu

SEQ ID NO: 1911516 - RNA, 13 nt, Human
aacugguauuuua

SEQ ID NO: 1911517 - RNA, 13 nt, Human
aacuguaaauaaa

SEQ ID NO: 1911518 - RNA, 23 nt, Human
gugcauguaugucuuggacacug

SEQ ID NO: 1911519 - RNA, 19 nt, Human
gugcauguguguucaugca

SEQ ID NO: 1911520 - RNA, 19 nt, Human
gugcauuaucuagauacug

SEQ ID NO: 1911521 - RNA, 15 nt, Human
gugcauuaucuagau

SEQ ID NO: 1911522 - RNA, 23 nt, Human
gugcauuaucuagauacuguauc

SEQ ID NO: 1911523 - RNA, 13 nt, Human
gugccucccuggu

SEQ ID NO: 1911524 - RNA, 15 nt, Human
gugccucccugguga

SEQ ID NO: 1911525 - RNA, 12 nt, Human
gugccucccugg

SEQ ID NO: 1911526 - RNA, 16 nt, Human
gugcauguaugucuug

SEQ ID NO: 1911527 - RNA, 22 nt, Human
gugcaugcugucccuuacguga

SEQ ID NO: 1911528 - RNA, 21 nt, Human
gugcacacaccagagcccacc

SEQ ID NO: 1911529 - RNA, 23 nt, Human
gugcacaaaguggcauaaaaaac

SEQ ID NO: 1911530 - RNA, 14 nt, Human
gugcacaaaguggc

SEQ ID NO: 1911531 - RNA, 21 nt, Human
gugcacaaaguggcauaaaaa

SEQ ID NO: 1911532 - RNA, 18 nt, Human
gugcacaaaacccagacc

SEQ ID NO: 1911533 - RNA, 13 nt, Human
gugcaaccaggga

SEQ ID NO: 1911534 - RNA, 23 nt, Human
gugcaaccucuuggccugaucag

SEQ ID NO: 1911535 - RNA, 19 nt, Human
gugauggggcccugccucc

SEQ ID NO: 1911536 - RNA, 21 nt, Human
gugcaaugucugagugaaccu

SEQ ID NO: 1911537 - RNA, 22 nt, Human
gugcaaugaccuuucaauagga

SEQ ID NO: 1911538 - RNA, 15 nt, Human
gugcaagccccugcu

SEQ ID NO: 1911539 - RNA, 12 nt, Human
gugcaagagagg

SEQ ID NO: 1911540 - RNA, 21 nt, Human
aacuggguacuuguggacaca

SEQ ID NO: 1911541 - RNA, 16 nt, Human
aacuggguacuugugg

SEQ ID NO: 1911542 - RNA, 22 nt, Human
aacugggggagggugaagugaa

SEQ ID NO: 1911543 - RNA, 21 nt, Human
aacugggggagggugaaguga

SEQ ID NO: 1911544 - RNA, 15 nt, Human
aacuggauuaaacuu

SEQ ID NO: 1911545 - RNA, 11 nt, Human
aacuggcugca

SEQ ID NO: 1911546 - RNA, 16 nt, Human
aacuggauuaaacuua

SEQ ID NO: 1911547 - RNA, 23 nt, Human
aacugcugacuguuuucucuuga

SEQ ID NO: 1911548 - RNA, 20 nt, Human
aacugcugacuguuuucucu

SEQ ID NO: 1911549 - RNA, 21 nt, Human
aacugcugacuguuuucucuu

SEQ ID NO: 1911550 - RNA, 15 nt, Human
aacugcugacuguuu

SEQ ID NO: 1911551 - RNA, 20 nt, Human
aacugccucgaaacacagaa

SEQ ID NO: 1911552 - RNA, 15 nt, Human
aacugcaaagugaag

SEQ ID NO: 1911553 - RNA, 18 nt, Human
aacugcaaagugaaguug

SEQ ID NO: 1911554 - RNA, 17 nt, Human
gugaacuugggccacug

SEQ ID NO: 1911555 - RNA, 19 nt, Human
gugaacuugggccacugug

SEQ ID NO: 1911556 - RNA, 21 nt, Human
gugagaugcuagaacucccuu

SEQ ID NO: 1911557 - RNA, 15 nt, Human
gugaacuuuauuaaa

SEQ ID NO: 1911558 - RNA, 18 nt, Human
gugaacuucuugaaucua

SEQ ID NO: 1911559 - RNA, 17 nt, Human
gugaggccagagacaca

SEQ ID NO: 1911560 - RNA, 22 nt, Human
gugaggccagagacacaagccu

SEQ ID NO: 1911561 - RNA, 22 nt, Human
gugagucgaggacagggaggug

SEQ ID NO: 1911562 - RNA, 21 nt, Human
gugagguggaauuauuuuaaa

SEQ ID NO: 1911563 - RNA, 21 nt, Human
aacucuucaaucucuugcacu

SEQ ID NO: 1911564 - RNA, 19 nt, Human
aacucuguugcaagugcaa

SEQ ID NO: 1911565 - RNA, 22 nt, Human
aacucuguugcaagugcaauaa

SEQ ID NO: 1911566 - RNA, 13 nt, Human
aacugaaagugaa

SEQ ID NO: 1911567 - RNA, 18 nt, Human
aacucuucacaaaaucug

SEQ ID NO: 1911568 - RNA, 12 nt, Human
aacccccacugg

SEQ ID NO: 1911569 - RNA, 16 nt, Human
aacccccacuggacug

SEQ ID NO: 1911570 - RNA, 19 nt, Human
aaccccccagcacugagga

SEQ ID NO: 1911571 - RNA, 18 nt, Human
aaccccccagcacugagg

SEQ ID NO: 1911572 - RNA, 14 nt, Human
aaccccccagcacu

SEQ ID NO: 1911573 - RNA, 11 nt, Human
aaccccccagc

SEQ ID NO: 1911574 - RNA, 20 nt, Human
aaccccuggcuccaggccag

SEQ ID NO: 1911575 - RNA, 17 nt, Human
aaccccccauuucuucc

SEQ ID NO: 1911576 - RNA, 20 nt, Human
aaccccggggugcccacagg

SEQ ID NO: 1911577 - RNA, 14 nt, Human
aaccccgucaacaa

SEQ ID NO: 1911578 - RNA, 15 nt, Human
aaccccgucaacaaa

SEQ ID NO: 1911579 - RNA, 16 nt, Human
aaccccgucaacaaau

SEQ ID NO: 1911580 - RNA, 17 nt, Human
aaccccgucaacaaauc

SEQ ID NO: 1911581 - RNA, 18 nt, Human
aaccccgucaacaaaucu

SEQ ID NO: 1911582 - RNA, 21 nt, Human
aacccagacggcuccacuagg

SEQ ID NO: 1911583 - RNA, 23 nt, Human
aacccagaccuguuagcagacag

SEQ ID NO: 1911584 - RNA, 12 nt, Human
aacccagacuca

SEQ ID NO: 1911585 - RNA, 14 nt, Human
aacccagacucaga

SEQ ID NO: 1911586 - RNA, 22 nt, Human
aacccagaccuguuagcagaca

SEQ ID NO: 1911587 - RNA, 14 nt, Human
aacccagauaaagg

SEQ ID NO: 1911588 - RNA, 15 nt, Human
aacccagacucagac

SEQ ID NO: 1911589 - RNA, 16 nt, Human
aacccagacucagaca

SEQ ID NO: 1911590 - RNA, 18 nt, Human
aacccagacucagacauu

SEQ ID NO: 1911591 - RNA, 10 nt, Human
aacccagcuc

SEQ ID NO: 1911592 - RNA, 23 nt, Human
aacccagcaacagaaaaauggag

SEQ ID NO: 1911593 - RNA, 13 nt, Human
aacccagauuuug

SEQ ID NO: 1911594 - RNA, 21 nt, Human
aacccagauuuugcuguauau

SEQ ID NO: 1911595 - RNA, 16 nt, Human
aacccagcaacagaaa

SEQ ID NO: 1911596 - RNA, 17 nt, Human
aacccagcaacagaaaa

SEQ ID NO: 1911597 - RNA, 22 nt, Human
aaccucgagguuucucaaagaa

SEQ ID NO: 1911598 - RNA, 21 nt, Human
aaccucgagguuucucaaaga

SEQ ID NO: 1911599 - RNA, 24 nt, Human
aaccucuaaauucuuucauuuuag

SEQ ID NO: 1911600 - RNA, 12 nt, Human
aaccucuaaauu

SEQ ID NO: 1911601 - RNA, 15 nt, Human
aaccugaaccuagga

SEQ ID NO: 1911602 - RNA, 18 nt, Human
aaccugagccccaaaagg

SEQ ID NO: 1911603 - RNA, 17 nt, Human
aaccugacguagcugca

SEQ ID NO: 1911604 - RNA, 16 nt, Human
aacccgggaggcagag

SEQ ID NO: 1911605 - RNA, 23 nt, Human
aacccgagucauucguucugugg

SEQ ID NO: 1911606 - RNA, 20 nt, Human
aaccucagccuggccagaca

SEQ ID NO: 1911607 - RNA, 14 nt, Human
aaccucauucccca

SEQ ID NO: 1911608 - RNA, 15 nt, Human
aaccaagucaaguga

SEQ ID NO: 1911609 - RNA, 19 nt, Human
aaccaccacacccagccca

SEQ ID NO: 1911610 - RNA, 20 nt, Human
aaccacauuggagauguuua

SEQ ID NO: 1911611 - RNA, 21 nt, Human
aacaguuaauuaguuaacagu

SEQ ID NO: 1911612 - RNA, 21 nt, Human
aaccaccacacccagcccacu

SEQ ID NO: 1911613 - RNA, 17 nt, Human
aaccaccagaagcccag

SEQ ID NO: 1911614 - RNA, 14 nt, Human
aaccaccagaagcc

SEQ ID NO: 1911615 - RNA, 12 nt, Human
aaccaucauuga

SEQ ID NO: 1911616 - RNA, 17 nt, Human
aaccaucauugaaaucu

SEQ ID NO: 1911617 - RNA, 18 nt, Human
aaccaucauugaaaucuu

SEQ ID NO: 1911618 - RNA, 14 nt, Human
aacccaauccaaau

SEQ ID NO: 1911619 - RNA, 15 nt, Human
aaccauuuucauuug

SEQ ID NO: 1911620 - RNA, 15 nt, Human
aacccaagcuuagaa

SEQ ID NO: 1911621 - RNA, 16 nt, Human
aacccaagcuuagaac

SEQ ID NO: 1911622 - RNA, 23 nt, Human
aaccauuuugcugucccuuuucc

SEQ ID NO: 1911623 - RNA, 22 nt, Human
aacccaaauuacguguacuaca

SEQ ID NO: 1911624 - RNA, 23 nt, Human
aacccaaauguucaucaaugaau

SEQ ID NO: 1911625 - RNA, 20 nt, Human
gucuguacacguguccugua

SEQ ID NO: 1911626 - RNA, 19 nt, Human
gucuguacacguguccugu

SEQ ID NO: 1911627 - RNA, 14 nt, Human
gucuguacacgugu

SEQ ID NO: 1911628 - RNA, 21 nt, Human
gucuguacacguguccuguag

SEQ ID NO: 1911629 - RNA, 16 nt, Human
gucuguaucacucugu

SEQ ID NO: 1911630 - RNA, 15 nt, Human
gucuguaucagugga

SEQ ID NO: 1911631 - RNA, 22 nt, Human
gucuguaucaguggauuuccca

SEQ ID NO: 1911632 - RNA, 23 nt, Human
gucuguaucaguggauuucccau

SEQ ID NO: 1911633 - RNA, 14 nt, Human
gucuggcccuuccu

SEQ ID NO: 1911634 - RNA, 12 nt, Human
gucuggcagccu

SEQ ID NO: 1911635 - RNA, 22 nt, Human
gucuggcagccucccauccagg

SEQ ID NO: 1911636 - RNA, 20 nt, Human
aaccugagccccaaaaggua

SEQ ID NO: 1911637 - RNA, 16 nt, Human
gucuuucacauuuaaa

SEQ ID NO: 1911638 - RNA, 16 nt, Human
gucuuuggugaacauu

SEQ ID NO: 1911639 - RNA, 15 nt, Human
gucuuuaaaugcugc

SEQ ID NO: 1911640 - RNA, 14 nt, Human
gucuucuaaacuuc

SEQ ID NO: 1911641 - RNA, 23 nt, Human
gucuucuaaacuuccccaucuuc

SEQ ID NO: 1911642 - RNA, 17 nt, Human
gucuuuaaaugcugcuu

SEQ ID NO: 1911643 - RNA, 14 nt, Human
gucuuuaacuguca

SEQ ID NO: 1911644 - RNA, 15 nt, Human
gucuuuuguucgcau

SEQ ID NO: 1911645 - RNA, 15 nt, Human
gucuuuuuaaaaaua

SEQ ID NO: 1911646 - RNA, 22 nt, Human
aaccuguauaaguggaggcacu

SEQ ID NO: 1911647 - RNA, 12 nt, Human
aaccugugucuc

SEQ ID NO: 1911648 - RNA, 18 nt, Human
aaccuugaaaacuuuaug

SEQ ID NO: 1911649 - RNA, 22 nt, Human
aacuacaugagaacaaacagau

SEQ ID NO: 1911650 - RNA, 20 nt, Human
aacuacugcaccauuuaaaa

SEQ ID NO: 1911651 - RNA, 16 nt, Human
aacuacugcaccauuu

SEQ ID NO: 1911652 - RNA, 17 nt, Human
aacuacugcaccauuua

SEQ ID NO: 1911653 - RNA, 17 nt, Human
aacuaugcauggugccc

SEQ ID NO: 1911654 - RNA, 22 nt, Human
aacuaugcauggugccccagga

SEQ ID NO: 1911655 - RNA, 23 nt, Human
aacuaugcauggugccccaggac

SEQ ID NO: 1911656 - RNA, 22 nt, Human
aacucaucuagguaaauuacag

SEQ ID NO: 1911657 - RNA, 12 nt, Human
aacuccuggccu

SEQ ID NO: 1911658 - RNA, 23 nt, Human
gugaaccaccacacccagcccac

SEQ ID NO: 1911659 - RNA, 22 nt, Human
gugaaccaccacacccagccca

SEQ ID NO: 1911660 - RNA, 14 nt, Human
gugaaccuguauaa

SEQ ID NO: 1911661 - RNA, 14 nt, Human
gugaacgauuuaga

SEQ ID NO: 1911662 - RNA, 16 nt, Human
gugaacgauuuagaaa

SEQ ID NO: 1911663 - RNA, 17 nt, Human
aacucuccucugcugcu

SEQ ID NO: 1911664 - RNA, 16 nt, Human
aacucuccucugcugc

SEQ ID NO: 1911665 - RNA, 15 nt, Human
aacucuccuccagag

SEQ ID NO: 1911666 - RNA, 18 nt, Human
aacucuccuccagaguca

SEQ ID NO: 1911667 - RNA, 14 nt, Human
aaauuauuaaagga

SEQ ID NO: 1911668 - RNA, 15 nt, Human
aaauuauuaaaggaa

SEQ ID NO: 1911669 - RNA, 22 nt, Human
aaauuaguaggcucauuuacug

SEQ ID NO: 1911670 - RNA, 13 nt, Human
aaauuaauaaucu

SEQ ID NO: 1911671 - RNA, 18 nt, Human
aaauuagguauuuugucc

SEQ ID NO: 1911672 - RNA, 14 nt, Human
aaauuaagaaagga

SEQ ID NO: 1911673 - RNA, 14 nt, Human
aaauuaagaaggca

SEQ ID NO: 1911674 - RNA, 15 nt, Human
aaauuaagaaggcaa

SEQ ID NO: 1911675 - RNA, 24 nt, Human
aaaugucuaguuguaacaccauga

SEQ ID NO: 1911676 - RNA, 19 nt, Human
aaaugucuaguuguaacac

SEQ ID NO: 1911677 - RNA, 21 nt, Human
aaaugucacguuuuguuuugu

SEQ ID NO: 1911678 - RNA, 15 nt, Human
aaauguauuacagug

SEQ ID NO: 1911679 - RNA, 16 nt, Human
aaauucugucucugga

SEQ ID NO: 1911680 - RNA, 19 nt, Human
aaauuguaagcaugcacaa

SEQ ID NO: 1911681 - RNA, 18 nt, Human
aaauucugucucuggauu

SEQ ID NO: 1911682 - RNA, 20 nt, Human
aaauuguaagcaugcacaaa

SEQ ID NO: 1911683 - RNA, 15 nt, Human
aaauuuaugugaugg

SEQ ID NO: 1911684 - RNA, 22 nt, Human
aaauugugugugcucugcuuca

SEQ ID NO: 1911685 - RNA, 21 nt, Human
aaauugugugugcucugcuuc

SEQ ID NO: 1911686 - RNA, 12 nt, Human
aaauuuauguga

SEQ ID NO: 1911687 - RNA, 13 nt, Human
aaauugugugugc

SEQ ID NO: 1911688 - RNA, 15 nt, Human
aaauugugauguguc

SEQ ID NO: 1911689 - RNA, 12 nt, Human
aaauugugaugu

SEQ ID NO: 1911690 - RNA, 22 nt, Human
guauuuuguuuuugucuuaaaa

SEQ ID NO: 1911691 - RNA, 21 nt, Human
guauuuuucaauaaagcauuu

SEQ ID NO: 1911692 - RNA, 20 nt, Human
gucaaacaaacucucugaac

SEQ ID NO: 1911693 - RNA, 18 nt, Human
guauuuuucaauaaagca

SEQ ID NO: 1911694 - RNA, 17 nt, Human
gucaacacuaacaugau

SEQ ID NO: 1911695 - RNA, 18 nt, Human
guaucaggugcugccauc

SEQ ID NO: 1911696 - RNA, 16 nt, Human
guaucaggugcugcca

SEQ ID NO: 1911697 - RNA, 22 nt, Human
guauauuuguauuuaaaugaaa

SEQ ID NO: 1911698 - RNA, 20 nt, Human
guauauuugugauagcacuu

SEQ ID NO: 1911699 - RNA, 21 nt, Human
guauauuugugauagcacuuu

SEQ ID NO: 1911700 - RNA, 23 nt, Human
guauauuugugauagcacuuucu

SEQ ID NO: 1911701 - RNA, 16 nt, Human
guauauuuuauaucaa

SEQ ID NO: 1911702 - RNA, 19 nt, Human
guauaaguggaggcacuuu

SEQ ID NO: 1911703 - RNA, 20 nt, Human
guauaaguggaggcacuuua

SEQ ID NO: 1911704 - RNA, 21 nt, Human
guauaaguggaggcacuuuag

SEQ ID NO: 1911705 - RNA, 15 nt, Human
guauaauauuuuuaa

SEQ ID NO: 1911706 - RNA, 12 nt, Human
guauaauauuuu

SEQ ID NO: 1911707 - RNA, 13 nt, Human
guauauuguguuu

SEQ ID NO: 1911708 - RNA, 19 nt, Human
guauauuguguuuguguau

SEQ ID NO: 1911709 - RNA, 20 nt, Human
guauauuguguuuguguauu

SEQ ID NO: 1911710 - RNA, 14 nt, Human
guaugguggcuggg

SEQ ID NO: 1911711 - RNA, 21 nt, Human
guaugcuucauacagggaugg

SEQ ID NO: 1911712 - RNA, 16 nt, Human
guaugguggcuggguu

SEQ ID NO: 1911713 - RNA, 15 nt, Human
guaugguggcugggu

SEQ ID NO: 1911714 - RNA, 21 nt, Human
guaucccaugagccucagcau

SEQ ID NO: 1911715 - RNA, 15 nt, Human
guaugcuucauacag

SEQ ID NO: 1911716 - RNA, 14 nt, Human
guaugcuucauaca

SEQ ID NO: 1911717 - RNA, 13 nt, Human
guaugcuucauac

SEQ ID NO: 1911718 - RNA, 12 nt, Human
guaugcuucaua

SEQ ID NO: 1911719 - RNA, 22 nt, Human
guaucaggugcugccauccagg

SEQ ID NO: 1911720 - RNA, 21 nt, Human
guaucaguggauuucccaucc

SEQ ID NO: 1911721 - RNA, 17 nt, Human
guaucaugcccugugca

SEQ ID NO: 1911722 - RNA, 19 nt, Human
guaucccaugagccucagc

SEQ ID NO: 1911723 - RNA, 18 nt, Human
guaucaugcccugugcaa

SEQ ID NO: 1911724 - RNA, 12 nt, Human
guaacaggcaga

SEQ ID NO: 1911725 - RNA, 22 nt, Human
guaacaggaaaauuuuaaaaau

SEQ ID NO: 1911726 - RNA, 19 nt, Human
aaaugguaggcauuuccua

SEQ ID NO: 1911727 - RNA, 22 nt, Human
aaauguaagaucguucucugcc

SEQ ID NO: 1911728 - RNA, 14 nt, Human
aaauguaagaucgu

SEQ ID NO: 1911729 - RNA, 19 nt, Human
guauaaaagggacugagaa

SEQ ID NO: 1911730 - RNA, 18 nt, Human
gucauaacuaaauaaagc

SEQ ID NO: 1911731 - RNA, 14 nt, Human
aaauuugauugauu

SEQ ID NO: 1911732 - RNA, 13 nt, Human
gucauaacuagaa

SEQ ID NO: 1911733 - RNA, 15 nt, Human
gucagugugacugau

SEQ ID NO: 1911734 - RNA, 14 nt, Human
gucagucacagcca

SEQ ID NO: 1911735 - RNA, 16 nt, Human
gucagucacagccacc

SEQ ID NO: 1911736 - RNA, 13 nt, Human
gucaguuguauca

SEQ ID NO: 1911737 - RNA, 13 nt, Human
gucagucacagcc

SEQ ID NO: 1911738 - RNA, 21 nt, Human
gucaguauguggaaguguggg

SEQ ID NO: 1911739 - RNA, 17 nt, Human
gucaguauguggaagug

SEQ ID NO: 1911740 - RNA, 18 nt, Human
aaauuuguuauaaugaau

SEQ ID NO: 1911741 - RNA, 15 nt, Human
aaauuugauugauuu

SEQ ID NO: 1911742 - RNA, 17 nt, Human
aaauuugauugauuuga

SEQ ID NO: 1911743 - RNA, 18 nt, Human
aaauuuggccaaacaagu

SEQ ID NO: 1911744 - RNA, 15 nt, Human
aaauuugguucuaau

SEQ ID NO: 1911745 - RNA, 16 nt, Human
aaauuugguucuaaua

SEQ ID NO: 1911746 - RNA, 22 nt, Human
gucacacaguauuacuucugcu

SEQ ID NO: 1911747 - RNA, 12 nt, Human
gucacagccacc

SEQ ID NO: 1911748 - RNA, 21 nt, Human
gucacacaguauuacuucugc

SEQ ID NO: 1911749 - RNA, 12 nt, Human
gucaacaaaucu

SEQ ID NO: 1911750 - RNA, 22 nt, Human
gucaacaaaucuaggaaaauau

SEQ ID NO: 1911751 - RNA, 17 nt, Human
gucagaauagaaauuag

SEQ ID NO: 1911752 - RNA, 19 nt, Human
gucagaauuagcugcuucu

SEQ ID NO: 1911753 - RNA, 13 nt, Human
gucagaauagaaa

SEQ ID NO: 1911754 - RNA, 13 nt, Human
gucaggaguuccu

SEQ ID NO: 1911755 - RNA, 23 nt, Human
gucaggaguucgagaccagccug

SEQ ID NO: 1911756 - RNA, 13 nt, Human
gucaggcagggug

SEQ ID NO: 1911757 - RNA, 12 nt, Human
aacaauaaaaga

SEQ ID NO: 1911758 - RNA, 18 nt, Human
aacaaggcaaggcuguca

SEQ ID NO: 1911759 - RNA, 21 nt, Human
aacaaggcaaggcugucaauu

SEQ ID NO: 1911760 - RNA, 16 nt, Human
aacaauguauuuucuu

SEQ ID NO: 1911761 - RNA, 20 nt, Human
aacaauguuguuuuaagacu

SEQ ID NO: 1911762 - RNA, 15 nt, Human
aacaaggcaaggcug

SEQ ID NO: 1911763 - RNA, 16 nt, Human
aacaaggcaaggcugu

SEQ ID NO: 1911764 - RNA, 19 nt, Human
aacaagagcacuacauuca

SEQ ID NO: 1911765 - RNA, 23 nt, Human
aaauuuugauguuuuaaggaugc

SEQ ID NO: 1911766 - RNA, 18 nt, Human
aaauuuugauguuuuaag

SEQ ID NO: 1911767 - RNA, 16 nt, Human
gucccaccuuggcugc

SEQ ID NO: 1911768 - RNA, 15 nt, Human
gucccaccuuggcug

SEQ ID NO: 1911769 - RNA, 14 nt, Human
gucccaccuuggcu

SEQ ID NO: 1911770 - RNA, 11 nt, Human
guccccccacc

SEQ ID NO: 1911771 - RNA, 12 nt, Human
guccccccaccc

SEQ ID NO: 1911772 - RNA, 13 nt, Human
guccauagagagc

SEQ ID NO: 1911773 - RNA, 14 nt, Human
guccauagagagca

SEQ ID NO: 1911774 - RNA, 21 nt, Human
gucccaccccacacacgccag

SEQ ID NO: 1911775 - RNA, 13 nt, Human
guccaagaagccc

SEQ ID NO: 1911776 - RNA, 15 nt, Human
guccaagaagcccag

SEQ ID NO: 1911777 - RNA, 16 nt, Human
guccaagaagcccagg

SEQ ID NO: 1911778 - RNA, 20 nt, Human
guccaagaagcccaggaaag

SEQ ID NO: 1911779 - RNA, 17 nt, Human
guccaagaagcccagga

SEQ ID NO: 1911780 - RNA, 18 nt, Human
guccaagaagcccaggaa

SEQ ID NO: 1911781 - RNA, 21 nt, Human
gucauuuuuuuuaagaaaaag

SEQ ID NO: 1911782 - RNA, 19 nt, Human
gucauuuuuuuuaagaaaa

SEQ ID NO: 1911783 - RNA, 20 nt, Human
gucauuuuucagaccuuuua

SEQ ID NO: 1911784 - RNA, 19 nt, Human
aacacagaaaccuuuuuaa

SEQ ID NO: 1911785 - RNA, 16 nt, Human
aacagauaaauaguuu

SEQ ID NO: 1911786 - RNA, 13 nt, Human
aacagaucuggaa

SEQ ID NO: 1911787 - RNA, 22 nt, Human
aacagaucuggaaccucagccu

SEQ ID NO: 1911788 - RNA, 21 nt, Human
aacagaucuggaaccucagcc

SEQ ID NO: 1911789 - RNA, 14 nt, Human
aacagaagcuucca

SEQ ID NO: 1911790 - RNA, 16 nt, Human
aacagaagcuuccauu

SEQ ID NO: 1911791 - RNA, 23 nt, Human
aacagaauacuguuaaaggaaaa

SEQ ID NO: 1911792 - RNA, 22 nt, Human
aacagugauuaccagggacuga

SEQ ID NO: 1911793 - RNA, 15 nt, Human
aacagugauuaccag

SEQ ID NO: 1911794 - RNA, 18 nt, Human
aacagguaauauaaaaag

SEQ ID NO: 1911795 - RNA, 15 nt, Human
aacagguaauauaaa

SEQ ID NO: 1911796 - RNA, 11 nt, Human
aacagggaggg

SEQ ID NO: 1911797 - RNA, 12 nt, Human
guccuacucugu

SEQ ID NO: 1911798 - RNA, 14 nt, Human
guccuacccauccc

SEQ ID NO: 1911799 - RNA, 16 nt, Human
guccuacccauccccg

SEQ ID NO: 1911800 - RNA, 18 nt, Human
guccuacccauccccgca

SEQ ID NO: 1911801 - RNA, 15 nt, Human
guccuacccacccuc

SEQ ID NO: 1911802 - RNA, 16 nt, Human
guccuacccacccucc

SEQ ID NO: 1911803 - RNA, 15 nt, Human
aacagaaauguacag

SEQ ID NO: 1911804 - RNA, 14 nt, Human
aacagaaauguaca

SEQ ID NO: 1911805 - RNA, 13 nt, Human
aacagaaauguac

SEQ ID NO: 1911806 - RNA, 12 nt, Human
aacagaaaugua

SEQ ID NO: 1911807 - RNA, 14 nt, Human
gucccccuuccaug

SEQ ID NO: 1911808 - RNA, 22 nt, Human
guccccccacccucauucuacu

SEQ ID NO: 1911809 - RNA, 13 nt, Human
guccccccacccu

SEQ ID NO: 1911810 - RNA, 16 nt, Human
gucccccuuccaugga

SEQ ID NO: 1911811 - RNA, 18 nt, Human
gucccccuuccauggacu

SEQ ID NO: 1911812 - RNA, 23 nt, Human
guugcguggacucugcacauguc

SEQ ID NO: 1911813 - RNA, 23 nt, Human
guugcuucuucuacuucagucuu

SEQ ID NO: 1911814 - RNA, 13 nt, Human
guugcccaggcug

SEQ ID NO: 1911815 - RNA, 12 nt, Human
guugcccaggcu

SEQ ID NO: 1911816 - RNA, 23 nt, Human
guugcccaggcaggucuugaacu

SEQ ID NO: 1911817 - RNA, 16 nt, Human
aaggccaaaggaagca

SEQ ID NO: 1911818 - RNA, 14 nt, Human
aaggccauaaaaca

SEQ ID NO: 1911819 - RNA, 17 nt, Human
aaggccauaaaacaggu

SEQ ID NO: 1911820 - RNA, 18 nt, Human
aaggccauaaaacaggua

SEQ ID NO: 1911821 - RNA, 24 nt, Human
aaggccauaaaacagguaauauaa

SEQ ID NO: 1911822 - RNA, 22 nt, Human
aaggccaucugggcuccuccag

SEQ ID NO: 1911823 - RNA, 22 nt, Human
aaggccauccuucccugucugc

SEQ ID NO: 1911824 - RNA, 22 nt, Human
aaggcccuaucuguuuacagug

SEQ ID NO: 1911825 - RNA, 21 nt, Human
aaggcccacgagcuuguucuu

SEQ ID NO: 1911826 - RNA, 21 nt, Human
aaggauacaaaagcaugugag

SEQ ID NO: 1911827 - RNA, 13 nt, Human
aaggauacaaaag

SEQ ID NO: 1911828 - RNA, 15 nt, Human
aaggauagaugcugg

SEQ ID NO: 1911829 - RNA, 18 nt, Human
aaggaauaccuguccccc

SEQ ID NO: 1911830 - RNA, 11 nt, Human
aaggagagcua

SEQ ID NO: 1911831 - RNA, 15 nt, Human
aaggagaugaagcaa

SEQ ID NO: 1911832 - RNA, 20 nt, Human
aaggagaggcaacauccaaa

SEQ ID NO: 1911833 - RNA, 14 nt, Human
aaggagauuuacaa

SEQ ID NO: 1911834 - RNA, 17 nt, Human
aaggagauuuacaacug

SEQ ID NO: 1911835 - RNA, 16 nt, Human
aaggagccuaggccag

SEQ ID NO: 1911836 - RNA, 21 nt, Human
aaggagccuaggccaggugca

SEQ ID NO: 1911837 - RNA, 18 nt, Human
aaggagccuaggccaggu

SEQ ID NO: 1911838 - RNA, 19 nt, Human
aaggagccuaggccaggug

SEQ ID NO: 1911839 - RNA, 20 nt, Human
aaggaggggauagagagaga

SEQ ID NO: 1911840 - RNA, 17 nt, Human
aaggagucaaaacuaca

SEQ ID NO: 1911841 - RNA, 12 nt, Human
aaggagggugag

SEQ ID NO: 1911842 - RNA, 18 nt, Human
aaggaggaagagaaaaaa

SEQ ID NO: 1911843 - RNA, 12 nt, Human
aaggagcugcua

SEQ ID NO: 1911844 - RNA, 14 nt, Human
aaggagcugcuaua

SEQ ID NO: 1911845 - RNA, 18 nt, Human
aaggagcugcuauagccu

SEQ ID NO: 1911846 - RNA, 20 nt, Human
aaggagcugcuauagccugg

SEQ ID NO: 1911847 - RNA, 21 nt, Human
aaggagcugcuauagccuggg

SEQ ID NO: 1911848 - RNA, 14 nt, Human
aaggaagacuucau

SEQ ID NO: 1911849 - RNA, 15 nt, Human
aaggaagacuucauc

SEQ ID NO: 1911850 - RNA, 13 nt, Human
aaggaagcacaug

SEQ ID NO: 1911851 - RNA, 16 nt, Human
aaggaagcacaugccu

SEQ ID NO: 1911852 - RNA, 22 nt, Human
aaggaagccacagcugguggua

SEQ ID NO: 1911853 - RNA, 17 nt, Human
aaggaauaccugucccc

SEQ ID NO: 1911854 - RNA, 15 nt, Human
aaggaaagagggagg

SEQ ID NO: 1911855 - RNA, 23 nt, Human
aaggaaccaaagcgaauuuuaaa

SEQ ID NO: 1911856 - RNA, 22 nt, Human
aaggaaccaaagcgaauuuuaa

SEQ ID NO: 1911857 - RNA, 16 nt, Human
guuuacacucuuugua

SEQ ID NO: 1911858 - RNA, 14 nt, Human
guuuacagucuauu

SEQ ID NO: 1911859 - RNA, 16 nt, Human
guuuacagucuauuug

SEQ ID NO: 1911860 - RNA, 21 nt, Human
guuuacagucuauuugagacu

SEQ ID NO: 1911861 - RNA, 13 nt, Human
guuuauugucaaa

SEQ ID NO: 1911862 - RNA, 15 nt, Human
guuuacaguguuccg

SEQ ID NO: 1911863 - RNA, 13 nt, Human
guuuacaguguuc

SEQ ID NO: 1911864 - RNA, 15 nt, Human
guugggcugguguca

SEQ ID NO: 1911865 - RNA, 13 nt, Human
guugggcuggugu

SEQ ID NO: 1911866 - RNA, 15 nt, Human
guugggccaggagcc

SEQ ID NO: 1911867 - RNA, 17 nt, Human
guugggccaggagccuc

SEQ ID NO: 1911868 - RNA, 22 nt, Human
aaggcucgagcaugccuggaug

SEQ ID NO: 1911869 - RNA, 19 nt, Human
aaggcucgagcaugccugg

SEQ ID NO: 1911870 - RNA, 20 nt, Human
aaggcucgagcaugccugga

SEQ ID NO: 1911871 - RNA, 19 nt, Human
aaggcuccaggagcagcca

SEQ ID NO: 1911872 - RNA, 22 nt, Human
aaggcuccaggagcagccacau

SEQ ID NO: 1911873 - RNA, 16 nt, Human
aaggcucgagcaugcc

SEQ ID NO: 1911874 - RNA, 18 nt, Human
aaggcucgagcaugccug

SEQ ID NO: 1911875 - RNA, 13 nt, Human
guuucaaacuuua

SEQ ID NO: 1911876 - RNA, 13 nt, Human
guuuauuuuaaga

SEQ ID NO: 1911877 - RNA, 16 nt, Human
guuucaaacuuuacua

SEQ ID NO: 1911878 - RNA, 14 nt, Human
guuucaaacuuuac

SEQ ID NO: 1911879 - RNA, 16 nt, Human
aaggcuccaggagcag

SEQ ID NO: 1911880 - RNA, 18 nt, Human
aaggcuccaggagcagcc

SEQ ID NO: 1911881 - RNA, 15 nt, Human
aaggcuccaggagca

SEQ ID NO: 1911882 - RNA, 22 nt, Human
aaggggcccaaauucuuucagu

SEQ ID NO: 1911883 - RNA, 18 nt, Human
aaggggcgucuguucccc

SEQ ID NO: 1911884 - RNA, 20 nt, Human
aagguagaaauaucugaaaa

SEQ ID NO: 1911885 - RNA, 19 nt, Human
guuucuauguguagggcgg

SEQ ID NO: 1911886 - RNA, 14 nt, Human
guuucucaaagaaa

SEQ ID NO: 1911887 - RNA, 18 nt, Human
guuucucaaagaaauuuc

SEQ ID NO: 1911888 - RNA, 17 nt, Human
guuucucaaagaaauuu

SEQ ID NO: 1911889 - RNA, 18 nt, Human
guuucugaaagggacgcu

SEQ ID NO: 1911890 - RNA, 20 nt, Human
guuucugaaaauuaacacug

SEQ ID NO: 1911891 - RNA, 21 nt, Human
guuucugaaaauuaacacugc

SEQ ID NO: 1911892 - RNA, 12 nt, Human
aaggucauuuuu

SEQ ID NO: 1911893 - RNA, 18 nt, Human
aagguauuuaauagguuu

SEQ ID NO: 1911894 - RNA, 16 nt, Human
aaguaaggaauuuuau

SEQ ID NO: 1911895 - RNA, 22 nt, Human
guuucuaugacacaugcaaggu

SEQ ID NO: 1911896 - RNA, 23 nt, Human
aagucuugugacuagugcugaag

SEQ ID NO: 1911897 - RNA, 20 nt, Human
aagucuugugacuagugcug

SEQ ID NO: 1911898 - RNA, 19 nt, Human
aagucuugugacuagugcu

SEQ ID NO: 1911899 - RNA, 14 nt, Human
aagucuugugacua

SEQ ID NO: 1911900 - RNA, 22 nt, Human
aagucuugugacuagugcugaa

SEQ ID NO: 1911901 - RNA, 21 nt, Human
aagucuugugacuagugcuga

SEQ ID NO: 1911902 - RNA, 14 nt, Human
aagucuuuuguucg

SEQ ID NO: 1911903 - RNA, 16 nt, Human
aagucuuucacauuua

SEQ ID NO: 1911904 - RNA, 14 nt, Human
aaguauuuuauucu

SEQ ID NO: 1911905 - RNA, 13 nt, Human
aaguauuugggaa

SEQ ID NO: 1911906 - RNA, 14 nt, Human
aagugagagcuggg

SEQ ID NO: 1911907 - RNA, 12 nt, Human
aagugagagagg

SEQ ID NO: 1911908 - RNA, 15 nt, Human
aagugagagcugggu

SEQ ID NO: 1911909 - RNA, 15 nt, Human
guuuuucauaaagca

SEQ ID NO: 1911910 - RNA, 14 nt, Human
guuuuucaguuuuc

SEQ ID NO: 1911911 - RNA, 19 nt, Human
guuuuuccuguucuuaaga

SEQ ID NO: 1911912 - RNA, 18 nt, Human
aagugagacuuugagggu

SEQ ID NO: 1911913 - RNA, 13 nt, Human
aagugaagacugg

SEQ ID NO: 1911914 - RNA, 16 nt, Human
aagugaagacuggaag

SEQ ID NO: 1911915 - RNA, 19 nt, Human
aagugaagacaaugacuua

SEQ ID NO: 1911916 - RNA, 17 nt, Human
aagugaagacaaugacu

SEQ ID NO: 1911917 - RNA, 21 nt, Human
aagugaaaaaggaggaagaga

SEQ ID NO: 1911918 - RNA, 18 nt, Human
aagucuuuuguucgcaug

SEQ ID NO: 1911919 - RNA, 20 nt, Human
aaguacacuguuucaaacuu

SEQ ID NO: 1911920 - RNA, 19 nt, Human
aaguacacuguuucaaacu

SEQ ID NO: 1911921 - RNA, 23 nt, Human
aaguacacuguuucaaacuuuac

SEQ ID NO: 1911922 - RNA, 22 nt, Human
guuuugccauguuggccaggcu

SEQ ID NO: 1911923 - RNA, 21 nt, Human
guuuugccauguuggccaggc

SEQ ID NO: 1911924 - RNA, 20 nt, Human
guuuugccauguuggccagg

SEQ ID NO: 1911925 - RNA, 16 nt, Human
guuuugccauguuggc

SEQ ID NO: 1911926 - RNA, 14 nt, Human
guuucugccgcagc

SEQ ID NO: 1911927 - RNA, 15 nt, Human
guuucugccgcagcc

SEQ ID NO: 1911928 - RNA, 21 nt, Human
aaguaauccaccugccucggc

SEQ ID NO: 1911929 - RNA, 18 nt, Human
aaguacacuguuucaaac

SEQ ID NO: 1911930 - RNA, 13 nt, Human
aaguacacuguuu

SEQ ID NO: 1911931 - RNA, 19 nt, Human
uaaaauaucauucagcaac

SEQ ID NO: 1911932 - RNA, 15 nt, Human
uaaaauauuuaucug

SEQ ID NO: 1911933 - RNA, 16 nt, Human
aagugaggaugaaaaa

SEQ ID NO: 1911934 - RNA, 18 nt, Human
aagugauucuccugccuc

SEQ ID NO: 1911935 - RNA, 17 nt, Human
aagugauucuccugccu

SEQ ID NO: 1911936 - RNA, 16 nt, Human
aagugauucuccugcc

SEQ ID NO: 1911937 - RNA, 15 nt, Human
aagugauucuccugc

SEQ ID NO: 1911938 - RNA, 19 nt, Human
aagugauucuccugccuca

SEQ ID NO: 1911939 - RNA, 20 nt, Human
aagugauucuccugccucag

SEQ ID NO: 1911940 - RNA, 18 nt, Human
uaaaauaucauucagcaa

SEQ ID NO: 1911941 - RNA, 18 nt, Human
uaaaauacgguaccuggc

SEQ ID NO: 1911942 - RNA, 22 nt, Human
uaaaauaccagccaguaaaugg

SEQ ID NO: 1911943 - RNA, 20 nt, Human
uaaaagacagugaaagaaaa

SEQ ID NO: 1911944 - RNA, 13 nt, Human
uaaaagacuuuuu

SEQ ID NO: 1911945 - RNA, 22 nt, Human
uaaaagugggcuugauucugca

SEQ ID NO: 1911946 - RNA, 23 nt, Human
uaaaagugggcuugauucugcag

SEQ ID NO: 1911947 - RNA, 15 nt, Human
uaaaaaucucaaauu

SEQ ID NO: 1911948 - RNA, 17 nt, Human
uaaaaaucucaaauuuc

SEQ ID NO: 1911949 - RNA, 16 nt, Human
uaaaaaucucaaauuu

SEQ ID NO: 1911950 - RNA, 21 nt, Human
uaaaaauaaaaaacacuggga

SEQ ID NO: 1911951 - RNA, 17 nt, Human
uaaaaauaaauuugguu

SEQ ID NO: 1911952 - RNA, 18 nt, Human
uaaaaauaaaaaacacug

SEQ ID NO: 1911953 - RNA, 19 nt, Human
uaaaaauaaaaaacacugg

SEQ ID NO: 1911954 - RNA, 15 nt, Human
uaaaaaguggaaaaa

SEQ ID NO: 1911955 - RNA, 15 nt, Human
guuuuucuucucccu

SEQ ID NO: 1911956 - RNA, 20 nt, Human
uaaaacuugauguguuaucu

SEQ ID NO: 1911957 - RNA, 22 nt, Human
uaaaacuugauguguuaucucu

SEQ ID NO: 1911958 - RNA, 12 nt, Human
uaaaagaauugu

SEQ ID NO: 1911959 - RNA, 21 nt, Human
uaaaaaucucaaauuucuaaa

SEQ ID NO: 1911960 - RNA, 20 nt, Human
uaaaaaucucaaauuucuaa

SEQ ID NO: 1911961 - RNA, 19 nt, Human
uaaaaaucucaaauuucua

SEQ ID NO: 1911962 - RNA, 15 nt, Human
guuaggauggcagga

SEQ ID NO: 1911963 - RNA, 19 nt, Human
guuaggcauugugggaagg

SEQ ID NO: 1911964 - RNA, 20 nt, Human
guuaggcauugugggaaggg

SEQ ID NO: 1911965 - RNA, 18 nt, Human
guuaagagaaaugagcuu

SEQ ID NO: 1911966 - RNA, 14 nt, Human
guuaagauuccuaa

SEQ ID NO: 1911967 - RNA, 11 nt, Human
guuaagagaaa

SEQ ID NO: 1911968 - RNA, 12 nt, Human
guuaagagaaau

SEQ ID NO: 1911969 - RNA, 20 nt, Human
guuagaauaauaaauauuua

SEQ ID NO: 1911970 - RNA, 18 nt, Human
guuacuuuucauauuugc

SEQ ID NO: 1911971 - RNA, 21 nt, Human
guuacuuuucauauuugcacu

SEQ ID NO: 1911972 - RNA, 22 nt, Human
guuacuuuucauauuugcacua

SEQ ID NO: 1911973 - RNA, 21 nt, Human
guuauuuuuuaauuauuauuu

SEQ ID NO: 1911974 - RNA, 20 nt, Human
guucaaagauauuuugcuuu

SEQ ID NO: 1911975 - RNA, 22 nt, Human
guucaaagauauuuugcuuugu

SEQ ID NO: 1911976 - RNA, 21 nt, Human
guucaaagauauuuugcuuug

SEQ ID NO: 1911977 - RNA, 18 nt, Human
guucaagcgauucuucug

SEQ ID NO: 1911978 - RNA, 15 nt, Human
guucaaacauuuacc

SEQ ID NO: 1911979 - RNA, 16 nt, Human
guuauuuuuuaauuau

SEQ ID NO: 1911980 - RNA, 23 nt, Human
guuauuuuuauuuauuuaaauuu

SEQ ID NO: 1911981 - RNA, 13 nt, Human
guuagggaauggc

SEQ ID NO: 1911982 - RNA, 16 nt, Human
aagcuaggccuggcca

SEQ ID NO: 1911983 - RNA, 12 nt, Human
aagcuaggccug

SEQ ID NO: 1911984 - RNA, 20 nt, Human
aagccugaguuugcuuucaa

SEQ ID NO: 1911985 - RNA, 24 nt, Human
aagccugaaggggcgucuguuccc

SEQ ID NO: 1911986 - RNA, 15 nt, Human
aagccugaugcugac

SEQ ID NO: 1911987 - RNA, 13 nt, Human
guucagccugccu

SEQ ID NO: 1911988 - RNA, 13 nt, Human
guucagcuccagc

SEQ ID NO: 1911989 - RNA, 15 nt, Human
guucagcuccagcuc

SEQ ID NO: 1911990 - RNA, 12 nt, Human
aagcucagggcc

SEQ ID NO: 1911991 - RNA, 13 nt, Human
aagcucagggccu

SEQ ID NO: 1911992 - RNA, 16 nt, Human
aagcucagggccuggc

SEQ ID NO: 1911993 - RNA, 17 nt, Human
aagcucagggccuggcu

SEQ ID NO: 1911994 - RNA, 20 nt, Human
aagcucagggccuggcucag

SEQ ID NO: 1911995 - RNA, 18 nt, Human
aagcucagggccuggcuc

SEQ ID NO: 1911996 - RNA, 19 nt, Human
aagcucagggccuggcuca

SEQ ID NO: 1911997 - RNA, 17 nt, Human
aagcuccaagcucccag

SEQ ID NO: 1911998 - RNA, 18 nt, Human
aagcuccaagcucccagg

SEQ ID NO: 1911999 - RNA, 21 nt, Human
gugugugcgccuacaggagug

SEQ ID NO: 1912000 - RNA, 17 nt, Human
gugugugaaugaacacu

SEQ ID NO: 1912001 - RNA, 17 nt, Human
gugugugcucugcuuca

SEQ ID NO: 1912002 - RNA, 16 nt, Human
gugugugggagugugu

SEQ ID NO: 1912003 - RNA, 12 nt, Human
aagcagugcaug

SEQ ID NO: 1912004 - RNA, 14 nt, Human
aagcagugcaugcu

SEQ ID NO: 1912005 - RNA, 15 nt, Human
aagcagugcaugcug

SEQ ID NO: 1912006 - RNA, 20 nt, Human
aagcagugcaugcugucccu

SEQ ID NO: 1912007 - RNA, 16 nt, Human
aagcauuuacuuugug

SEQ ID NO: 1912008 - RNA, 12 nt, Human
aagcauuuauaa

SEQ ID NO: 1912009 - RNA, 22 nt, Human
aagccaaagcuaggccuggcca

SEQ ID NO: 1912010 - RNA, 14 nt, Human
aagcccaggaaagg

SEQ ID NO: 1912011 - RNA, 17 nt, Human
aagcccaggaaaggcuc

SEQ ID NO: 1912012 - RNA, 22 nt, Human
aagccaagaggcugcagccagg

SEQ ID NO: 1912013 - RNA, 18 nt, Human
aagccaagaggcugcagc

SEQ ID NO: 1912014 - RNA, 19 nt, Human
aagcccaggaaaggcucca

SEQ ID NO: 1912015 - RNA, 22 nt, Human
aagcccaggaaaggcuccagga

SEQ ID NO: 1912016 - RNA, 19 nt, Human
aagcccaguucagcuuggg

SEQ ID NO: 1912017 - RNA, 18 nt, Human
aagcccaguucagcuugg

SEQ ID NO: 1912018 - RNA, 19 nt, Human
aagcccugagcuuucugcu

SEQ ID NO: 1912019 - RNA, 19 nt, Human
aagcccugggaucacugug

SEQ ID NO: 1912020 - RNA, 16 nt, Human
aagcccccccuuccac

SEQ ID NO: 1912021 - RNA, 16 nt, Human
aagcccccagcuaaga

SEQ ID NO: 1912022 - RNA, 21 nt, Human
aagcccccagcuaagaaccug

SEQ ID NO: 1912023 - RNA, 23 nt, Human
aagcccccagcuaagaaccugga

SEQ ID NO: 1912024 - RNA, 14 nt, Human
aagcccccaccgug

SEQ ID NO: 1912025 - RNA, 20 nt, Human
aagcccccaccgugggcagg

SEQ ID NO: 1912026 - RNA, 21 nt, Human
aagcccugugcuccauggcug

SEQ ID NO: 1912027 - RNA, 22 nt, Human
aagcccuguugacacaggucuu

SEQ ID NO: 1912028 - RNA, 20 nt, Human
aagccgcuggggccaguugg

SEQ ID NO: 1912029 - RNA, 14 nt, Human
guuaagaccuggca

SEQ ID NO: 1912030 - RNA, 16 nt, Human
guuaagaccuggcagc

SEQ ID NO: 1912031 - RNA, 17 nt, Human
guuaagacaugauuucc

SEQ ID NO: 1912032 - RNA, 19 nt, Human
guuaagacaugauuuccuu

SEQ ID NO: 1912033 - RNA, 22 nt, Human
guuaagacaugauuuccuugaa

SEQ ID NO: 1912034 - RNA, 13 nt, Human
guuaagaccuggc

SEQ ID NO: 1912035 - RNA, 18 nt, Human
aagaucucugcagggccg

SEQ ID NO: 1912036 - RNA, 18 nt, Human
aagaucuguccucagccu

SEQ ID NO: 1912037 - RNA, 17 nt, Human
aagaucuguccucagcc

SEQ ID NO: 1912038 - RNA, 18 nt, Human
aagaucucagugguuaag

SEQ ID NO: 1912039 - RNA, 17 nt, Human
aagaucguucucugccu

SEQ ID NO: 1912040 - RNA, 16 nt, Human
aagaucguucucugcc

SEQ ID NO: 1912041 - RNA, 13 nt, Human
aagaguaggaaga

SEQ ID NO: 1912042 - RNA, 14 nt, Human
aagaguaggaagac

SEQ ID NO: 1912043 - RNA, 19 nt, Human
aagaugcuucucacugcca

SEQ ID NO: 1912044 - RNA, 17 nt, Human
aagaugcuucucacugc

SEQ ID NO: 1912045 - RNA, 16 nt, Human
aagaugcuucucacug

SEQ ID NO: 1912046 - RNA, 15 nt, Human
aagaugaacagacug

SEQ ID NO: 1912047 - RNA, 17 nt, Human
aagaugaacagacugac

SEQ ID NO: 1912048 - RNA, 23 nt, Human
aagaugaaggagaggcaacaucc

SEQ ID NO: 1912049 - RNA, 17 nt, Human
guggggucacucuggca

SEQ ID NO: 1912050 - RNA, 20 nt, Human
guggggucacucuggcagcu

SEQ ID NO: 1912051 - RNA, 21 nt, Human
guggggucacucuggcagcuc

SEQ ID NO: 1912052 - RNA, 22 nt, Human
guggggucacucuggcagcuca

SEQ ID NO: 1912053 - RNA, 15 nt, Human
guggggucaugcccu

SEQ ID NO: 1912054 - RNA, 19 nt, Human
gugggguagguugggagaa

SEQ ID NO: 1912055 - RNA, 21 nt, Human
guggggucaugcccuccucuc

SEQ ID NO: 1912056 - RNA, 19 nt, Human
guggggucaugcccuccuc

SEQ ID NO: 1912057 - RNA, 22 nt, Human
aagagggucugaggaauccaga

SEQ ID NO: 1912058 - RNA, 12 nt, Human
aagaguaggaag

SEQ ID NO: 1912059 - RNA, 15 nt, Human
aagaguagaauugca

SEQ ID NO: 1912060 - RNA, 23 nt, Human
aagagggagggagggcuccagac

SEQ ID NO: 1912061 - RNA, 14 nt, Human
aagaggcugcagcc

SEQ ID NO: 1912062 - RNA, 22 nt, Human
aagaggcugaggcuggcacagg

SEQ ID NO: 1912063 - RNA, 18 nt, Human
aagaugggugaaggcugg

SEQ ID NO: 1912064 - RNA, 13 nt, Human
aagauguagagga

SEQ ID NO: 1912065 - RNA, 22 nt, Human
aagauggguccaggauuccucu

SEQ ID NO: 1912066 - RNA, 17 nt, Human
guguauuuacgcuuuga

SEQ ID NO: 1912067 - RNA, 21 nt, Human
guguauuuacgcuuugauuca

SEQ ID NO: 1912068 - RNA, 20 nt, Human
gugucaagagggucugagga

SEQ ID NO: 1912069 - RNA, 23 nt, Human
guguauuuuucaauaaagcauuu

SEQ ID NO: 1912070 - RNA, 23 nt, Human
guguauuuuuuuacuaauagaca

SEQ ID NO: 1912071 - RNA, 17 nt, Human
guguauuuuuuuacuaa

SEQ ID NO: 1912072 - RNA, 16 nt, Human
gugucagcauagaagu

SEQ ID NO: 1912073 - RNA, 23 nt, Human
gugucaggaugguaauucuuauu

SEQ ID NO: 1912074 - RNA, 21 nt, Human
gugugaccacugcagaagaca

SEQ ID NO: 1912075 - RNA, 15 nt, Human
gugugaaugaacacu

SEQ ID NO: 1912076 - RNA, 22 nt, Human
gugugacaaggauugcuacugu

SEQ ID NO: 1912077 - RNA, 14 nt, Human
gugugaaugaacac

SEQ ID NO: 1912078 - RNA, 20 nt, Human
gugucagguggggcagcuug

SEQ ID NO: 1912079 - RNA, 16 nt, Human
gugugguagagugugc

SEQ ID NO: 1912080 - RNA, 17 nt, Human
guguggguaccuguauu

SEQ ID NO: 1912081 - RNA, 14 nt, Human
gugugggucugugu

SEQ ID NO: 1912082 - RNA, 16 nt, Human
guguggguaccuguau

SEQ ID NO: 1912083 - RNA, 19 nt, Human
guguguccaaaacugccuc

SEQ ID NO: 1912084 - RNA, 20 nt, Human
gugugucuuuccucccugaa

SEQ ID NO: 1912085 - RNA, 18 nt, Human
guguguccaaaacugccu

SEQ ID NO: 1912086 - RNA, 20 nt, Human
gugugucacccuuaggccag

SEQ ID NO: 1912087 - RNA, 15 nt, Human
guguguauguggggg

SEQ ID NO: 1912088 - RNA, 13 nt, Human
guguguauguggg

SEQ ID NO: 1912089 - RNA, 15 nt, Human
aagaccuucuccuuc

SEQ ID NO: 1912090 - RNA, 18 nt, Human
aagaccuucuccuucacc

SEQ ID NO: 1912091 - RNA, 19 nt, Human
aagaccuucuccuucaccu

SEQ ID NO: 1912092 - RNA, 13 nt, Human
aagacgcugugcu

SEQ ID NO: 1912093 - RNA, 13 nt, Human
aagaccuuucaaa

SEQ ID NO: 1912094 - RNA, 15 nt, Human
aagacgcugugcugc

SEQ ID NO: 1912095 - RNA, 17 nt, Human
aagacgcugugcugccc

SEQ ID NO: 1912096 - RNA, 18 nt, Human
aagacgcugugcugcccu

SEQ ID NO: 1912097 - RNA, 19 nt, Human
aagacgcugugcugcccug

SEQ ID NO: 1912098 - RNA, 20 nt, Human
aagacgcugugcugcccugc

SEQ ID NO: 1912099 - RNA, 22 nt, Human
aagacgugauuuugcuguagaa

SEQ ID NO: 1912100 - RNA, 16 nt, Human
aagacgugauuuugcu

SEQ ID NO: 1912101 - RNA, 23 nt, Human
aagacgugauuuugcuguagaag

SEQ ID NO: 1912102 - RNA, 15 nt, Human
aagacguguuugugu

SEQ ID NO: 1912103 - RNA, 16 nt, Human
aagacguguuuguguu

SEQ ID NO: 1912104 - RNA, 23 nt, Human
aagacguguuuguguuugugugu

SEQ ID NO: 1912105 - RNA, 23 nt, Human
aagacugaguacguugugcauuu

SEQ ID NO: 1912106 - RNA, 20 nt, Human
aagacuauccaacuuaacau

SEQ ID NO: 1912107 - RNA, 18 nt, Human
aagacuuccagagccuca

SEQ ID NO: 1912108 - RNA, 16 nt, Human
aagacuuccagagccu

SEQ ID NO: 1912109 - RNA, 20 nt, Human
aagacuugcauuuaaaugug

SEQ ID NO: 1912110 - RNA, 16 nt, Human
aagacuuuggaaagac

SEQ ID NO: 1912111 - RNA, 11 nt, Human
aagagccacag

SEQ ID NO: 1912112 - RNA, 21 nt, Human
guggccucccaacucacccca

SEQ ID NO: 1912113 - RNA, 22 nt, Human
guggccucccaacucaccccag

SEQ ID NO: 1912114 - RNA, 23 nt, Human
aagaggaaugaaguacucauaca

SEQ ID NO: 1912115 - RNA, 15 nt, Human
aagagccacaggucu

SEQ ID NO: 1912116 - RNA, 22 nt, Human
aagagccacaggucuuuauguu

SEQ ID NO: 1912117 - RNA, 22 nt, Human
aagaggacauaaugggguccug

SEQ ID NO: 1912118 - RNA, 14 nt, Human
aagaggaugcugug

SEQ ID NO: 1912119 - RNA, 17 nt, Human
aagaggaugcugugaaa

SEQ ID NO: 1912120 - RNA, 17 nt, Human
guggccgcccaaggccc

SEQ ID NO: 1912121 - RNA, 23 nt, Human
gugggaggaucucuugagccugg

SEQ ID NO: 1912122 - RNA, 18 nt, Human
gugggagcugccuguuca

SEQ ID NO: 1912123 - RNA, 15 nt, Human
gugggagcugccugu

SEQ ID NO: 1912124 - RNA, 15 nt, Human
guggggucacucugg

SEQ ID NO: 1912125 - RNA, 14 nt, Human
gugggagcugccug

SEQ ID NO: 1912126 - RNA, 15 nt, Human
gugggacacccugug

SEQ ID NO: 1912127 - RNA, 13 nt, Human
gugggacacccug

SEQ ID NO: 1912128 - RNA, 22 nt, Human
guggcgcagcauauucaggaag

SEQ ID NO: 1912129 - RNA, 20 nt, Human
guggcgacucuauagacucu

SEQ ID NO: 1912130 - RNA, 20 nt, Human
aauagucuagacuaaaagau

SEQ ID NO: 1912131 - RNA, 14 nt, Human
aauagucuagaugg

SEQ ID NO: 1912132 - RNA, 21 nt, Human
aauagucuagauggcuccucu

SEQ ID NO: 1912133 - RNA, 19 nt, Human
aauagucuagacuaaaaga

SEQ ID NO: 1912134 - RNA, 20 nt, Human
aauagucuagauggcuccuc

SEQ ID NO: 1912135 - RNA, 15 nt, Human
aauauauuuaagaua

SEQ ID NO: 1912136 - RNA, 20 nt, Human
aauauauuuaagauaauuau

SEQ ID NO: 1912137 - RNA, 19 nt, Human
aauauauuuaagauaauua

SEQ ID NO: 1912138 - RNA, 21 nt, Human
aauauauuuuaagacgaaaca

SEQ ID NO: 1912139 - RNA, 21 nt, Human
aauaguucagguaacaggcag

SEQ ID NO: 1912140 - RNA, 21 nt, Human
aauauauucagccuggcuuca

SEQ ID NO: 1912141 - RNA, 22 nt, Human
aauaguuaagacaugauuuccu

SEQ ID NO: 1912142 - RNA, 23 nt, Human
aauaguuaagacaugauuuccuu

SEQ ID NO: 1912143 - RNA, 21 nt, Human
aauaguuaagacaugauuucc

SEQ ID NO: 1912144 - RNA, 20 nt, Human
uaacaugaauauuuaguguu

SEQ ID NO: 1912145 - RNA, 21 nt, Human
uaacaugaauauuuaguguuc

SEQ ID NO: 1912146 - RNA, 14 nt, Human
uaacaugaauauuu

SEQ ID NO: 1912147 - RNA, 18 nt, Human
uaacaugaggggacauuu

SEQ ID NO: 1912148 - RNA, 19 nt, Human
uaacaugaggggacauuuu

SEQ ID NO: 1912149 - RNA, 20 nt, Human
uaacaugaggggacauuuug

SEQ ID NO: 1912150 - RNA, 19 nt, Human
uaacauguaauuaaguacu

SEQ ID NO: 1912151 - RNA, 23 nt, Human
uaacaugaggggacauuuuggug

SEQ ID NO: 1912152 - RNA, 19 nt, Human
uaacaugaauauuuagugu

SEQ ID NO: 1912153 - RNA, 13 nt, Human
uaacguauaaaag

SEQ ID NO: 1912154 - RNA, 17 nt, Human
uaacguauaaaagccug

SEQ ID NO: 1912155 - RNA, 16 nt, Human
uaacuagauggugcug

SEQ ID NO: 1912156 - RNA, 18 nt, Human
uaacuagauggugcugag

SEQ ID NO: 1912157 - RNA, 19 nt, Human
uaacuagauggugcugaga

SEQ ID NO: 1912158 - RNA, 20 nt, Human
uaacuagauggugcugagaa

SEQ ID NO: 1912159 - RNA, 21 nt, Human
uaacuagauggugcugagaag

SEQ ID NO: 1912160 - RNA, 13 nt, Human
uaacuucacauau

SEQ ID NO: 1912161 - RNA, 17 nt, Human
uaacuuccaugugaggg

SEQ ID NO: 1912162 - RNA, 15 nt, Human
uaacuagcuuggaaa

SEQ ID NO: 1912163 - RNA, 16 nt, Human
uaacuugucuuuggac

SEQ ID NO: 1912164 - RNA, 20 nt, Human
uaacuugucuuuggacccug

SEQ ID NO: 1912165 - RNA, 17 nt, Human
uaacuucuuauggaauu

SEQ ID NO: 1912166 - RNA, 13 nt, Human
uaacuucugccug

SEQ ID NO: 1912167 - RNA, 18 nt, Human
uaacuucuuauggaauug

SEQ ID NO: 1912168 - RNA, 19 nt, Human
uaacuucuuauggaauuga

SEQ ID NO: 1912169 - RNA, 13 nt, Human
uaagaagugaaaa

SEQ ID NO: 1912170 - RNA, 13 nt, Human
uaagaaggcaaaa

SEQ ID NO: 1912171 - RNA, 17 nt, Human
uaagaaggcaaaaaugu

SEQ ID NO: 1912172 - RNA, 18 nt, Human
uaagaaggcaaaaaugua

SEQ ID NO: 1912173 - RNA, 14 nt, Human
uaagaauucaaacu

SEQ ID NO: 1912174 - RNA, 18 nt, Human
uaagaauucaaacugggg

SEQ ID NO: 1912175 - RNA, 23 nt, Human
uaagacaaaaagcuacuuauugu

SEQ ID NO: 1912176 - RNA, 18 nt, Human
uaagaccuggcagcucug

SEQ ID NO: 1912177 - RNA, 17 nt, Human
uaagaccuggcagcucu

SEQ ID NO: 1912178 - RNA, 22 nt, Human
uaagaauucaaacuggggccuc

SEQ ID NO: 1912179 - RNA, 20 nt, Human
uaaauuaacuuuuauaaacu

SEQ ID NO: 1912180 - RNA, 19 nt, Human
uaaauuaacuuuuauaaac

SEQ ID NO: 1912181 - RNA, 16 nt, Human
uaaauguuaagaaaaa

SEQ ID NO: 1912182 - RNA, 18 nt, Human
uaaaugaaaaucgugaca

SEQ ID NO: 1912183 - RNA, 21 nt, Human
aaguguauuuuuuuacuaaua

SEQ ID NO: 1912184 - RNA, 18 nt, Human
aaguguauuuuuuuacua

SEQ ID NO: 1912185 - RNA, 13 nt, Human
aaguguauuuuuc

SEQ ID NO: 1912186 - RNA, 15 nt, Human
aaguguauuuuucaa

SEQ ID NO: 1912187 - RNA, 22 nt, Human
aaguguauuuuucaauaaagca

SEQ ID NO: 1912188 - RNA, 21 nt, Human
uaaauuaugggaaucaagauu

SEQ ID NO: 1912189 - RNA, 20 nt, Human
uaaauuaugggaaucaagau

SEQ ID NO: 1912190 - RNA, 21 nt, Human
uaaauuaacuuuuauaaacuu

SEQ ID NO: 1912191 - RNA, 13 nt, Human
aauacagaggcaa

SEQ ID NO: 1912192 - RNA, 21 nt, Human
aauacaccagguagaacacaa

SEQ ID NO: 1912193 - RNA, 16 nt, Human
aauacagggcauuuug

SEQ ID NO: 1912194 - RNA, 17 nt, Human
aauaccagccaguaaau

SEQ ID NO: 1912195 - RNA, 19 nt, Human
aauaccagccaguaaaugg

SEQ ID NO: 1912196 - RNA, 12 nt, Human
aauaccaaggaa

SEQ ID NO: 1912197 - RNA, 16 nt, Human
aauaccucugugugcu

SEQ ID NO: 1912198 - RNA, 15 nt, Human
aauaccucugugugc

SEQ ID NO: 1912199 - RNA, 14 nt, Human
aauaccucugugug

SEQ ID NO: 1912200 - RNA, 13 nt, Human
aauaccucugugu

SEQ ID NO: 1912201 - RNA, 15 nt, Human
aauaccugucccccu

SEQ ID NO: 1912202 - RNA, 18 nt, Human
aauaccugucccccugac

SEQ ID NO: 1912203 - RNA, 19 nt, Human
aauaccugucccccugaca

SEQ ID NO: 1912204 - RNA, 21 nt, Human
aauaccugucccccugacaac

SEQ ID NO: 1912205 - RNA, 18 nt, Human
aauagcgucauaacuaga

SEQ ID NO: 1912206 - RNA, 16 nt, Human
aauagacuaaaugaaa

SEQ ID NO: 1912207 - RNA, 15 nt, Human
aauagacuaaaugaa

SEQ ID NO: 1912208 - RNA, 18 nt, Human
aaucagggaggucauuuu

SEQ ID NO: 1912209 - RNA, 19 nt, Human
aaucagggaggucauuuug

SEQ ID NO: 1912210 - RNA, 14 nt, Human
aaucaguauaaaca

SEQ ID NO: 1912211 - RNA, 15 nt, Human
aaucaguauaaacaa

SEQ ID NO: 1912212 - RNA, 17 nt, Human
aaucaguauaaacaaag

SEQ ID NO: 1912213 - RNA, 19 nt, Human
aaucagccugcuccagcug

SEQ ID NO: 1912214 - RNA, 13 nt, Human
aaucagccugcuc

SEQ ID NO: 1912215 - RNA, 18 nt, Human
aaucagccugcuccagcu

SEQ ID NO: 1912216 - RNA, 11 nt, Human
aaucagccugc

SEQ ID NO: 1912217 - RNA, 20 nt, Human
aaucacguaaagcuagaaau

SEQ ID NO: 1912218 - RNA, 21 nt, Human
aaucacguaaagcuagaaaug

SEQ ID NO: 1912219 - RNA, 19 nt, Human
aauauuuucuuuaaugcuu

SEQ ID NO: 1912220 - RNA, 21 nt, Human
aauauuuucuuuaaugcuuuu

SEQ ID NO: 1912221 - RNA, 19 nt, Human
aauauuuauuauuuucacc

SEQ ID NO: 1912222 - RNA, 20 nt, Human
aauauuuauuauuuucaccu

SEQ ID NO: 1912223 - RNA, 18 nt, Human
aauauuuucuuuaaugcu

SEQ ID NO: 1912224 - RNA, 15 nt, Human
uaagacguguuugug

SEQ ID NO: 1912225 - RNA, 12 nt, Human
aauauuuauuac

SEQ ID NO: 1912226 - RNA, 13 nt, Human
aauauuuauuacc

SEQ ID NO: 1912227 - RNA, 14 nt, Human
aauauuuauuaccu

SEQ ID NO: 1912228 - RNA, 15 nt, Human
aauauuuauuaccuc

SEQ ID NO: 1912229 - RNA, 16 nt, Human
aauauuuauuaccucu

SEQ ID NO: 1912230 - RNA, 17 nt, Human
aauauuuauuaccucug

SEQ ID NO: 1912231 - RNA, 18 nt, Human
aauauuuauuaccucuga

SEQ ID NO: 1912232 - RNA, 12 nt, Human
aauauuuauuau

SEQ ID NO: 1912233 - RNA, 22 nt, Human
uaaggaauuuuauuuuuuucug

SEQ ID NO: 1912234 - RNA, 17 nt, Human
uaaggaauaccuguccc

SEQ ID NO: 1912235 - RNA, 18 nt, Human
uaaggaauaccugucccc

SEQ ID NO: 1912236 - RNA, 13 nt, Human
uaaggaagacaau

SEQ ID NO: 1912237 - RNA, 9 nt, Human
uaaggaaua

SEQ ID NO: 1912238 - RNA, 14 nt, Human
uaagauucauauuu

SEQ ID NO: 1912239 - RNA, 14 nt, Human
uaagcaaaauguga

SEQ ID NO: 1912240 - RNA, 21 nt, Human
uaagcaaaaugugauauguac

SEQ ID NO: 1912241 - RNA, 15 nt, Human
uaagcaaaaugugau

SEQ ID NO: 1912242 - RNA, 21 nt, Human
uaagcuauucaguaauaacuc

SEQ ID NO: 1912243 - RNA, 21 nt, Human
uaaguuuccuuccagcccaga

SEQ ID NO: 1912244 - RNA, 19 nt, Human
uaaguuuccuuccagccca

SEQ ID NO: 1912245 - RNA, 17 nt, Human
uaaguguguguuuuuca

SEQ ID NO: 1912246 - RNA, 21 nt, Human
uaaguuacacauuuuucagau

SEQ ID NO: 1912247 - RNA, 21 nt, Human
uaaguauucuuauuuaaugaa

SEQ ID NO: 1912248 - RNA, 18 nt, Human
aaucccacccacauguga

SEQ ID NO: 1912249 - RNA, 14 nt, Human
aaucccagcaauuu

SEQ ID NO: 1912250 - RNA, 17 nt, Human
aaucccacccacaugug

SEQ ID NO: 1912251 - RNA, 17 nt, Human
aaucccauuuaaaaaaa

SEQ ID NO: 1912252 - RNA, 21 nt, Human
aaucccaaauuugauugauuu

SEQ ID NO: 1912253 - RNA, 20 nt, Human
aauccucaguuuuugugaaa

SEQ ID NO: 1912254 - RNA, 13 nt, Human
aaucucaaauaac

SEQ ID NO: 1912255 - RNA, 12 nt, Human
aaucuauuuaag

SEQ ID NO: 1912256 - RNA, 17 nt, Human
aaucuauuuaucuucau

SEQ ID NO: 1912257 - RNA, 18 nt, Human
aaucuaugauuccaggug

SEQ ID NO: 1912258 - RNA, 15 nt, Human
aaucuaugauuccag

SEQ ID NO: 1912259 - RNA, 11 nt, Human
aaucuauuuaa

SEQ ID NO: 1912260 - RNA, 21 nt, Human
aaucggaucuggggcucuggg

SEQ ID NO: 1912261 - RNA, 22 nt, Human
aaucggaucuggggcucuggga

SEQ ID NO: 1912262 - RNA, 23 nt, Human
aaucggaucuggggcucugggau

SEQ ID NO: 1912263 - RNA, 14 nt, Human
aauggaaccaggcu

SEQ ID NO: 1912264 - RNA, 19 nt, Human
aaugcuuuagaaagguuuu

SEQ ID NO: 1912265 - RNA, 16 nt, Human
aauggaaccaggcuug

SEQ ID NO: 1912266 - RNA, 17 nt, Human
aauggaaccaggcuugg

SEQ ID NO: 1912267 - RNA, 18 nt, Human
aaugcuuuagaaagguuu

SEQ ID NO: 1912268 - RNA, 13 nt, Human
aauggaagacagc

SEQ ID NO: 1912269 - RNA, 18 nt, Human
aaugcugguuuuucaguu

SEQ ID NO: 1912270 - RNA, 22 nt, Human
aaugcuggcuguuggcuggggg

SEQ ID NO: 1912271 - RNA, 21 nt, Human
aaugcuggcuguuggcugggg

SEQ ID NO: 1912272 - RNA, 16 nt, Human
aaugcaugauuuugua

SEQ ID NO: 1912273 - RNA, 17 nt, Human
aaugcaugauuuuguaa

SEQ ID NO: 1912274 - RNA, 19 nt, Human
aaugcaugauuuuguaacc

SEQ ID NO: 1912275 - RNA, 16 nt, Human
aaugcaucuagauuau

SEQ ID NO: 1912276 - RNA, 19 nt, Human
aaugcaucuagauuaugga

SEQ ID NO: 1912277 - RNA, 18 nt, Human
uaauuuuuuugagacaga

SEQ ID NO: 1912278 - RNA, 21 nt, Human
uacaaaaaaaaaaaaaaauua

SEQ ID NO: 1912279 - RNA, 14 nt, Human
uaauuuuuguaauu

SEQ ID NO: 1912280 - RNA, 16 nt, Human
uacaaugcugugcccu

SEQ ID NO: 1912281 - RNA, 18 nt, Human
uacaaugaugcuauuugc

SEQ ID NO: 1912282 - RNA, 14 nt, Human
uacaaugcugugcc

SEQ ID NO: 1912283 - RNA, 13 nt, Human
uacaaugcugugc

SEQ ID NO: 1912284 - RNA, 22 nt, Human
uacaauuaaaaaaaaagaucug

SEQ ID NO: 1912285 - RNA, 18 nt, Human
uacaauuaaaaaaaaaga

SEQ ID NO: 1912286 - RNA, 19 nt, Human
aauguaaucaauguuucuu

SEQ ID NO: 1912287 - RNA, 13 nt, Human
uacagacaaagcg

SEQ ID NO: 1912288 - RNA, 14 nt, Human
uacagacaaagcgu

SEQ ID NO: 1912289 - RNA, 15 nt, Human
uacagacaaagcgug

SEQ ID NO: 1912290 - RNA, 23 nt, Human
uacagagcagacaguuaagagaa

SEQ ID NO: 1912291 - RNA, 23 nt, Human
uacagagaagugaauaacugcaa

SEQ ID NO: 1912292 - RNA, 19 nt, Human
uacagagcccacgccccca

SEQ ID NO: 1912293 - RNA, 22 nt, Human
uacagagcccacgcccccacug

SEQ ID NO: 1912294 - RNA, 19 nt, Human
uacagacaaagcguggugg

SEQ ID NO: 1912295 - RNA, 17 nt, Human
uacagagacagaaagca

SEQ ID NO: 1912296 - RNA, 15 nt, Human
uacagagaagugaau

SEQ ID NO: 1912297 - RNA, 16 nt, Human
aaugguuuucaaaaua

SEQ ID NO: 1912298 - RNA, 16 nt, Human
aaugguuuucuugugu

SEQ ID NO: 1912299 - RNA, 20 nt, Human
aauguaaaggagucaaaacu

SEQ ID NO: 1912300 - RNA, 21 nt, Human
aauguaaaggagucaaaacua

SEQ ID NO: 1912301 - RNA, 23 nt, Human
aauguaaaggagucaaaacuaca

SEQ ID NO: 1912302 - RNA, 14 nt, Human
aaugguuuucaaaa

SEQ ID NO: 1912303 - RNA, 19 nt, Human
aaugguuugcaaggaagcc

SEQ ID NO: 1912304 - RNA, 18 nt, Human
aaugguuugcaaggaagc

SEQ ID NO: 1912305 - RNA, 17 nt, Human
aaugguuugcaaggaag

SEQ ID NO: 1912306 - RNA, 18 nt, Human
aauggaagacagcucuua

SEQ ID NO: 1912307 - RNA, 16 nt, Human
aauggaagacagcucu

SEQ ID NO: 1912308 - RNA, 18 nt, Human
aauggauaaaaucugaua

SEQ ID NO: 1912309 - RNA, 22 nt, Human
aaugagaagaaaauggaaccag

SEQ ID NO: 1912310 - RNA, 12 nt, Human
aaugagaaaucu

SEQ ID NO: 1912311 - RNA, 22 nt, Human
aaugagaaaucuaaaaaacgaa

SEQ ID NO: 1912312 - RNA, 11 nt, Human
aaugagccugg

SEQ ID NO: 1912313 - RNA, 17 nt, Human
aaugagaggcauuuccc

SEQ ID NO: 1912314 - RNA, 18 nt, Human
aaugagauuaauuccuuu

SEQ ID NO: 1912315 - RNA, 17 nt, Human
aaugagauuaauuccuu

SEQ ID NO: 1912316 - RNA, 20 nt, Human
aaugagaaaaugucuuuauu

SEQ ID NO: 1912317 - RNA, 17 nt, Human
aaugacuaauucuugca

SEQ ID NO: 1912318 - RNA, 18 nt, Human
aaugacuaauucuugcau

SEQ ID NO: 1912319 - RNA, 20 nt, Human
aaugacuaauucuugcauau

SEQ ID NO: 1912320 - RNA, 21 nt, Human
aaugaccuuucaauaggaaaa

SEQ ID NO: 1912321 - RNA, 20 nt, Human
aaugaccuuucaauaggaaa

SEQ ID NO: 1912322 - RNA, 18 nt, Human
aaugaggucagagccugc

SEQ ID NO: 1912323 - RNA, 16 nt, Human
aaugaggucagagccu

SEQ ID NO: 1912324 - RNA, 14 nt, Human
aaugagccuggcaa

SEQ ID NO: 1912325 - RNA, 12 nt, Human
aaugagccuggc

SEQ ID NO: 1912326 - RNA, 13 nt, Human
aaugagccuggca

SEQ ID NO: 1912327 - RNA, 19 nt, Human
aaugaguuaccuacauuuu

SEQ ID NO: 1912328 - RNA, 13 nt, Human
uaauuauuauuua

SEQ ID NO: 1912329 - RNA, 12 nt, Human
uaauuauuauuu

SEQ ID NO: 1912330 - RNA, 14 nt, Human
uaauuauuauucuu

SEQ ID NO: 1912331 - RNA, 12 nt, Human
uaauuauuauuc

SEQ ID NO: 1912332 - RNA, 13 nt, Human
aaugcaccuggaa

SEQ ID NO: 1912333 - RNA, 14 nt, Human
aaugcaaaccauca

SEQ ID NO: 1912334 - RNA, 13 nt, Human
aaugcaaaaaucu

SEQ ID NO: 1912335 - RNA, 12 nt, Human
aaugcaaaccau

SEQ ID NO: 1912336 - RNA, 11 nt, Human
aaugcaaacca

SEQ ID NO: 1912337 - RNA, 13 nt, Human
aaugauuuuuaaa

SEQ ID NO: 1912338 - RNA, 16 nt, Human
aaugauuucauucaau

SEQ ID NO: 1912339 - RNA, 22 nt, Human
uaauuauuauuuauauauguau

SEQ ID NO: 1912340 - RNA, 17 nt, Human
uaauuauuauuuauaua

SEQ ID NO: 1912341 - RNA, 14 nt, Human
uaauuauuauuuau

SEQ ID NO: 1912342 - RNA, 22 nt, Human
uaauuccguagguuauuuucag

SEQ ID NO: 1912343 - RNA, 19 nt, Human
uaauuccucaacguauugu

SEQ ID NO: 1912344 - RNA, 12 nt, Human
uaauuuaaagcc

SEQ ID NO: 1912345 - RNA, 19 nt, Human
uaauuuaaagccacaacca

SEQ ID NO: 1912346 - RNA, 20 nt, Human
uaauuuaaaauugugaugug

SEQ ID NO: 1912347 - RNA, 19 nt, Human
uaauuuaaaauugugaugu

SEQ ID NO: 1912348 - RNA, 13 nt, Human
uaauuuauaaaaa

SEQ ID NO: 1912349 - RNA, 16 nt, Human
uaauuuauaaaaaggu

SEQ ID NO: 1912350 - RNA, 21 nt, Human
uacauuagucauucaauaaau

SEQ ID NO: 1912351 - RNA, 13 nt, Human
uacauucauuuag

SEQ ID NO: 1912352 - RNA, 15 nt, Human
uacauucauuuagcu

SEQ ID NO: 1912353 - RNA, 22 nt, Human
aauuaaguuagggaauggcaca

SEQ ID NO: 1912354 - RNA, 15 nt, Human
aauuaauaaucuuau

SEQ ID NO: 1912355 - RNA, 13 nt, Human
uacauuuccuaaa

SEQ ID NO: 1912356 - RNA, 12 nt, Human
uacauucuguua

SEQ ID NO: 1912357 - RNA, 18 nt, Human
uaccagccaguaaauggg

SEQ ID NO: 1912358 - RNA, 22 nt, Human
uaccagcagagcaccuuagaca

SEQ ID NO: 1912359 - RNA, 13 nt, Human
uaccagcagagca

SEQ ID NO: 1912360 - RNA, 14 nt, Human
uaccagcagagcac

SEQ ID NO: 1912361 - RNA, 12 nt, Human
uaccagcagagc

SEQ ID NO: 1912362 - RNA, 19 nt, Human
uaccagggacugaggggag

SEQ ID NO: 1912363 - RNA, 16 nt, Human
uacccccuccuucaga

SEQ ID NO: 1912364 - RNA, 17 nt, Human
uacccccuccuucagac

SEQ ID NO: 1912365 - RNA, 14 nt, Human
uaccauucagugau

SEQ ID NO: 1912366 - RNA, 23 nt, Human
uaccauucagugauuacugucaa

SEQ ID NO: 1912367 - RNA, 13 nt, Human
uacccccuccuuc

SEQ ID NO: 1912368 - RNA, 17 nt, Human
uaccaugugcuacaggg

SEQ ID NO: 1912369 - RNA, 15 nt, Human
aauguuguuauuuaa

SEQ ID NO: 1912370 - RNA, 13 nt, Human
aauuaacuuuuau

SEQ ID NO: 1912371 - RNA, 12 nt, Human
aauuaacuuuua

SEQ ID NO: 1912372 - RNA, 16 nt, Human
aauuaacuuuuauaaa

SEQ ID NO: 1912373 - RNA, 15 nt, Human
aauuaacuuuuauaa

SEQ ID NO: 1912374 - RNA, 16 nt, Human
aauuaaguacuaugua

SEQ ID NO: 1912375 - RNA, 17 nt, Human
aauuaaguacuauguau

SEQ ID NO: 1912376 - RNA, 21 nt, Human
aauguuauuuuuuaauuauua

SEQ ID NO: 1912377 - RNA, 20 nt, Human
aauguucaucaaugaaugaa

SEQ ID NO: 1912378 - RNA, 16 nt, Human
aauguucaucaaugaa

SEQ ID NO: 1912379 - RNA, 17 nt, Human
uacagggguucuggaaa

SEQ ID NO: 1912380 - RNA, 15 nt, Human
uacaggggccagaag

SEQ ID NO: 1912381 - RNA, 13 nt, Human
uacaggggccaga

SEQ ID NO: 1912382 - RNA, 20 nt, Human
uacagggcacaggccaugga

SEQ ID NO: 1912383 - RNA, 17 nt, Human
uacagggaugguguuca

SEQ ID NO: 1912384 - RNA, 21 nt, Human
aaugugcugaaugguuuucaa

SEQ ID NO: 1912385 - RNA, 22 nt, Human
aauguggcaaggaaaaacaggu

SEQ ID NO: 1912386 - RNA, 16 nt, Human
aauguuacauuauuau

SEQ ID NO: 1912387 - RNA, 15 nt, Human
aauguuacauuguuu

SEQ ID NO: 1912388 - RNA, 15 nt, Human
aauguuacauuauua

SEQ ID NO: 1912389 - RNA, 15 nt, Human
aauguuagauaguua

SEQ ID NO: 1912390 - RNA, 20 nt, Human
aauguuauuuuuuaauuauu

SEQ ID NO: 1912391 - RNA, 19 nt, Human
aauguuauuuuuuaauuau

SEQ ID NO: 1912392 - RNA, 13 nt, Human
aauguucaucaau

SEQ ID NO: 1912393 - RNA, 14 nt, Human
aauguuauuuaaca

SEQ ID NO: 1912394 - RNA, 15 nt, Human
uacccgggcagggcu

SEQ ID NO: 1912395 - RNA, 23 nt, Human
uacccgggaagggggcugggaca

SEQ ID NO: 1912396 - RNA, 18 nt, Human
uacccccuccuucagaca

SEQ ID NO: 1912397 - RNA, 23 nt, Human
uaccucuugagccuugaacuuug

SEQ ID NO: 1912398 - RNA, 13 nt, Human
uaccucuuggcug

SEQ ID NO: 1912399 - RNA, 22 nt, Human
uaccucuugagccuugaacuuu

SEQ ID NO: 1912400 - RNA, 16 nt, Human
uaccugaagucuuugu

SEQ ID NO: 1912401 - RNA, 13 nt, Human
uaccugaggggcc

SEQ ID NO: 1912402 - RNA, 15 nt, Human
uaccugaggggccuc

SEQ ID NO: 1912403 - RNA, 23 nt, Human
uaccugaagcuaucguaaaauua

SEQ ID NO: 1912404 - RNA, 13 nt, Human
uaccugaagucuu

SEQ ID NO: 1912405 - RNA, 14 nt, Human
uaccugaagucuuu

SEQ ID NO: 1912406 - RNA, 17 nt, Human
aauuacaggaaguacug

SEQ ID NO: 1912407 - RNA, 19 nt, Human
aauuacaggaaguacugga

SEQ ID NO: 1912408 - RNA, 20 nt, Human
aauuacaggaaguacuggag

SEQ ID NO: 1912409 - RNA, 16 nt, Human
uaccugaggggccucu

SEQ ID NO: 1912410 - RNA, 16 nt, Human
uaccugccaggaagcc

SEQ ID NO: 1912411 - RNA, 22 nt, Human
uaccuguguauuuuuuaaagcu

SEQ ID NO: 1912412 - RNA, 22 nt, Human
uaccuguuuuguggucagcugu

SEQ ID NO: 1912413 - RNA, 21 nt, Human
aauuauuauucuucauaacaa

SEQ ID NO: 1912414 - RNA, 13 nt, Human
aauuauuauucuu

SEQ ID NO: 1912415 - RNA, 18 nt, Human
aauuauuauuuauauaug

SEQ ID NO: 1912416 - RNA, 16 nt, Human
aauuauuauuuauaua

SEQ ID NO: 1912417 - RNA, 13 nt, Human
aauuauuauuuau

SEQ ID NO: 1912418 - RNA, 11 nt, Human
aauuauuauuu

SEQ ID NO: 1912419 - RNA, 21 nt, Human
aauuauuauuuauauauguau

SEQ ID NO: 1912420 - RNA, 21 nt, Human
aauuauuuauuaaaugcccag

SEQ ID NO: 1912421 - RNA, 22 nt, Human
aauuaugugccagauuuaugca

SEQ ID NO: 1912422 - RNA, 22 nt, Human
aauuagaaaauguuauuuaaca

SEQ ID NO: 1912423 - RNA, 15 nt, Human
aauuagaauaguguu

SEQ ID NO: 1912424 - RNA, 22 nt, Human
aauuauuuauuaaaugcccagc

SEQ ID NO: 1912425 - RNA, 12 nt, Human
aauuauuuuaaa

SEQ ID NO: 1912426 - RNA, 15 nt, Human
aauuauuuuaaaaga

SEQ ID NO: 1912427 - RNA, 17 nt, Human
aauucaauuguaaauug

SEQ ID NO: 1912428 - RNA, 14 nt, Human
aauucaauuguaaa

SEQ ID NO: 1912429 - RNA, 17 nt, Human
aauucaguuguuagugu

SEQ ID NO: 1912430 - RNA, 22 nt, Human
aauucaguuguuagugugucuu

SEQ ID NO: 1912431 - RNA, 18 nt, Human
aauucaucccaacugucu

SEQ ID NO: 1912432 - RNA, 11 nt, Human
aauucaguugu

SEQ ID NO: 1912433 - RNA, 19 nt, Human
aauucaauuguaaauugaa

SEQ ID NO: 1912434 - RNA, 23 nt, Human
aauucaauuguaaauugaaucag

SEQ ID NO: 1912435 - RNA, 13 nt, Human
aauucacaaacuu

SEQ ID NO: 1912436 - RNA, 14 nt, Human
acaggagaccuggc

SEQ ID NO: 1912437 - RNA, 18 nt, Human
acaggacuuaaaaugaca

SEQ ID NO: 1912438 - RNA, 15 nt, Human
acaggcagauacagg

SEQ ID NO: 1912439 - RNA, 20 nt, Human
acaggaaaauuuuaaaaaua

SEQ ID NO: 1912440 - RNA, 17 nt, Human
acaggcccggcuccagg

SEQ ID NO: 1912441 - RNA, 16 nt, Human
acaggcccggcuccag

SEQ ID NO: 1912442 - RNA, 22 nt, Human
acaggcccggcuccaggcuccu

SEQ ID NO: 1912443 - RNA, 21 nt, Human
acaggcccggcuccaggcucc

SEQ ID NO: 1912444 - RNA, 20 nt, Human
acaggcccggcuccaggcuc

SEQ ID NO: 1912445 - RNA, 18 nt, Human
acaggcccggcuccaggc

SEQ ID NO: 1912446 - RNA, 21 nt, Human
acaggcccucccuguucccca

SEQ ID NO: 1912447 - RNA, 22 nt, Human
acaggcccucccuguuccccag

SEQ ID NO: 1912448 - RNA, 23 nt, Human
acaggcccucccuguuccccaga

SEQ ID NO: 1912449 - RNA, 21 nt, Human
uaugucucgugguaggacugu

SEQ ID NO: 1912450 - RNA, 21 nt, Human
acaggccugagauuucaucug

SEQ ID NO: 1912451 - RNA, 17 nt, Human
acaggccugagauuuca

SEQ ID NO: 1912452 - RNA, 15 nt, Human
acaggccugagauuu

SEQ ID NO: 1912453 - RNA, 16 nt, Human
acaggccgcccugcgg

SEQ ID NO: 1912454 - RNA, 19 nt, Human
acagcuaaugggacacuaa

SEQ ID NO: 1912455 - RNA, 17 nt, Human
acagcuaaugggacacu

SEQ ID NO: 1912456 - RNA, 16 nt, Human
acagcuaaugggacac

SEQ ID NO: 1912457 - RNA, 15 nt, Human
acagcuaaugggaca

SEQ ID NO: 1912458 - RNA, 15 nt, Human
acagcuauauuucug

SEQ ID NO: 1912459 - RNA, 21 nt, Human
acagcuucauuuccugugucu

SEQ ID NO: 1912460 - RNA, 19 nt, Human
acagcuucauuuccugugu

SEQ ID NO: 1912461 - RNA, 17 nt, Human
acagcuucauuuccugu

SEQ ID NO: 1912462 - RNA, 17 nt, Human
acagcuugaccgugagg

SEQ ID NO: 1912463 - RNA, 20 nt, Human
acagcuucucauccugcagg

SEQ ID NO: 1912464 - RNA, 20 nt, Human
acagcuugaccgugaggcca

SEQ ID NO: 1912465 - RNA, 21 nt, Human
acagcuugaccgugaggccag

SEQ ID NO: 1912466 - RNA, 21 nt, Human
acaggaaaagcugcugacagu

SEQ ID NO: 1912467 - RNA, 20 nt, Human
acaggaaaagcugcugacag

SEQ ID NO: 1912468 - RNA, 19 nt, Human
acaggaaaagcugcugaca

SEQ ID NO: 1912469 - RNA, 18 nt, Human
acaggaaaagcugcugac

SEQ ID NO: 1912470 - RNA, 22 nt, Human
acagcuugaccgugaggccaga

SEQ ID NO: 1912471 - RNA, 23 nt, Human
acagcuugaccgugaggccagag

SEQ ID NO: 1912472 - RNA, 21 nt, Human
acagcuucucauccugcaggc

SEQ ID NO: 1912473 - RNA, 16 nt, Human
uaugggaaucaagauu

SEQ ID NO: 1912474 - RNA, 23 nt, Human
uaugggaaaugagaggcauuucc

SEQ ID NO: 1912475 - RNA, 10 nt, Human
uaugggagag

SEQ ID NO: 1912476 - RNA, 21 nt, Human
uaugguaggaacugcugggcu

SEQ ID NO: 1912477 - RNA, 23 nt, Human
uaugggacucaaugcacugacau

SEQ ID NO: 1912478 - RNA, 16 nt, Human
uaugggacucaaugca

SEQ ID NO: 1912479 - RNA, 22 nt, Human
uauggcccuggccuagcauacg

SEQ ID NO: 1912480 - RNA, 21 nt, Human
uauggcccuggccuagcauac

SEQ ID NO: 1912481 - RNA, 20 nt, Human
uauggcccuggccuagcaua

SEQ ID NO: 1912482 - RNA, 13 nt, Human
uauggcagugucu

SEQ ID NO: 1912483 - RNA, 16 nt, Human
uauggcagugucuuuc

SEQ ID NO: 1912484 - RNA, 19 nt, Human
acagcggcuggacuuggag

SEQ ID NO: 1912485 - RNA, 18 nt, Human
acagcggcuggacuugga

SEQ ID NO: 1912486 - RNA, 13 nt, Human
acagcgcuaugca

SEQ ID NO: 1912487 - RNA, 14 nt, Human
uaugguauuugagu

SEQ ID NO: 1912488 - RNA, 17 nt, Human
uaugauacuugaaaauu

SEQ ID NO: 1912489 - RNA, 22 nt, Human
uaugcaugaaguaauaugcaca

SEQ ID NO: 1912490 - RNA, 18 nt, Human
uaugcauggugccccagg

SEQ ID NO: 1912491 - RNA, 20 nt, Human
uaugcauggugccccaggac

SEQ ID NO: 1912492 - RNA, 21 nt, Human
uaugcauggugccccaggacc

SEQ ID NO: 1912493 - RNA, 22 nt, Human
uaugcauggugccccaggacca

SEQ ID NO: 1912494 - RNA, 23 nt, Human
uaugcauggugccccaggaccag

SEQ ID NO: 1912495 - RNA, 12 nt, Human
acagcaagucag

SEQ ID NO: 1912496 - RNA, 16 nt, Human
acagcaagucaggguu

SEQ ID NO: 1912497 - RNA, 12 nt, Human
acagcacagcca

SEQ ID NO: 1912498 - RNA, 15 nt, Human
acagcccgggcucug

SEQ ID NO: 1912499 - RNA, 16 nt, Human
acagcccgggcucugc

SEQ ID NO: 1912500 - RNA, 20 nt, Human
uaugaagcuuuuaugugaaa

SEQ ID NO: 1912501 - RNA, 22 nt, Human
uaugaagcuuuuaugugaaaca

SEQ ID NO: 1912502 - RNA, 23 nt, Human
uaugaagcuuuuaugugaaacau

SEQ ID NO: 1912503 - RNA, 23 nt, Human
uaugaggcauuuguuugaacuga

SEQ ID NO: 1912504 - RNA, 21 nt, Human
uaugaggcauuuguuugaacu

SEQ ID NO: 1912505 - RNA, 15 nt, Human
uaugaggcauuuguu

SEQ ID NO: 1912506 - RNA, 14 nt, Human
uaugaggcauuugu

SEQ ID NO: 1912507 - RNA, 15 nt, Human
uaugaaaacuuauga

SEQ ID NO: 1912508 - RNA, 13 nt, Human
uaugaaaacuuau

SEQ ID NO: 1912509 - RNA, 18 nt, Human
uauagccuaggugacaga

SEQ ID NO: 1912510 - RNA, 22 nt, Human
uauagcccagccaggccccagg

SEQ ID NO: 1912511 - RNA, 23 nt, Human
uauaggaacuuaaauaaugugaa

SEQ ID NO: 1912512 - RNA, 12 nt, Human
uauaggaauuga

SEQ ID NO: 1912513 - RNA, 16 nt, Human
acacucauugaccuga

SEQ ID NO: 1912514 - RNA, 21 nt, Human
uauaucuauauuuuacauaaa

SEQ ID NO: 1912515 - RNA, 19 nt, Human
uauauauuuuuuucugaaa

SEQ ID NO: 1912516 - RNA, 14 nt, Human
uauauauuuuaauu

SEQ ID NO: 1912517 - RNA, 11 nt, Human
uauauauuucc

SEQ ID NO: 1912518 - RNA, 18 nt, Human
uauaauuuaccugaaguc

SEQ ID NO: 1912519 - RNA, 21 nt, Human
uauaauuuaccugaagucuuu

SEQ ID NO: 1912520 - RNA, 22 nt, Human
uauacacuuacacuuuaugcac

SEQ ID NO: 1912521 - RNA, 18 nt, Human
uauaaguggaggcacuuu

SEQ ID NO: 1912522 - RNA, 19 nt, Human
uauaaguggaggcacuuua

SEQ ID NO: 1912523 - RNA, 16 nt, Human
uauacauagcaugaca

SEQ ID NO: 1912524 - RNA, 22 nt, Human
uauacauagcaugacauuucuu

SEQ ID NO: 1912525 - RNA, 21 nt, Human
uauacauaucuuuauuaauca

SEQ ID NO: 1912526 - RNA, 15 nt, Human
uauacauaucuuuau

SEQ ID NO: 1912527 - RNA, 18 nt, Human
uauacauaucuuuauuaa

SEQ ID NO: 1912528 - RNA, 17 nt, Human
uagucacugagacagcc

SEQ ID NO: 1912529 - RNA, 20 nt, Human
uagucacugagacagcccgg

SEQ ID NO: 1912530 - RNA, 15 nt, Human
acacuaaugaggaaa

SEQ ID NO: 1912531 - RNA, 22 nt, Human
acacuaaugaggaaacugcacu

SEQ ID NO: 1912532 - RNA, 21 nt, Human
acacucaaaagcugggcaggu

SEQ ID NO: 1912533 - RNA, 19 nt, Human
uauaagugauugcugguuu

SEQ ID NO: 1912534 - RNA, 14 nt, Human
uauaacugcccagc

SEQ ID NO: 1912535 - RNA, 13 nt, Human
acagaaauguaca

SEQ ID NO: 1912536 - RNA, 19 nt, Human
acagacauacuaaccagca

SEQ ID NO: 1912537 - RNA, 18 nt, Human
acagacauacuaaccagc

SEQ ID NO: 1912538 - RNA, 16 nt, Human
acagaaagguuuucuu

SEQ ID NO: 1912539 - RNA, 11 nt, Human
acagaaaaacc

SEQ ID NO: 1912540 - RNA, 18 nt, Human
acacuuacacuuuaugca

SEQ ID NO: 1912541 - RNA, 21 nt, Human
acacuuacacuuuaugcacaa

SEQ ID NO: 1912542 - RNA, 18 nt, Human
acacuguuucaaacuuua

SEQ ID NO: 1912543 - RNA, 17 nt, Human
acacuguuucaaacuuu

SEQ ID NO: 1912544 - RNA, 17 nt, Human
acacucauugaccugag

SEQ ID NO: 1912545 - RNA, 20 nt, Human
acacuguuucaaacuuuacu

SEQ ID NO: 1912546 - RNA, 16 nt, Human
acacuuacacuuuaug

SEQ ID NO: 1912547 - RNA, 14 nt, Human
acacuuaauacuac

SEQ ID NO: 1912548 - RNA, 22 nt, Human
uaucacccagaagaaaauagug

SEQ ID NO: 1912549 - RNA, 19 nt, Human
uaucacccagaagaaaaua

SEQ ID NO: 1912550 - RNA, 22 nt, Human
uaucaauuggaaaggaagaaaa

SEQ ID NO: 1912551 - RNA, 16 nt, Human
acagaccuaaugcucc

SEQ ID NO: 1912552 - RNA, 17 nt, Human
uaucagaauucucagaa

SEQ ID NO: 1912553 - RNA, 14 nt, Human
uaucagcacgugug

SEQ ID NO: 1912554 - RNA, 19 nt, Human
uauccaacaucaacaucuu

SEQ ID NO: 1912555 - RNA, 15 nt, Human
uaucagcacgugugg

SEQ ID NO: 1912556 - RNA, 18 nt, Human
uaucuauacauaucuuua

SEQ ID NO: 1912557 - RNA, 20 nt, Human
uaucuauacauaucuuuauu

SEQ ID NO: 1912558 - RNA, 15 nt, Human
uauccccucuacucu

SEQ ID NO: 1912559 - RNA, 21 nt, Human
uacuuugccuuuccauaauca

SEQ ID NO: 1912560 - RNA, 20 nt, Human
aauuccacaccuuuuauuga

SEQ ID NO: 1912561 - RNA, 16 nt, Human
aauuccacaccuuuua

SEQ ID NO: 1912562 - RNA, 16 nt, Human
aauuccacacccucac

SEQ ID NO: 1912563 - RNA, 19 nt, Human
uacuuuucauauuugcacu

SEQ ID NO: 1912564 - RNA, 20 nt, Human
uacuuuucauauuugcacua

SEQ ID NO: 1912565 - RNA, 16 nt, Human
uagaacucccuuucaa

SEQ ID NO: 1912566 - RNA, 18 nt, Human
uagaacucccuuucaaca

SEQ ID NO: 1912567 - RNA, 17 nt, Human
uagaacucccuuucaac

SEQ ID NO: 1912568 - RNA, 14 nt, Human
uagaagaagugugu

SEQ ID NO: 1912569 - RNA, 21 nt, Human
uagacagagucucacuguugc

SEQ ID NO: 1912570 - RNA, 18 nt, Human
uagacagucucacuuugu

SEQ ID NO: 1912571 - RNA, 17 nt, Human
uagacagucccugccaa

SEQ ID NO: 1912572 - RNA, 21 nt, Human
uagacagucccugccaaugga

SEQ ID NO: 1912573 - RNA, 21 nt, Human
uagacauuugcuaugagcugg

SEQ ID NO: 1912574 - RNA, 20 nt, Human
aauuugugauacaaugcugu

SEQ ID NO: 1912575 - RNA, 18 nt, Human
aauuuggcuucuguuguc

SEQ ID NO: 1912576 - RNA, 18 nt, Human
aauuugugauacaaugcu

SEQ ID NO: 1912577 - RNA, 17 nt, Human
aauuugugauacaaugc

SEQ ID NO: 1912578 - RNA, 14 nt, Human
aauuugugauacaa

SEQ ID NO: 1912579 - RNA, 18 nt, Human
aauuugggggaaaauuua

SEQ ID NO: 1912580 - RNA, 12 nt, Human
aauuuggcuucu

SEQ ID NO: 1912581 - RNA, 10 nt, Human
uagacagagu

SEQ ID NO: 1912582 - RNA, 16 nt, Human
uagacagucccugcca

SEQ ID NO: 1912583 - RNA, 21 nt, Human
uagacacuccccgaagucuuu

SEQ ID NO: 1912584 - RNA, 18 nt, Human
uagacaauuuauuauggc

SEQ ID NO: 1912585 - RNA, 19 nt, Human
uagacacauaugaggggga

SEQ ID NO: 1912586 - RNA, 19 nt, Human
uagaauuugauaugugaac

SEQ ID NO: 1912587 - RNA, 20 nt, Human
uagaauuugauaugugaaca

SEQ ID NO: 1912588 - RNA, 22 nt, Human
uagaauuugauaugugaacagu

SEQ ID NO: 1912589 - RNA, 22 nt, Human
uagcacagacccugcccugugg

SEQ ID NO: 1912590 - RNA, 24 nt, Human
uagcacagacccugcccugugggc

SEQ ID NO: 1912591 - RNA, 12 nt, Human
uagccaaggcca

SEQ ID NO: 1912592 - RNA, 20 nt, Human
uagccaaaugguuuaacuuc

SEQ ID NO: 1912593 - RNA, 20 nt, Human
uagccacauuuggaauacuu

SEQ ID NO: 1912594 - RNA, 13 nt, Human
uagccaaggccaa

SEQ ID NO: 1912595 - RNA, 21 nt, Human
uagccacauuuggaauacuuu

SEQ ID NO: 1912596 - RNA, 18 nt, Human
uagccaccgccuccuaca

SEQ ID NO: 1912597 - RNA, 18 nt, Human
uagccacccaccacacug

SEQ ID NO: 1912598 - RNA, 19 nt, Human
uagccaccgccuccuacag

SEQ ID NO: 1912599 - RNA, 14 nt, Human
uagcacagacccug

SEQ ID NO: 1912600 - RNA, 20 nt, Human
uagcacagacccugcccugu

SEQ ID NO: 1912601 - RNA, 21 nt, Human
uagcacagacccugcccugug

SEQ ID NO: 1912602 - RNA, 15 nt, Human
uagcacagacccugc

SEQ ID NO: 1912603 - RNA, 21 nt, Human
uagcacaacgugguacuauuu

SEQ ID NO: 1912604 - RNA, 13 nt, Human
uagagggaggggc

SEQ ID NO: 1912605 - RNA, 14 nt, Human
uagagggaggggcc

SEQ ID NO: 1912606 - RNA, 24 nt, Human
uagaggggaaaagagaugaugaaa

SEQ ID NO: 1912607 - RNA, 15 nt, Human
uagagggaccucucc

SEQ ID NO: 1912608 - RNA, 19 nt, Human
uagagggaccucucccagg

SEQ ID NO: 1912609 - RNA, 20 nt, Human
uagagggaccucucccaggg

SEQ ID NO: 1912610 - RNA, 14 nt, Human
uagagccagggucu

SEQ ID NO: 1912611 - RNA, 23 nt, Human
acaaauacucuuaggaagagaaa

SEQ ID NO: 1912612 - RNA, 15 nt, Human
acaaauacucuuagg

SEQ ID NO: 1912613 - RNA, 17 nt, Human
acaaauacucuuaggaa

SEQ ID NO: 1912614 - RNA, 22 nt, Human
uagagcggagaaaggaagggcu

SEQ ID NO: 1912615 - RNA, 22 nt, Human
acaaaggugaaaauuguuugua

SEQ ID NO: 1912616 - RNA, 14 nt, Human
acaaaaucuguuua

SEQ ID NO: 1912617 - RNA, 12 nt, Human
aauuuuacauuu

SEQ ID NO: 1912618 - RNA, 20 nt, Human
aauuuuacauggcuggagcu

SEQ ID NO: 1912619 - RNA, 12 nt, Human
acaaaaaagaag

SEQ ID NO: 1912620 - RNA, 11 nt, Human
acaaaaaagug

SEQ ID NO: 1912621 - RNA, 16 nt, Human
acaaaaagcuacuuau

SEQ ID NO: 1912622 - RNA, 19 nt, Human
acaaaaauucucaguucuc

SEQ ID NO: 1912623 - RNA, 12 nt, Human
acaaaacaaaac

SEQ ID NO: 1912624 - RNA, 22 nt, Human
acaaaaagguaaaacuuuuuau

SEQ ID NO: 1912625 - RNA, 15 nt, Human
acaaaacuacaugag

SEQ ID NO: 1912626 - RNA, 14 nt, Human
acaaaaauuaggua

SEQ ID NO: 1912627 - RNA, 12 nt, Human
acaaaacaaaaa

SEQ ID NO: 1912628 - RNA, 16 nt, Human
acacaggccugcucuc

SEQ ID NO: 1912629 - RNA, 13 nt, Human
acacaggcccucc

SEQ ID NO: 1912630 - RNA, 16 nt, Human
acacaggcccucccug

SEQ ID NO: 1912631 - RNA, 24 nt, Human
acacaggcccggcuccaggcuccu

SEQ ID NO: 1912632 - RNA, 23 nt, Human
acacaggcccggcuccaggcucc

SEQ ID NO: 1912633 - RNA, 22 nt, Human
acacaggcccggcuccaggcuc

SEQ ID NO: 1912634 - RNA, 21 nt, Human
acacaggcccggcuccaggcu

SEQ ID NO: 1912635 - RNA, 20 nt, Human
acacaggcccggcuccaggc

SEQ ID NO: 1912636 - RNA, 19 nt, Human
acacaggcccggcuccagg

SEQ ID NO: 1912637 - RNA, 18 nt, Human
acacaggcccggcuccag

SEQ ID NO: 1912638 - RNA, 17 nt, Human
acacaggcccggcucca

SEQ ID NO: 1912639 - RNA, 16 nt, Human
acacaggcccggcucc

SEQ ID NO: 1912640 - RNA, 17 nt, Human
acacacagacucauauu

SEQ ID NO: 1912641 - RNA, 16 nt, Human
acacaguauuacuucu

SEQ ID NO: 1912642 - RNA, 22 nt, Human
uagguuuggacaaaauggaaua

SEQ ID NO: 1912643 - RNA, 15 nt, Human
acacaggucuuuccu

SEQ ID NO: 1912644 - RNA, 14 nt, Human
acacaggucuuucc

SEQ ID NO: 1912645 - RNA, 16 nt, Human
acacaggucuuuccua

SEQ ID NO: 1912646 - RNA, 11 nt, Human
acacagggcag

SEQ ID NO: 1912647 - RNA, 15 nt, Human
uagguuuuuauuagu

SEQ ID NO: 1912648 - RNA, 15 nt, Human
uaguaaaaauacaaa

SEQ ID NO: 1912649 - RNA, 22 nt, Human
uaguagagacaggguuuugcca

SEQ ID NO: 1912650 - RNA, 15 nt, Human
uaguagagacagggu

SEQ ID NO: 1912651 - RNA, 23 nt, Human
uagucacauggccuaugcacaua

SEQ ID NO: 1912652 - RNA, 14 nt, Human
uagucacugagaca

SEQ ID NO: 1912653 - RNA, 14 nt, Human
uaguagagacaggg

SEQ ID NO: 1912654 - RNA, 14 nt, Human
uaguaauugacaug

SEQ ID NO: 1912655 - RNA, 12 nt, Human
uaguaaucauau

SEQ ID NO: 1912656 - RNA, 23 nt, Human
acaaugcaaaccaucauugaaau

SEQ ID NO: 1912657 - RNA, 20 nt, Human
acaaugaugcuauuugcaau

SEQ ID NO: 1912658 - RNA, 18 nt, Human
acaaugaugcuauuugca

SEQ ID NO: 1912659 - RNA, 19 nt, Human
acaaugcaaaccaucauug

SEQ ID NO: 1912660 - RNA, 21 nt, Human
acaaugcaaaccaucauugaa

SEQ ID NO: 1912661 - RNA, 12 nt, Human
acacaauacaau

SEQ ID NO: 1912662 - RNA, 14 nt, Human
acacaauacaauaa

SEQ ID NO: 1912663 - RNA, 19 nt, Human
acacaaggauagaugcugg

SEQ ID NO: 1912664 - RNA, 23 nt, Human
acacaaggauagaugcuggccca

SEQ ID NO: 1912665 - RNA, 15 nt, Human
uaggguuauaauaau

SEQ ID NO: 1912666 - RNA, 17 nt, Human
uaggguuauaauaaugu

SEQ ID NO: 1912667 - RNA, 15 nt, Human
uagggucggaaccca

SEQ ID NO: 1912668 - RNA, 19 nt, Human
uaggguaagugagagaggg

SEQ ID NO: 1912669 - RNA, 22 nt, Human
acaaugacuuacuguacaugaa

SEQ ID NO: 1912670 - RNA, 20 nt, Human
acaaugacuuacuguacaug

SEQ ID NO: 1912671 - RNA, 11 nt, Human
acaaugcaaac

SEQ ID NO: 1912672 - RNA, 16 nt, Human
acaaugcaaaccauca

SEQ ID NO: 1912673 - RNA, 17 nt, Human
acaaugcaaaccaucau

SEQ ID NO: 1912674 - RNA, 18 nt, Human
acaaugcaaaccaucauu

SEQ ID NO: 1912675 - RNA, 17 nt, Human
uagcgcccaguugggug

SEQ ID NO: 1912676 - RNA, 14 nt, Human
uagcgcccaguugg

SEQ ID NO: 1912677 - RNA, 21 nt, Human
uagccuuagaagucacacagu

SEQ ID NO: 1912678 - RNA, 20 nt, Human
uagccuuagaagucacacag

SEQ ID NO: 1912679 - RNA, 22 nt, Human
acaaaucuaggaaaauauuuug

SEQ ID NO: 1912680 - RNA, 18 nt, Human
acaaaucuaggaaaauau

SEQ ID NO: 1912681 - RNA, 13 nt, Human
uaggaaaaacuga

SEQ ID NO: 1912682 - RNA, 14 nt, Human
uaggaaaaacugau

SEQ ID NO: 1912683 - RNA, 23 nt, Human
uagcuuuuuucucugauacagaa

SEQ ID NO: 1912684 - RNA, 13 nt, Human
uagcuuuuuucuc

SEQ ID NO: 1912685 - RNA, 16 nt, Human
uagcuuuugugucuua

SEQ ID NO: 1912686 - RNA, 19 nt, Human
uagcuuuugugucuuacau

SEQ ID NO: 1912687 - RNA, 20 nt, Human
uagcuuggaaacuggaugag

SEQ ID NO: 1912688 - RNA, 15 nt, Human
uagcuuggaaacugg

SEQ ID NO: 1912689 - RNA, 18 nt, Human
uagcuaaacggauuccaa

SEQ ID NO: 1912690 - RNA, 19 nt, Human
uagcuaaacggauuccaaa

SEQ ID NO: 1912691 - RNA, 20 nt, Human
uagcuaaacggauuccaaag

SEQ ID NO: 1912692 - RNA, 23 nt, Human
uagggaucaaccagcuaagaaaa

SEQ ID NO: 1912693 - RNA, 13 nt, Human
uagggaagauaau

SEQ ID NO: 1912694 - RNA, 14 nt, Human
uagggcuguaaaau

SEQ ID NO: 1912695 - RNA, 22 nt, Human
uagggcaggagugagaggucuc

SEQ ID NO: 1912696 - RNA, 16 nt, Human
uagggggaacucuagc

SEQ ID NO: 1912697 - RNA, 16 nt, Human
uaggaaaaacugauuu

SEQ ID NO: 1912698 - RNA, 17 nt, Human
uaggaaaaacugauuuu

SEQ ID NO: 1912699 - RNA, 13 nt, Human
uaggaaaauauuu

SEQ ID NO: 1912700 - RNA, 14 nt, Human
uaggauacugcugc

SEQ ID NO: 1912701 - RNA, 17 nt, Human
uaggagugugugauuuu

SEQ ID NO: 1912702 - RNA, 15 nt, Human
uaggcaggaccugug

SEQ ID NO: 1912703 - RNA, 14 nt, Human
uaggcaggaccugu

SEQ ID NO: 1912704 - RNA, 13 nt, Human
uaggauguugaaa

SEQ ID NO: 1912705 - RNA, 14 nt, Human
uaggauguaaaucu

SEQ ID NO: 1912706 - RNA, 17 nt, Human
acucagaagggagcuag

SEQ ID NO: 1912707 - RNA, 14 nt, Human
acucagaauucucu

SEQ ID NO: 1912708 - RNA, 22 nt, Human
acucagaauucucuaguuugau

SEQ ID NO: 1912709 - RNA, 21 nt, Human
acucagaauucucuaguuuga

SEQ ID NO: 1912710 - RNA, 18 nt, Human
acucagaagacacugaug

SEQ ID NO: 1912711 - RNA, 17 nt, Human
acucagaagacacugau

SEQ ID NO: 1912712 - RNA, 16 nt, Human
acucagaagacacuga

SEQ ID NO: 1912713 - RNA, 15 nt, Human
acucagaagacacug

SEQ ID NO: 1912714 - RNA, 14 nt, Human
acucagaagacacu

SEQ ID NO: 1912715 - RNA, 21 nt, Human
acucaccugccccucaacucu

SEQ ID NO: 1912716 - RNA, 14 nt, Human
acucaccugccccu

SEQ ID NO: 1912717 - RNA, 19 nt, Human
acucaccugccccucaacu

SEQ ID NO: 1912718 - RNA, 23 nt, Human
acucaucuagguaaauuacaguu

SEQ ID NO: 1912719 - RNA, 18 nt, Human
acucagacauuggcaccu

SEQ ID NO: 1912720 - RNA, 12 nt, Human
acucaucuuagg

SEQ ID NO: 1912721 - RNA, 21 nt, Human
acucaucuagguaaauuacag

SEQ ID NO: 1912722 - RNA, 16 nt, Human
acucauugaccugagg

SEQ ID NO: 1912723 - RNA, 17 nt, Human
acucauugaccugaggc

SEQ ID NO: 1912724 - RNA, 18 nt, Human
acucauugaccugaggcc

SEQ ID NO: 1912725 - RNA, 22 nt, Human
acucauugaccugaggcccuuc

SEQ ID NO: 1912726 - RNA, 14 nt, Human
acuccaccaagccu

SEQ ID NO: 1912727 - RNA, 18 nt, Human
ucccucagucuggcccuu

SEQ ID NO: 1912728 - RNA, 22 nt, Human
ucccucaccuuggcaccagaca

SEQ ID NO: 1912729 - RNA, 20 nt, Human
ucccucagucuggcccuucc

SEQ ID NO: 1912730 - RNA, 11 nt, Human
ucccucuuucc

SEQ ID NO: 1912731 - RNA, 13 nt, Human
ucccucuuucccu

SEQ ID NO: 1912732 - RNA, 12 nt, Human
ucccuccccccc

SEQ ID NO: 1912733 - RNA, 14 nt, Human
ucccucccccccau

SEQ ID NO: 1912734 - RNA, 16 nt, Human
ucccucccccccaugc

SEQ ID NO: 1912735 - RNA, 21 nt, Human
ucccucccccccaugcacugu

SEQ ID NO: 1912736 - RNA, 23 nt, Human
ucccugaaggccccgcccaggcu

SEQ ID NO: 1912737 - RNA, 16 nt, Human
ucccugacccuguaua

SEQ ID NO: 1912738 - RNA, 21 nt, Human
ucccugaccucccucuaauuu

SEQ ID NO: 1912739 - RNA, 17 nt, Human
ucccugacccuguauau

SEQ ID NO: 1912740 - RNA, 22 nt, Human
ucccugacccuguauauagccc

SEQ ID NO: 1912741 - RNA, 16 nt, Human
ucccugaccucccucu

SEQ ID NO: 1912742 - RNA, 17 nt, Human
ucccugaccucccucua

SEQ ID NO: 1912743 - RNA, 17 nt, Human
acucaccccagccccaa

SEQ ID NO: 1912744 - RNA, 16 nt, Human
acucaccucuaaaaca

SEQ ID NO: 1912745 - RNA, 18 nt, Human
ucccugaaggccccgccc

SEQ ID NO: 1912746 - RNA, 21 nt, Human
ucccugaaggccccgcccagg

SEQ ID NO: 1912747 - RNA, 22 nt, Human
ucccugaaggccccgcccaggc

SEQ ID NO: 1912748 - RNA, 18 nt, Human
uccccgcuucugccugca

SEQ ID NO: 1912749 - RNA, 21 nt, Human
acucacauuuauucugcucac

SEQ ID NO: 1912750 - RNA, 20 nt, Human
acucacauggcuauguuuua

SEQ ID NO: 1912751 - RNA, 20 nt, Human
acucacauuuauucugcuca

SEQ ID NO: 1912752 - RNA, 19 nt, Human
acucacauuuauucugcuc

SEQ ID NO: 1912753 - RNA, 14 nt, Human
acucaaugcacuga

SEQ ID NO: 1912754 - RNA, 19 nt, Human
acucacauggcuauguuuu

SEQ ID NO: 1912755 - RNA, 16 nt, Human
acucacauggcuaugu

SEQ ID NO: 1912756 - RNA, 23 nt, Human
acucaauauuuuccaugaaaaug

SEQ ID NO: 1912757 - RNA, 22 nt, Human
acucaauauuuuccaugaaaau

SEQ ID NO: 1912758 - RNA, 21 nt, Human
acucaauauuuuccaugaaaa

SEQ ID NO: 1912759 - RNA, 18 nt, Human
acucaauauuuuccauga

SEQ ID NO: 1912760 - RNA, 15 nt, Human
acucaauauuuucca

SEQ ID NO: 1912761 - RNA, 12 nt, Human
acucaauauuuu

SEQ ID NO: 1912762 - RNA, 14 nt, Human
uccccuaaccucau

SEQ ID NO: 1912763 - RNA, 23 nt, Human
uccccguaugaguuagaauaaua

SEQ ID NO: 1912764 - RNA, 14 nt, Human
uccccucucugcac

SEQ ID NO: 1912765 - RNA, 12 nt, Human
acuauguaucaa

SEQ ID NO: 1912766 - RNA, 12 nt, Human
acuauaauguaa

SEQ ID NO: 1912767 - RNA, 13 nt, Human
acuagaugaugga

SEQ ID NO: 1912768 - RNA, 13 nt, Human
acuauaauguaag

SEQ ID NO: 1912769 - RNA, 14 nt, Human
acuauaauguaagc

SEQ ID NO: 1912770 - RNA, 20 nt, Human
acuaugcauggugccccagg

SEQ ID NO: 1912771 - RNA, 21 nt, Human
acuaugcauggugccccagga

SEQ ID NO: 1912772 - RNA, 22 nt, Human
acuaugcauggugccccaggac

SEQ ID NO: 1912773 - RNA, 23 nt, Human
acuaugcauggugccccaggacc

SEQ ID NO: 1912774 - RNA, 24 nt, Human
acuaugcauggugccccaggacca

SEQ ID NO: 1912775 - RNA, 21 nt, Human
acuauaauguaagcucuacug

SEQ ID NO: 1912776 - RNA, 18 nt, Human
acuacggaauaguuggcu

SEQ ID NO: 1912777 - RNA, 20 nt, Human
acuacgggggggagaaggaa

SEQ ID NO: 1912778 - RNA, 17 nt, Human
acuaccuugaaaauaag

SEQ ID NO: 1912779 - RNA, 16 nt, Human
acuagaacugaauuuu

SEQ ID NO: 1912780 - RNA, 14 nt, Human
acuacuagggaaau

SEQ ID NO: 1912781 - RNA, 23 nt, Human
acuagaacugaauuuugucuuua

SEQ ID NO: 1912782 - RNA, 19 nt, Human
acuagaacugaauuuuguc

SEQ ID NO: 1912783 - RNA, 18 nt, Human
acuagaacugaauuuugu

SEQ ID NO: 1912784 - RNA, 17 nt, Human
acuagaacugaauuuug

SEQ ID NO: 1912785 - RNA, 15 nt, Human
acuagaauuuauuca

SEQ ID NO: 1912786 - RNA, 22 nt, Human
acuagagggaccucucccaggg

SEQ ID NO: 1912787 - RNA, 20 nt, Human
acuagagggaccucucccag

SEQ ID NO: 1912788 - RNA, 21 nt, Human
acuagagggaccucucccagg

SEQ ID NO: 1912789 - RNA, 13 nt, Human
acguacacacaca

SEQ ID NO: 1912790 - RNA, 12 nt, Human
acguacacauuu

SEQ ID NO: 1912791 - RNA, 14 nt, Human
acguacacauuuua

SEQ ID NO: 1912792 - RNA, 13 nt, Human
acguacacauuuu

SEQ ID NO: 1912793 - RNA, 20 nt, Human
uccccaucgccagcugauga

SEQ ID NO: 1912794 - RNA, 19 nt, Human
uccccaucgccagcugaug

SEQ ID NO: 1912795 - RNA, 19 nt, Human
ucccccacccccuccccgc

SEQ ID NO: 1912796 - RNA, 14 nt, Human
uccccaucuucuaa

SEQ ID NO: 1912797 - RNA, 19 nt, Human
ucccccaccccauuucucu

SEQ ID NO: 1912798 - RNA, 13 nt, Human
uccguuaaaauac

SEQ ID NO: 1912799 - RNA, 13 nt, Human
uccgugcugacag

SEQ ID NO: 1912800 - RNA, 17 nt, Human
uccgugcugacagcugc

SEQ ID NO: 1912801 - RNA, 18 nt, Human
uccgugcugacagcugcu

SEQ ID NO: 1912802 - RNA, 19 nt, Human
uccgugcugacagcugcuc

SEQ ID NO: 1912803 - RNA, 21 nt, Human
uccgugcugacagcugcuccu

SEQ ID NO: 1912804 - RNA, 15 nt, Human
uccguuaaaauacca

SEQ ID NO: 1912805 - RNA, 20 nt, Human
uccuacccugcgcccagucc

SEQ ID NO: 1912806 - RNA, 21 nt, Human
uccggcccuccuacccugcgc

SEQ ID NO: 1912807 - RNA, 23 nt, Human
uccggcccuccuacccugcgccc

SEQ ID NO: 1912808 - RNA, 12 nt, Human
uccuacucugug

SEQ ID NO: 1912809 - RNA, 20 nt, Human
uccuagccacccaccacacu

SEQ ID NO: 1912810 - RNA, 21 nt, Human
uccuagccugugccucuggga

SEQ ID NO: 1912811 - RNA, 21 nt, Human
uccuagccaccgccuccuaca

SEQ ID NO: 1912812 - RNA, 16 nt, Human
acucgaguuacagaca

SEQ ID NO: 1912813 - RNA, 19 nt, Human
acucgauucauauugaaua

SEQ ID NO: 1912814 - RNA, 17 nt, Human
acucgagaacuuucauu

SEQ ID NO: 1912815 - RNA, 13 nt, Human
acucgagaacuuu

SEQ ID NO: 1912816 - RNA, 23 nt, Human
acuccuuccaguguccuuagaac

SEQ ID NO: 1912817 - RNA, 21 nt, Human
acucuuauugcccacgcugga

SEQ ID NO: 1912818 - RNA, 19 nt, Human
acucuggcagcucagagag

SEQ ID NO: 1912819 - RNA, 20 nt, Human
acucuggcagcucagagagg

SEQ ID NO: 1912820 - RNA, 16 nt, Human
acucuggcagcucaga

SEQ ID NO: 1912821 - RNA, 17 nt, Human
acucuggcagcucagag

SEQ ID NO: 1912822 - RNA, 17 nt, Human
acucuucacaaaaucug

SEQ ID NO: 1912823 - RNA, 13 nt, Human
acucuugaaaaau

SEQ ID NO: 1912824 - RNA, 12 nt, Human
acucuucucagc

SEQ ID NO: 1912825 - RNA, 17 nt, Human
acucgcgacaaugcaaa

SEQ ID NO: 1912826 - RNA, 15 nt, Human
acucgcgacaaugca

SEQ ID NO: 1912827 - RNA, 16 nt, Human
acucgcgacaaugcaa

SEQ ID NO: 1912828 - RNA, 14 nt, Human
uccucucuccagau

SEQ ID NO: 1912829 - RNA, 19 nt, Human
uccucucuccagauguuuc

SEQ ID NO: 1912830 - RNA, 14 nt, Human
uccucccuucugcu

SEQ ID NO: 1912831 - RNA, 15 nt, Human
uccucccuucugcua

SEQ ID NO: 1912832 - RNA, 16 nt, Human
uccucccuucugcuac

SEQ ID NO: 1912833 - RNA, 17 nt, Human
uccucccuucugcuacu

SEQ ID NO: 1912834 - RNA, 18 nt, Human
uccucccuucugcuacug

SEQ ID NO: 1912835 - RNA, 18 nt, Human
uccucucccauugucccu

SEQ ID NO: 1912836 - RNA, 19 nt, Human
uccucucccauugucccuc

SEQ ID NO: 1912837 - RNA, 21 nt, Human
uccucuccccagcccagagac

SEQ ID NO: 1912838 - RNA, 23 nt, Human
uccucuccccagcccagagacau

SEQ ID NO: 1912839 - RNA, 20 nt, Human
uccucucccauugucccucu

SEQ ID NO: 1912840 - RNA, 22 nt, Human
uccucucccauugucccucugc

SEQ ID NO: 1912841 - RNA, 23 nt, Human
uccucucccauugucccucugcc

SEQ ID NO: 1912842 - RNA, 21 nt, Human
uccucccaccucagccucccg

SEQ ID NO: 1912843 - RNA, 10 nt, Human
uccucccuuc

SEQ ID NO: 1912844 - RNA, 13 nt, Human
uccucccuucugc

SEQ ID NO: 1912845 - RNA, 20 nt, Human
uccucccaccucagccuccc

SEQ ID NO: 1912846 - RNA, 18 nt, Human
uccucccaccucagccuc

SEQ ID NO: 1912847 - RNA, 16 nt, Human
uccucccaccucagcc

SEQ ID NO: 1912848 - RNA, 15 nt, Human
uccucccaccucagc

SEQ ID NO: 1912849 - RNA, 14 nt, Human
uccucccaccucag

SEQ ID NO: 1912850 - RNA, 21 nt, Human
acucuugaaaaaugcauguug

SEQ ID NO: 1912851 - RNA, 14 nt, Human
acucuugaaaaaug

SEQ ID NO: 1912852 - RNA, 19 nt, Human
acucuugaaaaaugcaugu

SEQ ID NO: 1912853 - RNA, 23 nt, Human
uccucuuuggucuacacugugcu

SEQ ID NO: 1912854 - RNA, 20 nt, Human
uccucuuguaaauaaagccc

SEQ ID NO: 1912855 - RNA, 18 nt, Human
uccucuuguaaauaaagc

SEQ ID NO: 1912856 - RNA, 19 nt, Human
uccucuuguaaauaaagcc

SEQ ID NO: 1912857 - RNA, 21 nt, Human
uccucuuguaaauaaagcccu

SEQ ID NO: 1912858 - RNA, 15 nt, Human
uccucuuuucucugc

SEQ ID NO: 1912859 - RNA, 13 nt, Human
uccugaagaacca

SEQ ID NO: 1912860 - RNA, 14 nt, Human
uccugaagaaccag

SEQ ID NO: 1912861 - RNA, 16 nt, Human
uccugaagaaccaguc

SEQ ID NO: 1912862 - RNA, 18 nt, Human
uccugaagaaccaguccc

SEQ ID NO: 1912863 - RNA, 23 nt, Human
uccugaagaaccaguccccccac

SEQ ID NO: 1912864 - RNA, 12 nt, Human
uccucugcugcu

SEQ ID NO: 1912865 - RNA, 12 nt, Human
uccucuuguaaa

SEQ ID NO: 1912866 - RNA, 15 nt, Human
uccugaagaauugaa

SEQ ID NO: 1912867 - RNA, 14 nt, Human
acucuuucuguaua

SEQ ID NO: 1912868 - RNA, 16 nt, Human
uccugaccucagguga

SEQ ID NO: 1912869 - RNA, 21 nt, Human
acucuuucuguauauacuuuu

SEQ ID NO: 1912870 - RNA, 22 nt, Human
acucuuucuguauauacuuuuu

SEQ ID NO: 1912871 - RNA, 15 nt, Human
acugaaaaccucucc

SEQ ID NO: 1912872 - RNA, 16 nt, Human
acugaaaaccucuccu

SEQ ID NO: 1912873 - RNA, 20 nt, Human
acugaaaaggaggggucugg

SEQ ID NO: 1912874 - RNA, 17 nt, Human
acugaaaaccucuccuc

SEQ ID NO: 1912875 - RNA, 22 nt, Human
accuucaguaacccccacugga

SEQ ID NO: 1912876 - RNA, 15 nt, Human
accuuccaagagccu

SEQ ID NO: 1912877 - RNA, 17 nt, Human
accuucacacacagacu

SEQ ID NO: 1912878 - RNA, 23 nt, Human
accuucacacacagacuguuguc

SEQ ID NO: 1912879 - RNA, 22 nt, Human
accuucacugugaccuugagaa

SEQ ID NO: 1912880 - RNA, 14 nt, Human
accuucagaauaag

SEQ ID NO: 1912881 - RNA, 21 nt, Human
accuggguaacuagggaagau

SEQ ID NO: 1912882 - RNA, 22 nt, Human
accuggggggcaguggugugga

SEQ ID NO: 1912883 - RNA, 15 nt, Human
accuucgggcugugc

SEQ ID NO: 1912884 - RNA, 14 nt, Human
accuucgggcugug

SEQ ID NO: 1912885 - RNA, 17 nt, Human
accuucgggcugugccc

SEQ ID NO: 1912886 - RNA, 16 nt, Human
accuucgggcugugcc

SEQ ID NO: 1912887 - RNA, 18 nt, Human
accuucgggcugugcccg

SEQ ID NO: 1912888 - RNA, 16 nt, Human
accuuccaagagccug

SEQ ID NO: 1912889 - RNA, 18 nt, Human
accuuuuuuauacauaaa

SEQ ID NO: 1912890 - RNA, 17 nt, Human
accuuuuuuauacauaa

SEQ ID NO: 1912891 - RNA, 16 nt, Human
accuuuuuuauacaua

SEQ ID NO: 1912892 - RNA, 14 nt, Human
accuuuguccccac

SEQ ID NO: 1912893 - RNA, 15 nt, Human
accuuuguccccacc

SEQ ID NO: 1912894 - RNA, 16 nt, Human
accuuuguccccaccg

SEQ ID NO: 1912895 - RNA, 14 nt, Human
accuuuuuuauaca

SEQ ID NO: 1912896 - RNA, 14 nt, Human
accuucuccuucac

SEQ ID NO: 1912897 - RNA, 22 nt, Human
accuucuccuucaccuuugucc

SEQ ID NO: 1912898 - RNA, 18 nt, Human
accuucuggccucccaca

SEQ ID NO: 1912899 - RNA, 22 nt, Human
accuucuggccucccacagacu

SEQ ID NO: 1912900 - RNA, 13 nt, Human
accuuugucccca

SEQ ID NO: 1912901 - RNA, 17 nt, Human
accuugaugagcugugc

SEQ ID NO: 1912902 - RNA, 18 nt, Human
uccaaggguacuaaggaa

SEQ ID NO: 1912903 - RNA, 18 nt, Human
uccaauguggcaaggaaa

SEQ ID NO: 1912904 - RNA, 18 nt, Human
uccaaauggcgucuggaa

SEQ ID NO: 1912905 - RNA, 20 nt, Human
uccaaauggcgucuggaagu

SEQ ID NO: 1912906 - RNA, 21 nt, Human
uccaaggggaaucagaacuca

SEQ ID NO: 1912907 - RNA, 20 nt, Human
uccacccaggagccccgagg

SEQ ID NO: 1912908 - RNA, 17 nt, Human
uccacccaggagccccg

SEQ ID NO: 1912909 - RNA, 13 nt, Human
uccacccaccuca

SEQ ID NO: 1912910 - RNA, 12 nt, Human
uccacccaccuc

SEQ ID NO: 1912911 - RNA, 18 nt, Human
uccaccaucaagccacca

SEQ ID NO: 1912912 - RNA, 12 nt, Human
accuggccucug

SEQ ID NO: 1912913 - RNA, 13 nt, Human
accuggccucugc

SEQ ID NO: 1912914 - RNA, 21 nt, Human
accuggcuuuuuauuguauuu

SEQ ID NO: 1912915 - RNA, 16 nt, Human
accuggcugccauacu

SEQ ID NO: 1912916 - RNA, 20 nt, Human
accuggcuuuucuuucuacc

SEQ ID NO: 1912917 - RNA, 18 nt, Human
accugggauucaggaaug

SEQ ID NO: 1912918 - RNA, 17 nt, Human
accuggacacaggccug

SEQ ID NO: 1912919 - RNA, 14 nt, Human
accuggacacaggc

SEQ ID NO: 1912920 - RNA, 20 nt, Human
accuggaauauauaaccagu

SEQ ID NO: 1912921 - RNA, 23 nt, Human
accugccuguugggccaggagcc

SEQ ID NO: 1912922 - RNA, 21 nt, Human
accugccucggccucccaaag

SEQ ID NO: 1912923 - RNA, 23 nt, Human
accugccucggccucccaaagug

SEQ ID NO: 1912924 - RNA, 16 nt, Human
accugcggugcuaucu

SEQ ID NO: 1912925 - RNA, 21 nt, Human
accugcgucucauacucaccu

SEQ ID NO: 1912926 - RNA, 22 nt, Human
ucauuuugguaaaauacuucuu

SEQ ID NO: 1912927 - RNA, 17 nt, Human
ucauuuuguaacaaaug

SEQ ID NO: 1912928 - RNA, 20 nt, Human
ucauuuuguaacaaaugaac

SEQ ID NO: 1912929 - RNA, 19 nt, Human
ucauuuuuaguagagacag

SEQ ID NO: 1912930 - RNA, 18 nt, Human
ucauuuuucagaccuuuu

SEQ ID NO: 1912931 - RNA, 18 nt, Human
ucauuuuuuuuaagaaaa

SEQ ID NO: 1912932 - RNA, 17 nt, Human
ucauuuuuuuuaagaaa

SEQ ID NO: 1912933 - RNA, 14 nt, Human
ucauuugucacaca

SEQ ID NO: 1912934 - RNA, 18 nt, Human
ucauuugguucauuaauu

SEQ ID NO: 1912935 - RNA, 16 nt, Human
ucauuugucacacacu

SEQ ID NO: 1912936 - RNA, 20 nt, Human
ucauuugguucauuaauucu

SEQ ID NO: 1912937 - RNA, 17 nt, Human
accugauuaacugaggc

SEQ ID NO: 1912938 - RNA, 22 nt, Human
accugauuaacugaggcaucca

SEQ ID NO: 1912939 - RNA, 14 nt, Human
accugauugugucu

SEQ ID NO: 1912940 - RNA, 16 nt, Human
accugaggggccucuu

SEQ ID NO: 1912941 - RNA, 22 nt, Human
accugauccuggaggcccaguu

SEQ ID NO: 1912942 - RNA, 13 nt, Human
accugauccugga

SEQ ID NO: 1912943 - RNA, 20 nt, Human
accugauccuggaggcccag

SEQ ID NO: 1912944 - RNA, 14 nt, Human
accugaggggccuc

SEQ ID NO: 1912945 - RNA, 18 nt, Human
accugccaggaagccagc

SEQ ID NO: 1912946 - RNA, 19 nt, Human
accugccaggaagccagca

SEQ ID NO: 1912947 - RNA, 16 nt, Human
accugccaggaagcca

SEQ ID NO: 1912948 - RNA, 17 nt, Human
accugccaggaagccag

SEQ ID NO: 1912949 - RNA, 15 nt, Human
accugcaaagaucug

SEQ ID NO: 1912950 - RNA, 16 nt, Human
accugcaaagaucugu

SEQ ID NO: 1912951 - RNA, 22 nt, Human
accugcaaagaucuguccucag

SEQ ID NO: 1912952 - RNA, 16 nt, Human
ucauaauaaguugcau

SEQ ID NO: 1912953 - RNA, 12 nt, Human
ucauaaugacuu

SEQ ID NO: 1912954 - RNA, 15 nt, Human
ucauaaucuuugcuu

SEQ ID NO: 1912955 - RNA, 14 nt, Human
ucauaaucuuugcu

SEQ ID NO: 1912956 - RNA, 18 nt, Human
accugaagacucauucuu

SEQ ID NO: 1912957 - RNA, 16 nt, Human
accugaacugaacacc

SEQ ID NO: 1912958 - RNA, 14 nt, Human
accugaaccuagga

SEQ ID NO: 1912959 - RNA, 19 nt, Human
accugaauuuuggcugugu

SEQ ID NO: 1912960 - RNA, 22 nt, Human
accugaagcuaucguaaaauua

SEQ ID NO: 1912961 - RNA, 23 nt, Human
accugaggcccuucucuccagcc

SEQ ID NO: 1912962 - RNA, 17 nt, Human
accugagccccaaaagg

SEQ ID NO: 1912963 - RNA, 12 nt, Human
accugagcccca

SEQ ID NO: 1912964 - RNA, 14 nt, Human
acgacacacuuuga

SEQ ID NO: 1912965 - RNA, 15 nt, Human
acgacugcccggcag

SEQ ID NO: 1912966 - RNA, 18 nt, Human
acgccaggggaaaaucag

SEQ ID NO: 1912967 - RNA, 23 nt, Human
acgccaggggaaaaucagccugc

SEQ ID NO: 1912968 - RNA, 11 nt, Human
acgccauccca

SEQ ID NO: 1912969 - RNA, 14 nt, Human
acgccaucccagcc

SEQ ID NO: 1912970 - RNA, 15 nt, Human
acgccaucccagccc

SEQ ID NO: 1912971 - RNA, 16 nt, Human
acgccaucccagcccc

SEQ ID NO: 1912972 - RNA, 17 nt, Human
acgccaucccagcccca

SEQ ID NO: 1912973 - RNA, 18 nt, Human
acgccaucccagccccaa

SEQ ID NO: 1912974 - RNA, 19 nt, Human
uccacgcacaugcgacccc

SEQ ID NO: 1912975 - RNA, 18 nt, Human
uccaggcugggagagccu

SEQ ID NO: 1912976 - RNA, 14 nt, Human
uccaggcugggaga

SEQ ID NO: 1912977 - RNA, 17 nt, Human
uccaggcugggagagcc

SEQ ID NO: 1912978 - RNA, 14 nt, Human
acgaauauugcuga

SEQ ID NO: 1912979 - RNA, 17 nt, Human
acgaagccaucuuucuu

SEQ ID NO: 1912980 - RNA, 15 nt, Human
acgaagaagagccac

SEQ ID NO: 1912981 - RNA, 17 nt, Human
acgaagaagagccacag

SEQ ID NO: 1912982 - RNA, 18 nt, Human
acgaagaagagccacagu

SEQ ID NO: 1912983 - RNA, 14 nt, Human
uccagggacugaag

SEQ ID NO: 1912984 - RNA, 19 nt, Human
uccagggagcauuuuccuc

SEQ ID NO: 1912985 - RNA, 14 nt, Human
uccagggacagagg

SEQ ID NO: 1912986 - RNA, 15 nt, Human
uccagggacagaggc

SEQ ID NO: 1912987 - RNA, 19 nt, Human
uccagggacagaggcccca

SEQ ID NO: 1912988 - RNA, 21 nt, Human
uccagggacagaggccccagc

SEQ ID NO: 1912989 - RNA, 23 nt, Human
uccagggacagaggccccagccu

SEQ ID NO: 1912990 - RNA, 21 nt, Human
uccagggacgaagaagagcca

SEQ ID NO: 1912991 - RNA, 23 nt, Human
acgcgugcacacaccagagccca

SEQ ID NO: 1912992 - RNA, 20 nt, Human
acgccgcccuaaaagcacac

SEQ ID NO: 1912993 - RNA, 14 nt, Human
acgcccccacuggu

SEQ ID NO: 1912994 - RNA, 14 nt, Human
acgcccccccccac

SEQ ID NO: 1912995 - RNA, 16 nt, Human
acgcccccccccaccc

SEQ ID NO: 1912996 - RNA, 23 nt, Human
acgcccccccccaccccuggggg

SEQ ID NO: 1912997 - RNA, 18 nt, Human
acgcuacccgggaagggg

SEQ ID NO: 1912998 - RNA, 16 nt, Human
acgcucucuggccuuc

SEQ ID NO: 1912999 - RNA, 15 nt, Human
acgcucucuggccuu

SEQ ID NO: 1913000 - RNA, 13 nt, Human
acgcuacccggga

SEQ ID NO: 1913001 - RNA, 17 nt, Human
acgcuacccgggaaggg

SEQ ID NO: 1913002 - RNA, 21 nt, Human
acggagucccaccuuggcugc

SEQ ID NO: 1913003 - RNA, 12 nt, Human
acggauuccaaa

SEQ ID NO: 1913004 - RNA, 16 nt, Human
acggccaggccagagg

SEQ ID NO: 1913005 - RNA, 17 nt, Human
acggccagggagaagcu

SEQ ID NO: 1913006 - RNA, 23 nt, Human
acggccagggagaagcuccucuc

SEQ ID NO: 1913007 - RNA, 18 nt, Human
acggccagggagaagcuc

SEQ ID NO: 1913008 - RNA, 17 nt, Human
acgcucucuggccuucg

SEQ ID NO: 1913009 - RNA, 19 nt, Human
acggagucccaccuuggcu

SEQ ID NO: 1913010 - RNA, 15 nt, Human
acggagcccagcccu

SEQ ID NO: 1913011 - RNA, 20 nt, Human
acggagcccagcccucccca

SEQ ID NO: 1913012 - RNA, 22 nt, Human
ucccacccacaugugacacaua

SEQ ID NO: 1913013 - RNA, 18 nt, Human
ucccacccacaugugaca

SEQ ID NO: 1913014 - RNA, 16 nt, Human
ucccacccacauguga

SEQ ID NO: 1913015 - RNA, 15 nt, Human
ucccacccacaugug

SEQ ID NO: 1913016 - RNA, 11 nt, Human
ucccaccccac

SEQ ID NO: 1913017 - RNA, 14 nt, Human
ucccaccccacaca

SEQ ID NO: 1913018 - RNA, 18 nt, Human
acggggcucuucucauuu

SEQ ID NO: 1913019 - RNA, 15 nt, Human
acggggcucuucuca

SEQ ID NO: 1913020 - RNA, 16 nt, Human
ucccaccuagcagcac

SEQ ID NO: 1913021 - RNA, 15 nt, Human
ucccaaagugcuggg

SEQ ID NO: 1913022 - RNA, 17 nt, Human
uccauuuguuaucuggg

SEQ ID NO: 1913023 - RNA, 19 nt, Human
uccauuuguuaucugggaa

SEQ ID NO: 1913024 - RNA, 16 nt, Human
ucccaaagugcuggga

SEQ ID NO: 1913025 - RNA, 20 nt, Human
ucccaaagugcugggauuac

SEQ ID NO: 1913026 - RNA, 21 nt, Human
ucccaaagugcugggauuaca

SEQ ID NO: 1913027 - RNA, 14 nt, Human
ucccacaaaggaga

SEQ ID NO: 1913028 - RNA, 17 nt, Human
ucccaauuucagacucc

SEQ ID NO: 1913029 - RNA, 18 nt, Human
ucccaauuucagacuccc

SEQ ID NO: 1913030 - RNA, 23 nt, Human
ucccaauuucagacucccauucc

SEQ ID NO: 1913031 - RNA, 15 nt, Human
uccaugaguccccug

SEQ ID NO: 1913032 - RNA, 16 nt, Human
uccaugaguccccugu

SEQ ID NO: 1913033 - RNA, 17 nt, Human
uccaugaguccccuguu

SEQ ID NO: 1913034 - RNA, 22 nt, Human
uccaugaagauguagaggagaa

SEQ ID NO: 1913035 - RNA, 12 nt, Human
uccaugaaaaug

SEQ ID NO: 1913036 - RNA, 20 nt, Human
uccaucucuuguuuaaauuc

SEQ ID NO: 1913037 - RNA, 11 nt, Human
uccauccugag

SEQ ID NO: 1913038 - RNA, 13 nt, Human
uccaucuuuacaa

SEQ ID NO: 1913039 - RNA, 14 nt, Human
acggcucacugcag

SEQ ID NO: 1913040 - RNA, 12 nt, Human
acggcccuggcc

SEQ ID NO: 1913041 - RNA, 14 nt, Human
acggcccuggccuu

SEQ ID NO: 1913042 - RNA, 23 nt, Human
acggcccuggccuugggcccucu

SEQ ID NO: 1913043 - RNA, 15 nt, Human
acggcucacugcagc

SEQ ID NO: 1913044 - RNA, 20 nt, Human
uccagugaggcucugcccuu

SEQ ID NO: 1913045 - RNA, 18 nt, Human
uccagugaggcucugccc

SEQ ID NO: 1913046 - RNA, 19 nt, Human
uccagugaggcucugcccu

SEQ ID NO: 1913047 - RNA, 17 nt, Human
uccagugaggcucugcc

SEQ ID NO: 1913048 - RNA, 14 nt, Human
uccagugagacagc

SEQ ID NO: 1913049 - RNA, 20 nt, Human
acauggccuaugcacauaug

SEQ ID NO: 1913050 - RNA, 18 nt, Human
acauggccuaugcacaua

SEQ ID NO: 1913051 - RNA, 17 nt, Human
acauggccuaugcacau

SEQ ID NO: 1913052 - RNA, 20 nt, Human
acauggcucuaaaaaguuuu

SEQ ID NO: 1913053 - RNA, 14 nt, Human
acauggccuuugcu

SEQ ID NO: 1913054 - RNA, 15 nt, Human
acauggaguauaugu

SEQ ID NO: 1913055 - RNA, 19 nt, Human
acauggaguauaugucaag

SEQ ID NO: 1913056 - RNA, 23 nt, Human
acaugagcaucaggccaggcccu

SEQ ID NO: 1913057 - RNA, 16 nt, Human
acaugaggggacauuu

SEQ ID NO: 1913058 - RNA, 17 nt, Human
acaugaggggacauuuu

SEQ ID NO: 1913059 - RNA, 20 nt, Human
acauggaauaacauguaauu

SEQ ID NO: 1913060 - RNA, 18 nt, Human
acauggaauaacauguaa

SEQ ID NO: 1913061 - RNA, 14 nt, Human
acauggaaguacua

SEQ ID NO: 1913062 - RNA, 16 nt, Human
acaugagguacugaga

SEQ ID NO: 1913063 - RNA, 14 nt, Human
acaugucuuguaca

SEQ ID NO: 1913064 - RNA, 13 nt, Human
acaugucuuguac

SEQ ID NO: 1913065 - RNA, 19 nt, Human
acaugucuuguacaugugu

SEQ ID NO: 1913066 - RNA, 16 nt, Human
acaugucuuguacaug

SEQ ID NO: 1913067 - RNA, 22 nt, Human
acaugucuuguacauguguagc

SEQ ID NO: 1913068 - RNA, 21 nt, Human
acaugucuuuucuugcaugag

SEQ ID NO: 1913069 - RNA, 17 nt, Human
acauuaagccuuccaca

SEQ ID NO: 1913070 - RNA, 14 nt, Human
acauguauaauauu

SEQ ID NO: 1913071 - RNA, 20 nt, Human
acauguauaauauuuuuaau

SEQ ID NO: 1913072 - RNA, 19 nt, Human
acauguauaauauuuuuaa

SEQ ID NO: 1913073 - RNA, 13 nt, Human
acaugagcaucag

SEQ ID NO: 1913074 - RNA, 15 nt, Human
acaugagaacaaaca

SEQ ID NO: 1913075 - RNA, 22 nt, Human
acaugaaaacacauuuuucuua

SEQ ID NO: 1913076 - RNA, 23 nt, Human
acaugaaaacacauuuuucuuag

SEQ ID NO: 1913077 - RNA, 13 nt, Human
ucaaauauauuca

SEQ ID NO: 1913078 - RNA, 23 nt, Human
ucaaauacgugggcauucaaaug

SEQ ID NO: 1913079 - RNA, 20 nt, Human
ucaaauacgugggcauucaa

SEQ ID NO: 1913080 - RNA, 22 nt, Human
ucaaauacgugggcauucaaau

SEQ ID NO: 1913081 - RNA, 21 nt, Human
ucaaauacgugggcauucaaa

SEQ ID NO: 1913082 - RNA, 22 nt, Human
ucaaagauauuuugcuuuguga

SEQ ID NO: 1913083 - RNA, 20 nt, Human
ucaaagauauuuugcuuugu

SEQ ID NO: 1913084 - RNA, 13 nt, Human
ucaaagauauuuu

SEQ ID NO: 1913085 - RNA, 16 nt, Human
ucaaaagcugggcagg

SEQ ID NO: 1913086 - RNA, 14 nt, Human
uauuuuaagacgaa

SEQ ID NO: 1913087 - RNA, 22 nt, Human
uauuuuaagacgaaacauuugu

SEQ ID NO: 1913088 - RNA, 21 nt, Human
uauuuuaaaagauaaauauua

SEQ ID NO: 1913089 - RNA, 16 nt, Human
acaugaaaacacauuu

SEQ ID NO: 1913090 - RNA, 15 nt, Human
acaugaaaacacauu

SEQ ID NO: 1913091 - RNA, 22 nt, Human
uauuuguaggggaacucauuug

SEQ ID NO: 1913092 - RNA, 22 nt, Human
uauuuguuaaugguuugaauau

SEQ ID NO: 1913093 - RNA, 20 nt, Human
uauuuguuaaugguuugaau

SEQ ID NO: 1913094 - RNA, 16 nt, Human
acaucuugcucugcug

SEQ ID NO: 1913095 - RNA, 15 nt, Human
acaucuugcucugcu

SEQ ID NO: 1913096 - RNA, 14 nt, Human
uaugugccagauuu

SEQ ID NO: 1913097 - RNA, 19 nt, Human
uaugugccagauuuaugca

SEQ ID NO: 1913098 - RNA, 20 nt, Human
uaugugggggucuguguguu

SEQ ID NO: 1913099 - RNA, 19 nt, Human
uaugugggggucugugugu

SEQ ID NO: 1913100 - RNA, 18 nt, Human
uaugugggggucugugug

SEQ ID NO: 1913101 - RNA, 17 nt, Human
acaucuugcucugcuga

SEQ ID NO: 1913102 - RNA, 22 nt, Human
acaucuugcucugcugacagac

SEQ ID NO: 1913103 - RNA, 19 nt, Human
acaucuuggucagauuuga

SEQ ID NO: 1913104 - RNA, 24 nt, Human
acaucuuuucuugccucugucccc

SEQ ID NO: 1913105 - RNA, 17 nt, Human
uauuuuguguuuaggaa

SEQ ID NO: 1913106 - RNA, 20 nt, Human
uauuuuguguuuaggaacua

SEQ ID NO: 1913107 - RNA, 16 nt, Human
uauuuuguaacuucca

SEQ ID NO: 1913108 - RNA, 17 nt, Human
uauuuuuguagagccag

SEQ ID NO: 1913109 - RNA, 17 nt, Human
uauuuuuauuuguuugu

SEQ ID NO: 1913110 - RNA, 18 nt, Human
uauuuuucaauaaagcau

SEQ ID NO: 1913111 - RNA, 20 nt, Human
uauuuuucaauaaagcauuu

SEQ ID NO: 1913112 - RNA, 15 nt, Human
uauuuugcuuuguga

SEQ ID NO: 1913113 - RNA, 13 nt, Human
uauuuugcuuugu

SEQ ID NO: 1913114 - RNA, 20 nt, Human
uauuuugcuuugugauuuuu

SEQ ID NO: 1913115 - RNA, 20 nt, Human
uauuuuggauuguauauugu

SEQ ID NO: 1913116 - RNA, 23 nt, Human
uauuuuggauuguauauuguguu

SEQ ID NO: 1913117 - RNA, 15 nt, Human
uauuuugaucuucaa

SEQ ID NO: 1913118 - RNA, 16 nt, Human
uauuuugaucuucaac

SEQ ID NO: 1913119 - RNA, 18 nt, Human
uauuuugaucuucaacaa

SEQ ID NO: 1913120 - RNA, 12 nt, Human
uauuuugaucuu

SEQ ID NO: 1913121 - RNA, 14 nt, Human
uauuuugaucuuca

SEQ ID NO: 1913122 - RNA, 14 nt, Human
uauuuuaauaaaca

SEQ ID NO: 1913123 - RNA, 17 nt, Human
uauuuuaauaaacacuc

SEQ ID NO: 1913124 - RNA, 13 nt, Human
uauuuuacauaaa

SEQ ID NO: 1913125 - RNA, 19 nt, Human
ucacauuacuguauauacu

SEQ ID NO: 1913126 - RNA, 21 nt, Human
ucacauggccuaugcacauau

SEQ ID NO: 1913127 - RNA, 16 nt, Human
ucacauggccuaugca

SEQ ID NO: 1913128 - RNA, 15 nt, Human
ucacaugggacaaag

SEQ ID NO: 1913129 - RNA, 17 nt, Human
ucaccagccccagugcc

SEQ ID NO: 1913130 - RNA, 17 nt, Human
ucacauuccugaacagg

SEQ ID NO: 1913131 - RNA, 13 nt, Human
ucacauuccugaa

SEQ ID NO: 1913132 - RNA, 20 nt, Human
ucacauauugauuuccguua

SEQ ID NO: 1913133 - RNA, 18 nt, Human
ucacauauugauuuccgu

SEQ ID NO: 1913134 - RNA, 16 nt, Human
ucacauauugauuucc

SEQ ID NO: 1913135 - RNA, 15 nt, Human
ucacagaugggugcu

SEQ ID NO: 1913136 - RNA, 16 nt, Human
ucacagccaccccuga

SEQ ID NO: 1913137 - RNA, 14 nt, Human
ucacagaugggugc

SEQ ID NO: 1913138 - RNA, 16 nt, Human
ucacagccacuuggga

SEQ ID NO: 1913139 - RNA, 19 nt, Human
ucacagcuccaagaauuuc

SEQ ID NO: 1913140 - RNA, 13 nt, Human
ucaauuuaaaaaa

SEQ ID NO: 1913141 - RNA, 12 nt, Human
ucaauuuaaaaa

SEQ ID NO: 1913142 - RNA, 20 nt, Human
accaaccacugcgaccacaa

SEQ ID NO: 1913143 - RNA, 17 nt, Human
accaacauacucccauc

SEQ ID NO: 1913144 - RNA, 16 nt, Human
accaacauacucccau

SEQ ID NO: 1913145 - RNA, 16 nt, Human
accaaaucagcugcua

SEQ ID NO: 1913146 - RNA, 19 nt, Human
accaaaucagcugcuacua

SEQ ID NO: 1913147 - RNA, 19 nt, Human
accaaaaacugaaagugaa

SEQ ID NO: 1913148 - RNA, 21 nt, Human
accaaugccaaaaaaagacag

SEQ ID NO: 1913149 - RNA, 23 nt, Human
accacacccagcccacuucugcc

SEQ ID NO: 1913150 - RNA, 21 nt, Human
accacacccagcccacuucug

SEQ ID NO: 1913151 - RNA, 20 nt, Human
accacacccagcccacuucu

SEQ ID NO: 1913152 - RNA, 16 nt, Human
accacacccagcccac

SEQ ID NO: 1913153 - RNA, 15 nt, Human
accacacccagccca

SEQ ID NO: 1913154 - RNA, 17 nt, Human
accacacagaggcugcc

SEQ ID NO: 1913155 - RNA, 18 nt, Human
acauuauuaucaacaaua

SEQ ID NO: 1913156 - RNA, 17 nt, Human
ucaagagggucugagga

SEQ ID NO: 1913157 - RNA, 22 nt, Human
ucaagauucccaggaguucugc

SEQ ID NO: 1913158 - RNA, 19 nt, Human
ucaagauucccaggaguuc

SEQ ID NO: 1913159 - RNA, 20 nt, Human
ucaagauucccaggaguucu

SEQ ID NO: 1913160 - RNA, 19 nt, Human
ucaagauacugcuacugua

SEQ ID NO: 1913161 - RNA, 16 nt, Human
ucaagauucccaggag

SEQ ID NO: 1913162 - RNA, 17 nt, Human
ucaagauucccaggagu

SEQ ID NO: 1913163 - RNA, 17 nt, Human
ucaagcaagauuucaga

SEQ ID NO: 1913164 - RNA, 22 nt, Human
ucaauaggaaaaacugauuuuu

SEQ ID NO: 1913165 - RNA, 16 nt, Human
ucaauauuuuccauga

SEQ ID NO: 1913166 - RNA, 15 nt, Human
ucaauauuuuccaug

SEQ ID NO: 1913167 - RNA, 24 nt, Human
ucaaguacauaaaguacauaacaa

SEQ ID NO: 1913168 - RNA, 18 nt, Human
ucaauauuuuccaugaaa

SEQ ID NO: 1913169 - RNA, 17 nt, Human
ucaauauuuuccaugaa

SEQ ID NO: 1913170 - RNA, 16 nt, Human
ucaauauuuuuagaua

SEQ ID NO: 1913171 - RNA, 17 nt, Human
ucaauaggaaaaacuga

SEQ ID NO: 1913172 - RNA, 17 nt, Human
ucaagugauucuccugc

SEQ ID NO: 1913173 - RNA, 18 nt, Human
ucaauaggaaaaacugau

SEQ ID NO: 1913174 - RNA, 19 nt, Human
ucaauaggaaaaacugauu

SEQ ID NO: 1913175 - RNA, 16 nt, Human
ucaagugauucuccug

SEQ ID NO: 1913176 - RNA, 19 nt, Human
ucaaguaauccaccugccu

SEQ ID NO: 1913177 - RNA, 23 nt, Human
acauuuuucuuagggaaggauac

SEQ ID NO: 1913178 - RNA, 13 nt, Human
acauuuuucuuag

SEQ ID NO: 1913179 - RNA, 21 nt, Human
accaaaaaagcuguauuuuga

SEQ ID NO: 1913180 - RNA, 21 nt, Human
acauuuuucagauauaaaaga

SEQ ID NO: 1913181 - RNA, 18 nt, Human
acauuuuuaagugcugca

SEQ ID NO: 1913182 - RNA, 15 nt, Human
acauuuuuaagugcu

SEQ ID NO: 1913183 - RNA, 18 nt, Human
acauuuuacuuuuuccug

SEQ ID NO: 1913184 - RNA, 13 nt, Human
acauuuuaauuca

SEQ ID NO: 1913185 - RNA, 15 nt, Human
acauuuuaaugcacc

SEQ ID NO: 1913186 - RNA, 19 nt, Human
acauuuuaaugcaccugaa

SEQ ID NO: 1913187 - RNA, 22 nt, Human
acauugcggacagccacggcca

SEQ ID NO: 1913188 - RNA, 21 nt, Human
acauugcggacagccacggcc

SEQ ID NO: 1913189 - RNA, 15 nt, Human
acauugcguuugacc

SEQ ID NO: 1913190 - RNA, 23 nt, Human
acauugcguuugaccuuuuaugu

SEQ ID NO: 1913191 - RNA, 15 nt, Human
ucaauccuaccuguu

SEQ ID NO: 1913192 - RNA, 16 nt, Human
acauuggaaacaaguc

SEQ ID NO: 1913193 - RNA, 21 nt, Human
acauuggcaccuaauccaggc

SEQ ID NO: 1913194 - RNA, 22 nt, Human
acauuggcaccuaauccaggca

SEQ ID NO: 1913195 - RNA, 15 nt, Human
acauugggaagggga

SEQ ID NO: 1913196 - RNA, 19 nt, Human
acauugggaaggggacccc

SEQ ID NO: 1913197 - RNA, 23 nt, Human
acauugggaaggggacccccgcc

SEQ ID NO: 1913198 - RNA, 22 nt, Human
acauugguauucgcuugagaaa

SEQ ID NO: 1913199 - RNA, 17 nt, Human
acccccacuggacugac

SEQ ID NO: 1913200 - RNA, 12 nt, Human
acccccagccug

SEQ ID NO: 1913201 - RNA, 13 nt, Human
acccccagccugc

SEQ ID NO: 1913202 - RNA, 17 nt, Human
ucaggcaggugggaugg

SEQ ID NO: 1913203 - RNA, 18 nt, Human
ucaggcaggugggaugga

SEQ ID NO: 1913204 - RNA, 13 nt, Human
ucaggccagcugc

SEQ ID NO: 1913205 - RNA, 14 nt, Human
ucaggccagcugcu

SEQ ID NO: 1913206 - RNA, 13 nt, Human
ucaggccaggccc

SEQ ID NO: 1913207 - RNA, 14 nt, Human
ucaggccaggcccu

SEQ ID NO: 1913208 - RNA, 15 nt, Human
ucaggccaggcccuc

SEQ ID NO: 1913209 - RNA, 16 nt, Human
ucaggccaggcccucu

SEQ ID NO: 1913210 - RNA, 19 nt, Human
ucaggguuggccccugccc

SEQ ID NO: 1913211 - RNA, 18 nt, Human
ucaggguuggccccugcc

SEQ ID NO: 1913212 - RNA, 23 nt, Human
ucaggguuggccccugcccggcu

SEQ ID NO: 1913213 - RNA, 19 nt, Human
acccgcuaagagggaggga

SEQ ID NO: 1913214 - RNA, 19 nt, Human
ucaggccaggcccucugcc

SEQ ID NO: 1913215 - RNA, 17 nt, Human
ucaggccaggcccucug

SEQ ID NO: 1913216 - RNA, 18 nt, Human
ucaggccaggcccucugc

SEQ ID NO: 1913217 - RNA, 12 nt, Human
ucaggggugugc

SEQ ID NO: 1913218 - RNA, 19 nt, Human
ucaggggugugcggccuuu

SEQ ID NO: 1913219 - RNA, 23 nt, Human
ucaggggugugcggccuuuggcu

SEQ ID NO: 1913220 - RNA, 17 nt, Human
ucaggguuggccccugc

SEQ ID NO: 1913221 - RNA, 21 nt, Human
acccuccuuucaccacaugug

SEQ ID NO: 1913222 - RNA, 23 nt, Human
acccucccucuacugggagccua

SEQ ID NO: 1913223 - RNA, 15 nt, Human
acccgggaggcagag

SEQ ID NO: 1913224 - RNA, 17 nt, Human
acccucauucuacugaa

SEQ ID NO: 1913225 - RNA, 17 nt, Human
acccucauguucuuaau

SEQ ID NO: 1913226 - RNA, 15 nt, Human
acccucauguucuua

SEQ ID NO: 1913227 - RNA, 14 nt, Human
acccucauguucuu

SEQ ID NO: 1913228 - RNA, 22 nt, Human
acccgggaagggggcugggaca

SEQ ID NO: 1913229 - RNA, 19 nt, Human
acccgggaagggggcuggg

SEQ ID NO: 1913230 - RNA, 20 nt, Human
acccgggaagggggcuggga

SEQ ID NO: 1913231 - RNA, 14 nt, Human
acccucgaggcgga

SEQ ID NO: 1913232 - RNA, 18 nt, Human
acccucgaggcggaucuu

SEQ ID NO: 1913233 - RNA, 11 nt, Human
acccugaggcc

SEQ ID NO: 1913234 - RNA, 13 nt, Human
acccugaggccca

SEQ ID NO: 1913235 - RNA, 19 nt, Human
acccugaggcccagagggc

SEQ ID NO: 1913236 - RNA, 21 nt, Human
acccugaggcccagagggccu

SEQ ID NO: 1913237 - RNA, 23 nt, Human
acccugaggcccagagggccugc

SEQ ID NO: 1913238 - RNA, 18 nt, Human
acccugaggccucuggaa

SEQ ID NO: 1913239 - RNA, 20 nt, Human
acccugauuuaggagaagcc

SEQ ID NO: 1913240 - RNA, 22 nt, Human
acccugauuuaggagaagccag

SEQ ID NO: 1913241 - RNA, 23 nt, Human
acccugauuuaggagaagccagg

SEQ ID NO: 1913242 - RNA, 22 nt, Human
acccugcgcccaguccuuccac

SEQ ID NO: 1913243 - RNA, 16 nt, Human
ucauaagcgaucacuu

SEQ ID NO: 1913244 - RNA, 15 nt, Human
ucauaacuagaacug

SEQ ID NO: 1913245 - RNA, 22 nt, Human
ucauaagagccacaggucuuua

SEQ ID NO: 1913246 - RNA, 24 nt, Human
ucauaaagcaggcagaacucaucu

SEQ ID NO: 1913247 - RNA, 14 nt, Human
ucauaaagaauugu

SEQ ID NO: 1913248 - RNA, 13 nt, Human
ucauaacuagaac

SEQ ID NO: 1913249 - RNA, 18 nt, Human
ucauaaauaaaguuuguu

SEQ ID NO: 1913250 - RNA, 19 nt, Human
ucaguuguuagugugucuu

SEQ ID NO: 1913251 - RNA, 13 nt, Human
ucaguuuuaacua

SEQ ID NO: 1913252 - RNA, 16 nt, Human
ucaguggcagcugcuu

SEQ ID NO: 1913253 - RNA, 15 nt, Human
ucaguggcagcugcu

SEQ ID NO: 1913254 - RNA, 14 nt, Human
ucaguggcagcugc

SEQ ID NO: 1913255 - RNA, 19 nt, Human
ucagugccuuauggaacac

SEQ ID NO: 1913256 - RNA, 20 nt, Human
ucagugccuuauggaacacu

SEQ ID NO: 1913257 - RNA, 22 nt, Human
ucagugccuuauggaacacucu

SEQ ID NO: 1913258 - RNA, 23 nt, Human
ucagugccuuauggaacacucug

SEQ ID NO: 1913259 - RNA, 22 nt, Human
ucaggugucccugcacuugcag

SEQ ID NO: 1913260 - RNA, 17 nt, Human
ucagguuugaguagagg

SEQ ID NO: 1913261 - RNA, 13 nt, Human
ucaguaauaacuc

SEQ ID NO: 1913262 - RNA, 13 nt, Human
ucaguaagccgug

SEQ ID NO: 1913263 - RNA, 20 nt, Human
accgaaaacguggcugcuuc

SEQ ID NO: 1913264 - RNA, 15 nt, Human
acccuugugguccca

SEQ ID NO: 1913265 - RNA, 20 nt, Human
acccuugccgucuaccugag

SEQ ID NO: 1913266 - RNA, 17 nt, Human
acccuggaaaaugaauc

SEQ ID NO: 1913267 - RNA, 18 nt, Human
ucaggugucccugcacuu

SEQ ID NO: 1913268 - RNA, 17 nt, Human
ucaggugucccugcacu

SEQ ID NO: 1913269 - RNA, 15 nt, Human
ucaggugucccugca

SEQ ID NO: 1913270 - RNA, 23 nt, Human
ucagguggggucacucuggcagc

SEQ ID NO: 1913271 - RNA, 22 nt, Human
ucagguggggucacucuggcag

SEQ ID NO: 1913272 - RNA, 21 nt, Human
accgaacugauguaaguaaac

SEQ ID NO: 1913273 - RNA, 21 nt, Human
accgaaaacguggcugcuuca

SEQ ID NO: 1913274 - RNA, 22 nt, Human
accgaaaacguggcugcuucaa

SEQ ID NO: 1913275 - RNA, 22 nt, Human
accccagccuggccacgcagcc

SEQ ID NO: 1913276 - RNA, 21 nt, Human
accccagccuggccacgcagc

SEQ ID NO: 1913277 - RNA, 18 nt, Human
accccagccuggccacgc

SEQ ID NO: 1913278 - RNA, 19 nt, Human
accccagcuggggccaggc

SEQ ID NO: 1913279 - RNA, 22 nt, Human
accccagcuggggccaggcugg

SEQ ID NO: 1913280 - RNA, 11 nt, Human
acccaggugcu

SEQ ID NO: 1913281 - RNA, 23 nt, Human
acccaggugcuaggaacacuccu

SEQ ID NO: 1913282 - RNA, 13 nt, Human
accccagguuucu

SEQ ID NO: 1913283 - RNA, 17 nt, Human
acccagcgagcccuggu

SEQ ID NO: 1913284 - RNA, 16 nt, Human
acccagcgagcccugg

SEQ ID NO: 1913285 - RNA, 13 nt, Human
acccagcgagccc

SEQ ID NO: 1913286 - RNA, 15 nt, Human
acccaggagccccga

SEQ ID NO: 1913287 - RNA, 23 nt, Human
acccaggacuuauuuaaacucug

SEQ ID NO: 1913288 - RNA, 23 nt, Human
acccaggagauggaaguugcagu

SEQ ID NO: 1913289 - RNA, 13 nt, Human
acccaggagcccc

SEQ ID NO: 1913290 - RNA, 15 nt, Human
ucagauuuccagucu

SEQ ID NO: 1913291 - RNA, 17 nt, Human
ucagauuuccagucucc

SEQ ID NO: 1913292 - RNA, 16 nt, Human
ucagaucucuaacuuc

SEQ ID NO: 1913293 - RNA, 15 nt, Human
ucagaucucuaacuu

SEQ ID NO: 1913294 - RNA, 23 nt, Human
ucagaucugacaugauuccuucc

SEQ ID NO: 1913295 - RNA, 16 nt, Human
ucagagacuccugcag

SEQ ID NO: 1913296 - RNA, 23 nt, Human
ucagagacuccugcaggcagcca

SEQ ID NO: 1913297 - RNA, 15 nt, Human
acccagcccacuucu

SEQ ID NO: 1913298 - RNA, 23 nt, Human
ucagaaguuucugccgcagcccu

SEQ ID NO: 1913299 - RNA, 19 nt, Human
acccagauuuugcuguaua

SEQ ID NO: 1913300 - RNA, 20 nt, Human
acccagauuuugcuguauau

SEQ ID NO: 1913301 - RNA, 17 nt, Human
acccagcaacagaaaaa

SEQ ID NO: 1913302 - RNA, 16 nt, Human
ucagaauagaaauuag

SEQ ID NO: 1913303 - RNA, 21 nt, Human
ucagaauagccacauuuggaa

SEQ ID NO: 1913304 - RNA, 18 nt, Human
ucagaauuagcugcuucu

SEQ ID NO: 1913305 - RNA, 22 nt, Human
ucagaauagccacauuuggaau

SEQ ID NO: 1913306 - RNA, 23 nt, Human
ucagaauagccacauuuggaaua

SEQ ID NO: 1913307 - RNA, 22 nt, Human
ucagagacuccugcaggcagcc

SEQ ID NO: 1913308 - RNA, 15 nt, Human
ucagagaccauugca

SEQ ID NO: 1913309 - RNA, 20 nt, Human
ucagaauucucagaaucuca

SEQ ID NO: 1913310 - RNA, 10 nt, Human
ucagaauucu

SEQ ID NO: 1913311 - RNA, 12 nt, Human
ucagaauucuca

SEQ ID NO: 1913312 - RNA, 22 nt, Human
accaugcgacacugggaggcca

SEQ ID NO: 1913313 - RNA, 23 nt, Human
accaugcgacacugggaggccag

SEQ ID NO: 1913314 - RNA, 20 nt, Human
accaugcccggcuaauuuuu

SEQ ID NO: 1913315 - RNA, 22 nt, Human
accaugugcuacaggggccaga

SEQ ID NO: 1913316 - RNA, 22 nt, Human
accauuuugggguacccacugc

SEQ ID NO: 1913317 - RNA, 20 nt, Human
acccaaauguucaucaauga

SEQ ID NO: 1913318 - RNA, 16 nt, Human
acccaaauguucauca

SEQ ID NO: 1913319 - RNA, 20 nt, Human
acccacugcuuuuggucugu

SEQ ID NO: 1913320 - RNA, 21 nt, Human
acccagauaaagguucaugca

SEQ ID NO: 1913321 - RNA, 21 nt, Human
accauuuugggguacccacug

SEQ ID NO: 1913322 - RNA, 23 nt, Human
accauuuugcugucccuuuuccu

SEQ ID NO: 1913323 - RNA, 22 nt, Human
accauuuugcugucccuuuucc

SEQ ID NO: 1913324 - RNA, 19 nt, Human
accauucuccaccugccag

SEQ ID NO: 1913325 - RNA, 20 nt, Human
accauucuccaccugccagg

SEQ ID NO: 1913326 - RNA, 21 nt, Human
accauucuccaccugccaggg

SEQ ID NO: 1913327 - RNA, 15 nt, Human
ucacuucacccugga

SEQ ID NO: 1913328 - RNA, 17 nt, Human
ucacuucacgcuuucag

SEQ ID NO: 1913329 - RNA, 15 nt, Human
ucacuguugcccagg

SEQ ID NO: 1913330 - RNA, 18 nt, Human
ucacugcaaccuccgccu

SEQ ID NO: 1913331 - RNA, 14 nt, Human
ucacuguugcccag

SEQ ID NO: 1913332 - RNA, 18 nt, Human
ucacugcaacuucugccu

SEQ ID NO: 1913333 - RNA, 17 nt, Human
ucacugcaacuucugcc

SEQ ID NO: 1913334 - RNA, 18 nt, Human
ucacugcaaccucuaccu

SEQ ID NO: 1913335 - RNA, 21 nt, Human
ucacuauguugcccaggcagg

SEQ ID NO: 1913336 - RNA, 22 nt, Human
ucaccagccccagugcccacag

SEQ ID NO: 1913337 - RNA, 19 nt, Human
ucacauuccugaacaggau

SEQ ID NO: 1913338 - RNA, 13 nt, Human
ucacucauugcug

SEQ ID NO: 1913339 - RNA, 23 nt, Human
ucacugagacagcccgggcucug

SEQ ID NO: 1913340 - RNA, 18 nt, Human
ucacucuuggagccugca

SEQ ID NO: 1913341 - RNA, 17 nt, Human
ucacucuuggagccugc

SEQ ID NO: 1913342 - RNA, 16 nt, Human
ucacucuuggagccug

SEQ ID NO: 1913343 - RNA, 14 nt, Human
ucacucuuggagcc

SEQ ID NO: 1913344 - RNA, 15 nt, Human
ucacucauugcugag

SEQ ID NO: 1913345 - RNA, 17 nt, Human
ucacucauugcugagcc

SEQ ID NO: 1913346 - RNA, 18 nt, Human
ucacucauugcugagccu

SEQ ID NO: 1913347 - RNA, 19 nt, Human
ucacucauugcugagccuc

SEQ ID NO: 1913348 - RNA, 20 nt, Human
ucacucauugcugagccucu

SEQ ID NO: 1913349 - RNA, 22 nt, Human
ucacucauugcugagccucugc

SEQ ID NO: 1913350 - RNA, 18 nt, Human
acuuguauuaaagacaga

SEQ ID NO: 1913351 - RNA, 15 nt, Human
acuuguauuaugugu

SEQ ID NO: 1913352 - RNA, 14 nt, Human
acuugucuuuggac

SEQ ID NO: 1913353 - RNA, 21 nt, Human
acuuggacuuguccucagcag

SEQ ID NO: 1913354 - RNA, 13 nt, Human
acuuguauuaugu

SEQ ID NO: 1913355 - RNA, 14 nt, Human
acuuguauuaugug

SEQ ID NO: 1913356 - RNA, 14 nt, Human
acuuggaagcuccg

SEQ ID NO: 1913357 - RNA, 22 nt, Human
acuugccgcgucgcccucccag

SEQ ID NO: 1913358 - RNA, 23 nt, Human
acuugccgcgucgcccucccagg

SEQ ID NO: 1913359 - RNA, 21 nt, Human
acuugaguuacaccagaccug

SEQ ID NO: 1913360 - RNA, 18 nt, Human
acuugaguuacaccagac

SEQ ID NO: 1913361 - RNA, 22 nt, Human
acuugaccccgacgccacagcc

SEQ ID NO: 1913362 - RNA, 20 nt, Human
acuugacagaacacugucuu

SEQ ID NO: 1913363 - RNA, 18 nt, Human
acuugacagaacacuguc

SEQ ID NO: 1913364 - RNA, 17 nt, Human
acuugacagaacacugu

SEQ ID NO: 1913365 - RNA, 14 nt, Human
acuugaagggccag

SEQ ID NO: 1913366 - RNA, 19 nt, Human
acuugagaauuacccuuuu

SEQ ID NO: 1913367 - RNA, 17 nt, Human
acuugaaaauuaacaug

SEQ ID NO: 1913368 - RNA, 18 nt, Human
acuugaaaauuaacauga

SEQ ID NO: 1913369 - RNA, 16 nt, Human
acuugaaaauuaacau

SEQ ID NO: 1913370 - RNA, 23 nt, Human
acuugaacccgggaggcagaggu

SEQ ID NO: 1913371 - RNA, 18 nt, Human
acuucuccacccugcucu

SEQ ID NO: 1913372 - RNA, 22 nt, Human
acuucggcagauacugucucuu

SEQ ID NO: 1913373 - RNA, 14 nt, Human
acuucucuuccuug

SEQ ID NO: 1913374 - RNA, 17 nt, Human
acuucgggaggucgagg

SEQ ID NO: 1913375 - RNA, 20 nt, Human
acuucgggaggucgaggcag

SEQ ID NO: 1913376 - RNA, 20 nt, Human
acuuccugagggaucuauac

SEQ ID NO: 1913377 - RNA, 16 nt, Human
ucuauuguuucuuuca

SEQ ID NO: 1913378 - RNA, 16 nt, Human
ucucaaaaaaagaaaa

SEQ ID NO: 1913379 - RNA, 13 nt, Human
ucuauaauuuaaa

SEQ ID NO: 1913380 - RNA, 18 nt, Human
ucuauacauaucuuuauu

SEQ ID NO: 1913381 - RNA, 15 nt, Human
ucuauacauaucuuu

SEQ ID NO: 1913382 - RNA, 23 nt, Human
ucuaguuugauuaaauucuugca

SEQ ID NO: 1913383 - RNA, 21 nt, Human
ucuaggaaaauauuuugaucu

SEQ ID NO: 1913384 - RNA, 22 nt, Human
ucuaggaaaauauuuugaucuu

SEQ ID NO: 1913385 - RNA, 16 nt, Human
ucuaggaaaauauuuu

SEQ ID NO: 1913386 - RNA, 21 nt, Human
ucuagcugggggugggccagg

SEQ ID NO: 1913387 - RNA, 11 nt, Human
ucuagcuguug

SEQ ID NO: 1913388 - RNA, 18 nt, Human
ucuagcuguugagcuguu

SEQ ID NO: 1913389 - RNA, 19 nt, Human
ucuagcuguugagcuguuu

SEQ ID NO: 1913390 - RNA, 24 nt, Human
ucuagauacuguaucaugacaaag

SEQ ID NO: 1913391 - RNA, 11 nt, Human
acuucccccaa

SEQ ID NO: 1913392 - RNA, 16 nt, Human
acuucccccaaauuua

SEQ ID NO: 1913393 - RNA, 19 nt, Human
ucuagaugaaguuuuacau

SEQ ID NO: 1913394 - RNA, 20 nt, Human
ucuagaugaaguuuuacauu

SEQ ID NO: 1913395 - RNA, 21 nt, Human
ucuagaugaaguuuuacauug

SEQ ID NO: 1913396 - RNA, 22 nt, Human
ucuagaugaaguuuuacauugu

SEQ ID NO: 1913397 - RNA, 23 nt, Human
ucuagaugaaguuuuacauuguu

SEQ ID NO: 1913398 - RNA, 18 nt, Human
ucuagauggcuccucuca

SEQ ID NO: 1913399 - RNA, 19 nt, Human
ucuagauggcuccucucag

SEQ ID NO: 1913400 - RNA, 20 nt, Human
ucuagauggcuccucucagu

SEQ ID NO: 1913401 - RNA, 16 nt, Human
acuucaugcaggugaa

SEQ ID NO: 1913402 - RNA, 22 nt, Human
acuucauggccuuugauaaaug

SEQ ID NO: 1913403 - RNA, 23 nt, Human
acuucauggccuuugauaaaugu

SEQ ID NO: 1913404 - RNA, 14 nt, Human
acuucauucuugaa

SEQ ID NO: 1913405 - RNA, 15 nt, Human
acuucauucuugaaa

SEQ ID NO: 1913406 - RNA, 19 nt, Human
acuucauucuugaaagcug

SEQ ID NO: 1913407 - RNA, 21 nt, Human
acuucauucuugaaagcugug

SEQ ID NO: 1913408 - RNA, 18 nt, Human
acuucaggcuugauaaua

SEQ ID NO: 1913409 - RNA, 20 nt, Human
acuucaggcuugauaauacu

SEQ ID NO: 1913410 - RNA, 20 nt, Human
acuuccagugcaacacugaa

SEQ ID NO: 1913411 - RNA, 22 nt, Human
acuuccaugugaggguuuucag

SEQ ID NO: 1913412 - RNA, 20 nt, Human
acuuccagguguuacuguaa

SEQ ID NO: 1913413 - RNA, 21 nt, Human
acuuccagguguuacuguaau

SEQ ID NO: 1913414 - RNA, 18 nt, Human
acuuccaauuuacauacu

SEQ ID NO: 1913415 - RNA, 17 nt, Human
acuuccacugccauccu

SEQ ID NO: 1913416 - RNA, 12 nt, Human
ucuaccugaggg

SEQ ID NO: 1913417 - RNA, 19 nt, Human
ucuaccugaggggccucuu

SEQ ID NO: 1913418 - RNA, 15 nt, Human
ucuaccucuuggcug

SEQ ID NO: 1913419 - RNA, 15 nt, Human
acuuacuguacauga

SEQ ID NO: 1913420 - RNA, 20 nt, Human
acuuagagguggggagcaga

SEQ ID NO: 1913421 - RNA, 14 nt, Human
acuuacuguacaug

SEQ ID NO: 1913422 - RNA, 13 nt, Human
acuuacuguacau

SEQ ID NO: 1913423 - RNA, 15 nt, Human
ucuacccauauuaca

SEQ ID NO: 1913424 - RNA, 21 nt, Human
ucuacccucuuagaaaaacca

SEQ ID NO: 1913425 - RNA, 15 nt, Human
ucuaagccugaaggg

SEQ ID NO: 1913426 - RNA, 16 nt, Human
ucuaagccugaagggg

SEQ ID NO: 1913427 - RNA, 14 nt, Human
ucuaagccugaagg

SEQ ID NO: 1913428 - RNA, 17 nt, Human
ucuaaacuuccccaucu

SEQ ID NO: 1913429 - RNA, 20 nt, Human
ucuaaagaguuuauuuuaag

SEQ ID NO: 1913430 - RNA, 17 nt, Human
ucuaaagcugccagccg

SEQ ID NO: 1913431 - RNA, 21 nt, Human
ucuaaagaguuuauuuuaaga

SEQ ID NO: 1913432 - RNA, 16 nt, Human
ucuaaaggcuaccuuu

SEQ ID NO: 1913433 - RNA, 13 nt, Human
ucuaaaggcuacc

SEQ ID NO: 1913434 - RNA, 23 nt, Human
ucgucacugcuuaacuucacaua

SEQ ID NO: 1913435 - RNA, 13 nt, Human
ucguucucccugg

SEQ ID NO: 1913436 - RNA, 13 nt, Human
ucguucucugccu

SEQ ID NO: 1913437 - RNA, 11 nt, Human
ucguucugugg

SEQ ID NO: 1913438 - RNA, 20 nt, Human
ucuaaacaaugcugauuugg

SEQ ID NO: 1913439 - RNA, 16 nt, Human
ucuaaacccaauccaa

SEQ ID NO: 1913440 - RNA, 19 nt, Human
ucuaaacccaauccaaaug

SEQ ID NO: 1913441 - RNA, 13 nt, Human
ucgggcugugccc

SEQ ID NO: 1913442 - RNA, 12 nt, Human
ucgggcugugcc

SEQ ID NO: 1913443 - RNA, 21 nt, Human
acuguuaauaguucagguaac

SEQ ID NO: 1913444 - RNA, 17 nt, Human
acuguuaauaguucagg

SEQ ID NO: 1913445 - RNA, 18 nt, Human
acuguguuucaaguucaa

SEQ ID NO: 1913446 - RNA, 16 nt, Human
acuguuaaaggaaaaa

SEQ ID NO: 1913447 - RNA, 14 nt, Human
acuguguguugcca

SEQ ID NO: 1913448 - RNA, 19 nt, Human
acuguguguugccacagga

SEQ ID NO: 1913449 - RNA, 20 nt, Human
acuguguguugccacaggac

SEQ ID NO: 1913450 - RNA, 22 nt, Human
acuguguguugccacaggacac

SEQ ID NO: 1913451 - RNA, 14 nt, Human
acuguguuucaagu

SEQ ID NO: 1913452 - RNA, 15 nt, Human
acuguguuucaaguu

SEQ ID NO: 1913453 - RNA, 22 nt, Human
acuguggggaaccaauugcuuu

SEQ ID NO: 1913454 - RNA, 22 nt, Human
acuguggggugugcacaucucu

SEQ ID NO: 1913455 - RNA, 15 nt, Human
acugugugugugaau

SEQ ID NO: 1913456 - RNA, 16 nt, Human
acugugugugugaaug

SEQ ID NO: 1913457 - RNA, 18 nt, Human
acugugugugugaaugaa

SEQ ID NO: 1913458 - RNA, 22 nt, Human
acugugugugugaaugaacacu

SEQ ID NO: 1913459 - RNA, 14 nt, Human
acuguccugggccu

SEQ ID NO: 1913460 - RNA, 20 nt, Human
acuguaucaugacaaagacu

SEQ ID NO: 1913461 - RNA, 16 nt, Human
acuguaucaugacaaa

SEQ ID NO: 1913462 - RNA, 22 nt, Human
acuguaucucuaauacagugug

SEQ ID NO: 1913463 - RNA, 23 nt, Human
acugucaaaaaguuugguucugu

SEQ ID NO: 1913464 - RNA, 20 nt, Human
acugucaaggcugcuuagaa

SEQ ID NO: 1913465 - RNA, 21 nt, Human
acugucaaggcugcuuagaau

SEQ ID NO: 1913466 - RNA, 22 nt, Human
acugucaaggcugcuuagaauc

SEQ ID NO: 1913467 - RNA, 14 nt, Human
acugucacucauug

SEQ ID NO: 1913468 - RNA, 15 nt, Human
acugucacucauugc

SEQ ID NO: 1913469 - RNA, 16 nt, Human
acuguccuccaagcca

SEQ ID NO: 1913470 - RNA, 18 nt, Human
acuguccuccaagccagc

SEQ ID NO: 1913471 - RNA, 18 nt, Human
acuggguacuuguggaca

SEQ ID NO: 1913472 - RNA, 17 nt, Human
acuggguacuuguggac

SEQ ID NO: 1913473 - RNA, 16 nt, Human
acuguacaaaguagaa

SEQ ID NO: 1913474 - RNA, 22 nt, Human
acuguacaaaguagaagucuua

SEQ ID NO: 1913475 - RNA, 18 nt, Human
acuguacagacagaaaaa

SEQ ID NO: 1913476 - RNA, 16 nt, Human
acuguacaugaaaaca

SEQ ID NO: 1913477 - RNA, 19 nt, Human
acuguacaugaaaacacau

SEQ ID NO: 1913478 - RNA, 23 nt, Human
acuguacuugcucuugaugccug

SEQ ID NO: 1913479 - RNA, 15 nt, Human
acuguacugggccau

SEQ ID NO: 1913480 - RNA, 14 nt, Human
acuguaucaugaca

SEQ ID NO: 1913481 - RNA, 15 nt, Human
acuguacuugcucuu

SEQ ID NO: 1913482 - RNA, 21 nt, Human
acuguacaugaaaacacauuu

SEQ ID NO: 1913483 - RNA, 20 nt, Human
acuguacaugaaaacacauu

SEQ ID NO: 1913484 - RNA, 23 nt, Human
ucgcugugucagcauagaaguaa

SEQ ID NO: 1913485 - RNA, 20 nt, Human
acugggccauguugugccuc

SEQ ID NO: 1913486 - RNA, 21 nt, Human
ucgcucuguugcccaggcugg

SEQ ID NO: 1913487 - RNA, 21 nt, Human
acugggcuuggggaccagagc

SEQ ID NO: 1913488 - RNA, 22 nt, Human
acugggcuuggggaccagagcu

SEQ ID NO: 1913489 - RNA, 21 nt, Human
acuggggccuacagcuuugau

SEQ ID NO: 1913490 - RNA, 12 nt, Human
acuggggccucc

SEQ ID NO: 1913491 - RNA, 13 nt, Human
acuggggccucca

SEQ ID NO: 1913492 - RNA, 16 nt, Human
acuggggccuccagaa

SEQ ID NO: 1913493 - RNA, 15 nt, Human
acuggguacuugugg

SEQ ID NO: 1913494 - RNA, 17 nt, Human
acuggggccuccagaac

SEQ ID NO: 1913495 - RNA, 14 nt, Human
ucgcuccugugucu

SEQ ID NO: 1913496 - RNA, 18 nt, Human
ucgcccuggacugugugc

SEQ ID NO: 1913497 - RNA, 13 nt, Human
ucgcccucccagg

SEQ ID NO: 1913498 - RNA, 17 nt, Human
ucgcccucccaggcucu

SEQ ID NO: 1913499 - RNA, 14 nt, Human
ucgcccucccaggc

SEQ ID NO: 1913500 - RNA, 17 nt, Human
acugaaauauacacaca

SEQ ID NO: 1913501 - RNA, 15 nt, Human
acugaaauauacaca

SEQ ID NO: 1913502 - RNA, 16 nt, Human
acugaaauauacacac

SEQ ID NO: 1913503 - RNA, 14 nt, Human
ucgccccagcaggu

SEQ ID NO: 1913504 - RNA, 20 nt, Human
ucgccccagcaggugcugac

SEQ ID NO: 1913505 - RNA, 20 nt, Human
acuuugccuuuccauaauca

SEQ ID NO: 1913506 - RNA, 23 nt, Human
acuuugaggguguauauuuucug

SEQ ID NO: 1913507 - RNA, 19 nt, Human
acuuuguauaaaagggacu

SEQ ID NO: 1913508 - RNA, 23 nt, Human
acuuuggaaagaguaggaagacu

SEQ ID NO: 1913509 - RNA, 12 nt, Human
acuuuggaaaga

SEQ ID NO: 1913510 - RNA, 13 nt, Human
acuuuggaaagag

SEQ ID NO: 1913511 - RNA, 14 nt, Human
acuuuggaaagagu

SEQ ID NO: 1913512 - RNA, 19 nt, Human
acuuucuuuucuggaaugu

SEQ ID NO: 1913513 - RNA, 15 nt, Human
acuuucuuuucugga

SEQ ID NO: 1913514 - RNA, 13 nt, Human
acuuuagggaagu

SEQ ID NO: 1913515 - RNA, 14 nt, Human
acuuguggacacag

SEQ ID NO: 1913516 - RNA, 17 nt, Human
acuugugauuauuuauu

SEQ ID NO: 1913517 - RNA, 20 nt, Human
acuugugauuauuuauuauu

SEQ ID NO: 1913518 - RNA, 16 nt, Human
acuugugauuauuuau

SEQ ID NO: 1913519 - RNA, 16 nt, Human
acuuuaaaaggagcca

SEQ ID NO: 1913520 - RNA, 15 nt, Human
acuuguggacacagc

SEQ ID NO: 1913521 - RNA, 22 nt, Human
acuuguuuuauuuaaccucuaa

SEQ ID NO: 1913522 - RNA, 16 nt, Human
acuuuguguucaccuu

SEQ ID NO: 1913523 - RNA, 10 nt, Human
acuuugugcu

SEQ ID NO: 1913524 - RNA, 20 nt, Human
acuuugucgcccaggcugga

SEQ ID NO: 1913525 - RNA, 18 nt, Human
acuuuguguucaccuugu

SEQ ID NO: 1913526 - RNA, 20 nt, Human
ucuccuuaaagaguguggca

SEQ ID NO: 1913527 - RNA, 21 nt, Human
ucuccuuagaaguggaaguag

SEQ ID NO: 1913528 - RNA, 15 nt, Human
ucuccuuagaagugg

SEQ ID NO: 1913529 - RNA, 21 nt, Human
ucuccuuggugucgggcauga

SEQ ID NO: 1913530 - RNA, 23 nt, Human
ucuccuuggugucgggcaugaca

SEQ ID NO: 1913531 - RNA, 17 nt, Human
ucucgcucuguugccca

SEQ ID NO: 1913532 - RNA, 21 nt, Human
ucucggaacugcaugcugcug

SEQ ID NO: 1913533 - RNA, 22 nt, Human
ucucucacuuguuuuauuuaac

SEQ ID NO: 1913534 - RNA, 21 nt, Human
ucucucacuuguuuuauuuaa

SEQ ID NO: 1913535 - RNA, 12 nt, Human
ucucucaggcca

SEQ ID NO: 1913536 - RNA, 14 nt, Human
ucucuccauucccg

SEQ ID NO: 1913537 - RNA, 21 nt, Human
ucucucaggccaaacucaccu

SEQ ID NO: 1913538 - RNA, 19 nt, Human
ucucugcaggucccuaaua

SEQ ID NO: 1913539 - RNA, 20 nt, Human
ucucugcaggucccuaauaa

SEQ ID NO: 1913540 - RNA, 21 nt, Human
ucucugcaggucccuaauaaa

SEQ ID NO: 1913541 - RNA, 22 nt, Human
ucucugcaggucccuaauaaag

SEQ ID NO: 1913542 - RNA, 16 nt, Human
ucucuugguccugcug

SEQ ID NO: 1913543 - RNA, 17 nt, Human
ucucuugguccugcugc

SEQ ID NO: 1913544 - RNA, 18 nt, Human
ucucuugguccugcugca

SEQ ID NO: 1913545 - RNA, 19 nt, Human
agaaaaaauauuuucccua

SEQ ID NO: 1913546 - RNA, 17 nt, Human
agaaaaaauauuuuccu

SEQ ID NO: 1913547 - RNA, 23 nt, Human
agaaaaaauauuuuccugccagg

SEQ ID NO: 1913548 - RNA, 18 nt, Human
agaaaaaugagccuggca

SEQ ID NO: 1913549 - RNA, 12 nt, Human
agaaaagauuuu

SEQ ID NO: 1913550 - RNA, 15 nt, Human
agaaaagauuuuaau

SEQ ID NO: 1913551 - RNA, 18 nt, Human
agaaaagauuuuaaucaa

SEQ ID NO: 1913552 - RNA, 20 nt, Human
agaaaagauuuuaaucaagu

SEQ ID NO: 1913553 - RNA, 22 nt, Human
agaaacuguucccaccugcugg

SEQ ID NO: 1913554 - RNA, 15 nt, Human
agaaacuguucccac

SEQ ID NO: 1913555 - RNA, 21 nt, Human
agaaacuguucccaccugcug

SEQ ID NO: 1913556 - RNA, 12 nt, Human
agaaaugaaaaa

SEQ ID NO: 1913557 - RNA, 13 nt, Human
agaaaugaaaaaa

SEQ ID NO: 1913558 - RNA, 16 nt, Human
agaaaugaaaaaauau

SEQ ID NO: 1913559 - RNA, 21 nt, Human
agaaaugcugguuuuucaguu

SEQ ID NO: 1913560 - RNA, 20 nt, Human
agaaaugcugguuuuucagu

SEQ ID NO: 1913561 - RNA, 20 nt, Human
agaaaugggacuuaacuccu

SEQ ID NO: 1913562 - RNA, 15 nt, Human
agaaaugccuuaccc

SEQ ID NO: 1913563 - RNA, 18 nt, Human
ucugaaggcuggguucug

SEQ ID NO: 1913564 - RNA, 20 nt, Human
ucugaaggguaauuauauag

SEQ ID NO: 1913565 - RNA, 20 nt, Human
agaaagcagaacagugauua

SEQ ID NO: 1913566 - RNA, 18 nt, Human
agaaagcagaacagugau

SEQ ID NO: 1913567 - RNA, 17 nt, Human
agaaagcagaacaguga

SEQ ID NO: 1913568 - RNA, 20 nt, Human
agaaagacuaucuaaauguu

SEQ ID NO: 1913569 - RNA, 22 nt, Human
agaaagacuaucuaaauguuga

SEQ ID NO: 1913570 - RNA, 18 nt, Human
agaaagacagagcuggga

SEQ ID NO: 1913571 - RNA, 19 nt, Human
agaagcucucgggcuagga

SEQ ID NO: 1913572 - RNA, 22 nt, Human
agaagcuccucuccccagccca

SEQ ID NO: 1913573 - RNA, 23 nt, Human
agaagcuccucuccccagcccag

SEQ ID NO: 1913574 - RNA, 16 nt, Human
agaaggagacaggcag

SEQ ID NO: 1913575 - RNA, 14 nt, Human
agaagcuccucucc

SEQ ID NO: 1913576 - RNA, 17 nt, Human
agaagcuccucucccca

SEQ ID NO: 1913577 - RNA, 18 nt, Human
agaagcuccucuccccag

SEQ ID NO: 1913578 - RNA, 20 nt, Human
agaagcuccucuccccagcc

SEQ ID NO: 1913579 - RNA, 11 nt, Human
agaaggcaaaa

SEQ ID NO: 1913580 - RNA, 22 nt, Human
agaaguuugagaucagccuggg

SEQ ID NO: 1913581 - RNA, 20 nt, Human
agaauagccacauuuggaau

SEQ ID NO: 1913582 - RNA, 19 nt, Human
agaauagccacauuuggaa

SEQ ID NO: 1913583 - RNA, 21 nt, Human
agaauagccacauuuggaaua

SEQ ID NO: 1913584 - RNA, 20 nt, Human
agaauaguugaaccuauuuc

SEQ ID NO: 1913585 - RNA, 16 nt, Human
agaauauaaaaaacuu

SEQ ID NO: 1913586 - RNA, 21 nt, Human
agaauaguugaaccuauuucu

SEQ ID NO: 1913587 - RNA, 23 nt, Human
agaauaguugaaccuauuucucu

SEQ ID NO: 1913588 - RNA, 13 nt, Human
agaauauaauacu

SEQ ID NO: 1913589 - RNA, 13 nt, Human
agaauaaacuggc

SEQ ID NO: 1913590 - RNA, 10 nt, Human
ucuggccuuc

SEQ ID NO: 1913591 - RNA, 17 nt, Human
agaagccugaugcugac

SEQ ID NO: 1913592 - RNA, 21 nt, Human
agaagccugaugcugacauuc

SEQ ID NO: 1913593 - RNA, 18 nt, Human
ucuggcagcucagagagg

SEQ ID NO: 1913594 - RNA, 21 nt, Human
ucuggcagcucagagagggug

SEQ ID NO: 1913595 - RNA, 13 nt, Human
ucuggccucccac

SEQ ID NO: 1913596 - RNA, 14 nt, Human
ucuggccucccaca

SEQ ID NO: 1913597 - RNA, 17 nt, Human
ucuggcagcucagagag

SEQ ID NO: 1913598 - RNA, 20 nt, Human
ucuggcagaguugaagacag

SEQ ID NO: 1913599 - RNA, 23 nt, Human
ucuggcagaguugaagacagagc

SEQ ID NO: 1913600 - RNA, 16 nt, Human
ucugccuguggaacug

SEQ ID NO: 1913601 - RNA, 22 nt, Human
ucugcuuugggguuuaucagaa

SEQ ID NO: 1913602 - RNA, 17 nt, Human
ucuggaaccucagccug

SEQ ID NO: 1913603 - RNA, 21 nt, Human
ucuggcaaagcuuuuagaaau

SEQ ID NO: 1913604 - RNA, 13 nt, Human
ucuggaaguccaa

SEQ ID NO: 1913605 - RNA, 23 nt, Human
ucuggaaccucagccuggccaga

SEQ ID NO: 1913606 - RNA, 18 nt, Human
ucuggaaccucagccugg

SEQ ID NO: 1913607 - RNA, 19 nt, Human
ucuggaaccucagccuggc

SEQ ID NO: 1913608 - RNA, 20 nt, Human
ucuggaaccucagccuggcc

SEQ ID NO: 1913609 - RNA, 21 nt, Human
ucuggaaccucagccuggcca

SEQ ID NO: 1913610 - RNA, 21 nt, Human
ucugcaggucccuaauaaagc

SEQ ID NO: 1913611 - RNA, 19 nt, Human
ucugcaggucccuaauaaa

SEQ ID NO: 1913612 - RNA, 22 nt, Human
ucugcaggucccuaauaaagcu

SEQ ID NO: 1913613 - RNA, 23 nt, Human
ucugcaggucccuaauaaagcug

SEQ ID NO: 1913614 - RNA, 12 nt, Human
agaaauuaugug

SEQ ID NO: 1913615 - RNA, 13 nt, Human
agaaccuggaacu

SEQ ID NO: 1913616 - RNA, 20 nt, Human
agaaccuggaacuuggggag

SEQ ID NO: 1913617 - RNA, 21 nt, Human
agaaccuggaacuuggggagu

SEQ ID NO: 1913618 - RNA, 15 nt, Human
ucugcaguaaaucuu

SEQ ID NO: 1913619 - RNA, 21 nt, Human
agaacugaauuuugucuuuau

SEQ ID NO: 1913620 - RNA, 16 nt, Human
agaacucccuuucaac

SEQ ID NO: 1913621 - RNA, 15 nt, Human
agaacucccuuucaa

SEQ ID NO: 1913622 - RNA, 17 nt, Human
agaacucccuuucaaca

SEQ ID NO: 1913623 - RNA, 20 nt, Human
agaacucaaauggggccaga

SEQ ID NO: 1913624 - RNA, 14 nt, Human
agaacucacugggg

SEQ ID NO: 1913625 - RNA, 16 nt, Human
agaacucacuggggcc

SEQ ID NO: 1913626 - RNA, 19 nt, Human
agaaccuuuugagugccuu

SEQ ID NO: 1913627 - RNA, 23 nt, Human
agaaccuuuugagugccuuacac

SEQ ID NO: 1913628 - RNA, 19 nt, Human
agaacucaaauggggccag

SEQ ID NO: 1913629 - RNA, 12 nt, Human
ucugcccuuggu

SEQ ID NO: 1913630 - RNA, 23 nt, Human
ucugcccuugguuaggcauugug

SEQ ID NO: 1913631 - RNA, 15 nt, Human
ucugccccauccucc

SEQ ID NO: 1913632 - RNA, 18 nt, Human
ucugccccauccuccagc

SEQ ID NO: 1913633 - RNA, 19 nt, Human
ucugccccauccuccagca

SEQ ID NO: 1913634 - RNA, 21 nt, Human
ucugccccauccuccagcagg

SEQ ID NO: 1913635 - RNA, 23 nt, Human
ucugcccacucccugcaaccuga

SEQ ID NO: 1913636 - RNA, 20 nt, Human
ucugcccauccugccccuga

SEQ ID NO: 1913637 - RNA, 23 nt, Human
agaagcccaggaaaggcuccagg

SEQ ID NO: 1913638 - RNA, 12 nt, Human
agaagcccccag

SEQ ID NO: 1913639 - RNA, 14 nt, Human
agaagcccccagcu

SEQ ID NO: 1913640 - RNA, 17 nt, Human
agaagcccccagcuaag

SEQ ID NO: 1913641 - RNA, 23 nt, Human
agaagcccccagcuaagaaccug

SEQ ID NO: 1913642 - RNA, 24 nt, Human
agaagcccccagcuaagaaccugg

SEQ ID NO: 1913643 - RNA, 19 nt, Human
agaagcaacccaaauguuc

SEQ ID NO: 1913644 - RNA, 16 nt, Human
agaagcagaggaagga

SEQ ID NO: 1913645 - RNA, 15 nt, Human
agaacuuuauuucca

SEQ ID NO: 1913646 - RNA, 18 nt, Human
agaacuuucauuuuuuuc

SEQ ID NO: 1913647 - RNA, 16 nt, Human
agaacuuucauuuuuu

SEQ ID NO: 1913648 - RNA, 15 nt, Human
agaacuuucauuuuu

SEQ ID NO: 1913649 - RNA, 14 nt, Human
agaacuuucauuuu

SEQ ID NO: 1913650 - RNA, 12 nt, Human
agaagcagcucu

SEQ ID NO: 1913651 - RNA, 13 nt, Human
agaagcagcucuu

SEQ ID NO: 1913652 - RNA, 15 nt, Human
agaagcauacaacuu

SEQ ID NO: 1913653 - RNA, 18 nt, Human
agaagcccaauauuauaa

SEQ ID NO: 1913654 - RNA, 22 nt, Human
agaagccaggaauuucccagga

SEQ ID NO: 1913655 - RNA, 21 nt, Human
agaagccacaggccugagauu

SEQ ID NO: 1913656 - RNA, 19 nt, Human
agaagccacaggccugaga

SEQ ID NO: 1913657 - RNA, 12 nt, Human
agaagccaggaa

SEQ ID NO: 1913658 - RNA, 13 nt, Human
agaagccaggaau

SEQ ID NO: 1913659 - RNA, 20 nt, Human
ugaaaaucuuauaauuuaaa

SEQ ID NO: 1913660 - RNA, 19 nt, Human
ugaaaaucgugacaacacu

SEQ ID NO: 1913661 - RNA, 17 nt, Human
ugaaaauguauguguaa

SEQ ID NO: 1913662 - RNA, 16 nt, Human
ugaaacgcaaccacca

SEQ ID NO: 1913663 - RNA, 12 nt, Human
ugaaacuuggau

SEQ ID NO: 1913664 - RNA, 16 nt, Human
ugaaaaucgugacaac

SEQ ID NO: 1913665 - RNA, 14 nt, Human
ugaaaauauuuaaa

SEQ ID NO: 1913666 - RNA, 13 nt, Human
ugaaaauauuuaa

SEQ ID NO: 1913667 - RNA, 12 nt, Human
ugaaaauauuua

SEQ ID NO: 1913668 - RNA, 11 nt, Human
ugaaaauauuu

SEQ ID NO: 1913669 - RNA, 16 nt, Human
ugaaaaggcaaaaagc

SEQ ID NO: 1913670 - RNA, 20 nt, Human
ugaaaaaggaggaagagaaa

SEQ ID NO: 1913671 - RNA, 22 nt, Human
ugaaaaaggaggaagagaaaaa

SEQ ID NO: 1913672 - RNA, 22 nt, Human
ugaaaaaguauccugcuucuga

SEQ ID NO: 1913673 - RNA, 22 nt, Human
ugaaaaaguucugcagauaaac

SEQ ID NO: 1913674 - RNA, 23 nt, Human
ugaaaaaauauauaucaaauaua

SEQ ID NO: 1913675 - RNA, 16 nt, Human
ugaaaaaggaggaaga

SEQ ID NO: 1913676 - RNA, 9 nt, Human
ugaaaaaga

SEQ ID NO: 1913677 - RNA, 12 nt, Human
ucuuuuacaacu

SEQ ID NO: 1913678 - RNA, 21 nt, Human
ucuuucugcagaaacagaaag

SEQ ID NO: 1913679 - RNA, 10 nt, Human
ucuuucugua

SEQ ID NO: 1913680 - RNA, 21 nt, Human
ucuuucuggcuaugcauuuga

SEQ ID NO: 1913681 - RNA, 20 nt, Human
ucuuucuggcuaugcauuug

SEQ ID NO: 1913682 - RNA, 14 nt, Human
ucuuucugauaacu

SEQ ID NO: 1913683 - RNA, 20 nt, Human
ucuuucugauaacuagaugg

SEQ ID NO: 1913684 - RNA, 23 nt, Human
ucuuucugauaacuagauggugc

SEQ ID NO: 1913685 - RNA, 22 nt, Human
ucuuuggugaacauugcaauag

SEQ ID NO: 1913686 - RNA, 17 nt, Human
ucuuugugucaacauga

SEQ ID NO: 1913687 - RNA, 19 nt, Human
ucuuugguuuaauuuaaag

SEQ ID NO: 1913688 - RNA, 16 nt, Human
ucuuuggugaacauug

SEQ ID NO: 1913689 - RNA, 22 nt, Human
ucuuuggucuacacugugcuga

SEQ ID NO: 1913690 - RNA, 17 nt, Human
agagacauacuugaagg

SEQ ID NO: 1913691 - RNA, 22 nt, Human
agagacauacuugaagggccag

SEQ ID NO: 1913692 - RNA, 23 nt, Human
agagacauacuugaagggccaga

SEQ ID NO: 1913693 - RNA, 23 nt, Human
agagacaguugggugagaacaac

SEQ ID NO: 1913694 - RNA, 20 nt, Human
agagacaguugggugagaac

SEQ ID NO: 1913695 - RNA, 22 nt, Human
agagacaguugggugagaacaa

SEQ ID NO: 1913696 - RNA, 22 nt, Human
agagaucaaccccuucgcuccu

SEQ ID NO: 1913697 - RNA, 23 nt, Human
agagacuccugcaggcagccagg

SEQ ID NO: 1913698 - RNA, 19 nt, Human
agagcaagacgcugugcug

SEQ ID NO: 1913699 - RNA, 23 nt, Human
agagcaagacgcugugcugcccu

SEQ ID NO: 1913700 - RNA, 13 nt, Human
ugaaagacuguac

SEQ ID NO: 1913701 - RNA, 15 nt, Human
ugaaagacuguacaa

SEQ ID NO: 1913702 - RNA, 12 nt, Human
ugaaacuuuugg

SEQ ID NO: 1913703 - RNA, 11 nt, Human
agagacuccug

SEQ ID NO: 1913704 - RNA, 17 nt, Human
agagacuccugcaggca

SEQ ID NO: 1913705 - RNA, 18 nt, Human
agagacuccugcaggcag

SEQ ID NO: 1913706 - RNA, 19 nt, Human
agagacuccugcaggcagc

SEQ ID NO: 1913707 - RNA, 20 nt, Human
agagacuccugcaggcagcc

SEQ ID NO: 1913708 - RNA, 21 nt, Human
agagacuccugcaggcagcca

SEQ ID NO: 1913709 - RNA, 22 nt, Human
agagacuccugcaggcagccag

SEQ ID NO: 1913710 - RNA, 22 nt, Human
agagcaccuuagacagucccug

SEQ ID NO: 1913711 - RNA, 21 nt, Human
agagcaccuuagacagucccu

SEQ ID NO: 1913712 - RNA, 23 nt, Human
agagcaccuuagacagucccugc

SEQ ID NO: 1913713 - RNA, 14 nt, Human
agagcaagacucug

SEQ ID NO: 1913714 - RNA, 22 nt, Human
agagccaggggggugaggagcu

SEQ ID NO: 1913715 - RNA, 14 nt, Human
agagcugccaccug

SEQ ID NO: 1913716 - RNA, 11 nt, Human
agagcugaggc

SEQ ID NO: 1913717 - RNA, 20 nt, Human
agagcuagcagcagggaggg

SEQ ID NO: 1913718 - RNA, 23 nt, Human
agagccaggggggugaggagcug

SEQ ID NO: 1913719 - RNA, 13 nt, Human
agagccuuccagg

SEQ ID NO: 1913720 - RNA, 15 nt, Human
agagccuuccagggg

SEQ ID NO: 1913721 - RNA, 17 nt, Human
agagccuuccaggggug

SEQ ID NO: 1913722 - RNA, 22 nt, Human
agagccuuccaggggugggaca

SEQ ID NO: 1913723 - RNA, 13 nt, Human
agaccuguaauca

SEQ ID NO: 1913724 - RNA, 23 nt, Human
agaccuggcagcucuggacagcc

SEQ ID NO: 1913725 - RNA, 17 nt, Human
agaccuggcagcucugg

SEQ ID NO: 1913726 - RNA, 18 nt, Human
agaccuggcagcucugga

SEQ ID NO: 1913727 - RNA, 18 nt, Human
agaccuguuagcagacag

SEQ ID NO: 1913728 - RNA, 15 nt, Human
agaccugucuccugg

SEQ ID NO: 1913729 - RNA, 16 nt, Human
agaccugucuccuggc

SEQ ID NO: 1913730 - RNA, 14 nt, Human
agaccugucuccug

SEQ ID NO: 1913731 - RNA, 11 nt, Human
agaccuggcag

SEQ ID NO: 1913732 - RNA, 14 nt, Human
agaccuggcagcuc

SEQ ID NO: 1913733 - RNA, 15 nt, Human
agaccuggcagcucu

SEQ ID NO: 1913734 - RNA, 16 nt, Human
agaccuggcagcucug

SEQ ID NO: 1913735 - RNA, 11 nt, Human
agaccuucucc

SEQ ID NO: 1913736 - RNA, 19 nt, Human
agaccuguuagcagacagg

SEQ ID NO: 1913737 - RNA, 15 nt, Human
agaccuucuccuuca

SEQ ID NO: 1913738 - RNA, 18 nt, Human
agaccuucuccuucaccu

SEQ ID NO: 1913739 - RNA, 21 nt, Human
agaccuucuccuucaccuuug

SEQ ID NO: 1913740 - RNA, 23 nt, Human
agaccuucuccuucaccuuuguc

SEQ ID NO: 1913741 - RNA, 16 nt, Human
ucuugagccuugaacu

SEQ ID NO: 1913742 - RNA, 13 nt, Human
ucuugagccuggg

SEQ ID NO: 1913743 - RNA, 16 nt, Human
ucuugagccugggagg

SEQ ID NO: 1913744 - RNA, 23 nt, Human
agacucaggccaagaaacgucuu

SEQ ID NO: 1913745 - RNA, 19 nt, Human
agacucaggccaagaaacg

SEQ ID NO: 1913746 - RNA, 20 nt, Human
agacucaggccaagaaacgu

SEQ ID NO: 1913747 - RNA, 13 nt, Human
ucuugauucauaa

SEQ ID NO: 1913748 - RNA, 14 nt, Human
ucuugauuauccau

SEQ ID NO: 1913749 - RNA, 23 nt, Human
ucuugauuauccauauugaguca

SEQ ID NO: 1913750 - RNA, 21 nt, Human
ucuugaugccuggcggggugg

SEQ ID NO: 1913751 - RNA, 22 nt, Human
ucuugcaauggcagccuuggca

SEQ ID NO: 1913752 - RNA, 18 nt, Human
ucuugcaauggcagccuu

SEQ ID NO: 1913753 - RNA, 19 nt, Human
ucuugcaauggcagccuug

SEQ ID NO: 1913754 - RNA, 17 nt, Human
ucuuggcuuggugagga

SEQ ID NO: 1913755 - RNA, 17 nt, Human
ucuuggucagauuugaa

SEQ ID NO: 1913756 - RNA, 14 nt, Human
ucuugguccugcug

SEQ ID NO: 1913757 - RNA, 13 nt, Human
ucuugggaacuga

SEQ ID NO: 1913758 - RNA, 14 nt, Human
ucuugggaacugaa

SEQ ID NO: 1913759 - RNA, 21 nt, Human
ucuuuauuaaauguagaaagu

SEQ ID NO: 1913760 - RNA, 17 nt, Human
ucuuuauuaaauguaga

SEQ ID NO: 1913761 - RNA, 16 nt, Human
ucuuuaugauuuuuaa

SEQ ID NO: 1913762 - RNA, 15 nt, Human
ucuuuauguugaguc

SEQ ID NO: 1913763 - RNA, 16 nt, Human
ucuuuauuaaucacua

SEQ ID NO: 1913764 - RNA, 17 nt, Human
ucuuuccugaggcuggg

SEQ ID NO: 1913765 - RNA, 15 nt, Human
ucuugguccugcugc

SEQ ID NO: 1913766 - RNA, 17 nt, Human
ucuugguccugcugcag

SEQ ID NO: 1913767 - RNA, 16 nt, Human
ucuuuaaaugcugcuu

SEQ ID NO: 1913768 - RNA, 19 nt, Human
ucuugguccugcugcaguu

SEQ ID NO: 1913769 - RNA, 16 nt, Human
ucuucugggcacccuc

SEQ ID NO: 1913770 - RNA, 19 nt, Human
ucuucugcuucagccuccc

SEQ ID NO: 1913771 - RNA, 12 nt, Human
ucuucugcuuca

SEQ ID NO: 1913772 - RNA, 21 nt, Human
ucuucugaacuuggcgcugcc

SEQ ID NO: 1913773 - RNA, 20 nt, Human
ucuucuguacgucugacagg

SEQ ID NO: 1913774 - RNA, 15 nt, Human
ucuucuguacgucug

SEQ ID NO: 1913775 - RNA, 20 nt, Human
ucuucuguggguuucuaaag

SEQ ID NO: 1913776 - RNA, 18 nt, Human
agacaucaacagauaaau

SEQ ID NO: 1913777 - RNA, 17 nt, Human
agacaucaacagauaaa

SEQ ID NO: 1913778 - RNA, 19 nt, Human
agacauacuaaccagcaga

SEQ ID NO: 1913779 - RNA, 21 nt, Human
agacauagaauuaacacauga

SEQ ID NO: 1913780 - RNA, 15 nt, Human
agacauuggcaccua

SEQ ID NO: 1913781 - RNA, 12 nt, Human
agacauugcacc

SEQ ID NO: 1913782 - RNA, 19 nt, Human
agacccccuggagacuaac

SEQ ID NO: 1913783 - RNA, 15 nt, Human
agacccccuggagac

SEQ ID NO: 1913784 - RNA, 14 nt, Human
agacccccuggaga

SEQ ID NO: 1913785 - RNA, 13 nt, Human
agacccccuggag

SEQ ID NO: 1913786 - RNA, 21 nt, Human
ucuuccaggcugggagagccu

SEQ ID NO: 1913787 - RNA, 13 nt, Human
ucuucacaaaauc

SEQ ID NO: 1913788 - RNA, 20 nt, Human
ucuucagagacuccugcagg

SEQ ID NO: 1913789 - RNA, 15 nt, Human
ucuuccaggcuggga

SEQ ID NO: 1913790 - RNA, 17 nt, Human
ucuuccaggcugggaga

SEQ ID NO: 1913791 - RNA, 20 nt, Human
ucuuccaggcugggagagcc

SEQ ID NO: 1913792 - RNA, 17 nt, Human
ucuucagagacuccugc

SEQ ID NO: 1913793 - RNA, 18 nt, Human
ucuucagagacuccugca

SEQ ID NO: 1913794 - RNA, 12 nt, Human
ucuucagagacu

SEQ ID NO: 1913795 - RNA, 20 nt, Human
ucuucaaccagggauuguuu

SEQ ID NO: 1913796 - RNA, 14 nt, Human
agaaucacuugaac

SEQ ID NO: 1913797 - RNA, 15 nt, Human
ucuuccucccucccu

SEQ ID NO: 1913798 - RNA, 14 nt, Human
ucuuccucccuccc

SEQ ID NO: 1913799 - RNA, 19 nt, Human
ucuucccuacaguugaaaa

SEQ ID NO: 1913800 - RNA, 22 nt, Human
ucuucccuacaguugaaaaaca

SEQ ID NO: 1913801 - RNA, 13 nt, Human
ucuucccauucuc

SEQ ID NO: 1913802 - RNA, 14 nt, Human
ucuucccauucucc

SEQ ID NO: 1913803 - RNA, 15 nt, Human
ucuucccauucucca

SEQ ID NO: 1913804 - RNA, 19 nt, Human
ucuucccauucuccauuug

SEQ ID NO: 1913805 - RNA, 15 nt, Human
ugaauacuuuauaaa

SEQ ID NO: 1913806 - RNA, 14 nt, Human
ugaagucacacagu

SEQ ID NO: 1913807 - RNA, 22 nt, Human
ugaaggguaauuauauaguuac

SEQ ID NO: 1913808 - RNA, 13 nt, Human
ugaauaaagugcu

SEQ ID NO: 1913809 - RNA, 16 nt, Human
ugaauaaauaaaugua

SEQ ID NO: 1913810 - RNA, 16 nt, Human
ugaauacuuuuuacaa

SEQ ID NO: 1913811 - RNA, 14 nt, Human
ugaauauaaacacu

SEQ ID NO: 1913812 - RNA, 11 nt, Human
ugaauguauuu

SEQ ID NO: 1913813 - RNA, 23 nt, Human
ugaauguaugcuucauacaggga

SEQ ID NO: 1913814 - RNA, 20 nt, Human
ugaauguaugcuucauacag

SEQ ID NO: 1913815 - RNA, 19 nt, Human
ugaauguaugcuucauaca

SEQ ID NO: 1913816 - RNA, 14 nt, Human
ugaauguaugcuuc

SEQ ID NO: 1913817 - RNA, 15 nt, Human
agagguuaagguggg

SEQ ID NO: 1913818 - RNA, 18 nt, Human
agagggaggcaagcccug

SEQ ID NO: 1913819 - RNA, 16 nt, Human
agagguggggagcaga

SEQ ID NO: 1913820 - RNA, 23 nt, Human
agaggugugcaagagagggaugc

SEQ ID NO: 1913821 - RNA, 22 nt, Human
agaggugugcaagagagggaug

SEQ ID NO: 1913822 - RNA, 20 nt, Human
ugaagcuaucguaaaauuaa

SEQ ID NO: 1913823 - RNA, 14 nt, Human
ugaagcuacugugu

SEQ ID NO: 1913824 - RNA, 22 nt, Human
ugaagcuacugugugugugaau

SEQ ID NO: 1913825 - RNA, 18 nt, Human
ugaagggccagagccagg

SEQ ID NO: 1913826 - RNA, 19 nt, Human
ugaagggccagagccaggg

SEQ ID NO: 1913827 - RNA, 22 nt, Human
ugaaggggccaaggagggugag

SEQ ID NO: 1913828 - RNA, 10 nt, Human
ugaaggggcg

SEQ ID NO: 1913829 - RNA, 18 nt, Human
ugaagccuuucuuuugga

SEQ ID NO: 1913830 - RNA, 19 nt, Human
ugaagccaauucagacagg

SEQ ID NO: 1913831 - RNA, 16 nt, Human
agagggaggcaagccc

SEQ ID NO: 1913832 - RNA, 17 nt, Human
agagggaggcaagcccu

SEQ ID NO: 1913833 - RNA, 16 nt, Human
agagggagggagggcu

SEQ ID NO: 1913834 - RNA, 14 nt, Human
agaggcccucugga

SEQ ID NO: 1913835 - RNA, 18 nt, Human
agaggcccucuggagugg

SEQ ID NO: 1913836 - RNA, 16 nt, Human
ugaaaguccagaaacu

SEQ ID NO: 1913837 - RNA, 18 nt, Human
ugaaaguccagaaacugu

SEQ ID NO: 1913838 - RNA, 12 nt, Human
agaggccccagc

SEQ ID NO: 1913839 - RNA, 13 nt, Human
agaggccccagcc

SEQ ID NO: 1913840 - RNA, 14 nt, Human
agaggccccagccu

SEQ ID NO: 1913841 - RNA, 15 nt, Human
agaggccccagccuc

SEQ ID NO: 1913842 - RNA, 16 nt, Human
agaggccccagccucc

SEQ ID NO: 1913843 - RNA, 23 nt, Human
agaggccccagccucccugaagc

SEQ ID NO: 1913844 - RNA, 22 nt, Human
ugacacauaugcaccuuguguc

SEQ ID NO: 1913845 - RNA, 21 nt, Human
ugacacauaugcaccuugugu

SEQ ID NO: 1913846 - RNA, 18 nt, Human
ugacacaggucuuuccua

SEQ ID NO: 1913847 - RNA, 20 nt, Human
ugacacaugcaaggucauuu

SEQ ID NO: 1913848 - RNA, 12 nt, Human
ugacacaugcaa

SEQ ID NO: 1913849 - RNA, 18 nt, Human
ugacacacagcucugucc

SEQ ID NO: 1913850 - RNA, 16 nt, Human
ugacacacagcucugu

SEQ ID NO: 1913851 - RNA, 19 nt, Human
ugacaaagacugaguacgu

SEQ ID NO: 1913852 - RNA, 23 nt, Human
ugacacagaaaauguugagaauc

SEQ ID NO: 1913853 - RNA, 19 nt, Human
ugacacacagcucuguccu

SEQ ID NO: 1913854 - RNA, 23 nt, Human
ugacacagucuuggcucacugca

SEQ ID NO: 1913855 - RNA, 22 nt, Human
ugacacagucuuggcucacugc

SEQ ID NO: 1913856 - RNA, 16 nt, Human
ugacacaggucuuucc

SEQ ID NO: 1913857 - RNA, 17 nt, Human
ugacacaggucuuuccu

SEQ ID NO: 1913858 - RNA, 23 nt, Human
ugaauuugugaagguggaaauaa

SEQ ID NO: 1913859 - RNA, 23 nt, Human
ugaauuucuuuugccguuauuaa

SEQ ID NO: 1913860 - RNA, 13 nt, Human
ugaauuugugaag

SEQ ID NO: 1913861 - RNA, 21 nt, Human
ugaauuugugaagguggaaau

SEQ ID NO: 1913862 - RNA, 18 nt, Human
agauaauacaccacuaca

SEQ ID NO: 1913863 - RNA, 17 nt, Human
agauaaggguaucuggu

SEQ ID NO: 1913864 - RNA, 13 nt, Human
agauaacuaggaa

SEQ ID NO: 1913865 - RNA, 20 nt, Human
agaguuguuacauuuuuaag

SEQ ID NO: 1913866 - RNA, 19 nt, Human
agaguuguuacauuuuuaa

SEQ ID NO: 1913867 - RNA, 13 nt, Human
agaguuuccugaa

SEQ ID NO: 1913868 - RNA, 16 nt, Human
agaguuucaaccauga

SEQ ID NO: 1913869 - RNA, 17 nt, Human
agaguuguuacauuuuu

SEQ ID NO: 1913870 - RNA, 22 nt, Human
agagucagaaguuucugccgca

SEQ ID NO: 1913871 - RNA, 15 nt, Human
agagucacuggaaca

SEQ ID NO: 1913872 - RNA, 15 nt, Human
ugaauguauuuauuu

SEQ ID NO: 1913873 - RNA, 22 nt, Human
agauacaguuacucagaauucu

SEQ ID NO: 1913874 - RNA, 11 nt, Human
agauacuguau

SEQ ID NO: 1913875 - RNA, 20 nt, Human
agauacaggaaaagcugcug

SEQ ID NO: 1913876 - RNA, 13 nt, Human
agauacaguuacu

SEQ ID NO: 1913877 - RNA, 18 nt, Human
agauaauauuaaggaaga

SEQ ID NO: 1913878 - RNA, 22 nt, Human
agauaauauuaaggaagacaau

SEQ ID NO: 1913879 - RNA, 16 nt, Human
agauacuguaucauga

SEQ ID NO: 1913880 - RNA, 15 nt, Human
agauacuguaucaug

SEQ ID NO: 1913881 - RNA, 18 nt, Human
agaucaaaagguuaauaa

SEQ ID NO: 1913882 - RNA, 21 nt, Human
agauauuuugcuuugugauuu

SEQ ID NO: 1913883 - RNA, 20 nt, Human
agauauuuugcuuugugauu

SEQ ID NO: 1913884 - RNA, 20 nt, Human
ugagaagaaaauggaaccag

SEQ ID NO: 1913885 - RNA, 14 nt, Human
ugagaagaaaacau

SEQ ID NO: 1913886 - RNA, 17 nt, Human
ugagaagaaaacaucua

SEQ ID NO: 1913887 - RNA, 17 nt, Human
ugagaacuuuauuucca

SEQ ID NO: 1913888 - RNA, 14 nt, Human
agcaagauuucaga

SEQ ID NO: 1913889 - RNA, 22 nt, Human
ugagaagaaaauggaaccaggc

SEQ ID NO: 1913890 - RNA, 23 nt, Human
ugagaagaaaacaucuauucucu

SEQ ID NO: 1913891 - RNA, 20 nt, Human
ugagaagcagaggaaggaga

SEQ ID NO: 1913892 - RNA, 22 nt, Human
ugagaagauucuucccauucuc

SEQ ID NO: 1913893 - RNA, 23 nt, Human
ugagaagauucuucccauucucc

SEQ ID NO: 1913894 - RNA, 23 nt, Human
agcaagacgcugugcugcccugc

SEQ ID NO: 1913895 - RNA, 12 nt, Human
agcaagacucug

SEQ ID NO: 1913896 - RNA, 17 nt, Human
agcaagacuguuagccc

SEQ ID NO: 1913897 - RNA, 12 nt, Human
agcaagaggagg

SEQ ID NO: 1913898 - RNA, 17 nt, Human
agcaagacgcugugcug

SEQ ID NO: 1913899 - RNA, 20 nt, Human
agcaagacgcugugcugccc

SEQ ID NO: 1913900 - RNA, 21 nt, Human
agcaagacgcugugcugcccu

SEQ ID NO: 1913901 - RNA, 22 nt, Human
agcaagacgcugugcugcccug

SEQ ID NO: 1913902 - RNA, 13 nt, Human
agcaagacgcugu

SEQ ID NO: 1913903 - RNA, 16 nt, Human
agcaagacgcugugcu

SEQ ID NO: 1913904 - RNA, 16 nt, Human
agcaacucuugauuau

SEQ ID NO: 1913905 - RNA, 20 nt, Human
agcaacucuugauuauccau

SEQ ID NO: 1913906 - RNA, 14 nt, Human
agcaacucuugauu

SEQ ID NO: 1913907 - RNA, 21 nt, Human
agauuuugaaauuuuuauuaa

SEQ ID NO: 1913908 - RNA, 17 nt, Human
agauuugaacucuucaa

SEQ ID NO: 1913909 - RNA, 23 nt, Human
agauuuccagucuccaccaggaa

SEQ ID NO: 1913910 - RNA, 22 nt, Human
agauuggcucacacugagaaug

SEQ ID NO: 1913911 - RNA, 15 nt, Human
agauuuccagucucc

SEQ ID NO: 1913912 - RNA, 19 nt, Human
agauuggcucacacugaga

SEQ ID NO: 1913913 - RNA, 14 nt, Human
agauuggcucacac

SEQ ID NO: 1913914 - RNA, 22 nt, Human
agauucauauuuacuucuuaua

SEQ ID NO: 1913915 - RNA, 19 nt, Human
ugacuuacuguacaugaaa

SEQ ID NO: 1913916 - RNA, 17 nt, Human
agauucccaggaguucu

SEQ ID NO: 1913917 - RNA, 22 nt, Human
agauucccaggaguucugcuca

SEQ ID NO: 1913918 - RNA, 19 nt, Human
agauucccaggaguucugc

SEQ ID NO: 1913919 - RNA, 13 nt, Human
agauuggaaggaa

SEQ ID NO: 1913920 - RNA, 13 nt, Human
ugacuagugcuga

SEQ ID NO: 1913921 - RNA, 14 nt, Human
ugacucaagauucc

SEQ ID NO: 1913922 - RNA, 15 nt, Human
ugacucaagauuccc

SEQ ID NO: 1913923 - RNA, 16 nt, Human
ugacucaagauuccca

SEQ ID NO: 1913924 - RNA, 17 nt, Human
ugacucaagauucccag

SEQ ID NO: 1913925 - RNA, 18 nt, Human
ugacucaagauucccagg

SEQ ID NO: 1913926 - RNA, 19 nt, Human
ugacucaagauucccagga

SEQ ID NO: 1913927 - RNA, 20 nt, Human
ugacucaagauucccaggag

SEQ ID NO: 1913928 - RNA, 21 nt, Human
ugacucaagauucccaggagu

SEQ ID NO: 1913929 - RNA, 22 nt, Human
ugacucaagauucccaggaguu

SEQ ID NO: 1913930 - RNA, 17 nt, Human
ugaccuucuaggaagcu

SEQ ID NO: 1913931 - RNA, 17 nt, Human
ugaccuugaugagcugu

SEQ ID NO: 1913932 - RNA, 23 nt, Human
ugacuagaugauggaugccaaua

SEQ ID NO: 1913933 - RNA, 16 nt, Human
ugacuuacuguacaug

SEQ ID NO: 1913934 - RNA, 15 nt, Human
ugacuuacuguacau

SEQ ID NO: 1913935 - RNA, 13 nt, Human
ugacuuacuguac

SEQ ID NO: 1913936 - RNA, 19 nt, Human
ugacucacaccugaacuga

SEQ ID NO: 1913937 - RNA, 14 nt, Human
ugacucacaccuga

SEQ ID NO: 1913938 - RNA, 18 nt, Human
ugaccugaggcccuucuc

SEQ ID NO: 1913939 - RNA, 19 nt, Human
ugaccugaggcccuucucu

SEQ ID NO: 1913940 - RNA, 18 nt, Human
ugaccuuccaagagccug

SEQ ID NO: 1913941 - RNA, 20 nt, Human
ugaccuuccaagagccugag

SEQ ID NO: 1913942 - RNA, 19 nt, Human
ugaccuuccaagagccuga

SEQ ID NO: 1913943 - RNA, 20 nt, Human
ugaccugugagcccagcugg

SEQ ID NO: 1913944 - RNA, 14 nt, Human
ugacccaugcugcc

SEQ ID NO: 1913945 - RNA, 15 nt, Human
ugacccaugcugccc

SEQ ID NO: 1913946 - RNA, 21 nt, Human
ugacccaugcugcccugugag

SEQ ID NO: 1913947 - RNA, 12 nt, Human
ugacccaugcug

SEQ ID NO: 1913948 - RNA, 16 nt, Human
ugacccaugcugcccu

SEQ ID NO: 1913949 - RNA, 22 nt, Human
agauggaaguugcagugagcug

SEQ ID NO: 1913950 - RNA, 23 nt, Human
agauggaaguugcagugagcuga

SEQ ID NO: 1913951 - RNA, 14 nt, Human
agauguuuccagac

SEQ ID NO: 1913952 - RNA, 21 nt, Human
agauguuuccagacuuccuug

SEQ ID NO: 1913953 - RNA, 23 nt, Human
agauguuuccagacuuccuugag

SEQ ID NO: 1913954 - RNA, 16 nt, Human
agaugccgcauuugga

SEQ ID NO: 1913955 - RNA, 16 nt, Human
agaugcagggcaguca

SEQ ID NO: 1913956 - RNA, 10 nt, Human
agauggaaag

SEQ ID NO: 1913957 - RNA, 16 nt, Human
ugacacuuaaaaaugg

SEQ ID NO: 1913958 - RNA, 17 nt, Human
ugacacuuaaaaauggu

SEQ ID NO: 1913959 - RNA, 13 nt, Human
agaugcagggcag

SEQ ID NO: 1913960 - RNA, 20 nt, Human
agcaucacaugaacuuguaa

SEQ ID NO: 1913961 - RNA, 12 nt, Human
agcaucaggcca

SEQ ID NO: 1913962 - RNA, 13 nt, Human
agcaucaggccag

SEQ ID NO: 1913963 - RNA, 21 nt, Human
ugaucacggcucacugcagcc

SEQ ID NO: 1913964 - RNA, 20 nt, Human
ugaucacggcucacugcagc

SEQ ID NO: 1913965 - RNA, 22 nt, Human
agcauauucaggaagcucaggg

SEQ ID NO: 1913966 - RNA, 19 nt, Human
ugaucacggcucacugcag

SEQ ID NO: 1913967 - RNA, 21 nt, Human
ugaucaacaucuuuucuugcc

SEQ ID NO: 1913968 - RNA, 18 nt, Human
ugaucaacaucuuuucuu

SEQ ID NO: 1913969 - RNA, 17 nt, Human
ugaucaacaucuuuucu

SEQ ID NO: 1913970 - RNA, 14 nt, Human
ugaucaacaucuuu

SEQ ID NO: 1913971 - RNA, 23 nt, Human
ugaucaacaucuuuucuugccuc

SEQ ID NO: 1913972 - RNA, 18 nt, Human
ugaucaaagccacacucu

SEQ ID NO: 1913973 - RNA, 19 nt, Human
ugauauguugguagauucu

SEQ ID NO: 1913974 - RNA, 16 nt, Human
ugauaugugaacaguu

SEQ ID NO: 1913975 - RNA, 15 nt, Human
ugauaugugaacagu

SEQ ID NO: 1913976 - RNA, 19 nt, Human
ugauagacacauaugaggg

SEQ ID NO: 1913977 - RNA, 21 nt, Human
ugauagaaggcuauggggaua

SEQ ID NO: 1913978 - RNA, 16 nt, Human
ugauauuugugcauuu

SEQ ID NO: 1913979 - RNA, 17 nt, Human
ugauauuugugcauuuu

SEQ ID NO: 1913980 - RNA, 19 nt, Human
ugauauuugugcauuuucu

SEQ ID NO: 1913981 - RNA, 15 nt, Human
ugauauguauuguuu

SEQ ID NO: 1913982 - RNA, 21 nt, Human
agcauguacugagccuuguaa

SEQ ID NO: 1913983 - RNA, 12 nt, Human
agcauggcugcc

SEQ ID NO: 1913984 - RNA, 20 nt, Human
agcaugucgucaaagcugaa

SEQ ID NO: 1913985 - RNA, 17 nt, Human
agcaugucgucaaagcu

SEQ ID NO: 1913986 - RNA, 14 nt, Human
agcaucaggccagg

SEQ ID NO: 1913987 - RNA, 16 nt, Human
agcaucaggccaggcc

SEQ ID NO: 1913988 - RNA, 17 nt, Human
agcaucaggccaggccc

SEQ ID NO: 1913989 - RNA, 18 nt, Human
agcaucaggccaggcccu

SEQ ID NO: 1913990 - RNA, 19 nt, Human
agcaucaggccaggcccuc

SEQ ID NO: 1913991 - RNA, 20 nt, Human
agcaucaggccaggcccucu

SEQ ID NO: 1913992 - RNA, 21 nt, Human
agcauugggugagguaauaaa

SEQ ID NO: 1913993 - RNA, 20 nt, Human
agcauuucgcgauggacaga

SEQ ID NO: 1913994 - RNA, 23 nt, Human
agcauugugugugcagacuucag

SEQ ID NO: 1913995 - RNA, 15 nt, Human
agcauugauauuugu

SEQ ID NO: 1913996 - RNA, 18 nt, Human
agcauugauauuugugca

SEQ ID NO: 1913997 - RNA, 21 nt, Human
agcauugauauuugugcauuu

SEQ ID NO: 1913998 - RNA, 19 nt, Human
agcauugauauuugugcau

SEQ ID NO: 1913999 - RNA, 23 nt, Human
agcauaaguuucugggaccucag

SEQ ID NO: 1914000 - RNA, 17 nt, Human
agcauaaguuucuggga

SEQ ID NO: 1914001 - RNA, 19 nt, Human
ugagacacaggaugaagca

SEQ ID NO: 1914002 - RNA, 21 nt, Human
agcauaauacuugcuuuggaa

SEQ ID NO: 1914003 - RNA, 15 nt, Human
agcauacguacacau

SEQ ID NO: 1914004 - RNA, 12 nt, Human
ugagaauuaccc

SEQ ID NO: 1914005 - RNA, 16 nt, Human
ugagacacaggaugaa

SEQ ID NO: 1914006 - RNA, 21 nt, Human
agcauacguacacauuuuauu

SEQ ID NO: 1914007 - RNA, 20 nt, Human
agcauacguacacauuuuau

SEQ ID NO: 1914008 - RNA, 19 nt, Human
agcauacguacacauuuua

SEQ ID NO: 1914009 - RNA, 18 nt, Human
agcauacguacacauuuu

SEQ ID NO: 1914010 - RNA, 17 nt, Human
agcauacguacacauuu

SEQ ID NO: 1914011 - RNA, 16 nt, Human
agcauacguacacauu

SEQ ID NO: 1914012 - RNA, 22 nt, Human
ugaguaacugauuuguaacaag

SEQ ID NO: 1914013 - RNA, 15 nt, Human
ugaguacuacagucc

SEQ ID NO: 1914014 - RNA, 22 nt, Human
ugaguaaaauaaauauugucuu

SEQ ID NO: 1914015 - RNA, 14 nt, Human
agcauauucaggaa

SEQ ID NO: 1914016 - RNA, 13 nt, Human
ugaguagcuggau

SEQ ID NO: 1914017 - RNA, 14 nt, Human
ugaguagaggcuua

SEQ ID NO: 1914018 - RNA, 17 nt, Human
ugaguacuacaguccuc

SEQ ID NO: 1914019 - RNA, 21 nt, Human
ugaguacuacaguccucccau

SEQ ID NO: 1914020 - RNA, 22 nt, Human
ugaguacuacaguccucccauc

SEQ ID NO: 1914021 - RNA, 23 nt, Human
ugaguacuacaguccucccaucu

SEQ ID NO: 1914022 - RNA, 17 nt, Human
ugaguucauacccuguu

SEQ ID NO: 1914023 - RNA, 20 nt, Human
ugauaagaaccuuuugagug

SEQ ID NO: 1914024 - RNA, 24 nt, Human
ugauaagcagucauccucagauca

SEQ ID NO: 1914025 - RNA, 21 nt, Human
ugauacaaugcugugcccuaa

SEQ ID NO: 1914026 - RNA, 12 nt, Human
ugauacagaaaa

SEQ ID NO: 1914027 - RNA, 20 nt, Human
ugauacaaugcugugcccua

SEQ ID NO: 1914028 - RNA, 17 nt, Human
ugauacuacaguuuguu

SEQ ID NO: 1914029 - RNA, 14 nt, Human
ugauacuacaguuu

SEQ ID NO: 1914030 - RNA, 23 nt, Human
ugagugggggaucacagccucug

SEQ ID NO: 1914031 - RNA, 21 nt, Human
ugagugggugaauaauacagu

SEQ ID NO: 1914032 - RNA, 23 nt, Human
ugagucacaaagaacauguagaa

SEQ ID NO: 1914033 - RNA, 18 nt, Human
ugaguucauaaauuuaug

SEQ ID NO: 1914034 - RNA, 17 nt, Human
ugagucaccaagcccag

SEQ ID NO: 1914035 - RNA, 16 nt, Human
ugagucaccaagccca

SEQ ID NO: 1914036 - RNA, 17 nt, Human
ugagugccuuacacaau

SEQ ID NO: 1914037 - RNA, 20 nt, Human
ugagugccuuacacaauggu

SEQ ID NO: 1914038 - RNA, 14 nt, Human
ugagucaccaagcc

SEQ ID NO: 1914039 - RNA, 14 nt, Human
ugagucaauuggaa

SEQ ID NO: 1914040 - RNA, 19 nt, Human
agccacggacgcuggcucc

SEQ ID NO: 1914041 - RNA, 23 nt, Human
agccaccuuuugggaauguuuua

SEQ ID NO: 1914042 - RNA, 15 nt, Human
agccacggccaggcc

SEQ ID NO: 1914043 - RNA, 15 nt, Human
ugauccagcccugag

SEQ ID NO: 1914044 - RNA, 18 nt, Human
ugauccagcccugaguuc

SEQ ID NO: 1914045 - RNA, 17 nt, Human
ugauccagcccugaguu

SEQ ID NO: 1914046 - RNA, 20 nt, Human
ugauccuggaggcccaguuc

SEQ ID NO: 1914047 - RNA, 20 nt, Human
ugaugacaacuacagaaaaa

SEQ ID NO: 1914048 - RNA, 24 nt, Human
ugaugagcugugcacaaaguggca

SEQ ID NO: 1914049 - RNA, 19 nt, Human
ugaugagcugugcacaaag

SEQ ID NO: 1914050 - RNA, 14 nt, Human
agccacauuccuga

SEQ ID NO: 1914051 - RNA, 18 nt, Human
agccacauuccugaugcu

SEQ ID NO: 1914052 - RNA, 19 nt, Human
agccaccaacauacuccca

SEQ ID NO: 1914053 - RNA, 15 nt, Human
agccacauuuggaau

SEQ ID NO: 1914054 - RNA, 20 nt, Human
agccacauuuggaauacuuu

SEQ ID NO: 1914055 - RNA, 20 nt, Human
agccaccaacauacucccau

SEQ ID NO: 1914056 - RNA, 23 nt, Human
agccaccaacauacucccaucug

SEQ ID NO: 1914057 - RNA, 14 nt, Human
agccacggccaggc

SEQ ID NO: 1914058 - RNA, 22 nt, Human
agccaccuuuugggaauguuuu

SEQ ID NO: 1914059 - RNA, 22 nt, Human
agccaccgaagccgccugugga

SEQ ID NO: 1914060 - RNA, 21 nt, Human
agccaccgaagccgccugugg

SEQ ID NO: 1914061 - RNA, 20 nt, Human
agccaccgaagccgccugug

SEQ ID NO: 1914062 - RNA, 15 nt, Human
agccaccgaagccgc

SEQ ID NO: 1914063 - RNA, 21 nt, Human
agccacauuuggaauacuuuu

SEQ ID NO: 1914064 - RNA, 22 nt, Human
agccacauuuggaauacuuuuu

SEQ ID NO: 1914065 - RNA, 23 nt, Human
agccacauuuggaauacuuuuug

SEQ ID NO: 1914066 - RNA, 15 nt, Human
agccacugagcaaug

SEQ ID NO: 1914067 - RNA, 14 nt, Human
ugauuaccagggac

SEQ ID NO: 1914068 - RNA, 15 nt, Human
ugauuaauuaaaaca

SEQ ID NO: 1914069 - RNA, 12 nt, Human
ugauuaaaccaa

SEQ ID NO: 1914070 - RNA, 21 nt, Human
ugauuaauucaccuuccagug

SEQ ID NO: 1914071 - RNA, 19 nt, Human
ugauuaauuaaauagcuuu

SEQ ID NO: 1914072 - RNA, 22 nt, Human
agccacugcaccgggccacaga

SEQ ID NO: 1914073 - RNA, 21 nt, Human
agccacugcaccgggccacag

SEQ ID NO: 1914074 - RNA, 13 nt, Human
agccacugcaccg

SEQ ID NO: 1914075 - RNA, 13 nt, Human
agccacugaagua

SEQ ID NO: 1914076 - RNA, 18 nt, Human
ugauguuuuaaggaugcu

SEQ ID NO: 1914077 - RNA, 17 nt, Human
ugauguuuuaaggaugc

SEQ ID NO: 1914078 - RNA, 14 nt, Human
ugaugauccuaggc

SEQ ID NO: 1914079 - RNA, 20 nt, Human
ugaugauccuaggcauuugc

SEQ ID NO: 1914080 - RNA, 17 nt, Human
ugauggugcaaugaccu

SEQ ID NO: 1914081 - RNA, 23 nt, Human
ugauggugcaaugaccuuucaau

SEQ ID NO: 1914082 - RNA, 16 nt, Human
ugauggugcaaugacc

SEQ ID NO: 1914083 - RNA, 22 nt, Human
agccaggacaccgggcagggcc

SEQ ID NO: 1914084 - RNA, 20 nt, Human
agccaggaauuucccaggac

SEQ ID NO: 1914085 - RNA, 21 nt, Human
agccaggaauuucccaggacc

SEQ ID NO: 1914086 - RNA, 22 nt, Human
agccaggaauuucccaggaccc

SEQ ID NO: 1914087 - RNA, 23 nt, Human
agccaggaauuucccaggacccu

SEQ ID NO: 1914088 - RNA, 17 nt, Human
agccaggaauuucccag

SEQ ID NO: 1914089 - RNA, 19 nt, Human
agccaggaauuucccagga

SEQ ID NO: 1914090 - RNA, 12 nt, Human
agccaggccaca

SEQ ID NO: 1914091 - RNA, 14 nt, Human
agccaggccacaag

SEQ ID NO: 1914092 - RNA, 23 nt, Human
agccaguaaaugggggugcauuu

SEQ ID NO: 1914093 - RNA, 12 nt, Human
agccagggucuc

SEQ ID NO: 1914094 - RNA, 21 nt, Human
agccaggccacaagacccuug

SEQ ID NO: 1914095 - RNA, 22 nt, Human
agccaggccacaagacccuugu

SEQ ID NO: 1914096 - RNA, 14 nt, Human
agccaggccccagg

SEQ ID NO: 1914097 - RNA, 15 nt, Human
agccaggccccaggc

SEQ ID NO: 1914098 - RNA, 15 nt, Human
agccaggccacuggc

SEQ ID NO: 1914099 - RNA, 22 nt, Human
agcccacuucugccauauucug

SEQ ID NO: 1914100 - RNA, 11 nt, Human
agcccagagac

SEQ ID NO: 1914101 - RNA, 10 nt, Human
agcccagaga

SEQ ID NO: 1914102 - RNA, 12 nt, Human
agcccagagaca

SEQ ID NO: 1914103 - RNA, 21 nt, Human
agcccagagacauacuugaag

SEQ ID NO: 1914104 - RNA, 22 nt, Human
agcccagagacauacuugaagg

SEQ ID NO: 1914105 - RNA, 15 nt, Human
agccaugucugcauu

SEQ ID NO: 1914106 - RNA, 22 nt, Human
agccaugggcacaaagggccca

SEQ ID NO: 1914107 - RNA, 23 nt, Human
agccaugggcacaaagggcccag

SEQ ID NO: 1914108 - RNA, 14 nt, Human
agccaugucugcau

SEQ ID NO: 1914109 - RNA, 13 nt, Human
agccaucaaaaug

SEQ ID NO: 1914110 - RNA, 14 nt, Human
agccaucaaaaugc

SEQ ID NO: 1914111 - RNA, 15 nt, Human
agccaucaaaaugcu

SEQ ID NO: 1914112 - RNA, 16 nt, Human
agccaucaaaaugcuu

SEQ ID NO: 1914113 - RNA, 19 nt, Human
agcccaggaaaggcuccag

SEQ ID NO: 1914114 - RNA, 13 nt, Human
agcccagcugggu

SEQ ID NO: 1914115 - RNA, 15 nt, Human
agcccagcuggguca

SEQ ID NO: 1914116 - RNA, 16 nt, Human
agcccagcugggucag

SEQ ID NO: 1914117 - RNA, 20 nt, Human
agcccaggaaaggcuccagg

SEQ ID NO: 1914118 - RNA, 21 nt, Human
agcccaggaaaggcuccagga

SEQ ID NO: 1914119 - RNA, 13 nt, Human
agcccagcccucc

SEQ ID NO: 1914120 - RNA, 12 nt, Human
agcccagcucca

SEQ ID NO: 1914121 - RNA, 16 nt, Human
agcccagaggagggca

SEQ ID NO: 1914122 - RNA, 15 nt, Human
agcccagaggagggc

SEQ ID NO: 1914123 - RNA, 14 nt, Human
agcccagaggaggg

SEQ ID NO: 1914124 - RNA, 12 nt, Human
agcccagaggag

SEQ ID NO: 1914125 - RNA, 15 nt, Human
ugauucauaaugacu

SEQ ID NO: 1914126 - RNA, 13 nt, Human
ugauucagcucug

SEQ ID NO: 1914127 - RNA, 14 nt, Human
ugauucagcucugc

SEQ ID NO: 1914128 - RNA, 24 nt, Human
agcccaggaaaggcuccaggagca

SEQ ID NO: 1914129 - RNA, 22 nt, Human
agcccaggaaaggcuccaggag

SEQ ID NO: 1914130 - RNA, 23 nt, Human
agcccaggaaaggcuccaggagc

SEQ ID NO: 1914131 - RNA, 18 nt, Human
ugauucccaagcucugcu

SEQ ID NO: 1914132 - RNA, 16 nt, Human
ugauucccaagcucug

SEQ ID NO: 1914133 - RNA, 15 nt, Human
ugauucccaagcucu

SEQ ID NO: 1914134 - RNA, 21 nt, Human
ugauucccaagcucugcuccu

SEQ ID NO: 1914135 - RNA, 19 nt, Human
ugauucccaagcucugcuc

SEQ ID NO: 1914136 - RNA, 18 nt, Human
ugauuccuuccuguucug

SEQ ID NO: 1914137 - RNA, 19 nt, Human
ugauuccuuccuguucuga

SEQ ID NO: 1914138 - RNA, 20 nt, Human
ugauuccuuccuguucugaa

SEQ ID NO: 1914139 - RNA, 16 nt, Human
agccuuguaauucuaa

SEQ ID NO: 1914140 - RNA, 18 nt, Human
agccuuguaauucuaaau

SEQ ID NO: 1914141 - RNA, 16 nt, Human
agccuuccacacucac

SEQ ID NO: 1914142 - RNA, 11 nt, Human
agccuuccagg

SEQ ID NO: 1914143 - RNA, 14 nt, Human
agccuuccaggggu

SEQ ID NO: 1914144 - RNA, 16 nt, Human
agccuuccaggggugg

SEQ ID NO: 1914145 - RNA, 17 nt, Human
agccuuccagggguggg

SEQ ID NO: 1914146 - RNA, 18 nt, Human
agcggagacggaguccca

SEQ ID NO: 1914147 - RNA, 20 nt, Human
agcggagaaaggaagggcug

SEQ ID NO: 1914148 - RNA, 20 nt, Human
ugcauuaucuagauacugua

SEQ ID NO: 1914149 - RNA, 17 nt, Human
agcgccuuucccaacuc

SEQ ID NO: 1914150 - RNA, 20 nt, Human
agcgccuuucccaacucuag

SEQ ID NO: 1914151 - RNA, 16 nt, Human
agcggagaaaggaagg

SEQ ID NO: 1914152 - RNA, 22 nt, Human
ugcauuaucuagauacuguauc

SEQ ID NO: 1914153 - RNA, 21 nt, Human
ugcauuaucuagauacuguau

SEQ ID NO: 1914154 - RNA, 23 nt, Human
ugcauugaacacaaacuguaaau

SEQ ID NO: 1914155 - RNA, 22 nt, Human
ugcauugaccgcgacuaauuuc

SEQ ID NO: 1914156 - RNA, 20 nt, Human
ugcauugaccgcgacuaauu

SEQ ID NO: 1914157 - RNA, 15 nt, Human
ugccacaaggacuuc

SEQ ID NO: 1914158 - RNA, 16 nt, Human
ugccacaaggacuucc

SEQ ID NO: 1914159 - RNA, 13 nt, Human
ugccaaguuuguu

SEQ ID NO: 1914160 - RNA, 16 nt, Human
agccuggugcugcugc

SEQ ID NO: 1914161 - RNA, 15 nt, Human
agccuggugcugcug

SEQ ID NO: 1914162 - RNA, 14 nt, Human
agccuggugcugcu

SEQ ID NO: 1914163 - RNA, 20 nt, Human
agccuggucagcccaaacca

SEQ ID NO: 1914164 - RNA, 21 nt, Human
agccugugccucugggacugg

SEQ ID NO: 1914165 - RNA, 18 nt, Human
agccugguuuagccugga

SEQ ID NO: 1914166 - RNA, 16 nt, Human
agccugugucuuuaaa

SEQ ID NO: 1914167 - RNA, 23 nt, Human
agccugugucuuuaaaugcugcu

SEQ ID NO: 1914168 - RNA, 13 nt, Human
agccuguuuaaga

SEQ ID NO: 1914169 - RNA, 12 nt, Human
ugcauaccacuu

SEQ ID NO: 1914170 - RNA, 12 nt, Human
ugcauaccaacc

SEQ ID NO: 1914171 - RNA, 14 nt, Human
ugcauaccaaccug

SEQ ID NO: 1914172 - RNA, 18 nt, Human
ugcauaccaaccugggca

SEQ ID NO: 1914173 - RNA, 18 nt, Human
ugcauaagguuuuuaugc

SEQ ID NO: 1914174 - RNA, 14 nt, Human
ugcauaccacuuuu

SEQ ID NO: 1914175 - RNA, 15 nt, Human
agccugcuccagcug

SEQ ID NO: 1914176 - RNA, 16 nt, Human
agccugcuccagcugu

SEQ ID NO: 1914177 - RNA, 17 nt, Human
agccugcuccagcuguu

SEQ ID NO: 1914178 - RNA, 22 nt, Human
agccugggugacagagcaagug

SEQ ID NO: 1914179 - RNA, 15 nt, Human
agccuggggucugga

SEQ ID NO: 1914180 - RNA, 20 nt, Human
agccugggguggggucaugc

SEQ ID NO: 1914181 - RNA, 19 nt, Human
agccugggguggggucaug

SEQ ID NO: 1914182 - RNA, 23 nt, Human
agccugggguggggucaugcccu

SEQ ID NO: 1914183 - RNA, 16 nt, Human
agccuggucagcccaa

SEQ ID NO: 1914184 - RNA, 15 nt, Human
agccuggucagccca

SEQ ID NO: 1914185 - RNA, 19 nt, Human
agccugcuccagcuguuca

SEQ ID NO: 1914186 - RNA, 22 nt, Human
agccugcuccagcuguucagcu

SEQ ID NO: 1914187 - RNA, 12 nt, Human
agcuagccagag

SEQ ID NO: 1914188 - RNA, 17 nt, Human
agcuagccagaggacug

SEQ ID NO: 1914189 - RNA, 19 nt, Human
agcuagccagaggacugug

SEQ ID NO: 1914190 - RNA, 18 nt, Human
agcuagacgagcaggcuu

SEQ ID NO: 1914191 - RNA, 12 nt, Human
agcuagaaauga

SEQ ID NO: 1914192 - RNA, 16 nt, Human
agcuagaauuugauau

SEQ ID NO: 1914193 - RNA, 13 nt, Human
agcuagaauuuga

SEQ ID NO: 1914194 - RNA, 11 nt, Human
agcuagaaaug

SEQ ID NO: 1914195 - RNA, 16 nt, Human
agcuacuugggaggcu

SEQ ID NO: 1914196 - RNA, 18 nt, Human
agcuacuugggaggcuga

SEQ ID NO: 1914197 - RNA, 17 nt, Human
agcuacuugggaggcug

SEQ ID NO: 1914198 - RNA, 19 nt, Human
agcuacuaauuuuaaaaug

SEQ ID NO: 1914199 - RNA, 23 nt, Human
agcuaccucaaccaaugccaaaa

SEQ ID NO: 1914200 - RNA, 14 nt, Human
agcuaccucaacca

SEQ ID NO: 1914201 - RNA, 22 nt, Human
agcgugagccacugcaccgggc

SEQ ID NO: 1914202 - RNA, 15 nt, Human
agcgugcauaaguua

SEQ ID NO: 1914203 - RNA, 19 nt, Human
agcgugagccacugcaccg

SEQ ID NO: 1914204 - RNA, 18 nt, Human
agcguacucaucaucaac

SEQ ID NO: 1914205 - RNA, 17 nt, Human
ugccagacccccuggag

SEQ ID NO: 1914206 - RNA, 22 nt, Human
agcggugcuguccucagguggc

SEQ ID NO: 1914207 - RNA, 16 nt, Human
ugcccacaggaucagu

SEQ ID NO: 1914208 - RNA, 19 nt, Human
ugcccacaggaucagucug

SEQ ID NO: 1914209 - RNA, 20 nt, Human
ugcccacaggaucagucuga

SEQ ID NO: 1914210 - RNA, 12 nt, Human
ugcccacaggcc

SEQ ID NO: 1914211 - RNA, 21 nt, Human
ugcccagccccuucugaccca

SEQ ID NO: 1914212 - RNA, 20 nt, Human
ugcccagccccuucugaccc

SEQ ID NO: 1914213 - RNA, 14 nt, Human
ugcccacaggccgc

SEQ ID NO: 1914214 - RNA, 21 nt, Human
ugcccacaggccgcccugcgg

SEQ ID NO: 1914215 - RNA, 18 nt, Human
ugcccagcggacaguggc

SEQ ID NO: 1914216 - RNA, 16 nt, Human
agcuccaaccugcaaa

SEQ ID NO: 1914217 - RNA, 18 nt, Human
agcuccaaccugcaaaga

SEQ ID NO: 1914218 - RNA, 13 nt, Human
agcuccaaccugc

SEQ ID NO: 1914219 - RNA, 14 nt, Human
agcuccaaccugca

SEQ ID NO: 1914220 - RNA, 15 nt, Human
agcuccaaccugcaa

SEQ ID NO: 1914221 - RNA, 21 nt, Human
agcucauucuccuuguguuac

SEQ ID NO: 1914222 - RNA, 20 nt, Human
agcucauucuccuuguguua

SEQ ID NO: 1914223 - RNA, 18 nt, Human
agcucauaagagccacag

SEQ ID NO: 1914224 - RNA, 21 nt, Human
agcucaggugucccugcacuu

SEQ ID NO: 1914225 - RNA, 20 nt, Human
agcucaggugucccugcacu

SEQ ID NO: 1914226 - RNA, 22 nt, Human
agcucaggugucccugcacuug

SEQ ID NO: 1914227 - RNA, 18 nt, Human
agcucaggugucccugca

SEQ ID NO: 1914228 - RNA, 13 nt, Human
agcucaggacaga

SEQ ID NO: 1914229 - RNA, 17 nt, Human
agcucaggacagaugcc

SEQ ID NO: 1914230 - RNA, 18 nt, Human
agcucaggacagaugcca

SEQ ID NO: 1914231 - RNA, 15 nt, Human
agcuaggccuggcca

SEQ ID NO: 1914232 - RNA, 14 nt, Human
agcuaggccuggcc

SEQ ID NO: 1914233 - RNA, 16 nt, Human
agcuaggccuggccag

SEQ ID NO: 1914234 - RNA, 12 nt, Human
agcuaggccugg

SEQ ID NO: 1914235 - RNA, 18 nt, Human
agcuaggaauuguguuua

SEQ ID NO: 1914236 - RNA, 18 nt, Human
ugcacccacccaggagug

SEQ ID NO: 1914237 - RNA, 17 nt, Human
ugcacccacccaggagu

SEQ ID NO: 1914238 - RNA, 19 nt, Human
ugcaccauuuaaaaacagg

SEQ ID NO: 1914239 - RNA, 20 nt, Human
ugcacacauuuuuuaaaugc

SEQ ID NO: 1914240 - RNA, 10 nt, Human
ugcacacauu

SEQ ID NO: 1914241 - RNA, 15 nt, Human
ugcacgugugugcac

SEQ ID NO: 1914242 - RNA, 14 nt, Human
ugcacgugugugca

SEQ ID NO: 1914243 - RNA, 16 nt, Human
ugcacccucaggcagg

SEQ ID NO: 1914244 - RNA, 17 nt, Human
ugcacccucaggcaggu

SEQ ID NO: 1914245 - RNA, 23 nt, Human
agcccugguggcagugggagcug

SEQ ID NO: 1914246 - RNA, 22 nt, Human
agcccugguggcagugggagcu

SEQ ID NO: 1914247 - RNA, 15 nt, Human
ugcacaagcugcacc

SEQ ID NO: 1914248 - RNA, 18 nt, Human
ugcacaagcugcacccuc

SEQ ID NO: 1914249 - RNA, 21 nt, Human
ugcacaagcugcacccucagg

SEQ ID NO: 1914250 - RNA, 21 nt, Human
agcccugguggcagugggagc

SEQ ID NO: 1914251 - RNA, 17 nt, Human
agccccuugagaaaccu

SEQ ID NO: 1914252 - RNA, 15 nt, Human
agccccuucugcuca

SEQ ID NO: 1914253 - RNA, 16 nt, Human
agccccuucugcucag

SEQ ID NO: 1914254 - RNA, 19 nt, Human
agccccuucugcucagcuc

SEQ ID NO: 1914255 - RNA, 22 nt, Human
agccccuucugcucagcucugg

SEQ ID NO: 1914256 - RNA, 20 nt, Human
agccccuucugacccaugcu

SEQ ID NO: 1914257 - RNA, 24 nt, Human
agccccuucugacccaugcugccc

SEQ ID NO: 1914258 - RNA, 22 nt, Human
agccccuggaugcagccucaca

SEQ ID NO: 1914259 - RNA, 19 nt, Human
agccccuggaugcagccuc

SEQ ID NO: 1914260 - RNA, 17 nt, Human
agccccuggaugcagcc

SEQ ID NO: 1914261 - RNA, 18 nt, Human
agccccuggaugcagccu

SEQ ID NO: 1914262 - RNA, 16 nt, Human
agccccgaggccuucu

SEQ ID NO: 1914263 - RNA, 19 nt, Human
agcccccagcuaagaaccu

SEQ ID NO: 1914264 - RNA, 20 nt, Human
agcccccagcuaagaaccug

SEQ ID NO: 1914265 - RNA, 22 nt, Human
agcccccagcuaagaaccugga

SEQ ID NO: 1914266 - RNA, 22 nt, Human
agccccgaggccuucucugaag

SEQ ID NO: 1914267 - RNA, 17 nt, Human
agccccgaggccuucuc

SEQ ID NO: 1914268 - RNA, 24 nt, Human
agccccaaaacucuccucugcugc

SEQ ID NO: 1914269 - RNA, 19 nt, Human
agcccccaccgugggcagg

SEQ ID NO: 1914270 - RNA, 12 nt, Human
agcccccagcua

SEQ ID NO: 1914271 - RNA, 21 nt, Human
agccccaaaacucuccucugc

SEQ ID NO: 1914272 - RNA, 22 nt, Human
agccccaaaacucuccucugcu

SEQ ID NO: 1914273 - RNA, 20 nt, Human
agccccaaaacucuccucug

SEQ ID NO: 1914274 - RNA, 18 nt, Human
agcccauggcacucuaug

SEQ ID NO: 1914275 - RNA, 20 nt, Human
ugauucuccugccucagccu

SEQ ID NO: 1914276 - RNA, 18 nt, Human
agcccaguucagcuuggg

SEQ ID NO: 1914277 - RNA, 19 nt, Human
ugauucuccugccucagcc

SEQ ID NO: 1914278 - RNA, 15 nt, Human
ugauucuccugccuc

SEQ ID NO: 1914279 - RNA, 21 nt, Human
ugauucuauuuauauguacau

SEQ ID NO: 1914280 - RNA, 22 nt, Human
ugauucuauuuauauguacaug

SEQ ID NO: 1914281 - RNA, 23 nt, Human
ugcacuauagccuaggugacaga

SEQ ID NO: 1914282 - RNA, 23 nt, Human
agcccuucuaccuuccugcaaca

SEQ ID NO: 1914283 - RNA, 16 nt, Human
agccucccaaagugcu

SEQ ID NO: 1914284 - RNA, 20 nt, Human
agccucauguccacugguuc

SEQ ID NO: 1914285 - RNA, 23 nt, Human
agccucagcauccuggcacccgg

SEQ ID NO: 1914286 - RNA, 22 nt, Human
agccucagcauccuggcacccg

SEQ ID NO: 1914287 - RNA, 12 nt, Human
agccucaucucu

SEQ ID NO: 1914288 - RNA, 15 nt, Human
agccucauguccacu

SEQ ID NO: 1914289 - RNA, 21 nt, Human
agccucagcauccuggcaccc

SEQ ID NO: 1914290 - RNA, 20 nt, Human
agccucagcauccuggcacc

SEQ ID NO: 1914291 - RNA, 19 nt, Human
agccucagcauccuggcac

SEQ ID NO: 1914292 - RNA, 17 nt, Human
agccucagcauccuggc

SEQ ID NO: 1914293 - RNA, 17 nt, Human
agccucccaaagugcug

SEQ ID NO: 1914294 - RNA, 22 nt, Human
agccugaaggggcgucuguucc

SEQ ID NO: 1914295 - RNA, 22 nt, Human
agccugaaagaggaaugaagua

SEQ ID NO: 1914296 - RNA, 16 nt, Human
ugcagccucacagucc

SEQ ID NO: 1914297 - RNA, 13 nt, Human
ugcagccucacag

SEQ ID NO: 1914298 - RNA, 15 nt, Human
ugcagccucacaguc

SEQ ID NO: 1914299 - RNA, 14 nt, Human
ugcagccugcgcca

SEQ ID NO: 1914300 - RNA, 22 nt, Human
ugcauaacguauaaaagccugu

SEQ ID NO: 1914301 - RNA, 23 nt, Human
ugcauaacguauaaaagccuguu

SEQ ID NO: 1914302 - RNA, 14 nt, Human
ugcauaaguuaacu

SEQ ID NO: 1914303 - RNA, 17 nt, Human
ugcauaaguuaacuucc

SEQ ID NO: 1914304 - RNA, 14 nt, Human
ugcaguaaaucuuu

SEQ ID NO: 1914305 - RNA, 15 nt, Human
ugcaguaaaucuuuu

SEQ ID NO: 1914306 - RNA, 18 nt, Human
ugcaguaaaucuuuuaca

SEQ ID NO: 1914307 - RNA, 21 nt, Human
ugcaguaaaucuuuuacaacu

SEQ ID NO: 1914308 - RNA, 12 nt, Human
ugcaggucccua

SEQ ID NO: 1914309 - RNA, 14 nt, Human
ugcaggucccuaau

SEQ ID NO: 1914310 - RNA, 15 nt, Human
ugcaggucccuaaua

SEQ ID NO: 1914311 - RNA, 16 nt, Human
ugcaggucccuaauaa

SEQ ID NO: 1914312 - RNA, 17 nt, Human
aggagcugggagccggg

SEQ ID NO: 1914313 - RNA, 18 nt, Human
aggagcugggagccgggc

SEQ ID NO: 1914314 - RNA, 15 nt, Human
aggagcugggagccg

SEQ ID NO: 1914315 - RNA, 12 nt, Human
aggagcugggga

SEQ ID NO: 1914316 - RNA, 20 nt, Human
aggagcuggggaucccuccc

SEQ ID NO: 1914317 - RNA, 11 nt, Human
aggagcuuccu

SEQ ID NO: 1914318 - RNA, 16 nt, Human
aggagcuuccuguccu

SEQ ID NO: 1914319 - RNA, 21 nt, Human
aggagcuggggaucccucccc

SEQ ID NO: 1914320 - RNA, 20 nt, Human
aggagcuuccuguccuccca

SEQ ID NO: 1914321 - RNA, 22 nt, Human
aggagcugacucacaccugaac

SEQ ID NO: 1914322 - RNA, 13 nt, Human
aggauccugagcc

SEQ ID NO: 1914323 - RNA, 14 nt, Human
aggauccugagcca

SEQ ID NO: 1914324 - RNA, 14 nt, Human
aggauagaugcugg

SEQ ID NO: 1914325 - RNA, 13 nt, Human
aggauacugcugc

SEQ ID NO: 1914326 - RNA, 19 nt, Human
uggaagggauggggugcca

SEQ ID NO: 1914327 - RNA, 20 nt, Human
uggaagcuucuggugaccuu

SEQ ID NO: 1914328 - RNA, 17 nt, Human
uggaagguauuuaauag

SEQ ID NO: 1914329 - RNA, 13 nt, Human
uggaagguauuua

SEQ ID NO: 1914330 - RNA, 18 nt, Human
uggaaguacuauaauuua

SEQ ID NO: 1914331 - RNA, 16 nt, Human
uggaagcacagcuuca

SEQ ID NO: 1914332 - RNA, 17 nt, Human
uggaaaugggcagagca

SEQ ID NO: 1914333 - RNA, 18 nt, Human
uggaaaugggcagagcag

SEQ ID NO: 1914334 - RNA, 21 nt, Human
ugcuugaggcaacucaucuua

SEQ ID NO: 1914335 - RNA, 20 nt, Human
aggacauaaauuagaggucu

SEQ ID NO: 1914336 - RNA, 13 nt, Human
aggacauaauggg

SEQ ID NO: 1914337 - RNA, 20 nt, Human
aggacauaaugggguccugg

SEQ ID NO: 1914338 - RNA, 15 nt, Human
aggacauaauggggu

SEQ ID NO: 1914339 - RNA, 14 nt, Human
ugcuugagucaggu

SEQ ID NO: 1914340 - RNA, 20 nt, Human
ugcuugagucagguuugagu

SEQ ID NO: 1914341 - RNA, 23 nt, Human
ugcuugagucagguuugaguaga

SEQ ID NO: 1914342 - RNA, 19 nt, Human
aggacaguauuugugggga

SEQ ID NO: 1914343 - RNA, 12 nt, Human
aggacaguauuu

SEQ ID NO: 1914344 - RNA, 14 nt, Human
ugcuuggaggaagg

SEQ ID NO: 1914345 - RNA, 15 nt, Human
ugcuuggaggaagga

SEQ ID NO: 1914346 - RNA, 16 nt, Human
ugcuuggaggaaggaa

SEQ ID NO: 1914347 - RNA, 13 nt, Human
ugcuuguacauaa

SEQ ID NO: 1914348 - RNA, 12 nt, Human
ugcuuguacaua

SEQ ID NO: 1914349 - RNA, 17 nt, Human
ugcuuuuggucugugug

SEQ ID NO: 1914350 - RNA, 14 nt, Human
ugcuuuuggucugu

SEQ ID NO: 1914351 - RNA, 21 nt, Human
ugcuuuuggggggcauauauu

SEQ ID NO: 1914352 - RNA, 16 nt, Human
ugcuuugugauuuuug

SEQ ID NO: 1914353 - RNA, 14 nt, Human
ugcuuugugauuuu

SEQ ID NO: 1914354 - RNA, 12 nt, Human
ugcuuugugauu

SEQ ID NO: 1914355 - RNA, 22 nt, Human
ugcuuguacauaaugcgugcau

SEQ ID NO: 1914356 - RNA, 15 nt, Human
ugcuuguauagguuu

SEQ ID NO: 1914357 - RNA, 16 nt, Human
ugcuuguacauaaugc

SEQ ID NO: 1914358 - RNA, 14 nt, Human
ugcuuguacauaau

SEQ ID NO: 1914359 - RNA, 12 nt, Human
aggcaccucaag

SEQ ID NO: 1914360 - RNA, 18 nt, Human
aggcaccucaagaagaag

SEQ ID NO: 1914361 - RNA, 20 nt, Human
aggcaccucacaggccccag

SEQ ID NO: 1914362 - RNA, 22 nt, Human
aggcacccaccaucaugucugg

SEQ ID NO: 1914363 - RNA, 21 nt, Human
aggcacccaccaucaugucug

SEQ ID NO: 1914364 - RNA, 20 nt, Human
aggcacccaccaucaugucu

SEQ ID NO: 1914365 - RNA, 14 nt, Human
aggcaaugcuggcu

SEQ ID NO: 1914366 - RNA, 13 nt, Human
aggcaaucauggu

SEQ ID NO: 1914367 - RNA, 17 nt, Human
aggcaagguuauaugca

SEQ ID NO: 1914368 - RNA, 13 nt, Human
uggagaagcggcu

SEQ ID NO: 1914369 - RNA, 22 nt, Human
uggagaagcggcuggcagccca

SEQ ID NO: 1914370 - RNA, 23 nt, Human
uggagaagccacaggccugagau

SEQ ID NO: 1914371 - RNA, 22 nt, Human
uggagaagccacaggccugaga

SEQ ID NO: 1914372 - RNA, 15 nt, Human
uggacugugugcuca

SEQ ID NO: 1914373 - RNA, 20 nt, Human
uggacuuguccucagcagcu

SEQ ID NO: 1914374 - RNA, 15 nt, Human
uggacuuguccucag

SEQ ID NO: 1914375 - RNA, 13 nt, Human
uggacacaggccu

SEQ ID NO: 1914376 - RNA, 15 nt, Human
uggacacaggccugc

SEQ ID NO: 1914377 - RNA, 23 nt, Human
uggacacagcucuucuccaggcu

SEQ ID NO: 1914378 - RNA, 16 nt, Human
uggacccugaggccca

SEQ ID NO: 1914379 - RNA, 18 nt, Human
uggacccugaggcccaga

SEQ ID NO: 1914380 - RNA, 19 nt, Human
uggacccugaggcccagag

SEQ ID NO: 1914381 - RNA, 20 nt, Human
uggacccugaggcccagagg

SEQ ID NO: 1914382 - RNA, 21 nt, Human
uggacccugaggcccagaggg

SEQ ID NO: 1914383 - RNA, 23 nt, Human
uggacccuguggaugauaaaaca

SEQ ID NO: 1914384 - RNA, 15 nt, Human
uggacccugaggccc

SEQ ID NO: 1914385 - RNA, 15 nt, Human
uggaccuuaggccuu

SEQ ID NO: 1914386 - RNA, 16 nt, Human
uggaccuuaggccuuc

SEQ ID NO: 1914387 - RNA, 17 nt, Human
uggaccuuaggccuucc

SEQ ID NO: 1914388 - RNA, 19 nt, Human
uggaccuuaggccuuccuc

SEQ ID NO: 1914389 - RNA, 21 nt, Human
uggaccuuaggccuuccucuc

SEQ ID NO: 1914390 - RNA, 20 nt, Human
uggaccuugaacuggguacu

SEQ ID NO: 1914391 - RNA, 16 nt, Human
aggcaaaggguccaga

SEQ ID NO: 1914392 - RNA, 19 nt, Human
aggcaaaggguccagaagg

SEQ ID NO: 1914393 - RNA, 20 nt, Human
aggcaaaggguccagaagga

SEQ ID NO: 1914394 - RNA, 20 nt, Human
uggaauuauuuuaaaagaua

SEQ ID NO: 1914395 - RNA, 19 nt, Human
aggaucucuugagccuggg

SEQ ID NO: 1914396 - RNA, 19 nt, Human
aggcaaaauugcaaaucuu

SEQ ID NO: 1914397 - RNA, 20 nt, Human
aggcaaaauugcaaaucuug

SEQ ID NO: 1914398 - RNA, 17 nt, Human
aggaucucuugagccug

SEQ ID NO: 1914399 - RNA, 18 nt, Human
aggaucucuugagccugg

SEQ ID NO: 1914400 - RNA, 14 nt, Human
uggacacagcucuu

SEQ ID NO: 1914401 - RNA, 13 nt, Human
uggacacagcucu

SEQ ID NO: 1914402 - RNA, 22 nt, Human
uggacacagcucuucuccaggc

SEQ ID NO: 1914403 - RNA, 21 nt, Human
uggacacagcucuucuccagg

SEQ ID NO: 1914404 - RNA, 19 nt, Human
uggaauugauuugcauuga

SEQ ID NO: 1914405 - RNA, 20 nt, Human
uggaauugauuugcauugaa

SEQ ID NO: 1914406 - RNA, 22 nt, Human
uggaauugauuugcauugaaca

SEQ ID NO: 1914407 - RNA, 12 nt, Human
uggaauugauuu

SEQ ID NO: 1914408 - RNA, 15 nt, Human
uggaauugauuugca

SEQ ID NO: 1914409 - RNA, 16 nt, Human
uggaauugauuugcau

SEQ ID NO: 1914410 - RNA, 17 nt, Human
uggaauugauuugcauu

SEQ ID NO: 1914411 - RNA, 18 nt, Human
uggaauugauuugcauug

SEQ ID NO: 1914412 - RNA, 12 nt, Human
aggccccugcca

SEQ ID NO: 1914413 - RNA, 16 nt, Human
aggccugagauuucau

SEQ ID NO: 1914414 - RNA, 17 nt, Human
aggccccgcccaggcuu

SEQ ID NO: 1914415 - RNA, 21 nt, Human
aggccccuauguaguccgugc

SEQ ID NO: 1914416 - RNA, 22 nt, Human
aggccugagcgcuccugccgca

SEQ ID NO: 1914417 - RNA, 21 nt, Human
aggccugagcgcuccugccgc

SEQ ID NO: 1914418 - RNA, 19 nt, Human
aggccugagcgcuccugcc

SEQ ID NO: 1914419 - RNA, 18 nt, Human
aggccugagcgcuccugc

SEQ ID NO: 1914420 - RNA, 14 nt, Human
aggccugagcgcuc

SEQ ID NO: 1914421 - RNA, 23 nt, Human
aggccugagauuucaucugcucu

SEQ ID NO: 1914422 - RNA, 22 nt, Human
aggccugagauuucaucugcuc

SEQ ID NO: 1914423 - RNA, 21 nt, Human
aggccugagauuucaucugcu

SEQ ID NO: 1914424 - RNA, 20 nt, Human
aggccugagauuucaucugc

SEQ ID NO: 1914425 - RNA, 19 nt, Human
aggccugagauuucaucug

SEQ ID NO: 1914426 - RNA, 17 nt, Human
aggccugagauuucauc

SEQ ID NO: 1914427 - RNA, 23 nt, Human
uggccagugugacaaggauugcu

SEQ ID NO: 1914428 - RNA, 13 nt, Human
uggccaucccaca

SEQ ID NO: 1914429 - RNA, 22 nt, Human
uggccaugaagaggaugcugug

SEQ ID NO: 1914430 - RNA, 23 nt, Human
uggccaaagccaaagcuaggccu

SEQ ID NO: 1914431 - RNA, 21 nt, Human
uggccaaagccaaagcuaggc

SEQ ID NO: 1914432 - RNA, 16 nt, Human
uggccaaacaaguguu

SEQ ID NO: 1914433 - RNA, 17 nt, Human
uggccacaguagucuug

SEQ ID NO: 1914434 - RNA, 14 nt, Human
uggccuucggccuc

SEQ ID NO: 1914435 - RNA, 20 nt, Human
aggccugggggcugggcaga

SEQ ID NO: 1914436 - RNA, 12 nt, Human
aggccuggggac

SEQ ID NO: 1914437 - RNA, 18 nt, Human
aggccugggggcugggca

SEQ ID NO: 1914438 - RNA, 18 nt, Human
uggccuggccccucaggg

SEQ ID NO: 1914439 - RNA, 21 nt, Human
uggccuggccccucagggucc

SEQ ID NO: 1914440 - RNA, 21 nt, Human
uggccuguucuucuauggguu

SEQ ID NO: 1914441 - RNA, 18 nt, Human
uggccugagcugggauga

SEQ ID NO: 1914442 - RNA, 21 nt, Human
uggccugaagaguccucugaa

SEQ ID NO: 1914443 - RNA, 13 nt, Human
uggccucuucaga

SEQ ID NO: 1914444 - RNA, 23 nt, Human
uggccgggcgcgguggcucacgc

SEQ ID NO: 1914445 - RNA, 13 nt, Human
uggcccacgcacu

SEQ ID NO: 1914446 - RNA, 17 nt, Human
uggccaugaugacaacu

SEQ ID NO: 1914447 - RNA, 14 nt, Human
uggccaugccucag

SEQ ID NO: 1914448 - RNA, 15 nt, Human
uggccaugccucagc

SEQ ID NO: 1914449 - RNA, 17 nt, Human
uggccaugccucagccc

SEQ ID NO: 1914450 - RNA, 18 nt, Human
uggccaugccucagcccu

SEQ ID NO: 1914451 - RNA, 20 nt, Human
uggccaugccucagcccuga

SEQ ID NO: 1914452 - RNA, 14 nt, Human
aggccagagggagu

SEQ ID NO: 1914453 - RNA, 19 nt, Human
aggccacaagacccuugug

SEQ ID NO: 1914454 - RNA, 17 nt, Human
aggccacaagacccuug

SEQ ID NO: 1914455 - RNA, 18 nt, Human
aggccacaagacccuugu

SEQ ID NO: 1914456 - RNA, 17 nt, Human
uggcagccuuggcaaac

SEQ ID NO: 1914457 - RNA, 15 nt, Human
uggcagcucaccucu

SEQ ID NO: 1914458 - RNA, 16 nt, Human
aggccacaagacccuu

SEQ ID NO: 1914459 - RNA, 19 nt, Human
uggcagcucaccucucccu

SEQ ID NO: 1914460 - RNA, 20 nt, Human
aggccagagggagugacaga

SEQ ID NO: 1914461 - RNA, 21 nt, Human
aggcccagagggccugcaagg

SEQ ID NO: 1914462 - RNA, 16 nt, Human
aggccccgcccaggcu

SEQ ID NO: 1914463 - RNA, 12 nt, Human
aggccccagccu

SEQ ID NO: 1914464 - RNA, 13 nt, Human
aggccccagccuc

SEQ ID NO: 1914465 - RNA, 14 nt, Human
aggccccagccucc

SEQ ID NO: 1914466 - RNA, 17 nt, Human
aggcccaguucacccug

SEQ ID NO: 1914467 - RNA, 17 nt, Human
aggcagccccauucugc

SEQ ID NO: 1914468 - RNA, 16 nt, Human
aggcagccccauucug

SEQ ID NO: 1914469 - RNA, 18 nt, Human
aggcagccaggccacaag

SEQ ID NO: 1914470 - RNA, 16 nt, Human
aggccaaaggaagcac

SEQ ID NO: 1914471 - RNA, 18 nt, Human
aggccaaaggaagcacau

SEQ ID NO: 1914472 - RNA, 19 nt, Human
aggccaaaggaagcacaug

SEQ ID NO: 1914473 - RNA, 16 nt, Human
aggccaaggugggagg

SEQ ID NO: 1914474 - RNA, 18 nt, Human
aggccaaggcggguggau

SEQ ID NO: 1914475 - RNA, 20 nt, Human
uggagguacgaaaagagggg

SEQ ID NO: 1914476 - RNA, 18 nt, Human
uggaugggggaacucaga

SEQ ID NO: 1914477 - RNA, 21 nt, Human
uggaugggggaacucagaucc

SEQ ID NO: 1914478 - RNA, 22 nt, Human
uggaugggggaacucagaucca

SEQ ID NO: 1914479 - RNA, 14 nt, Human
uggaguauauguca

SEQ ID NO: 1914480 - RNA, 17 nt, Human
uggauuauauuaugaag

SEQ ID NO: 1914481 - RNA, 13 nt, Human
uggauuggauuug

SEQ ID NO: 1914482 - RNA, 14 nt, Human
uggauugggguccc

SEQ ID NO: 1914483 - RNA, 21 nt, Human
uggauuguccccgacccuugc

SEQ ID NO: 1914484 - RNA, 13 nt, Human
uggauuguccccg

SEQ ID NO: 1914485 - RNA, 19 nt, Human
ugcuccuccuuggugccug

SEQ ID NO: 1914486 - RNA, 16 nt, Human
ugcucuggacaggcau

SEQ ID NO: 1914487 - RNA, 15 nt, Human
ugcucuggacaggca

SEQ ID NO: 1914488 - RNA, 14 nt, Human
ugcucuggacaggc

SEQ ID NO: 1914489 - RNA, 14 nt, Human
ugcuccuagaggga

SEQ ID NO: 1914490 - RNA, 24 nt, Human
ugcuccuagagggaggggccuagg

SEQ ID NO: 1914491 - RNA, 20 nt, Human
ugcuccuagagggaggggcc

SEQ ID NO: 1914492 - RNA, 19 nt, Human
ugcucauucuaaugauggc

SEQ ID NO: 1914493 - RNA, 21 nt, Human
ugcucauucuaaugauggccc

SEQ ID NO: 1914494 - RNA, 23 nt, Human
ugcucauucuaaugauggcccau

SEQ ID NO: 1914495 - RNA, 20 nt, Human
ugcuaucucccccagcccca

SEQ ID NO: 1914496 - RNA, 18 nt, Human
ugcuauuguagagccaga

SEQ ID NO: 1914497 - RNA, 19 nt, Human
ugcuaucucccccagcccc

SEQ ID NO: 1914498 - RNA, 13 nt, Human
agcuuuaaaagaa

SEQ ID NO: 1914499 - RNA, 15 nt, Human
agcuuuaaaagaaaa

SEQ ID NO: 1914500 - RNA, 14 nt, Human
agcuuuaccagcug

SEQ ID NO: 1914501 - RNA, 12 nt, Human
aggaagcucagg

SEQ ID NO: 1914502 - RNA, 22 nt, Human
aggaagcccccaccgugggcag

SEQ ID NO: 1914503 - RNA, 23 nt, Human
aggaaggaaacccagcucugguc

SEQ ID NO: 1914504 - RNA, 20 nt, Human
aggaaggaaacccagcucug

SEQ ID NO: 1914505 - RNA, 22 nt, Human
aggaaggaaacccagcucuggu

SEQ ID NO: 1914506 - RNA, 18 nt, Human
aggaagccgcuggggcca

SEQ ID NO: 1914507 - RNA, 19 nt, Human
aggaagccgcuggggccag

SEQ ID NO: 1914508 - RNA, 20 nt, Human
aggaagccgcuggggccagu

SEQ ID NO: 1914509 - RNA, 22 nt, Human
aggaagcacaugccucucucag

SEQ ID NO: 1914510 - RNA, 21 nt, Human
aggaagccagcaggcucucag

SEQ ID NO: 1914511 - RNA, 22 nt, Human
aggaagccagcaggcucucagg

SEQ ID NO: 1914512 - RNA, 23 nt, Human
aggaagccagcaggcucucaggc

SEQ ID NO: 1914513 - RNA, 16 nt, Human
ugcugacuguuuucuc

SEQ ID NO: 1914514 - RNA, 13 nt, Human
aggaaaggcucca

SEQ ID NO: 1914515 - RNA, 14 nt, Human
aggaaaggcuccag

SEQ ID NO: 1914516 - RNA, 15 nt, Human
aggaaaggcuccagg

SEQ ID NO: 1914517 - RNA, 16 nt, Human
aggaaaggcuccagga

SEQ ID NO: 1914518 - RNA, 15 nt, Human
aggaaauagaauuga

SEQ ID NO: 1914519 - RNA, 11 nt, Human
aggaagcacau

SEQ ID NO: 1914520 - RNA, 16 nt, Human
aggaagcacaugccuc

SEQ ID NO: 1914521 - RNA, 17 nt, Human
aggaagcacaugccucu

SEQ ID NO: 1914522 - RNA, 15 nt, Human
aggaaaucaccgaaa

SEQ ID NO: 1914523 - RNA, 19 nt, Human
aggaaaucaccgaaaacgu

SEQ ID NO: 1914524 - RNA, 13 nt, Human
ugcugcccugccc

SEQ ID NO: 1914525 - RNA, 16 nt, Human
ugcugcccugcccacc

SEQ ID NO: 1914526 - RNA, 17 nt, Human
ugcugcccugcccaccu

SEQ ID NO: 1914527 - RNA, 18 nt, Human
ugcugcccugcccaccug

SEQ ID NO: 1914528 - RNA, 11 nt, Human
ugcugcccugu

SEQ ID NO: 1914529 - RNA, 19 nt, Human
ugcugcccugcccaccugg

SEQ ID NO: 1914530 - RNA, 21 nt, Human
ugcugcccugcccaccuggcc

SEQ ID NO: 1914531 - RNA, 20 nt, Human
ugcuggaguuucauguacaa

SEQ ID NO: 1914532 - RNA, 17 nt, Human
ugcugggauuacaggug

SEQ ID NO: 1914533 - RNA, 21 nt, Human
ugcugggauuacaagcgugag

SEQ ID NO: 1914534 - RNA, 23 nt, Human
ugcuguauccauccauggggcug

SEQ ID NO: 1914535 - RNA, 21 nt, Human
ugcuggcuguuggcugggggc

SEQ ID NO: 1914536 - RNA, 19 nt, Human
ugcuggcuguuggcugggg

SEQ ID NO: 1914537 - RNA, 19 nt, Human
ugcugggauuacaagcgug

SEQ ID NO: 1914538 - RNA, 19 nt, Human
aggacagauccagggacug

SEQ ID NO: 1914539 - RNA, 18 nt, Human
aggacacuaaccacgcug

SEQ ID NO: 1914540 - RNA, 16 nt, Human
ugcuuccagugaggcu

SEQ ID NO: 1914541 - RNA, 20 nt, Human
ugcuucaaggauccugagcc

SEQ ID NO: 1914542 - RNA, 21 nt, Human
ugcuucaaggauccugagcca

SEQ ID NO: 1914543 - RNA, 23 nt, Human
ugcuucaaggauccugagccaga

SEQ ID NO: 1914544 - RNA, 17 nt, Human
ugcugucccuuacguga

SEQ ID NO: 1914545 - RNA, 21 nt, Human
ugcuguauauuugugauagca

SEQ ID NO: 1914546 - RNA, 19 nt, Human
ugcugucccuuacgugagu

SEQ ID NO: 1914547 - RNA, 15 nt, Human
ugcugucccuuuucc

SEQ ID NO: 1914548 - RNA, 17 nt, Human
ugcugucccuuuuccuu

SEQ ID NO: 1914549 - RNA, 21 nt, Human
ugcuucaaaaacauucuuaca

SEQ ID NO: 1914550 - RNA, 13 nt, Human
ugcuucaaaaaca

SEQ ID NO: 1914551 - RNA, 14 nt, Human
ugcuuagaaaagaa

SEQ ID NO: 1914552 - RNA, 19 nt, Human
ugcuuagaauccaaacuug

SEQ ID NO: 1914553 - RNA, 22 nt, Human
ugcggacagccacggccaggcc

SEQ ID NO: 1914554 - RNA, 23 nt, Human
ugcggacagccacggccaggcca

SEQ ID NO: 1914555 - RNA, 13 nt, Human
ugcggauggccgg

SEQ ID NO: 1914556 - RNA, 17 nt, Human
ugccuuuggcagaguuc

SEQ ID NO: 1914557 - RNA, 18 nt, Human
ugcgguccacccaggagc

SEQ ID NO: 1914558 - RNA, 22 nt, Human
ugcgggugaacaaagcagccac

SEQ ID NO: 1914559 - RNA, 23 nt, Human
ugcgggugaacaaagcagccacg

SEQ ID NO: 1914560 - RNA, 17 nt, Human
ugcggugcuaucucccc

SEQ ID NO: 1914561 - RNA, 21 nt, Human
ugcggugcuaucucccccagc

SEQ ID NO: 1914562 - RNA, 17 nt, Human
ugcgguccacccaggag

SEQ ID NO: 1914563 - RNA, 18 nt, Human
ugcgggugaacaaagcag

SEQ ID NO: 1914564 - RNA, 21 nt, Human
ugcgggugaacaaagcagcca

SEQ ID NO: 1914565 - RNA, 17 nt, Human
ugcggccuuuggcuuca

SEQ ID NO: 1914566 - RNA, 19 nt, Human
ugcggccuuuggcuucacg

SEQ ID NO: 1914567 - RNA, 20 nt, Human
ugcgggcuuccuccuggugu

SEQ ID NO: 1914568 - RNA, 11 nt, Human
ugcuacacacu

SEQ ID NO: 1914569 - RNA, 13 nt, Human
agcuguugagcug

SEQ ID NO: 1914570 - RNA, 14 nt, Human
agcuguugagcugu

SEQ ID NO: 1914571 - RNA, 15 nt, Human
agcuguugagcuguu

SEQ ID NO: 1914572 - RNA, 16 nt, Human
agcuguugagcuguuu

SEQ ID NO: 1914573 - RNA, 17 nt, Human
agcuguugagcuguuuu

SEQ ID NO: 1914574 - RNA, 19 nt, Human
agcuugaccgugaggccag

SEQ ID NO: 1914575 - RNA, 14 nt, Human
agcuucuuugccaa

SEQ ID NO: 1914576 - RNA, 10 nt, Human
agcuuagaac

SEQ ID NO: 1914577 - RNA, 18 nt, Human
agcuuguaaauagcucag

SEQ ID NO: 1914578 - RNA, 23 nt, Human
agcuuggggacaggggcaggagg

SEQ ID NO: 1914579 - RNA, 22 nt, Human
agcuugaggguugggcuggugu

SEQ ID NO: 1914580 - RNA, 18 nt, Human
agcuugaggguugggcug

SEQ ID NO: 1914581 - RNA, 14 nt, Human
agcuugaggguugg

SEQ ID NO: 1914582 - RNA, 20 nt, Human
agcugccuguucagcuccag

SEQ ID NO: 1914583 - RNA, 14 nt, Human
ugccuggauggggc

SEQ ID NO: 1914584 - RNA, 15 nt, Human
ugccuggauggggcu

SEQ ID NO: 1914585 - RNA, 22 nt, Human
agcugccuguucagcuccagcu

SEQ ID NO: 1914586 - RNA, 21 nt, Human
agcugccuguucagcuccagc

SEQ ID NO: 1914587 - RNA, 21 nt, Human
agcugcuugggcuucauccuc

SEQ ID NO: 1914588 - RNA, 21 nt, Human
agcugcuuuugucuaugggac

SEQ ID NO: 1914589 - RNA, 13 nt, Human
agcuggccccgcc

SEQ ID NO: 1914590 - RNA, 15 nt, Human
ugccucugccucuga

SEQ ID NO: 1914591 - RNA, 14 nt, Human
ugccucugccucug

SEQ ID NO: 1914592 - RNA, 13 nt, Human
ugccucugccucu

SEQ ID NO: 1914593 - RNA, 14 nt, Human
ugcccaggcagguc

SEQ ID NO: 1914594 - RNA, 13 nt, Human
ugcccaggcaggu

SEQ ID NO: 1914595 - RNA, 12 nt, Human
ugcccaggcagg

SEQ ID NO: 1914596 - RNA, 19 nt, Human
ugcccagcggacaguggca

SEQ ID NO: 1914597 - RNA, 20 nt, Human
ugcccagcggacaguggcag

SEQ ID NO: 1914598 - RNA, 21 nt, Human
ugcccagcggacaguggcagg

SEQ ID NO: 1914599 - RNA, 22 nt, Human
ugcccagcggacaguggcagga

SEQ ID NO: 1914600 - RNA, 16 nt, Human
ugccugcccaggcccc

SEQ ID NO: 1914601 - RNA, 15 nt, Human
ugccugcccaggccc

SEQ ID NO: 1914602 - RNA, 14 nt, Human
ugccugcccaggcc

SEQ ID NO: 1914603 - RNA, 15 nt, Human
ugccugcccuauucu

SEQ ID NO: 1914604 - RNA, 20 nt, Human
ugccuguucagcuccagcuc

SEQ ID NO: 1914605 - RNA, 18 nt, Human
ugccuguucagcuccagc

SEQ ID NO: 1914606 - RNA, 13 nt, Human
agcuguucagcug

SEQ ID NO: 1914607 - RNA, 14 nt, Human
agcuguucagcugg

SEQ ID NO: 1914608 - RNA, 14 nt, Human
agcuguuacugucu

SEQ ID NO: 1914609 - RNA, 20 nt, Human
agcugugugcucuccaagcc

SEQ ID NO: 1914610 - RNA, 15 nt, Human
ugccuuauggaacac

SEQ ID NO: 1914611 - RNA, 16 nt, Human
ugccuuauggaacacu

SEQ ID NO: 1914612 - RNA, 21 nt, Human
ugccuguucagcuccagcuca

SEQ ID NO: 1914613 - RNA, 19 nt, Human
ugccuguugggccaggagc

SEQ ID NO: 1914614 - RNA, 20 nt, Human
ugccuguugggccaggagcc

SEQ ID NO: 1914615 - RNA, 15 nt, Human
agcugggacuacagg

SEQ ID NO: 1914616 - RNA, 14 nt, Human
agcuggccccgccg

SEQ ID NO: 1914617 - RNA, 15 nt, Human
agcuggccccgccgc

SEQ ID NO: 1914618 - RNA, 18 nt, Human
agcuggccccgccgccug

SEQ ID NO: 1914619 - RNA, 19 nt, Human
agcuggccccgccgccugg

SEQ ID NO: 1914620 - RNA, 20 nt, Human
agcugugcucuggacaggca

SEQ ID NO: 1914621 - RNA, 19 nt, Human
agcugugcucuggacaggc

SEQ ID NO: 1914622 - RNA, 23 nt, Human
agcugugcucuggacaggcaugu

SEQ ID NO: 1914623 - RNA, 18 nt, Human
agcugugugcucuccaag

SEQ ID NO: 1914624 - RNA, 21 nt, Human
agcugugcucuggacaggcau

SEQ ID NO: 1914625 - RNA, 14 nt, Human
agcuguguggcagu

SEQ ID NO: 1914626 - RNA, 16 nt, Human
agcuguguggcagucu

SEQ ID NO: 1914627 - RNA, 16 nt, Human
ugggcugggcccacaa

SEQ ID NO: 1914628 - RNA, 18 nt, Human
ugggcuggguucuaccca

SEQ ID NO: 1914629 - RNA, 19 nt, Human
ugggcuggguucuacccag

SEQ ID NO: 1914630 - RNA, 15 nt, Human
uggggaaugaagaua

SEQ ID NO: 1914631 - RNA, 14 nt, Human
uggggaaugaagau

SEQ ID NO: 1914632 - RNA, 13 nt, Human
uggggaccucagg

SEQ ID NO: 1914633 - RNA, 17 nt, Human
uggggaccagagcugcc

SEQ ID NO: 1914634 - RNA, 18 nt, Human
uggggaccagagcugcca

SEQ ID NO: 1914635 - RNA, 22 nt, Human
uggggacaggggcaggaggaag

SEQ ID NO: 1914636 - RNA, 20 nt, Human
uggggacaggggcaggagga

SEQ ID NO: 1914637 - RNA, 14 nt, Human
uggggaccagagcu

SEQ ID NO: 1914638 - RNA, 15 nt, Human
uggggaccagagcug

SEQ ID NO: 1914639 - RNA, 23 nt, Human
agggcuucugccauuucugagau

SEQ ID NO: 1914640 - RNA, 18 nt, Human
ugggcucccuucccaccu

SEQ ID NO: 1914641 - RNA, 19 nt, Human
ugggcucccuucccaccuc

SEQ ID NO: 1914642 - RNA, 20 nt, Human
ugggcucccuucccaccucu

SEQ ID NO: 1914643 - RNA, 21 nt, Human
ugggcucccuucccaccucuc

SEQ ID NO: 1914644 - RNA, 14 nt, Human
ugggguacccacug

SEQ ID NO: 1914645 - RNA, 20 nt, Human
ugggggaacucagauccagg

SEQ ID NO: 1914646 - RNA, 18 nt, Human
ugggggaacucagaucca

SEQ ID NO: 1914647 - RNA, 20 nt, Human
uggggcugcaccggcuggcc

SEQ ID NO: 1914648 - RNA, 14 nt, Human
uggggcugauugua

SEQ ID NO: 1914649 - RNA, 16 nt, Human
uggggcugguucugua

SEQ ID NO: 1914650 - RNA, 20 nt, Human
ugggguacccacugcucugg

SEQ ID NO: 1914651 - RNA, 16 nt, Human
ugggguacccacugcu

SEQ ID NO: 1914652 - RNA, 15 nt, Human
ugggguacccacugc

SEQ ID NO: 1914653 - RNA, 17 nt, Human
uggggucacucuggcag

SEQ ID NO: 1914654 - RNA, 18 nt, Human
uggggucacucuggcagc

SEQ ID NO: 1914655 - RNA, 15 nt, Human
ugggguaugggagag

SEQ ID NO: 1914656 - RNA, 21 nt, Human
ugggguagguugggagaaugu

SEQ ID NO: 1914657 - RNA, 15 nt, Human
ugggguagguuggga

SEQ ID NO: 1914658 - RNA, 18 nt, Human
uggggcggugagagggga

SEQ ID NO: 1914659 - RNA, 20 nt, Human
uggggcuagggggagccccu

SEQ ID NO: 1914660 - RNA, 13 nt, Human
uggggcucuggga

SEQ ID NO: 1914661 - RNA, 15 nt, Human
uggggcccugccucc

SEQ ID NO: 1914662 - RNA, 16 nt, Human
uggggcccugccuccu

SEQ ID NO: 1914663 - RNA, 18 nt, Human
uggggccuacagcuuuga

SEQ ID NO: 1914664 - RNA, 12 nt, Human
uggggagaaagu

SEQ ID NO: 1914665 - RNA, 23 nt, Human
uggggaccucaggccugggggcu

SEQ ID NO: 1914666 - RNA, 14 nt, Human
uggggcccugccuc

SEQ ID NO: 1914667 - RNA, 16 nt, Human
uggggaguuaagaccu

SEQ ID NO: 1914668 - RNA, 17 nt, Human
uggggaguuaagaccug

SEQ ID NO: 1914669 - RNA, 18 nt, Human
uggggaguuaagaccugg

SEQ ID NO: 1914670 - RNA, 19 nt, Human
uggggaguuaagaccuggc

SEQ ID NO: 1914671 - RNA, 20 nt, Human
uggggaguuaagaccuggca

SEQ ID NO: 1914672 - RNA, 18 nt, Human
ugggcccacaaaggcaaa

SEQ ID NO: 1914673 - RNA, 15 nt, Human
agggagggcuucugc

SEQ ID NO: 1914674 - RNA, 12 nt, Human
agggaggggccu

SEQ ID NO: 1914675 - RNA, 19 nt, Human
agggagugacagaggcagc

SEQ ID NO: 1914676 - RNA, 21 nt, Human
agggcagcagaaggggguggu

SEQ ID NO: 1914677 - RNA, 15 nt, Human
agggcagcagaaggg

SEQ ID NO: 1914678 - RNA, 18 nt, Human
agggagugacagaggcag

SEQ ID NO: 1914679 - RNA, 17 nt, Human
agggagugacagaggca

SEQ ID NO: 1914680 - RNA, 17 nt, Human
agggaggugaccccagg

SEQ ID NO: 1914681 - RNA, 15 nt, Human
agggaggggccuagg

SEQ ID NO: 1914682 - RNA, 19 nt, Human
agggaggggccuaggccuc

SEQ ID NO: 1914683 - RNA, 20 nt, Human
agggaggggccuaggccuca

SEQ ID NO: 1914684 - RNA, 20 nt, Human
agggcagccgucaccccugc

SEQ ID NO: 1914685 - RNA, 14 nt, Human
agggcagcgccagg

SEQ ID NO: 1914686 - RNA, 16 nt, Human
agggcagcgccaggcu

SEQ ID NO: 1914687 - RNA, 20 nt, Human
agggcaggcccaaauuauca

SEQ ID NO: 1914688 - RNA, 20 nt, Human
agggcagucauuggcugucu

SEQ ID NO: 1914689 - RNA, 19 nt, Human
agggccgcccgggcccaga

SEQ ID NO: 1914690 - RNA, 18 nt, Human
agggccgggcagaggggc

SEQ ID NO: 1914691 - RNA, 20 nt, Human
agggccgcccgggcccagag

SEQ ID NO: 1914692 - RNA, 16 nt, Human
agggccgggcagaggg

SEQ ID NO: 1914693 - RNA, 20 nt, Human
agggccgccagggagaccug

SEQ ID NO: 1914694 - RNA, 23 nt, Human
agggccgccagggagaccuggac

SEQ ID NO: 1914695 - RNA, 20 nt, Human
agggccgggcagaggggcag

SEQ ID NO: 1914696 - RNA, 12 nt, Human
agggcccagagc

SEQ ID NO: 1914697 - RNA, 13 nt, Human
agggcccagagcc

SEQ ID NO: 1914698 - RNA, 14 nt, Human
agggcccagagccc

SEQ ID NO: 1914699 - RNA, 15 nt, Human
agggcccagagccca

SEQ ID NO: 1914700 - RNA, 16 nt, Human
agggcccagagcccag

SEQ ID NO: 1914701 - RNA, 23 nt, Human
agggcccagagaggguggugacc

SEQ ID NO: 1914702 - RNA, 23 nt, Human
ugggauugacagaagcuucugcc

SEQ ID NO: 1914703 - RNA, 16 nt, Human
ugggcaacccccagcc

SEQ ID NO: 1914704 - RNA, 20 nt, Human
ugggagguggagguugcagu

SEQ ID NO: 1914705 - RNA, 17 nt, Human
ugggauucaggaaugug

SEQ ID NO: 1914706 - RNA, 19 nt, Human
ugggagguugaucagaucu

SEQ ID NO: 1914707 - RNA, 18 nt, Human
ugggaggucaaggcugca

SEQ ID NO: 1914708 - RNA, 19 nt, Human
ugggaggucaaggcugcag

SEQ ID NO: 1914709 - RNA, 20 nt, Human
ugggaggucaaggcugcagu

SEQ ID NO: 1914710 - RNA, 23 nt, Human
ugggaggucaaggcugcagugag

SEQ ID NO: 1914711 - RNA, 17 nt, Human
ugggaggucaaggcugc

SEQ ID NO: 1914712 - RNA, 16 nt, Human
aggccuuccucucucc

SEQ ID NO: 1914713 - RNA, 18 nt, Human
aggccuuccucucuccag

SEQ ID NO: 1914714 - RNA, 19 nt, Human
aggccuuccucucuccaga

SEQ ID NO: 1914715 - RNA, 17 nt, Human
aggccuuaucuccaaga

SEQ ID NO: 1914716 - RNA, 19 nt, Human
aggccuuaucuccaagacc

SEQ ID NO: 1914717 - RNA, 15 nt, Human
aggccuuccucucuc

SEQ ID NO: 1914718 - RNA, 21 nt, Human
ugggcaacccccagccugcua

SEQ ID NO: 1914719 - RNA, 22 nt, Human
ugggcacacgccucccacuggg

SEQ ID NO: 1914720 - RNA, 20 nt, Human
ugggcaacccccagccugcu

SEQ ID NO: 1914721 - RNA, 17 nt, Human
ugggcaacccccagccu

SEQ ID NO: 1914722 - RNA, 22 nt, Human
ugggccacuucuggguggggca

SEQ ID NO: 1914723 - RNA, 14 nt, Human
ugggcacccacccu

SEQ ID NO: 1914724 - RNA, 16 nt, Human
ugggcacccacccugg

SEQ ID NO: 1914725 - RNA, 20 nt, Human
ugggcacccacccugggacc

SEQ ID NO: 1914726 - RNA, 13 nt, Human
ugggccagacaug

SEQ ID NO: 1914727 - RNA, 18 nt, Human
ugggccagacaugccaca

SEQ ID NO: 1914728 - RNA, 19 nt, Human
ugggccagacaugccacaa

SEQ ID NO: 1914729 - RNA, 13 nt, Human
ugggccaggagcc

SEQ ID NO: 1914730 - RNA, 20 nt, Human
ugggcccaaugcacuuuguu

SEQ ID NO: 1914731 - RNA, 18 nt, Human
ugggccauguugugccuc

SEQ ID NO: 1914732 - RNA, 19 nt, Human
ugggccauucuccacagca

SEQ ID NO: 1914733 - RNA, 20 nt, Human
ugggccauucuccacagcaa

SEQ ID NO: 1914734 - RNA, 14 nt, Human
ugggccaggagccu

SEQ ID NO: 1914735 - RNA, 16 nt, Human
ugggccaggagccucc

SEQ ID NO: 1914736 - RNA, 15 nt, Human
agggugugcccucac

SEQ ID NO: 1914737 - RNA, 22 nt, Human
aggguguccggucccuguccca

SEQ ID NO: 1914738 - RNA, 13 nt, Human
aggguuauaauaa

SEQ ID NO: 1914739 - RNA, 12 nt, Human
agggugugugcu

SEQ ID NO: 1914740 - RNA, 17 nt, Human
uggucugacccacugcu

SEQ ID NO: 1914741 - RNA, 16 nt, Human
uggucugacccacugc

SEQ ID NO: 1914742 - RNA, 14 nt, Human
uggucccaccccac

SEQ ID NO: 1914743 - RNA, 15 nt, Human
uggucccaccccaca

SEQ ID NO: 1914744 - RNA, 21 nt, Human
uggucagguauuucaguucuu

SEQ ID NO: 1914745 - RNA, 18 nt, Human
uggucaccaaaucagcug

SEQ ID NO: 1914746 - RNA, 22 nt, Human
uggucagauuugaacucuucaa

SEQ ID NO: 1914747 - RNA, 20 nt, Human
uggucaccaaaucagcugcu

SEQ ID NO: 1914748 - RNA, 10 nt, Human
uggucagccc

SEQ ID NO: 1914749 - RNA, 12 nt, Human
uggucagcccaa

SEQ ID NO: 1914750 - RNA, 11 nt, Human
uggucagccca

SEQ ID NO: 1914751 - RNA, 13 nt, Human
uggucccacucag

SEQ ID NO: 1914752 - RNA, 16 nt, Human
uggucccaccccacac

SEQ ID NO: 1914753 - RNA, 16 nt, Human
uggucucaaacucuug

SEQ ID NO: 1914754 - RNA, 23 nt, Human
uggucucaaacucuugaccucag

SEQ ID NO: 1914755 - RNA, 17 nt, Human
uggucucaaacucuuga

SEQ ID NO: 1914756 - RNA, 18 nt, Human
uggucucaaacuccugac

SEQ ID NO: 1914757 - RNA, 14 nt, Human
uggucuccacuggg

SEQ ID NO: 1914758 - RNA, 13 nt, Human
aggguugggcugg

SEQ ID NO: 1914759 - RNA, 23 nt, Human
aggguuggccccugcccggcugc

SEQ ID NO: 1914760 - RNA, 18 nt, Human
aggguuggccccugcccg

SEQ ID NO: 1914761 - RNA, 17 nt, Human
agguagaaauaucugaa

SEQ ID NO: 1914762 - RNA, 19 nt, Human
agguagaaauaucugaaaa

SEQ ID NO: 1914763 - RNA, 23 nt, Human
agguagaaauaucugaaaaugua

SEQ ID NO: 1914764 - RNA, 23 nt, Human
agguauaauucacauuguauuca

SEQ ID NO: 1914765 - RNA, 21 nt, Human
agguaugcaaucaaaucugcu

SEQ ID NO: 1914766 - RNA, 12 nt, Human
aggucagagccu

SEQ ID NO: 1914767 - RNA, 20 nt, Human
aggucauuuuuuuuaagaaa

SEQ ID NO: 1914768 - RNA, 17 nt, Human
aggucauuuuuuuuaag

SEQ ID NO: 1914769 - RNA, 20 nt, Human
agguauucaauauccuuugc

SEQ ID NO: 1914770 - RNA, 21 nt, Human
agggucucacucugucgccca

SEQ ID NO: 1914771 - RNA, 22 nt, Human
agggucucacucugucgcccag

SEQ ID NO: 1914772 - RNA, 21 nt, Human
ugggucgcccuggacugugug

SEQ ID NO: 1914773 - RNA, 15 nt, Human
agggugggagugggc

SEQ ID NO: 1914774 - RNA, 12 nt, Human
ugggucugugug

SEQ ID NO: 1914775 - RNA, 22 nt, Human
ugggugcuuggaggaaggaaac

SEQ ID NO: 1914776 - RNA, 22 nt, Human
uggguggcaccagcagccugga

SEQ ID NO: 1914777 - RNA, 15 nt, Human
ugggugcuuggagga

SEQ ID NO: 1914778 - RNA, 19 nt, Human
ugggugcuuggaggaagga

SEQ ID NO: 1914779 - RNA, 20 nt, Human
ugguaggaacugcugggcuu

SEQ ID NO: 1914780 - RNA, 13 nt, Human
ugguaggaacugc

SEQ ID NO: 1914781 - RNA, 17 nt, Human
ugguacucauuaaaaaa

SEQ ID NO: 1914782 - RNA, 16 nt, Human
ugguacuaacuuuccu

SEQ ID NO: 1914783 - RNA, 15 nt, Human
ugguaaucuugcucu

SEQ ID NO: 1914784 - RNA, 16 nt, Human
ugggugggcaggaaaa

SEQ ID NO: 1914785 - RNA, 16 nt, Human
uggguggggggcuuca

SEQ ID NO: 1914786 - RNA, 18 nt, Human
ugggugggcaggaaaagg

SEQ ID NO: 1914787 - RNA, 20 nt, Human
uggguggggaggaaauagaa

SEQ ID NO: 1914788 - RNA, 23 nt, Human
agggucucacuauguugcccagg

SEQ ID NO: 1914789 - RNA, 22 nt, Human
agggucucacuauguugcccag

SEQ ID NO: 1914790 - RNA, 21 nt, Human
agggucucacuauguugccca

SEQ ID NO: 1914791 - RNA, 24 nt, Human
agggguucccuuuuuuggcugcug

SEQ ID NO: 1914792 - RNA, 20 nt, Human
aggggugggacacccuguga

SEQ ID NO: 1914793 - RNA, 22 nt, Human
aggggugggacacccugugaug

SEQ ID NO: 1914794 - RNA, 15 nt, Human
aggggguggccuccc

SEQ ID NO: 1914795 - RNA, 17 nt, Human
aggggguggccucccaa

SEQ ID NO: 1914796 - RNA, 18 nt, Human
aggggguggccucccaac

SEQ ID NO: 1914797 - RNA, 20 nt, Human
uggggucacucuggcagcuc

SEQ ID NO: 1914798 - RNA, 19 nt, Human
uggggucacucuggcagcu

SEQ ID NO: 1914799 - RNA, 23 nt, Human
aggggcgccgcaaaccacacugg

SEQ ID NO: 1914800 - RNA, 23 nt, Human
aggggagcaaaaucgaugcagug

SEQ ID NO: 1914801 - RNA, 16 nt, Human
aggggcgucuguuccc

SEQ ID NO: 1914802 - RNA, 19 nt, Human
aggggcgucuguucccccu

SEQ ID NO: 1914803 - RNA, 21 nt, Human
aggggcgucuguucccccuuc

SEQ ID NO: 1914804 - RNA, 22 nt, Human
aggggcgucuguucccccuuca

SEQ ID NO: 1914805 - RNA, 20 nt, Human
aggggcgugggaguggccug

SEQ ID NO: 1914806 - RNA, 21 nt, Human
agggggagccccuucugcuca

SEQ ID NO: 1914807 - RNA, 22 nt, Human
agggggagccccuucugcucag

SEQ ID NO: 1914808 - RNA, 17 nt, Human
uguaccauguacaugaa

SEQ ID NO: 1914809 - RNA, 12 nt, Human
uguaccauguac

SEQ ID NO: 1914810 - RNA, 19 nt, Human
uguaccaugugcuacaggg

SEQ ID NO: 1914811 - RNA, 13 nt, Human
uguacuuugugcu

SEQ ID NO: 1914812 - RNA, 13 nt, Human
uguagagugggag

SEQ ID NO: 1914813 - RNA, 14 nt, Human
uguagagugggagc

SEQ ID NO: 1914814 - RNA, 18 nt, Human
uguagaggagaaacugga

SEQ ID NO: 1914815 - RNA, 11 nt, Human
uguagaaaaca

SEQ ID NO: 1914816 - RNA, 14 nt, Human
uguaauuugugaua

SEQ ID NO: 1914817 - RNA, 22 nt, Human
uguaauuuaaaauugugaugug

SEQ ID NO: 1914818 - RNA, 21 nt, Human
uguaauuuaaaauugugaugu

SEQ ID NO: 1914819 - RNA, 15 nt, Human
uguaauuguuugucu

SEQ ID NO: 1914820 - RNA, 19 nt, Human
uguaauuguuugucuuuaa

SEQ ID NO: 1914821 - RNA, 23 nt, Human
aguaaggaauuuuauuuuuuucu

SEQ ID NO: 1914822 - RNA, 19 nt, Human
aguaaaaauacaaaaauua

SEQ ID NO: 1914823 - RNA, 18 nt, Human
aguaaggaguucauuuua

SEQ ID NO: 1914824 - RNA, 20 nt, Human
aguaauaugcacacauuuuu

SEQ ID NO: 1914825 - RNA, 17 nt, Human
aguaauaugcacacauu

SEQ ID NO: 1914826 - RNA, 19 nt, Human
aguaauaugcacacauuuu

SEQ ID NO: 1914827 - RNA, 18 nt, Human
aguaauaugcacacauuu

SEQ ID NO: 1914828 - RNA, 12 nt, Human
aguaaaaauaca

SEQ ID NO: 1914829 - RNA, 13 nt, Human
aguaaaaauacaa

SEQ ID NO: 1914830 - RNA, 20 nt, Human
aguaagccgugauuuucauu

SEQ ID NO: 1914831 - RNA, 11 nt, Human
agguuuuccug

SEQ ID NO: 1914832 - RNA, 12 nt, Human
aguagagacagg

SEQ ID NO: 1914833 - RNA, 17 nt, Human
aguagaagucuuagaug

SEQ ID NO: 1914834 - RNA, 15 nt, Human
aguagaggcuuagag

SEQ ID NO: 1914835 - RNA, 18 nt, Human
uguaggaagguuaauguu

SEQ ID NO: 1914836 - RNA, 20 nt, Human
uguaggaagguuaauguuca

SEQ ID NO: 1914837 - RNA, 22 nt, Human
uguaggagcugccuuggcucag

SEQ ID NO: 1914838 - RNA, 12 nt, Human
uguaggagcugc

SEQ ID NO: 1914839 - RNA, 15 nt, Human
uguaggagcugccuu

SEQ ID NO: 1914840 - RNA, 14 nt, Human
aguacacuguuuca

SEQ ID NO: 1914841 - RNA, 20 nt, Human
aguacacuguuucaaacuuu

SEQ ID NO: 1914842 - RNA, 16 nt, Human
aguacacuguuucaaa

SEQ ID NO: 1914843 - RNA, 19 nt, Human
aguacuuuuggcauuuuac

SEQ ID NO: 1914844 - RNA, 22 nt, Human
aguacuuuggaggccccuaugu

SEQ ID NO: 1914845 - RNA, 19 nt, Human
aguacuuuggaggccccua

SEQ ID NO: 1914846 - RNA, 21 nt, Human
aguagaaagacagagcuggga

SEQ ID NO: 1914847 - RNA, 20 nt, Human
aguagaaagacagagcuggg

SEQ ID NO: 1914848 - RNA, 15 nt, Human
aguaauccaagcaaa

SEQ ID NO: 1914849 - RNA, 14 nt, Human
aguaauccaccugc

SEQ ID NO: 1914850 - RNA, 21 nt, Human
aguaauccaagcaaaugugaa

SEQ ID NO: 1914851 - RNA, 19 nt, Human
aguacaccacaagggucac

SEQ ID NO: 1914852 - RNA, 15 nt, Human
aguacaauucuuacu

SEQ ID NO: 1914853 - RNA, 14 nt, Human
aggugcagccagag

SEQ ID NO: 1914854 - RNA, 15 nt, Human
aggugcagccagagg

SEQ ID NO: 1914855 - RNA, 16 nt, Human
aggugcagccagaggc

SEQ ID NO: 1914856 - RNA, 17 nt, Human
aggugcagccagaggca

SEQ ID NO: 1914857 - RNA, 18 nt, Human
aggugcagccagaggcac

SEQ ID NO: 1914858 - RNA, 12 nt, Human
agguggccaugc

SEQ ID NO: 1914859 - RNA, 13 nt, Human
aggugcagccaga

SEQ ID NO: 1914860 - RNA, 21 nt, Human
aggugcacaagcuccaagcuc

SEQ ID NO: 1914861 - RNA, 20 nt, Human
aggugggauccuccaggugc

SEQ ID NO: 1914862 - RNA, 18 nt, Human
agguggccaugccucagc

SEQ ID NO: 1914863 - RNA, 19 nt, Human
agguggccaugccucagcc

SEQ ID NO: 1914864 - RNA, 23 nt, Human
aggucuugaacuccuggccucaa

SEQ ID NO: 1914865 - RNA, 18 nt, Human
agguccccagcuuuggcu

SEQ ID NO: 1914866 - RNA, 10 nt, Human
aggucccuaa

SEQ ID NO: 1914867 - RNA, 17 nt, Human
agguccccagcuuuggc

SEQ ID NO: 1914868 - RNA, 11 nt, Human
agguccccaga

SEQ ID NO: 1914869 - RNA, 11 nt, Human
aggucuuuccu

SEQ ID NO: 1914870 - RNA, 16 nt, Human
aggugcacaagcucca

SEQ ID NO: 1914871 - RNA, 17 nt, Human
aggugcacaagcuccaa

SEQ ID NO: 1914872 - RNA, 18 nt, Human
aggugcacaagcuccaag

SEQ ID NO: 1914873 - RNA, 20 nt, Human
aggugcacaagcuccaagcu

SEQ ID NO: 1914874 - RNA, 15 nt, Human
aggugcacaagcucc

SEQ ID NO: 1914875 - RNA, 13 nt, Human
aggugcaaccagg

SEQ ID NO: 1914876 - RNA, 15 nt, Human
aggugcaaccaggga

SEQ ID NO: 1914877 - RNA, 17 nt, Human
aggugguuauggagagg

SEQ ID NO: 1914878 - RNA, 23 nt, Human
agguugggagaaugucaguaugu

SEQ ID NO: 1914879 - RNA, 16 nt, Human
agguugaucagaucug

SEQ ID NO: 1914880 - RNA, 17 nt, Human
uguaacuuucugaaaua

SEQ ID NO: 1914881 - RNA, 19 nt, Human
uguaacuuccaugugaggg

SEQ ID NO: 1914882 - RNA, 14 nt, Human
agguuggugggggc

SEQ ID NO: 1914883 - RNA, 19 nt, Human
uguaagaacuacaaacaaa

SEQ ID NO: 1914884 - RNA, 20 nt, Human
uguaagaucguucucugccu

SEQ ID NO: 1914885 - RNA, 19 nt, Human
uguaagaucguucucugcc

SEQ ID NO: 1914886 - RNA, 15 nt, Human
uguaaguaaacgguc

SEQ ID NO: 1914887 - RNA, 23 nt, Human
uguaauuaaguacuauguaucaa

SEQ ID NO: 1914888 - RNA, 20 nt, Human
uguaauuuaaaauugugaug

SEQ ID NO: 1914889 - RNA, 18 nt, Human
uguaauuuaaaauuguga

SEQ ID NO: 1914890 - RNA, 17 nt, Human
uguaauuuaaaauugug

SEQ ID NO: 1914891 - RNA, 16 nt, Human
agucuagacuaaaaga

SEQ ID NO: 1914892 - RNA, 17 nt, Human
agucuagauggcuccuc

SEQ ID NO: 1914893 - RNA, 18 nt, Human
agucuagauggcuccucu

SEQ ID NO: 1914894 - RNA, 19 nt, Human
agucuagauggcuccucuc

SEQ ID NO: 1914895 - RNA, 20 nt, Human
agucuagauggcuccucuca

SEQ ID NO: 1914896 - RNA, 17 nt, Human
agucucacuguugccca

SEQ ID NO: 1914897 - RNA, 16 nt, Human
agucucacuguugccc

SEQ ID NO: 1914898 - RNA, 23 nt, Human
aguccgaaagggacuuggaagcu

SEQ ID NO: 1914899 - RNA, 22 nt, Human
aguccgugcugacagcugcucc

SEQ ID NO: 1914900 - RNA, 23 nt, Human
aguccgugcugacagcugcuccu

SEQ ID NO: 1914901 - RNA, 21 nt, Human
aguccgugcugacagcugcuc

SEQ ID NO: 1914902 - RNA, 20 nt, Human
aguccgugcugacagcugcu

SEQ ID NO: 1914903 - RNA, 12 nt, Human
agucccugccaa

SEQ ID NO: 1914904 - RNA, 23 nt, Human
agucccugaggcagguccccaga

SEQ ID NO: 1914905 - RNA, 22 nt, Human
agucccugaggcagguccccag

SEQ ID NO: 1914906 - RNA, 22 nt, Human
aguccaggcuuuuuuaucaugu

SEQ ID NO: 1914907 - RNA, 20 nt, Human
agucccugaggcaggucccc

SEQ ID NO: 1914908 - RNA, 19 nt, Human
agucccugaggcagguccc

SEQ ID NO: 1914909 - RNA, 22 nt, Human
ugucuaaacaaugcugauuugg

SEQ ID NO: 1914910 - RNA, 20 nt, Human
ugucuaaacaaugcugauuu

SEQ ID NO: 1914911 - RNA, 21 nt, Human
ugucuaaacaaugcugauuug

SEQ ID NO: 1914912 - RNA, 22 nt, Human
agucagaaguuucugccgcagc

SEQ ID NO: 1914913 - RNA, 18 nt, Human
ugucuaaaaaacaaaaca

SEQ ID NO: 1914914 - RNA, 16 nt, Human
ugucuaaacaaugcug

SEQ ID NO: 1914915 - RNA, 17 nt, Human
ugucuaaacaaugcuga

SEQ ID NO: 1914916 - RNA, 13 nt, Human
ugucuaaaaaaca

SEQ ID NO: 1914917 - RNA, 14 nt, Human
ugucuaaaaaacaa

SEQ ID NO: 1914918 - RNA, 19 nt, Human
agucagaauuagcugcuuc

SEQ ID NO: 1914919 - RNA, 15 nt, Human
ugucgcccagucugg

SEQ ID NO: 1914920 - RNA, 14 nt, Human
ugucgcccagucug

SEQ ID NO: 1914921 - RNA, 12 nt, Human
ugucgggcauga

SEQ ID NO: 1914922 - RNA, 14 nt, Human
ugucgggcaugaca

SEQ ID NO: 1914923 - RNA, 15 nt, Human
ugucgggcaugacac

SEQ ID NO: 1914924 - RNA, 16 nt, Human
uguccuacccacccuc

SEQ ID NO: 1914925 - RNA, 13 nt, Human
uguccgagcuuug

SEQ ID NO: 1914926 - RNA, 14 nt, Human
uguccgagcuuuga

SEQ ID NO: 1914927 - RNA, 22 nt, Human
uguccuaaaacaccugguagga

SEQ ID NO: 1914928 - RNA, 17 nt, Human
ugucccuuuuccuuuuu

SEQ ID NO: 1914929 - RNA, 19 nt, Human
ugucaagagggucugagga

SEQ ID NO: 1914930 - RNA, 15 nt, Human
ugucaagccauaauu

SEQ ID NO: 1914931 - RNA, 16 nt, Human
uguauuuuuuuacuaa

SEQ ID NO: 1914932 - RNA, 14 nt, Human
uguauuuuuuaaag

SEQ ID NO: 1914933 - RNA, 16 nt, Human
uguauuuuuuaaagcu

SEQ ID NO: 1914934 - RNA, 17 nt, Human
uguauuuuuuaaagcua

SEQ ID NO: 1914935 - RNA, 14 nt, Human
uguauuuuuuuacu

SEQ ID NO: 1914936 - RNA, 19 nt, Human
uguauuuuucaauaaagca

SEQ ID NO: 1914937 - RNA, 14 nt, Human
uguaguaauugaca

SEQ ID NO: 1914938 - RNA, 15 nt, Human
uguaguaauugacau

SEQ ID NO: 1914939 - RNA, 16 nt, Human
uguaguaauugacaug

SEQ ID NO: 1914940 - RNA, 17 nt, Human
aguaggaagacuuugga

SEQ ID NO: 1914941 - RNA, 18 nt, Human
aguaggaagacuuuggaa

SEQ ID NO: 1914942 - RNA, 19 nt, Human
aguaggaagacuuuggaaa

SEQ ID NO: 1914943 - RNA, 22 nt, Human
aguaggaagacuuuggaaagac

SEQ ID NO: 1914944 - RNA, 16 nt, Human
aguaggaagacuuugg

SEQ ID NO: 1914945 - RNA, 17 nt, Human
aguaggcucauuuacug

SEQ ID NO: 1914946 - RNA, 18 nt, Human
aguaggggaagacaugca

SEQ ID NO: 1914947 - RNA, 18 nt, Human
aguagugccuuuacuuca

SEQ ID NO: 1914948 - RNA, 23 nt, Human
ugucauuugcuggagcucugccc

SEQ ID NO: 1914949 - RNA, 22 nt, Human
ugucaguauguggaaguguggg

SEQ ID NO: 1914950 - RNA, 18 nt, Human
ugucaguauguggaagug

SEQ ID NO: 1914951 - RNA, 20 nt, Human
ugucaguauguggaagugug

SEQ ID NO: 1914952 - RNA, 19 nt, Human
ugucaguauguggaagugu

SEQ ID NO: 1914953 - RNA, 16 nt, Human
ugucagguggggcagc

SEQ ID NO: 1914954 - RNA, 22 nt, Human
ugucaggggcggggagggugac

SEQ ID NO: 1914955 - RNA, 19 nt, Human
ugucagcugaaccugggua

SEQ ID NO: 1914956 - RNA, 19 nt, Human
agucacugagacagcccgg

SEQ ID NO: 1914957 - RNA, 18 nt, Human
agucacugagacagcccg

SEQ ID NO: 1914958 - RNA, 16 nt, Human
ugucagcugaaccugg

SEQ ID NO: 1914959 - RNA, 14 nt, Human
agucaccaagccca

SEQ ID NO: 1914960 - RNA, 13 nt, Human
agucaccaagccc

SEQ ID NO: 1914961 - RNA, 21 nt, Human
aguauuugggaagugaagacu

SEQ ID NO: 1914962 - RNA, 20 nt, Human
agucacauuccugaacagga

SEQ ID NO: 1914963 - RNA, 18 nt, Human
agucacauuccugaacag

SEQ ID NO: 1914964 - RNA, 19 nt, Human
agucacauuccugaacagg

SEQ ID NO: 1914965 - RNA, 17 nt, Human
aguauuugggaagugaa

SEQ ID NO: 1914966 - RNA, 19 nt, Human
aguauguggaagugugggu

SEQ ID NO: 1914967 - RNA, 17 nt, Human
aguauguggaagugugg

SEQ ID NO: 1914968 - RNA, 15 nt, Human
aguauguggaagugu

SEQ ID NO: 1914969 - RNA, 13 nt, Human
aguauaaacaaag

SEQ ID NO: 1914970 - RNA, 16 nt, Human
aguauaaacaaaguua

SEQ ID NO: 1914971 - RNA, 17 nt, Human
aguauaaacaaaguuac

SEQ ID NO: 1914972 - RNA, 19 nt, Human
aguauaaacaaaguuacua

SEQ ID NO: 1914973 - RNA, 22 nt, Human
agugccguguguugcaugcagc

SEQ ID NO: 1914974 - RNA, 20 nt, Human
agugcugcauuuaaaagaua

SEQ ID NO: 1914975 - RNA, 17 nt, Human
agugccuuacacaaugg

SEQ ID NO: 1914976 - RNA, 15 nt, Human
agugccuuacacaau

SEQ ID NO: 1914977 - RNA, 21 nt, Human
agugccuguaaucacagcuac

SEQ ID NO: 1914978 - RNA, 19 nt, Human
agugcugggauuacaggug

SEQ ID NO: 1914979 - RNA, 17 nt, Human
agugcugggauuacagg

SEQ ID NO: 1914980 - RNA, 19 nt, Human
agugcugggauuacaggcu

SEQ ID NO: 1914981 - RNA, 20 nt, Human
agugcugggauuacaagcgu

SEQ ID NO: 1914982 - RNA, 22 nt, Human
agugcugcauuuaaaagauaca

SEQ ID NO: 1914983 - RNA, 16 nt, Human
agugcuuccaaggaug

SEQ ID NO: 1914984 - RNA, 19 nt, Human
ugugucagcauagaaguaa

SEQ ID NO: 1914985 - RNA, 12 nt, Human
ugugguuucauu

SEQ ID NO: 1914986 - RNA, 15 nt, Human
ugugguuaaugccau

SEQ ID NO: 1914987 - RNA, 20 nt, Human
ugugguuaaugccauggaca

SEQ ID NO: 1914988 - RNA, 16 nt, Human
uguggugcagugugaa

SEQ ID NO: 1914989 - RNA, 17 nt, Human
uguggugcagugugaaa

SEQ ID NO: 1914990 - RNA, 14 nt, Human
ugugguuaaugcca

SEQ ID NO: 1914991 - RNA, 14 nt, Human
uguggugguuguga

SEQ ID NO: 1914992 - RNA, 13 nt, Human
uguggucuccacu

SEQ ID NO: 1914993 - RNA, 21 nt, Human
uguuaacauggacaugaucuu

SEQ ID NO: 1914994 - RNA, 17 nt, Human
uguuaacauuuuuggua

SEQ ID NO: 1914995 - RNA, 20 nt, Human
uguuaacauuuuugguaguc

SEQ ID NO: 1914996 - RNA, 18 nt, Human
uguguugccacaggacac

SEQ ID NO: 1914997 - RNA, 23 nt, Human
uguguugccacaggacacaguca

SEQ ID NO: 1914998 - RNA, 19 nt, Human
uguuaaugauagcuacugu

SEQ ID NO: 1914999 - RNA, 17 nt, Human
uguuaaugguuugaaua

SEQ ID NO: 1915000 - RNA, 15 nt, Human
uguuaaugcuuucug

SEQ ID NO: 1915001 - RNA, 11 nt, Human
aguggaaaaau

SEQ ID NO: 1915002 - RNA, 18 nt, Human
aguggaaaaauagccugc

SEQ ID NO: 1915003 - RNA, 19 nt, Human
aguggaaaaauagccugcc

SEQ ID NO: 1915004 - RNA, 19 nt, Human
ugugucagguggggcagcu

SEQ ID NO: 1915005 - RNA, 17 nt, Human
ugugucagguggggcag

SEQ ID NO: 1915006 - RNA, 20 nt, Human
ugugucagguggggcagcuu

SEQ ID NO: 1915007 - RNA, 19 nt, Human
ugugucuaggcaggaccug

SEQ ID NO: 1915008 - RNA, 13 nt, Human
ugugucucuuggu

SEQ ID NO: 1915009 - RNA, 20 nt, Human
ugugucuaggcaggaccugu

SEQ ID NO: 1915010 - RNA, 16 nt, Human
ugugucucuugguccu

SEQ ID NO: 1915011 - RNA, 14 nt, Human
uguguuaugaagca

SEQ ID NO: 1915012 - RNA, 16 nt, Human
uguguguguguaugug

SEQ ID NO: 1915013 - RNA, 13 nt, Human
uguguguguguau

SEQ ID NO: 1915014 - RNA, 18 nt, Human
agugcaaugacacagucu

SEQ ID NO: 1915015 - RNA, 16 nt, Human
agugcaaugacacagu

SEQ ID NO: 1915016 - RNA, 24 nt, Human
agugauucuccugccucagccucc

SEQ ID NO: 1915017 - RNA, 22 nt, Human
agugauucuccugccucagccu

SEQ ID NO: 1915018 - RNA, 16 nt, Human
agugagucgaggacag

SEQ ID NO: 1915019 - RNA, 14 nt, Human
agugcccacaggau

SEQ ID NO: 1915020 - RNA, 14 nt, Human
agugcccccacuga

SEQ ID NO: 1915021 - RNA, 20 nt, Human
agugccccauucuuuuguaa

SEQ ID NO: 1915022 - RNA, 16 nt, Human
agugcccccacugacc

SEQ ID NO: 1915023 - RNA, 19 nt, Human
agugccccauucuuuugua

SEQ ID NO: 1915024 - RNA, 16 nt, Human
agugccaaaaacaaca

SEQ ID NO: 1915025 - RNA, 15 nt, Human
agugccaaguuuguu

SEQ ID NO: 1915026 - RNA, 17 nt, Human
agugcagccguuugaga

SEQ ID NO: 1915027 - RNA, 18 nt, Human
agugcagccguuugagaa

SEQ ID NO: 1915028 - RNA, 15 nt, Human
ugugcucuggacagg

SEQ ID NO: 1915029 - RNA, 23 nt, Human
ugugcucugaucauccacugugc

SEQ ID NO: 1915030 - RNA, 12 nt, Human
ugugcucugauc

SEQ ID NO: 1915031 - RNA, 22 nt, Human
ugugcucugaucauccacugug

SEQ ID NO: 1915032 - RNA, 16 nt, Human
ugugccucccugguga

SEQ ID NO: 1915033 - RNA, 14 nt, Human
ugugccucccuggu

SEQ ID NO: 1915034 - RNA, 19 nt, Human
agucucacuguugcccagg

SEQ ID NO: 1915035 - RNA, 18 nt, Human
agucucacuguugcccag

SEQ ID NO: 1915036 - RNA, 20 nt, Human
agucucacuguugcccaggc

SEQ ID NO: 1915037 - RNA, 21 nt, Human
agucucacuguugcccaggcu

SEQ ID NO: 1915038 - RNA, 21 nt, Human
ugugcccuaaaguguauuuuu

SEQ ID NO: 1915039 - RNA, 20 nt, Human
ugugcccuaaaguguauuuu

SEQ ID NO: 1915040 - RNA, 19 nt, Human
ugugcucuggacaggcaug

SEQ ID NO: 1915041 - RNA, 14 nt, Human
ugugcucugcuuca

SEQ ID NO: 1915042 - RNA, 18 nt, Human
ugugcucuggacaggcau

SEQ ID NO: 1915043 - RNA, 16 nt, Human
ugugcucuggacaggc

SEQ ID NO: 1915044 - RNA, 13 nt, Human
ugugcugcccugc

SEQ ID NO: 1915045 - RNA, 14 nt, Human
ugugcugcccugcc

SEQ ID NO: 1915046 - RNA, 15 nt, Human
ugugcugcccugccc

SEQ ID NO: 1915047 - RNA, 16 nt, Human
uguggauuuuuuccua

SEQ ID NO: 1915048 - RNA, 17 nt, Human
uguggcaaggaaaaaca

SEQ ID NO: 1915049 - RNA, 13 nt, Human
uguuguuauuuaa

SEQ ID NO: 1915050 - RNA, 11 nt, Human
uguuguuauuu

SEQ ID NO: 1915051 - RNA, 15 nt, Human
uguuguuccuuuuga

SEQ ID NO: 1915052 - RNA, 14 nt, Human
uguuguuccuuuug

SEQ ID NO: 1915053 - RNA, 18 nt, Human
uguuguuccuuuugaaag

SEQ ID NO: 1915054 - RNA, 20 nt, Human
uguuuagauaauacaccacu

SEQ ID NO: 1915055 - RNA, 16 nt, Human
uguugugugugggagu

SEQ ID NO: 1915056 - RNA, 16 nt, Human
uguugugccucccugg

SEQ ID NO: 1915057 - RNA, 15 nt, Human
uguugugugugggag

SEQ ID NO: 1915058 - RNA, 14 nt, Human
uguuguguguggga

SEQ ID NO: 1915059 - RNA, 22 nt, Human
uguugguuacccuccuagcuuu

SEQ ID NO: 1915060 - RNA, 16 nt, Human
uguugucugcaacucu

SEQ ID NO: 1915061 - RNA, 13 nt, Human
uguugucugcaac

SEQ ID NO: 1915062 - RNA, 13 nt, Human
uguuuaguaauca

SEQ ID NO: 1915063 - RNA, 17 nt, Human
uguuuagcagcagccuu

SEQ ID NO: 1915064 - RNA, 22 nt, Human
uguuuagcagcagccuuuaaug

SEQ ID NO: 1915065 - RNA, 14 nt, Human
uguuuaguaaucau

SEQ ID NO: 1915066 - RNA, 17 nt, Human
uguuuaguaaucauauu

SEQ ID NO: 1915067 - RNA, 14 nt, Human
uguuuauugucaaa

SEQ ID NO: 1915068 - RNA, 19 nt, Human
uguuuauuaguuuugcaua

SEQ ID NO: 1915069 - RNA, 14 nt, Human
uguuuaugcuuuug

SEQ ID NO: 1915070 - RNA, 21 nt, Human
aguucaauaaaugucuguuga

SEQ ID NO: 1915071 - RNA, 19 nt, Human
aguucaauaaaugucuguu

SEQ ID NO: 1915072 - RNA, 18 nt, Human
aguucaauaaaugucugu

SEQ ID NO: 1915073 - RNA, 13 nt, Human
aguucaauccuac

SEQ ID NO: 1915074 - RNA, 16 nt, Human
aguucaauucucauuu

SEQ ID NO: 1915075 - RNA, 16 nt, Human
aguuaucuaaaagaaa

SEQ ID NO: 1915076 - RNA, 23 nt, Human
aguuccucauuagcauuuugcua

SEQ ID NO: 1915077 - RNA, 15 nt, Human
aguucuaguugcuug

SEQ ID NO: 1915078 - RNA, 19 nt, Human
aguucggugagcuacaaau

SEQ ID NO: 1915079 - RNA, 20 nt, Human
aguucggugagcuacaaaug

SEQ ID NO: 1915080 - RNA, 23 nt, Human
aguguuaucagucauaacuaaau

SEQ ID NO: 1915081 - RNA, 16 nt, Human
aguguuaucagucaua

SEQ ID NO: 1915082 - RNA, 19 nt, Human
aguguguguuuuucauaaa

SEQ ID NO: 1915083 - RNA, 15 nt, Human
uguugcccaggcugg

SEQ ID NO: 1915084 - RNA, 21 nt, Human
uguugcccaggcuggagugca

SEQ ID NO: 1915085 - RNA, 14 nt, Human
uguugcccaggcug

SEQ ID NO: 1915086 - RNA, 13 nt, Human
uguugcccaggcu

SEQ ID NO: 1915087 - RNA, 19 nt, Human
uguucuuucacccuuuucu

SEQ ID NO: 1915088 - RNA, 20 nt, Human
uguucuugguuuguaaauua

SEQ ID NO: 1915089 - RNA, 22 nt, Human
uguucuugguuuguaaauuaac

SEQ ID NO: 1915090 - RNA, 19 nt, Human
aguuagaauaauaaauauu

SEQ ID NO: 1915091 - RNA, 18 nt, Human
aguuagaauaauaaauau

SEQ ID NO: 1915092 - RNA, 15 nt, Human
aguuagaauaauaaa

SEQ ID NO: 1915093 - RNA, 14 nt, Human
uguuauuuaaagaa

SEQ ID NO: 1915094 - RNA, 18 nt, Human
uguuauuuaacagcugaa

SEQ ID NO: 1915095 - RNA, 19 nt, Human
uguuccccuccuccacucu

SEQ ID NO: 1915096 - RNA, 17 nt, Human
uguuccccuccuccacu

SEQ ID NO: 1915097 - RNA, 12 nt, Human
uguuccccuccu

SEQ ID NO: 1915098 - RNA, 15 nt, Human
uguuccccuccucca

SEQ ID NO: 1915099 - RNA, 13 nt, Human
uguuccccuccuc

SEQ ID NO: 1915100 - RNA, 23 nt, Human
uguuccccuccuccacucucccc

SEQ ID NO: 1915101 - RNA, 18 nt, Human
uguucuagcauggcugcc

SEQ ID NO: 1915102 - RNA, 18 nt, Human
uguucuuaguuugcaguu

SEQ ID NO: 1915103 - RNA, 15 nt, Human
uguucuacuuuguuc

SEQ ID NO: 1915104 - RNA, 20 nt, Human
uguuaucaaaacuuucuuuu

SEQ ID NO: 1915105 - RNA, 21 nt, Human
uguuaucagucaauauuuuua

SEQ ID NO: 1915106 - RNA, 23 nt, Human
agugugggucuguguguguguau

SEQ ID NO: 1915107 - RNA, 19 nt, Human
agugugggucugugugugu

SEQ ID NO: 1915108 - RNA, 13 nt, Human
uguuauccuauuu

SEQ ID NO: 1915109 - RNA, 19 nt, Human
uguuauccuuuuuuaaaag

SEQ ID NO: 1915110 - RNA, 16 nt, Human
aguggaaccagcccag

SEQ ID NO: 1915111 - RNA, 22 nt, Human
aguggaaagacagcuucucauc

SEQ ID NO: 1915112 - RNA, 19 nt, Human
aguggagaacugggcuugc

SEQ ID NO: 1915113 - RNA, 14 nt, Human
aguggaggcacuuu

SEQ ID NO: 1915114 - RNA, 17 nt, Human
aguggaggcacuuuagg

SEQ ID NO: 1915115 - RNA, 15 nt, Human
agugugggucugugu

SEQ ID NO: 1915116 - RNA, 17 nt, Human
agugugggucugugugu

SEQ ID NO: 1915117 - RNA, 16 nt, Human
agugugggucugugug

SEQ ID NO: 1915118 - RNA, 17 nt, Human
auaaaauaucauucagc

SEQ ID NO: 1915119 - RNA, 16 nt, Human
auaaaauaucauucag

SEQ ID NO: 1915120 - RNA, 15 nt, Human
auaaaauaucauuca

SEQ ID NO: 1915121 - RNA, 13 nt, Human
auaaaauaucauu

SEQ ID NO: 1915122 - RNA, 19 nt, Human
auaaaauaucauucagcaa

SEQ ID NO: 1915123 - RNA, 18 nt, Human
auaaaauaucauucagca

SEQ ID NO: 1915124 - RNA, 20 nt, Human
uuaagaaaaaggaugcacag

SEQ ID NO: 1915125 - RNA, 21 nt, Human
uuaagaaaaaggaugcacaga

SEQ ID NO: 1915126 - RNA, 13 nt, Human
auaaaagccuguu

SEQ ID NO: 1915127 - RNA, 20 nt, Human
aguuuuuauugcuuguugga

SEQ ID NO: 1915128 - RNA, 15 nt, Human
aguuuuuauugcuug

SEQ ID NO: 1915129 - RNA, 18 nt, Human
auaaaagccuguuuaaga

SEQ ID NO: 1915130 - RNA, 22 nt, Human
aguuuccccaccagugaaugaa

SEQ ID NO: 1915131 - RNA, 23 nt, Human
aguuuccccaccagugaaugaaa

SEQ ID NO: 1915132 - RNA, 17 nt, Human
aguuuccccaccaguga

SEQ ID NO: 1915133 - RNA, 15 nt, Human
aguuuuguaaauuuc

SEQ ID NO: 1915134 - RNA, 12 nt, Human
aguuuuguaaau

SEQ ID NO: 1915135 - RNA, 23 nt, Human
aguuuuuauggcuuuugugcauu

SEQ ID NO: 1915136 - RNA, 20 nt, Human
uuaaucuuuucacaaauaaa

SEQ ID NO: 1915137 - RNA, 19 nt, Human
uuaaucuuuucacaaauaa

SEQ ID NO: 1915138 - RNA, 18 nt, Human
uuaaucuuuucacaaaua

SEQ ID NO: 1915139 - RNA, 22 nt, Human
uuaaucuccaccagucauuuuu

SEQ ID NO: 1915140 - RNA, 17 nt, Human
uuaaucuuuucacaaau

SEQ ID NO: 1915141 - RNA, 18 nt, Human
uuaaugaaagacuguaca

SEQ ID NO: 1915142 - RNA, 22 nt, Human
uuaaucugguuuauuuuuguuc

SEQ ID NO: 1915143 - RNA, 19 nt, Human
uuaaugaaagacuguacaa

SEQ ID NO: 1915144 - RNA, 21 nt, Human
uuaauugacuuauuuauauaa

SEQ ID NO: 1915145 - RNA, 12 nt, Human
uuaauugcuuug

SEQ ID NO: 1915146 - RNA, 13 nt, Human
uuaauugcuuuga

SEQ ID NO: 1915147 - RNA, 13 nt, Human
uuaaucauuaggu

SEQ ID NO: 1915148 - RNA, 14 nt, Human
uuaaucaaguugaa

SEQ ID NO: 1915149 - RNA, 17 nt, Human
uuaaucaaguugaauug

SEQ ID NO: 1915150 - RNA, 23 nt, Human
uuaaucauuaggugugacugaau

SEQ ID NO: 1915151 - RNA, 22 nt, Human
uuaaucauuaggugugacugaa

SEQ ID NO: 1915152 - RNA, 20 nt, Human
auaaaauaucauucagcaac

SEQ ID NO: 1915153 - RNA, 22 nt, Human
uuaagaaagacuaucuaaaugu

SEQ ID NO: 1915154 - RNA, 9 nt, Human
uuaaggugg

SEQ ID NO: 1915155 - RNA, 22 nt, Human
uuaagggaguguacucccaggg

SEQ ID NO: 1915156 - RNA, 18 nt, Human
uuaaggugauauauuuaa

SEQ ID NO: 1915157 - RNA, 14 nt, Human
uuaagugcugcauu

SEQ ID NO: 1915158 - RNA, 19 nt, Human
uuaagugcugcauuuaaaa

SEQ ID NO: 1915159 - RNA, 16 nt, Human
uuaagugcugcauuua

SEQ ID NO: 1915160 - RNA, 15 nt, Human
uuaagugcugcauuu

SEQ ID NO: 1915161 - RNA, 14 nt, Human
aguugcuuguaaaa

SEQ ID NO: 1915162 - RNA, 13 nt, Human
aguugggcuuccu

SEQ ID NO: 1915163 - RNA, 19 nt, Human
aguugggcuuccucauagu

SEQ ID NO: 1915164 - RNA, 17 nt, Human
aguuggguggaugccug

SEQ ID NO: 1915165 - RNA, 15 nt, Human
aguugggugagaaca

SEQ ID NO: 1915166 - RNA, 17 nt, Human
aguuggggucuggcagc

SEQ ID NO: 1915167 - RNA, 21 nt, Human
aguuggggucuggcagccucc

SEQ ID NO: 1915168 - RNA, 23 nt, Human
aguugccagucaccccggccacc

SEQ ID NO: 1915169 - RNA, 14 nt, Human
aguuuaaauuguaa

SEQ ID NO: 1915170 - RNA, 18 nt, Human
aguuuaaaacagaagccu

SEQ ID NO: 1915171 - RNA, 17 nt, Human
aguuggucccccuucca

SEQ ID NO: 1915172 - RNA, 15 nt, Human
aguuuaaaaaaauug

SEQ ID NO: 1915173 - RNA, 11 nt, Human
aguuggucccc

SEQ ID NO: 1915174 - RNA, 13 nt, Human
aguuggucccccu

SEQ ID NO: 1915175 - RNA, 13 nt, Human
uuaaaaaaaaucc

SEQ ID NO: 1915176 - RNA, 12 nt, Human
uuaaaaaaagaa

SEQ ID NO: 1915177 - RNA, 12 nt, Human
uuaaaaaaauca

SEQ ID NO: 1915178 - RNA, 20 nt, Human
uuaaaaaaauugguuggaga

SEQ ID NO: 1915179 - RNA, 18 nt, Human
uuaaaaaaaucaaaacaa

SEQ ID NO: 1915180 - RNA, 18 nt, Human
uuaaaaaaagaagagaaa

SEQ ID NO: 1915181 - RNA, 18 nt, Human
aguuuaauugacuuauuu

SEQ ID NO: 1915182 - RNA, 15 nt, Human
aguuuaauugacuua

SEQ ID NO: 1915183 - RNA, 14 nt, Human
aguuuaauugacuu

SEQ ID NO: 1915184 - RNA, 17 nt, Human
uuaaaaaucucaaauuu

SEQ ID NO: 1915185 - RNA, 16 nt, Human
uuaaaaaucucaaauu

SEQ ID NO: 1915186 - RNA, 15 nt, Human
uuaaaaaucucaaau

SEQ ID NO: 1915187 - RNA, 14 nt, Human
uuaaaaaucucaaa

SEQ ID NO: 1915188 - RNA, 22 nt, Human
uuaaacaaauguaugauuacau

SEQ ID NO: 1915189 - RNA, 15 nt, Human
uuaaauaaugugaaa

SEQ ID NO: 1915190 - RNA, 12 nt, Human
uuaaaguauuuu

SEQ ID NO: 1915191 - RNA, 18 nt, Human
uuaaauaaugugaaacug

SEQ ID NO: 1915192 - RNA, 16 nt, Human
uuaaauaaugugaaac

SEQ ID NO: 1915193 - RNA, 15 nt, Human
uuaaauacaaaacuu

SEQ ID NO: 1915194 - RNA, 16 nt, Human
uuaaauacaaaacuuc

SEQ ID NO: 1915195 - RNA, 18 nt, Human
uuaaauacaaaacuucca

SEQ ID NO: 1915196 - RNA, 20 nt, Human
uuaacagaaauguacagcaa

SEQ ID NO: 1915197 - RNA, 15 nt, Human
aguuucauguacaag

SEQ ID NO: 1915198 - RNA, 18 nt, Human
aguuucauguacaagaug

SEQ ID NO: 1915199 - RNA, 21 nt, Human
aguuucauguacaagaugaag

SEQ ID NO: 1915200 - RNA, 19 nt, Human
uuaacagaaauguacagca

SEQ ID NO: 1915201 - RNA, 14 nt, Human
auaaauaaaaauaa

SEQ ID NO: 1915202 - RNA, 15 nt, Human
auaaauaguuuauga

SEQ ID NO: 1915203 - RNA, 20 nt, Human
auaaauauugucuuuuugua

SEQ ID NO: 1915204 - RNA, 21 nt, Human
auaaauauugucuuuuuguau

SEQ ID NO: 1915205 - RNA, 23 nt, Human
auaaauauugucuuuuuguaugu

SEQ ID NO: 1915206 - RNA, 11 nt, Human
auaaauauuua

SEQ ID NO: 1915207 - RNA, 13 nt, Human
auaaauaaaaaua

SEQ ID NO: 1915208 - RNA, 17 nt, Human
auaaagguucaugcaaa

SEQ ID NO: 1915209 - RNA, 15 nt, Human
auaaagguucaugca

SEQ ID NO: 1915210 - RNA, 22 nt, Human
auaacgauaaaagacagugaaa

SEQ ID NO: 1915211 - RNA, 14 nt, Human
auaacguauaaaag

SEQ ID NO: 1915212 - RNA, 23 nt, Human
auaaccguuuccuuucauuuacu

SEQ ID NO: 1915213 - RNA, 20 nt, Human
auaaccaugugaaaaggcaa

SEQ ID NO: 1915214 - RNA, 13 nt, Human
auaaauuccucuu

SEQ ID NO: 1915215 - RNA, 20 nt, Human
auaaauuccucuuugcuuug

SEQ ID NO: 1915216 - RNA, 11 nt, Human
auaaauuauuu

SEQ ID NO: 1915217 - RNA, 19 nt, Human
uuacccucauguucuuaau

SEQ ID NO: 1915218 - RNA, 13 nt, Human
uuaccuuugacaa

SEQ ID NO: 1915219 - RNA, 20 nt, Human
uuaccuuugacaaagguaaa

SEQ ID NO: 1915220 - RNA, 18 nt, Human
uuacccuccuagcuuucc

SEQ ID NO: 1915221 - RNA, 20 nt, Human
uuagacagagucucacuguu

SEQ ID NO: 1915222 - RNA, 13 nt, Human
uuagacagucccu

SEQ ID NO: 1915223 - RNA, 13 nt, Human
uuagacagagucu

SEQ ID NO: 1915224 - RNA, 20 nt, Human
uuagaacacugguuuaaagg

SEQ ID NO: 1915225 - RNA, 16 nt, Human
uuacugaagccuuucu

SEQ ID NO: 1915226 - RNA, 22 nt, Human
uuagaaagaagcccaauauuau

SEQ ID NO: 1915227 - RNA, 15 nt, Human
auaauaaauguacau

SEQ ID NO: 1915228 - RNA, 12 nt, Human
auaauacaccac

SEQ ID NO: 1915229 - RNA, 20 nt, Human
auaauacaccacuacauucu

SEQ ID NO: 1915230 - RNA, 18 nt, Human
auaauacaccacuacauu

SEQ ID NO: 1915231 - RNA, 19 nt, Human
auaauacuugcuuuggaaa

SEQ ID NO: 1915232 - RNA, 22 nt, Human
auaauacuauauuuauacugua

SEQ ID NO: 1915233 - RNA, 18 nt, Human
auaauccuaaacauauga

SEQ ID NO: 1915234 - RNA, 18 nt, Human
auaaucucuccauucccg

SEQ ID NO: 1915235 - RNA, 15 nt, Human
auaaucuauaugcug

SEQ ID NO: 1915236 - RNA, 15 nt, Human
auaaugcgugcauac

SEQ ID NO: 1915237 - RNA, 15 nt, Human
auaaugaaugaaaca

SEQ ID NO: 1915238 - RNA, 22 nt, Human
auaauugacaggauuauuggaa

SEQ ID NO: 1915239 - RNA, 14 nt, Human
uuagcggagacgga

SEQ ID NO: 1915240 - RNA, 16 nt, Human
uuagccuuugucccag

SEQ ID NO: 1915241 - RNA, 18 nt, Human
uuagccaagugugguaga

SEQ ID NO: 1915242 - RNA, 18 nt, Human
auaauuuaccugaagucu

SEQ ID NO: 1915243 - RNA, 18 nt, Human
uuagcaaauucuguuuuu

SEQ ID NO: 1915244 - RNA, 20 nt, Human
uuagggaaggauacaaaagc

SEQ ID NO: 1915245 - RNA, 16 nt, Human
uuaggugugacugaau

SEQ ID NO: 1915246 - RNA, 16 nt, Human
uuaggugaggaagcaa

SEQ ID NO: 1915247 - RNA, 21 nt, Human
uuaggugugacugaauuucuu

SEQ ID NO: 1915248 - RNA, 13 nt, Human
uuagggagaaaau

SEQ ID NO: 1915249 - RNA, 17 nt, Human
uuagggagaaaauucaa

SEQ ID NO: 1915250 - RNA, 15 nt, Human
uuaguuucuccaagc

SEQ ID NO: 1915251 - RNA, 22 nt, Human
uuaguuugcaguuacacuaaaa

SEQ ID NO: 1915252 - RNA, 24 nt, Human
uuaguaacaugaggggacauuuug

SEQ ID NO: 1915253 - RNA, 22 nt, Human
uuuuaaaacaagaaaguuuccc

SEQ ID NO: 1915254 - RNA, 17 nt, Human
uuuuaaaaauagacacu

SEQ ID NO: 1915255 - RNA, 18 nt, Human
uuuguuugaacugauaaa

SEQ ID NO: 1915256 - RNA, 13 nt, Human
uuuguuugugcau

SEQ ID NO: 1915257 - RNA, 15 nt, Human
uuuuaagaggcaggg

SEQ ID NO: 1915258 - RNA, 16 nt, Human
uuuuaagaggcagggu

SEQ ID NO: 1915259 - RNA, 22 nt, Human
uuuuaagauaaauuauaaguua

SEQ ID NO: 1915260 - RNA, 19 nt, Human
uuuuaagacguguuugugu

SEQ ID NO: 1915261 - RNA, 13 nt, Human
uuuuaacucaaua

SEQ ID NO: 1915262 - RNA, 16 nt, Human
uuuuaacuagaauuua

SEQ ID NO: 1915263 - RNA, 21 nt, Human
uuuuaaccccgucaacaaauc

SEQ ID NO: 1915264 - RNA, 12 nt, Human
uuuuaacuagaa

SEQ ID NO: 1915265 - RNA, 16 nt, Human
uuuuaaccccgucaac

SEQ ID NO: 1915266 - RNA, 18 nt, Human
uuuuaaccccgucaacaa

SEQ ID NO: 1915267 - RNA, 20 nt, Human
uuuuaaccccgucaacaaau

SEQ ID NO: 1915268 - RNA, 12 nt, Human
uuuuaagcuguu

SEQ ID NO: 1915269 - RNA, 16 nt, Human
uuuuaaguaaggaauu

SEQ ID NO: 1915270 - RNA, 15 nt, Human
uuuuaagugcugcau

SEQ ID NO: 1915271 - RNA, 16 nt, Human
augucuguugaugacu

SEQ ID NO: 1915272 - RNA, 19 nt, Human
augucuguaucacucugug

SEQ ID NO: 1915273 - RNA, 14 nt, Human
augucugcauuucg

SEQ ID NO: 1915274 - RNA, 15 nt, Human
augucugagugaacc

SEQ ID NO: 1915275 - RNA, 16 nt, Human
augucugagugaaccu

SEQ ID NO: 1915276 - RNA, 22 nt, Human
augucugagugaaccuguauaa

SEQ ID NO: 1915277 - RNA, 13 nt, Human
uuuguagagccag

SEQ ID NO: 1915278 - RNA, 20 nt, Human
uuuguaacccagauuuugcu

SEQ ID NO: 1915279 - RNA, 17 nt, Human
uuuguaaauuuauguga

SEQ ID NO: 1915280 - RNA, 21 nt, Human
uuuguaacccagauuuugcug

SEQ ID NO: 1915281 - RNA, 17 nt, Human
uuugucugucuucauag

SEQ ID NO: 1915282 - RNA, 18 nt, Human
uuuguaggggaacucauu

SEQ ID NO: 1915283 - RNA, 20 nt, Human
uuuguaggggaacucauuug

SEQ ID NO: 1915284 - RNA, 17 nt, Human
uuuguagaagucacauu

SEQ ID NO: 1915285 - RNA, 14 nt, Human
uuuguuugaacuga

SEQ ID NO: 1915286 - RNA, 13 nt, Human
uuuguuugaacug

SEQ ID NO: 1915287 - RNA, 12 nt, Human
uuuguuugaacu

SEQ ID NO: 1915288 - RNA, 18 nt, Human
uuugugaggaagccgcug

SEQ ID NO: 1915289 - RNA, 19 nt, Human
uuugugaggaagccgcugg

SEQ ID NO: 1915290 - RNA, 21 nt, Human
uuugcuguagaagauggcacu

SEQ ID NO: 1915291 - RNA, 18 nt, Human
uuugcuguauauuuguga

SEQ ID NO: 1915292 - RNA, 13 nt, Human
uuugcuguagaag

SEQ ID NO: 1915293 - RNA, 12 nt, Human
uuugcuuagaaa

SEQ ID NO: 1915294 - RNA, 16 nt, Human
uuugcuuagaaaagaa

SEQ ID NO: 1915295 - RNA, 15 nt, Human
uuugcuucaaaaaca

SEQ ID NO: 1915296 - RNA, 14 nt, Human
uuuggggauauuuu

SEQ ID NO: 1915297 - RNA, 22 nt, Human
uuugggaggccaaggugggagg

SEQ ID NO: 1915298 - RNA, 22 nt, Human
uuugggaaaaaaacauacacaa

SEQ ID NO: 1915299 - RNA, 20 nt, Human
uuugggaagugaagacugga

SEQ ID NO: 1915300 - RNA, 22 nt, Human
uuugggaagugaagacuggaag

SEQ ID NO: 1915301 - RNA, 22 nt, Human
uuugccauguuggccaggcugg

SEQ ID NO: 1915302 - RNA, 19 nt, Human
uuugcuaugagcuggggau

SEQ ID NO: 1915303 - RNA, 23 nt, Human
uuugcucagugucuggcugcaga

SEQ ID NO: 1915304 - RNA, 22 nt, Human
uuugggggaaaauuuagaaaua

SEQ ID NO: 1915305 - RNA, 21 nt, Human
auguagucagaauuagcugcu

SEQ ID NO: 1915306 - RNA, 15 nt, Human
auguaucaaugagua

SEQ ID NO: 1915307 - RNA, 15 nt, Human
auguaucugagcagg

SEQ ID NO: 1915308 - RNA, 17 nt, Human
auguaugcuucauacag

SEQ ID NO: 1915309 - RNA, 20 nt, Human
auguaugcuucauacaggga

SEQ ID NO: 1915310 - RNA, 12 nt, Human
auguauguguaa

SEQ ID NO: 1915311 - RNA, 13 nt, Human
augucaguaugug

SEQ ID NO: 1915312 - RNA, 23 nt, Human
augucaggggcggggagggugac

SEQ ID NO: 1915313 - RNA, 16 nt, Human
auguccacugguucuu

SEQ ID NO: 1915314 - RNA, 22 nt, Human
augucuauaaaccgaacugaug

SEQ ID NO: 1915315 - RNA, 17 nt, Human
augucuauuaaggugau

SEQ ID NO: 1915316 - RNA, 21 nt, Human
augucagugugacugaucucu

SEQ ID NO: 1915317 - RNA, 14 nt, Human
augucaguaugugg

SEQ ID NO: 1915318 - RNA, 15 nt, Human
augucagugugacug

SEQ ID NO: 1915319 - RNA, 16 nt, Human
augucagugugacuga

SEQ ID NO: 1915320 - RNA, 19 nt, Human
auguccaagaagcccagga

SEQ ID NO: 1915321 - RNA, 18 nt, Human
auguccaagaagcccagg

SEQ ID NO: 1915322 - RNA, 23 nt, Human
auguccaagaagcccaggaaagg

SEQ ID NO: 1915323 - RNA, 22 nt, Human
auguuuacacucuuuguaagag

SEQ ID NO: 1915324 - RNA, 19 nt, Human
auguuuacagaggacagua

SEQ ID NO: 1915325 - RNA, 17 nt, Human
auguuuacagaggacag

SEQ ID NO: 1915326 - RNA, 15 nt, Human
auguuuacagaggac

SEQ ID NO: 1915327 - RNA, 14 nt, Human
auguuuuccaugag

SEQ ID NO: 1915328 - RNA, 23 nt, Human
auguuuauuucauaaagaauugu

SEQ ID NO: 1915329 - RNA, 22 nt, Human
uuuucuccaauuuuuuuuuccu

SEQ ID NO: 1915330 - RNA, 18 nt, Human
auguugugccucccuggu

SEQ ID NO: 1915331 - RNA, 18 nt, Human
auguuuuucuucucccuc

SEQ ID NO: 1915332 - RNA, 17 nt, Human
auguuuuuguguauuug

SEQ ID NO: 1915333 - RNA, 17 nt, Human
auguuuuucuucucccu

SEQ ID NO: 1915334 - RNA, 18 nt, Human
auuaaccacuucagcuga

SEQ ID NO: 1915335 - RNA, 20 nt, Human
auuaaccacuucagcugacu

SEQ ID NO: 1915336 - RNA, 17 nt, Human
auuaaccacuucagcug

SEQ ID NO: 1915337 - RNA, 21 nt, Human
auuaaacuuaaucuaaaugga

SEQ ID NO: 1915338 - RNA, 19 nt, Human
auuaaacuuaaucuaaaug

SEQ ID NO: 1915339 - RNA, 16 nt, Human
auuaaacuuaaucuaa

SEQ ID NO: 1915340 - RNA, 17 nt, Human
auuaaacuuaaucuaaa

SEQ ID NO: 1915341 - RNA, 12 nt, Human
auuaacuuuuau

SEQ ID NO: 1915342 - RNA, 20 nt, Human
auuaacuuuuauaaacuuua

SEQ ID NO: 1915343 - RNA, 19 nt, Human
auuaacuuuuauaaacuuu

SEQ ID NO: 1915344 - RNA, 17 nt, Human
auuaacuuuuauaaacu

SEQ ID NO: 1915345 - RNA, 16 nt, Human
auuaacuuuuauaaac

SEQ ID NO: 1915346 - RNA, 23 nt, Human
auuaacuuuuauaaacuuuaccu

SEQ ID NO: 1915347 - RNA, 13 nt, Human
auuaagaaagacu

SEQ ID NO: 1915348 - RNA, 14 nt, Human
auuaagaaagacua

SEQ ID NO: 1915349 - RNA, 15 nt, Human
auuaagaaggcaaaa

SEQ ID NO: 1915350 - RNA, 19 nt, Human
auuaagaaggcaaaaaugu

SEQ ID NO: 1915351 - RNA, 22 nt, Human
auuaagaaggcaaaaauguaaa

SEQ ID NO: 1915352 - RNA, 13 nt, Human
auguugaggugga

SEQ ID NO: 1915353 - RNA, 16 nt, Human
auguugagaaucccaa

SEQ ID NO: 1915354 - RNA, 22 nt, Human
auguugagaaucccaaauuuga

SEQ ID NO: 1915355 - RNA, 16 nt, Human
auguuggccaggcugg

SEQ ID NO: 1915356 - RNA, 14 nt, Human
auguuggccaggcu

SEQ ID NO: 1915357 - RNA, 13 nt, Human
auguuggccaggc

SEQ ID NO: 1915358 - RNA, 23 nt, Human
uuuuagaguugauacuacaguuu

SEQ ID NO: 1915359 - RNA, 18 nt, Human
uuuuagauacuuugcuag

SEQ ID NO: 1915360 - RNA, 19 nt, Human
uuuuaguugcaacuuugua

SEQ ID NO: 1915361 - RNA, 13 nt, Human
uuuuauaaacuuu

SEQ ID NO: 1915362 - RNA, 12 nt, Human
uuuuauaaacuu

SEQ ID NO: 1915363 - RNA, 14 nt, Human
uuuuaaguugcuga

SEQ ID NO: 1915364 - RNA, 22 nt, Human
uuuuaaguuacacauuuuucag

SEQ ID NO: 1915365 - RNA, 21 nt, Human
uuuuaaguuacacauuuuuca

SEQ ID NO: 1915366 - RNA, 21 nt, Human
uuuuaagugcugcauuuaaaa

SEQ ID NO: 1915367 - RNA, 17 nt, Human
uuuuaagugcugcauuu

SEQ ID NO: 1915368 - RNA, 16 nt, Human
uuuuaagugcugcauu

SEQ ID NO: 1915369 - RNA, 21 nt, Human
auguucaucauccuaagcuau

SEQ ID NO: 1915370 - RNA, 19 nt, Human
auguucaucaaugaaugaa

SEQ ID NO: 1915371 - RNA, 14 nt, Human
auguugaauacuuu

SEQ ID NO: 1915372 - RNA, 15 nt, Human
auguugaauacuuuu

SEQ ID NO: 1915373 - RNA, 19 nt, Human
auguugaauacuuuuuaca

SEQ ID NO: 1915374 - RNA, 17 nt, Human
uuuuauaaacuuuaccu

SEQ ID NO: 1915375 - RNA, 14 nt, Human
uuuuauaaacuuua

SEQ ID NO: 1915376 - RNA, 19 nt, Human
uuuuauaaacuuuaccuuu

SEQ ID NO: 1915377 - RNA, 19 nt, Human
uuuuaugccuuuuauuucu

SEQ ID NO: 1915378 - RNA, 22 nt, Human
uuuuauguugcauagaauaaaa

SEQ ID NO: 1915379 - RNA, 19 nt, Human
uuuuaugugaaacauguuu

SEQ ID NO: 1915380 - RNA, 19 nt, Human
uuuuauguaguaauugaca

SEQ ID NO: 1915381 - RNA, 18 nt, Human
uuuuaugugaaacauguu

SEQ ID NO: 1915382 - RNA, 19 nt, Human
uuuuccagguuuaagcugu

SEQ ID NO: 1915383 - RNA, 19 nt, Human
uuuuccaugaaaaugcaac

SEQ ID NO: 1915384 - RNA, 18 nt, Human
uuuuccaugaaaaugcaa

SEQ ID NO: 1915385 - RNA, 13 nt, Human
uuuuccaggcugg

SEQ ID NO: 1915386 - RNA, 21 nt, Human
uuuucagauauaaaagacuga

SEQ ID NO: 1915387 - RNA, 19 nt, Human
uuuucagauauaaaagacu

SEQ ID NO: 1915388 - RNA, 22 nt, Human
uuuucagauauaaaagacugac

SEQ ID NO: 1915389 - RNA, 13 nt, Human
uuuucagcauuga

SEQ ID NO: 1915390 - RNA, 17 nt, Human
uuuucagauauaaaaga

SEQ ID NO: 1915391 - RNA, 21 nt, Human
uuuuauucagcucauggacuu

SEQ ID NO: 1915392 - RNA, 16 nt, Human
auuccaccugcaauca

SEQ ID NO: 1915393 - RNA, 20 nt, Human
auuccacuuauaggaauuga

SEQ ID NO: 1915394 - RNA, 14 nt, Human
auucaguuuucauu

SEQ ID NO: 1915395 - RNA, 13 nt, Human
auucaguuuucau

SEQ ID NO: 1915396 - RNA, 15 nt, Human
auucaguuuucauuu

SEQ ID NO: 1915397 - RNA, 19 nt, Human
auuccccaggaggccagcc

SEQ ID NO: 1915398 - RNA, 20 nt, Human
auucccuucgacagcauuuu

SEQ ID NO: 1915399 - RNA, 23 nt, Human
auucccuucgacagcauuuuccu

SEQ ID NO: 1915400 - RNA, 22 nt, Human
auuccccacccugaaagcccug

SEQ ID NO: 1915401 - RNA, 20 nt, Human
auuccccagauugcaacagg

SEQ ID NO: 1915402 - RNA, 16 nt, Human
auuccccaggaggcca

SEQ ID NO: 1915403 - RNA, 17 nt, Human
auucagcggaauauuga

SEQ ID NO: 1915404 - RNA, 14 nt, Human
auucagcucaugga

SEQ ID NO: 1915405 - RNA, 21 nt, Human
auucaguuguuagugugucuu

SEQ ID NO: 1915406 - RNA, 21 nt, Human
auucaggaauguguggccugc

SEQ ID NO: 1915407 - RNA, 23 nt, Human
auucaggaagcucagggccuggc

SEQ ID NO: 1915408 - RNA, 16 nt, Human
auucaguuguuagugu

SEQ ID NO: 1915409 - RNA, 14 nt, Human
auucagcucugcaa

SEQ ID NO: 1915410 - RNA, 18 nt, Human
auucagcucugcaagaau

SEQ ID NO: 1915411 - RNA, 21 nt, Human
auucaggaagcucagggccug

SEQ ID NO: 1915412 - RNA, 22 nt, Human
auucaggaagcucagggccugg

SEQ ID NO: 1915413 - RNA, 16 nt, Human
auuauuuauauaugua

SEQ ID NO: 1915414 - RNA, 23 nt, Human
auuauuuauuaaaugcccagccc

SEQ ID NO: 1915415 - RNA, 13 nt, Human
auuauuuuaaaag

SEQ ID NO: 1915416 - RNA, 13 nt, Human
auuauuuauuauu

SEQ ID NO: 1915417 - RNA, 16 nt, Human
auuauuuuauguugca

SEQ ID NO: 1915418 - RNA, 14 nt, Human
auuauuuuaaaaga

SEQ ID NO: 1915419 - RNA, 18 nt, Human
auuauuuuauguugcaua

SEQ ID NO: 1915420 - RNA, 11 nt, Human
auuauuaaagg

SEQ ID NO: 1915421 - RNA, 20 nt, Human
auuauguuuuuuaaaauauu

SEQ ID NO: 1915422 - RNA, 16 nt, Human
auuauguuuuuuaaaa

SEQ ID NO: 1915423 - RNA, 23 nt, Human
auuaucaagcuaauaaaauauca

SEQ ID NO: 1915424 - RNA, 22 nt, Human
auuaucaagcuaauaaaauauc

SEQ ID NO: 1915425 - RNA, 17 nt, Human
auuaucaagcuaauaaa

SEQ ID NO: 1915426 - RNA, 16 nt, Human
auuaucaagcuaauaa

SEQ ID NO: 1915427 - RNA, 15 nt, Human
auuaucaagcuaaua

SEQ ID NO: 1915428 - RNA, 17 nt, Human
auuauauuuacaaaugg

SEQ ID NO: 1915429 - RNA, 14 nt, Human
auuauccauauuga

SEQ ID NO: 1915430 - RNA, 17 nt, Human
auuauccauauugaguc

SEQ ID NO: 1915431 - RNA, 22 nt, Human
auuauaauauacuauauuuaug

SEQ ID NO: 1915432 - RNA, 13 nt, Human
auuagaauagugu

SEQ ID NO: 1915433 - RNA, 22 nt, Human
auuagaauaguguucugcaaaa

SEQ ID NO: 1915434 - RNA, 19 nt, Human
auuagaaaauguuauuuaa

SEQ ID NO: 1915435 - RNA, 22 nt, Human
auuagaaaauguuauuuaacag

SEQ ID NO: 1915436 - RNA, 13 nt, Human
auuagaaaauguu

SEQ ID NO: 1915437 - RNA, 18 nt, Human
auuagaaaauguuauuua

SEQ ID NO: 1915438 - RNA, 16 nt, Human
auuauauuuacaaaug

SEQ ID NO: 1915439 - RNA, 22 nt, Human
uuuuuguuccacaaguuaaaua

SEQ ID NO: 1915440 - RNA, 16 nt, Human
auuaagaucucagugg

SEQ ID NO: 1915441 - RNA, 20 nt, Human
auuaagagagucuauuuacg

SEQ ID NO: 1915442 - RNA, 12 nt, Human
uuuuuuaaaaaa

SEQ ID NO: 1915443 - RNA, 20 nt, Human
auuaauauggggaugcagca

SEQ ID NO: 1915444 - RNA, 12 nt, Human
auuaauaugaaa

SEQ ID NO: 1915445 - RNA, 14 nt, Human
auuaauaugaaaac

SEQ ID NO: 1915446 - RNA, 15 nt, Human
auuaauaugaaaacu

SEQ ID NO: 1915447 - RNA, 19 nt, Human
auuaccacagacauacuaa

SEQ ID NO: 1915448 - RNA, 22 nt, Human
auuaccugaauuuuggcugugu

SEQ ID NO: 1915449 - RNA, 12 nt, Human
auuaccagggac

SEQ ID NO: 1915450 - RNA, 13 nt, Human
auuacucuuucuc

SEQ ID NO: 1915451 - RNA, 13 nt, Human
auuaccucugaua

SEQ ID NO: 1915452 - RNA, 15 nt, Human
auuguauuacaaauc

SEQ ID NO: 1915453 - RNA, 14 nt, Human
auuguauuacaaau

SEQ ID NO: 1915454 - RNA, 15 nt, Human
auugugaaauuauuc

SEQ ID NO: 1915455 - RNA, 13 nt, Human
auugugccccugc

SEQ ID NO: 1915456 - RNA, 15 nt, Human
auugucuuuuuguau

SEQ ID NO: 1915457 - RNA, 23 nt, Human
auugugaaauaaaacuggcuuug

SEQ ID NO: 1915458 - RNA, 21 nt, Human
auuguuugggauccuauugaa

SEQ ID NO: 1915459 - RNA, 12 nt, Human
auuguuugaacc

SEQ ID NO: 1915460 - RNA, 23 nt, Human
auuggcuuuggguugcaggaccu

SEQ ID NO: 1915461 - RNA, 21 nt, Human
auuggcucacacugagaaugu

SEQ ID NO: 1915462 - RNA, 21 nt, Human
auuggcucuugaacugagcuu

SEQ ID NO: 1915463 - RNA, 20 nt, Human
auugcguuugaccuuuuaug

SEQ ID NO: 1915464 - RNA, 21 nt, Human
auugcguuugaccuuuuaugu

SEQ ID NO: 1915465 - RNA, 17 nt, Human
auuguauauuguguuug

SEQ ID NO: 1915466 - RNA, 16 nt, Human
auuuacaaaugggaaa

SEQ ID NO: 1915467 - RNA, 22 nt, Human
auuuacaacugggggaggguga

SEQ ID NO: 1915468 - RNA, 19 nt, Human
auuuacccuucuuuucuga

SEQ ID NO: 1915469 - RNA, 23 nt, Human
auuuaauuuuuuugagacagagu

SEQ ID NO: 1915470 - RNA, 19 nt, Human
auuuaauuuuuuugagaca

SEQ ID NO: 1915471 - RNA, 18 nt, Human
auuuaaccucuaaauucu

SEQ ID NO: 1915472 - RNA, 16 nt, Human
auuuaaccucuaaauu

SEQ ID NO: 1915473 - RNA, 17 nt, Human
auuuaacagggagggga

SEQ ID NO: 1915474 - RNA, 22 nt, Human
auuuaacagcugaauuaucuau

SEQ ID NO: 1915475 - RNA, 16 nt, Human
auuuaacagaaaugua

SEQ ID NO: 1915476 - RNA, 15 nt, Human
auuuaacagaaaugu

SEQ ID NO: 1915477 - RNA, 21 nt, Human
auuuaaaggcccuaucuguuu

SEQ ID NO: 1915478 - RNA, 20 nt, Human
auuuaaaggcccuaucuguu

SEQ ID NO: 1915479 - RNA, 18 nt, Human
auuuaaaggcccuaucug

SEQ ID NO: 1915480 - RNA, 19 nt, Human
auuuaacagaaauguacag

SEQ ID NO: 1915481 - RNA, 17 nt, Human
auuuaacagaaauguac

SEQ ID NO: 1915482 - RNA, 20 nt, Human
auuuaacagaaauguacagc

SEQ ID NO: 1915483 - RNA, 15 nt, Human
auuuaacagcugaau

SEQ ID NO: 1915484 - RNA, 21 nt, Human
auuuaacagcugaauuaucua

SEQ ID NO: 1915485 - RNA, 20 nt, Human
auuuaaaauugugauguguc

SEQ ID NO: 1915486 - RNA, 19 nt, Human
auuuaaaauugugaugugu

SEQ ID NO: 1915487 - RNA, 15 nt, Human
auuuaaacaaacaaa

SEQ ID NO: 1915488 - RNA, 13 nt, Human
auugacagaagcu

SEQ ID NO: 1915489 - RNA, 20 nt, Human
auugacacuuaaaaaugguu

SEQ ID NO: 1915490 - RNA, 16 nt, Human
auucuccaccugccag

SEQ ID NO: 1915491 - RNA, 17 nt, Human
auucuccaccugccagg

SEQ ID NO: 1915492 - RNA, 18 nt, Human
auucucagaaucucaaau

SEQ ID NO: 1915493 - RNA, 20 nt, Human
auucucagaaucucaaauaa

SEQ ID NO: 1915494 - RNA, 13 nt, Human
auucuccaccugc

SEQ ID NO: 1915495 - RNA, 14 nt, Human
auucucagaaucuc

SEQ ID NO: 1915496 - RNA, 22 nt, Human
auucuacuugcucuggaccugc

SEQ ID NO: 1915497 - RNA, 19 nt, Human
auucucacagcuccaagaa

SEQ ID NO: 1915498 - RNA, 22 nt, Human
auucucacagcuccaagaauuu

SEQ ID NO: 1915499 - RNA, 21 nt, Human
auucucacagcuccaagaauu

SEQ ID NO: 1915500 - RNA, 13 nt, Human
auucuacuuugag

SEQ ID NO: 1915501 - RNA, 16 nt, Human
auucuacuuugagugc

SEQ ID NO: 1915502 - RNA, 12 nt, Human
auucuacuugcu

SEQ ID NO: 1915503 - RNA, 13 nt, Human
auucuacuugcuc

SEQ ID NO: 1915504 - RNA, 15 nt, Human
auucuacuugcucug

SEQ ID NO: 1915505 - RNA, 16 nt, Human
auucuacuugcucugg

SEQ ID NO: 1915506 - RNA, 17 nt, Human
auucuacuugcucugga

SEQ ID NO: 1915507 - RNA, 18 nt, Human
auucuacuugcucuggac

SEQ ID NO: 1915508 - RNA, 19 nt, Human
auucuacuugcucuggacc

SEQ ID NO: 1915509 - RNA, 20 nt, Human
auucuacuugcucuggaccu

SEQ ID NO: 1915510 - RNA, 21 nt, Human
auucuacuugcucuggaccug

SEQ ID NO: 1915511 - RNA, 23 nt, Human
auucuacuugcucuggaccugcc

SEQ ID NO: 1915512 - RNA, 18 nt, Human
auucuccaccugccaggg

SEQ ID NO: 1915513 - RNA, 20 nt, Human
auugcauuuuuuaaaacaag

SEQ ID NO: 1915514 - RNA, 19 nt, Human
auugcauuuuuuaaaacaa

SEQ ID NO: 1915515 - RNA, 18 nt, Human
auugcauuuuuuaaaaca

SEQ ID NO: 1915516 - RNA, 21 nt, Human
auugcauuuuuuaaaacaaga

SEQ ID NO: 1915517 - RNA, 23 nt, Human
auugccauuucuuccacaagagc

SEQ ID NO: 1915518 - RNA, 21 nt, Human
auugcccacgcuggagugcag

SEQ ID NO: 1915519 - RNA, 17 nt, Human
auugcccacgcuggagu

SEQ ID NO: 1915520 - RNA, 19 nt, Human
auugcggacagccacggcc

SEQ ID NO: 1915521 - RNA, 18 nt, Human
auugcggacagccacggc

SEQ ID NO: 1915522 - RNA, 16 nt, Human
auugcggacagccacg

SEQ ID NO: 1915523 - RNA, 15 nt, Human
auugcaacaggcugg

SEQ ID NO: 1915524 - RNA, 12 nt, Human
auugcaaaucuu

SEQ ID NO: 1915525 - RNA, 16 nt, Human
auugcaaaucuugaaa

SEQ ID NO: 1915526 - RNA, 17 nt, Human
auugcaaaucuugaaau

SEQ ID NO: 1915527 - RNA, 19 nt, Human
auugcaaaucuugaaauua

SEQ ID NO: 1915528 - RNA, 13 nt, Human
auugaccugaggc

SEQ ID NO: 1915529 - RNA, 18 nt, Human
auugacaggauuauugga

SEQ ID NO: 1915530 - RNA, 16 nt, Human
auucuccacagcaacc

SEQ ID NO: 1915531 - RNA, 13 nt, Human
auugacagcuuug

SEQ ID NO: 1915532 - RNA, 14 nt, Human
auugacagcuuugc

SEQ ID NO: 1915533 - RNA, 15 nt, Human
auugacagcuuugcu

SEQ ID NO: 1915534 - RNA, 16 nt, Human
auugacagcuuugcug

SEQ ID NO: 1915535 - RNA, 18 nt, Human
auugacagcuuugcugcu

SEQ ID NO: 1915536 - RNA, 19 nt, Human
auugacagcuuugcugcug

SEQ ID NO: 1915537 - RNA, 21 nt, Human
auugacccacaagaaaugaaa

SEQ ID NO: 1915538 - RNA, 23 nt, Human
auugaccgcgacuaauuucaaaa

SEQ ID NO: 1915539 - RNA, 17 nt, Human
auugaccgcgacuaauu

SEQ ID NO: 1915540 - RNA, 20 nt, Human
auugaccgcgacuaauuuca

SEQ ID NO: 1915541 - RNA, 21 nt, Human
auugcaacaggcugggcuuca

SEQ ID NO: 1915542 - RNA, 16 nt, Human
auugcaacaggcuggg

SEQ ID NO: 1915543 - RNA, 12 nt, Human
auugcaauagaa

SEQ ID NO: 1915544 - RNA, 20 nt, Human
auugcagaacuaaacucauu

SEQ ID NO: 1915545 - RNA, 22 nt, Human
auugcagaacuaaacucauuua

SEQ ID NO: 1915546 - RNA, 23 nt, Human
auugcaggagucccugccaucau

SEQ ID NO: 1915547 - RNA, 14 nt, Human
auugcuacuguccu

SEQ ID NO: 1915548 - RNA, 22 nt, Human
auuugaggucuguucuuuccaa

SEQ ID NO: 1915549 - RNA, 19 nt, Human
auuugaguguuuuaagaua

SEQ ID NO: 1915550 - RNA, 12 nt, Human
auuugaguguuu

SEQ ID NO: 1915551 - RNA, 17 nt, Human
auuugagcagggcucag

SEQ ID NO: 1915552 - RNA, 23 nt, Human
auuugaggucuguucuuuccaaa

SEQ ID NO: 1915553 - RNA, 15 nt, Human
auuugaggucuguuc

SEQ ID NO: 1915554 - RNA, 20 nt, Human
auuucuuuugccguuauuaa

SEQ ID NO: 1915555 - RNA, 19 nt, Human
auuucuuugugcuuuggcu

SEQ ID NO: 1915556 - RNA, 18 nt, Human
auuugaauguaugcuuca

SEQ ID NO: 1915557 - RNA, 17 nt, Human
auuugaauguaugcuuc

SEQ ID NO: 1915558 - RNA, 22 nt, Human
auuugaauguaugcuucauaca

SEQ ID NO: 1915559 - RNA, 21 nt, Human
auuugaauguaugcuucauac

SEQ ID NO: 1915560 - RNA, 20 nt, Human
auuugaauguaugcuucaua

SEQ ID NO: 1915561 - RNA, 20 nt, Human
auuuggugguuucagaaaug

SEQ ID NO: 1915562 - RNA, 18 nt, Human
auuuggugguuucagaaa

SEQ ID NO: 1915563 - RNA, 17 nt, Human
auuugguuuucacauug

SEQ ID NO: 1915564 - RNA, 15 nt, Human
auuugguuuucacau

SEQ ID NO: 1915565 - RNA, 22 nt, Human
auuugguuuucacauuggaaac

SEQ ID NO: 1915566 - RNA, 21 nt, Human
auuugguuuucacauuggaaa

SEQ ID NO: 1915567 - RNA, 14 nt, Human
auuugguuuuccug

SEQ ID NO: 1915568 - RNA, 16 nt, Human
auuugguuuuccugua

SEQ ID NO: 1915569 - RNA, 17 nt, Human
auuuggugguuucagaa

SEQ ID NO: 1915570 - RNA, 17 nt, Human
auuuggguucugccugc

SEQ ID NO: 1915571 - RNA, 12 nt, Human
auuuggggugga

SEQ ID NO: 1915572 - RNA, 13 nt, Human
auuuggaauacuu

SEQ ID NO: 1915573 - RNA, 14 nt, Human
auuuggaauacuuu

SEQ ID NO: 1915574 - RNA, 15 nt, Human
auuuggaauacuuuu

SEQ ID NO: 1915575 - RNA, 13 nt, Human
auuuauuauggca

SEQ ID NO: 1915576 - RNA, 22 nt, Human
auuuauuaaaugcccagccccu

SEQ ID NO: 1915577 - RNA, 20 nt, Human
auuuauuaaaugcccagccc

SEQ ID NO: 1915578 - RNA, 18 nt, Human
auuuagguuuuuauuagu

SEQ ID NO: 1915579 - RNA, 19 nt, Human
auuuagguuuuuauuagua

SEQ ID NO: 1915580 - RNA, 17 nt, Human
auuuagguuuuuauuag

SEQ ID NO: 1915581 - RNA, 21 nt, Human
auuuaguaggugaguuuucac

SEQ ID NO: 1915582 - RNA, 22 nt, Human
auuuauguuugcacuugugauu

SEQ ID NO: 1915583 - RNA, 21 nt, Human
auuuagcuaaacggauuccaa

SEQ ID NO: 1915584 - RNA, 22 nt, Human
auuuagcuaaacggauuccaaa

SEQ ID NO: 1915585 - RNA, 19 nt, Human
auuuacgcuuugauucaua

SEQ ID NO: 1915586 - RNA, 16 nt, Human
auuuaccuuuuugaaa

SEQ ID NO: 1915587 - RNA, 15 nt, Human
auuuacgcuuugauu

SEQ ID NO: 1915588 - RNA, 17 nt, Human
auuuacgcuuugauuca

SEQ ID NO: 1915589 - RNA, 23 nt, Human
auuuagcuaaacggauuccaaag

SEQ ID NO: 1915590 - RNA, 21 nt, Human
auuuagcuccaaaccuucaca

SEQ ID NO: 1915591 - RNA, 14 nt, Human
auuuaggagaagcc

SEQ ID NO: 1915592 - RNA, 17 nt, Human
auuuaggagaagccagg

SEQ ID NO: 1915593 - RNA, 14 nt, Human
auuuccugugucuu

SEQ ID NO: 1915594 - RNA, 16 nt, Human
auuuauuauggcacau

SEQ ID NO: 1915595 - RNA, 22 nt, Human
auuuccugggagcuuuuguaga

SEQ ID NO: 1915596 - RNA, 23 nt, Human
auuuccugggagcuuuuguagaa

SEQ ID NO: 1915597 - RNA, 13 nt, Human
auuucuaaaucuc

SEQ ID NO: 1915598 - RNA, 12 nt, Human
auuucuaaaucu

SEQ ID NO: 1915599 - RNA, 21 nt, Human
auuucuaaaucuccaaaauaa

SEQ ID NO: 1915600 - RNA, 14 nt, Human
auuuccuugaaugu

SEQ ID NO: 1915601 - RNA, 21 nt, Human
auuuuacuuuaaaaggagcca

SEQ ID NO: 1915602 - RNA, 18 nt, Human
auuuuauguugcauagaa

SEQ ID NO: 1915603 - RNA, 21 nt, Human
auuuuauguugcauagaauaa

SEQ ID NO: 1915604 - RNA, 14 nt, Human
auuuuauguugcau

SEQ ID NO: 1915605 - RNA, 13 nt, Human
auuuuauuaugca

SEQ ID NO: 1915606 - RNA, 15 nt, Human
auuuuauuaugcaug

SEQ ID NO: 1915607 - RNA, 14 nt, Human
auuuuauuaugcau

SEQ ID NO: 1915608 - RNA, 17 nt, Human
auuuuauuaugcaugaa

SEQ ID NO: 1915609 - RNA, 22 nt, Human
auuuuauuuguaggggaacuca

SEQ ID NO: 1915610 - RNA, 22 nt, Human
auuuuacuguacagacagaaaa

SEQ ID NO: 1915611 - RNA, 20 nt, Human
auuuuacuguacagacagaa

SEQ ID NO: 1915612 - RNA, 13 nt, Human
auuuuacauaaau

SEQ ID NO: 1915613 - RNA, 22 nt, Human
auuuguaggggaacucauuugg

SEQ ID NO: 1915614 - RNA, 19 nt, Human
auuuguaggggaacucauu

SEQ ID NO: 1915615 - RNA, 23 nt, Human
auuucuuuugccguuauuaaaaa

SEQ ID NO: 1915616 - RNA, 20 nt, Human
uucauauguaccauguacau

SEQ ID NO: 1915617 - RNA, 14 nt, Human
uucauauugaauau

SEQ ID NO: 1915618 - RNA, 18 nt, Human
uucauauugcugagagaa

SEQ ID NO: 1915619 - RNA, 19 nt, Human
uucauaauuauuauuuggc

SEQ ID NO: 1915620 - RNA, 18 nt, Human
uucagugccuuauggaac

SEQ ID NO: 1915621 - RNA, 21 nt, Human
uucauacagggaugguguuca

SEQ ID NO: 1915622 - RNA, 16 nt, Human
uucagugccaaaaaca

SEQ ID NO: 1915623 - RNA, 12 nt, Human
uucagugccuua

SEQ ID NO: 1915624 - RNA, 13 nt, Human
uucagugccuuau

SEQ ID NO: 1915625 - RNA, 13 nt, Human
uucagaaaugugu

SEQ ID NO: 1915626 - RNA, 11 nt, Human
uucagaaaugu

SEQ ID NO: 1915627 - RNA, 16 nt, Human
uucagaaagugugcuu

SEQ ID NO: 1915628 - RNA, 18 nt, Human
uucagaaagugugcuuua

SEQ ID NO: 1915629 - RNA, 12 nt, Human
auauauguauuu

SEQ ID NO: 1915630 - RNA, 21 nt, Human
uucaucccucuggggcuguuc

SEQ ID NO: 1915631 - RNA, 19 nt, Human
auauauguauauauaugca

SEQ ID NO: 1915632 - RNA, 17 nt, Human
uucaucccucuggggcu

SEQ ID NO: 1915633 - RNA, 19 nt, Human
uucaucccaacugucuuuu

SEQ ID NO: 1915634 - RNA, 12 nt, Human
auauauuuuaag

SEQ ID NO: 1915635 - RNA, 13 nt, Human
auauauuuuaaga

SEQ ID NO: 1915636 - RNA, 13 nt, Human
auauauuugugua

SEQ ID NO: 1915637 - RNA, 12 nt, Human
auauauuuaaaa

SEQ ID NO: 1915638 - RNA, 17 nt, Human
auauauuggguuccauu

SEQ ID NO: 1915639 - RNA, 21 nt, Human
auauauuggguuccauucuca

SEQ ID NO: 1915640 - RNA, 19 nt, Human
auauguaccauguacauga

SEQ ID NO: 1915641 - RNA, 14 nt, Human
auauguaccaugua

SEQ ID NO: 1915642 - RNA, 14 nt, Human
auauguacaugaga

SEQ ID NO: 1915643 - RNA, 17 nt, Human
auauguaacaagccacc

SEQ ID NO: 1915644 - RNA, 16 nt, Human
auauguaacaagccac

SEQ ID NO: 1915645 - RNA, 22 nt, Human
auaugcacacauuuuuuaaaug

SEQ ID NO: 1915646 - RNA, 16 nt, Human
auaugcacacauuuuu

SEQ ID NO: 1915647 - RNA, 15 nt, Human
auaugcacacauuuu

SEQ ID NO: 1915648 - RNA, 14 nt, Human
auaugcacacauuu

SEQ ID NO: 1915649 - RNA, 16 nt, Human
auaucugaaaauguau

SEQ ID NO: 1915650 - RNA, 17 nt, Human
auaucugaaaauguaug

SEQ ID NO: 1915651 - RNA, 20 nt, Human
auaucugaaaauguaugugu

SEQ ID NO: 1915652 - RNA, 13 nt, Human
auaucuuuauuaa

SEQ ID NO: 1915653 - RNA, 16 nt, Human
auaucuuuauuaauca

SEQ ID NO: 1915654 - RNA, 14 nt, Human
auauauuuuaagac

SEQ ID NO: 1915655 - RNA, 22 nt, Human
auauauuuguguauuuaacagg

SEQ ID NO: 1915656 - RNA, 17 nt, Human
auauauuuguguauuua

SEQ ID NO: 1915657 - RNA, 21 nt, Human
auauauuuguguauuuaacag

SEQ ID NO: 1915658 - RNA, 21 nt, Human
auaucuccgucaacucauauu

SEQ ID NO: 1915659 - RNA, 20 nt, Human
auaucuccgucaacucauau

SEQ ID NO: 1915660 - RNA, 19 nt, Human
auaucuccgucaacucaua

SEQ ID NO: 1915661 - RNA, 13 nt, Human
uucauuuacugug

SEQ ID NO: 1915662 - RNA, 19 nt, Human
uucauuuacuguggcuucu

SEQ ID NO: 1915663 - RNA, 16 nt, Human
uucauuuacuguggcu

SEQ ID NO: 1915664 - RNA, 18 nt, Human
uucauuuaggugaggaag

SEQ ID NO: 1915665 - RNA, 21 nt, Human
uucauuuagcuaaacggauuc

SEQ ID NO: 1915666 - RNA, 13 nt, Human
uuccaagagccug

SEQ ID NO: 1915667 - RNA, 15 nt, Human
uuccaaggguacuaa

SEQ ID NO: 1915668 - RNA, 17 nt, Human
uuccaaggguacuaagg

SEQ ID NO: 1915669 - RNA, 13 nt, Human
uuccaagagcuga

SEQ ID NO: 1915670 - RNA, 12 nt, Human
uuccaagagcug

SEQ ID NO: 1915671 - RNA, 22 nt, Human
uuccaagagccugagagugagg

SEQ ID NO: 1915672 - RNA, 14 nt, Human
uuccaagagccuga

SEQ ID NO: 1915673 - RNA, 16 nt, Human
auauguggaguucauc

SEQ ID NO: 1915674 - RNA, 15 nt, Human
auauguggaguucau

SEQ ID NO: 1915675 - RNA, 22 nt, Human
uuccacaagagcccaggccucc

SEQ ID NO: 1915676 - RNA, 19 nt, Human
uuccaccaucaagccacca

SEQ ID NO: 1915677 - RNA, 15 nt, Human
uuccacaccuuuuau

SEQ ID NO: 1915678 - RNA, 22 nt, Human
uuccacaccuuuuauugacaca

SEQ ID NO: 1915679 - RNA, 18 nt, Human
uuccacacucaccucuaa

SEQ ID NO: 1915680 - RNA, 17 nt, Human
uuccaggggugggacac

SEQ ID NO: 1915681 - RNA, 21 nt, Human
uuccaggcuaaacauccaaua

SEQ ID NO: 1915682 - RNA, 23 nt, Human
uucccaaagcagugcaugcuguc

SEQ ID NO: 1915683 - RNA, 18 nt, Human
uuccaguguccuuagaac

SEQ ID NO: 1915684 - RNA, 15 nt, Human
uuccagugcaacacu

SEQ ID NO: 1915685 - RNA, 19 nt, Human
uuccagugcaacacugaag

SEQ ID NO: 1915686 - RNA, 21 nt, Human
uuccagugcaacacugaagcu

SEQ ID NO: 1915687 - RNA, 21 nt, Human
uuccaggggugggacacccug

SEQ ID NO: 1915688 - RNA, 17 nt, Human
uuccagugaggcucugc

SEQ ID NO: 1915689 - RNA, 19 nt, Human
uuccagugaggcucugccc

SEQ ID NO: 1915690 - RNA, 20 nt, Human
uuccagugaggcucugcccu

SEQ ID NO: 1915691 - RNA, 21 nt, Human
uuccagugaggcucugcccuu

SEQ ID NO: 1915692 - RNA, 22 nt, Human
uuccagugaggcucugcccuug

SEQ ID NO: 1915693 - RNA, 16 nt, Human
uucccaagcucugcuc

SEQ ID NO: 1915694 - RNA, 15 nt, Human
uucccaagcucugcu

SEQ ID NO: 1915695 - RNA, 14 nt, Human
uucccaagcucugc

SEQ ID NO: 1915696 - RNA, 13 nt, Human
uucccaagcucug

SEQ ID NO: 1915697 - RNA, 15 nt, Human
uucccaacucuagcu

SEQ ID NO: 1915698 - RNA, 17 nt, Human
uucccaacucuagcugg

SEQ ID NO: 1915699 - RNA, 18 nt, Human
uucccaacucuagcuggg

SEQ ID NO: 1915700 - RNA, 18 nt, Human
uucccaagcucugcuccu

SEQ ID NO: 1915701 - RNA, 11 nt, Human
uucccaagcuc

SEQ ID NO: 1915702 - RNA, 12 nt, Human
uucccaccucuc

SEQ ID NO: 1915703 - RNA, 22 nt, Human
uucccaccucucucacuccuug

SEQ ID NO: 1915704 - RNA, 19 nt, Human
auagucuagacuaaaagau

SEQ ID NO: 1915705 - RNA, 20 nt, Human
auagucuagauggcuccucu

SEQ ID NO: 1915706 - RNA, 17 nt, Human
auaguggcuuaaaacaa

SEQ ID NO: 1915707 - RNA, 15 nt, Human
auaguggugugauuu

SEQ ID NO: 1915708 - RNA, 16 nt, Human
auaguggggagacuuc

SEQ ID NO: 1915709 - RNA, 22 nt, Human
auaguguucugcaaaaauauuu

SEQ ID NO: 1915710 - RNA, 22 nt, Human
auaguuggcuaggaccccucca

SEQ ID NO: 1915711 - RNA, 20 nt, Human
auaguuguaccgcaauguga

SEQ ID NO: 1915712 - RNA, 14 nt, Human
auauaaaaaacuuu

SEQ ID NO: 1915713 - RNA, 22 nt, Human
auaguuaagcgugcauaaguua

SEQ ID NO: 1915714 - RNA, 15 nt, Human
auaguuagaaccugg

SEQ ID NO: 1915715 - RNA, 21 nt, Human
auaguugaaccuauuucucuu

SEQ ID NO: 1915716 - RNA, 13 nt, Human
uucacuucacgcu

SEQ ID NO: 1915717 - RNA, 22 nt, Human
uucacuguccuccaagccagcg

SEQ ID NO: 1915718 - RNA, 22 nt, Human
uucacugugaccuugagaagau

SEQ ID NO: 1915719 - RNA, 21 nt, Human
auauauauuuuuuucugaaau

SEQ ID NO: 1915720 - RNA, 13 nt, Human
auauauauuuuaa

SEQ ID NO: 1915721 - RNA, 15 nt, Human
auauauauauauauu

SEQ ID NO: 1915722 - RNA, 12 nt, Human
auauauaaccag

SEQ ID NO: 1915723 - RNA, 13 nt, Human
auauauaaccagu

SEQ ID NO: 1915724 - RNA, 16 nt, Human
auauaaaagacugacc

SEQ ID NO: 1915725 - RNA, 15 nt, Human
auauaaauaaaacau

SEQ ID NO: 1915726 - RNA, 18 nt, Human
auauaaauaaaacauuuu

SEQ ID NO: 1915727 - RNA, 17 nt, Human
auaggcguaacuaauuu

SEQ ID NO: 1915728 - RNA, 17 nt, Human
auagcuuuugugucuua

SEQ ID NO: 1915729 - RNA, 22 nt, Human
auaggacucaaaguuucagaga

SEQ ID NO: 1915730 - RNA, 22 nt, Human
auaggaauugacccacaagaaa

SEQ ID NO: 1915731 - RNA, 22 nt, Human
auagcuuuucccuuuuuuuaag

SEQ ID NO: 1915732 - RNA, 15 nt, Human
auagcuuuuuucucu

SEQ ID NO: 1915733 - RNA, 12 nt, Human
auaggaaaaacu

SEQ ID NO: 1915734 - RNA, 14 nt, Human
auaggaaaaacuga

SEQ ID NO: 1915735 - RNA, 16 nt, Human
auaggaaaaacugauu

SEQ ID NO: 1915736 - RNA, 17 nt, Human
auaggaaaaacugauuu

SEQ ID NO: 1915737 - RNA, 23 nt, Human
uucacaagacccaaaaggcagaa

SEQ ID NO: 1915738 - RNA, 20 nt, Human
uucacacacagacuguuguc

SEQ ID NO: 1915739 - RNA, 20 nt, Human
uucacagaugggugcuugga

SEQ ID NO: 1915740 - RNA, 15 nt, Human
uucacaguucucucc

SEQ ID NO: 1915741 - RNA, 20 nt, Human
uucacaguucucuccuucuu

SEQ ID NO: 1915742 - RNA, 20 nt, Human
uucacaguucuuugggccag

SEQ ID NO: 1915743 - RNA, 13 nt, Human
uucacaguucucu

SEQ ID NO: 1915744 - RNA, 21 nt, Human
uucacaguucuuugggccaga

SEQ ID NO: 1915745 - RNA, 16 nt, Human
uuauuuuuuaauuauu

SEQ ID NO: 1915746 - RNA, 14 nt, Human
uuauuuuuuaauua

SEQ ID NO: 1915747 - RNA, 17 nt, Human
uuauuuuuuucugaauu

SEQ ID NO: 1915748 - RNA, 13 nt, Human
uuauuuuuuucug

SEQ ID NO: 1915749 - RNA, 17 nt, Human
uuauuuuuagacagagu

SEQ ID NO: 1915750 - RNA, 18 nt, Human
uuauuuuuagacagaguc

SEQ ID NO: 1915751 - RNA, 21 nt, Human
uucaagcgauucuucugcuuc

SEQ ID NO: 1915752 - RNA, 19 nt, Human
uucaagguaauuucuugug

SEQ ID NO: 1915753 - RNA, 21 nt, Human
uucaaaauuguuacaaauugu

SEQ ID NO: 1915754 - RNA, 17 nt, Human
uucaaaauaaaaaugag

SEQ ID NO: 1915755 - RNA, 14 nt, Human
aucccacccacaug

SEQ ID NO: 1915756 - RNA, 13 nt, Human
auccauucuuucu

SEQ ID NO: 1915757 - RNA, 15 nt, Human
auccauucuuucuga

SEQ ID NO: 1915758 - RNA, 16 nt, Human
auccauucuuucugau

SEQ ID NO: 1915759 - RNA, 19 nt, Human
auccaauauuuucuuuaau

SEQ ID NO: 1915760 - RNA, 22 nt, Human
auccaauauuuucuuuaaugcu

SEQ ID NO: 1915761 - RNA, 24 nt, Human
auccaauauuuucuuuaaugcuuu

SEQ ID NO: 1915762 - RNA, 22 nt, Human
auccaaaagaagcccccagcua

SEQ ID NO: 1915763 - RNA, 13 nt, Human
auccaaaagaagc

SEQ ID NO: 1915764 - RNA, 18 nt, Human
auccaaaagaagccccca

SEQ ID NO: 1915765 - RNA, 19 nt, Human
auccaaaagaagcccccag

SEQ ID NO: 1915766 - RNA, 20 nt, Human
auccaaacuuggauuuuuga

SEQ ID NO: 1915767 - RNA, 22 nt, Human
uucuggcucucccauuuccuga

SEQ ID NO: 1915768 - RNA, 16 nt, Human
uucuggcucucccauu

SEQ ID NO: 1915769 - RNA, 15 nt, Human
uucuggcucuuccag

SEQ ID NO: 1915770 - RNA, 10 nt, Human
uucuggcuca

SEQ ID NO: 1915771 - RNA, 20 nt, Human
uucuggcuaugcauuugaaa

SEQ ID NO: 1915772 - RNA, 18 nt, Human
uucuggcuaugcauuuga

SEQ ID NO: 1915773 - RNA, 14 nt, Human
uucugccgcagccc

SEQ ID NO: 1915774 - RNA, 15 nt, Human
uucugccgcagcccu

SEQ ID NO: 1915775 - RNA, 17 nt, Human
uucucuacucuagggaa

SEQ ID NO: 1915776 - RNA, 16 nt, Human
uucucuuuucaaaaca

SEQ ID NO: 1915777 - RNA, 11 nt, Human
uucucuuucuu

SEQ ID NO: 1915778 - RNA, 16 nt, Human
uucucuuucuuuacaa

SEQ ID NO: 1915779 - RNA, 22 nt, Human
uucucuuucuuuacaagauggg

SEQ ID NO: 1915780 - RNA, 14 nt, Human
uucugacccaugcu

SEQ ID NO: 1915781 - RNA, 13 nt, Human
uucugccgcagcc

SEQ ID NO: 1915782 - RNA, 22 nt, Human
uucuccucuuguaaauaaagcc

SEQ ID NO: 1915783 - RNA, 17 nt, Human
uucuccucuuguaaaua

SEQ ID NO: 1915784 - RNA, 19 nt, Human
uucuccucuuguaaauaaa

SEQ ID NO: 1915785 - RNA, 13 nt, Human
uucuccucuugua

SEQ ID NO: 1915786 - RNA, 14 nt, Human
uucuccucuuguaa

SEQ ID NO: 1915787 - RNA, 21 nt, Human
aucauugaaaucuuuuugcuu

SEQ ID NO: 1915788 - RNA, 22 nt, Human
aucauuggauucugagagcugu

SEQ ID NO: 1915789 - RNA, 21 nt, Human
aucauuggauucugagagcug

SEQ ID NO: 1915790 - RNA, 21 nt, Human
aucaggccaggcccucugccc

SEQ ID NO: 1915791 - RNA, 22 nt, Human
aucaggccaggcccucugccca

SEQ ID NO: 1915792 - RNA, 23 nt, Human
aucaggccaggcccucugcccac

SEQ ID NO: 1915793 - RNA, 20 nt, Human
aucaggccaggcccucugcc

SEQ ID NO: 1915794 - RNA, 23 nt, Human
uucuuaaucuuuucacaaauaaa

SEQ ID NO: 1915795 - RNA, 22 nt, Human
uucuuaaucuuuucacaaauaa

SEQ ID NO: 1915796 - RNA, 17 nt, Human
uucuuaaacaaauguau

SEQ ID NO: 1915797 - RNA, 13 nt, Human
uucuuaauucuua

SEQ ID NO: 1915798 - RNA, 15 nt, Human
uucuuacaaacaugu

SEQ ID NO: 1915799 - RNA, 23 nt, Human
uucuuccucccucccucuuuccc

SEQ ID NO: 1915800 - RNA, 23 nt, Human
aucccacccacaugugacacaua

SEQ ID NO: 1915801 - RNA, 20 nt, Human
aucccacccacaugugacac

SEQ ID NO: 1915802 - RNA, 18 nt, Human
aucccacccacaugugac

SEQ ID NO: 1915803 - RNA, 15 nt, Human
aucccacccacaugu

SEQ ID NO: 1915804 - RNA, 18 nt, Human
uucuguucuuucuggcua

SEQ ID NO: 1915805 - RNA, 21 nt, Human
uucuguuggccagugugacaa

SEQ ID NO: 1915806 - RNA, 20 nt, Human
uucuguuuuucuaggccugg

SEQ ID NO: 1915807 - RNA, 12 nt, Human
uucuugcaaagu

SEQ ID NO: 1915808 - RNA, 21 nt, Human
uucuugaucaacaucuuuucu

SEQ ID NO: 1915809 - RNA, 13 nt, Human
uucuugcaaagua

SEQ ID NO: 1915810 - RNA, 22 nt, Human
uucuuucuggcuaugcauuuga

SEQ ID NO: 1915811 - RNA, 16 nt, Human
uucuuuguaaugaaaa

SEQ ID NO: 1915812 - RNA, 19 nt, Human
uucuuugugucaacaugaa

SEQ ID NO: 1915813 - RNA, 21 nt, Human
auccuaggcauuugcugaaua

SEQ ID NO: 1915814 - RNA, 13 nt, Human
auccuaguuccac

SEQ ID NO: 1915815 - RNA, 18 nt, Human
uugaacccgggaggcaga

SEQ ID NO: 1915816 - RNA, 20 nt, Human
uugaacacaaacuguaaaua

SEQ ID NO: 1915817 - RNA, 21 nt, Human
uugaacacaaacuguaaauaa

SEQ ID NO: 1915818 - RNA, 17 nt, Human
uugaacccaggaguuca

SEQ ID NO: 1915819 - RNA, 21 nt, Human
uugaaauuuuuauuaaauuau

SEQ ID NO: 1915820 - RNA, 14 nt, Human
uugaacacaaacug

SEQ ID NO: 1915821 - RNA, 15 nt, Human
uugaacacaaacugu

SEQ ID NO: 1915822 - RNA, 18 nt, Human
uugaacacaaacuguaaa

SEQ ID NO: 1915823 - RNA, 11 nt, Human
uugaaaucuuu

SEQ ID NO: 1915824 - RNA, 20 nt, Human
uugaaauauaggaacuuaaa

SEQ ID NO: 1915825 - RNA, 15 nt, Human
uucuuuuuauugaau

SEQ ID NO: 1915826 - RNA, 13 nt, Human
uucuuuuguaauu

SEQ ID NO: 1915827 - RNA, 20 nt, Human
aucagaccauaauguuacau

SEQ ID NO: 1915828 - RNA, 16 nt, Human
aucagaccauaauguu

SEQ ID NO: 1915829 - RNA, 19 nt, Human
aucagacuaugaaguuuuu

SEQ ID NO: 1915830 - RNA, 13 nt, Human
aucaggccaggcc

SEQ ID NO: 1915831 - RNA, 14 nt, Human
aucaggccaggccc

SEQ ID NO: 1915832 - RNA, 13 nt, Human
uucucagaaucuc

SEQ ID NO: 1915833 - RNA, 14 nt, Human
uucuauaauuuaaa

SEQ ID NO: 1915834 - RNA, 13 nt, Human
uucuauaauuuaa

SEQ ID NO: 1915835 - RNA, 21 nt, Human
uucucacugccaugccagcuu

SEQ ID NO: 1915836 - RNA, 20 nt, Human
uucgaugggcccaauucuua

SEQ ID NO: 1915837 - RNA, 21 nt, Human
uucgaugggcccaauucuuac

SEQ ID NO: 1915838 - RNA, 21 nt, Human
uucgcaggauucuuccucccu

SEQ ID NO: 1915839 - RNA, 14 nt, Human
uucgcauggucaca

SEQ ID NO: 1915840 - RNA, 16 nt, Human
uucgcauggucacaca

SEQ ID NO: 1915841 - RNA, 17 nt, Human
uucgcauggucacacac

SEQ ID NO: 1915842 - RNA, 18 nt, Human
uucgcauggucacacacu

SEQ ID NO: 1915843 - RNA, 19 nt, Human
uucgcauggucacacacug

SEQ ID NO: 1915844 - RNA, 20 nt, Human
uucgcauggucacacacuga

SEQ ID NO: 1915845 - RNA, 21 nt, Human
uucgcauggucacacacugau

SEQ ID NO: 1915846 - RNA, 23 nt, Human
uucgcauggucacacacugaugc

SEQ ID NO: 1915847 - RNA, 14 nt, Human
uucgagaccagccu

SEQ ID NO: 1915848 - RNA, 15 nt, Human
uucgagaccagccug

SEQ ID NO: 1915849 - RNA, 16 nt, Human
uucgagaccagccugg

SEQ ID NO: 1915850 - RNA, 19 nt, Human
uucgagaccagccuggcca

SEQ ID NO: 1915851 - RNA, 23 nt, Human
uucgacagcauuuuccucugcuu

SEQ ID NO: 1915852 - RNA, 16 nt, Human
uucgacagcauuuucc

SEQ ID NO: 1915853 - RNA, 22 nt, Human
uucgaaaccugggauucaggaa

SEQ ID NO: 1915854 - RNA, 19 nt, Human
uucuaaaucuccaaaauaa

SEQ ID NO: 1915855 - RNA, 13 nt, Human
uucgcuccugugu

SEQ ID NO: 1915856 - RNA, 22 nt, Human
uucgcgauggacagacucacaa

SEQ ID NO: 1915857 - RNA, 15 nt, Human
uucuaaaguaaaaac

SEQ ID NO: 1915858 - RNA, 13 nt, Human
uucuaaaguaaaa

SEQ ID NO: 1915859 - RNA, 18 nt, Human
uucccuuuuuuggcugcu

SEQ ID NO: 1915860 - RNA, 19 nt, Human
uucccuuuuuuggcugcug

SEQ ID NO: 1915861 - RNA, 20 nt, Human
uucccuuuuuuggcugcuga

SEQ ID NO: 1915862 - RNA, 17 nt, Human
uucccccuucacaaagc

SEQ ID NO: 1915863 - RNA, 19 nt, Human
uuccccuaaccucauuccc

SEQ ID NO: 1915864 - RNA, 15 nt, Human
uuccccuccuccacu

SEQ ID NO: 1915865 - RNA, 11 nt, Human
auauuuuaauu

SEQ ID NO: 1915866 - RNA, 20 nt, Human
auauuuuacauaaauuuagu

SEQ ID NO: 1915867 - RNA, 16 nt, Human
auauuuuacauaaauu

SEQ ID NO: 1915868 - RNA, 15 nt, Human
auauuuuacauaaau

SEQ ID NO: 1915869 - RNA, 22 nt, Human
aucaaccccuucgcuccugugu

SEQ ID NO: 1915870 - RNA, 20 nt, Human
aucaaccccuucgcuccugu

SEQ ID NO: 1915871 - RNA, 19 nt, Human
aucaaccccuucgcuccug

SEQ ID NO: 1915872 - RNA, 15 nt, Human
aucaaguugaauuga

SEQ ID NO: 1915873 - RNA, 14 nt, Human
aucaaguuauuuuu

SEQ ID NO: 1915874 - RNA, 20 nt, Human
aucaaguauuugggaaguga

SEQ ID NO: 1915875 - RNA, 21 nt, Human
aucaaguauuugggaagugaa

SEQ ID NO: 1915876 - RNA, 15 nt, Human
auauuuuuaauuaaa

SEQ ID NO: 1915877 - RNA, 13 nt, Human
auauuuuuagaua

SEQ ID NO: 1915878 - RNA, 16 nt, Human
auauuuuccaugaaaa

SEQ ID NO: 1915879 - RNA, 18 nt, Human
auauuuuccaugaaaaug

SEQ ID NO: 1915880 - RNA, 22 nt, Human
uuccuguccagcuccaaccugc

SEQ ID NO: 1915881 - RNA, 15 nt, Human
uuccuguccagcucc

SEQ ID NO: 1915882 - RNA, 16 nt, Human
uuccuguccagcucca

SEQ ID NO: 1915883 - RNA, 17 nt, Human
uuccuguccagcuccaa

SEQ ID NO: 1915884 - RNA, 22 nt, Human
uugugauaaguucuaguugcuu

SEQ ID NO: 1915885 - RNA, 18 nt, Human
uuguggccaaggagcugc

SEQ ID NO: 1915886 - RNA, 19 nt, Human
uuguggccaaggagcugcu

SEQ ID NO: 1915887 - RNA, 19 nt, Human
uugugauacaaugcugugc

SEQ ID NO: 1915888 - RNA, 18 nt, Human
uugugauacaaugcugug

SEQ ID NO: 1915889 - RNA, 17 nt, Human
uuguggcuauuaaaacu

SEQ ID NO: 1915890 - RNA, 20 nt, Human
uuguggccaaggagcugcua

SEQ ID NO: 1915891 - RNA, 22 nt, Human
uugugacuagugcugaagcuua

SEQ ID NO: 1915892 - RNA, 23 nt, Human
uugugacuagugcugaagcuuau

SEQ ID NO: 1915893 - RNA, 21 nt, Human
uugugacuagugcugaagcuu

SEQ ID NO: 1915894 - RNA, 17 nt, Human
uugugacuagugcugaa

SEQ ID NO: 1915895 - RNA, 16 nt, Human
uugugacuagugcuga

SEQ ID NO: 1915896 - RNA, 13 nt, Human
uugugacuagugc

SEQ ID NO: 1915897 - RNA, 21 nt, Human
uugugaggaagccgcuggggc

SEQ ID NO: 1915898 - RNA, 13 nt, Human
uugugguuaaucu

SEQ ID NO: 1915899 - RNA, 20 nt, Human
uuguucuggcucuuccaggc

SEQ ID NO: 1915900 - RNA, 22 nt, Human
uuguucuggcucuuccaggcug

SEQ ID NO: 1915901 - RNA, 19 nt, Human
uuguucugcuguucucuag

SEQ ID NO: 1915902 - RNA, 17 nt, Human
uuguguguuuauuguca

SEQ ID NO: 1915903 - RNA, 19 nt, Human
uuguucuggcucuuccagg

SEQ ID NO: 1915904 - RNA, 21 nt, Human
augcacauauggacucugcac

SEQ ID NO: 1915905 - RNA, 13 nt, Human
augcaccagcccu

SEQ ID NO: 1915906 - RNA, 21 nt, Human
augcaacaacauguauaauau

SEQ ID NO: 1915907 - RNA, 19 nt, Human
augcacauauggacucugc

SEQ ID NO: 1915908 - RNA, 16 nt, Human
augcaacaacauguau

SEQ ID NO: 1915909 - RNA, 14 nt, Human
augcaacaacaugu

SEQ ID NO: 1915910 - RNA, 14 nt, Human
augcaccagcccuu

SEQ ID NO: 1915911 - RNA, 12 nt, Human
augcacuuuguu

SEQ ID NO: 1915912 - RNA, 16 nt, Human
augauuuuuaaagaaa

SEQ ID NO: 1915913 - RNA, 14 nt, Human
augauuuuuaaaga

SEQ ID NO: 1915914 - RNA, 21 nt, Human
augauuuccuugaauguggcu

SEQ ID NO: 1915915 - RNA, 21 nt, Human
augauucaacagguuuuccug

SEQ ID NO: 1915916 - RNA, 21 nt, Human
augauucaaaugucuauaaac

SEQ ID NO: 1915917 - RNA, 13 nt, Human
augauuccuuccu

SEQ ID NO: 1915918 - RNA, 15 nt, Human
augauuccuuccugu

SEQ ID NO: 1915919 - RNA, 16 nt, Human
augauuccagguggca

SEQ ID NO: 1915920 - RNA, 15 nt, Human
augauuccagguggc

SEQ ID NO: 1915921 - RNA, 20 nt, Human
augauuaaccacuucagcug

SEQ ID NO: 1915922 - RNA, 21 nt, Human
augauuaaccacuucagcuga

SEQ ID NO: 1915923 - RNA, 19 nt, Human
augauuaaccacuucagcu

SEQ ID NO: 1915924 - RNA, 15 nt, Human
uuguugucugcaacu

SEQ ID NO: 1915925 - RNA, 15 nt, Human
uuuaagauaauuaua

SEQ ID NO: 1915926 - RNA, 15 nt, Human
uuuaagauaaauuau

SEQ ID NO: 1915927 - RNA, 14 nt, Human
uuuaagauaauuau

SEQ ID NO: 1915928 - RNA, 16 nt, Human
augcacuuuguucugg

SEQ ID NO: 1915929 - RNA, 15 nt, Human
augcacuuuguucug

SEQ ID NO: 1915930 - RNA, 13 nt, Human
uuguuuucagugu

SEQ ID NO: 1915931 - RNA, 16 nt, Human
uuguuuucaguguaca

SEQ ID NO: 1915932 - RNA, 14 nt, Human
uuuaaauguuuuuu

SEQ ID NO: 1915933 - RNA, 12 nt, Human
uuuaauuuuaca

SEQ ID NO: 1915934 - RNA, 23 nt, Human
uuuaauucaucccaacugucuuu

SEQ ID NO: 1915935 - RNA, 23 nt, Human
uuuaaugccgauauacucuagau

SEQ ID NO: 1915936 - RNA, 16 nt, Human
uuuaagugcugcauuu

SEQ ID NO: 1915937 - RNA, 15 nt, Human
uuuaagugcugcauu

SEQ ID NO: 1915938 - RNA, 19 nt, Human
uuuaagugcugcauuuaaa

SEQ ID NO: 1915939 - RNA, 17 nt, Human
uuuaagugcugcauuua

SEQ ID NO: 1915940 - RNA, 19 nt, Human
augcagucuguccaggcuc

SEQ ID NO: 1915941 - RNA, 20 nt, Human
augcagucuguccaggcucg

SEQ ID NO: 1915942 - RNA, 18 nt, Human
augcaggugaaacccagu

SEQ ID NO: 1915943 - RNA, 18 nt, Human
augcagucuguccaggcu

SEQ ID NO: 1915944 - RNA, 17 nt, Human
augcaggugaaacccag

SEQ ID NO: 1915945 - RNA, 15 nt, Human
augcagggcagucau

SEQ ID NO: 1915946 - RNA, 17 nt, Human
augcagccucacagucc

SEQ ID NO: 1915947 - RNA, 13 nt, Human
augcagggcaguc

SEQ ID NO: 1915948 - RNA, 14 nt, Human
augcagccucacag

SEQ ID NO: 1915949 - RNA, 15 nt, Human
augcagccucacagu

SEQ ID NO: 1915950 - RNA, 13 nt, Human
augcagccucaca

SEQ ID NO: 1915951 - RNA, 21 nt, Human
augcagccuaaggcuguauga

SEQ ID NO: 1915952 - RNA, 15 nt, Human
augcaguuuuccuua

SEQ ID NO: 1915953 - RNA, 17 nt, Human
augccacuaaauugaca

SEQ ID NO: 1915954 - RNA, 15 nt, Human
augccacuaaauuga

SEQ ID NO: 1915955 - RNA, 21 nt, Human
auggcuauaaacaauuacaug

SEQ ID NO: 1915956 - RNA, 18 nt, Human
auggcuaccuaaaaagau

SEQ ID NO: 1915957 - RNA, 20 nt, Human
auggcuaguaucaaaagaaa

SEQ ID NO: 1915958 - RNA, 18 nt, Human
auggccuuugauaaaugu

SEQ ID NO: 1915959 - RNA, 21 nt, Human
auggccucaagaucaaugaaa

SEQ ID NO: 1915960 - RNA, 18 nt, Human
auggccuaugcacauaug

SEQ ID NO: 1915961 - RNA, 18 nt, Human
auggccguguagaagcau

SEQ ID NO: 1915962 - RNA, 21 nt, Human
auggccguguagaagcauggu

SEQ ID NO: 1915963 - RNA, 20 nt, Human
auggccuuugcuugaaagaa

SEQ ID NO: 1915964 - RNA, 16 nt, Human
auggccugggggaugu

SEQ ID NO: 1915965 - RNA, 21 nt, Human
auggccgggcgcgguggcuca

SEQ ID NO: 1915966 - RNA, 18 nt, Human
auggccggagaggaccgg

SEQ ID NO: 1915967 - RNA, 22 nt, Human
auggccacaguagucuugauga

SEQ ID NO: 1915968 - RNA, 23 nt, Human
auggcacaucagcacgauuucug

SEQ ID NO: 1915969 - RNA, 17 nt, Human
auggcacaucagcacga

SEQ ID NO: 1915970 - RNA, 24 nt, Human
auggcaacagaucuggaaccucag

SEQ ID NO: 1915971 - RNA, 16 nt, Human
auggcaacagaucugg

SEQ ID NO: 1915972 - RNA, 17 nt, Human
auggcaacagaucugga

SEQ ID NO: 1915973 - RNA, 23 nt, Human
auggcacagcccaaagaaggaaa

SEQ ID NO: 1915974 - RNA, 19 nt, Human
auggacguguuaugacucc

SEQ ID NO: 1915975 - RNA, 20 nt, Human
auggacguguuaugacucca

SEQ ID NO: 1915976 - RNA, 18 nt, Human
auggauuuccagccaaag

SEQ ID NO: 1915977 - RNA, 23 nt, Human
auggacguguuaugacuccagaa

SEQ ID NO: 1915978 - RNA, 14 nt, Human
auggcaacagaucu

SEQ ID NO: 1915979 - RNA, 15 nt, Human
auggcaacagaucug

SEQ ID NO: 1915980 - RNA, 13 nt, Human
uuucacugccaua

SEQ ID NO: 1915981 - RNA, 13 nt, Human
uuucagaaaugug

SEQ ID NO: 1915982 - RNA, 16 nt, Human
auggaagacagcucuu

SEQ ID NO: 1915983 - RNA, 16 nt, Human
auggaauacucuuaua

SEQ ID NO: 1915984 - RNA, 17 nt, Human
auggaauacucuuauau

SEQ ID NO: 1915985 - RNA, 21 nt, Human
auggaaugaugggucaguugu

SEQ ID NO: 1915986 - RNA, 16 nt, Human
uuucauauuugcacua

SEQ ID NO: 1915987 - RNA, 22 nt, Human
uuucaucugcucuccuuccugg

SEQ ID NO: 1915988 - RNA, 12 nt, Human
uuucagaccuuu

SEQ ID NO: 1915989 - RNA, 13 nt, Human
uuucagaccuuuu

SEQ ID NO: 1915990 - RNA, 21 nt, Human
uuucagacucccauuccugaa

SEQ ID NO: 1915991 - RNA, 11 nt, Human
uuucagacucc

SEQ ID NO: 1915992 - RNA, 14 nt, Human
auggacaugaucuu

SEQ ID NO: 1915993 - RNA, 14 nt, Human
auggacaggcuggc

SEQ ID NO: 1915994 - RNA, 20 nt, Human
auggacagaagaaggcagca

SEQ ID NO: 1915995 - RNA, 19 nt, Human
auggacagaagaaggcagc

SEQ ID NO: 1915996 - RNA, 19 nt, Human
auggacaggcuggcuccag

SEQ ID NO: 1915997 - RNA, 22 nt, Human
uuucccccaccccauuucucuc

SEQ ID NO: 1915998 - RNA, 23 nt, Human
uuucaugugcggggaucaucugc

SEQ ID NO: 1915999 - RNA, 20 nt, Human
uuuauggcuuuugugcauua

SEQ ID NO: 1916000 - RNA, 22 nt, Human
uuuaugggucagaguuccgacu

SEQ ID NO: 1916001 - RNA, 24 nt, Human
uuuauggcuuuugugcauuaucua

SEQ ID NO: 1916002 - RNA, 23 nt, Human
uuuauguuugcacuugugauuau

SEQ ID NO: 1916003 - RNA, 13 nt, Human
uuuaugugugugu

SEQ ID NO: 1916004 - RNA, 11 nt, Human
uuuaugugugu

SEQ ID NO: 1916005 - RNA, 12 nt, Human
uuuaugugaugg

SEQ ID NO: 1916006 - RNA, 16 nt, Human
uuuaguaucuuuuuau

SEQ ID NO: 1916007 - RNA, 15 nt, Human
uuuaguagagacagg

SEQ ID NO: 1916008 - RNA, 19 nt, Human
uuuagcaguaaaauagcug

SEQ ID NO: 1916009 - RNA, 22 nt, Human
uuuagcagcagccuuuaaugca

SEQ ID NO: 1916010 - RNA, 19 nt, Human
augcuagaacucccuuuca

SEQ ID NO: 1916011 - RNA, 16 nt, Human
augcuagaacucccuu

SEQ ID NO: 1916012 - RNA, 15 nt, Human
augcuccuuguuccu

SEQ ID NO: 1916013 - RNA, 18 nt, Human
augcuccuuguuccuaga

SEQ ID NO: 1916014 - RNA, 16 nt, Human
augcucuagugccuuc

SEQ ID NO: 1916015 - RNA, 17 nt, Human
augcucuagugccuucu

SEQ ID NO: 1916016 - RNA, 15 nt, Human
augcuagaacucccu

SEQ ID NO: 1916017 - RNA, 14 nt, Human
uuuauuaccucuga

SEQ ID NO: 1916018 - RNA, 20 nt, Human
uuuauuaccucugauaccuc

SEQ ID NO: 1916019 - RNA, 12 nt, Human
uuuauuaccccc

SEQ ID NO: 1916020 - RNA, 17 nt, Human
uuuauuacccccuccuu

SEQ ID NO: 1916021 - RNA, 23 nt, Human
uuuauuacccccuccuucagaca

SEQ ID NO: 1916022 - RNA, 13 nt, Human
uuuauuaccucug

SEQ ID NO: 1916023 - RNA, 15 nt, Human
augcucugcauguua

SEQ ID NO: 1916024 - RNA, 12 nt, Human
augcuggcccag

SEQ ID NO: 1916025 - RNA, 13 nt, Human
augcuggcccagg

SEQ ID NO: 1916026 - RNA, 15 nt, Human
augcuggcccagggc

SEQ ID NO: 1916027 - RNA, 16 nt, Human
augcuggcccagggcc

SEQ ID NO: 1916028 - RNA, 18 nt, Human
augcuggcccagggccca

SEQ ID NO: 1916029 - RNA, 13 nt, Human
augcugguuuuuc

SEQ ID NO: 1916030 - RNA, 22 nt, Human
augcuguaacuuucugaaauaa

SEQ ID NO: 1916031 - RNA, 19 nt, Human
augcuggcccagggcccag

SEQ ID NO: 1916032 - RNA, 20 nt, Human
augcuggcccagggcccaga

SEQ ID NO: 1916033 - RNA, 21 nt, Human
augcuggcccagggcccagag

SEQ ID NO: 1916034 - RNA, 22 nt, Human
augcuggcccagggcccagagc

SEQ ID NO: 1916035 - RNA, 23 nt, Human
augcuggcccagggcccagagcc

SEQ ID NO: 1916036 - RNA, 15 nt, Human
auggaagacagcucu

SEQ ID NO: 1916037 - RNA, 16 nt, Human
auggaacacucugaga

SEQ ID NO: 1916038 - RNA, 11 nt, Human
auggaacacuc

SEQ ID NO: 1916039 - RNA, 22 nt, Human
augcuguacaucuauuuuggau

SEQ ID NO: 1916040 - RNA, 23 nt, Human
augcuucauacagggaugguguu

SEQ ID NO: 1916041 - RNA, 14 nt, Human
auggaacacucuga

SEQ ID NO: 1916042 - RNA, 15 nt, Human
auggaacacucugag

SEQ ID NO: 1916043 - RNA, 19 nt, Human
augcugucccuuacgugag

SEQ ID NO: 1916044 - RNA, 12 nt, Human
augcuguacauc

SEQ ID NO: 1916045 - RNA, 16 nt, Human
augcuguacaucuauu

SEQ ID NO: 1916046 - RNA, 23 nt, Human
augcugucccuuacgugaguccu

SEQ ID NO: 1916047 - RNA, 10 nt, Human
augcuucaua

SEQ ID NO: 1916048 - RNA, 12 nt, Human
augcuucauaca

SEQ ID NO: 1916049 - RNA, 11 nt, Human
augcuucauac

SEQ ID NO: 1916050 - RNA, 19 nt, Human
augcuucauacagggaugg

SEQ ID NO: 1916051 - RNA, 16 nt, Human
augcuucauacaggga

SEQ ID NO: 1916052 - RNA, 15 nt, Human
augcuucauacaggg

SEQ ID NO: 1916053 - RNA, 13 nt, Human
augcuucauacag

SEQ ID NO: 1916054 - RNA, 23 nt, Human
augagaagaaaauggaaccaggc

SEQ ID NO: 1916055 - RNA, 16 nt, Human
augagaaggaacuucc

SEQ ID NO: 1916056 - RNA, 23 nt, Human
augagaaucuacccccagaucca

SEQ ID NO: 1916057 - RNA, 18 nt, Human
augagaccacuguuauca

SEQ ID NO: 1916058 - RNA, 13 nt, Human
augagacacagga

SEQ ID NO: 1916059 - RNA, 14 nt, Human
augagacacaggau

SEQ ID NO: 1916060 - RNA, 21 nt, Human
augagaagaaaauggaaccag

SEQ ID NO: 1916061 - RNA, 14 nt, Human
augagaacucugag

SEQ ID NO: 1916062 - RNA, 23 nt, Human
augagaaaucuaaaaaacgaaaa

SEQ ID NO: 1916063 - RNA, 13 nt, Human
augagaacaaaca

SEQ ID NO: 1916064 - RNA, 22 nt, Human
augagaaagguugaagcaccaa

SEQ ID NO: 1916065 - RNA, 21 nt, Human
augagaaagguugaagcacca

SEQ ID NO: 1916066 - RNA, 15 nt, Human
augagaaaucuaaaa

SEQ ID NO: 1916067 - RNA, 18 nt, Human
augagaaaucuaaaaaac

SEQ ID NO: 1916068 - RNA, 14 nt, Human
augaccacaccugc

SEQ ID NO: 1916069 - RNA, 17 nt, Human
augacuuacuguacaug

SEQ ID NO: 1916070 - RNA, 16 nt, Human
augacuuacuguacau

SEQ ID NO: 1916071 - RNA, 17 nt, Human
augagaaaaugucuuua

SEQ ID NO: 1916072 - RNA, 14 nt, Human
augacuuacuguac

SEQ ID NO: 1916073 - RNA, 22 nt, Human
augacuuaagcacacuugacau

SEQ ID NO: 1916074 - RNA, 19 nt, Human
augacauuguuaaaauaaa

SEQ ID NO: 1916075 - RNA, 21 nt, Human
augacauuucuuugugcuuug

SEQ ID NO: 1916076 - RNA, 22 nt, Human
augacauuucuuugugcuuugg

SEQ ID NO: 1916077 - RNA, 15 nt, Human
augaccaaaguccuu

SEQ ID NO: 1916078 - RNA, 18 nt, Human
augacacgaauauugcug

SEQ ID NO: 1916079 - RNA, 22 nt, Human
augacacaugcaaggucauuuu

SEQ ID NO: 1916080 - RNA, 14 nt, Human
augacacaugcaag

SEQ ID NO: 1916081 - RNA, 19 nt, Human
uuguauauuguguuugugu

SEQ ID NO: 1916082 - RNA, 13 nt, Human
uuguauauugugu

SEQ ID NO: 1916083 - RNA, 15 nt, Human
uuguauauuguguuu

SEQ ID NO: 1916084 - RNA, 13 nt, Human
uugguucuguguc

SEQ ID NO: 1916085 - RNA, 15 nt, Human
uugguucuaauagaa

SEQ ID NO: 1916086 - RNA, 19 nt, Human
uugguucuaauagaacuca

SEQ ID NO: 1916087 - RNA, 16 nt, Human
uugguuuaauuuaaag

SEQ ID NO: 1916088 - RNA, 22 nt, Human
augaauguuuacacucuuugua

SEQ ID NO: 1916089 - RNA, 11 nt, Human
augaauguuua

SEQ ID NO: 1916090 - RNA, 17 nt, Human
uugggccagacaugcca

SEQ ID NO: 1916091 - RNA, 14 nt, Human
uuggggauauuuuu

SEQ ID NO: 1916092 - RNA, 16 nt, Human
uugggccugcuccaga

SEQ ID NO: 1916093 - RNA, 17 nt, Human
uugggccugcuccagac

SEQ ID NO: 1916094 - RNA, 22 nt, Human
uuggggggcugaggugggagga

SEQ ID NO: 1916095 - RNA, 16 nt, Human
uuggggggcauauauu

SEQ ID NO: 1916096 - RNA, 19 nt, Human
uugggccugcuccagaccu

SEQ ID NO: 1916097 - RNA, 16 nt, Human
augaacucuuaaucaa

SEQ ID NO: 1916098 - RNA, 14 nt, Human
augaacucaacuuu

SEQ ID NO: 1916099 - RNA, 21 nt, Human
augaaccuucuggccucccac

SEQ ID NO: 1916100 - RNA, 24 nt, Human
augaaccuucuggccucccacaga

SEQ ID NO: 1916101 - RNA, 15 nt, Human
augaagauacugaaa

SEQ ID NO: 1916102 - RNA, 15 nt, Human
augaaagggcccaga

SEQ ID NO: 1916103 - RNA, 20 nt, Human
augaaugucagugugacuga

SEQ ID NO: 1916104 - RNA, 16 nt, Human
augaaugagaaucuac

SEQ ID NO: 1916105 - RNA, 13 nt, Human
augaaugaauggc

SEQ ID NO: 1916106 - RNA, 18 nt, Human
augaagauguagaggaga

SEQ ID NO: 1916107 - RNA, 17 nt, Human
augaagauacugaaaua

SEQ ID NO: 1916108 - RNA, 16 nt, Human
augaagauacugaaau

SEQ ID NO: 1916109 - RNA, 22 nt, Human
augaagauauuugcuuuaauaa

SEQ ID NO: 1916110 - RNA, 18 nt, Human
uuggcuagagguucaaag

SEQ ID NO: 1916111 - RNA, 23 nt, Human
uuggcgcugccccuggcagcccc

SEQ ID NO: 1916112 - RNA, 22 nt, Human
uuggaugggacuagagcuuucu

SEQ ID NO: 1916113 - RNA, 15 nt, Human
augaaagcagggacu

SEQ ID NO: 1916114 - RNA, 12 nt, Human
augaaagauuca

SEQ ID NO: 1916115 - RNA, 23 nt, Human
aucuuuggacagaagcagcucuu

SEQ ID NO: 1916116 - RNA, 12 nt, Human
aucuuugugaag

SEQ ID NO: 1916117 - RNA, 22 nt, Human
aucuuuuguucccauccucuuc

SEQ ID NO: 1916118 - RNA, 16 nt, Human
aucuuuuguucccauc

SEQ ID NO: 1916119 - RNA, 13 nt, Human
aucuuuuuauuca

SEQ ID NO: 1916120 - RNA, 13 nt, Human
uuggcugcaggga

SEQ ID NO: 1916121 - RNA, 17 nt, Human
aucuuuacaaaacuaca

SEQ ID NO: 1916122 - RNA, 21 nt, Human
aucuuuacaaaacuacaugag

SEQ ID NO: 1916123 - RNA, 22 nt, Human
aucuuuaauuuuacauuuccua

SEQ ID NO: 1916124 - RNA, 16 nt, Human
aucuuuaauuuuacau

SEQ ID NO: 1916125 - RNA, 21 nt, Human
aucuuuaauuuuacauuuccu

SEQ ID NO: 1916126 - RNA, 18 nt, Human
aucuuugcagacaggcaa

SEQ ID NO: 1916127 - RNA, 13 nt, Human
aucuuuauuaauc

SEQ ID NO: 1916128 - RNA, 14 nt, Human
aucuuuauuaauca

SEQ ID NO: 1916129 - RNA, 22 nt, Human
aucuuuggacagaagcagcucu

SEQ ID NO: 1916130 - RNA, 14 nt, Human
aucucagggccugg

SEQ ID NO: 1916131 - RNA, 20 nt, Human
aucucaccuccugcugggca

SEQ ID NO: 1916132 - RNA, 21 nt, Human
aucucaccuccugcugggcag

SEQ ID NO: 1916133 - RNA, 20 nt, Human
aucucagaucaguguaccau

SEQ ID NO: 1916134 - RNA, 15 nt, Human
auccuaguuccacca

SEQ ID NO: 1916135 - RNA, 19 nt, Human
auccuaguuccaccaucaa

SEQ ID NO: 1916136 - RNA, 17 nt, Human
aucucaccuccugcugg

SEQ ID NO: 1916137 - RNA, 16 nt, Human
aucucacacaugagca

SEQ ID NO: 1916138 - RNA, 15 nt, Human
aucucacacaugagc

SEQ ID NO: 1916139 - RNA, 13 nt, Human
aucuccaaaauaa

SEQ ID NO: 1916140 - RNA, 23 nt, Human
aucucagugguuaagauuccuaa

SEQ ID NO: 1916141 - RNA, 16 nt, Human
aucuccccaucauugg

SEQ ID NO: 1916142 - RNA, 20 nt, Human
aucucccaccuagcagcacc

SEQ ID NO: 1916143 - RNA, 18 nt, Human
aucucccaccuagcagca

SEQ ID NO: 1916144 - RNA, 19 nt, Human
aucucccaccuagcagcac

SEQ ID NO: 1916145 - RNA, 14 nt, Human
aucucccccagccc

SEQ ID NO: 1916146 - RNA, 18 nt, Human
aucucuuagcauuuuaau

SEQ ID NO: 1916147 - RNA, 19 nt, Human
aucucuuagcuccccucca

SEQ ID NO: 1916148 - RNA, 18 nt, Human
aucucuuagcuccccucc

SEQ ID NO: 1916149 - RNA, 16 nt, Human
aucucuuagcuccccu

SEQ ID NO: 1916150 - RNA, 13 nt, Human
aucucuuagcucc

SEQ ID NO: 1916151 - RNA, 12 nt, Human
aucucccccagc

SEQ ID NO: 1916152 - RNA, 13 nt, Human
aucucccccagcc

SEQ ID NO: 1916153 - RNA, 19 nt, Human
uugcacaaaccaauuaaac

SEQ ID NO: 1916154 - RNA, 15 nt, Human
uugcaauuccugcuc

SEQ ID NO: 1916155 - RNA, 15 nt, Human
uugauucagacagcu

SEQ ID NO: 1916156 - RNA, 16 nt, Human
uugauucagacagcug

SEQ ID NO: 1916157 - RNA, 14 nt, Human
uugcaucugaaaau

SEQ ID NO: 1916158 - RNA, 12 nt, Human
uugaugccuggc

SEQ ID NO: 1916159 - RNA, 23 nt, Human
aucucuuagcuccccuccaaccu

SEQ ID NO: 1916160 - RNA, 22 nt, Human
aucucuuagcuccccuccaacc

SEQ ID NO: 1916161 - RNA, 15 nt, Human
uugaugggauuuggu

SEQ ID NO: 1916162 - RNA, 17 nt, Human
uugaugcugacagucau

SEQ ID NO: 1916163 - RNA, 14 nt, Human
uugauucagacagc

SEQ ID NO: 1916164 - RNA, 13 nt, Human
uugauucacuuca

SEQ ID NO: 1916165 - RNA, 16 nt, Human
uugaugugugucuagg

SEQ ID NO: 1916166 - RNA, 18 nt, Human
aucugauauguauuguuu

SEQ ID NO: 1916167 - RNA, 14 nt, Human
aucugauauguauu

SEQ ID NO: 1916168 - RNA, 19 nt, Human
aucugagcucuuugcacua

SEQ ID NO: 1916169 - RNA, 18 nt, Human
aucugagcucuuugcacu

SEQ ID NO: 1916170 - RNA, 20 nt, Human
aucugagaggccacagugca

SEQ ID NO: 1916171 - RNA, 13 nt, Human
uugccgucuaccu

SEQ ID NO: 1916172 - RNA, 18 nt, Human
uugccgcgucgcccuccc

SEQ ID NO: 1916173 - RNA, 21 nt, Human
uugccgcgucgcccucccagg

SEQ ID NO: 1916174 - RNA, 12 nt, Human
uugcauucuccc

SEQ ID NO: 1916175 - RNA, 13 nt, Human
uugcauuaaauuc

SEQ ID NO: 1916176 - RNA, 20 nt, Human
uugcauuaaauucacaaacu

SEQ ID NO: 1916177 - RNA, 21 nt, Human
uugcauuaaauucacaaacuu

SEQ ID NO: 1916178 - RNA, 22 nt, Human
uugcauuaaauucacaaacuuu

SEQ ID NO: 1916179 - RNA, 14 nt, Human
uugccguuauuaaa

SEQ ID NO: 1916180 - RNA, 19 nt, Human
uugccgucuaccugagggg

SEQ ID NO: 1916181 - RNA, 15 nt, Human
uugccgucuaccuga

SEQ ID NO: 1916182 - RNA, 18 nt, Human
uugccgucuaccugaggg

SEQ ID NO: 1916183 - RNA, 22 nt, Human
uugccgcgucgcccucccaggc

SEQ ID NO: 1916184 - RNA, 16 nt, Human
uugccgguggugcagg

SEQ ID NO: 1916185 - RNA, 19 nt, Human
aucuggguucacugcaacc

SEQ ID NO: 1916186 - RNA, 22 nt, Human
aucugguaccaguugaaauuuu

SEQ ID NO: 1916187 - RNA, 17 nt, Human
aucuggguucacugcaa

SEQ ID NO: 1916188 - RNA, 14 nt, Human
aucugguccuaccc

SEQ ID NO: 1916189 - RNA, 17 nt, Human
aucugguccuacccauc

SEQ ID NO: 1916190 - RNA, 18 nt, Human
aucugguccuacccaucc

SEQ ID NO: 1916191 - RNA, 21 nt, Human
aucugguccuacccauccccg

SEQ ID NO: 1916192 - RNA, 16 nt, Human
aucuguaccucugccu

SEQ ID NO: 1916193 - RNA, 23 nt, Human
aucugugaaaggaaagagggagg

SEQ ID NO: 1916194 - RNA, 19 nt, Human
aucuugcucugcugacaga

SEQ ID NO: 1916195 - RNA, 17 nt, Human
aucuugcucugcugaca

SEQ ID NO: 1916196 - RNA, 21 nt, Human
aucuugauaccaccuauauag

SEQ ID NO: 1916197 - RNA, 15 nt, Human
aucuugcucugcuug

SEQ ID NO: 1916198 - RNA, 18 nt, Human
aucuugaauuguaaggaa

SEQ ID NO: 1916199 - RNA, 12 nt, Human
aucuguuuacag

SEQ ID NO: 1916200 - RNA, 23 nt, Human
caacuuguauuaaagacagaggc

SEQ ID NO: 1916201 - RNA, 15 nt, Human
caagaaaugaaagca

SEQ ID NO: 1916202 - RNA, 19 nt, Human
caagaaaugaaagcaggga

SEQ ID NO: 1916203 - RNA, 17 nt, Human
caagaaaugaaagcagg

SEQ ID NO: 1916204 - RNA, 14 nt, Human
caagaagcccagga

SEQ ID NO: 1916205 - RNA, 13 nt, Human
caagaagcccagg

SEQ ID NO: 1916206 - RNA, 13 nt, Human
caagagcccaggc

SEQ ID NO: 1916207 - RNA, 12 nt, Human
caagagcugagg

SEQ ID NO: 1916208 - RNA, 21 nt, Human
caagaccuucuccuucaccuu

SEQ ID NO: 1916209 - RNA, 23 nt, Human
caagaccuucuccuucaccuuug

SEQ ID NO: 1916210 - RNA, 13 nt, Human
caagacgcugugc

SEQ ID NO: 1916211 - RNA, 15 nt, Human
caagacgcugugcug

SEQ ID NO: 1916212 - RNA, 22 nt, Human
caagagaauugcuugaacccag

SEQ ID NO: 1916213 - RNA, 12 nt, Human
caacaggcuggg

SEQ ID NO: 1916214 - RNA, 17 nt, Human
caacauacucccaucug

SEQ ID NO: 1916215 - RNA, 19 nt, Human
caacauacucccaucugug

SEQ ID NO: 1916216 - RNA, 20 nt, Human
caacauacucccaucuguga

SEQ ID NO: 1916217 - RNA, 20 nt, Human
caaccuggggggcaguggug

SEQ ID NO: 1916218 - RNA, 22 nt, Human
caaauuucuaaaucuccaaaau

SEQ ID NO: 1916219 - RNA, 15 nt, Human
caaauuucuaaaucu

SEQ ID NO: 1916220 - RNA, 15 nt, Human
caaauuuuauuugua

SEQ ID NO: 1916221 - RNA, 17 nt, Human
caaauuuuauuuguagg

SEQ ID NO: 1916222 - RNA, 14 nt, Human
caaauuugauugau

SEQ ID NO: 1916223 - RNA, 17 nt, Human
caaauuugauugauuug

SEQ ID NO: 1916224 - RNA, 16 nt, Human
caaauuacucuuucuc

SEQ ID NO: 1916225 - RNA, 19 nt, Human
caaauuacucuuucuccau

SEQ ID NO: 1916226 - RNA, 11 nt, Human
caaauuagaaa

SEQ ID NO: 1916227 - RNA, 12 nt, Human
caaauuagaaaa

SEQ ID NO: 1916228 - RNA, 13 nt, Human
caaauuagaaaau

SEQ ID NO: 1916229 - RNA, 18 nt, Human
caaauuagaaaauguuau

SEQ ID NO: 1916230 - RNA, 19 nt, Human
caaauuagaaaauguuauu

SEQ ID NO: 1916231 - RNA, 22 nt, Human
caaauuagaaaauguuauuuaa

SEQ ID NO: 1916232 - RNA, 15 nt, Human
caacagaagcuucca

SEQ ID NO: 1916233 - RNA, 10 nt, Human
caacagaaaa

SEQ ID NO: 1916234 - RNA, 14 nt, Human
caacagaaaaaugg

SEQ ID NO: 1916235 - RNA, 15 nt, Human
caacagaagaacugu

SEQ ID NO: 1916236 - RNA, 13 nt, Human
caacagaucugga

SEQ ID NO: 1916237 - RNA, 14 nt, Human
caacagaucuggaa

SEQ ID NO: 1916238 - RNA, 17 nt, Human
caacagaucuggaaccu

SEQ ID NO: 1916239 - RNA, 23 nt, Human
caacagaucuggaaccucagccu

SEQ ID NO: 1916240 - RNA, 23 nt, Human
caaauauauucagccuggcuuca

SEQ ID NO: 1916241 - RNA, 23 nt, Human
caaauggaaaugggcagagcaga

SEQ ID NO: 1916242 - RNA, 18 nt, Human
caaauggcgucuggaagu

SEQ ID NO: 1916243 - RNA, 14 nt, Human
caaauguucaucaa

SEQ ID NO: 1916244 - RNA, 19 nt, Human
caaauggcgucuggaaguc

SEQ ID NO: 1916245 - RNA, 21 nt, Human
caaauggcgucuggaagucca

SEQ ID NO: 1916246 - RNA, 18 nt, Human
caaauguucaucaaugaa

SEQ ID NO: 1916247 - RNA, 22 nt, Human
caaauggcgucuggaaguccaa

SEQ ID NO: 1916248 - RNA, 19 nt, Human
caaagugcugggauuacaa

SEQ ID NO: 1916249 - RNA, 13 nt, Human
caaagugcuggga

SEQ ID NO: 1916250 - RNA, 17 nt, Human
caaagagaaaaagaaau

SEQ ID NO: 1916251 - RNA, 19 nt, Human
caaagagaaaaagaaaugc

SEQ ID NO: 1916252 - RNA, 20 nt, Human
caaagagaaaaagaaaugca

SEQ ID NO: 1916253 - RNA, 21 nt, Human
caaagagaaaaagaaaugcaa

SEQ ID NO: 1916254 - RNA, 19 nt, Human
caaagaaggaaaaggcagg

SEQ ID NO: 1916255 - RNA, 21 nt, Human
caaagaacauguagaaaacaa

SEQ ID NO: 1916256 - RNA, 22 nt, Human
caaagaacauguagaaaacaaa

SEQ ID NO: 1916257 - RNA, 16 nt, Human
caaaguuacuagguaa

SEQ ID NO: 1916258 - RNA, 21 nt, Human
caaaguuacuagguaacuuca

SEQ ID NO: 1916259 - RNA, 16 nt, Human
caaaguuccaaaaugc

SEQ ID NO: 1916260 - RNA, 18 nt, Human
caaaguuccaaaaugcca

SEQ ID NO: 1916261 - RNA, 23 nt, Human
caaagugcugggauuacaagcgu

SEQ ID NO: 1916262 - RNA, 21 nt, Human
caaaaucgaugcagugcuucc

SEQ ID NO: 1916263 - RNA, 20 nt, Human
caaaauaaaacuuuuuaaaa

SEQ ID NO: 1916264 - RNA, 16 nt, Human
caaaauaaaacuuuuu

SEQ ID NO: 1916265 - RNA, 14 nt, Human
caaaaguuucucuu

SEQ ID NO: 1916266 - RNA, 23 nt, Human
caaaacucuccucugcugcuggc

SEQ ID NO: 1916267 - RNA, 19 nt, Human
caaaacucuccucugcugc

SEQ ID NO: 1916268 - RNA, 15 nt, Human
caaaacucuccucug

SEQ ID NO: 1916269 - RNA, 16 nt, Human
caaaacucuccucugc

SEQ ID NO: 1916270 - RNA, 18 nt, Human
auuuuauuuuauuaugca

SEQ ID NO: 1916271 - RNA, 15 nt, Human
caaaacgguuuuacu

SEQ ID NO: 1916272 - RNA, 21 nt, Human
caaaacgguuuuacugcagcu

SEQ ID NO: 1916273 - RNA, 13 nt, Human
caaacagaggccg

SEQ ID NO: 1916274 - RNA, 15 nt, Human
caaacagaggccgcc

SEQ ID NO: 1916275 - RNA, 16 nt, Human
caaacagaaaacaugu

SEQ ID NO: 1916276 - RNA, 18 nt, Human
caaacaaaauuucuauua

SEQ ID NO: 1916277 - RNA, 15 nt, Human
caaacaaaauuucua

SEQ ID NO: 1916278 - RNA, 14 nt, Human
caaacaaaauuucu

SEQ ID NO: 1916279 - RNA, 11 nt, Human
caaaaugaaac

SEQ ID NO: 1916280 - RNA, 22 nt, Human
caaaaugaaacgcaaccaccac

SEQ ID NO: 1916281 - RNA, 14 nt, Human
caaaauuucuauua

SEQ ID NO: 1916282 - RNA, 21 nt, Human
caaacucuugaccucagguga

SEQ ID NO: 1916283 - RNA, 19 nt, Human
caaagaaauuuccacucag

SEQ ID NO: 1916284 - RNA, 18 nt, Human
caaagaaauuuccacuca

SEQ ID NO: 1916285 - RNA, 12 nt, Human
caaagaaauuuc

SEQ ID NO: 1916286 - RNA, 20 nt, Human
caaacucuugaccucaggug

SEQ ID NO: 1916287 - RNA, 19 nt, Human
caaacucuugaccucaggu

SEQ ID NO: 1916288 - RNA, 17 nt, Human
caaacucuugaccucag

SEQ ID NO: 1916289 - RNA, 14 nt, Human
caaacucucugaac

SEQ ID NO: 1916290 - RNA, 12 nt, Human
caaaccuucaca

SEQ ID NO: 1916291 - RNA, 13 nt, Human
caacaggcugggc

SEQ ID NO: 1916292 - RNA, 20 nt, Human
cacaaaggcaaaggguccag

SEQ ID NO: 1916293 - RNA, 13 nt, Human
cacaaagggccca

SEQ ID NO: 1916294 - RNA, 18 nt, Human
cacaagaaaugaaagcag

SEQ ID NO: 1916295 - RNA, 13 nt, Human
cacaaaggagagc

SEQ ID NO: 1916296 - RNA, 21 nt, Human
cacaagaaaugaaagcaggga

SEQ ID NO: 1916297 - RNA, 20 nt, Human
cacaagaaaugaaagcaggg

SEQ ID NO: 1916298 - RNA, 21 nt, Human
cacaaguggugguaacccugg

SEQ ID NO: 1916299 - RNA, 16 nt, Human
cacaaagggcccagau

SEQ ID NO: 1916300 - RNA, 15 nt, Human
cacaaagggcccaga

SEQ ID NO: 1916301 - RNA, 14 nt, Human
cacaagugguggua

SEQ ID NO: 1916302 - RNA, 20 nt, Human
cacaaguggugguaacccug

SEQ ID NO: 1916303 - RNA, 21 nt, Human
cacaauaccuuauuuaaguaa

SEQ ID NO: 1916304 - RNA, 13 nt, Human
cacaauacaauaa

SEQ ID NO: 1916305 - RNA, 17 nt, Human
cacacacgcgugcacac

SEQ ID NO: 1916306 - RNA, 17 nt, Human
caauguuucuucuaggu

SEQ ID NO: 1916307 - RNA, 21 nt, Human
caauguuuauuucauaaagaa

SEQ ID NO: 1916308 - RNA, 17 nt, Human
caauguuguuuuaagac

SEQ ID NO: 1916309 - RNA, 17 nt, Human
caauuacaggaaguacu

SEQ ID NO: 1916310 - RNA, 17 nt, Human
caauguuuuuaaaaauc

SEQ ID NO: 1916311 - RNA, 20 nt, Human
caaugugucuuucuuuuugg

SEQ ID NO: 1916312 - RNA, 21 nt, Human
caauaucuuuuuuuuaauaaa

SEQ ID NO: 1916313 - RNA, 12 nt, Human
caauauccuuug

SEQ ID NO: 1916314 - RNA, 13 nt, Human
caauauccuuugc

SEQ ID NO: 1916315 - RNA, 15 nt, Human
caauauccuuugccu

SEQ ID NO: 1916316 - RNA, 20 nt, Human
caauauccuuugccucaagg

SEQ ID NO: 1916317 - RNA, 22 nt, Human
caaugugaaaagaaaaaugagc

SEQ ID NO: 1916318 - RNA, 14 nt, Human
caaugugaacuuua

SEQ ID NO: 1916319 - RNA, 15 nt, Human
caaugugaacuuuau

SEQ ID NO: 1916320 - RNA, 18 nt, Human
caaugugaacuuuauuaa

SEQ ID NO: 1916321 - RNA, 19 nt, Human
caaugugaacuuuauuaaa

SEQ ID NO: 1916322 - RNA, 21 nt, Human
caaugugaacuuuauuaaaua

SEQ ID NO: 1916323 - RNA, 22 nt, Human
caaugugacuuaaugccacuaa

SEQ ID NO: 1916324 - RNA, 23 nt, Human
caauguggcaaggaaaaacaggu

SEQ ID NO: 1916325 - RNA, 13 nt, Human
caauuccaccugc

SEQ ID NO: 1916326 - RNA, 18 nt, Human
caauuacaggaaguacug

SEQ ID NO: 1916327 - RNA, 23 nt, Human
caauuaaaaaaaaagaucuguuu

SEQ ID NO: 1916328 - RNA, 18 nt, Human
caauguuuuuaaaaaucu

SEQ ID NO: 1916329 - RNA, 15 nt, Human
caauuccucugggaa

SEQ ID NO: 1916330 - RNA, 13 nt, Human
caauuccucuggg

SEQ ID NO: 1916331 - RNA, 14 nt, Human
caauuccucuggga

SEQ ID NO: 1916332 - RNA, 13 nt, Human
cacaaacagaggc

SEQ ID NO: 1916333 - RNA, 15 nt, Human
cacaaacagaggccg

SEQ ID NO: 1916334 - RNA, 14 nt, Human
cacaaacagaggcc

SEQ ID NO: 1916335 - RNA, 16 nt, Human
caauuuuuuuuuccuu

SEQ ID NO: 1916336 - RNA, 12 nt, Human
cacagagaaagu

SEQ ID NO: 1916337 - RNA, 21 nt, Human
cacagagaaaguacuucucca

SEQ ID NO: 1916338 - RNA, 20 nt, Human
cacagagaaaguacuucucc

SEQ ID NO: 1916339 - RNA, 19 nt, Human
cacagagaaaguacuucuc

SEQ ID NO: 1916340 - RNA, 23 nt, Human
cacagaugggugcuuggaggaag

SEQ ID NO: 1916341 - RNA, 21 nt, Human
cacagaguuguuacauuuuua

SEQ ID NO: 1916342 - RNA, 22 nt, Human
cacagaguuguuacauuuuuaa

SEQ ID NO: 1916343 - RNA, 13 nt, Human
cacagaggcugcc

SEQ ID NO: 1916344 - RNA, 13 nt, Human
cacagccaccccu

SEQ ID NO: 1916345 - RNA, 20 nt, Human
caaggaaaaaauaacaauga

SEQ ID NO: 1916346 - RNA, 18 nt, Human
caaggaaaaaauaacaau

SEQ ID NO: 1916347 - RNA, 23 nt, Human
caagcuggucccacucaguccau

SEQ ID NO: 1916348 - RNA, 22 nt, Human
caagcuggucccacucagucca

SEQ ID NO: 1916349 - RNA, 16 nt, Human
caaggagauuuacaac

SEQ ID NO: 1916350 - RNA, 13 nt, Human
caaggagaugaag

SEQ ID NO: 1916351 - RNA, 23 nt, Human
caaggagaugaagcaaacacauu

SEQ ID NO: 1916352 - RNA, 18 nt, Human
caaggauccugagccaga

SEQ ID NO: 1916353 - RNA, 19 nt, Human
caaggauccugagccagau

SEQ ID NO: 1916354 - RNA, 22 nt, Human
caaggauccugagccagauuuc

SEQ ID NO: 1916355 - RNA, 20 nt, Human
caaggauccugagccagauu

SEQ ID NO: 1916356 - RNA, 17 nt, Human
caaggcugcagugagcc

SEQ ID NO: 1916357 - RNA, 22 nt, Human
caaggcugcagugagccgagau

SEQ ID NO: 1916358 - RNA, 18 nt, Human
caagcgauucuucugcuu

SEQ ID NO: 1916359 - RNA, 21 nt, Human
caagcugcacccucaggcagg

SEQ ID NO: 1916360 - RNA, 17 nt, Human
caagcgauucuucugcu

SEQ ID NO: 1916361 - RNA, 15 nt, Human
caagcgauucuucug

SEQ ID NO: 1916362 - RNA, 21 nt, Human
caagcuggucccacucagucc

SEQ ID NO: 1916363 - RNA, 22 nt, Human
caagcugcacccucaggcaggu

SEQ ID NO: 1916364 - RNA, 14 nt, Human
caagaggcugcagc

SEQ ID NO: 1916365 - RNA, 17 nt, Human
caagccuuggcucuacc

SEQ ID NO: 1916366 - RNA, 18 nt, Human
caagccuggucagcccaa

SEQ ID NO: 1916367 - RNA, 17 nt, Human
caagccuggucagccca

SEQ ID NO: 1916368 - RNA, 16 nt, Human
caagccuggucagccc

SEQ ID NO: 1916369 - RNA, 15 nt, Human
caagccuggucagcc

SEQ ID NO: 1916370 - RNA, 16 nt, Human
caauaaaugucuguug

SEQ ID NO: 1916371 - RNA, 15 nt, Human
caauaaaugucuguu

SEQ ID NO: 1916372 - RNA, 14 nt, Human
caauaaaugucugu

SEQ ID NO: 1916373 - RNA, 17 nt, Human
caauaaaucugacccag

SEQ ID NO: 1916374 - RNA, 18 nt, Human
caauaaaucugacccagu

SEQ ID NO: 1916375 - RNA, 20 nt, Human
caauaaaucugacccagugc

SEQ ID NO: 1916376 - RNA, 18 nt, Human
caaggcugggggaagaag

SEQ ID NO: 1916377 - RNA, 16 nt, Human
caaggcugcuuagaau

SEQ ID NO: 1916378 - RNA, 19 nt, Human
caauagcagacaguguuuu

SEQ ID NO: 1916379 - RNA, 15 nt, Human
caauaggaaaaacug

SEQ ID NO: 1916380 - RNA, 16 nt, Human
caauaggaaaaacuga

SEQ ID NO: 1916381 - RNA, 17 nt, Human
caauaggaaaaacugau

SEQ ID NO: 1916382 - RNA, 19 nt, Human
caauagauauuuaccuuuu

SEQ ID NO: 1916383 - RNA, 18 nt, Human
caauaggaaaaacugauu

SEQ ID NO: 1916384 - RNA, 14 nt, Human
caauguuaacauuu

SEQ ID NO: 1916385 - RNA, 17 nt, Human
cacaguucaauucucau

SEQ ID NO: 1916386 - RNA, 19 nt, Human
cacaguggaaccagcccag

SEQ ID NO: 1916387 - RNA, 13 nt, Human
cacaguggaacca

SEQ ID NO: 1916388 - RNA, 22 nt, Human
cacaguggaaagacagcuucuc

SEQ ID NO: 1916389 - RNA, 13 nt, Human
cacaggaaaccag

SEQ ID NO: 1916390 - RNA, 23 nt, Human
cauaugcaccuugugucuguaca

SEQ ID NO: 1916391 - RNA, 21 nt, Human
cauaugcaccuugugucugua

SEQ ID NO: 1916392 - RNA, 20 nt, Human
cauaugcaccuugugucugu

SEQ ID NO: 1916393 - RNA, 19 nt, Human
cauaugcaccuugugucug

SEQ ID NO: 1916394 - RNA, 18 nt, Human
cauaugcaccuugugucu

SEQ ID NO: 1916395 - RNA, 17 nt, Human
cauaugcaccuuguguc

SEQ ID NO: 1916396 - RNA, 16 nt, Human
cauaugcaccuugugu

SEQ ID NO: 1916397 - RNA, 13 nt, Human
cauaugccugggc

SEQ ID NO: 1916398 - RNA, 14 nt, Human
cauauuuacuucuu

SEQ ID NO: 1916399 - RNA, 12 nt, Human
cauauuuauaaa

SEQ ID NO: 1916400 - RNA, 20 nt, Human
cauauuuacuucuuauacau

SEQ ID NO: 1916401 - RNA, 16 nt, Human
cauauuuacuucuuau

SEQ ID NO: 1916402 - RNA, 17 nt, Human
cauauuuacuucuuaua

SEQ ID NO: 1916403 - RNA, 17 nt, Human
cauauuuauaaaaauaa

SEQ ID NO: 1916404 - RNA, 12 nt, Human
cauauuucaauu

SEQ ID NO: 1916405 - RNA, 14 nt, Human
cauauuucuuuggc

SEQ ID NO: 1916406 - RNA, 12 nt, Human
cauauuugcacu

SEQ ID NO: 1916407 - RNA, 22 nt, Human
caucaagucuuucacauuuaaa

SEQ ID NO: 1916408 - RNA, 14 nt, Human
caucaagaugugac

SEQ ID NO: 1916409 - RNA, 11 nt, Human
caucaaagagg

SEQ ID NO: 1916410 - RNA, 23 nt, Human
caucaaagaggcugaggcuggca

SEQ ID NO: 1916411 - RNA, 13 nt, Human
caucaaaaugcuu

SEQ ID NO: 1916412 - RNA, 15 nt, Human
caucaaaaugcuuuu

SEQ ID NO: 1916413 - RNA, 18 nt, Human
caucaaugaaugaaugaa

SEQ ID NO: 1916414 - RNA, 12 nt, Human
cauauuuucaug

SEQ ID NO: 1916415 - RNA, 14 nt, Human
cauauuuuguaacu

SEQ ID NO: 1916416 - RNA, 18 nt, Human
cauauaauguuguuauuu

SEQ ID NO: 1916417 - RNA, 17 nt, Human
cauauaauguuguuauu

SEQ ID NO: 1916418 - RNA, 15 nt, Human
cauauaauguuguua

SEQ ID NO: 1916419 - RNA, 22 nt, Human
cauauauauguuuuaagaggca

SEQ ID NO: 1916420 - RNA, 23 nt, Human
cauauauauguuuuaagaggcag

SEQ ID NO: 1916421 - RNA, 15 nt, Human
cauaugauguacaug

SEQ ID NO: 1916422 - RNA, 17 nt, Human
cauaugauguacaugua

SEQ ID NO: 1916423 - RNA, 21 nt, Human
cauaugauguacauguacuga

SEQ ID NO: 1916424 - RNA, 17 nt, Human
cauauccguauauaucc

SEQ ID NO: 1916425 - RNA, 15 nt, Human
cauaucauguacagu

SEQ ID NO: 1916426 - RNA, 22 nt, Human
cauaguggcuuaaaacaacacu

SEQ ID NO: 1916427 - RNA, 22 nt, Human
cauaguuggggucauagauguu

SEQ ID NO: 1916428 - RNA, 20 nt, Human
cauaguaugguggcuggguu

SEQ ID NO: 1916429 - RNA, 19 nt, Human
cauaguaugguggcugggu

SEQ ID NO: 1916430 - RNA, 18 nt, Human
cauaguaugguggcuggg

SEQ ID NO: 1916431 - RNA, 11 nt, Human
cauacucugcu

SEQ ID NO: 1916432 - RNA, 18 nt, Human
cauacuaucuacucuccu

SEQ ID NO: 1916433 - RNA, 15 nt, Human
cauacuuaagcaaaa

SEQ ID NO: 1916434 - RNA, 16 nt, Human
cauacucccaucugug

SEQ ID NO: 1916435 - RNA, 15 nt, Human
cauacucccaucugu

SEQ ID NO: 1916436 - RNA, 18 nt, Human
cauacucccaucugugaa

SEQ ID NO: 1916437 - RNA, 20 nt, Human
cauacucccaucugugaaag

SEQ ID NO: 1916438 - RNA, 14 nt, Human
cauagaauaaaauu

SEQ ID NO: 1916439 - RNA, 20 nt, Human
cauagaauaaaauuuuuaau

SEQ ID NO: 1916440 - RNA, 19 nt, Human
cauagagagcaagacgcug

SEQ ID NO: 1916441 - RNA, 21 nt, Human
cauagagagcaagacgcugug

SEQ ID NO: 1916442 - RNA, 23 nt, Human
cauagagagcaagacgcugugcu

SEQ ID NO: 1916443 - RNA, 14 nt, Human
cauacuuuccugua

SEQ ID NO: 1916444 - RNA, 13 nt, Human
cauacuugaaggg

SEQ ID NO: 1916445 - RNA, 14 nt, Human
cauacuugaagggc

SEQ ID NO: 1916446 - RNA, 17 nt, Human
cauacuugaagggccag

SEQ ID NO: 1916447 - RNA, 18 nt, Human
cauacuugaagggccaga

SEQ ID NO: 1916448 - RNA, 20 nt, Human
cauacuugaagggccagagc

SEQ ID NO: 1916449 - RNA, 21 nt, Human
cauacuugaagggccagagcc

SEQ ID NO: 1916450 - RNA, 22 nt, Human
cauacuugaagggccagagcca

SEQ ID NO: 1916451 - RNA, 23 nt, Human
cauacuugaagggccagagccag

SEQ ID NO: 1916452 - RNA, 16 nt, Human
caucucaccuccugcu

SEQ ID NO: 1916453 - RNA, 17 nt, Human
caucucaccuccugcug

SEQ ID NO: 1916454 - RNA, 18 nt, Human
caucucaccuccugcugg

SEQ ID NO: 1916455 - RNA, 20 nt, Human
caucucacacaugagcauca

SEQ ID NO: 1916456 - RNA, 22 nt, Human
caucucaugccccuggcuggga

SEQ ID NO: 1916457 - RNA, 22 nt, Human
caucucagguuaagugugagua

SEQ ID NO: 1916458 - RNA, 16 nt, Human
caucucacacaugagc

SEQ ID NO: 1916459 - RNA, 17 nt, Human
caucucacacaugagca

SEQ ID NO: 1916460 - RNA, 14 nt, Human
caucuauuuuggau

SEQ ID NO: 1916461 - RNA, 16 nt, Human
caucuauuuuggauug

SEQ ID NO: 1916462 - RNA, 13 nt, Human
caucuauucucuc

SEQ ID NO: 1916463 - RNA, 20 nt, Human
caucuauucucuccaaaaau

SEQ ID NO: 1916464 - RNA, 15 nt, Human
caucuacccuccgau

SEQ ID NO: 1916465 - RNA, 12 nt, Human
caucuaggauuu

SEQ ID NO: 1916466 - RNA, 17 nt, Human
caucuagguaaauuaca

SEQ ID NO: 1916467 - RNA, 18 nt, Human
caucuagguaaauuacag

SEQ ID NO: 1916468 - RNA, 21 nt, Human
cauccucuguacagagcccac

SEQ ID NO: 1916469 - RNA, 19 nt, Human
cauccucuguacagagccc

SEQ ID NO: 1916470 - RNA, 12 nt, Human
caucuaagccug

SEQ ID NO: 1916471 - RNA, 16 nt, Human
caucuaagccugaagg

SEQ ID NO: 1916472 - RNA, 15 nt, Human
cauccucuguacaga

SEQ ID NO: 1916473 - RNA, 18 nt, Human
cauccucuguacagagcc

SEQ ID NO: 1916474 - RNA, 13 nt, Human
cauccucccaagg

SEQ ID NO: 1916475 - RNA, 16 nt, Human
cauccuccagcaggga

SEQ ID NO: 1916476 - RNA, 13 nt, Human
cauccuccagcag

SEQ ID NO: 1916477 - RNA, 14 nt, Human
cauccuccagcagg

SEQ ID NO: 1916478 - RNA, 17 nt, Human
cauccucauacccaccc

SEQ ID NO: 1916479 - RNA, 18 nt, Human
cauccucauacccacccc

SEQ ID NO: 1916480 - RNA, 21 nt, Human
cauccucauacccacccccac

SEQ ID NO: 1916481 - RNA, 22 nt, Human
cauccucauacccacccccacc

SEQ ID NO: 1916482 - RNA, 11 nt, Human
cauccuccuca

SEQ ID NO: 1916483 - RNA, 12 nt, Human
cauccuccucag

SEQ ID NO: 1916484 - RNA, 15 nt, Human
cauccuccucagauc

SEQ ID NO: 1916485 - RNA, 16 nt, Human
cauccuccucagaucu

SEQ ID NO: 1916486 - RNA, 18 nt, Human
cauccuccucagaucuuc

SEQ ID NO: 1916487 - RNA, 19 nt, Human
cauccuccucagaucuucu

SEQ ID NO: 1916488 - RNA, 15 nt, Human
cauccucauacccac

SEQ ID NO: 1916489 - RNA, 16 nt, Human
cauccucauacccacc

SEQ ID NO: 1916490 - RNA, 20 nt, Human
caucuugcucugcugacaga

SEQ ID NO: 1916491 - RNA, 14 nt, Human
caucuugcucugcu

SEQ ID NO: 1916492 - RNA, 15 nt, Human
caucuugcucugcug

SEQ ID NO: 1916493 - RNA, 13 nt, Human
caucuugcucugc

SEQ ID NO: 1916494 - RNA, 21 nt, Human
caucuucuaaacccaauccaa

SEQ ID NO: 1916495 - RNA, 23 nt, Human
caucucuuagcuccccuccaacc

SEQ ID NO: 1916496 - RNA, 21 nt, Human
caucucuuagcuccccuccaa

SEQ ID NO: 1916497 - RNA, 19 nt, Human
caucucuuagcuccccucc

SEQ ID NO: 1916498 - RNA, 18 nt, Human
caucucuuagcuccccuc

SEQ ID NO: 1916499 - RNA, 17 nt, Human
caucucuuagcuccccu

SEQ ID NO: 1916500 - RNA, 16 nt, Human
caucucuuagcucccc

SEQ ID NO: 1916501 - RNA, 21 nt, Human
caucucccaccuagcagcacc

SEQ ID NO: 1916502 - RNA, 16 nt, Human
caucucuuguuuaaau

SEQ ID NO: 1916503 - RNA, 22 nt, Human
caucuuccaaggguacuaagga

SEQ ID NO: 1916504 - RNA, 15 nt, Human
cauccagguucagcu

SEQ ID NO: 1916505 - RNA, 11 nt, Human
caucccugaag

SEQ ID NO: 1916506 - RNA, 13 nt, Human
caucccugaaggc

SEQ ID NO: 1916507 - RNA, 19 nt, Human
caucccucuggggcuguuc

SEQ ID NO: 1916508 - RNA, 21 nt, Human
cauccagggcccccaucucau

SEQ ID NO: 1916509 - RNA, 11 nt, Human
cauccagggcc

SEQ ID NO: 1916510 - RNA, 13 nt, Human
caucauugaaauc

SEQ ID NO: 1916511 - RNA, 15 nt, Human
caucaccaacgucug

SEQ ID NO: 1916512 - RNA, 14 nt, Human
caucauugaaaucu

SEQ ID NO: 1916513 - RNA, 15 nt, Human
caucauugaaaucuu

SEQ ID NO: 1916514 - RNA, 20 nt, Human
caucauugaaaucuuuuugc

SEQ ID NO: 1916515 - RNA, 21 nt, Human
caucauugaaaucuuuuugcu

SEQ ID NO: 1916516 - RNA, 23 nt, Human
cauccaaaauaguuaagacauga

SEQ ID NO: 1916517 - RNA, 15 nt, Human
cauccaaagcagaca

SEQ ID NO: 1916518 - RNA, 16 nt, Human
cauccaaagcagacag

SEQ ID NO: 1916519 - RNA, 17 nt, Human
cauccaaagcagacagc

SEQ ID NO: 1916520 - RNA, 18 nt, Human
cauccaaagcagacagcu

SEQ ID NO: 1916521 - RNA, 21 nt, Human
cauccaaagcagacagcucca

SEQ ID NO: 1916522 - RNA, 14 nt, Human
cauccaaccuuccc

SEQ ID NO: 1916523 - RNA, 16 nt, Human
cauccaaccuucccaa

SEQ ID NO: 1916524 - RNA, 22 nt, Human
caucccugaaggccccgcccag

SEQ ID NO: 1916525 - RNA, 17 nt, Human
caucccugaaggccccg

SEQ ID NO: 1916526 - RNA, 18 nt, Human
caucccugaaggccccgc

SEQ ID NO: 1916527 - RNA, 19 nt, Human
caucccugaaggccccgcc

SEQ ID NO: 1916528 - RNA, 21 nt, Human
caucccugaaggccccgccca

SEQ ID NO: 1916529 - RNA, 19 nt, Human
cauacucaauguuacuauc

SEQ ID NO: 1916530 - RNA, 13 nt, Human
cauacguacacau

SEQ ID NO: 1916531 - RNA, 16 nt, Human
cauacguacacauuuu

SEQ ID NO: 1916532 - RNA, 15 nt, Human
cauacguacacauuu

SEQ ID NO: 1916533 - RNA, 21 nt, Human
cauacuaaccagcagaaaugc

SEQ ID NO: 1916534 - RNA, 14 nt, Human
cauacuaaccagca

SEQ ID NO: 1916535 - RNA, 18 nt, Human
cauacguacacauuuuau

SEQ ID NO: 1916536 - RNA, 17 nt, Human
cauacguacacauuuua

SEQ ID NO: 1916537 - RNA, 14 nt, Human
cauacccaccccca

SEQ ID NO: 1916538 - RNA, 17 nt, Human
cauacccacccccaccc

SEQ ID NO: 1916539 - RNA, 18 nt, Human
cauacccacccccaccca

SEQ ID NO: 1916540 - RNA, 21 nt, Human
cauacccacccccacccaagg

SEQ ID NO: 1916541 - RNA, 15 nt, Human
cauaccuggcccugu

SEQ ID NO: 1916542 - RNA, 12 nt, Human
cauaaguuucug

SEQ ID NO: 1916543 - RNA, 17 nt, Human
cauaauaaaugcuucag

SEQ ID NO: 1916544 - RNA, 17 nt, Human
cauaagguuuuuaugca

SEQ ID NO: 1916545 - RNA, 16 nt, Human
cauaagguuuuuaugc

SEQ ID NO: 1916546 - RNA, 11 nt, Human
cauaagguuuu

SEQ ID NO: 1916547 - RNA, 19 nt, Human
cauaagaaaacuaagaaau

SEQ ID NO: 1916548 - RNA, 13 nt, Human
cauaacuagaacu

SEQ ID NO: 1916549 - RNA, 14 nt, Human
cauaagauaaaugu

SEQ ID NO: 1916550 - RNA, 23 nt, Human
cauaagagccacaggucuuuaug

SEQ ID NO: 1916551 - RNA, 19 nt, Human
cauaccacuuuuguucuug

SEQ ID NO: 1916552 - RNA, 11 nt, Human
cauacccaccc

SEQ ID NO: 1916553 - RNA, 12 nt, Human
cauacccacccc

SEQ ID NO: 1916554 - RNA, 18 nt, Human
cauaccacuuuuguucuu

SEQ ID NO: 1916555 - RNA, 15 nt, Human
cauaccacuuuuguu

SEQ ID NO: 1916556 - RNA, 14 nt, Human
cauaccacuuuugu

SEQ ID NO: 1916557 - RNA, 13 nt, Human
cauaccacuuuug

SEQ ID NO: 1916558 - RNA, 15 nt, Human
cauaauacuugcuuu

SEQ ID NO: 1916559 - RNA, 18 nt, Human
cauaaucacaacccuuca

SEQ ID NO: 1916560 - RNA, 16 nt, Human
cauaaccuagccuuag

SEQ ID NO: 1916561 - RNA, 20 nt, Human
cauaacagauuuuuuuugga

SEQ ID NO: 1916562 - RNA, 22 nt, Human
cauaaccaugugaaaaggcaaa

SEQ ID NO: 1916563 - RNA, 20 nt, Human
cauaaauuuaguauuuuguu

SEQ ID NO: 1916564 - RNA, 19 nt, Human
cauaaauuuaguauuuugu

SEQ ID NO: 1916565 - RNA, 13 nt, Human
cauaaagcaaaua

SEQ ID NO: 1916566 - RNA, 20 nt, Human
cauaaagcaaauagacacag

SEQ ID NO: 1916567 - RNA, 14 nt, Human
cauaaagcaggcag

SEQ ID NO: 1916568 - RNA, 16 nt, Human
cauaaagcaggcagaa

SEQ ID NO: 1916569 - RNA, 21 nt, Human
cauaaacaagaccacguuucu

SEQ ID NO: 1916570 - RNA, 20 nt, Human
cauaaacaagaccacguuuc

SEQ ID NO: 1916571 - RNA, 22 nt, Human
cauaaacaagaccacguuucua

SEQ ID NO: 1916572 - RNA, 21 nt, Human
cauaaaaauuagccaagugug

SEQ ID NO: 1916573 - RNA, 12 nt, Human
cauaaaacaggu

SEQ ID NO: 1916574 - RNA, 23 nt, Human
cauaaaaagcaaaacaaaaauua

SEQ ID NO: 1916575 - RNA, 16 nt, Human
caguuuuuuaugcuaa

SEQ ID NO: 1916576 - RNA, 15 nt, Human
caguuuuuauugcuu

SEQ ID NO: 1916577 - RNA, 17 nt, Human
caguuguuagugugucu

SEQ ID NO: 1916578 - RNA, 17 nt, Human
caguugggugagaacaa

SEQ ID NO: 1916579 - RNA, 22 nt, Human
caguugguguucaaauagcacu

SEQ ID NO: 1916580 - RNA, 16 nt, Human
caguuggccagagagc

SEQ ID NO: 1916581 - RNA, 17 nt, Human
caguuggccagagagcc

SEQ ID NO: 1916582 - RNA, 16 nt, Human
caguuggguggaugcc

SEQ ID NO: 1916583 - RNA, 23 nt, Human
caguugccagucaccccggccac

SEQ ID NO: 1916584 - RNA, 19 nt, Human
caguuggguggaugccugg

SEQ ID NO: 1916585 - RNA, 18 nt, Human
caguuggguggaugccug

SEQ ID NO: 1916586 - RNA, 18 nt, Human
caguuggucccccuucca

SEQ ID NO: 1916587 - RNA, 19 nt, Human
caguuggucccccuuccau

SEQ ID NO: 1916588 - RNA, 20 nt, Human
caguuggucccccuuccaug

SEQ ID NO: 1916589 - RNA, 21 nt, Human
caguuggucccccuuccaugg

SEQ ID NO: 1916590 - RNA, 22 nt, Human
caguuggucccccuuccaugga

SEQ ID NO: 1916591 - RNA, 20 nt, Human
caguucuuugggccagacau

SEQ ID NO: 1916592 - RNA, 21 nt, Human
caguucuuugggccagacaug

SEQ ID NO: 1916593 - RNA, 22 nt, Human
caguucuuugggccagacaugc

SEQ ID NO: 1916594 - RNA, 22 nt, Human
caguguuuucugggauaaguaa

SEQ ID NO: 1916595 - RNA, 15 nt, Human
caguguuuucuggga

SEQ ID NO: 1916596 - RNA, 24 nt, Human
caguguuggccaugaugacaacua

SEQ ID NO: 1916597 - RNA, 22 nt, Human
caguguuguggauuuaacagaa

SEQ ID NO: 1916598 - RNA, 20 nt, Human
caguguuguggauuuaacag

SEQ ID NO: 1916599 - RNA, 19 nt, Human
caguguuguggauuuaaca

SEQ ID NO: 1916600 - RNA, 18 nt, Human
caguguuccgugguuaaa

SEQ ID NO: 1916601 - RNA, 21 nt, Human
cagugugucgagucaaaaugu

SEQ ID NO: 1916602 - RNA, 15 nt, Human
caguuaaguuuuucc

SEQ ID NO: 1916603 - RNA, 13 nt, Human
caguuaagagaaa

SEQ ID NO: 1916604 - RNA, 14 nt, Human
caguuaagagaaau

SEQ ID NO: 1916605 - RNA, 14 nt, Human
caguuacucagaau

SEQ ID NO: 1916606 - RNA, 22 nt, Human
caguucggugagcuacaaaugc

SEQ ID NO: 1916607 - RNA, 15 nt, Human
caguuccuuucaaug

SEQ ID NO: 1916608 - RNA, 13 nt, Human
caguucucuccuu

SEQ ID NO: 1916609 - RNA, 14 nt, Human
caguucucuccuuc

SEQ ID NO: 1916610 - RNA, 15 nt, Human
caguucucuccuucu

SEQ ID NO: 1916611 - RNA, 22 nt, Human
caguucucuccuucuucccccc

SEQ ID NO: 1916612 - RNA, 16 nt, Human
caguucucuucacuca

SEQ ID NO: 1916613 - RNA, 12 nt, Human
caguugaaaaac

SEQ ID NO: 1916614 - RNA, 16 nt, Human
caguucuuugggccag

SEQ ID NO: 1916615 - RNA, 17 nt, Human
caguucuuugggccaga

SEQ ID NO: 1916616 - RNA, 18 nt, Human
caguucuuugggccagac

SEQ ID NO: 1916617 - RNA, 19 nt, Human
caguucuuugggccagaca

SEQ ID NO: 1916618 - RNA, 18 nt, Human
caguugaaaaacagcuga

SEQ ID NO: 1916619 - RNA, 19 nt, Human
caguugaaaaacagcugag

SEQ ID NO: 1916620 - RNA, 19 nt, Human
caguucuugccacuuuuuu

SEQ ID NO: 1916621 - RNA, 15 nt, Human
caguguacagucuug

SEQ ID NO: 1916622 - RNA, 12 nt, Human
caguguacaguc

SEQ ID NO: 1916623 - RNA, 18 nt, Human
caguguacagucuuguau

SEQ ID NO: 1916624 - RNA, 17 nt, Human
caguguacagucuugua

SEQ ID NO: 1916625 - RNA, 16 nt, Human
caguguacauggaaua

SEQ ID NO: 1916626 - RNA, 20 nt, Human
caguguacauggaauaacau

SEQ ID NO: 1916627 - RNA, 23 nt, Human
caguguacauggaauaacaugua

SEQ ID NO: 1916628 - RNA, 14 nt, Human
cagugucaaugcag

SEQ ID NO: 1916629 - RNA, 20 nt, Human
caguguccuuagaacauuuu

SEQ ID NO: 1916630 - RNA, 16 nt, Human
caguguccuuagaaca

SEQ ID NO: 1916631 - RNA, 14 nt, Human
cagugugacaagga

SEQ ID NO: 1916632 - RNA, 12 nt, Human
cagugugacuga

SEQ ID NO: 1916633 - RNA, 19 nt, Human
cagugucuggcugcagagc

SEQ ID NO: 1916634 - RNA, 17 nt, Human
cagugucuggcugcaga

SEQ ID NO: 1916635 - RNA, 14 nt, Human
cagugucucggagg

SEQ ID NO: 1916636 - RNA, 18 nt, Human
cagugugaauaaagugcu

SEQ ID NO: 1916637 - RNA, 15 nt, Human
cagugugcacuaagg

SEQ ID NO: 1916638 - RNA, 19 nt, Human
cagugugcacuaaggggcc

SEQ ID NO: 1916639 - RNA, 23 nt, Human
cagugugcacuaaggggcccggc

SEQ ID NO: 1916640 - RNA, 11 nt, Human
cagugguuaag

SEQ ID NO: 1916641 - RNA, 22 nt, Human
cagugguuccuaauccucuagg

SEQ ID NO: 1916642 - RNA, 20 nt, Human
caguggcuggaucugugagg

SEQ ID NO: 1916643 - RNA, 18 nt, Human
caguggcuggaucuguga

SEQ ID NO: 1916644 - RNA, 16 nt, Human
caguggcuggaucugu

SEQ ID NO: 1916645 - RNA, 17 nt, Human
caguggcaggacaggaa

SEQ ID NO: 1916646 - RNA, 16 nt, Human
caguggcagcugcuuu

SEQ ID NO: 1916647 - RNA, 15 nt, Human
caguggcagcugcuu

SEQ ID NO: 1916648 - RNA, 14 nt, Human
caguggcagcugcu

SEQ ID NO: 1916649 - RNA, 13 nt, Human
caguggcagcugc

SEQ ID NO: 1916650 - RNA, 12 nt, Human
caguggcagcug

SEQ ID NO: 1916651 - RNA, 16 nt, Human
caguggaaccagccca

SEQ ID NO: 1916652 - RNA, 22 nt, Human
caugcgacacugggaggccagu

SEQ ID NO: 1916653 - RNA, 23 nt, Human
caugccuggauggggcugcaccg

SEQ ID NO: 1916654 - RNA, 18 nt, Human
caugccuggauggggcug

SEQ ID NO: 1916655 - RNA, 21 nt, Human
caugccuggauggggcugcac

SEQ ID NO: 1916656 - RNA, 22 nt, Human
caugcugucccuuacgugaguc

SEQ ID NO: 1916657 - RNA, 20 nt, Human
caugcuguucaugaaagauu

SEQ ID NO: 1916658 - RNA, 19 nt, Human
caugcgguagccagcacac

SEQ ID NO: 1916659 - RNA, 21 nt, Human
caugcgguagccagcacacag

SEQ ID NO: 1916660 - RNA, 13 nt, Human
caugcgguagcca

SEQ ID NO: 1916661 - RNA, 14 nt, Human
caugcgguagccag

SEQ ID NO: 1916662 - RNA, 15 nt, Human
caugcgguagccagc

SEQ ID NO: 1916663 - RNA, 16 nt, Human
caugcgguagccagca

SEQ ID NO: 1916664 - RNA, 17 nt, Human
caugcgguagccagcac

SEQ ID NO: 1916665 - RNA, 16 nt, Human
cauggaauaacaugua

SEQ ID NO: 1916666 - RNA, 18 nt, Human
cauggacaugaucuucuu

SEQ ID NO: 1916667 - RNA, 21 nt, Human
cauggacagaagaaggcagca

SEQ ID NO: 1916668 - RNA, 15 nt, Human
cauggacagaagaag

SEQ ID NO: 1916669 - RNA, 14 nt, Human
cauggacaggcugg

SEQ ID NO: 1916670 - RNA, 15 nt, Human
cauggacaggcuggc

SEQ ID NO: 1916671 - RNA, 16 nt, Human
cauggacaggcuggcu

SEQ ID NO: 1916672 - RNA, 18 nt, Human
cauggacaggcuggcucc

SEQ ID NO: 1916673 - RNA, 20 nt, Human
cauggaaguacuauaauuua

SEQ ID NO: 1916674 - RNA, 22 nt, Human
cauggaaguacuauaauuuacc

SEQ ID NO: 1916675 - RNA, 19 nt, Human
caugcugugauugugccua

SEQ ID NO: 1916676 - RNA, 15 nt, Human
caugggccuccugug

SEQ ID NO: 1916677 - RNA, 22 nt, Human
caugggaaugaaugucagugug

SEQ ID NO: 1916678 - RNA, 17 nt, Human
caugggacagggaggac

SEQ ID NO: 1916679 - RNA, 17 nt, Human
caugggccuccugugug

SEQ ID NO: 1916680 - RNA, 16 nt, Human
caugggccuccugugu

SEQ ID NO: 1916681 - RNA, 19 nt, Human
cauggggcugauuguauuu

SEQ ID NO: 1916682 - RNA, 17 nt, Human
cauggucacacacugau

SEQ ID NO: 1916683 - RNA, 21 nt, Human
cauggucacacacugaugcuu

SEQ ID NO: 1916684 - RNA, 18 nt, Human
caugggaaugaaugucag

SEQ ID NO: 1916685 - RNA, 19 nt, Human
cauggaugggggaacucag

SEQ ID NO: 1916686 - RNA, 14 nt, Human
cauggauggaaaac

SEQ ID NO: 1916687 - RNA, 16 nt, Human
cauggaguauauguca

SEQ ID NO: 1916688 - RNA, 11 nt, Human
cauggacuuug

SEQ ID NO: 1916689 - RNA, 13 nt, Human
cauggacuuuguu

SEQ ID NO: 1916690 - RNA, 17 nt, Human
cauggagguuugaagau

SEQ ID NO: 1916691 - RNA, 10 nt, Human
cauggagcca

SEQ ID NO: 1916692 - RNA, 21 nt, Human
cauggagauagccccacagga

SEQ ID NO: 1916693 - RNA, 14 nt, Human
caugccucucucag

SEQ ID NO: 1916694 - RNA, 15 nt, Human
caugccucucucagg

SEQ ID NO: 1916695 - RNA, 23 nt, Human
caugcccugugcaaccucuuggc

SEQ ID NO: 1916696 - RNA, 11 nt, Human
caugccucagc

SEQ ID NO: 1916697 - RNA, 14 nt, Human
caugccucagcccu

SEQ ID NO: 1916698 - RNA, 16 nt, Human
caugccucagcccuga

SEQ ID NO: 1916699 - RNA, 20 nt, Human
caugcccuccucucccauug

SEQ ID NO: 1916700 - RNA, 13 nt, Human
caugcccuccucu

SEQ ID NO: 1916701 - RNA, 14 nt, Human
caugcccuccucuc

SEQ ID NO: 1916702 - RNA, 15 nt, Human
caugcccuccucucc

SEQ ID NO: 1916703 - RNA, 17 nt, Human
caugcccuccucuccca

SEQ ID NO: 1916704 - RNA, 14 nt, Human
caugcccugugcaa

SEQ ID NO: 1916705 - RNA, 18 nt, Human
caugcccugugcaaccuc

SEQ ID NO: 1916706 - RNA, 19 nt, Human
caugcccugugcaaccucu

SEQ ID NO: 1916707 - RNA, 15 nt, Human
caugccccuggcugg

SEQ ID NO: 1916708 - RNA, 16 nt, Human
caugccccuggcuggg

SEQ ID NO: 1916709 - RNA, 21 nt, Human
caugcccggcuaauuuuugua

SEQ ID NO: 1916710 - RNA, 16 nt, Human
caugccucucucaggc

SEQ ID NO: 1916711 - RNA, 17 nt, Human
caugccucucucaggcc

SEQ ID NO: 1916712 - RNA, 18 nt, Human
caugccucucucaggcca

SEQ ID NO: 1916713 - RNA, 19 nt, Human
caugccucucucaggccaa

SEQ ID NO: 1916714 - RNA, 13 nt, Human
caugccuggaugg

SEQ ID NO: 1916715 - RNA, 21 nt, Human
caugccucccccuagccauuu

SEQ ID NO: 1916716 - RNA, 19 nt, Human
caugccucagcccugaccc

SEQ ID NO: 1916717 - RNA, 20 nt, Human
caugccucagcccugacccu

SEQ ID NO: 1916718 - RNA, 14 nt, Human
caugccccuggcug

SEQ ID NO: 1916719 - RNA, 19 nt, Human
caugccagcuuaucucagg

SEQ ID NO: 1916720 - RNA, 20 nt, Human
caugccagcuuaucucaggg

SEQ ID NO: 1916721 - RNA, 17 nt, Human
caugccacaaggacuuc

SEQ ID NO: 1916722 - RNA, 21 nt, Human
caugccacaaggacuuccugu

SEQ ID NO: 1916723 - RNA, 13 nt, Human
caugccccugaac

SEQ ID NO: 1916724 - RNA, 22 nt, Human
caugcagucugggaguggggaa

SEQ ID NO: 1916725 - RNA, 15 nt, Human
cauguacaugaagaa

SEQ ID NO: 1916726 - RNA, 23 nt, Human
caugucuuguacauguguagccu

SEQ ID NO: 1916727 - RNA, 18 nt, Human
cauguaauuaaguacuau

SEQ ID NO: 1916728 - RNA, 21 nt, Human
cauguaauuaaguacuaugua

SEQ ID NO: 1916729 - RNA, 15 nt, Human
caugugaaaucauuc

SEQ ID NO: 1916730 - RNA, 22 nt, Human
caugugaaaaggcaaaaagcau

SEQ ID NO: 1916731 - RNA, 16 nt, Human
caugugaaaucauuca

SEQ ID NO: 1916732 - RNA, 17 nt, Human
caugugaaaucauucau

SEQ ID NO: 1916733 - RNA, 14 nt, Human
caugucuuuucuug

SEQ ID NO: 1916734 - RNA, 19 nt, Human
caugucuuuucuugcauga

SEQ ID NO: 1916735 - RNA, 21 nt, Human
caugucuuuucuugcaugagg

SEQ ID NO: 1916736 - RNA, 23 nt, Human
caugucuuuucuugcaugaggcu

SEQ ID NO: 1916737 - RNA, 16 nt, Human
cauggucggaaaacau

SEQ ID NO: 1916738 - RNA, 15 nt, Human
cauggugccccagga

SEQ ID NO: 1916739 - RNA, 20 nt, Human
cauggugacuuuugaaaaga

SEQ ID NO: 1916740 - RNA, 16 nt, Human
cauggugccccaggac

SEQ ID NO: 1916741 - RNA, 17 nt, Human
cauggugccccaggacc

SEQ ID NO: 1916742 - RNA, 18 nt, Human
cauggugccccaggacca

SEQ ID NO: 1916743 - RNA, 19 nt, Human
cauggugccccaggaccag

SEQ ID NO: 1916744 - RNA, 20 nt, Human
cauggugccccaggaccagc

SEQ ID NO: 1916745 - RNA, 22 nt, Human
cauggugccccaggaccagcuc

SEQ ID NO: 1916746 - RNA, 16 nt, Human
cauggugcccuggcuu

SEQ ID NO: 1916747 - RNA, 14 nt, Human
cauguaauccucaa

SEQ ID NO: 1916748 - RNA, 13 nt, Human
caugugacacaua

SEQ ID NO: 1916749 - RNA, 12 nt, Human
caugugacacau

SEQ ID NO: 1916750 - RNA, 15 nt, Human
caugugacacauaug

SEQ ID NO: 1916751 - RNA, 14 nt, Human
caugugacacauau

SEQ ID NO: 1916752 - RNA, 16 nt, Human
caugugacacauaugc

SEQ ID NO: 1916753 - RNA, 15 nt, Human
caugugcacaugcac

SEQ ID NO: 1916754 - RNA, 22 nt, Human
caugugccagggcaaugaugaa

SEQ ID NO: 1916755 - RNA, 24 nt, Human
caugugccagggcaaugaugaaug

SEQ ID NO: 1916756 - RNA, 21 nt, Human
caugugccagguuuuuggucu

SEQ ID NO: 1916757 - RNA, 22 nt, Human
caugugguuaaugccauggaca

SEQ ID NO: 1916758 - RNA, 23 nt, Human
caugugguuacacagugugaaua

SEQ ID NO: 1916759 - RNA, 16 nt, Human
caugugguuacacagu

SEQ ID NO: 1916760 - RNA, 17 nt, Human
caugugguuaaugccau

SEQ ID NO: 1916761 - RNA, 20 nt, Human
cauguuucuuuguaaugaaa

SEQ ID NO: 1916762 - RNA, 21 nt, Human
cauguuucuuuguaaugaaaa

SEQ ID NO: 1916763 - RNA, 15 nt, Human
cauguuugugauuga

SEQ ID NO: 1916764 - RNA, 22 nt, Human
cauguuucuuuguaaugaaaac

SEQ ID NO: 1916765 - RNA, 23 nt, Human
cauguuugauguaucugagcagg

SEQ ID NO: 1916766 - RNA, 15 nt, Human
cauguuuucaacugc

SEQ ID NO: 1916767 - RNA, 16 nt, Human
cauguuuucaacugcc

SEQ ID NO: 1916768 - RNA, 17 nt, Human
cauguuuucaacugcca

SEQ ID NO: 1916769 - RNA, 14 nt, Human
cauguuuuccguga

SEQ ID NO: 1916770 - RNA, 14 nt, Human
cauuaaauucacaa

SEQ ID NO: 1916771 - RNA, 17 nt, Human
cauuaaauucacaaacu

SEQ ID NO: 1916772 - RNA, 18 nt, Human
cauuaaauucacaaacuu

SEQ ID NO: 1916773 - RNA, 21 nt, Human
cauuaaauucacaaacuuuua

SEQ ID NO: 1916774 - RNA, 12 nt, Human
cauuaauucuau

SEQ ID NO: 1916775 - RNA, 22 nt, Human
cauuaccucagugagaagccag

SEQ ID NO: 1916776 - RNA, 21 nt, Human
cauuaccucagugagaagcca

SEQ ID NO: 1916777 - RNA, 21 nt, Human
cauuaaagccugaguuugcuu

SEQ ID NO: 1916778 - RNA, 15 nt, Human
cauguuuuguuuacg

SEQ ID NO: 1916779 - RNA, 13 nt, Human
cauuaaauucaca

SEQ ID NO: 1916780 - RNA, 18 nt, Human
cauguuuuucuucucccu

SEQ ID NO: 1916781 - RNA, 17 nt, Human
cauuuuaauuauuauuc

SEQ ID NO: 1916782 - RNA, 14 nt, Human
cauuuuaauucauc

SEQ ID NO: 1916783 - RNA, 23 nt, Human
cauuuuaauuuauuaauugcuuu

SEQ ID NO: 1916784 - RNA, 22 nt, Human
cauuugaggucuguucuuucca

SEQ ID NO: 1916785 - RNA, 21 nt, Human
cauuuuauuuuauuaugcaug

SEQ ID NO: 1916786 - RNA, 19 nt, Human
cauuuuauuuuauuaugca

SEQ ID NO: 1916787 - RNA, 22 nt, Human
cauuuuaauuuauuaauugcuu

SEQ ID NO: 1916788 - RNA, 22 nt, Human
cauuuugggguacccacugcuc

SEQ ID NO: 1916789 - RNA, 21 nt, Human
cauuuugggguacccacugcu

SEQ ID NO: 1916790 - RNA, 20 nt, Human
cauuuugggguacccacugc

SEQ ID NO: 1916791 - RNA, 20 nt, Human
cauuuuggagaguuuccuga

SEQ ID NO: 1916792 - RNA, 22 nt, Human
cauuuuggagaguuuccugaaa

SEQ ID NO: 1916793 - RNA, 18 nt, Human
cauuuugcuaaaugugaa

SEQ ID NO: 1916794 - RNA, 21 nt, Human
cauuuugcuaaaugugaauga

SEQ ID NO: 1916795 - RNA, 24 nt, Human
cauuuugcuaaaugugaaugauga

SEQ ID NO: 1916796 - RNA, 18 nt, Human
cauuuuuaguagagacag

SEQ ID NO: 1916797 - RNA, 19 nt, Human
cauuuuuaguagagacagg

SEQ ID NO: 1916798 - RNA, 20 nt, Human
cauuuuuaagugcugcauuu

SEQ ID NO: 1916799 - RNA, 15 nt, Human
cauuuuuaagugcug

SEQ ID NO: 1916800 - RNA, 23 nt, Human
cauuuugggguacccacugcucu

SEQ ID NO: 1916801 - RNA, 15 nt, Human
cauuuuggugagaaa

SEQ ID NO: 1916802 - RNA, 18 nt, Human
cauuuuguaacaaaugaa

SEQ ID NO: 1916803 - RNA, 20 nt, Human
cauuuuuaguagagacaggg

SEQ ID NO: 1916804 - RNA, 21 nt, Human
ccaaaauaaaacuuuuuaaaa

SEQ ID NO: 1916805 - RNA, 18 nt, Human
ccaaaauaaaacuuuuua

SEQ ID NO: 1916806 - RNA, 13 nt, Human
ccaaacgccuccc

SEQ ID NO: 1916807 - RNA, 18 nt, Human
ccaaaccuucacacacag

SEQ ID NO: 1916808 - RNA, 21 nt, Human
ccaaaccuucacacacagacu

SEQ ID NO: 1916809 - RNA, 18 nt, Human
ccaaacuuggauuuuuga

SEQ ID NO: 1916810 - RNA, 16 nt, Human
ccaaacuuggauuuuu

SEQ ID NO: 1916811 - RNA, 14 nt, Human
cauuugagcagggc

SEQ ID NO: 1916812 - RNA, 16 nt, Human
cauuugagcagggcuc

SEQ ID NO: 1916813 - RNA, 17 nt, Human
cauuugaggucuguucu

SEQ ID NO: 1916814 - RNA, 19 nt, Human
cauuugaggucuguucuuu

SEQ ID NO: 1916815 - RNA, 18 nt, Human
cauuugaggucuguucuu

SEQ ID NO: 1916816 - RNA, 23 nt, Human
cauuucuuccacaagagcccagg

SEQ ID NO: 1916817 - RNA, 21 nt, Human
cauuuacuuuguguucaccuu

SEQ ID NO: 1916818 - RNA, 17 nt, Human
cauuuacuuuguguuca

SEQ ID NO: 1916819 - RNA, 15 nt, Human
cauuuaaaguauuuu

SEQ ID NO: 1916820 - RNA, 17 nt, Human
cauuuacugugucuuug

SEQ ID NO: 1916821 - RNA, 15 nt, Human
cauugcaauagaaau

SEQ ID NO: 1916822 - RNA, 13 nt, Human
cauugcaauagaa

SEQ ID NO: 1916823 - RNA, 14 nt, Human
cauugcaauagaaa

SEQ ID NO: 1916824 - RNA, 21 nt, Human
cauuuaaaagauacaguuacu

SEQ ID NO: 1916825 - RNA, 21 nt, Human
cauuucuuccacaagagccca

SEQ ID NO: 1916826 - RNA, 10 nt, Human
cauuucucuc

SEQ ID NO: 1916827 - RNA, 15 nt, Human
cauuucucuccucac

SEQ ID NO: 1916828 - RNA, 20 nt, Human
cauuucccccaccccauuuc

SEQ ID NO: 1916829 - RNA, 21 nt, Human
cauuucccccaccccauuucu

SEQ ID NO: 1916830 - RNA, 13 nt, Human
cauugaccugagg

SEQ ID NO: 1916831 - RNA, 22 nt, Human
cauugaccugaggcccuucucu

SEQ ID NO: 1916832 - RNA, 14 nt, Human
cauugaacacaaac

SEQ ID NO: 1916833 - RNA, 15 nt, Human
cauugaacacaaacu

SEQ ID NO: 1916834 - RNA, 16 nt, Human
cauugaacacaaacug

SEQ ID NO: 1916835 - RNA, 17 nt, Human
cauugaacacaaacugu

SEQ ID NO: 1916836 - RNA, 18 nt, Human
cauugaacacaaacugua

SEQ ID NO: 1916837 - RNA, 21 nt, Human
cauugaccgcgacuaauuuca

SEQ ID NO: 1916838 - RNA, 22 nt, Human
cauugaccgcgacuaauuucaa

SEQ ID NO: 1916839 - RNA, 19 nt, Human
cauugaaaucuuuuugcuu

SEQ ID NO: 1916840 - RNA, 19 nt, Human
ccacaacaugaaaacucca

SEQ ID NO: 1916841 - RNA, 20 nt, Human
ccacaaaggcaaagggucca

SEQ ID NO: 1916842 - RNA, 16 nt, Human
ccacaaaggcaaaggg

SEQ ID NO: 1916843 - RNA, 18 nt, Human
ccacaaaggagagcuagc

SEQ ID NO: 1916844 - RNA, 16 nt, Human
ccacaagacccuugug

SEQ ID NO: 1916845 - RNA, 13 nt, Human
ccacaagagccca

SEQ ID NO: 1916846 - RNA, 22 nt, Human
ccacaagaaaugaaagcaggga

SEQ ID NO: 1916847 - RNA, 16 nt, Human
ccacaagaaaugaaag

SEQ ID NO: 1916848 - RNA, 18 nt, Human
ccaauauuguacaguuuu

SEQ ID NO: 1916849 - RNA, 16 nt, Human
ccaauauuguacaguu

SEQ ID NO: 1916850 - RNA, 15 nt, Human
ccaauauuguacagu

SEQ ID NO: 1916851 - RNA, 14 nt, Human
ccaauauuguacag

SEQ ID NO: 1916852 - RNA, 19 nt, Human
ccaauucuuacaaacaugu

SEQ ID NO: 1916853 - RNA, 18 nt, Human
ccaauucuuacaaacaug

SEQ ID NO: 1916854 - RNA, 16 nt, Human
ccaauuuuuuuuuccu

SEQ ID NO: 1916855 - RNA, 17 nt, Human
ccaauuuuuuuuuccuu

SEQ ID NO: 1916856 - RNA, 16 nt, Human
ccaauuucagacuccc

SEQ ID NO: 1916857 - RNA, 14 nt, Human
ccaaggcuggggga

SEQ ID NO: 1916858 - RNA, 13 nt, Human
ccaaggcucuguu

SEQ ID NO: 1916859 - RNA, 19 nt, Human
ccaaggcugauuaaaccaa

SEQ ID NO: 1916860 - RNA, 20 nt, Human
ccaauauucauagcagcuua

SEQ ID NO: 1916861 - RNA, 23 nt, Human
ccaagcagagguugggaggccau

SEQ ID NO: 1916862 - RNA, 22 nt, Human
ccaagagcugaggcaauucuaa

SEQ ID NO: 1916863 - RNA, 16 nt, Human
ccaagagccugagagu

SEQ ID NO: 1916864 - RNA, 13 nt, Human
ccaagaggcugca

SEQ ID NO: 1916865 - RNA, 12 nt, Human
ccaagaggcugc

SEQ ID NO: 1916866 - RNA, 14 nt, Human
ccaagcaggacaug

SEQ ID NO: 1916867 - RNA, 12 nt, Human
ccaagcucccag

SEQ ID NO: 1916868 - RNA, 13 nt, Human
ccaagcucccagg

SEQ ID NO: 1916869 - RNA, 18 nt, Human
ccaaggcuagaaccaccu

SEQ ID NO: 1916870 - RNA, 15 nt, Human
ccacaaguuaaauaa

SEQ ID NO: 1916871 - RNA, 20 nt, Human
ccacaaguuaaauaaaucau

SEQ ID NO: 1916872 - RNA, 17 nt, Human
ccacaaggacuuccugu

SEQ ID NO: 1916873 - RNA, 21 nt, Human
ccacaaggacuuccuguccag

SEQ ID NO: 1916874 - RNA, 15 nt, Human
ccacaagugguggua

SEQ ID NO: 1916875 - RNA, 21 nt, Human
ccacaaguggugguaacccug

SEQ ID NO: 1916876 - RNA, 22 nt, Human
ccacacaaggauagaugcuggc

SEQ ID NO: 1916877 - RNA, 20 nt, Human
ccacacaaggauagaugcug

SEQ ID NO: 1916878 - RNA, 22 nt, Human
ccacaaguggugguaacccugg

SEQ ID NO: 1916879 - RNA, 20 nt, Human
ccacaagagcccaggccucc

SEQ ID NO: 1916880 - RNA, 21 nt, Human
ccacaagagcccaggccuccu

SEQ ID NO: 1916881 - RNA, 16 nt, Human
ccacaagagcccaggc

SEQ ID NO: 1916882 - RNA, 17 nt, Human
ccacaagagcccaggcc

SEQ ID NO: 1916883 - RNA, 18 nt, Human
ccacaagagcccaggccu

SEQ ID NO: 1916884 - RNA, 19 nt, Human
ccacaagagcccaggccuc

SEQ ID NO: 1916885 - RNA, 17 nt, Human
ccaagaccucagggcac

SEQ ID NO: 1916886 - RNA, 12 nt, Human
ccaagagccuga

SEQ ID NO: 1916887 - RNA, 15 nt, Human
ccaagaccuucuccu

SEQ ID NO: 1916888 - RNA, 12 nt, Human
ccaaccuuccca

SEQ ID NO: 1916889 - RNA, 14 nt, Human
ccaaccuggggggc

SEQ ID NO: 1916890 - RNA, 17 nt, Human
ccaaccugcaaagaucu

SEQ ID NO: 1916891 - RNA, 18 nt, Human
ccaaccugcaaagaucug

SEQ ID NO: 1916892 - RNA, 19 nt, Human
ccaaccugcaaagaucugu

SEQ ID NO: 1916893 - RNA, 21 nt, Human
ccaaccuauuuugaaguacca

SEQ ID NO: 1916894 - RNA, 14 nt, Human
ccaaccuauuuuga

SEQ ID NO: 1916895 - RNA, 11 nt, Human
ccaacccuucu

SEQ ID NO: 1916896 - RNA, 13 nt, Human
ccaacccuucucc

SEQ ID NO: 1916897 - RNA, 21 nt, Human
ccaacccuucuccucuuguaa

SEQ ID NO: 1916898 - RNA, 13 nt, Human
ccaacccucauca

SEQ ID NO: 1916899 - RNA, 15 nt, Human
ccaacccucaucacc

SEQ ID NO: 1916900 - RNA, 16 nt, Human
ccaacaucaacaucuu

SEQ ID NO: 1916901 - RNA, 14 nt, Human
ccaacauacuccca

SEQ ID NO: 1916902 - RNA, 16 nt, Human
ccaacacgcaccugcc

SEQ ID NO: 1916903 - RNA, 17 nt, Human
ccaacacgcaccugccu

SEQ ID NO: 1916904 - RNA, 15 nt, Human
ccaaauucuuucagu

SEQ ID NO: 1916905 - RNA, 22 nt, Human
ccaaauucuuucaguggcuacc

SEQ ID NO: 1916906 - RNA, 13 nt, Human
ccaaagcagacag

SEQ ID NO: 1916907 - RNA, 14 nt, Human
ccaaagcagacagc

SEQ ID NO: 1916908 - RNA, 22 nt, Human
ccaaagaguagaauugcauuga

SEQ ID NO: 1916909 - RNA, 13 nt, Human
ccaaagaugcagc

SEQ ID NO: 1916910 - RNA, 14 nt, Human
ccaaagaugcagcc

SEQ ID NO: 1916911 - RNA, 9 nt, Human
ccaaagagu

SEQ ID NO: 1916912 - RNA, 16 nt, Human
ccagccuggccacgca

SEQ ID NO: 1916913 - RNA, 11 nt, Human
ccagccuggcc

SEQ ID NO: 1916914 - RNA, 23 nt, Human
ccagccuggccacgcagccagga

SEQ ID NO: 1916915 - RNA, 19 nt, Human
ccagccuggccacgcagcc

SEQ ID NO: 1916916 - RNA, 20 nt, Human
ccagcugagcgccaggaugg

SEQ ID NO: 1916917 - RNA, 15 nt, Human
ccagcugaugacuca

SEQ ID NO: 1916918 - RNA, 16 nt, Human
ccagcugaugacucaa

SEQ ID NO: 1916919 - RNA, 17 nt, Human
ccagcugaugacucaag

SEQ ID NO: 1916920 - RNA, 22 nt, Human
ccagcugaugacucaagauucc

SEQ ID NO: 1916921 - RNA, 23 nt, Human
ccagcugaugacucaagauuccc

SEQ ID NO: 1916922 - RNA, 15 nt, Human
ccagcugagcgccag

SEQ ID NO: 1916923 - RNA, 17 nt, Human
ccagcugagcgccagga

SEQ ID NO: 1916924 - RNA, 14 nt, Human
ccagcucuuuccuc

SEQ ID NO: 1916925 - RNA, 16 nt, Human
ccagcucuuuccuccu

SEQ ID NO: 1916926 - RNA, 17 nt, Human
ccagcucuuuccuccuu

SEQ ID NO: 1916927 - RNA, 21 nt, Human
ccagcugugcucuggacaggc

SEQ ID NO: 1916928 - RNA, 20 nt, Human
ccagcugugcucuggacagg

SEQ ID NO: 1916929 - RNA, 18 nt, Human
ccagcugugcucuggaca

SEQ ID NO: 1916930 - RNA, 18 nt, Human
ccagcugggucaggcagg

SEQ ID NO: 1916931 - RNA, 16 nt, Human
ccagcugggucaggca

SEQ ID NO: 1916932 - RNA, 17 nt, Human
ccagcugggucaggcag

SEQ ID NO: 1916933 - RNA, 13 nt, Human
ccagcugcacuga

SEQ ID NO: 1916934 - RNA, 16 nt, Human
ccagcugcuugggcuu

SEQ ID NO: 1916935 - RNA, 18 nt, Human
ccagcugcuugggcuuca

SEQ ID NO: 1916936 - RNA, 13 nt, Human
ccagcugcuuggg

SEQ ID NO: 1916937 - RNA, 15 nt, Human
ccagcugcuugggcu

SEQ ID NO: 1916938 - RNA, 17 nt, Human
ccaggcccucugcccac

SEQ ID NO: 1916939 - RNA, 18 nt, Human
ccaggcccucugcccacu

SEQ ID NO: 1916940 - RNA, 19 nt, Human
ccaggcccucugcccacuc

SEQ ID NO: 1916941 - RNA, 13 nt, Human
ccaggccuccuac

SEQ ID NO: 1916942 - RNA, 18 nt, Human
ccaggccuccuacagcuu

SEQ ID NO: 1916943 - RNA, 19 nt, Human
ccaggccuccuacagcuug

SEQ ID NO: 1916944 - RNA, 19 nt, Human
ccaggccccugccacccug

SEQ ID NO: 1916945 - RNA, 23 nt, Human
ccaggccccugccacccugggga

SEQ ID NO: 1916946 - RNA, 21 nt, Human
ccaggccccugccacccuggg

SEQ ID NO: 1916947 - RNA, 21 nt, Human
ccaggccagagggagugacag

SEQ ID NO: 1916948 - RNA, 14 nt, Human
ccaggccagaggga

SEQ ID NO: 1916949 - RNA, 14 nt, Human
ccaggagcagccac

SEQ ID NO: 1916950 - RNA, 23 nt, Human
ccagcugugcucuggacaggcau

SEQ ID NO: 1916951 - RNA, 22 nt, Human
ccagcugugcucuggacaggca

SEQ ID NO: 1916952 - RNA, 15 nt, Human
ccaggaagccagcag

SEQ ID NO: 1916953 - RNA, 17 nt, Human
ccaggaagccagcaggc

SEQ ID NO: 1916954 - RNA, 19 nt, Human
ccaggaagccagcaggcuc

SEQ ID NO: 1916955 - RNA, 15 nt, Human
ccaggaccaucaucc

SEQ ID NO: 1916956 - RNA, 14 nt, Human
ccaggacccugaag

SEQ ID NO: 1916957 - RNA, 16 nt, Human
ccaggacccugaaggg

SEQ ID NO: 1916958 - RNA, 17 nt, Human
ccaggaccagcucagga

SEQ ID NO: 1916959 - RNA, 20 nt, Human
ccaggaccagcucaggacag

SEQ ID NO: 1916960 - RNA, 13 nt, Human
ccaggaccagcuc

SEQ ID NO: 1916961 - RNA, 14 nt, Human
ccaggaccagcuca

SEQ ID NO: 1916962 - RNA, 15 nt, Human
ccaggaccagcucag

SEQ ID NO: 1916963 - RNA, 16 nt, Human
ccaggaccagcucagg

SEQ ID NO: 1916964 - RNA, 23 nt, Human
ccaggacccugaaggggccauga

SEQ ID NO: 1916965 - RNA, 18 nt, Human
ccaggacccugaaggggc

SEQ ID NO: 1916966 - RNA, 19 nt, Human
ccaggacccugaaggggcc

SEQ ID NO: 1916967 - RNA, 15 nt, Human
ccaggaccuggcugc

SEQ ID NO: 1916968 - RNA, 17 nt, Human
ccaggaccuggcugcca

SEQ ID NO: 1916969 - RNA, 18 nt, Human
ccaggaccuggcugccau

SEQ ID NO: 1916970 - RNA, 12 nt, Human
ccaggagcagcc

SEQ ID NO: 1916971 - RNA, 13 nt, Human
ccaggagcagcca

SEQ ID NO: 1916972 - RNA, 13 nt, Human
ccaggacugggcc

SEQ ID NO: 1916973 - RNA, 12 nt, Human
ccaggacugggc

SEQ ID NO: 1916974 - RNA, 17 nt, Human
ccaggacugggccacuu

SEQ ID NO: 1916975 - RNA, 14 nt, Human
ccaggacugggcca

SEQ ID NO: 1916976 - RNA, 21 nt, Human
ccaggacuuauuuaaacucug

SEQ ID NO: 1916977 - RNA, 16 nt, Human
ccagggagaccuggac

SEQ ID NO: 1916978 - RNA, 17 nt, Human
ccagggagaccuggaca

SEQ ID NO: 1916979 - RNA, 23 nt, Human
ccagggacagaggggguggccuc

SEQ ID NO: 1916980 - RNA, 23 nt, Human
ccagggacagaggccccagccuc

SEQ ID NO: 1916981 - RNA, 21 nt, Human
ccagggacagaggccccagcc

SEQ ID NO: 1916982 - RNA, 22 nt, Human
ccagggacagaggccccagccu

SEQ ID NO: 1916983 - RNA, 18 nt, Human
ccagggacgaagaagagc

SEQ ID NO: 1916984 - RNA, 19 nt, Human
ccagggacgaagaagagcc

SEQ ID NO: 1916985 - RNA, 20 nt, Human
ccagggacgaagaagagcca

SEQ ID NO: 1916986 - RNA, 21 nt, Human
ccagggacgaagaagagccac

SEQ ID NO: 1916987 - RNA, 23 nt, Human
ccagggacgaagaagagccacag

SEQ ID NO: 1916988 - RNA, 15 nt, Human
ccagggagaagcucc

SEQ ID NO: 1916989 - RNA, 13 nt, Human
ccagggagaagcu

SEQ ID NO: 1916990 - RNA, 14 nt, Human
ccagggagaagcuc

SEQ ID NO: 1916991 - RNA, 13 nt, Human
ccagggacagagg

SEQ ID NO: 1916992 - RNA, 18 nt, Human
ccagggacagaggcccca

SEQ ID NO: 1916993 - RNA, 20 nt, Human
ccagggacagaggccccagc

SEQ ID NO: 1916994 - RNA, 18 nt, Human
ccaggccuuaucuccaag

SEQ ID NO: 1916995 - RNA, 16 nt, Human
ccaucaugucuggcua

SEQ ID NO: 1916996 - RNA, 14 nt, Human
ccaucaugucuggc

SEQ ID NO: 1916997 - RNA, 20 nt, Human
ccaucauguuuacagaggac

SEQ ID NO: 1916998 - RNA, 22 nt, Human
ccaucauguuuacagaggacag

SEQ ID NO: 1916999 - RNA, 21 nt, Human
ccauccucuguacagagccca

SEQ ID NO: 1917000 - RNA, 15 nt, Human
ccauccugaggcucc

SEQ ID NO: 1917001 - RNA, 16 nt, Human
ccauccugaggcucca

SEQ ID NO: 1917002 - RNA, 16 nt, Human
ccauccucuucuuuua

SEQ ID NO: 1917003 - RNA, 23 nt, Human
ccaucucaccuccugcugggcag

SEQ ID NO: 1917004 - RNA, 20 nt, Human
ccaucucaugccccuggcug

SEQ ID NO: 1917005 - RNA, 21 nt, Human
ccaucucaugccccuggcugg

SEQ ID NO: 1917006 - RNA, 14 nt, Human
ccaucuuucuuugg

SEQ ID NO: 1917007 - RNA, 19 nt, Human
ccaucucaccuccugcugg

SEQ ID NO: 1917008 - RNA, 21 nt, Human
ccaucucaccuccugcugggc

SEQ ID NO: 1917009 - RNA, 18 nt, Human
ccaucucaccuccugcug

SEQ ID NO: 1917010 - RNA, 22 nt, Human
ccaucgccagcugaugacucaa

SEQ ID NO: 1917011 - RNA, 19 nt, Human
ccaucgccagcugaugacu

SEQ ID NO: 1917012 - RNA, 21 nt, Human
ccaucgccagcugaugacuca

SEQ ID NO: 1917013 - RNA, 23 nt, Human
ccaucgccagcugaugacucaag

SEQ ID NO: 1917014 - RNA, 20 nt, Human
ccauccuucccugucugcca

SEQ ID NO: 1917015 - RNA, 17 nt, Human
ccaucgccagcugauga

SEQ ID NO: 1917016 - RNA, 19 nt, Human
ccauauucuguuggccagu

SEQ ID NO: 1917017 - RNA, 18 nt, Human
ccauauucuguuggccag

SEQ ID NO: 1917018 - RNA, 15 nt, Human
ccauauucuguuggc

SEQ ID NO: 1917019 - RNA, 19 nt, Human
ccauauuaccacagacaua

SEQ ID NO: 1917020 - RNA, 23 nt, Human
ccauagagagcaagacgcugugc

SEQ ID NO: 1917021 - RNA, 12 nt, Human
ccaucacccgcu

SEQ ID NO: 1917022 - RNA, 16 nt, Human
ccaucaaaaugcuuuu

SEQ ID NO: 1917023 - RNA, 19 nt, Human
ccaucaaaaugcuuuuuau

SEQ ID NO: 1917024 - RNA, 23 nt, Human
ccauguuggccaggcuggucuca

SEQ ID NO: 1917025 - RNA, 22 nt, Human
cccagaggagcugggagccggg

SEQ ID NO: 1917026 - RNA, 20 nt, Human
cccagaggagcugggagccg

SEQ ID NO: 1917027 - RNA, 15 nt, Human
cccagaggagggcag

SEQ ID NO: 1917028 - RNA, 17 nt, Human
cccagagcccagcucca

SEQ ID NO: 1917029 - RNA, 12 nt, Human
cccagagcccag

SEQ ID NO: 1917030 - RNA, 13 nt, Human
cccagagcccagc

SEQ ID NO: 1917031 - RNA, 15 nt, Human
cccagagcccagcuc

SEQ ID NO: 1917032 - RNA, 16 nt, Human
cccagagcccagcucc

SEQ ID NO: 1917033 - RNA, 13 nt, Human
cccagccccaaug

SEQ ID NO: 1917034 - RNA, 18 nt, Human
cccagauuuugcuguaua

SEQ ID NO: 1917035 - RNA, 19 nt, Human
cccagauuuugcuguauau

SEQ ID NO: 1917036 - RNA, 21 nt, Human
cccagauuuugcuguauauuu

SEQ ID NO: 1917037 - RNA, 17 nt, Human
cccagauuggcucacac

SEQ ID NO: 1917038 - RNA, 22 nt, Human
cccagauuggcucacacugaga

SEQ ID NO: 1917039 - RNA, 21 nt, Human
cccagauuggcucacacugag

SEQ ID NO: 1917040 - RNA, 20 nt, Human
cccagauuggcucacacuga

SEQ ID NO: 1917041 - RNA, 19 nt, Human
cccagauuggcucacacug

SEQ ID NO: 1917042 - RNA, 17 nt, Human
cccagccccaaugaaca

SEQ ID NO: 1917043 - RNA, 11 nt, Human
cccagccccau

SEQ ID NO: 1917044 - RNA, 12 nt, Human
cccagccccauc

SEQ ID NO: 1917045 - RNA, 16 nt, Human
cccagccucccugaag

SEQ ID NO: 1917046 - RNA, 17 nt, Human
cccagccucccugaagc

SEQ ID NO: 1917047 - RNA, 18 nt, Human
cccagccucccugaagcc

SEQ ID NO: 1917048 - RNA, 18 nt, Human
cccagccccauccucugu

SEQ ID NO: 1917049 - RNA, 19 nt, Human
cccagccccauccucugua

SEQ ID NO: 1917050 - RNA, 13 nt, Human
cccagccccaucc

SEQ ID NO: 1917051 - RNA, 14 nt, Human
cccagccccauccc

SEQ ID NO: 1917052 - RNA, 14 nt, Human
cccagccccauccu

SEQ ID NO: 1917053 - RNA, 15 nt, Human
cccagccccauccuc

SEQ ID NO: 1917054 - RNA, 12 nt, Human
cccagcucuggu

SEQ ID NO: 1917055 - RNA, 13 nt, Human
cccagcucugguc

SEQ ID NO: 1917056 - RNA, 14 nt, Human
cccagcucuggucc

SEQ ID NO: 1917057 - RNA, 15 nt, Human
cccagcucuggucca

SEQ ID NO: 1917058 - RNA, 16 nt, Human
cccagcucugguccau

SEQ ID NO: 1917059 - RNA, 18 nt, Human
cccagcucugguccauag

SEQ ID NO: 1917060 - RNA, 14 nt, Human
cccagcgagcccug

SEQ ID NO: 1917061 - RNA, 19 nt, Human
cccagcuacucgggaagcu

SEQ ID NO: 1917062 - RNA, 15 nt, Human
cccagcuacuuggga

SEQ ID NO: 1917063 - RNA, 21 nt, Human
cccagcuaugguucucucgca

SEQ ID NO: 1917064 - RNA, 14 nt, Human
cccaggaggccagc

SEQ ID NO: 1917065 - RNA, 14 nt, Human
cccaggagccccga

SEQ ID NO: 1917066 - RNA, 13 nt, Human
cccaggagccccg

SEQ ID NO: 1917067 - RNA, 15 nt, Human
cccaggacugggcca

SEQ ID NO: 1917068 - RNA, 14 nt, Human
cccaggacugggcc

SEQ ID NO: 1917069 - RNA, 13 nt, Human
cccaggacugggc

SEQ ID NO: 1917070 - RNA, 12 nt, Human
cccaggacuggg

SEQ ID NO: 1917071 - RNA, 12 nt, Human
cccaggaccagc

SEQ ID NO: 1917072 - RNA, 14 nt, Human
cccaggaccagcuc

SEQ ID NO: 1917073 - RNA, 15 nt, Human
cccaggaccagcuca

SEQ ID NO: 1917074 - RNA, 16 nt, Human
cccaggaccagcucag

SEQ ID NO: 1917075 - RNA, 17 nt, Human
cccaggaccagcucagg

SEQ ID NO: 1917076 - RNA, 20 nt, Human
cccaggaccagcucaggaca

SEQ ID NO: 1917077 - RNA, 21 nt, Human
cccaggaccagcucaggacag

SEQ ID NO: 1917078 - RNA, 22 nt, Human
cccaggaccagcucaggacaga

SEQ ID NO: 1917079 - RNA, 18 nt, Human
cccaggaccuggcugcca

SEQ ID NO: 1917080 - RNA, 16 nt, Human
cccaggaccuggcugc

SEQ ID NO: 1917081 - RNA, 16 nt, Human
cccaggaccccugagu

SEQ ID NO: 1917082 - RNA, 11 nt, Human
cccaggacccu

SEQ ID NO: 1917083 - RNA, 12 nt, Human
cccaggacccug

SEQ ID NO: 1917084 - RNA, 13 nt, Human
cccaggacccuga

SEQ ID NO: 1917085 - RNA, 23 nt, Human
cccaggacccugaaggggccaug

SEQ ID NO: 1917086 - RNA, 18 nt, Human
cccaggaggccagccuug

SEQ ID NO: 1917087 - RNA, 21 nt, Human
cccagacggcuccacuaggac

SEQ ID NO: 1917088 - RNA, 12 nt, Human
cccagacucaga

SEQ ID NO: 1917089 - RNA, 13 nt, Human
cccagacucagac

SEQ ID NO: 1917090 - RNA, 16 nt, Human
cccagacucagacauu

SEQ ID NO: 1917091 - RNA, 20 nt, Human
cccagacucagacauuggca

SEQ ID NO: 1917092 - RNA, 21 nt, Human
cccagaccuguuagcagacag

SEQ ID NO: 1917093 - RNA, 22 nt, Human
cccagaccuguuagcagacagg

SEQ ID NO: 1917094 - RNA, 15 nt, Human
cccacgcccccacug

SEQ ID NO: 1917095 - RNA, 20 nt, Human
cccagacacaucgcacugug

SEQ ID NO: 1917096 - RNA, 23 nt, Human
cccagacacaucgcacuguggau

SEQ ID NO: 1917097 - RNA, 11 nt, Human
cccagacacau

SEQ ID NO: 1917098 - RNA, 13 nt, Human
cccacgcccccac

SEQ ID NO: 1917099 - RNA, 14 nt, Human
cccacgcccccacu

SEQ ID NO: 1917100 - RNA, 20 nt, Human
cccaccuuggcugcagggag

SEQ ID NO: 1917101 - RNA, 19 nt, Human
cccaccuuggcugcaggga

SEQ ID NO: 1917102 - RNA, 17 nt, Human
cccaccuuggcugcagg

SEQ ID NO: 1917103 - RNA, 16 nt, Human
cccaccuuggcugcag

SEQ ID NO: 1917104 - RNA, 12 nt, Human
cccaccuggccu

SEQ ID NO: 1917105 - RNA, 15 nt, Human
cccaccuggccucug

SEQ ID NO: 1917106 - RNA, 21 nt, Human
ccauguuggccaggcuggucu

SEQ ID NO: 1917107 - RNA, 19 nt, Human
ccauguuggccaggcuggu

SEQ ID NO: 1917108 - RNA, 15 nt, Human
ccauguuggccaggc

SEQ ID NO: 1917109 - RNA, 18 nt, Human
ccauguuggccaggcugg

SEQ ID NO: 1917110 - RNA, 13 nt, Human
ccauuccugaaga

SEQ ID NO: 1917111 - RNA, 16 nt, Human
ccauuccugaagaacc

SEQ ID NO: 1917112 - RNA, 16 nt, Human
ccaugcgacacuggga

SEQ ID NO: 1917113 - RNA, 21 nt, Human
ccaugcgacacugggaggcca

SEQ ID NO: 1917114 - RNA, 22 nt, Human
ccaugcgacacugggaggccag

SEQ ID NO: 1917115 - RNA, 13 nt, Human
ccaugcuccuggc

SEQ ID NO: 1917116 - RNA, 22 nt, Human
ccaugaaaaugcaacaacaugu

SEQ ID NO: 1917117 - RNA, 16 nt, Human
ccaugcugcccuguga

SEQ ID NO: 1917118 - RNA, 17 nt, Human
ccaugcugcccugugag

SEQ ID NO: 1917119 - RNA, 15 nt, Human
ccaugcugcccugug

SEQ ID NO: 1917120 - RNA, 15 nt, Human
ccaugcuccuggccc

SEQ ID NO: 1917121 - RNA, 18 nt, Human
ccaugcuccuggcccacu

SEQ ID NO: 1917122 - RNA, 13 nt, Human
ccaugugccaggu

SEQ ID NO: 1917123 - RNA, 23 nt, Human
ccauggcacucuauguucuaaga

SEQ ID NO: 1917124 - RNA, 16 nt, Human
ccauggauggaaaacg

SEQ ID NO: 1917125 - RNA, 14 nt, Human
ccauguuggccagg

SEQ ID NO: 1917126 - RNA, 13 nt, Human
ccauguuggccag

SEQ ID NO: 1917127 - RNA, 23 nt, Human
ccaugugcuacaggggccagaag

SEQ ID NO: 1917128 - RNA, 18 nt, Human
ccaugugcuacaggggcc

SEQ ID NO: 1917129 - RNA, 21 nt, Human
ccaugugaggguuuucagcau

SEQ ID NO: 1917130 - RNA, 12 nt, Human
ccauggaaccug

SEQ ID NO: 1917131 - RNA, 14 nt, Human
ccauggacaggcug

SEQ ID NO: 1917132 - RNA, 15 nt, Human
ccauggacaggcugg

SEQ ID NO: 1917133 - RNA, 14 nt, Human
ccauggagccagcu

SEQ ID NO: 1917134 - RNA, 17 nt, Human
ccauggagccagcuccc

SEQ ID NO: 1917135 - RNA, 18 nt, Human
ccauggagccagcucccu

SEQ ID NO: 1917136 - RNA, 22 nt, Human
ccauggagccagcucccucuau

SEQ ID NO: 1917137 - RNA, 21 nt, Human
ccccaaauggaaaugggcaga

SEQ ID NO: 1917138 - RNA, 14 nt, Human
cccauguagccccc

SEQ ID NO: 1917139 - RNA, 15 nt, Human
cccauguagcccccu

SEQ ID NO: 1917140 - RNA, 21 nt, Human
cccauguagcccccuggccuc

SEQ ID NO: 1917141 - RNA, 22 nt, Human
cccauguagcccccuggccucu

SEQ ID NO: 1917142 - RNA, 23 nt, Human
cccauguagcccccuggccucug

SEQ ID NO: 1917143 - RNA, 20 nt, Human
cccaugagccucagcauccu

SEQ ID NO: 1917144 - RNA, 16 nt, Human
cccaugagccucagca

SEQ ID NO: 1917145 - RNA, 15 nt, Human
cccaugagccucagc

SEQ ID NO: 1917146 - RNA, 14 nt, Human
cccaugcugcccug

SEQ ID NO: 1917147 - RNA, 12 nt, Human
cccaugcugccc

SEQ ID NO: 1917148 - RNA, 13 nt, Human
cccaugcugcccu

SEQ ID NO: 1917149 - RNA, 20 nt, Human
cccaucugugaaaggaaaga

SEQ ID NO: 1917150 - RNA, 14 nt, Human
cccaucucaugccc

SEQ ID NO: 1917151 - RNA, 18 nt, Human
cccaucucacacaugagc

SEQ ID NO: 1917152 - RNA, 20 nt, Human
cccaucucaugccccuggcu

SEQ ID NO: 1917153 - RNA, 13 nt, Human
cccaucucacaca

SEQ ID NO: 1917154 - RNA, 19 nt, Human
cccagucuggaaugcagug

SEQ ID NO: 1917155 - RNA, 18 nt, Human
cccagucuggaaugcagu

SEQ ID NO: 1917156 - RNA, 10 nt, Human
cccagucugg

SEQ ID NO: 1917157 - RNA, 14 nt, Human
cccaguccuuccac

SEQ ID NO: 1917158 - RNA, 16 nt, Human
cccaguccuuccaccu

SEQ ID NO: 1917159 - RNA, 17 nt, Human
cccaguccuuccaccuc

SEQ ID NO: 1917160 - RNA, 21 nt, Human
cccagugcccacaggaucagu

SEQ ID NO: 1917161 - RNA, 14 nt, Human
cccagugcccccac

SEQ ID NO: 1917162 - RNA, 15 nt, Human
cccagugccgagaag

SEQ ID NO: 1917163 - RNA, 19 nt, Human
cccagugcccccacugacc

SEQ ID NO: 1917164 - RNA, 20 nt, Human
cccagugcccccacugacca

SEQ ID NO: 1917165 - RNA, 22 nt, Human
cccagugcccccacugaccaga

SEQ ID NO: 1917166 - RNA, 20 nt, Human
cccagugguuccuaauccuc

SEQ ID NO: 1917167 - RNA, 14 nt, Human
cccaguuagcucuc

SEQ ID NO: 1917168 - RNA, 14 nt, Human
cccaguucacccug

SEQ ID NO: 1917169 - RNA, 23 nt, Human
cccaggcaggucuugaacuccug

SEQ ID NO: 1917170 - RNA, 15 nt, Human
cccaggcauucccca

SEQ ID NO: 1917171 - RNA, 15 nt, Human
cccaggaggccagcc

SEQ ID NO: 1917172 - RNA, 16 nt, Human
cccaggaggccagccu

SEQ ID NO: 1917173 - RNA, 17 nt, Human
cccaggcauuccccagg

SEQ ID NO: 1917174 - RNA, 18 nt, Human
cccaggcauuccccagga

SEQ ID NO: 1917175 - RNA, 13 nt, Human
cccagguuucuau

SEQ ID NO: 1917176 - RNA, 12 nt, Human
cccuggagccca

SEQ ID NO: 1917177 - RNA, 15 nt, Human
cccugggaggcucug

SEQ ID NO: 1917178 - RNA, 16 nt, Human
cccugggaggcucugg

SEQ ID NO: 1917179 - RNA, 17 nt, Human
cccugggaggcucugga

SEQ ID NO: 1917180 - RNA, 18 nt, Human
cccugggaggcucuggag

SEQ ID NO: 1917181 - RNA, 22 nt, Human
cccugguggcagugggagcugc

SEQ ID NO: 1917182 - RNA, 16 nt, Human
cccuggugggccaaca

SEQ ID NO: 1917183 - RNA, 21 nt, Human
cccuggacugugugcucagga

SEQ ID NO: 1917184 - RNA, 21 nt, Human
cccuggagaggcccucuggag

SEQ ID NO: 1917185 - RNA, 20 nt, Human
cccugcugguucaggguugg

SEQ ID NO: 1917186 - RNA, 19 nt, Human
cccugcugguucaggguug

SEQ ID NO: 1917187 - RNA, 13 nt, Human
cccugcugguuca

SEQ ID NO: 1917188 - RNA, 16 nt, Human
cccugccucucugcag

SEQ ID NO: 1917189 - RNA, 21 nt, Human
cccugccucucugcagguccc

SEQ ID NO: 1917190 - RNA, 22 nt, Human
cccugccucucugcaggucccu

SEQ ID NO: 1917191 - RNA, 22 nt, Human
cccugcaaccugauugugucuc

SEQ ID NO: 1917192 - RNA, 16 nt, Human
cccugcaaccugauug

SEQ ID NO: 1917193 - RNA, 12 nt, Human
cccugcagaggg

SEQ ID NO: 1917194 - RNA, 20 nt, Human
cccugcagagggcacagaaa

SEQ ID NO: 1917195 - RNA, 18 nt, Human
cccugcagagggcacaga

SEQ ID NO: 1917196 - RNA, 20 nt, Human
cccucuacugggagccuacc

SEQ ID NO: 1917197 - RNA, 17 nt, Human
cccucuacugggagccu

SEQ ID NO: 1917198 - RNA, 21 nt, Human
cccugauuuaggagaagccag

SEQ ID NO: 1917199 - RNA, 23 nt, Human
cccugauuuaggagaagccagga

SEQ ID NO: 1917200 - RNA, 15 nt, Human
cccugccacccuggg

SEQ ID NO: 1917201 - RNA, 14 nt, Human
cccugccacccugg

SEQ ID NO: 1917202 - RNA, 12 nt, Human
cccugccacccu

SEQ ID NO: 1917203 - RNA, 18 nt, Human
cccugccacccuggggag

SEQ ID NO: 1917204 - RNA, 17 nt, Human
cccugccacccugggga

SEQ ID NO: 1917205 - RNA, 14 nt, Human
cccugccuccuuug

SEQ ID NO: 1917206 - RNA, 20 nt, Human
cccugccaucauguuuacag

SEQ ID NO: 1917207 - RNA, 11 nt, Human
cccugccucuc

SEQ ID NO: 1917208 - RNA, 18 nt, Human
cccugccucucugcaggu

SEQ ID NO: 1917209 - RNA, 16 nt, Human
cccugccuccuuugug

SEQ ID NO: 1917210 - RNA, 23 nt, Human
cccugccuccuuugugaggaagc

SEQ ID NO: 1917211 - RNA, 14 nt, Human
cccugguggcagcu

SEQ ID NO: 1917212 - RNA, 22 nt, Human
ccccagccuggccacgcagcca

SEQ ID NO: 1917213 - RNA, 23 nt, Human
ccccagccuggccacgcagccag

SEQ ID NO: 1917214 - RNA, 21 nt, Human
ccccagccuggccacgcagcc

SEQ ID NO: 1917215 - RNA, 16 nt, Human
ccccagccuggccacg

SEQ ID NO: 1917216 - RNA, 13 nt, Human
ccccagccugcua

SEQ ID NO: 1917217 - RNA, 21 nt, Human
ccccagcuggggccaggcugg

SEQ ID NO: 1917218 - RNA, 22 nt, Human
ccccagcuggggccaggcuggg

SEQ ID NO: 1917219 - RNA, 15 nt, Human
ccccagccccauccu

SEQ ID NO: 1917220 - RNA, 16 nt, Human
ccccagccccauccca

SEQ ID NO: 1917221 - RNA, 23 nt, Human
ccccacaggagguggucugggac

SEQ ID NO: 1917222 - RNA, 12 nt, Human
ccccaggaggcc

SEQ ID NO: 1917223 - RNA, 22 nt, Human
ccccaggacugggccacuucug

SEQ ID NO: 1917224 - RNA, 16 nt, Human
ccccaggacugggcca

SEQ ID NO: 1917225 - RNA, 14 nt, Human
ccccaggacugggc

SEQ ID NO: 1917226 - RNA, 13 nt, Human
ccccaggacuggg

SEQ ID NO: 1917227 - RNA, 18 nt, Human
ccccaggaccagcucagg

SEQ ID NO: 1917228 - RNA, 19 nt, Human
ccccaggaccagcucagga

SEQ ID NO: 1917229 - RNA, 21 nt, Human
ccccaggaccagcucaggaca

SEQ ID NO: 1917230 - RNA, 15 nt, Human
ccccaggaccuggcu

SEQ ID NO: 1917231 - RNA, 17 nt, Human
ccccaggaccuggcugc

SEQ ID NO: 1917232 - RNA, 20 nt, Human
ccccaggaccuggcugccau

SEQ ID NO: 1917233 - RNA, 21 nt, Human
ccccaggaccuggcugccaua

SEQ ID NO: 1917234 - RNA, 15 nt, Human
ccccuggcagccccu

SEQ ID NO: 1917235 - RNA, 12 nt, Human
ccccuggcagcc

SEQ ID NO: 1917236 - RNA, 14 nt, Human
ccccuggcagcccc

SEQ ID NO: 1917237 - RNA, 22 nt, Human
ccccaggugguuauggagaggg

SEQ ID NO: 1917238 - RNA, 21 nt, Human
cccgcggggacauugggaagg

SEQ ID NO: 1917239 - RNA, 22 nt, Human
cccgcuaagagggagggagggc

SEQ ID NO: 1917240 - RNA, 15 nt, Human
cccgaggccuucucu

SEQ ID NO: 1917241 - RNA, 20 nt, Human
cccgaggccuucucugaagg

SEQ ID NO: 1917242 - RNA, 22 nt, Human
ccccuguccccgcacugggcuu

SEQ ID NO: 1917243 - RNA, 14 nt, Human
ccccuguacuccag

SEQ ID NO: 1917244 - RNA, 18 nt, Human
ccccugguucucaucuuu

SEQ ID NO: 1917245 - RNA, 19 nt, Human
ccccugggggcucucaugu

SEQ ID NO: 1917246 - RNA, 15 nt, Human
ccccugguucucauc

SEQ ID NO: 1917247 - RNA, 23 nt, Human
ccccuggugguucacucuuggag

SEQ ID NO: 1917248 - RNA, 20 nt, Human
ccccuguucuggcagaguug

SEQ ID NO: 1917249 - RNA, 14 nt, Human
ccccugucuagaga

SEQ ID NO: 1917250 - RNA, 18 nt, Human
ccccugucuagagaggga

SEQ ID NO: 1917251 - RNA, 14 nt, Human
ccccuucacaaagc

SEQ ID NO: 1917252 - RNA, 17 nt, Human
cccuccaugugggcuag

SEQ ID NO: 1917253 - RNA, 17 nt, Human
cccuccccgcccuuuuu

SEQ ID NO: 1917254 - RNA, 16 nt, Human
cccuccccgcccuuuu

SEQ ID NO: 1917255 - RNA, 20 nt, Human
cccucccuguuccccagaga

SEQ ID NO: 1917256 - RNA, 19 nt, Human
cccucccuguuccccagag

SEQ ID NO: 1917257 - RNA, 14 nt, Human
cccucccuuucucc

SEQ ID NO: 1917258 - RNA, 13 nt, Human
cccucccuuucuc

SEQ ID NO: 1917259 - RNA, 16 nt, Human
cccucccuuucucccc

SEQ ID NO: 1917260 - RNA, 13 nt, Human
cccucccucuuuc

SEQ ID NO: 1917261 - RNA, 23 nt, Human
cccucccucuacugggagccuac

SEQ ID NO: 1917262 - RNA, 22 nt, Human
cccucaucaccaacgucugugc

SEQ ID NO: 1917263 - RNA, 17 nt, Human
cccucauccucauaccc

SEQ ID NO: 1917264 - RNA, 20 nt, Human
cccucauccucauacccacc

SEQ ID NO: 1917265 - RNA, 21 nt, Human
cccucagggucccugguggca

SEQ ID NO: 1917266 - RNA, 20 nt, Human
cccucagucuggcccuuccu

SEQ ID NO: 1917267 - RNA, 21 nt, Human
cccuccaagaccuucuccuuc

SEQ ID NO: 1917268 - RNA, 19 nt, Human
cccucauuggcucuugaac

SEQ ID NO: 1917269 - RNA, 22 nt, Human
cccucauccucauacccacccc

SEQ ID NO: 1917270 - RNA, 17 nt, Human
cccucaucucucugccc

SEQ ID NO: 1917271 - RNA, 16 nt, Human
cccggcaggguccuag

SEQ ID NO: 1917272 - RNA, 22 nt, Human
cccuaaaguguauuuuuuuacu

SEQ ID NO: 1917273 - RNA, 17 nt, Human
cccuaaaguguauuuuu

SEQ ID NO: 1917274 - RNA, 14 nt, Human
cccuaaaagcacac

SEQ ID NO: 1917275 - RNA, 15 nt, Human
cccuaauaaagcugu

SEQ ID NO: 1917276 - RNA, 18 nt, Human
cccuaauaaagcugugug

SEQ ID NO: 1917277 - RNA, 21 nt, Human
cccuaaggucauuaccacagg

SEQ ID NO: 1917278 - RNA, 12 nt, Human
cccuaauaaagc

SEQ ID NO: 1917279 - RNA, 13 nt, Human
cccuaauaaagcu

SEQ ID NO: 1917280 - RNA, 14 nt, Human
cccuaauaaagcug

SEQ ID NO: 1917281 - RNA, 15 nt, Human
cccucagggucccug

SEQ ID NO: 1917282 - RNA, 16 nt, Human
cccucagggucccugg

SEQ ID NO: 1917283 - RNA, 17 nt, Human
cccucagggucccuggu

SEQ ID NO: 1917284 - RNA, 18 nt, Human
cccucagggucccuggug

SEQ ID NO: 1917285 - RNA, 19 nt, Human
cccucagggucccuggugg

SEQ ID NO: 1917286 - RNA, 17 nt, Human
ccuccuuggugccuggc

SEQ ID NO: 1917287 - RNA, 15 nt, Human
ccuccuuggugccug

SEQ ID NO: 1917288 - RNA, 21 nt, Human
ccuccuccagccgccaugcuc

SEQ ID NO: 1917289 - RNA, 15 nt, Human
ccucuccccagcaag

SEQ ID NO: 1917290 - RNA, 11 nt, Human
ccucucccagg

SEQ ID NO: 1917291 - RNA, 14 nt, Human
ccucuacugggagc

SEQ ID NO: 1917292 - RNA, 20 nt, Human
ccucuccccagcaagugaga

SEQ ID NO: 1917293 - RNA, 12 nt, Human
ccucuccccagc

SEQ ID NO: 1917294 - RNA, 14 nt, Human
ccucuccccagccc

SEQ ID NO: 1917295 - RNA, 16 nt, Human
ccucuccccagcccag

SEQ ID NO: 1917296 - RNA, 17 nt, Human
ccucuccccagcccaga

SEQ ID NO: 1917297 - RNA, 13 nt, Human
ccucucccuugga

SEQ ID NO: 1917298 - RNA, 22 nt, Human
ccucucccuuggauuguccccg

SEQ ID NO: 1917299 - RNA, 21 nt, Human
ccucucccugacccuguauau

SEQ ID NO: 1917300 - RNA, 12 nt, Human
ccucucccugac

SEQ ID NO: 1917301 - RNA, 15 nt, Human
ccucucccugacccu

SEQ ID NO: 1917302 - RNA, 20 nt, Human
ccucugacacacagcucugu

SEQ ID NO: 1917303 - RNA, 19 nt, Human
ccucugacacacagcucug

SEQ ID NO: 1917304 - RNA, 14 nt, Human
ccucugacacacag

SEQ ID NO: 1917305 - RNA, 15 nt, Human
ccucugacacacagc

SEQ ID NO: 1917306 - RNA, 20 nt, Human
ccucugaaugaaccuucugg

SEQ ID NO: 1917307 - RNA, 13 nt, Human
ccucugacacaca

SEQ ID NO: 1917308 - RNA, 18 nt, Human
ccucuccucauguucugc

SEQ ID NO: 1917309 - RNA, 21 nt, Human
ccucugacacacagcucuguc

SEQ ID NO: 1917310 - RNA, 19 nt, Human
ccucugcagcaauaaagca

SEQ ID NO: 1917311 - RNA, 13 nt, Human
ccucugcccacuc

SEQ ID NO: 1917312 - RNA, 16 nt, Human
ccucugcccacucccu

SEQ ID NO: 1917313 - RNA, 18 nt, Human
ccucugcagcaauaaagc

SEQ ID NO: 1917314 - RNA, 14 nt, Human
ccucugcagcaaua

SEQ ID NO: 1917315 - RNA, 23 nt, Human
ccucugcacuccccugcugggug

SEQ ID NO: 1917316 - RNA, 18 nt, Human
ccucugcacuccccugcu

SEQ ID NO: 1917317 - RNA, 16 nt, Human
ccucugcacuccccug

SEQ ID NO: 1917318 - RNA, 17 nt, Human
ccucugcacuccccugc

SEQ ID NO: 1917319 - RNA, 15 nt, Human
ccucugauaccucaa

SEQ ID NO: 1917320 - RNA, 14 nt, Human
ccucugauaccuca

SEQ ID NO: 1917321 - RNA, 19 nt, Human
ccucaguuuuaucauuuuc

SEQ ID NO: 1917322 - RNA, 17 nt, Human
ccuccacucucccccac

SEQ ID NO: 1917323 - RNA, 14 nt, Human
ccuccacucucccc

SEQ ID NO: 1917324 - RNA, 12 nt, Human
ccucauacccac

SEQ ID NO: 1917325 - RNA, 19 nt, Human
ccucaguucuugccacuuu

SEQ ID NO: 1917326 - RNA, 17 nt, Human
ccucaggugagaagcag

SEQ ID NO: 1917327 - RNA, 18 nt, Human
ccucaggugagaagcaga

SEQ ID NO: 1917328 - RNA, 20 nt, Human
ccucaggugagaagcagagg

SEQ ID NO: 1917329 - RNA, 21 nt, Human
ccuccagaacucacuggggcc

SEQ ID NO: 1917330 - RNA, 22 nt, Human
ccuccagaacucacuggggccu

SEQ ID NO: 1917331 - RNA, 22 nt, Human
ccuccacucucccccacccccu

SEQ ID NO: 1917332 - RNA, 19 nt, Human
ccuccacucucccccaccc

SEQ ID NO: 1917333 - RNA, 13 nt, Human
ccuccacucuccu

SEQ ID NO: 1917334 - RNA, 23 nt, Human
ccuccagggcuggacugaggccu

SEQ ID NO: 1917335 - RNA, 15 nt, Human
ccuccaggaaccaca

SEQ ID NO: 1917336 - RNA, 15 nt, Human
ccuccagcucuuucc

SEQ ID NO: 1917337 - RNA, 16 nt, Human
ccuccagcucuuuccu

SEQ ID NO: 1917338 - RNA, 22 nt, Human
ccuccagcucuuuccuccuucc

SEQ ID NO: 1917339 - RNA, 17 nt, Human
ccuccagcucuuuccuc

SEQ ID NO: 1917340 - RNA, 19 nt, Human
ccuccagcucuuuccuccu

SEQ ID NO: 1917341 - RNA, 13 nt, Human
ccuccauccugag

SEQ ID NO: 1917342 - RNA, 12 nt, Human
ccuccauccuga

SEQ ID NO: 1917343 - RNA, 17 nt, Human
ccucccaaagugcuggg

SEQ ID NO: 1917344 - RNA, 14 nt, Human
ccucccaacucacc

SEQ ID NO: 1917345 - RNA, 15 nt, Human
ccuccaugugggcua

SEQ ID NO: 1917346 - RNA, 12 nt, Human
ccuccauguggg

SEQ ID NO: 1917347 - RNA, 17 nt, Human
ccuccaggugcacaagc

SEQ ID NO: 1917348 - RNA, 17 nt, Human
ccuccagggugugugcu

SEQ ID NO: 1917349 - RNA, 11 nt, Human
ccuccaggugc

SEQ ID NO: 1917350 - RNA, 12 nt, Human
ccuccaggugca

SEQ ID NO: 1917351 - RNA, 13 nt, Human
ccuccauccuagu

SEQ ID NO: 1917352 - RNA, 18 nt, Human
ccucccgaauagcuggga

SEQ ID NO: 1917353 - RNA, 23 nt, Human
ccucccaaagugcugggauuaca

SEQ ID NO: 1917354 - RNA, 15 nt, Human
ccucccaacucaccc

SEQ ID NO: 1917355 - RNA, 15 nt, Human
ccucccccccaugca

SEQ ID NO: 1917356 - RNA, 16 nt, Human
ccucccccccaugcac

SEQ ID NO: 1917357 - RNA, 17 nt, Human
ccucccccccaugcacu

SEQ ID NO: 1917358 - RNA, 19 nt, Human
ccucccccccaugcacugu

SEQ ID NO: 1917359 - RNA, 16 nt, Human
ccuccccgcccuuuuu

SEQ ID NO: 1917360 - RNA, 20 nt, Human
ccucccgaauagcugggacu

SEQ ID NO: 1917361 - RNA, 19 nt, Human
ccucccgaauagcugggac

SEQ ID NO: 1917362 - RNA, 21 nt, Human
ccucccgaauagcugggacua

SEQ ID NO: 1917363 - RNA, 18 nt, Human
ccucccgaguagcuggga

SEQ ID NO: 1917364 - RNA, 17 nt, Human
ccucccgaguagcuggg

SEQ ID NO: 1917365 - RNA, 13 nt, Human
ccucccucuaauu

SEQ ID NO: 1917366 - RNA, 13 nt, Human
ccucccucuuucc

SEQ ID NO: 1917367 - RNA, 11 nt, Human
ccuccucagau

SEQ ID NO: 1917368 - RNA, 12 nt, Human
ccuccuccagcc

SEQ ID NO: 1917369 - RNA, 16 nt, Human
ccuccuccacucuccc

SEQ ID NO: 1917370 - RNA, 15 nt, Human
ccucaccacccacuu

SEQ ID NO: 1917371 - RNA, 16 nt, Human
ccucagaucuucugug

SEQ ID NO: 1917372 - RNA, 14 nt, Human
ccucagagugcaag

SEQ ID NO: 1917373 - RNA, 21 nt, Human
ccucagagugcaagccccugc

SEQ ID NO: 1917374 - RNA, 13 nt, Human
ccucagcccugac

SEQ ID NO: 1917375 - RNA, 15 nt, Human
ccucagcccugaccc

SEQ ID NO: 1917376 - RNA, 16 nt, Human
ccucagggucccuggu

SEQ ID NO: 1917377 - RNA, 17 nt, Human
ccucagggucccuggug

SEQ ID NO: 1917378 - RNA, 20 nt, Human
ccucagggucccugguggca

SEQ ID NO: 1917379 - RNA, 22 nt, Human
ccucagggucccugguggcagc

SEQ ID NO: 1917380 - RNA, 16 nt, Human
ccucagcccugacccu

SEQ ID NO: 1917381 - RNA, 17 nt, Human
ccucagcccugacccug

SEQ ID NO: 1917382 - RNA, 21 nt, Human
ccucagcccugacccugugga

SEQ ID NO: 1917383 - RNA, 18 nt, Human
ccucagcccugacccugu

SEQ ID NO: 1917384 - RNA, 15 nt, Human
ccuaggugacagagu

SEQ ID NO: 1917385 - RNA, 24 nt, Human
ccucacaguccuuaccagcagagc

SEQ ID NO: 1917386 - RNA, 23 nt, Human
ccucacaguccuuaccagcagag

SEQ ID NO: 1917387 - RNA, 15 nt, Human
ccuauucuuucgaaa

SEQ ID NO: 1917388 - RNA, 11 nt, Human
ccucacacagc

SEQ ID NO: 1917389 - RNA, 14 nt, Human
ccucacacucaccc

SEQ ID NO: 1917390 - RNA, 16 nt, Human
ccuauuagagaagaga

SEQ ID NO: 1917391 - RNA, 22 nt, Human
ccuaucuguuuacaguguuccg

SEQ ID NO: 1917392 - RNA, 17 nt, Human
ccuauuagagaagagau

SEQ ID NO: 1917393 - RNA, 22 nt, Human
ccucaggugagaagcagaggaa

SEQ ID NO: 1917394 - RNA, 16 nt, Human
ccggggcagggcagcc

SEQ ID NO: 1917395 - RNA, 14 nt, Human
ccggggcagggcag

SEQ ID NO: 1917396 - RNA, 17 nt, Human
ccgggaagggggcuggg

SEQ ID NO: 1917397 - RNA, 14 nt, Human
ccggagaggaccgg

SEQ ID NO: 1917398 - RNA, 22 nt, Human
cccuuguggucccaccccacac

SEQ ID NO: 1917399 - RNA, 21 nt, Human
cccuuuauugaaaaaauaaaa

SEQ ID NO: 1917400 - RNA, 22 nt, Human
cccuugguuaggcauuguggga

SEQ ID NO: 1917401 - RNA, 23 nt, Human
cccuugguuaggcauugugggaa

SEQ ID NO: 1917402 - RNA, 11 nt, Human
cccuucuuuuu

SEQ ID NO: 1917403 - RNA, 17 nt, Human
cccuuggauuguccccg

SEQ ID NO: 1917404 - RNA, 13 nt, Human
cccuucccaccuc

SEQ ID NO: 1917405 - RNA, 12 nt, Human
cccuucccaccu

SEQ ID NO: 1917406 - RNA, 14 nt, Human
cccugguucucauc

SEQ ID NO: 1917407 - RNA, 23 nt, Human
cccuggugggccaacaaagaaca

SEQ ID NO: 1917408 - RNA, 16 nt, Human
cccuggugguugcugu

SEQ ID NO: 1917409 - RNA, 13 nt, Human
cccuggugguuca

SEQ ID NO: 1917410 - RNA, 13 nt, Human
ccuaaacauauga

SEQ ID NO: 1917411 - RNA, 16 nt, Human
ccuaaaccaaaaacug

SEQ ID NO: 1917412 - RNA, 16 nt, Human
ccuaaaauucagugga

SEQ ID NO: 1917413 - RNA, 22 nt, Human
ccuacaguugaaaaacagcuga

SEQ ID NO: 1917414 - RNA, 17 nt, Human
ccuacagcuuugauccc

SEQ ID NO: 1917415 - RNA, 20 nt, Human
ccuacagcuuugaucccuga

SEQ ID NO: 1917416 - RNA, 21 nt, Human
ccuacagcuuugaucccugac

SEQ ID NO: 1917417 - RNA, 19 nt, Human
ccuacagcuugaccgugag

SEQ ID NO: 1917418 - RNA, 15 nt, Human
ccuacagcccaccug

SEQ ID NO: 1917419 - RNA, 19 nt, Human
ccuaacauaccuaagcaaa

SEQ ID NO: 1917420 - RNA, 13 nt, Human
ccuacccacccuc

SEQ ID NO: 1917421 - RNA, 18 nt, Human
ccuacccacccuccuuuc

SEQ ID NO: 1917422 - RNA, 14 nt, Human
ccuacccauccccg

SEQ ID NO: 1917423 - RNA, 19 nt, Human
ccuacccauccccgcagug

SEQ ID NO: 1917424 - RNA, 19 nt, Human
ccuacuguaauuugugaua

SEQ ID NO: 1917425 - RNA, 21 nt, Human
ccuagaaauuccccacccuga

SEQ ID NO: 1917426 - RNA, 13 nt, Human
ccuaggugacaga

SEQ ID NO: 1917427 - RNA, 22 nt, Human
ccuagguauaauucacauugua

SEQ ID NO: 1917428 - RNA, 12 nt, Human
ccguuauuaaaa

SEQ ID NO: 1917429 - RNA, 21 nt, Human
cuagacuaaaagauugagaag

SEQ ID NO: 1917430 - RNA, 14 nt, Human
cuagagcuuucuuu

SEQ ID NO: 1917431 - RNA, 22 nt, Human
cuagagcuuucuuucacaaaaa

SEQ ID NO: 1917432 - RNA, 20 nt, Human
cuagacgagcaggcuucuuc

SEQ ID NO: 1917433 - RNA, 21 nt, Human
cuagacgagcaggcuucuucc

SEQ ID NO: 1917434 - RNA, 17 nt, Human
cuagagugaacuugggc

SEQ ID NO: 1917435 - RNA, 21 nt, Human
cuagagugaacuugggccacu

SEQ ID NO: 1917436 - RNA, 17 nt, Human
cuagaguagaguggagg

SEQ ID NO: 1917437 - RNA, 15 nt, Human
cuagagguucaaaga

SEQ ID NO: 1917438 - RNA, 15 nt, Human
cuagagggaggggcc

SEQ ID NO: 1917439 - RNA, 16 nt, Human
cuagagggaggggccu

SEQ ID NO: 1917440 - RNA, 19 nt, Human
cuagagggaggggccuagg

SEQ ID NO: 1917441 - RNA, 21 nt, Human
cuagagggaggggccuaggcc

SEQ ID NO: 1917442 - RNA, 22 nt, Human
cuagagggaggggccuaggccu

SEQ ID NO: 1917443 - RNA, 18 nt, Human
cuagagggaccucuccca

SEQ ID NO: 1917444 - RNA, 19 nt, Human
cuagagggaccucucccag

SEQ ID NO: 1917445 - RNA, 20 nt, Human
cuagagggaccucucccagg

SEQ ID NO: 1917446 - RNA, 21 nt, Human
cuagagggaccucucccaggg

SEQ ID NO: 1917447 - RNA, 17 nt, Human
cuagcacuuugggaggc

SEQ ID NO: 1917448 - RNA, 13 nt, Human
cuagcacaugccc

SEQ ID NO: 1917449 - RNA, 17 nt, Human
cuagaugaaguuuuaca

SEQ ID NO: 1917450 - RNA, 16 nt, Human
cuagauggcagucacu

SEQ ID NO: 1917451 - RNA, 14 nt, Human
cuagauggcuccuc

SEQ ID NO: 1917452 - RNA, 15 nt, Human
cuagauggcuccucu

SEQ ID NO: 1917453 - RNA, 16 nt, Human
cuagauggcuccucuc

SEQ ID NO: 1917454 - RNA, 18 nt, Human
cuagauggcuccucucag

SEQ ID NO: 1917455 - RNA, 13 nt, Human
cuagauggugcug

SEQ ID NO: 1917456 - RNA, 19 nt, Human
cuagauggugcugagaagc

SEQ ID NO: 1917457 - RNA, 22 nt, Human
cuagauggugcugagaagcuuu

SEQ ID NO: 1917458 - RNA, 14 nt, Human
cuagauggugcuga

SEQ ID NO: 1917459 - RNA, 15 nt, Human
cuagauggugcugag

SEQ ID NO: 1917460 - RNA, 16 nt, Human
cuagauggugcugaga

SEQ ID NO: 1917461 - RNA, 17 nt, Human
cuagauggugcugagaa

SEQ ID NO: 1917462 - RNA, 21 nt, Human
cuacucugugucagguggggc

SEQ ID NO: 1917463 - RNA, 16 nt, Human
cuacucugugucaggu

SEQ ID NO: 1917464 - RNA, 14 nt, Human
cuacccgggaaggg

SEQ ID NO: 1917465 - RNA, 15 nt, Human
cuacccgggaagggg

SEQ ID NO: 1917466 - RNA, 20 nt, Human
cuacccgggaagggggcugg

SEQ ID NO: 1917467 - RNA, 21 nt, Human
cuacccgggaagggggcuggg

SEQ ID NO: 1917468 - RNA, 21 nt, Human
cuacuguaaggcaaucauggu

SEQ ID NO: 1917469 - RNA, 16 nt, Human
cuacuguaauuuguga

SEQ ID NO: 1917470 - RNA, 17 nt, Human
cuacuguaauuugugau

SEQ ID NO: 1917471 - RNA, 22 nt, Human
cuacuguaauaaagaugauugu

SEQ ID NO: 1917472 - RNA, 14 nt, Human
cuacugaggugcua

SEQ ID NO: 1917473 - RNA, 22 nt, Human
cuacuuauuguagcauccugga

SEQ ID NO: 1917474 - RNA, 15 nt, Human
cuacuguguguguga

SEQ ID NO: 1917475 - RNA, 17 nt, Human
cuacugugugugugaau

SEQ ID NO: 1917476 - RNA, 19 nt, Human
cuacugugugugugaauga

SEQ ID NO: 1917477 - RNA, 20 nt, Human
cuacugugugugugaaugaa

SEQ ID NO: 1917478 - RNA, 21 nt, Human
cuacugugguguuuuguuuau

SEQ ID NO: 1917479 - RNA, 19 nt, Human
cuacuugggaggcugagau

SEQ ID NO: 1917480 - RNA, 12 nt, Human
cuacuugggagg

SEQ ID NO: 1917481 - RNA, 21 nt, Human
cuacuugcucuggaccugccc

SEQ ID NO: 1917482 - RNA, 21 nt, Human
cuacuuuaauaaaugguuauu

SEQ ID NO: 1917483 - RNA, 18 nt, Human
cuacuugggaggcugaga

SEQ ID NO: 1917484 - RNA, 15 nt, Human
cuacuugggaggcug

SEQ ID NO: 1917485 - RNA, 13 nt, Human
cuacuugcucugg

SEQ ID NO: 1917486 - RNA, 14 nt, Human
cuacuugcucugga

SEQ ID NO: 1917487 - RNA, 15 nt, Human
cuacuugcucuggac

SEQ ID NO: 1917488 - RNA, 16 nt, Human
cuacuugcucuggacc

SEQ ID NO: 1917489 - RNA, 17 nt, Human
cuacuugcucuggaccu

SEQ ID NO: 1917490 - RNA, 18 nt, Human
cuacuugcucuggaccug

SEQ ID NO: 1917491 - RNA, 19 nt, Human
cuacuugcucuggaccugc

SEQ ID NO: 1917492 - RNA, 21 nt, Human
cuacuguaauuugugauacaa

SEQ ID NO: 1917493 - RNA, 19 nt, Human
cuacaagcuaaaauuagau

SEQ ID NO: 1917494 - RNA, 17 nt, Human
cuacaagcuaaaauuag

SEQ ID NO: 1917495 - RNA, 19 nt, Human
cuaaugugccuaguucuuu

SEQ ID NO: 1917496 - RNA, 18 nt, Human
cuaaugucuguaucacuc

SEQ ID NO: 1917497 - RNA, 16 nt, Human
cuaauguacugcauau

SEQ ID NO: 1917498 - RNA, 14 nt, Human
cuaauguacugcau

SEQ ID NO: 1917499 - RNA, 13 nt, Human
cuaaugauggccc

SEQ ID NO: 1917500 - RNA, 22 nt, Human
cuaaugauggcccauucuacuu

SEQ ID NO: 1917501 - RNA, 23 nt, Human
cuaaugauggcccauucuacuug

SEQ ID NO: 1917502 - RNA, 16 nt, Human
cuaaggugugcucuga

SEQ ID NO: 1917503 - RNA, 12 nt, Human
cuaauaaagcug

SEQ ID NO: 1917504 - RNA, 21 nt, Human
cuaauaaaauuuaaaagucuu

SEQ ID NO: 1917505 - RNA, 13 nt, Human
cuaauaaagcugu

SEQ ID NO: 1917506 - RNA, 17 nt, Human
cuaauccaggcagaucc

SEQ ID NO: 1917507 - RNA, 18 nt, Human
cuaauccaggcagaucca

SEQ ID NO: 1917508 - RNA, 19 nt, Human
cuaauccaggcagauccag

SEQ ID NO: 1917509 - RNA, 20 nt, Human
cuaauccaggcagauccagg

SEQ ID NO: 1917510 - RNA, 23 nt, Human
cuaauccaggcagauccaggacu

SEQ ID NO: 1917511 - RNA, 15 nt, Human
cuacagaggccaugg

SEQ ID NO: 1917512 - RNA, 13 nt, Human
cuacagaaaaacc

SEQ ID NO: 1917513 - RNA, 23 nt, Human
cuacagaaaaaccagaggcagcu

SEQ ID NO: 1917514 - RNA, 15 nt, Human
cuacacacugcaugu

SEQ ID NO: 1917515 - RNA, 13 nt, Human
cuacacacugcau

SEQ ID NO: 1917516 - RNA, 16 nt, Human
cuacaauuuaaagcaa

SEQ ID NO: 1917517 - RNA, 13 nt, Human
cuacaaugugaac

SEQ ID NO: 1917518 - RNA, 17 nt, Human
cuacaaugugaacuuua

SEQ ID NO: 1917519 - RNA, 19 nt, Human
cuacaaugugaacuuuauu

SEQ ID NO: 1917520 - RNA, 18 nt, Human
cuacaaugugaacuuuau

SEQ ID NO: 1917521 - RNA, 18 nt, Human
cuacacugugcugagucu

SEQ ID NO: 1917522 - RNA, 17 nt, Human
cuacacuccagugagac

SEQ ID NO: 1917523 - RNA, 21 nt, Human
cuacacacugcauguuuguga

SEQ ID NO: 1917524 - RNA, 16 nt, Human
cuacacuccagugaga

SEQ ID NO: 1917525 - RNA, 19 nt, Human
cuacccagcgagcccuggu

SEQ ID NO: 1917526 - RNA, 20 nt, Human
cuacccagcgagcccuggug

SEQ ID NO: 1917527 - RNA, 12 nt, Human
cuacccaggugc

SEQ ID NO: 1917528 - RNA, 15 nt, Human
cuacccgcagaguuc

SEQ ID NO: 1917529 - RNA, 22 nt, Human
cuacccacccuccuuucaccac

SEQ ID NO: 1917530 - RNA, 17 nt, Human
cuacccacccuccuuuc

SEQ ID NO: 1917531 - RNA, 17 nt, Human
cuacagaggccaugggc

SEQ ID NO: 1917532 - RNA, 17 nt, Human
cuaaccacgcuggaccu

SEQ ID NO: 1917533 - RNA, 16 nt, Human
cuaaccagcagaaaug

SEQ ID NO: 1917534 - RNA, 17 nt, Human
cuaaccagcagaaaugc

SEQ ID NO: 1917535 - RNA, 14 nt, Human
cuaagcaaaaugug

SEQ ID NO: 1917536 - RNA, 23 nt, Human
cuaagcacgggccauaugaauaa

SEQ ID NO: 1917537 - RNA, 20 nt, Human
cuaagcacgggccauaugaa

SEQ ID NO: 1917538 - RNA, 18 nt, Human
cuaagcaaaaugugauau

SEQ ID NO: 1917539 - RNA, 15 nt, Human
cuaagcaaaauguga

SEQ ID NO: 1917540 - RNA, 12 nt, Human
cuaagcagagga

SEQ ID NO: 1917541 - RNA, 13 nt, Human
cuaagcagaggag

SEQ ID NO: 1917542 - RNA, 14 nt, Human
cuaagcagaggagg

SEQ ID NO: 1917543 - RNA, 15 nt, Human
cuaagcagaggaggg

SEQ ID NO: 1917544 - RNA, 16 nt, Human
cuaagcagaggagggg

SEQ ID NO: 1917545 - RNA, 18 nt, Human
cuaagcagaggaggggcc

SEQ ID NO: 1917546 - RNA, 19 nt, Human
cuaagcagaggaggggccg

SEQ ID NO: 1917547 - RNA, 20 nt, Human
cuaagcagaggaggggccgc

SEQ ID NO: 1917548 - RNA, 23 nt, Human
cuaagcagaggaggggccgcugc

SEQ ID NO: 1917549 - RNA, 19 nt, Human
cuaagcuauucaguaauaa

SEQ ID NO: 1917550 - RNA, 21 nt, Human
cuaagcuauucaguaauaacu

SEQ ID NO: 1917551 - RNA, 17 nt, Human
cuaagccugaaggggcg

SEQ ID NO: 1917552 - RNA, 20 nt, Human
cuaagccugaaggggcgucu

SEQ ID NO: 1917553 - RNA, 15 nt, Human
cuaaggugugcucug

SEQ ID NO: 1917554 - RNA, 19 nt, Human
cuaaggucauuaccacagg

SEQ ID NO: 1917555 - RNA, 12 nt, Human
cuaaggggcccg

SEQ ID NO: 1917556 - RNA, 13 nt, Human
cuaaggggcccgg

SEQ ID NO: 1917557 - RNA, 18 nt, Human
cuaaggggcccggccagc

SEQ ID NO: 1917558 - RNA, 22 nt, Human
cuaaggggcccggccagccaug

SEQ ID NO: 1917559 - RNA, 13 nt, Human
cuaggauuucaug

SEQ ID NO: 1917560 - RNA, 14 nt, Human
cuaggauacugcug

SEQ ID NO: 1917561 - RNA, 15 nt, Human
cuaggauacugcugc

SEQ ID NO: 1917562 - RNA, 17 nt, Human
cuaggaggucucuaaga

SEQ ID NO: 1917563 - RNA, 17 nt, Human
cuaggacuucaaauugg

SEQ ID NO: 1917564 - RNA, 22 nt, Human
cuaggacugaauuaugaaacuu

SEQ ID NO: 1917565 - RNA, 23 nt, Human
cuaggaagaucucugcagggccg

SEQ ID NO: 1917566 - RNA, 22 nt, Human
cuaggaccccuccaugugggcu

SEQ ID NO: 1917567 - RNA, 20 nt, Human
cuagcagcaccguucugugc

SEQ ID NO: 1917568 - RNA, 21 nt, Human
cuagcagcaccguucugugca

SEQ ID NO: 1917569 - RNA, 12 nt, Human
cuagcagcaccg

SEQ ID NO: 1917570 - RNA, 19 nt, Human
cuagcagcaccguucugug

SEQ ID NO: 1917571 - RNA, 21 nt, Human
cuaggaagacuuuggaaagag

SEQ ID NO: 1917572 - RNA, 22 nt, Human
cuagcagcaccguucugugcac

SEQ ID NO: 1917573 - RNA, 13 nt, Human
cuaggaacacucc

SEQ ID NO: 1917574 - RNA, 15 nt, Human
cuaggaacacuccuu

SEQ ID NO: 1917575 - RNA, 12 nt, Human
cuagcagcaggg

SEQ ID NO: 1917576 - RNA, 22 nt, Human
cuaguacuugggagaccuguaa

SEQ ID NO: 1917577 - RNA, 20 nt, Human
cuaggccaggugcaaccagg

SEQ ID NO: 1917578 - RNA, 22 nt, Human
cuaggccaggugcaaccaggga

SEQ ID NO: 1917579 - RNA, 11 nt, Human
cuaggccaggu

SEQ ID NO: 1917580 - RNA, 14 nt, Human
cuaggccaggugca

SEQ ID NO: 1917581 - RNA, 16 nt, Human
cuaggcaggaccugug

SEQ ID NO: 1917582 - RNA, 15 nt, Human
cuaggcaggaccugu

SEQ ID NO: 1917583 - RNA, 21 nt, Human
cuaggcauuugcugaauacag

SEQ ID NO: 1917584 - RNA, 23 nt, Human
cuaguaucaaaagaaagaaaauc

SEQ ID NO: 1917585 - RNA, 17 nt, Human
cuaguaucaaaagaaag

SEQ ID NO: 1917586 - RNA, 15 nt, Human
cuaguaucaaaagaa

SEQ ID NO: 1917587 - RNA, 15 nt, Human
cuagugcugaagcuu

SEQ ID NO: 1917588 - RNA, 14 nt, Human
cuagugcugaagcu

SEQ ID NO: 1917589 - RNA, 13 nt, Human
cuagugcugaagc

SEQ ID NO: 1917590 - RNA, 12 nt, Human
cuagugcugaag

SEQ ID NO: 1917591 - RNA, 17 nt, Human
cuagugccuucuaaagg

SEQ ID NO: 1917592 - RNA, 21 nt, Human
cuagugcugaagcuuauuaau

SEQ ID NO: 1917593 - RNA, 20 nt, Human
cuagugcugaagcuuauuaa

SEQ ID NO: 1917594 - RNA, 17 nt, Human
cuagugcugaagcuuau

SEQ ID NO: 1917595 - RNA, 16 nt, Human
cuagugcugaagcuua

SEQ ID NO: 1917596 - RNA, 22 nt, Human
cuagugcugaagcuuauuaaug

SEQ ID NO: 1917597 - RNA, 19 nt, Human
cuagugugguguuuccugg

SEQ ID NO: 1917598 - RNA, 21 nt, Human
cuagugugguguuuccuggca

SEQ ID NO: 1917599 - RNA, 22 nt, Human
cuagugugguguuuccuggcac

SEQ ID NO: 1917600 - RNA, 23 nt, Human
cuagugugguguuuccuggcacu

SEQ ID NO: 1917601 - RNA, 23 nt, Human
cuauauuguuuucaguguacaug

SEQ ID NO: 1917602 - RNA, 20 nt, Human
cuauauuuuuuguuaaauga

SEQ ID NO: 1917603 - RNA, 22 nt, Human
cuauauuguuuucaguguacau

SEQ ID NO: 1917604 - RNA, 22 nt, Human
cuauauuuuuuguuaaaugauu

SEQ ID NO: 1917605 - RNA, 20 nt, Human
cuaucaaguauuauaccuuu

SEQ ID NO: 1917606 - RNA, 21 nt, Human
cuaucuguuuacaguguuccg

SEQ ID NO: 1917607 - RNA, 20 nt, Human
cuaucuguuuacaguguucc

SEQ ID NO: 1917608 - RNA, 14 nt, Human
cuaugacacaugca

SEQ ID NO: 1917609 - RNA, 14 nt, Human
cuaguuccaccauc

SEQ ID NO: 1917610 - RNA, 18 nt, Human
cucaagaucaaugaaaug

SEQ ID NO: 1917611 - RNA, 17 nt, Human
cucaagaucaaugaaau

SEQ ID NO: 1917612 - RNA, 17 nt, Human
cucaagauacugcuacu

SEQ ID NO: 1917613 - RNA, 21 nt, Human
cucaagauacugcuacuguaa

SEQ ID NO: 1917614 - RNA, 22 nt, Human
cucaagauacugcuacuguaau

SEQ ID NO: 1917615 - RNA, 16 nt, Human
cucaagaugaaggcaa

SEQ ID NO: 1917616 - RNA, 16 nt, Human
cucaagcgauucuccu

SEQ ID NO: 1917617 - RNA, 17 nt, Human
cucaagcgauucuccug

SEQ ID NO: 1917618 - RNA, 19 nt, Human
cucaacucuccuccagagu

SEQ ID NO: 1917619 - RNA, 18 nt, Human
cucaacuagcagauacag

SEQ ID NO: 1917620 - RNA, 13 nt, Human
cucaaauuucuaa

SEQ ID NO: 1917621 - RNA, 12 nt, Human
cucaaccucuuc

SEQ ID NO: 1917622 - RNA, 13 nt, Human
cucaaccucuucu

SEQ ID NO: 1917623 - RNA, 14 nt, Human
cucaaccucuucug

SEQ ID NO: 1917624 - RNA, 18 nt, Human
cucaaccucuucuggcuc

SEQ ID NO: 1917625 - RNA, 20 nt, Human
cucaaccucuucuggcucaa

SEQ ID NO: 1917626 - RNA, 19 nt, Human
cucaaauggggccagaucc

SEQ ID NO: 1917627 - RNA, 20 nt, Human
cucaaauggggccagaucca

SEQ ID NO: 1917628 - RNA, 21 nt, Human
cucaaauggggccagauccag

SEQ ID NO: 1917629 - RNA, 20 nt, Human
cucaacucuccuccagaguc

SEQ ID NO: 1917630 - RNA, 21 nt, Human
cucaacucuccuccagaguca

SEQ ID NO: 1917631 - RNA, 15 nt, Human
cucaacguauuguuu

SEQ ID NO: 1917632 - RNA, 16 nt, Human
cucaacguauuguuuc

SEQ ID NO: 1917633 - RNA, 21 nt, Human
cucaaccucuucuggcucaaa

SEQ ID NO: 1917634 - RNA, 18 nt, Human
cuauuuuaauaaacacuc

SEQ ID NO: 1917635 - RNA, 22 nt, Human
cuauuuuaauaaacacucuuga

SEQ ID NO: 1917636 - RNA, 12 nt, Human
cuauuuugaagu

SEQ ID NO: 1917637 - RNA, 17 nt, Human
cuauuuuggauuguaua

SEQ ID NO: 1917638 - RNA, 15 nt, Human
cucaaauggggccag

SEQ ID NO: 1917639 - RNA, 16 nt, Human
cucaaauggggccaga

SEQ ID NO: 1917640 - RNA, 17 nt, Human
cucaaauggggccagau

SEQ ID NO: 1917641 - RNA, 14 nt, Human
cuaugcauuugaaa

SEQ ID NO: 1917642 - RNA, 13 nt, Human
cucacauuuauau

SEQ ID NO: 1917643 - RNA, 19 nt, Human
cucaccagccccagugccc

SEQ ID NO: 1917644 - RNA, 20 nt, Human
cucacauagcuuacaagcca

SEQ ID NO: 1917645 - RNA, 21 nt, Human
cucaccagccccagugcccac

SEQ ID NO: 1917646 - RNA, 20 nt, Human
cucaccagccccagugccca

SEQ ID NO: 1917647 - RNA, 16 nt, Human
cucacauuacacacac

SEQ ID NO: 1917648 - RNA, 20 nt, Human
cucaagugauucuccugccu

SEQ ID NO: 1917649 - RNA, 19 nt, Human
cucaagugauucuccugcc

SEQ ID NO: 1917650 - RNA, 18 nt, Human
cucaagugauucuccugc

SEQ ID NO: 1917651 - RNA, 17 nt, Human
cucacuauguugcccag

SEQ ID NO: 1917652 - RNA, 16 nt, Human
cucacuauguugccca

SEQ ID NO: 1917653 - RNA, 17 nt, Human
cucaccccuugccauaa

SEQ ID NO: 1917654 - RNA, 23 nt, Human
cucaccccugguucucaucuuuc

SEQ ID NO: 1917655 - RNA, 21 nt, Human
cucaccccugguucucaucuu

SEQ ID NO: 1917656 - RNA, 20 nt, Human
cucaccccugguucucaucu

SEQ ID NO: 1917657 - RNA, 19 nt, Human
cucaccccugguucucauc

SEQ ID NO: 1917658 - RNA, 14 nt, Human
cucaccccagcccc

SEQ ID NO: 1917659 - RNA, 23 nt, Human
cucaccccagacuccugacuguc

SEQ ID NO: 1917660 - RNA, 12 nt, Human
cucaccccagcc

SEQ ID NO: 1917661 - RNA, 13 nt, Human
cucaccccagccc

SEQ ID NO: 1917662 - RNA, 17 nt, Human
cucaccccugguucuca

SEQ ID NO: 1917663 - RNA, 14 nt, Human
cucaccccugguuc

SEQ ID NO: 1917664 - RNA, 21 nt, Human
cuaugcauuugaaaauuuuga

SEQ ID NO: 1917665 - RNA, 12 nt, Human
cuaugcauuuga

SEQ ID NO: 1917666 - RNA, 11 nt, Human
cuaugcauuug

SEQ ID NO: 1917667 - RNA, 16 nt, Human
cguggacucugcacau

SEQ ID NO: 1917668 - RNA, 13 nt, Human
cguggacucugca

SEQ ID NO: 1917669 - RNA, 20 nt, Human
cguggaacguuuuuccuguu

SEQ ID NO: 1917670 - RNA, 15 nt, Human
cguggaacguuuuuc

SEQ ID NO: 1917671 - RNA, 15 nt, Human
cgugcugacagcugc

SEQ ID NO: 1917672 - RNA, 17 nt, Human
cgugcugacagcugcuc

SEQ ID NO: 1917673 - RNA, 16 nt, Human
cgugcugacagcugcu

SEQ ID NO: 1917674 - RNA, 19 nt, Human
cgugcucgccccagcaggu

SEQ ID NO: 1917675 - RNA, 22 nt, Human
cgugggcugggcccacaaaggc

SEQ ID NO: 1917676 - RNA, 19 nt, Human
cgugcacacaccagagccc

SEQ ID NO: 1917677 - RNA, 18 nt, Human
cgugcacacaccagagcc

SEQ ID NO: 1917678 - RNA, 18 nt, Human
cgugaaaacggagcugaa

SEQ ID NO: 1917679 - RNA, 22 nt, Human
cgugcaguggugcgaucugggu

SEQ ID NO: 1917680 - RNA, 17 nt, Human
cgugcagggacaaagag

SEQ ID NO: 1917681 - RNA, 21 nt, Human
cgugcaguggugcgaucuggg

SEQ ID NO: 1917682 - RNA, 23 nt, Human
cgugcauaccacuuuuguucuug

SEQ ID NO: 1917683 - RNA, 22 nt, Human
cgucugacaggcaaugcuggcu

SEQ ID NO: 1917684 - RNA, 21 nt, Human
cgucugacaggcaaugcuggc

SEQ ID NO: 1917685 - RNA, 20 nt, Human
cgucugacaggcaaugcugg

SEQ ID NO: 1917686 - RNA, 16 nt, Human
cgugcacacaccagag

SEQ ID NO: 1917687 - RNA, 15 nt, Human
cgugaaaacggagcu

SEQ ID NO: 1917688 - RNA, 16 nt, Human
cgugaaaacggagcug

SEQ ID NO: 1917689 - RNA, 17 nt, Human
cgugaaaacggagcuga

SEQ ID NO: 1917690 - RNA, 16 nt, Human
cgucgacguagaaccu

SEQ ID NO: 1917691 - RNA, 16 nt, Human
cgucucauacucaccu

SEQ ID NO: 1917692 - RNA, 16 nt, Human
cgucuaccugaggggc

SEQ ID NO: 1917693 - RNA, 18 nt, Human
cggugcuaucucccccag

SEQ ID NO: 1917694 - RNA, 20 nt, Human
cggugcuaucucccccagcc

SEQ ID NO: 1917695 - RNA, 21 nt, Human
cggugcuaucucccccagccc

SEQ ID NO: 1917696 - RNA, 22 nt, Human
cggugcuaucucccccagcccc

SEQ ID NO: 1917697 - RNA, 21 nt, Human
cuaaauccuuuacuguuaguc

SEQ ID NO: 1917698 - RNA, 17 nt, Human
cuaaauccuuuacuguu

SEQ ID NO: 1917699 - RNA, 18 nt, Human
cuaaauauauuuuaagac

SEQ ID NO: 1917700 - RNA, 20 nt, Human
cuaaauauauuuuaagacga

SEQ ID NO: 1917701 - RNA, 15 nt, Human
cuaaacggauuccaa

SEQ ID NO: 1917702 - RNA, 16 nt, Human
cuaaacggauuccaaa

SEQ ID NO: 1917703 - RNA, 17 nt, Human
cuaaacggauuccaaag

SEQ ID NO: 1917704 - RNA, 16 nt, Human
cuaaaugaauguuuac

SEQ ID NO: 1917705 - RNA, 15 nt, Human
cuaaauggaaccacu

SEQ ID NO: 1917706 - RNA, 15 nt, Human
cuaaaugaauguuua

SEQ ID NO: 1917707 - RNA, 20 nt, Human
cuaaaucuccaaaauaaaac

SEQ ID NO: 1917708 - RNA, 17 nt, Human
cuaaauggaaccacucu

SEQ ID NO: 1917709 - RNA, 16 nt, Human
cuaaauggaaccacuc

SEQ ID NO: 1917710 - RNA, 18 nt, Human
cuaaauggaaccacucua

SEQ ID NO: 1917711 - RNA, 15 nt, Human
cuaacauggaaguac

SEQ ID NO: 1917712 - RNA, 17 nt, Human
cuaacauggaaguacua

SEQ ID NO: 1917713 - RNA, 15 nt, Human
cuaacaugauuuggg

SEQ ID NO: 1917714 - RNA, 15 nt, Human
cuaacaccagacaga

SEQ ID NO: 1917715 - RNA, 23 nt, Human
cuaaauugacacuuaaaaauggu

SEQ ID NO: 1917716 - RNA, 16 nt, Human
cuaaauguugaaagau

SEQ ID NO: 1917717 - RNA, 18 nt, Human
cuaaacauccaauauuuu

SEQ ID NO: 1917718 - RNA, 19 nt, Human
cuaaacaaugcugauuugg

SEQ ID NO: 1917719 - RNA, 15 nt, Human
cuaaacccaauccaa

SEQ ID NO: 1917720 - RNA, 19 nt, Human
cuaaacccaauccaaaugg

SEQ ID NO: 1917721 - RNA, 16 nt, Human
cuaaacccaauccaaa

SEQ ID NO: 1917722 - RNA, 23 nt, Human
cguuuacaagcccccccuuccac

SEQ ID NO: 1917723 - RNA, 19 nt, Human
cuaaaacuacaaaaauuaa

SEQ ID NO: 1917724 - RNA, 13 nt, Human
cgcccccuuggcu

SEQ ID NO: 1917725 - RNA, 15 nt, Human
cgcccccugcccucc

SEQ ID NO: 1917726 - RNA, 19 nt, Human
cgcccccugcccuccccuc

SEQ ID NO: 1917727 - RNA, 12 nt, Human
cgcccagucugg

SEQ ID NO: 1917728 - RNA, 16 nt, Human
cgcccaguccuuccac

SEQ ID NO: 1917729 - RNA, 14 nt, Human
cgcccccugcccuc

SEQ ID NO: 1917730 - RNA, 19 nt, Human
cgccccucccacagcgcug

SEQ ID NO: 1917731 - RNA, 21 nt, Human
cgccccucccacagcgcuggc

SEQ ID NO: 1917732 - RNA, 22 nt, Human
cgcccaggcuuagucacugaga

SEQ ID NO: 1917733 - RNA, 14 nt, Human
cgcccaguccuucc

SEQ ID NO: 1917734 - RNA, 15 nt, Human
cgcccaguccuucca

SEQ ID NO: 1917735 - RNA, 22 nt, Human
cgcccagagacccaagcugccu

SEQ ID NO: 1917736 - RNA, 21 nt, Human
cgcccagauuaugagacacag

SEQ ID NO: 1917737 - RNA, 20 nt, Human
cgcccaggcuggagugcagu

SEQ ID NO: 1917738 - RNA, 16 nt, Human
cgcccuggacugugug

SEQ ID NO: 1917739 - RNA, 19 nt, Human
cgcgccaaauaaugucucu

SEQ ID NO: 1917740 - RNA, 23 nt, Human
cgcgccaaauaaugucucuguga

SEQ ID NO: 1917741 - RNA, 21 nt, Human
cgcgccaaauaaugucucugu

SEQ ID NO: 1917742 - RNA, 23 nt, Human
cgccaggggaaaaucagccugcu

SEQ ID NO: 1917743 - RNA, 15 nt, Human
cgccagcugaugacu

SEQ ID NO: 1917744 - RNA, 16 nt, Human
cgccagcugaugacuc

SEQ ID NO: 1917745 - RNA, 17 nt, Human
cgccagcugaugacuca

SEQ ID NO: 1917746 - RNA, 18 nt, Human
cgccagcugaugacucaa

SEQ ID NO: 1917747 - RNA, 20 nt, Human
cgccagcugaugacucaaga

SEQ ID NO: 1917748 - RNA, 14 nt, Human
cgccaucccagccc

SEQ ID NO: 1917749 - RNA, 16 nt, Human
cgccaucccagcccca

SEQ ID NO: 1917750 - RNA, 22 nt, Human
cgccagauucuuuccugaggcu

SEQ ID NO: 1917751 - RNA, 19 nt, Human
ccucugccccauccuccag

SEQ ID NO: 1917752 - RNA, 22 nt, Human
ccucugccccauccuccagcag

SEQ ID NO: 1917753 - RNA, 13 nt, Human
cgccagcugauga

SEQ ID NO: 1917754 - RNA, 17 nt, Human
ccucugcccacucccug

SEQ ID NO: 1917755 - RNA, 19 nt, Human
ccucugcccacucccugca

SEQ ID NO: 1917756 - RNA, 20 nt, Human
ccucugcccacucccugcaa

SEQ ID NO: 1917757 - RNA, 22 nt, Human
cgcggcucccggggcagggcag

SEQ ID NO: 1917758 - RNA, 19 nt, Human
cgcggcucccggggcaggg

SEQ ID NO: 1917759 - RNA, 23 nt, Human
cgcggcggagcuggccccgccgc

SEQ ID NO: 1917760 - RNA, 22 nt, Human
cgcuaagagggagggagggcuc

SEQ ID NO: 1917761 - RNA, 15 nt, Human
cgcggcggagcuggc

SEQ ID NO: 1917762 - RNA, 17 nt, Human
cgcggcggagcuggccc

SEQ ID NO: 1917763 - RNA, 18 nt, Human
cgcggcggagcuggcccc

SEQ ID NO: 1917764 - RNA, 21 nt, Human
cgcggcggagcuggccccgcc

SEQ ID NO: 1917765 - RNA, 22 nt, Human
cgcggcggagcuggccccgccg

SEQ ID NO: 1917766 - RNA, 16 nt, Human
cgcuacccgggaaggg

SEQ ID NO: 1917767 - RNA, 15 nt, Human
cgcucucuggccuuc

SEQ ID NO: 1917768 - RNA, 14 nt, Human
cgcucucuggccuu

SEQ ID NO: 1917769 - RNA, 20 nt, Human
cggaaaacaugcuacacacu

SEQ ID NO: 1917770 - RNA, 15 nt, Human
cggaaaacaugcuac

SEQ ID NO: 1917771 - RNA, 18 nt, Human
cgcugugcugcccugccc

SEQ ID NO: 1917772 - RNA, 13 nt, Human
cgcuugagaaaaa

SEQ ID NO: 1917773 - RNA, 15 nt, Human
cgcugugcugcccug

SEQ ID NO: 1917774 - RNA, 23 nt, Human
cgcugucccuaguaaaaauacaa

SEQ ID NO: 1917775 - RNA, 16 nt, Human
cgcugugcugcccugc

SEQ ID NO: 1917776 - RNA, 17 nt, Human
cgcugugcugcccugcc

SEQ ID NO: 1917777 - RNA, 22 nt, Human
cgcugucagccauuccuguucc

SEQ ID NO: 1917778 - RNA, 18 nt, Human
cgcucucuggccuucggc

SEQ ID NO: 1917779 - RNA, 15 nt, Human
cgguagcugugcgug

SEQ ID NO: 1917780 - RNA, 22 nt, Human
cgguagccagcacacagggcag

SEQ ID NO: 1917781 - RNA, 15 nt, Human
cgguagccagcacac

SEQ ID NO: 1917782 - RNA, 21 nt, Human
cgguagccagcacacagggca

SEQ ID NO: 1917783 - RNA, 20 nt, Human
cgguccacccaggagccccg

SEQ ID NO: 1917784 - RNA, 16 nt, Human
cgguccacccaggagc

SEQ ID NO: 1917785 - RNA, 15 nt, Human
cgguccacccaggag

SEQ ID NO: 1917786 - RNA, 14 nt, Human
cgguccacccagga

SEQ ID NO: 1917787 - RNA, 15 nt, Human
cgggucaucuguacc

SEQ ID NO: 1917788 - RNA, 20 nt, Human
cgggugaacaaagcagccac

SEQ ID NO: 1917789 - RNA, 22 nt, Human
cgggucaucuguaccucugccu

SEQ ID NO: 1917790 - RNA, 22 nt, Human
cgggugugcaaugucugaguga

SEQ ID NO: 1917791 - RNA, 21 nt, Human
cgggugaacaaagcagccacg

SEQ ID NO: 1917792 - RNA, 17 nt, Human
cggugagcuacaaaugc

SEQ ID NO: 1917793 - RNA, 21 nt, Human
cggugagaggggaacagacug

SEQ ID NO: 1917794 - RNA, 20 nt, Human
cggugagaggggaacagacu

SEQ ID NO: 1917795 - RNA, 22 nt, Human
cgggcacucagaagacacugau

SEQ ID NO: 1917796 - RNA, 14 nt, Human
cgggcacucagaag

SEQ ID NO: 1917797 - RNA, 22 nt, Human
cggggacagcuccuucuguccu

SEQ ID NO: 1917798 - RNA, 18 nt, Human
cgggaggucgaggcagga

SEQ ID NO: 1917799 - RNA, 20 nt, Human
cgggaggucgaggcaggagg

SEQ ID NO: 1917800 - RNA, 23 nt, Human
cggcuggccuggccccucagggu

SEQ ID NO: 1917801 - RNA, 22 nt, Human
cggcuggccuggccccucaggg

SEQ ID NO: 1917802 - RNA, 19 nt, Human
cggcuggccuggccccuca

SEQ ID NO: 1917803 - RNA, 19 nt, Human
cgggagccucccugccuca

SEQ ID NO: 1917804 - RNA, 22 nt, Human
cgggagccucccugccucaggc

SEQ ID NO: 1917805 - RNA, 15 nt, Human
cgggagccucccugc

SEQ ID NO: 1917806 - RNA, 17 nt, Human
cgggagccucccugccu

SEQ ID NO: 1917807 - RNA, 15 nt, Human
cgggggcagagaggg

SEQ ID NO: 1917808 - RNA, 16 nt, Human
cgggguggauuggauu

SEQ ID NO: 1917809 - RNA, 16 nt, Human
cggggugcccacaggc

SEQ ID NO: 1917810 - RNA, 15 nt, Human
cgggguauccugggg

SEQ ID NO: 1917811 - RNA, 21 nt, Human
cgggguauccugggggaccca

SEQ ID NO: 1917812 - RNA, 23 nt, Human
cggggacagcuccuucuguccua

SEQ ID NO: 1917813 - RNA, 23 nt, Human
cggggcucuucucauuucacccc

SEQ ID NO: 1917814 - RNA, 17 nt, Human
cggggcucuucucauuu

SEQ ID NO: 1917815 - RNA, 16 nt, Human
cggggcucuucucauu

SEQ ID NO: 1917816 - RNA, 14 nt, Human
cggccuccauccug

SEQ ID NO: 1917817 - RNA, 12 nt, Human
cggccuccaucc

SEQ ID NO: 1917818 - RNA, 23 nt, Human
cggccggccagccccuggcccca

SEQ ID NO: 1917819 - RNA, 14 nt, Human
cggccggccagccc

SEQ ID NO: 1917820 - RNA, 16 nt, Human
cggccggccagccccu

SEQ ID NO: 1917821 - RNA, 15 nt, Human
cggcuggacuuggag

SEQ ID NO: 1917822 - RNA, 24 nt, Human
cggccaggccagagggagugacag

SEQ ID NO: 1917823 - RNA, 15 nt, Human
cggccagccaugucu

SEQ ID NO: 1917824 - RNA, 17 nt, Human
cggccagggagaagcuc

SEQ ID NO: 1917825 - RNA, 16 nt, Human
cggccagggagaagcu

SEQ ID NO: 1917826 - RNA, 19 nt, Human
cggccccugcugguucagg

SEQ ID NO: 1917827 - RNA, 18 nt, Human
cggccccugcugguucag

SEQ ID NO: 1917828 - RNA, 13 nt, Human
cggccccugcugg

SEQ ID NO: 1917829 - RNA, 11 nt, Human
cggccaccugc

SEQ ID NO: 1917830 - RNA, 15 nt, Human
cggccaccugcggug

SEQ ID NO: 1917831 - RNA, 16 nt, Human
cggccaccugcggugc

SEQ ID NO: 1917832 - RNA, 17 nt, Human
cggccaccugcggugcu

SEQ ID NO: 1917833 - RNA, 14 nt, Human
cggaauaguuggcu

SEQ ID NO: 1917834 - RNA, 13 nt, Human
cggaagagccuug

SEQ ID NO: 1917835 - RNA, 14 nt, Human
cucuccagccugac

SEQ ID NO: 1917836 - RNA, 19 nt, Human
cucuccagccccuggaugc

SEQ ID NO: 1917837 - RNA, 24 nt, Human
cucuccccagcaagugagagcugg

SEQ ID NO: 1917838 - RNA, 12 nt, Human
cucuccucugcu

SEQ ID NO: 1917839 - RNA, 22 nt, Human
cucuccccagcaagugagagcu

SEQ ID NO: 1917840 - RNA, 14 nt, Human
cucuccccagcaag

SEQ ID NO: 1917841 - RNA, 13 nt, Human
cucuccucugcug

SEQ ID NO: 1917842 - RNA, 14 nt, Human
cucuccucugcugc

SEQ ID NO: 1917843 - RNA, 15 nt, Human
cucuccucugcugcu

SEQ ID NO: 1917844 - RNA, 18 nt, Human
cucuccucugcugcuggc

SEQ ID NO: 1917845 - RNA, 13 nt, Human
cucucucaggcca

SEQ ID NO: 1917846 - RNA, 12 nt, Human
cucucuccagau

SEQ ID NO: 1917847 - RNA, 14 nt, Human
cucucuccagaugu

SEQ ID NO: 1917848 - RNA, 17 nt, Human
cucucuccagauguuuc

SEQ ID NO: 1917849 - RNA, 12 nt, Human
cucucucacucc

SEQ ID NO: 1917850 - RNA, 23 nt, Human
cucucuacuaaaacuacaaaaau

SEQ ID NO: 1917851 - RNA, 22 nt, Human
cucucuacuaaaacuacaaaaa

SEQ ID NO: 1917852 - RNA, 14 nt, Human
cucuccuuccugug

SEQ ID NO: 1917853 - RNA, 16 nt, Human
cucuccuuccuggagc

SEQ ID NO: 1917854 - RNA, 21 nt, Human
cucuaguuugauuaaauucuu

SEQ ID NO: 1917855 - RNA, 20 nt, Human
cucuaguuugauuaaauucu

SEQ ID NO: 1917856 - RNA, 19 nt, Human
cucuaguuugauuaaauuc

SEQ ID NO: 1917857 - RNA, 15 nt, Human
cucuaguuugauuaa

SEQ ID NO: 1917858 - RNA, 14 nt, Human
cucuagugccuucu

SEQ ID NO: 1917859 - RNA, 16 nt, Human
cucuagugccuucuaa

SEQ ID NO: 1917860 - RNA, 12 nt, Human
cucucaggccaa

SEQ ID NO: 1917861 - RNA, 20 nt, Human
cucucaggccaaacucaccu

SEQ ID NO: 1917862 - RNA, 21 nt, Human
cucucaggccaaacucaccug

SEQ ID NO: 1917863 - RNA, 22 nt, Human
cucucaggccaaacucaccugc

SEQ ID NO: 1917864 - RNA, 23 nt, Human
cucucaggccaaacucaccugcc

SEQ ID NO: 1917865 - RNA, 13 nt, Human
cucucaggccagc

SEQ ID NO: 1917866 - RNA, 15 nt, Human
cucucaggccagcug

SEQ ID NO: 1917867 - RNA, 17 nt, Human
cucucaggccagcugcu

SEQ ID NO: 1917868 - RNA, 18 nt, Human
cucucaggccagcugcuu

SEQ ID NO: 1917869 - RNA, 19 nt, Human
cucucaggccagcugcuug

SEQ ID NO: 1917870 - RNA, 21 nt, Human
cucucaggccagcugcuuggg

SEQ ID NO: 1917871 - RNA, 20 nt, Human
cucucauguuuucaacugcc

SEQ ID NO: 1917872 - RNA, 15 nt, Human
cucuccaaaaaugca

SEQ ID NO: 1917873 - RNA, 14 nt, Human
cucuccagccccug

SEQ ID NO: 1917874 - RNA, 15 nt, Human
cucuccagccccugg

SEQ ID NO: 1917875 - RNA, 16 nt, Human
cucuccagccccugga

SEQ ID NO: 1917876 - RNA, 17 nt, Human
cucuccagccccuggau

SEQ ID NO: 1917877 - RNA, 18 nt, Human
cucuccagccccuggaug

SEQ ID NO: 1917878 - RNA, 16 nt, Human
cucuacccauauuaca

SEQ ID NO: 1917879 - RNA, 19 nt, Human
cucuacccauauuacagau

SEQ ID NO: 1917880 - RNA, 13 nt, Human
cucuacccuggca

SEQ ID NO: 1917881 - RNA, 20 nt, Human
cucuaccauccccuguagag

SEQ ID NO: 1917882 - RNA, 21 nt, Human
cucuacugggagccuacccac

SEQ ID NO: 1917883 - RNA, 18 nt, Human
cucuacugggagccuacc

SEQ ID NO: 1917884 - RNA, 12 nt, Human
cucuacucugcu

SEQ ID NO: 1917885 - RNA, 13 nt, Human
cucuacucugcuu

SEQ ID NO: 1917886 - RNA, 14 nt, Human
cucuacucugcuuu

SEQ ID NO: 1917887 - RNA, 16 nt, Human
cucuacucuuacuucc

SEQ ID NO: 1917888 - RNA, 22 nt, Human
cucuacuaaaaauacaaaaauu

SEQ ID NO: 1917889 - RNA, 23 nt, Human
cucuagggaaaaaccagcgugug

SEQ ID NO: 1917890 - RNA, 20 nt, Human
cucuagcugggggugggcca

SEQ ID NO: 1917891 - RNA, 23 nt, Human
cucuagcugggggugggccaggc

SEQ ID NO: 1917892 - RNA, 19 nt, Human
cucuagccaaaugguuuaa

SEQ ID NO: 1917893 - RNA, 20 nt, Human
cuccugugugugcgccuaca

SEQ ID NO: 1917894 - RNA, 16 nt, Human
cuccuucacagauggg

SEQ ID NO: 1917895 - RNA, 17 nt, Human
cuccuucacagaugggu

SEQ ID NO: 1917896 - RNA, 13 nt, Human
cuccuucaccuuu

SEQ ID NO: 1917897 - RNA, 19 nt, Human
cuccuucacagaugggugc

SEQ ID NO: 1917898 - RNA, 17 nt, Human
cucggagggauuccccu

SEQ ID NO: 1917899 - RNA, 13 nt, Human
cucggaggaagcc

SEQ ID NO: 1917900 - RNA, 17 nt, Human
cucggaggaagccccca

SEQ ID NO: 1917901 - RNA, 16 nt, Human
cucuacagaggccaug

SEQ ID NO: 1917902 - RNA, 14 nt, Human
cucuacagaggcca

SEQ ID NO: 1917903 - RNA, 19 nt, Human
cucuacagaggccaugggc

SEQ ID NO: 1917904 - RNA, 13 nt, Human
cucuacagaggcc

SEQ ID NO: 1917905 - RNA, 13 nt, Human
cucuacaaaaagc

SEQ ID NO: 1917906 - RNA, 19 nt, Human
cuccuccuuggugccuggc

SEQ ID NO: 1917907 - RNA, 22 nt, Human
cuccucuccccagcaagugaga

SEQ ID NO: 1917908 - RNA, 15 nt, Human
cuccucuccccagcc

SEQ ID NO: 1917909 - RNA, 22 nt, Human
cuccuccagccgccaugcuccu

SEQ ID NO: 1917910 - RNA, 14 nt, Human
cuccucaucucuaa

SEQ ID NO: 1917911 - RNA, 13 nt, Human
cuccuccagggug

SEQ ID NO: 1917912 - RNA, 16 nt, Human
cuccuccacucucccc

SEQ ID NO: 1917913 - RNA, 19 nt, Human
cucccuuuuaauccuggcu

SEQ ID NO: 1917914 - RNA, 20 nt, Human
cucccuuuuaauccuggcug

SEQ ID NO: 1917915 - RNA, 15 nt, Human
cuccgaccagacacc

SEQ ID NO: 1917916 - RNA, 14 nt, Human
cuccugccucagcc

SEQ ID NO: 1917917 - RNA, 13 nt, Human
cuccugccucagc

SEQ ID NO: 1917918 - RNA, 11 nt, Human
cuccugcccuu

SEQ ID NO: 1917919 - RNA, 18 nt, Human
cuccugcaggcagccagg

SEQ ID NO: 1917920 - RNA, 20 nt, Human
cuccugcaggcagccaggcc

SEQ ID NO: 1917921 - RNA, 11 nt, Human
cuccugcaggc

SEQ ID NO: 1917922 - RNA, 16 nt, Human
cuccugcaggcagcca

SEQ ID NO: 1917923 - RNA, 17 nt, Human
cuccugcaggcagccag

SEQ ID NO: 1917924 - RNA, 17 nt, Human
cuccucuccccagccca

SEQ ID NO: 1917925 - RNA, 18 nt, Human
cuccucuccccagcccag

SEQ ID NO: 1917926 - RNA, 19 nt, Human
cuccucuccccagcccaga

SEQ ID NO: 1917927 - RNA, 20 nt, Human
cuccucuccccagcccagag

SEQ ID NO: 1917928 - RNA, 21 nt, Human
cuccucuccccagcccagaga

SEQ ID NO: 1917929 - RNA, 22 nt, Human
cuccucuccccagcccagagac

SEQ ID NO: 1917930 - RNA, 23 nt, Human
cuccucuccccagcccagagaca

SEQ ID NO: 1917931 - RNA, 19 nt, Human
cuccugugugugcgccuac

SEQ ID NO: 1917932 - RNA, 16 nt, Human
cuccugugugugcgcc

SEQ ID NO: 1917933 - RNA, 15 nt, Human
cuccugccucagccu

SEQ ID NO: 1917934 - RNA, 14 nt, Human
cuccugccgcagag

SEQ ID NO: 1917935 - RNA, 17 nt, Human
cucccaggugcagccag

SEQ ID NO: 1917936 - RNA, 18 nt, Human
cucccaggugcagccaga

SEQ ID NO: 1917937 - RNA, 11 nt, Human
cucccaucugu

SEQ ID NO: 1917938 - RNA, 14 nt, Human
cucccaucugugaa

SEQ ID NO: 1917939 - RNA, 15 nt, Human
cucccaucugugaaa

SEQ ID NO: 1917940 - RNA, 18 nt, Human
cucccaucugugaaagga

SEQ ID NO: 1917941 - RNA, 23 nt, Human
cucccaucugugaaaggaaagag

SEQ ID NO: 1917942 - RNA, 18 nt, Human
cucccaaagugcugggau

SEQ ID NO: 1917943 - RNA, 22 nt, Human
cucccaaagugcugggauuaca

SEQ ID NO: 1917944 - RNA, 17 nt, Human
cucccaacucaccccag

SEQ ID NO: 1917945 - RNA, 16 nt, Human
cucccaacucacccca

SEQ ID NO: 1917946 - RNA, 22 nt, Human
cucccaacucaccccagcccca

SEQ ID NO: 1917947 - RNA, 18 nt, Human
cucacuauguugcccagg

SEQ ID NO: 1917948 - RNA, 18 nt, Human
cuccauccugaggcucca

SEQ ID NO: 1917949 - RNA, 16 nt, Human
cuccauccugaggcuc

SEQ ID NO: 1917950 - RNA, 11 nt, Human
cuccauccuga

SEQ ID NO: 1917951 - RNA, 13 nt, Human
cuccaugugggcu

SEQ ID NO: 1917952 - RNA, 17 nt, Human
cucccaaagugcuggga

SEQ ID NO: 1917953 - RNA, 16 nt, Human
cuccccaaagggugug

SEQ ID NO: 1917954 - RNA, 12 nt, Human
cuccccagcaag

SEQ ID NO: 1917955 - RNA, 12 nt, Human
cuccccugcugg

SEQ ID NO: 1917956 - RNA, 21 nt, Human
cuccccagcaagugagagcug

SEQ ID NO: 1917957 - RNA, 20 nt, Human
cuccccagcaagugagagcu

SEQ ID NO: 1917958 - RNA, 18 nt, Human
cucccgaguagcugggac

SEQ ID NO: 1917959 - RNA, 19 nt, Human
cucccgaauagcugggacu

SEQ ID NO: 1917960 - RNA, 17 nt, Human
cucccgaguagcuggga

SEQ ID NO: 1917961 - RNA, 16 nt, Human
cucccgaguagcuggg

SEQ ID NO: 1917962 - RNA, 18 nt, Human
cucccgaauagcugggac

SEQ ID NO: 1917963 - RNA, 15 nt, Human
cucccgaguagcugg

SEQ ID NO: 1917964 - RNA, 16 nt, Human
cucccgaauagcuggg

SEQ ID NO: 1917965 - RNA, 17 nt, Human
cucccgaauagcuggga

SEQ ID NO: 1917966 - RNA, 13 nt, Human
cuccccugcuggg

SEQ ID NO: 1917967 - RNA, 14 nt, Human
cuccccugcugggu

SEQ ID NO: 1917968 - RNA, 22 nt, Human
cugacuuggggagauggaguuc

SEQ ID NO: 1917969 - RNA, 21 nt, Human
cugacuuggggagauggaguu

SEQ ID NO: 1917970 - RNA, 20 nt, Human
cugacuuggggagauggagu

SEQ ID NO: 1917971 - RNA, 11 nt, Human
cugagaaauuu

SEQ ID NO: 1917972 - RNA, 14 nt, Human
cugagaaauuuaua

SEQ ID NO: 1917973 - RNA, 14 nt, Human
cugagacagcccgg

SEQ ID NO: 1917974 - RNA, 15 nt, Human
cugagacagcccggg

SEQ ID NO: 1917975 - RNA, 19 nt, Human
cugagaauguaagaacuac

SEQ ID NO: 1917976 - RNA, 17 nt, Human
cugagaauguaagaacu

SEQ ID NO: 1917977 - RNA, 23 nt, Human
cugagaagguuugguccagccug

SEQ ID NO: 1917978 - RNA, 20 nt, Human
cugagaauauaauacuguau

SEQ ID NO: 1917979 - RNA, 23 nt, Human
cugagaauauaauacuguauuug

SEQ ID NO: 1917980 - RNA, 16 nt, Human
cugacuguuuucucuu

SEQ ID NO: 1917981 - RNA, 22 nt, Human
cugacucacaccugaacugaac

SEQ ID NO: 1917982 - RNA, 18 nt, Human
cugacuguuuucucuuga

SEQ ID NO: 1917983 - RNA, 17 nt, Human
cugacuucaucucccac

SEQ ID NO: 1917984 - RNA, 23 nt, Human
cugacuucaucucccaccuagca

SEQ ID NO: 1917985 - RNA, 21 nt, Human
cugacaggcaaugcuggcugu

SEQ ID NO: 1917986 - RNA, 15 nt, Human
cugacagcugcuccu

SEQ ID NO: 1917987 - RNA, 16 nt, Human
cugacagcugcuccua

SEQ ID NO: 1917988 - RNA, 17 nt, Human
cugacagcugcuccuag

SEQ ID NO: 1917989 - RNA, 17 nt, Human
cugacagucaugcaguc

SEQ ID NO: 1917990 - RNA, 16 nt, Human
cugacaucuggaaucu

SEQ ID NO: 1917991 - RNA, 15 nt, Human
cugacaugauuccuu

SEQ ID NO: 1917992 - RNA, 20 nt, Human
cugacaugauuccuuccugu

SEQ ID NO: 1917993 - RNA, 16 nt, Human
cugacaugauuccuuc

SEQ ID NO: 1917994 - RNA, 19 nt, Human
cugaagacucauucuucug

SEQ ID NO: 1917995 - RNA, 14 nt, Human
cugaagaguccucu

SEQ ID NO: 1917996 - RNA, 15 nt, Human
cugaagaguccucug

SEQ ID NO: 1917997 - RNA, 16 nt, Human
cugaagaguccucuga

SEQ ID NO: 1917998 - RNA, 18 nt, Human
cugaagaguccucugaau

SEQ ID NO: 1917999 - RNA, 12 nt, Human
cugacagcugcu

SEQ ID NO: 1918000 - RNA, 13 nt, Human
cugacagcugcuc

SEQ ID NO: 1918001 - RNA, 14 nt, Human
cugacagcugcucc

SEQ ID NO: 1918002 - RNA, 22 nt, Human
cugacauuguuggccaaagcca

SEQ ID NO: 1918003 - RNA, 18 nt, Human
cugaccaauauuguacag

SEQ ID NO: 1918004 - RNA, 15 nt, Human
cugaccaauauugua

SEQ ID NO: 1918005 - RNA, 12 nt, Human
cugacccacugc

SEQ ID NO: 1918006 - RNA, 21 nt, Human
cugaccaauauuguacaguuu

SEQ ID NO: 1918007 - RNA, 20 nt, Human
cugaccaauauuguacaguu

SEQ ID NO: 1918008 - RNA, 19 nt, Human
cugaccaauauuguacagu

SEQ ID NO: 1918009 - RNA, 14 nt, Human
cugacccacugcuu

SEQ ID NO: 1918010 - RNA, 13 nt, Human
cugacccacugcu

SEQ ID NO: 1918011 - RNA, 13 nt, Human
cugacccaugcug

SEQ ID NO: 1918012 - RNA, 21 nt, Human
cugacccagccccuugagaaa

SEQ ID NO: 1918013 - RNA, 16 nt, Human
cugacccaugcugccc

SEQ ID NO: 1918014 - RNA, 14 nt, Human
cugacccaugcugc

SEQ ID NO: 1918015 - RNA, 15 nt, Human
cugacccaugcugcc

SEQ ID NO: 1918016 - RNA, 21 nt, Human
cugagccuuguaauucuaaau

SEQ ID NO: 1918017 - RNA, 15 nt, Human
cugagcgccaggaug

SEQ ID NO: 1918018 - RNA, 15 nt, Human
cugagcgccuggguc

SEQ ID NO: 1918019 - RNA, 14 nt, Human
cugagcgcuccugc

SEQ ID NO: 1918020 - RNA, 22 nt, Human
cugagcgccuggguccagggga

SEQ ID NO: 1918021 - RNA, 16 nt, Human
cugagccuuguaauuc

SEQ ID NO: 1918022 - RNA, 15 nt, Human
cugagccuuguaauu

SEQ ID NO: 1918023 - RNA, 20 nt, Human
cugagcgacagugagacucu

SEQ ID NO: 1918024 - RNA, 16 nt, Human
cugagcgacagugaga

SEQ ID NO: 1918025 - RNA, 12 nt, Human
cugagccucugc

SEQ ID NO: 1918026 - RNA, 14 nt, Human
cugagccucugcuc

SEQ ID NO: 1918027 - RNA, 15 nt, Human
cugagccucugcucc

SEQ ID NO: 1918028 - RNA, 16 nt, Human
cugagccucugcuccc

SEQ ID NO: 1918029 - RNA, 18 nt, Human
cugagccucugcucccca

SEQ ID NO: 1918030 - RNA, 22 nt, Human
cugagccagugucaggaggaag

SEQ ID NO: 1918031 - RNA, 16 nt, Human
cugagccagugucagg

SEQ ID NO: 1918032 - RNA, 16 nt, Human
cugagacagcccgggc

SEQ ID NO: 1918033 - RNA, 17 nt, Human
cugagacagcccgggcu

SEQ ID NO: 1918034 - RNA, 18 nt, Human
cugagacagcccgggcuc

SEQ ID NO: 1918035 - RNA, 17 nt, Human
cugagccagauuucacu

SEQ ID NO: 1918036 - RNA, 18 nt, Human
cugagccagauuucacuc

SEQ ID NO: 1918037 - RNA, 19 nt, Human
cugagccagauuucacucu

SEQ ID NO: 1918038 - RNA, 20 nt, Human
cugagccagauuucacucuc

SEQ ID NO: 1918039 - RNA, 21 nt, Human
cugagccagauuucacucucc

SEQ ID NO: 1918040 - RNA, 19 nt, Human
cugaggaucagaguaaucc

SEQ ID NO: 1918041 - RNA, 12 nt, Human
cugaggcaagag

SEQ ID NO: 1918042 - RNA, 16 nt, Human
cugaggcaagagaauu

SEQ ID NO: 1918043 - RNA, 17 nt, Human
cugaggaucagaguaau

SEQ ID NO: 1918044 - RNA, 17 nt, Human
cugagcucuuugcacua

SEQ ID NO: 1918045 - RNA, 12 nt, Human
cugaggccacac

SEQ ID NO: 1918046 - RNA, 14 nt, Human
cugaggccacacuc

SEQ ID NO: 1918047 - RNA, 20 nt, Human
cugaggccacacucagcaca

SEQ ID NO: 1918048 - RNA, 21 nt, Human
cugaggccacacucagcacaa

SEQ ID NO: 1918049 - RNA, 24 nt, Human
cugaggccacacucagcacaaggc

SEQ ID NO: 1918050 - RNA, 19 nt, Human
cugaggcagguccccagac

SEQ ID NO: 1918051 - RNA, 18 nt, Human
cugaggcagguccccaga

SEQ ID NO: 1918052 - RNA, 17 nt, Human
cugaggcagguccccag

SEQ ID NO: 1918053 - RNA, 14 nt, Human
cugaggcagguccc

SEQ ID NO: 1918054 - RNA, 12 nt, Human
cugaggcccaga

SEQ ID NO: 1918055 - RNA, 13 nt, Human
cugaggcccagag

SEQ ID NO: 1918056 - RNA, 14 nt, Human
cugaggcccagagg

SEQ ID NO: 1918057 - RNA, 15 nt, Human
cugaggcccagaggg

SEQ ID NO: 1918058 - RNA, 16 nt, Human
cugaggcccagagggc

SEQ ID NO: 1918059 - RNA, 17 nt, Human
cugaggcccagagggcc

SEQ ID NO: 1918060 - RNA, 18 nt, Human
cugaggcccagagggccu

SEQ ID NO: 1918061 - RNA, 19 nt, Human
cugaggcccagagggccug

SEQ ID NO: 1918062 - RNA, 21 nt, Human
cugaggcccagagggccugca

SEQ ID NO: 1918063 - RNA, 23 nt, Human
cugaggcccagagggccugcaag

SEQ ID NO: 1918064 - RNA, 14 nt, Human
cugaggcccuucuc

SEQ ID NO: 1918065 - RNA, 15 nt, Human
cugaggcccuucucu

SEQ ID NO: 1918066 - RNA, 18 nt, Human
cugaggcccuucucucca

SEQ ID NO: 1918067 - RNA, 19 nt, Human
cugaggcccuucucuccag

SEQ ID NO: 1918068 - RNA, 20 nt, Human
cugaggcccuucucuccagc

SEQ ID NO: 1918069 - RNA, 22 nt, Human
cucuuuauauggccucaagauc

SEQ ID NO: 1918070 - RNA, 13 nt, Human
cucuuucccuccc

SEQ ID NO: 1918071 - RNA, 17 nt, Human
cucuuucccucccuucc

SEQ ID NO: 1918072 - RNA, 23 nt, Human
cucuuuaaugucacaggcagguc

SEQ ID NO: 1918073 - RNA, 22 nt, Human
cucuuuaaugucacaggcaggu

SEQ ID NO: 1918074 - RNA, 21 nt, Human
cucuuuaaugucacaggcagg

SEQ ID NO: 1918075 - RNA, 20 nt, Human
cucuuuaaugucacaggcag

SEQ ID NO: 1918076 - RNA, 18 nt, Human
cucuuuaaugucacaggc

SEQ ID NO: 1918077 - RNA, 13 nt, Human
cucuugguccugc

SEQ ID NO: 1918078 - RNA, 15 nt, Human
cucuugguccugcug

SEQ ID NO: 1918079 - RNA, 16 nt, Human
cucuugguccugcugc

SEQ ID NO: 1918080 - RNA, 17 nt, Human
cucuugguccugcugca

SEQ ID NO: 1918081 - RNA, 19 nt, Human
cucuuggguucaagcgauu

SEQ ID NO: 1918082 - RNA, 21 nt, Human
cucuuggguucaagcgauucu

SEQ ID NO: 1918083 - RNA, 19 nt, Human
cucuuggguucaagugauu

SEQ ID NO: 1918084 - RNA, 22 nt, Human
cucuugaaauauaggaacuuaa

SEQ ID NO: 1918085 - RNA, 22 nt, Human
cucuucuuuuagcaguaaaaua

SEQ ID NO: 1918086 - RNA, 13 nt, Human
cugaacucacuuu

SEQ ID NO: 1918087 - RNA, 19 nt, Human
cugaagaauugaaaaacca

SEQ ID NO: 1918088 - RNA, 19 nt, Human
cugaacugauggguuucuc

SEQ ID NO: 1918089 - RNA, 13 nt, Human
cugaacugaacac

SEQ ID NO: 1918090 - RNA, 20 nt, Human
cugaacaccauugaaggcuu

SEQ ID NO: 1918091 - RNA, 16 nt, Human
cugaaauuuccuggga

SEQ ID NO: 1918092 - RNA, 19 nt, Human
cugaacaccauugaaggcu

SEQ ID NO: 1918093 - RNA, 18 nt, Human
cugaacaccauugaaggc

SEQ ID NO: 1918094 - RNA, 11 nt, Human
cugaacaccau

SEQ ID NO: 1918095 - RNA, 23 nt, Human
cugaaauuuccugggagcuuuug

SEQ ID NO: 1918096 - RNA, 13 nt, Human
cugaaauuuccug

SEQ ID NO: 1918097 - RNA, 15 nt, Human
cugaaagcccugagc

SEQ ID NO: 1918098 - RNA, 12 nt, Human
cucuuugcacua

SEQ ID NO: 1918099 - RNA, 17 nt, Human
cucuuucuauuguuucu

SEQ ID NO: 1918100 - RNA, 15 nt, Human
cucuuucuguauaua

SEQ ID NO: 1918101 - RNA, 16 nt, Human
cucuuuccuccuucca

SEQ ID NO: 1918102 - RNA, 19 nt, Human
cugaaauauacacacagca

SEQ ID NO: 1918103 - RNA, 18 nt, Human
cugaaauauacacacagc

SEQ ID NO: 1918104 - RNA, 23 nt, Human
cugaaagcccugagcuuucugcu

SEQ ID NO: 1918105 - RNA, 21 nt, Human
cugaaauaaacgucuuaaaua

SEQ ID NO: 1918106 - RNA, 16 nt, Human
cugaaagcccugagcu

SEQ ID NO: 1918107 - RNA, 17 nt, Human
cugaaagcccugagcuu

SEQ ID NO: 1918108 - RNA, 18 nt, Human
cugaaagcccugagcuuu

SEQ ID NO: 1918109 - RNA, 19 nt, Human
cugaaagcccugagcuuuc

SEQ ID NO: 1918110 - RNA, 18 nt, Human
cucugugagacucgagaa

SEQ ID NO: 1918111 - RNA, 17 nt, Human
cucugugagacucgaga

SEQ ID NO: 1918112 - RNA, 13 nt, Human
cucugugagacuc

SEQ ID NO: 1918113 - RNA, 22 nt, Human
cucugugcccacccuccacucu

SEQ ID NO: 1918114 - RNA, 15 nt, Human
cucugugccuucuuu

SEQ ID NO: 1918115 - RNA, 16 nt, Human
cucugugccuucuuuu

SEQ ID NO: 1918116 - RNA, 13 nt, Human
cucuuccaggcug

SEQ ID NO: 1918117 - RNA, 14 nt, Human
cucuuccaggcugg

SEQ ID NO: 1918118 - RNA, 15 nt, Human
cucuuccaggcuggg

SEQ ID NO: 1918119 - RNA, 13 nt, Human
cucuuagaaaaac

SEQ ID NO: 1918120 - RNA, 15 nt, Human
cucuuagaaaaacca

SEQ ID NO: 1918121 - RNA, 15 nt, Human
cucugugucaggugg

SEQ ID NO: 1918122 - RNA, 19 nt, Human
cucugugucagguggggca

SEQ ID NO: 1918123 - RNA, 12 nt, Human
cucuggcagcuc

SEQ ID NO: 1918124 - RNA, 14 nt, Human
cucuggcagcucag

SEQ ID NO: 1918125 - RNA, 20 nt, Human
cucuggaguggccacuaagc

SEQ ID NO: 1918126 - RNA, 12 nt, Human
cucuggaguggc

SEQ ID NO: 1918127 - RNA, 14 nt, Human
cucuggaguggcca

SEQ ID NO: 1918128 - RNA, 15 nt, Human
cucuggaguggccac

SEQ ID NO: 1918129 - RNA, 16 nt, Human
cucuggaguggccacu

SEQ ID NO: 1918130 - RNA, 22 nt, Human
cucuggacaggcauguucucug

SEQ ID NO: 1918131 - RNA, 16 nt, Human
cucuggacaggcaugu

SEQ ID NO: 1918132 - RNA, 19 nt, Human
cucuggagcccacuguacu

SEQ ID NO: 1918133 - RNA, 19 nt, Human
cucuggccuucggccucca

SEQ ID NO: 1918134 - RNA, 15 nt, Human
cucuggcagcucaga

SEQ ID NO: 1918135 - RNA, 16 nt, Human
cucuggcagcucagag

SEQ ID NO: 1918136 - RNA, 12 nt, Human
cucuggccuucg

SEQ ID NO: 1918137 - RNA, 15 nt, Human
cucuggacaggcaug

SEQ ID NO: 1918138 - RNA, 17 nt, Human
cucugcuugagucaggu

SEQ ID NO: 1918139 - RNA, 18 nt, Human
cucugcuugagucagguu

SEQ ID NO: 1918140 - RNA, 14 nt, Human
cucugcuuuaaagu

SEQ ID NO: 1918141 - RNA, 13 nt, Human
cucugcuuugaaa

SEQ ID NO: 1918142 - RNA, 19 nt, Human
cucugcuugacaacaucug

SEQ ID NO: 1918143 - RNA, 22 nt, Human
cucugccugaagucacacagug

SEQ ID NO: 1918144 - RNA, 21 nt, Human
cucugccugaagucacacagu

SEQ ID NO: 1918145 - RNA, 16 nt, Human
cucucugaaccccucc

SEQ ID NO: 1918146 - RNA, 13 nt, Human
cucucuccucccu

SEQ ID NO: 1918147 - RNA, 21 nt, Human
cuggccacgcagccaggacac

SEQ ID NO: 1918148 - RNA, 20 nt, Human
cuggccacgcagccaggaca

SEQ ID NO: 1918149 - RNA, 18 nt, Human
cuggccacgcagccagga

SEQ ID NO: 1918150 - RNA, 15 nt, Human
cuggccacgcagcca

SEQ ID NO: 1918151 - RNA, 14 nt, Human
cuggccacgcagcc

SEQ ID NO: 1918152 - RNA, 24 nt, Human
cuggcaugggaaugaaugucagug

SEQ ID NO: 1918153 - RNA, 18 nt, Human
cuggcaugcuaaagccuu

SEQ ID NO: 1918154 - RNA, 17 nt, Human
cuggcaugauccaagca

SEQ ID NO: 1918155 - RNA, 18 nt, Human
cuggcaugauccaagcaa

SEQ ID NO: 1918156 - RNA, 22 nt, Human
cuggcacuauaauguaagcucu

SEQ ID NO: 1918157 - RNA, 15 nt, Human
cuggcacuauaaugu

SEQ ID NO: 1918158 - RNA, 16 nt, Human
cuggcacuauaaugua

SEQ ID NO: 1918159 - RNA, 16 nt, Human
cuggcaugggaaugaa

SEQ ID NO: 1918160 - RNA, 18 nt, Human
cuggcaugggaaugaaug

SEQ ID NO: 1918161 - RNA, 19 nt, Human
cuggcaugggaaugaaugu

SEQ ID NO: 1918162 - RNA, 22 nt, Human
cuggcaugggaaugaaugucag

SEQ ID NO: 1918163 - RNA, 18 nt, Human
cuggcacccggccccugc

SEQ ID NO: 1918164 - RNA, 17 nt, Human
cuggcacccggccccug

SEQ ID NO: 1918165 - RNA, 16 nt, Human
cuggcacccggccccu

SEQ ID NO: 1918166 - RNA, 20 nt, Human
cuggaagugcuaauuuugaa

SEQ ID NO: 1918167 - RNA, 18 nt, Human
cuggaauauauaaccagu

SEQ ID NO: 1918168 - RNA, 17 nt, Human
cuggaaucuggagacca

SEQ ID NO: 1918169 - RNA, 18 nt, Human
cuggaaucuggagaccag

SEQ ID NO: 1918170 - RNA, 19 nt, Human
cuggaaucuggagaccagg

SEQ ID NO: 1918171 - RNA, 14 nt, Human
cuggcaagaaugug

SEQ ID NO: 1918172 - RNA, 24 nt, Human
cuggaaucuggagaccagggagcc

SEQ ID NO: 1918173 - RNA, 23 nt, Human
cuggccucaagugauucuccugc

SEQ ID NO: 1918174 - RNA, 21 nt, Human
cuggccccaggaccuggcugc

SEQ ID NO: 1918175 - RNA, 12 nt, Human
cuggccucugca

SEQ ID NO: 1918176 - RNA, 16 nt, Human
cuggccucccaaauga

SEQ ID NO: 1918177 - RNA, 13 nt, Human
cuggccucccaca

SEQ ID NO: 1918178 - RNA, 14 nt, Human
cuggccucccacag

SEQ ID NO: 1918179 - RNA, 14 nt, Human
cuggccucccaaau

SEQ ID NO: 1918180 - RNA, 16 nt, Human
cuggccccaggaccug

SEQ ID NO: 1918181 - RNA, 20 nt, Human
cuggccccaggaccuggcug

SEQ ID NO: 1918182 - RNA, 14 nt, Human
cuggccuggccccu

SEQ ID NO: 1918183 - RNA, 15 nt, Human
cuggccugagcuggg

SEQ ID NO: 1918184 - RNA, 18 nt, Human
cuggccugagcugggaug

SEQ ID NO: 1918185 - RNA, 13 nt, Human
cuggccucugcac

SEQ ID NO: 1918186 - RNA, 14 nt, Human
cuggccucugcacu

SEQ ID NO: 1918187 - RNA, 16 nt, Human
cuggccucugcacucc

SEQ ID NO: 1918188 - RNA, 16 nt, Human
cuggccugagcuggga

SEQ ID NO: 1918189 - RNA, 16 nt, Human
cuggccuggccccuca

SEQ ID NO: 1918190 - RNA, 17 nt, Human
cuggccuggccccucag

SEQ ID NO: 1918191 - RNA, 15 nt, Human
cuggccuucggccuc

SEQ ID NO: 1918192 - RNA, 21 nt, Human
cuggccuucggccuccauccu

SEQ ID NO: 1918193 - RNA, 18 nt, Human
cuggccuucggccuccau

SEQ ID NO: 1918194 - RNA, 17 nt, Human
cuggccuucggccucca

SEQ ID NO: 1918195 - RNA, 16 nt, Human
cuggccuucggccucc

SEQ ID NO: 1918196 - RNA, 19 nt, Human
cugggagccgggccgcaga

SEQ ID NO: 1918197 - RNA, 16 nt, Human
cugggagccuacccac

SEQ ID NO: 1918198 - RNA, 22 nt, Human
cugggagccuacccacccccag

SEQ ID NO: 1918199 - RNA, 19 nt, Human
cugggagccuacccacccc

SEQ ID NO: 1918200 - RNA, 15 nt, Human
cugggagauucaagg

SEQ ID NO: 1918201 - RNA, 19 nt, Human
cugggagauucaagggacc

SEQ ID NO: 1918202 - RNA, 18 nt, Human
cugggaggcucuggagcc

SEQ ID NO: 1918203 - RNA, 20 nt, Human
cugggaggcucuggagccca

SEQ ID NO: 1918204 - RNA, 21 nt, Human
cugggaggcucuggagcccac

SEQ ID NO: 1918205 - RNA, 17 nt, Human
cugggaggcucuggagc

SEQ ID NO: 1918206 - RNA, 22 nt, Human
cugggaggcucuggagcccacu

SEQ ID NO: 1918207 - RNA, 19 nt, Human
cugggaggucaaggcugca

SEQ ID NO: 1918208 - RNA, 21 nt, Human
cugggaggucaaggcugcagu

SEQ ID NO: 1918209 - RNA, 17 nt, Human
cugggauuacaggugug

SEQ ID NO: 1918210 - RNA, 20 nt, Human
cugggaugggaggagaggac

SEQ ID NO: 1918211 - RNA, 20 nt, Human
cugggauuacaggugugaac

SEQ ID NO: 1918212 - RNA, 20 nt, Human
cugggaucccucauccucau

SEQ ID NO: 1918213 - RNA, 18 nt, Human
cugggaugauuggagggg

SEQ ID NO: 1918214 - RNA, 15 nt, Human
cuggcgccuccgagg

SEQ ID NO: 1918215 - RNA, 13 nt, Human
cuggcuggaguga

SEQ ID NO: 1918216 - RNA, 13 nt, Human
cuggcugucgaga

SEQ ID NO: 1918217 - RNA, 17 nt, Human
cuggcuguuggcugggg

SEQ ID NO: 1918218 - RNA, 16 nt, Human
cuggcuguuggcuggg

SEQ ID NO: 1918219 - RNA, 20 nt, Human
cuggcugguuagagguuccc

SEQ ID NO: 1918220 - RNA, 12 nt, Human
cuggcugggacg

SEQ ID NO: 1918221 - RNA, 16 nt, Human
cuggcugggacguggc

SEQ ID NO: 1918222 - RNA, 19 nt, Human
cuggcugggacguggcuca

SEQ ID NO: 1918223 - RNA, 21 nt, Human
cuggcugggacguggcucagc

SEQ ID NO: 1918224 - RNA, 23 nt, Human
cuggcugggacguggcucagcca

SEQ ID NO: 1918225 - RNA, 18 nt, Human
cuggcuguuggcuggggg

SEQ ID NO: 1918226 - RNA, 11 nt, Human
cuggcuuuggc

SEQ ID NO: 1918227 - RNA, 14 nt, Human
cuggcuuuggcuuc

SEQ ID NO: 1918228 - RNA, 19 nt, Human
cuggcuuuuuauuguauuu

SEQ ID NO: 1918229 - RNA, 11 nt, Human
cugggaaacag

SEQ ID NO: 1918230 - RNA, 15 nt, Human
cugggaaacagaggc

SEQ ID NO: 1918231 - RNA, 16 nt, Human
cugggaaacagaggcu

SEQ ID NO: 1918232 - RNA, 17 nt, Human
cugggagagccuuccag

SEQ ID NO: 1918233 - RNA, 18 nt, Human
cugggagagccuuccagg

SEQ ID NO: 1918234 - RNA, 21 nt, Human
cugggagagccuuccaggggu

SEQ ID NO: 1918235 - RNA, 19 nt, Human
cugggagagccuuccaggg

SEQ ID NO: 1918236 - RNA, 20 nt, Human
cugggagagccuuccagggg

SEQ ID NO: 1918237 - RNA, 13 nt, Human
cugguccacaggg

SEQ ID NO: 1918238 - RNA, 13 nt, Human
cuggucagcccaa

SEQ ID NO: 1918239 - RNA, 12 nt, Human
cuggucagccca

SEQ ID NO: 1918240 - RNA, 16 nt, Human
cugguccacagggcac

SEQ ID NO: 1918241 - RNA, 22 nt, Human
cugguccacagggcaccugcca

SEQ ID NO: 1918242 - RNA, 13 nt, Human
cuggucccacuca

SEQ ID NO: 1918243 - RNA, 17 nt, Human
cuggucagguauuucag

SEQ ID NO: 1918244 - RNA, 14 nt, Human
cuggucccacucag

SEQ ID NO: 1918245 - RNA, 23 nt, Human
cuggucucaaacucuugaccuca

SEQ ID NO: 1918246 - RNA, 14 nt, Human
cuggguacuugugg

SEQ ID NO: 1918247 - RNA, 16 nt, Human
cuggguacuuguggac

SEQ ID NO: 1918248 - RNA, 18 nt, Human
cuggguacuuguggacac

SEQ ID NO: 1918249 - RNA, 19 nt, Human
cuggguacuuguggacaca

SEQ ID NO: 1918250 - RNA, 20 nt, Human
cugggcucccuucccaccuc

SEQ ID NO: 1918251 - RNA, 21 nt, Human
cugggcucccuucccaccucu

SEQ ID NO: 1918252 - RNA, 22 nt, Human
cugggcucccuucccaccucuc

SEQ ID NO: 1918253 - RNA, 15 nt, Human
cuggguuggagggug

SEQ ID NO: 1918254 - RNA, 17 nt, Human
cugggucgcccuggacu

SEQ ID NO: 1918255 - RNA, 18 nt, Human
cugggucgcccuggacug

SEQ ID NO: 1918256 - RNA, 22 nt, Human
cugggucgcccuggacugugug

SEQ ID NO: 1918257 - RNA, 23 nt, Human
cuguacaugaaaacacauuuuuc

SEQ ID NO: 1918258 - RNA, 22 nt, Human
cuguacaugaaaacacauuuuu

SEQ ID NO: 1918259 - RNA, 21 nt, Human
cuguaccucuugagccuugaa

SEQ ID NO: 1918260 - RNA, 23 nt, Human
cuguaccaugugcuacaggggcc

SEQ ID NO: 1918261 - RNA, 17 nt, Human
cuguaauuugugauaca

SEQ ID NO: 1918262 - RNA, 18 nt, Human
cuguaauuugugauacaa

SEQ ID NO: 1918263 - RNA, 22 nt, Human
cuguaauuugugauacaaugcu

SEQ ID NO: 1918264 - RNA, 21 nt, Human
cuguaauuugugauacaaugc

SEQ ID NO: 1918265 - RNA, 23 nt, Human
cuguacagagcccacgcccccac

SEQ ID NO: 1918266 - RNA, 16 nt, Human
cugguggcagcucacc

SEQ ID NO: 1918267 - RNA, 13 nt, Human
cugguggcagcuc

SEQ ID NO: 1918268 - RNA, 14 nt, Human
cugguggcagcuca

SEQ ID NO: 1918269 - RNA, 12 nt, Human
cugguggcagcu

SEQ ID NO: 1918270 - RNA, 20 nt, Human
cugguucaggguuggccccu

SEQ ID NO: 1918271 - RNA, 18 nt, Human
cuguaaggcaaucauggu

SEQ ID NO: 1918272 - RNA, 18 nt, Human
cuguaucccaugagccuc

SEQ ID NO: 1918273 - RNA, 19 nt, Human
cuguaucccaugagccuca

SEQ ID NO: 1918274 - RNA, 13 nt, Human
cuguauauacuuu

SEQ ID NO: 1918275 - RNA, 20 nt, Human
cuguaugucucgugguagga

SEQ ID NO: 1918276 - RNA, 16 nt, Human
cuguauuugagaauau

SEQ ID NO: 1918277 - RNA, 15 nt, Human
cuguaucccaugagc

SEQ ID NO: 1918278 - RNA, 14 nt, Human
cuguaucccaugag

SEQ ID NO: 1918279 - RNA, 22 nt, Human
cuguaccucuugagccuugaac

SEQ ID NO: 1918280 - RNA, 14 nt, Human
cuguaccucugccu

SEQ ID NO: 1918281 - RNA, 22 nt, Human
cugucccagugccgagaaggaa

SEQ ID NO: 1918282 - RNA, 18 nt, Human
cugucucuacuaaaaaua

SEQ ID NO: 1918283 - RNA, 12 nt, Human
cugucuccuggc

SEQ ID NO: 1918284 - RNA, 21 nt, Human
cuguccuacucugugucaggu

SEQ ID NO: 1918285 - RNA, 22 nt, Human
cugucucaaaaaaagaaaaaga

SEQ ID NO: 1918286 - RNA, 20 nt, Human
cuguccuacucugugucagg

SEQ ID NO: 1918287 - RNA, 18 nt, Human
cuguccuacucuguguca

SEQ ID NO: 1918288 - RNA, 17 nt, Human
cuguccuacucuguguc

SEQ ID NO: 1918289 - RNA, 16 nt, Human
cuguccuacucugugu

SEQ ID NO: 1918290 - RNA, 13 nt, Human
cugucccccugac

SEQ ID NO: 1918291 - RNA, 14 nt, Human
cugucccccugaca

SEQ ID NO: 1918292 - RNA, 19 nt, Human
cugucccuaguaaaaauac

SEQ ID NO: 1918293 - RNA, 21 nt, Human
cugucccuaguaaaaauacaa

SEQ ID NO: 1918294 - RNA, 15 nt, Human
cugccugcaccccug

SEQ ID NO: 1918295 - RNA, 19 nt, Human
cugccugaagucacacagu

SEQ ID NO: 1918296 - RNA, 23 nt, Human
cugccugaagucacacagugagu

SEQ ID NO: 1918297 - RNA, 21 nt, Human
cugccugccagcugcacugau

SEQ ID NO: 1918298 - RNA, 15 nt, Human
cugccugccagcugc

SEQ ID NO: 1918299 - RNA, 16 nt, Human
cugccugccagcugca

SEQ ID NO: 1918300 - RNA, 20 nt, Human
cugccugccagcugcacuga

SEQ ID NO: 1918301 - RNA, 16 nt, Human
cugccugaagucacac

SEQ ID NO: 1918302 - RNA, 18 nt, Human
cugccugaagucacacag

SEQ ID NO: 1918303 - RNA, 21 nt, Human
cugcccugcccaccuggccuc

SEQ ID NO: 1918304 - RNA, 20 nt, Human
cugcccugcccaccuggccu

SEQ ID NO: 1918305 - RNA, 17 nt, Human
cugcccugcccaccugg

SEQ ID NO: 1918306 - RNA, 23 nt, Human
cugcgguccacccaggagccccg

SEQ ID NO: 1918307 - RNA, 18 nt, Human
cugcggugcuaucucccc

SEQ ID NO: 1918308 - RNA, 19 nt, Human
cugcggugcuaucuccccc

SEQ ID NO: 1918309 - RNA, 22 nt, Human
cugccugcuuuuuauggccugu

SEQ ID NO: 1918310 - RNA, 18 nt, Human
cugcgcccaguccuucca

SEQ ID NO: 1918311 - RNA, 19 nt, Human
cugcgcccaguccuuccac

SEQ ID NO: 1918312 - RNA, 23 nt, Human
cugcgcccaguccuuccaccucg

SEQ ID NO: 1918313 - RNA, 15 nt, Human
cugcucuccgaccag

SEQ ID NO: 1918314 - RNA, 20 nt, Human
cugcuccucuccccagcaag

SEQ ID NO: 1918315 - RNA, 19 nt, Human
cugcuccucuccccagcaa

SEQ ID NO: 1918316 - RNA, 23 nt, Human
cugcuccucuccccagcaaguga

SEQ ID NO: 1918317 - RNA, 20 nt, Human
cugcggugcuaucuccccca

SEQ ID NO: 1918318 - RNA, 21 nt, Human
cugcggugcuaucucccccag

SEQ ID NO: 1918319 - RNA, 22 nt, Human
cugcggugcuaucucccccagc

SEQ ID NO: 1918320 - RNA, 23 nt, Human
cugcggugcuaucucccccagcc

SEQ ID NO: 1918321 - RNA, 16 nt, Human
cugcuccccaggggag

SEQ ID NO: 1918322 - RNA, 22 nt, Human
cugcgggugaacaaagcagcca

SEQ ID NO: 1918323 - RNA, 23 nt, Human
cugcgggugaacaaagcagccac

SEQ ID NO: 1918324 - RNA, 12 nt, Human
cugcucugguua

SEQ ID NO: 1918325 - RNA, 15 nt, Human
cugcucugugcccac

SEQ ID NO: 1918326 - RNA, 14 nt, Human
cugcugccugcuuu

SEQ ID NO: 1918327 - RNA, 23 nt, Human
cugcugccugcuuuuuauggccu

SEQ ID NO: 1918328 - RNA, 15 nt, Human
cugcugcaguugcca

SEQ ID NO: 1918329 - RNA, 14 nt, Human
cugcugcaguugcc

SEQ ID NO: 1918330 - RNA, 10 nt, Human
cugcugcagu

SEQ ID NO: 1918331 - RNA, 13 nt, Human
cugcugcaguugc

SEQ ID NO: 1918332 - RNA, 14 nt, Human
cugcugcugcugug

SEQ ID NO: 1918333 - RNA, 12 nt, Human
cugcugcuggcu

SEQ ID NO: 1918334 - RNA, 13 nt, Human
cugcugcuggcug

SEQ ID NO: 1918335 - RNA, 14 nt, Human
cugcugcuggcugg

SEQ ID NO: 1918336 - RNA, 14 nt, Human
cugcuggguguggc

SEQ ID NO: 1918337 - RNA, 15 nt, Human
cugcuggguguggcg

SEQ ID NO: 1918338 - RNA, 17 nt, Human
cugcuggguguggcgca

SEQ ID NO: 1918339 - RNA, 13 nt, Human
cugcuugaggcaa

SEQ ID NO: 1918340 - RNA, 20 nt, Human
cugcuugaggcaacucaucu

SEQ ID NO: 1918341 - RNA, 21 nt, Human
cugcuugaggcaacucaucuu

SEQ ID NO: 1918342 - RNA, 17 nt, Human
cugcuugacaacaucug

SEQ ID NO: 1918343 - RNA, 22 nt, Human
cugcuguaaauuuggcuucugu

SEQ ID NO: 1918344 - RNA, 15 nt, Human
cugcuuuuggucugu

SEQ ID NO: 1918345 - RNA, 20 nt, Human
cugcuuugggaagccgugcu

SEQ ID NO: 1918346 - RNA, 17 nt, Human
cugcuuuuggucugugu

SEQ ID NO: 1918347 - RNA, 19 nt, Human
cugcuuuugucuaugggac

SEQ ID NO: 1918348 - RNA, 17 nt, Human
cuggaagcuaauuugca

SEQ ID NO: 1918349 - RNA, 16 nt, Human
cuggaaguccaaugug

SEQ ID NO: 1918350 - RNA, 19 nt, Human
cuggaaguccaauguggca

SEQ ID NO: 1918351 - RNA, 18 nt, Human
cuggaagcuaauuugcau

SEQ ID NO: 1918352 - RNA, 19 nt, Human
cuggaagcuaauuugcauu

SEQ ID NO: 1918353 - RNA, 22 nt, Human
cuggaagcuaauuugcauuaaa

SEQ ID NO: 1918354 - RNA, 19 nt, Human
cugcuugggcuucauccuc

SEQ ID NO: 1918355 - RNA, 19 nt, Human
cugcuugugaaaggaaaga

SEQ ID NO: 1918356 - RNA, 13 nt, Human
cugcuugggcuuc

SEQ ID NO: 1918357 - RNA, 15 nt, Human
cugcuugggcuucau

SEQ ID NO: 1918358 - RNA, 17 nt, Human
cugcuugggcuucaucc

SEQ ID NO: 1918359 - RNA, 18 nt, Human
cugcuugggcuucauccu

SEQ ID NO: 1918360 - RNA, 22 nt, Human
cugcuugaggcaacucaucuua

SEQ ID NO: 1918361 - RNA, 20 nt, Human
cugcuugcuugcuuuuuaau

SEQ ID NO: 1918362 - RNA, 23 nt, Human
cugccacccugggccuggcagcu

SEQ ID NO: 1918363 - RNA, 21 nt, Human
cugccacccuggggagaaagu

SEQ ID NO: 1918364 - RNA, 16 nt, Human
cugccacccugggccu

SEQ ID NO: 1918365 - RNA, 17 nt, Human
cugccacccugggccug

SEQ ID NO: 1918366 - RNA, 14 nt, Human
cugccacccugggg

SEQ ID NO: 1918367 - RNA, 12 nt, Human
cugccacccugg

SEQ ID NO: 1918368 - RNA, 19 nt, Human
cugccagacccccuggaga

SEQ ID NO: 1918369 - RNA, 17 nt, Human
cugccagacccccugga

SEQ ID NO: 1918370 - RNA, 17 nt, Human
cugcauacccgggcagg

SEQ ID NO: 1918371 - RNA, 16 nt, Human
cugcauaccaaccugg

SEQ ID NO: 1918372 - RNA, 15 nt, Human
cugcauaugaaagga

SEQ ID NO: 1918373 - RNA, 15 nt, Human
cugcauaccaaccug

SEQ ID NO: 1918374 - RNA, 20 nt, Human
cugcaucaagaugugacaug

SEQ ID NO: 1918375 - RNA, 14 nt, Human
cugcauauguugaa

SEQ ID NO: 1918376 - RNA, 21 nt, Human
cugcauauguugaauacuuuu

SEQ ID NO: 1918377 - RNA, 20 nt, Human
cugccacccaccucccugcc

SEQ ID NO: 1918378 - RNA, 22 nt, Human
cugccacccaccucccugccuc

SEQ ID NO: 1918379 - RNA, 23 nt, Human
cugccacccaccucccugccucc

SEQ ID NO: 1918380 - RNA, 13 nt, Human
cugccaggaagcc

SEQ ID NO: 1918381 - RNA, 14 nt, Human
cugccaggaagcca

SEQ ID NO: 1918382 - RNA, 20 nt, Human
cugccaggaagccagcaggc

SEQ ID NO: 1918383 - RNA, 21 nt, Human
cugccaggaagccagcaggcu

SEQ ID NO: 1918384 - RNA, 11 nt, Human
cugccagcugc

SEQ ID NO: 1918385 - RNA, 12 nt, Human
cugccagcugca

SEQ ID NO: 1918386 - RNA, 13 nt, Human
cugccagcugcac

SEQ ID NO: 1918387 - RNA, 20 nt, Human
cugccaucucaccuccugcu

SEQ ID NO: 1918388 - RNA, 21 nt, Human
cugccauccagguucagcuug

SEQ ID NO: 1918389 - RNA, 15 nt, Human
cugccauccucccaa

SEQ ID NO: 1918390 - RNA, 22 nt, Human
cugccaggaagccagcaggcuc

SEQ ID NO: 1918391 - RNA, 16 nt, Human
cugccagcugcacuga

SEQ ID NO: 1918392 - RNA, 17 nt, Human
cugccagcugcacugau

SEQ ID NO: 1918393 - RNA, 20 nt, Human
cugcccaggccccugccacc

SEQ ID NO: 1918394 - RNA, 19 nt, Human
cugcccaggccccugccac

SEQ ID NO: 1918395 - RNA, 18 nt, Human
cugcccaggccccugcca

SEQ ID NO: 1918396 - RNA, 16 nt, Human
cugcccaggccccugc

SEQ ID NO: 1918397 - RNA, 13 nt, Human
cugccccaacucu

SEQ ID NO: 1918398 - RNA, 15 nt, Human
cugcccaggccccug

SEQ ID NO: 1918399 - RNA, 14 nt, Human
cugcccaggccccu

SEQ ID NO: 1918400 - RNA, 12 nt, Human
cugcccaccugg

SEQ ID NO: 1918401 - RNA, 15 nt, Human
cugccauuucugaga

SEQ ID NO: 1918402 - RNA, 18 nt, Human
cugccccuggcagccccu

SEQ ID NO: 1918403 - RNA, 19 nt, Human
cugccccuggcagccccug

SEQ ID NO: 1918404 - RNA, 13 nt, Human
cugcccggcaggg

SEQ ID NO: 1918405 - RNA, 20 nt, Human
cugcccggcaggguccuaga

SEQ ID NO: 1918406 - RNA, 21 nt, Human
cugcaguuugagacaggagac

SEQ ID NO: 1918407 - RNA, 19 nt, Human
cugcaguuugagacaggag

SEQ ID NO: 1918408 - RNA, 13 nt, Human
cugcaguugccag

SEQ ID NO: 1918409 - RNA, 16 nt, Human
cugcaguugccaguca

SEQ ID NO: 1918410 - RNA, 16 nt, Human
cugcagugaggcugug

SEQ ID NO: 1918411 - RNA, 19 nt, Human
cugcaggucccuaauaaag

SEQ ID NO: 1918412 - RNA, 20 nt, Human
cugcaggucccuaauaaagc

SEQ ID NO: 1918413 - RNA, 21 nt, Human
cugcaggucccuaauaaagcu

SEQ ID NO: 1918414 - RNA, 22 nt, Human
cugcaggucccuaauaaagcug

SEQ ID NO: 1918415 - RNA, 23 nt, Human
cugcaggucccuaauaaagcugu

SEQ ID NO: 1918416 - RNA, 14 nt, Human
cugcaguaaaucuu

SEQ ID NO: 1918417 - RNA, 17 nt, Human
cugcaguaaaucuuuua

SEQ ID NO: 1918418 - RNA, 11 nt, Human
cugcagguccc

SEQ ID NO: 1918419 - RNA, 12 nt, Human
cugcaggucccu

SEQ ID NO: 1918420 - RNA, 13 nt, Human
cugcaggucccua

SEQ ID NO: 1918421 - RNA, 14 nt, Human
cugcaggucccuaa

SEQ ID NO: 1918422 - RNA, 15 nt, Human
cugcaggucccuaau

SEQ ID NO: 1918423 - RNA, 16 nt, Human
cugcaggucccuaaua

SEQ ID NO: 1918424 - RNA, 17 nt, Human
cugcaggucccuaauaa

SEQ ID NO: 1918425 - RNA, 18 nt, Human
cugcaggucccuaauaaa

SEQ ID NO: 1918426 - RNA, 17 nt, Human
cugcagcaauaaagcag

SEQ ID NO: 1918427 - RNA, 15 nt, Human
cugcaccgggccaca

SEQ ID NO: 1918428 - RNA, 14 nt, Human
cugcaccgggccac

SEQ ID NO: 1918429 - RNA, 15 nt, Human
cugcaccggcuggcc

SEQ ID NO: 1918430 - RNA, 16 nt, Human
cugcaccggcuggccu

SEQ ID NO: 1918431 - RNA, 22 nt, Human
cugaggcccuucucuccagccc

SEQ ID NO: 1918432 - RNA, 23 nt, Human
cugaggcccuucucuccagcccc

SEQ ID NO: 1918433 - RNA, 14 nt, Human
cugcaccggcuggc

SEQ ID NO: 1918434 - RNA, 20 nt, Human
cugcaccgggccacagagaa

SEQ ID NO: 1918435 - RNA, 18 nt, Human
cugcaccgggccacagag

SEQ ID NO: 1918436 - RNA, 20 nt, Human
cugcacuccagccuggguga

SEQ ID NO: 1918437 - RNA, 14 nt, Human
cugcacuccccugc

SEQ ID NO: 1918438 - RNA, 13 nt, Human
cugcacuccccug

SEQ ID NO: 1918439 - RNA, 19 nt, Human
cugcacuccccugcugggu

SEQ ID NO: 1918440 - RNA, 20 nt, Human
cugcacuccccugcugggug

SEQ ID NO: 1918441 - RNA, 10 nt, Human
cugcagaggg

SEQ ID NO: 1918442 - RNA, 15 nt, Human
cugcagacgcccaga

SEQ ID NO: 1918443 - RNA, 16 nt, Human
cugcagcaauaaagca

SEQ ID NO: 1918444 - RNA, 15 nt, Human
cugcagcaauaaagc

SEQ ID NO: 1918445 - RNA, 13 nt, Human
cugcagagggcac

SEQ ID NO: 1918446 - RNA, 21 nt, Human
cugcacuccccugcugggugu

SEQ ID NO: 1918447 - RNA, 22 nt, Human
cugcagaauuuggguucugccu

SEQ ID NO: 1918448 - RNA, 22 nt, Human
cuuucuuuucuggaauguaauc

SEQ ID NO: 1918449 - RNA, 16 nt, Human
cuuucuuucacaaaaa

SEQ ID NO: 1918450 - RNA, 17 nt, Human
cuuuccugaggcugggc

SEQ ID NO: 1918451 - RNA, 16 nt, Human
cuuuccugaggcuggg

SEQ ID NO: 1918452 - RNA, 20 nt, Human
cuuuccugaggcugggcucc

SEQ ID NO: 1918453 - RNA, 21 nt, Human
cuuuccugaggcugggcuccc

SEQ ID NO: 1918454 - RNA, 15 nt, Human
cuuugcagacaggca

SEQ ID NO: 1918455 - RNA, 14 nt, Human
cuuugcagacaggc

SEQ ID NO: 1918456 - RNA, 19 nt, Human
cuuuggaaagaguaggaag

SEQ ID NO: 1918457 - RNA, 23 nt, Human
cuuuggaaagaguaggaagacuu

SEQ ID NO: 1918458 - RNA, 18 nt, Human
cuuucaauaaacuaaaga

SEQ ID NO: 1918459 - RNA, 22 nt, Human
cuuucaauaaacuaaagaaaaa

SEQ ID NO: 1918460 - RNA, 18 nt, Human
cuuucaugaguuuuuccc

SEQ ID NO: 1918461 - RNA, 22 nt, Human
cuuucaugaguuuuucccagcu

SEQ ID NO: 1918462 - RNA, 15 nt, Human
cuuucaaagccauuu

SEQ ID NO: 1918463 - RNA, 17 nt, Human
cuuucaaagccauuuua

SEQ ID NO: 1918464 - RNA, 18 nt, Human
cuugugucuguacacgug

SEQ ID NO: 1918465 - RNA, 15 nt, Human
cuugugucuguacac

SEQ ID NO: 1918466 - RNA, 14 nt, Human
cuugugucuguaca

SEQ ID NO: 1918467 - RNA, 12 nt, Human
cuugugucugua

SEQ ID NO: 1918468 - RNA, 21 nt, Human
cuuguggacacagcucuucuc

SEQ ID NO: 1918469 - RNA, 19 nt, Human
cuuuauuuuguguuuagga

SEQ ID NO: 1918470 - RNA, 17 nt, Human
cuuucauuuacuguggc

SEQ ID NO: 1918471 - RNA, 16 nt, Human
cuuucauuuacugugg

SEQ ID NO: 1918472 - RNA, 16 nt, Human
cuuuccaaaguacacu

SEQ ID NO: 1918473 - RNA, 22 nt, Human
cuuuccaaaguacacuguuuca

SEQ ID NO: 1918474 - RNA, 16 nt, Human
cuuuccaaaugcccag

SEQ ID NO: 1918475 - RNA, 14 nt, Human
cuuuccaggaaggc

SEQ ID NO: 1918476 - RNA, 21 nt, Human
cuuuccacuccuccuagccac

SEQ ID NO: 1918477 - RNA, 18 nt, Human
cuuuccacuccuccuagc

SEQ ID NO: 1918478 - RNA, 23 nt, Human
cuuuccaaagccaaugugaacag

SEQ ID NO: 1918479 - RNA, 21 nt, Human
cuuuccuagauggcagucacu

SEQ ID NO: 1918480 - RNA, 17 nt, Human
cuuuccuaaggcugcaa

SEQ ID NO: 1918481 - RNA, 20 nt, Human
cuuuccuaaggcugcaaggu

SEQ ID NO: 1918482 - RNA, 20 nt, Human
cuuuccuagauggcagucac

SEQ ID NO: 1918483 - RNA, 16 nt, Human
cuuuccuaaggcugca

SEQ ID NO: 1918484 - RNA, 15 nt, Human
cuuuucacaaauaaa

SEQ ID NO: 1918485 - RNA, 14 nt, Human
cuuuucacaaauaa

SEQ ID NO: 1918486 - RNA, 13 nt, Human
cuuuucacaaaua

SEQ ID NO: 1918487 - RNA, 12 nt, Human
cuuuucacaaau

SEQ ID NO: 1918488 - RNA, 22 nt, Human
cuuuucauuuaggugaggaagc

SEQ ID NO: 1918489 - RNA, 13 nt, Human
cuuuuccaacccu

SEQ ID NO: 1918490 - RNA, 23 nt, Human
cuuuuccaacccucaucaccaac

SEQ ID NO: 1918491 - RNA, 20 nt, Human
cuuuucgcaggauucuuccu

SEQ ID NO: 1918492 - RNA, 21 nt, Human
cuuuucgcaggauucuuccuc

SEQ ID NO: 1918493 - RNA, 15 nt, Human
cuuuuaauccuggcu

SEQ ID NO: 1918494 - RNA, 20 nt, Human
cuuuuaacuccucaauucca

SEQ ID NO: 1918495 - RNA, 21 nt, Human
cuuuuaacuccucaauuccaa

SEQ ID NO: 1918496 - RNA, 14 nt, Human
cuuuguuuuuauuu

SEQ ID NO: 1918497 - RNA, 14 nt, Human
cuuuggaggccccu

SEQ ID NO: 1918498 - RNA, 15 nt, Human
cuuuggaagaaaaaa

SEQ ID NO: 1918499 - RNA, 17 nt, Human
cuuuggaagaaaaaauc

SEQ ID NO: 1918500 - RNA, 22 nt, Human
cuuuggagaagaguguggaguc

SEQ ID NO: 1918501 - RNA, 17 nt, Human
cuuuucuuucagccaag

SEQ ID NO: 1918502 - RNA, 16 nt, Human
cuuuucuuucuaccaa

SEQ ID NO: 1918503 - RNA, 13 nt, Human
cuuuucuuuucuu

SEQ ID NO: 1918504 - RNA, 22 nt, Human
cuuuuuaauauugauaugcuua

SEQ ID NO: 1918505 - RNA, 18 nt, Human
cuuuuuuauacauaaaca

SEQ ID NO: 1918506 - RNA, 19 nt, Human
cuuuuuuaucaugugaaau

SEQ ID NO: 1918507 - RNA, 11 nt, Human
gaaaaagaaaa

SEQ ID NO: 1918508 - RNA, 16 nt, Human
gaaaaagaaaaaauau

SEQ ID NO: 1918509 - RNA, 15 nt, Human
cuuuuuuauacauaa

SEQ ID NO: 1918510 - RNA, 17 nt, Human
cuuuuuuauacauaaac

SEQ ID NO: 1918511 - RNA, 16 nt, Human
cuuuuuuauacauaaa

SEQ ID NO: 1918512 - RNA, 16 nt, Human
cuugagccaguaauug

SEQ ID NO: 1918513 - RNA, 13 nt, Human
cuugagccaguaa

SEQ ID NO: 1918514 - RNA, 19 nt, Human
cuugagccuugaacuuuga

SEQ ID NO: 1918515 - RNA, 17 nt, Human
cuugaccauucuccacc

SEQ ID NO: 1918516 - RNA, 20 nt, Human
cuugaccauucuccaccugc

SEQ ID NO: 1918517 - RNA, 14 nt, Human
cuugagagggugga

SEQ ID NO: 1918518 - RNA, 21 nt, Human
cuugaccauucuccaccugcc

SEQ ID NO: 1918519 - RNA, 13 nt, Human
cuugagcucagga

SEQ ID NO: 1918520 - RNA, 22 nt, Human
cuugagccuugaacuuugaccu

SEQ ID NO: 1918521 - RNA, 20 nt, Human
cuugagccuugaacuuugac

SEQ ID NO: 1918522 - RNA, 12 nt, Human
cuugaguaaaau

SEQ ID NO: 1918523 - RNA, 13 nt, Human
cuugaguaaaaua

SEQ ID NO: 1918524 - RNA, 14 nt, Human
cuugaguaaaauaa

SEQ ID NO: 1918525 - RNA, 18 nt, Human
cuugcagacucuacagag

SEQ ID NO: 1918526 - RNA, 21 nt, Human
cuugcaugaggcuaguguggu

SEQ ID NO: 1918527 - RNA, 21 nt, Human
cuugcaugguuuagaaagcuu

SEQ ID NO: 1918528 - RNA, 13 nt, Human
cuugcauauuuug

SEQ ID NO: 1918529 - RNA, 14 nt, Human
cuugcaauggcagc

SEQ ID NO: 1918530 - RNA, 19 nt, Human
cuugcacguauuuuaauag

SEQ ID NO: 1918531 - RNA, 22 nt, Human
cuugcaaaguaucccuacugua

SEQ ID NO: 1918532 - RNA, 16 nt, Human
cuugagucacaaagaa

SEQ ID NO: 1918533 - RNA, 18 nt, Human
cuugaacuccuggccuca

SEQ ID NO: 1918534 - RNA, 17 nt, Human
cuugaacuccuggccuc

SEQ ID NO: 1918535 - RNA, 15 nt, Human
cuugaacuccuggcc

SEQ ID NO: 1918536 - RNA, 14 nt, Human
cuugaacuccuggc

SEQ ID NO: 1918537 - RNA, 20 nt, Human
cuugaacccgggaggcagag

SEQ ID NO: 1918538 - RNA, 19 nt, Human
cuugaacccgggaggcaga

SEQ ID NO: 1918539 - RNA, 14 nt, Human
cuugaacccgggag

SEQ ID NO: 1918540 - RNA, 20 nt, Human
cuugaacuggguacuugugg

SEQ ID NO: 1918541 - RNA, 18 nt, Human
cuugaacuggguacuugu

SEQ ID NO: 1918542 - RNA, 15 nt, Human
cuugaacuuugaccu

SEQ ID NO: 1918543 - RNA, 16 nt, Human
cuugaacuggguacuu

SEQ ID NO: 1918544 - RNA, 19 nt, Human
cuugaacugagcuuggaag

SEQ ID NO: 1918545 - RNA, 17 nt, Human
cuugaacugagcuugga

SEQ ID NO: 1918546 - RNA, 19 nt, Human
cuugaacuccuggccucaa

SEQ ID NO: 1918547 - RNA, 20 nt, Human
cuugaaauuaagaaggcaaa

SEQ ID NO: 1918548 - RNA, 19 nt, Human
cuugaaauauaggaacuua

SEQ ID NO: 1918549 - RNA, 21 nt, Human
cuugaaauuaagaaggcaaaa

SEQ ID NO: 1918550 - RNA, 16 nt, Human
cuucuuuugauuaugu

SEQ ID NO: 1918551 - RNA, 13 nt, Human
cuucuuuugauua

SEQ ID NO: 1918552 - RNA, 14 nt, Human
cuucuuuugauuau

SEQ ID NO: 1918553 - RNA, 23 nt, Human
cuucuuuuagcaguaaaauagcu

SEQ ID NO: 1918554 - RNA, 12 nt, Human
cuucuuuuagca

SEQ ID NO: 1918555 - RNA, 17 nt, Human
cuuguauuaaagacaga

SEQ ID NO: 1918556 - RNA, 13 nt, Human
cuuguauuaaacu

SEQ ID NO: 1918557 - RNA, 23 nt, Human
cuuguauuaaacucuucacaaaa

SEQ ID NO: 1918558 - RNA, 17 nt, Human
cuuguauuaaguuguua

SEQ ID NO: 1918559 - RNA, 13 nt, Human
cuuguauuaaguu

SEQ ID NO: 1918560 - RNA, 23 nt, Human
cuuguauuaaguuguuaauaaaa

SEQ ID NO: 1918561 - RNA, 22 nt, Human
cuuguauuaaguuguuaauaaa

SEQ ID NO: 1918562 - RNA, 13 nt, Human
cuuguauuaugug

SEQ ID NO: 1918563 - RNA, 18 nt, Human
cuuguggacacagcucuu

SEQ ID NO: 1918564 - RNA, 17 nt, Human
cuuguggacacagcucu

SEQ ID NO: 1918565 - RNA, 18 nt, Human
cuuguauuauguguguuu

SEQ ID NO: 1918566 - RNA, 18 nt, Human
cuuguaaaggaauuuaaa

SEQ ID NO: 1918567 - RNA, 22 nt, Human
cuuggggaguuaagaccuggca

SEQ ID NO: 1918568 - RNA, 23 nt, Human
cuuggggaguuaagaccuggcag

SEQ ID NO: 1918569 - RNA, 16 nt, Human
cuuggggaccagagcu

SEQ ID NO: 1918570 - RNA, 17 nt, Human
cuuggggaccagagcug

SEQ ID NO: 1918571 - RNA, 18 nt, Human
cuuggggaccagagcugc

SEQ ID NO: 1918572 - RNA, 19 nt, Human
cuuggggaccagagcugcc

SEQ ID NO: 1918573 - RNA, 17 nt, Human
cuugccaaauauaaaua

SEQ ID NO: 1918574 - RNA, 14 nt, Human
cuugcauugcagag

SEQ ID NO: 1918575 - RNA, 13 nt, Human
cuugcuugcuuuu

SEQ ID NO: 1918576 - RNA, 17 nt, Human
cuugcuuuguguucuuu

SEQ ID NO: 1918577 - RNA, 15 nt, Human
cuugcuuuuaaaauc

SEQ ID NO: 1918578 - RNA, 18 nt, Human
cuugcuuuguguucuuug

SEQ ID NO: 1918579 - RNA, 19 nt, Human
cuugcuuuguguucuuugu

SEQ ID NO: 1918580 - RNA, 13 nt, Human
cuuggcugcaggg

SEQ ID NO: 1918581 - RNA, 12 nt, Human
cuuggcugcagg

SEQ ID NO: 1918582 - RNA, 14 nt, Human
cuuggcucagacau

SEQ ID NO: 1918583 - RNA, 16 nt, Human
cuuggcucagacaugu

SEQ ID NO: 1918584 - RNA, 23 nt, Human
cuuggcucaaguccucuuuucug

SEQ ID NO: 1918585 - RNA, 24 nt, Human
cuuggcucacugcaacuucugccu

SEQ ID NO: 1918586 - RNA, 12 nt, Human
cuuggcucagac

SEQ ID NO: 1918587 - RNA, 13 nt, Human
cuuggauuguccc

SEQ ID NO: 1918588 - RNA, 14 nt, Human
cuuggauugucccc

SEQ ID NO: 1918589 - RNA, 13 nt, Human
cuuggagccugca

SEQ ID NO: 1918590 - RNA, 18 nt, Human
cuuggagccugcagagcu

SEQ ID NO: 1918591 - RNA, 17 nt, Human
cuuggagccugcagagc

SEQ ID NO: 1918592 - RNA, 16 nt, Human
cuuggagccugcagag

SEQ ID NO: 1918593 - RNA, 15 nt, Human
cuuggagccugcaga

SEQ ID NO: 1918594 - RNA, 20 nt, Human
cuuggagccugcagagcugc

SEQ ID NO: 1918595 - RNA, 19 nt, Human
cuuggagccugcagagcug

SEQ ID NO: 1918596 - RNA, 22 nt, Human
gaagaacaucuuuaugguaaag

SEQ ID NO: 1918597 - RNA, 13 nt, Human
gaagaaccagucc

SEQ ID NO: 1918598 - RNA, 18 nt, Human
gaagaacacccucuaaau

SEQ ID NO: 1918599 - RNA, 22 nt, Human
gaacuuugaccucugcagcaau

SEQ ID NO: 1918600 - RNA, 16 nt, Human
gaacuuugaccucugc

SEQ ID NO: 1918601 - RNA, 14 nt, Human
gaacuuuauuucca

SEQ ID NO: 1918602 - RNA, 22 nt, Human
gaacuuguaaaggaauuuaaaa

SEQ ID NO: 1918603 - RNA, 22 nt, Human
gaacuuggggaguuaagaccug

SEQ ID NO: 1918604 - RNA, 18 nt, Human
gaacuuggcgcugccccu

SEQ ID NO: 1918605 - RNA, 17 nt, Human
gaacuugggccacugug

SEQ ID NO: 1918606 - RNA, 17 nt, Human
gaacuuuccaggaaggc

SEQ ID NO: 1918607 - RNA, 23 nt, Human
gaacuuucauuuuuuuccaggcu

SEQ ID NO: 1918608 - RNA, 14 nt, Human
gaacuuucauuuuu

SEQ ID NO: 1918609 - RNA, 24 nt, Human
gaacuuuccacauucagagcuuac

SEQ ID NO: 1918610 - RNA, 12 nt, Human
gaacuugguucc

SEQ ID NO: 1918611 - RNA, 13 nt, Human
gaacuuucauuuu

SEQ ID NO: 1918612 - RNA, 12 nt, Human
gaacuuucauuu

SEQ ID NO: 1918613 - RNA, 18 nt, Human
gaaccacaucuugcucug

SEQ ID NO: 1918614 - RNA, 20 nt, Human
gaaccacaucuugcucugcu

SEQ ID NO: 1918615 - RNA, 20 nt, Human
gaacuguguuucaaguucaa

SEQ ID NO: 1918616 - RNA, 16 nt, Human
gaacucccuuucaaca

SEQ ID NO: 1918617 - RNA, 17 nt, Human
gaacuuaaauaauguga

SEQ ID NO: 1918618 - RNA, 14 nt, Human
gaacuuaaauaaug

SEQ ID NO: 1918619 - RNA, 17 nt, Human
gaacuuggcgcugcccc

SEQ ID NO: 1918620 - RNA, 19 nt, Human
gaagaucucugcagggccg

SEQ ID NO: 1918621 - RNA, 22 nt, Human
gaagaucucugcagggccgcca

SEQ ID NO: 1918622 - RNA, 21 nt, Human
gaagaguguggagucauucuc

SEQ ID NO: 1918623 - RNA, 23 nt, Human
gaagauuuugaaauuuuuauuaa

SEQ ID NO: 1918624 - RNA, 17 nt, Human
gaagauugagauguguu

SEQ ID NO: 1918625 - RNA, 22 nt, Human
gaagauugagauguguucacaa

SEQ ID NO: 1918626 - RNA, 17 nt, Human
gaagauguagaggagaa

SEQ ID NO: 1918627 - RNA, 21 nt, Human
gaagauucuucccauucucca

SEQ ID NO: 1918628 - RNA, 22 nt, Human
gaagauucuucccauucuccau

SEQ ID NO: 1918629 - RNA, 15 nt, Human
gaagacuucaucccu

SEQ ID NO: 1918630 - RNA, 16 nt, Human
gaagacuucaucccuc

SEQ ID NO: 1918631 - RNA, 13 nt, Human
gaagaaguguguc

SEQ ID NO: 1918632 - RNA, 12 nt, Human
gaagagccuugc

SEQ ID NO: 1918633 - RNA, 17 nt, Human
gaagacuucaucccucu

SEQ ID NO: 1918634 - RNA, 19 nt, Human
gaagacuucaucccucugg

SEQ ID NO: 1918635 - RNA, 14 nt, Human
gaagaguccucuga

SEQ ID NO: 1918636 - RNA, 16 nt, Human
gaagaguccucugaau

SEQ ID NO: 1918637 - RNA, 22 nt, Human
gaagcuuauuaaugcuaagggc

SEQ ID NO: 1918638 - RNA, 22 nt, Human
gaagcuucuggugaccuuccaa

SEQ ID NO: 1918639 - RNA, 15 nt, Human
gaaggaacguccccu

SEQ ID NO: 1918640 - RNA, 21 nt, Human
gaaggaaacccagcucugguc

SEQ ID NO: 1918641 - RNA, 22 nt, Human
gaaggaaacccagcucuggucc

SEQ ID NO: 1918642 - RNA, 19 nt, Human
gaaggaagacuucaucccu

SEQ ID NO: 1918643 - RNA, 23 nt, Human
gaaggaaccaaagcgaauuuuaa

SEQ ID NO: 1918644 - RNA, 21 nt, Human
gaaggacauugcggacagcca

SEQ ID NO: 1918645 - RNA, 20 nt, Human
gaaggacauugcggacagcc

SEQ ID NO: 1918646 - RNA, 19 nt, Human
gaaggacauugcggacagc

SEQ ID NO: 1918647 - RNA, 18 nt, Human
gaagccuuaccacgcagu

SEQ ID NO: 1918648 - RNA, 17 nt, Human
gaagccuuaccacgcag

SEQ ID NO: 1918649 - RNA, 23 nt, Human
gaagcuuauuaaugcuaagggca

SEQ ID NO: 1918650 - RNA, 21 nt, Human
gaagcuuauuaaugcuaaggg

SEQ ID NO: 1918651 - RNA, 20 nt, Human
gaagcuuauuaaugcuaagg

SEQ ID NO: 1918652 - RNA, 19 nt, Human
gaagcuuauuaaugcuaag

SEQ ID NO: 1918653 - RNA, 17 nt, Human
gaagcuuauuaaugcua

SEQ ID NO: 1918654 - RNA, 16 nt, Human
gaagcuuauuaaugcu

SEQ ID NO: 1918655 - RNA, 15 nt, Human
gaagcuuauuaaugc

SEQ ID NO: 1918656 - RNA, 14 nt, Human
gaagcuuauuaaug

SEQ ID NO: 1918657 - RNA, 19 nt, Human
gaaggaaacccagcucugg

SEQ ID NO: 1918658 - RNA, 20 nt, Human
gaaggaaacccagcucuggu

SEQ ID NO: 1918659 - RNA, 21 nt, Human
gaagccgcuggggccaguugg

SEQ ID NO: 1918660 - RNA, 18 nt, Human
gaagccgcuggggccagu

SEQ ID NO: 1918661 - RNA, 20 nt, Human
gaagccgcuggggccaguug

SEQ ID NO: 1918662 - RNA, 14 nt, Human
gaagccgcuggggc

SEQ ID NO: 1918663 - RNA, 13 nt, Human
gaagccaaagagu

SEQ ID NO: 1918664 - RNA, 13 nt, Human
gaagggggcuggg

SEQ ID NO: 1918665 - RNA, 21 nt, Human
gaaggggcgucuguucccccu

SEQ ID NO: 1918666 - RNA, 15 nt, Human
gaagggggcugggac

SEQ ID NO: 1918667 - RNA, 13 nt, Human
gaagucacacagu

SEQ ID NO: 1918668 - RNA, 21 nt, Human
gaaguaauaugcacacauuuu

SEQ ID NO: 1918669 - RNA, 20 nt, Human
gaaguaauaugcacacauuu

SEQ ID NO: 1918670 - RNA, 19 nt, Human
gaaguaauaugcacacauu

SEQ ID NO: 1918671 - RNA, 21 nt, Human
gaaggugaggagcuugaaacc

SEQ ID NO: 1918672 - RNA, 21 nt, Human
gaagucacauuccugaacagg

SEQ ID NO: 1918673 - RNA, 20 nt, Human
gaagucacauuccugaacag

SEQ ID NO: 1918674 - RNA, 16 nt, Human
gaagucacauuccuga

SEQ ID NO: 1918675 - RNA, 14 nt, Human
gaaguccaaugugg

SEQ ID NO: 1918676 - RNA, 17 nt, Human
gaaguccaauguggcaa

SEQ ID NO: 1918677 - RNA, 18 nt, Human
gaagucuuagauguauau

SEQ ID NO: 1918678 - RNA, 15 nt, Human
gaaccaacacuaaca

SEQ ID NO: 1918679 - RNA, 20 nt, Human
gaacauguagaaaacaaaau

SEQ ID NO: 1918680 - RNA, 19 nt, Human
gaacaugugagagguuuga

SEQ ID NO: 1918681 - RNA, 23 nt, Human
gaaccaaagcgaauuuuaaaaga

SEQ ID NO: 1918682 - RNA, 20 nt, Human
gaaccaaagcgaauuuuaaa

SEQ ID NO: 1918683 - RNA, 22 nt, Human
gaacaguuguguuugaagcaca

SEQ ID NO: 1918684 - RNA, 22 nt, Human
gaacagacuggaagcacagcuu

SEQ ID NO: 1918685 - RNA, 17 nt, Human
gaacaggauauucucac

SEQ ID NO: 1918686 - RNA, 20 nt, Human
gaacaguuguguuugaagca

SEQ ID NO: 1918687 - RNA, 19 nt, Human
gaacagacuggaagcacag

SEQ ID NO: 1918688 - RNA, 20 nt, Human
gaacagacuggaagcacagc

SEQ ID NO: 1918689 - RNA, 17 nt, Human
gaacacuccuucacaga

SEQ ID NO: 1918690 - RNA, 15 nt, Human
gaacacuccuucaca

SEQ ID NO: 1918691 - RNA, 16 nt, Human
gaacacuccuucacag

SEQ ID NO: 1918692 - RNA, 21 nt, Human
gaaauuuccugggagcuuuug

SEQ ID NO: 1918693 - RNA, 19 nt, Human
gaaauuuccacucaggucu

SEQ ID NO: 1918694 - RNA, 20 nt, Human
gaaauuuccacucaggucug

SEQ ID NO: 1918695 - RNA, 23 nt, Human
gaaauucaacguuaauaauucug

SEQ ID NO: 1918696 - RNA, 19 nt, Human
gaaauucaacguuaauaau

SEQ ID NO: 1918697 - RNA, 23 nt, Human
gaaauuaguacuccccuccuuga

SEQ ID NO: 1918698 - RNA, 14 nt, Human
gaaauuaggaugua

SEQ ID NO: 1918699 - RNA, 20 nt, Human
gaaauaucugaaaauguaug

SEQ ID NO: 1918700 - RNA, 18 nt, Human
gaaauaucugaaaaugua

SEQ ID NO: 1918701 - RNA, 19 nt, Human
gaaauaucugaaaauguau

SEQ ID NO: 1918702 - RNA, 17 nt, Human
gaaauauaggaacuuaa

SEQ ID NO: 1918703 - RNA, 17 nt, Human
gaaauaaaggaugugau

SEQ ID NO: 1918704 - RNA, 21 nt, Human
gaaauaaacgucuuaaauauu

SEQ ID NO: 1918705 - RNA, 18 nt, Human
gaaauaaacgucuuaaau

SEQ ID NO: 1918706 - RNA, 17 nt, Human
gaaauaaacgucuuaaa

SEQ ID NO: 1918707 - RNA, 16 nt, Human
gaaauaaacgucuuaa

SEQ ID NO: 1918708 - RNA, 14 nt, Human
gaaauaaacgucuu

SEQ ID NO: 1918709 - RNA, 23 nt, Human
gaaauaaaaggaagccaaagagu

SEQ ID NO: 1918710 - RNA, 20 nt, Human
gaaauaaaggaugugauugu

SEQ ID NO: 1918711 - RNA, 16 nt, Human
gaaaugggcagagcag

SEQ ID NO: 1918712 - RNA, 15 nt, Human
gaaaugggcagagca

SEQ ID NO: 1918713 - RNA, 18 nt, Human
gaaaugaggucagagccu

SEQ ID NO: 1918714 - RNA, 14 nt, Human
gaaaugcaaaaauc

SEQ ID NO: 1918715 - RNA, 17 nt, Human
gaaaugcaaaaaucucu

SEQ ID NO: 1918716 - RNA, 11 nt, Human
gaaaugagcug

SEQ ID NO: 1918717 - RNA, 20 nt, Human
gaaaugagaggcauuucccc

SEQ ID NO: 1918718 - RNA, 17 nt, Human
gaaauguacagcaagga

SEQ ID NO: 1918719 - RNA, 17 nt, Human
gaaaugggcagagcaga

SEQ ID NO: 1918720 - RNA, 19 nt, Human
gaaaugggcagagcagaga

SEQ ID NO: 1918721 - RNA, 22 nt, Human
gaaagucuugugacuagugcug

SEQ ID NO: 1918722 - RNA, 21 nt, Human
gaaagucuugugacuagugcu

SEQ ID NO: 1918723 - RNA, 20 nt, Human
gaaagucuugugacuagugc

SEQ ID NO: 1918724 - RNA, 16 nt, Human
gaaagugaaaguccag

SEQ ID NO: 1918725 - RNA, 19 nt, Human
gaaagucuugugacuagug

SEQ ID NO: 1918726 - RNA, 16 nt, Human
gaaagugccagaaagu

SEQ ID NO: 1918727 - RNA, 20 nt, Human
gaaaguuuccccaccaguga

SEQ ID NO: 1918728 - RNA, 22 nt, Human
gaaaguuuggggacaugugauu

SEQ ID NO: 1918729 - RNA, 23 nt, Human
gaaaguuuccccaccagugaaug

SEQ ID NO: 1918730 - RNA, 16 nt, Human
gaaauaaaaggaagcc

SEQ ID NO: 1918731 - RNA, 17 nt, Human
gaaauaaaaggaagcca

SEQ ID NO: 1918732 - RNA, 18 nt, Human
gaaauaaaaggaagccaa

SEQ ID NO: 1918733 - RNA, 19 nt, Human
gaaauaaaaggaagccaaa

SEQ ID NO: 1918734 - RNA, 11 nt, Human
gaaaguuuccc

SEQ ID NO: 1918735 - RNA, 13 nt, Human
gaaaguucaugcu

SEQ ID NO: 1918736 - RNA, 11 nt, Human
gaaaggaaaga

SEQ ID NO: 1918737 - RNA, 16 nt, Human
gaaaggaaagaggcuc

SEQ ID NO: 1918738 - RNA, 21 nt, Human
gaaagcuugcccuggugccuc

SEQ ID NO: 1918739 - RNA, 19 nt, Human
gaaaggagccuaggccagg

SEQ ID NO: 1918740 - RNA, 22 nt, Human
gaaaggagccuaggccaggugc

SEQ ID NO: 1918741 - RNA, 20 nt, Human
gaaacuaggugcauauuuau

SEQ ID NO: 1918742 - RNA, 14 nt, Human
gaaacgcagacacu

SEQ ID NO: 1918743 - RNA, 20 nt, Human
gaaacgaagccaucuuucuu

SEQ ID NO: 1918744 - RNA, 16 nt, Human
gaaaaaugagccuggc

SEQ ID NO: 1918745 - RNA, 22 nt, Human
gaaaaagaaaugcaaaaaucuc

SEQ ID NO: 1918746 - RNA, 13 nt, Human
gaaaaagaaaugc

SEQ ID NO: 1918747 - RNA, 14 nt, Human
gaaaaagaaaugca

SEQ ID NO: 1918748 - RNA, 11 nt, Human
gaaaaauggag

SEQ ID NO: 1918749 - RNA, 14 nt, Human
gaaagauaacuagg

SEQ ID NO: 1918750 - RNA, 16 nt, Human
gaaagaucaaaagguu

SEQ ID NO: 1918751 - RNA, 14 nt, Human
gaaagcaaagggcu

SEQ ID NO: 1918752 - RNA, 14 nt, Human
gaaagcagaacagu

SEQ ID NO: 1918753 - RNA, 13 nt, Human
gaaagcagaacag

SEQ ID NO: 1918754 - RNA, 15 nt, Human
gagccgggccgcaga

SEQ ID NO: 1918755 - RNA, 14 nt, Human
gagccgggccgcag

SEQ ID NO: 1918756 - RNA, 22 nt, Human
gagccgagaucacgccacugca

SEQ ID NO: 1918757 - RNA, 21 nt, Human
gagccgagaucacgccacugc

SEQ ID NO: 1918758 - RNA, 20 nt, Human
gagccgagaucacgccacug

SEQ ID NO: 1918759 - RNA, 19 nt, Human
gagccgagaucacgccacu

SEQ ID NO: 1918760 - RNA, 11 nt, Human
gagcccacugu

SEQ ID NO: 1918761 - RNA, 18 nt, Human
gagcccacuguacuugcu

SEQ ID NO: 1918762 - RNA, 21 nt, Human
gagcccacuguacuugcucuu

SEQ ID NO: 1918763 - RNA, 18 nt, Human
gagcccacgcccccacug

SEQ ID NO: 1918764 - RNA, 15 nt, Human
gagccucagcauccu

SEQ ID NO: 1918765 - RNA, 14 nt, Human
gagccucagcaucc

SEQ ID NO: 1918766 - RNA, 17 nt, Human
gagccucagcauccugg

SEQ ID NO: 1918767 - RNA, 13 nt, Human
gagccucagcauc

SEQ ID NO: 1918768 - RNA, 14 nt, Human
gagccuaggccagg

SEQ ID NO: 1918769 - RNA, 15 nt, Human
gagccuaggccaggu

SEQ ID NO: 1918770 - RNA, 17 nt, Human
gagccuaggccaggugc

SEQ ID NO: 1918771 - RNA, 16 nt, Human
gagccuaggccaggug

SEQ ID NO: 1918772 - RNA, 17 nt, Human
gagccuacccaccccca

SEQ ID NO: 1918773 - RNA, 15 nt, Human
gagccuacccacccc

SEQ ID NO: 1918774 - RNA, 12 nt, Human
gagccugcaguu

SEQ ID NO: 1918775 - RNA, 17 nt, Human
gagccucugcuccccag

SEQ ID NO: 1918776 - RNA, 13 nt, Human
gagccuccugccc

SEQ ID NO: 1918777 - RNA, 15 nt, Human
gagccucccugccuc

SEQ ID NO: 1918778 - RNA, 19 nt, Human
gagccucccugccucaggc

SEQ ID NO: 1918779 - RNA, 16 nt, Human
gagccucugcucccca

SEQ ID NO: 1918780 - RNA, 12 nt, Human
gagccucccugc

SEQ ID NO: 1918781 - RNA, 13 nt, Human
gagccucccugcc

SEQ ID NO: 1918782 - RNA, 14 nt, Human
gagccucccugccu

SEQ ID NO: 1918783 - RNA, 20 nt, Human
gagauagccaaggccaaagg

SEQ ID NO: 1918784 - RNA, 21 nt, Human
gagauagccaaggccaaagga

SEQ ID NO: 1918785 - RNA, 17 nt, Human
gagcagagaccaucccu

SEQ ID NO: 1918786 - RNA, 18 nt, Human
gagcagagaccaucccug

SEQ ID NO: 1918787 - RNA, 16 nt, Human
gagcagagaccauccc

SEQ ID NO: 1918788 - RNA, 19 nt, Human
gagauagccaaggccaaag

SEQ ID NO: 1918789 - RNA, 22 nt, Human
gagcagccacauuccugaugcu

SEQ ID NO: 1918790 - RNA, 21 nt, Human
gagcagccacauuccugaugc

SEQ ID NO: 1918791 - RNA, 22 nt, Human
gagcagagaucacaccacugca

SEQ ID NO: 1918792 - RNA, 23 nt, Human
gagcagagaccaucccugaaggc

SEQ ID NO: 1918793 - RNA, 20 nt, Human
gagcagagaucacaccacug

SEQ ID NO: 1918794 - RNA, 19 nt, Human
gagcagagaccaucccuga

SEQ ID NO: 1918795 - RNA, 21 nt, Human
gagcagagaccaucccugaag

SEQ ID NO: 1918796 - RNA, 20 nt, Human
gagccacugcaccgggccac

SEQ ID NO: 1918797 - RNA, 15 nt, Human
gagccagauuucacu

SEQ ID NO: 1918798 - RNA, 18 nt, Human
gagccagauuucacucuc

SEQ ID NO: 1918799 - RNA, 19 nt, Human
gagccagauuucacucucc

SEQ ID NO: 1918800 - RNA, 19 nt, Human
gagccacugcaccgggcca

SEQ ID NO: 1918801 - RNA, 18 nt, Human
gagccacugcaccgggcc

SEQ ID NO: 1918802 - RNA, 17 nt, Human
gagcccaccuuggcuca

SEQ ID NO: 1918803 - RNA, 15 nt, Human
gagcccaccuuggcu

SEQ ID NO: 1918804 - RNA, 13 nt, Human
gagcccaccuugg

SEQ ID NO: 1918805 - RNA, 13 nt, Human
gagccagauuuca

SEQ ID NO: 1918806 - RNA, 13 nt, Human
gagccagcucccu

SEQ ID NO: 1918807 - RNA, 18 nt, Human
gagccagcucccucuauu

SEQ ID NO: 1918808 - RNA, 12 nt, Human
gagcuagccaga

SEQ ID NO: 1918809 - RNA, 13 nt, Human
gagcuagccagag

SEQ ID NO: 1918810 - RNA, 14 nt, Human
gagcuagccagagg

SEQ ID NO: 1918811 - RNA, 15 nt, Human
gagcuagccagagga

SEQ ID NO: 1918812 - RNA, 18 nt, Human
gagcuagccagaggacug

SEQ ID NO: 1918813 - RNA, 15 nt, Human
gagcuagcagcaggg

SEQ ID NO: 1918814 - RNA, 17 nt, Human
gagcuagcagcagggag

SEQ ID NO: 1918815 - RNA, 15 nt, Human
gagccugcaguuauu

SEQ ID NO: 1918816 - RNA, 13 nt, Human
gagcuauugcugu

SEQ ID NO: 1918817 - RNA, 21 nt, Human
gagcucccaggugcagccaga

SEQ ID NO: 1918818 - RNA, 16 nt, Human
gagcucccaggugcag

SEQ ID NO: 1918819 - RNA, 20 nt, Human
gagcucccaggugcagccag

SEQ ID NO: 1918820 - RNA, 21 nt, Human
gagcucuuggaggugucugua

SEQ ID NO: 1918821 - RNA, 15 nt, Human
gagcugaguggggga

SEQ ID NO: 1918822 - RNA, 17 nt, Human
gagcugaggcaauucua

SEQ ID NO: 1918823 - RNA, 17 nt, Human
gagcugaggccacacuc

SEQ ID NO: 1918824 - RNA, 14 nt, Human
gagcucuuugcacu

SEQ ID NO: 1918825 - RNA, 14 nt, Human
gaggaacaaggcaa

SEQ ID NO: 1918826 - RNA, 16 nt, Human
gaggaacaaggcaagg

SEQ ID NO: 1918827 - RNA, 23 nt, Human
gaggaagaacggggcucuucuca

SEQ ID NO: 1918828 - RNA, 19 nt, Human
gaggaagaacggggcucuu

SEQ ID NO: 1918829 - RNA, 17 nt, Human
gaggaagagaaaaaaua

SEQ ID NO: 1918830 - RNA, 13 nt, Human
gaggaagccgcug

SEQ ID NO: 1918831 - RNA, 14 nt, Human
gaggaagccgcugg

SEQ ID NO: 1918832 - RNA, 17 nt, Human
gaggaagccgcuggggc

SEQ ID NO: 1918833 - RNA, 18 nt, Human
gaggaagccgcuggggcc

SEQ ID NO: 1918834 - RNA, 16 nt, Human
gaggaaagcaaaggag

SEQ ID NO: 1918835 - RNA, 17 nt, Human
gaggaaagcaaaggaga

SEQ ID NO: 1918836 - RNA, 18 nt, Human
gaggaaacaacagcuuua

SEQ ID NO: 1918837 - RNA, 22 nt, Human
gaggaaaaguaaccaucacugg

SEQ ID NO: 1918838 - RNA, 22 nt, Human
gaggaaaaaaaucguccaggga

SEQ ID NO: 1918839 - RNA, 14 nt, Human
gagcuuuuguagaa

SEQ ID NO: 1918840 - RNA, 20 nt, Human
gagcuuugaaaauucagugg

SEQ ID NO: 1918841 - RNA, 22 nt, Human
gagcuuucugcuaucaaagagg

SEQ ID NO: 1918842 - RNA, 22 nt, Human
gagcuugaaacccguggcgcuu

SEQ ID NO: 1918843 - RNA, 18 nt, Human
gagacaaggagggcacag

SEQ ID NO: 1918844 - RNA, 11 nt, Human
gagacacagga

SEQ ID NO: 1918845 - RNA, 17 nt, Human
gagacacaggaugaagc

SEQ ID NO: 1918846 - RNA, 18 nt, Human
gagacacaggaugaagca

SEQ ID NO: 1918847 - RNA, 15 nt, Human
gagacacaagccuuc

SEQ ID NO: 1918848 - RNA, 17 nt, Human
gagacacaagccuucgg

SEQ ID NO: 1918849 - RNA, 18 nt, Human
gagaauugcuugaaccca

SEQ ID NO: 1918850 - RNA, 14 nt, Human
gagaauugggggcu

SEQ ID NO: 1918851 - RNA, 19 nt, Human
gagacagaguuuucacucu

SEQ ID NO: 1918852 - RNA, 16 nt, Human
gagacagccaacuaug

SEQ ID NO: 1918853 - RNA, 12 nt, Human
gagacagcccgg

SEQ ID NO: 1918854 - RNA, 16 nt, Human
gagacacggagcccag

SEQ ID NO: 1918855 - RNA, 22 nt, Human
gagaaugcacaaacagaggccg

SEQ ID NO: 1918856 - RNA, 20 nt, Human
gagaaugcacaaacagaggc

SEQ ID NO: 1918857 - RNA, 21 nt, Human
gagaaugcacaaacagaggcc

SEQ ID NO: 1918858 - RNA, 12 nt, Human
gagaagccagga

SEQ ID NO: 1918859 - RNA, 22 nt, Human
gagaagccagcuuuccucauca

SEQ ID NO: 1918860 - RNA, 22 nt, Human
gagaagccaggaauuucccagg

SEQ ID NO: 1918861 - RNA, 23 nt, Human
gagaagccaggaauuucccagga

SEQ ID NO: 1918862 - RNA, 23 nt, Human
gagaagauucuucccauucucca

SEQ ID NO: 1918863 - RNA, 19 nt, Human
gacuugugacgguguaccu

SEQ ID NO: 1918864 - RNA, 15 nt, Human
gacuccggcccuccu

SEQ ID NO: 1918865 - RNA, 21 nt, Human
gagaaaauggacguguuauga

SEQ ID NO: 1918866 - RNA, 16 nt, Human
gacuuggaagcuccgc

SEQ ID NO: 1918867 - RNA, 15 nt, Human
gacuuggaagcuccg

SEQ ID NO: 1918868 - RNA, 14 nt, Human
gacuuggaagcucc

SEQ ID NO: 1918869 - RNA, 19 nt, Human
gacucgcgacaaugcaaac

SEQ ID NO: 1918870 - RNA, 14 nt, Human
gacuccggcccucc

SEQ ID NO: 1918871 - RNA, 17 nt, Human
gacuccugcaggcagcc

SEQ ID NO: 1918872 - RNA, 18 nt, Human
gacucgcgacaaugcaaa

SEQ ID NO: 1918873 - RNA, 16 nt, Human
gagaaacagccugugu

SEQ ID NO: 1918874 - RNA, 21 nt, Human
gagaaaccuuauuguaccucu

SEQ ID NO: 1918875 - RNA, 23 nt, Human
gagaaaccuuauuguaccucucu

SEQ ID NO: 1918876 - RNA, 23 nt, Human
gagaaaguacuucuccacccugc

SEQ ID NO: 1918877 - RNA, 20 nt, Human
gagaaauauggacacuuaau

SEQ ID NO: 1918878 - RNA, 23 nt, Human
gagaaauaaaguuugcuuagaaa

SEQ ID NO: 1918879 - RNA, 14 nt, Human
gagaaauuuauaaa

SEQ ID NO: 1918880 - RNA, 17 nt, Human
gagaacaaacagaucga

SEQ ID NO: 1918881 - RNA, 19 nt, Human
gagagccuggugcugcugc

SEQ ID NO: 1918882 - RNA, 19 nt, Human
gagagggaggcaagcccug

SEQ ID NO: 1918883 - RNA, 17 nt, Human
gagagccuggugcugcu

SEQ ID NO: 1918884 - RNA, 13 nt, Human
gagagccuggugc

SEQ ID NO: 1918885 - RNA, 23 nt, Human
gagagggccgggcagaggggcag

SEQ ID NO: 1918886 - RNA, 13 nt, Human
gagagccuuccag

SEQ ID NO: 1918887 - RNA, 14 nt, Human
gagagccuuccagg

SEQ ID NO: 1918888 - RNA, 18 nt, Human
gagaggggaacagacugg

SEQ ID NO: 1918889 - RNA, 13 nt, Human
gagaggggaacag

SEQ ID NO: 1918890 - RNA, 21 nt, Human
gagagggugggagugggccca

SEQ ID NO: 1918891 - RNA, 17 nt, Human
gagauacagaauuuuau

SEQ ID NO: 1918892 - RNA, 19 nt, Human
gagagugaacaaauuuaca

SEQ ID NO: 1918893 - RNA, 14 nt, Human
gagaguuuccugaa

SEQ ID NO: 1918894 - RNA, 15 nt, Human
gagagugagguggaa

SEQ ID NO: 1918895 - RNA, 15 nt, Human
gagagugaacaaauu

SEQ ID NO: 1918896 - RNA, 17 nt, Human
gagagaagagaaugcac

SEQ ID NO: 1918897 - RNA, 18 nt, Human
gagagaaaacagaccuaa

SEQ ID NO: 1918898 - RNA, 22 nt, Human
gagagaaaacagaccuaaugcu

SEQ ID NO: 1918899 - RNA, 23 nt, Human
gagagaaaacagaccuaaugcuc

SEQ ID NO: 1918900 - RNA, 18 nt, Human
gagagaggcaauggcucc

SEQ ID NO: 1918901 - RNA, 14 nt, Human
gagacucugucuca

SEQ ID NO: 1918902 - RNA, 12 nt, Human
gagaccaucccu

SEQ ID NO: 1918903 - RNA, 16 nt, Human
gagaccagggagccuu

SEQ ID NO: 1918904 - RNA, 13 nt, Human
gagaccagccugg

SEQ ID NO: 1918905 - RNA, 14 nt, Human
gagaccagccuggc

SEQ ID NO: 1918906 - RNA, 16 nt, Human
gagacucgcgacaaug

SEQ ID NO: 1918907 - RNA, 18 nt, Human
gagacucgcgacaaugca

SEQ ID NO: 1918908 - RNA, 22 nt, Human
gagacuccugcaggcagccagg

SEQ ID NO: 1918909 - RNA, 14 nt, Human
gagacucgagaacu

SEQ ID NO: 1918910 - RNA, 20 nt, Human
gagacucgagaacuuucauu

SEQ ID NO: 1918911 - RNA, 17 nt, Human
gagacucgagaacuuuc

SEQ ID NO: 1918912 - RNA, 16 nt, Human
gagacucgagaacuuu

SEQ ID NO: 1918913 - RNA, 15 nt, Human
gagacucgagaacuu

SEQ ID NO: 1918914 - RNA, 14 nt, Human
gagacagcccgggc

SEQ ID NO: 1918915 - RNA, 17 nt, Human
gagacagcccgggcucu

SEQ ID NO: 1918916 - RNA, 18 nt, Human
gagacagcccgggcucug

SEQ ID NO: 1918917 - RNA, 19 nt, Human
gagacagcccgggcucugc

SEQ ID NO: 1918918 - RNA, 20 nt, Human
gagacagcccgggcucugcc

SEQ ID NO: 1918919 - RNA, 21 nt, Human
gagacagcccgggcucugccu

SEQ ID NO: 1918920 - RNA, 22 nt, Human
gagacagcccgggcucugccuc

SEQ ID NO: 1918921 - RNA, 23 nt, Human
gagacagcccgggcucugccucc

SEQ ID NO: 1918922 - RNA, 24 nt, Human
gagacagcccgggcucugccuccc

SEQ ID NO: 1918923 - RNA, 13 nt, Human
gagacagcucugc

SEQ ID NO: 1918924 - RNA, 18 nt, Human
gagacagcucugcauacu

SEQ ID NO: 1918925 - RNA, 15 nt, Human
gagacagcucugcau

SEQ ID NO: 1918926 - RNA, 15 nt, Human
gagacauacuugaag

SEQ ID NO: 1918927 - RNA, 18 nt, Human
gagacauacuugaagggc

SEQ ID NO: 1918928 - RNA, 20 nt, Human
gagacauacuugaagggcca

SEQ ID NO: 1918929 - RNA, 21 nt, Human
gagacauacuugaagggccag

SEQ ID NO: 1918930 - RNA, 22 nt, Human
gacacauaugcaccuugugucu

SEQ ID NO: 1918931 - RNA, 16 nt, Human
gacacauaugaggggg

SEQ ID NO: 1918932 - RNA, 15 nt, Human
gacacauaugagggg

SEQ ID NO: 1918933 - RNA, 13 nt, Human
gacacccccucgc

SEQ ID NO: 1918934 - RNA, 12 nt, Human
gacacccuguga

SEQ ID NO: 1918935 - RNA, 13 nt, Human
gacacccugugau

SEQ ID NO: 1918936 - RNA, 12 nt, Human
gacacaggccug

SEQ ID NO: 1918937 - RNA, 17 nt, Human
gacacaggcccucccug

SEQ ID NO: 1918938 - RNA, 18 nt, Human
gacacaggcccggcucca

SEQ ID NO: 1918939 - RNA, 22 nt, Human
gacacaggucuuuccuaaggcu

SEQ ID NO: 1918940 - RNA, 16 nt, Human
gacacaggucuuuccu

SEQ ID NO: 1918941 - RNA, 17 nt, Human
gacacaggucuuuccua

SEQ ID NO: 1918942 - RNA, 13 nt, Human
gacacccucaacc

SEQ ID NO: 1918943 - RNA, 22 nt, Human
gacacccugugauggggcccug

SEQ ID NO: 1918944 - RNA, 23 nt, Human
gacacccugugauggggcccugc

SEQ ID NO: 1918945 - RNA, 18 nt, Human
gacacuaaccacgcugga

SEQ ID NO: 1918946 - RNA, 17 nt, Human
gacacuaaccacgcugg

SEQ ID NO: 1918947 - RNA, 16 nt, Human
gacacuaaccacgcug

SEQ ID NO: 1918948 - RNA, 15 nt, Human
gacacuaaccacgcu

SEQ ID NO: 1918949 - RNA, 19 nt, Human
gacacgaauauugcugaug

SEQ ID NO: 1918950 - RNA, 12 nt, Human
gacaccuuucau

SEQ ID NO: 1918951 - RNA, 17 nt, Human
gacacgaauauugcuga

SEQ ID NO: 1918952 - RNA, 18 nt, Human
gacacgaauauugcugau

SEQ ID NO: 1918953 - RNA, 17 nt, Human
gacaccuugacagggca

SEQ ID NO: 1918954 - RNA, 15 nt, Human
gacaccuugacaggg

SEQ ID NO: 1918955 - RNA, 20 nt, Human
gacaccuugacagggcacac

SEQ ID NO: 1918956 - RNA, 18 nt, Human
gacaccuugacagggcac

SEQ ID NO: 1918957 - RNA, 15 nt, Human
gacacgaauauugcu

SEQ ID NO: 1918958 - RNA, 22 nt, Human
gacaaggauugcuacuguccua

SEQ ID NO: 1918959 - RNA, 14 nt, Human
gaagucuuuguaca

SEQ ID NO: 1918960 - RNA, 16 nt, Human
gaagucuuuguacaga

SEQ ID NO: 1918961 - RNA, 16 nt, Human
gacaaugacccagugg

SEQ ID NO: 1918962 - RNA, 20 nt, Human
gacaaguggacucagggcag

SEQ ID NO: 1918963 - RNA, 15 nt, Human
gacaaguggacucag

SEQ ID NO: 1918964 - RNA, 17 nt, Human
gacacaggcccggcucc

SEQ ID NO: 1918965 - RNA, 15 nt, Human
gacacaggcccggcu

SEQ ID NO: 1918966 - RNA, 13 nt, Human
gacacacagcucu

SEQ ID NO: 1918967 - RNA, 19 nt, Human
gacaauuuauuauggcaca

SEQ ID NO: 1918968 - RNA, 13 nt, Human
gacaauuuauuau

SEQ ID NO: 1918969 - RNA, 22 nt, Human
gacacaagccuucggcgccuua

SEQ ID NO: 1918970 - RNA, 22 nt, Human
gacacaaguggaccuuaggccu

SEQ ID NO: 1918971 - RNA, 12 nt, Human
gacaauuuauua

SEQ ID NO: 1918972 - RNA, 16 nt, Human
gacaaugcaaaccauc

SEQ ID NO: 1918973 - RNA, 18 nt, Human
gacaaugcaaaccaucau

SEQ ID NO: 1918974 - RNA, 21 nt, Human
gacaaugacuuacuguacaug

SEQ ID NO: 1918975 - RNA, 12 nt, Human
gacaaugcaaac

SEQ ID NO: 1918976 - RNA, 20 nt, Human
gacaaugacuuacuguacau

SEQ ID NO: 1918977 - RNA, 17 nt, Human
gacaaugacuuacugua

SEQ ID NO: 1918978 - RNA, 21 nt, Human
gacaggagaccuggcacugga

SEQ ID NO: 1918979 - RNA, 18 nt, Human
gacaggagaccuggcacu

SEQ ID NO: 1918980 - RNA, 22 nt, Human
gacagcuucucauccugcaggc

SEQ ID NO: 1918981 - RNA, 21 nt, Human
gacagcuucucauccugcagg

SEQ ID NO: 1918982 - RNA, 14 nt, Human
gacagcugccuggg

SEQ ID NO: 1918983 - RNA, 15 nt, Human
gacagcugccuggga

SEQ ID NO: 1918984 - RNA, 11 nt, Human
gacagcugcuc

SEQ ID NO: 1918985 - RNA, 14 nt, Human
gacagcugcuccua

SEQ ID NO: 1918986 - RNA, 17 nt, Human
gacagcugcuccuagag

SEQ ID NO: 1918987 - RNA, 20 nt, Human
gacagcugcuccuagaggga

SEQ ID NO: 1918988 - RNA, 21 nt, Human
gacagcugcuccuagagggag

SEQ ID NO: 1918989 - RNA, 19 nt, Human
gacaggcauguucucugag

SEQ ID NO: 1918990 - RNA, 18 nt, Human
gacaggcauguucucuga

SEQ ID NO: 1918991 - RNA, 17 nt, Human
gacaggcaaugcuggcu

SEQ ID NO: 1918992 - RNA, 16 nt, Human
gacaggcaaugcuggc

SEQ ID NO: 1918993 - RNA, 14 nt, Human
gacaggcaaugcug

SEQ ID NO: 1918994 - RNA, 16 nt, Human
gacagacacaggcccg

SEQ ID NO: 1918995 - RNA, 15 nt, Human
gacagacacaggccc

SEQ ID NO: 1918996 - RNA, 21 nt, Human
gacacuaaccacgcuggaccu

SEQ ID NO: 1918997 - RNA, 20 nt, Human
gacacuaaccacgcuggacc

SEQ ID NO: 1918998 - RNA, 14 nt, Human
gacagacacaggcc

SEQ ID NO: 1918999 - RNA, 13 nt, Human
gacagccacggcc

SEQ ID NO: 1919000 - RNA, 22 nt, Human
gacagccaacuauggccugugg

SEQ ID NO: 1919001 - RNA, 12 nt, Human
gacagcugccug

SEQ ID NO: 1919002 - RNA, 13 nt, Human
gacagcugccugg

SEQ ID NO: 1919003 - RNA, 19 nt, Human
gacagccaacuauggccug

SEQ ID NO: 1919004 - RNA, 16 nt, Human
gacagcauuuuccucu

SEQ ID NO: 1919005 - RNA, 20 nt, Human
gacagcauuuuccucugcuu

SEQ ID NO: 1919006 - RNA, 23 nt, Human
gacagcauuuuccucugcuuuga

SEQ ID NO: 1919007 - RNA, 14 nt, Human
gacaggcagagcug

SEQ ID NO: 1919008 - RNA, 16 nt, Human
gacauacuaaccagca

SEQ ID NO: 1919009 - RNA, 15 nt, Human
gacauacuaaccagc

SEQ ID NO: 1919010 - RNA, 12 nt, Human
gacaggcuggcu

SEQ ID NO: 1919011 - RNA, 14 nt, Human
gacaggcuggcucc

SEQ ID NO: 1919012 - RNA, 21 nt, Human
gacaggcuggcuccagaugca

SEQ ID NO: 1919013 - RNA, 22 nt, Human
gacaggcuggcuccagaugcag

SEQ ID NO: 1919014 - RNA, 22 nt, Human
gacauaaugggguccuggccau

SEQ ID NO: 1919015 - RNA, 23 nt, Human
gacauacuaaccagcagaaaugc

SEQ ID NO: 1919016 - RNA, 21 nt, Human
gacauagcaucuuguggcuuu

SEQ ID NO: 1919017 - RNA, 14 nt, Human
gacaucaacagaua

SEQ ID NO: 1919018 - RNA, 14 nt, Human
gacaucuggaaucu

SEQ ID NO: 1919019 - RNA, 18 nt, Human
gacaucuggaaucuggag

SEQ ID NO: 1919020 - RNA, 19 nt, Human
gacaucuggaaucuggaga

SEQ ID NO: 1919021 - RNA, 20 nt, Human
gacaucuggaaucuggagac

SEQ ID NO: 1919022 - RNA, 22 nt, Human
gacaucuggaaucuggagacca

SEQ ID NO: 1919023 - RNA, 21 nt, Human
gacaugucuuuucuugcauga

SEQ ID NO: 1919024 - RNA, 17 nt, Human
gacaugucuuuucuugc

SEQ ID NO: 1919025 - RNA, 18 nt, Human
gacaugcgguagccagca

SEQ ID NO: 1919026 - RNA, 19 nt, Human
gacaugcgguagccagcac

SEQ ID NO: 1919027 - RNA, 22 nt, Human
gacaugcgguagccagcacaca

SEQ ID NO: 1919028 - RNA, 23 nt, Human
gacaugcgguagccagcacacag

SEQ ID NO: 1919029 - RNA, 22 nt, Human
gaccccgacgccacagcccagc

SEQ ID NO: 1919030 - RNA, 20 nt, Human
gaccccgagccuggcuccaa

SEQ ID NO: 1919031 - RNA, 13 nt, Human
gaccccuccaugu

SEQ ID NO: 1919032 - RNA, 18 nt, Human
gacccugaggcccagagg

SEQ ID NO: 1919033 - RNA, 19 nt, Human
gacccugaggcccagaggg

SEQ ID NO: 1919034 - RNA, 20 nt, Human
gacccugaggcccagagggc

SEQ ID NO: 1919035 - RNA, 12 nt, Human
gacccugcccug

SEQ ID NO: 1919036 - RNA, 21 nt, Human
gacccugaggcccagagggcc

SEQ ID NO: 1919037 - RNA, 13 nt, Human
gacccugcccugu

SEQ ID NO: 1919038 - RNA, 15 nt, Human
gacccugcccugugg

SEQ ID NO: 1919039 - RNA, 16 nt, Human
gacccugcccuguggg

SEQ ID NO: 1919040 - RNA, 23 nt, Human
gacccugucucaaaaaaagaaaa

SEQ ID NO: 1919041 - RNA, 14 nt, Human
gacccaugcugccc

SEQ ID NO: 1919042 - RNA, 15 nt, Human
gacccaugcugcccu

SEQ ID NO: 1919043 - RNA, 16 nt, Human
gacccaugcugcccug

SEQ ID NO: 1919044 - RNA, 17 nt, Human
gacccaugcugcccugu

SEQ ID NO: 1919045 - RNA, 12 nt, Human
gacccacugcuu

SEQ ID NO: 1919046 - RNA, 11 nt, Human
gacccacugcu

SEQ ID NO: 1919047 - RNA, 14 nt, Human
gaccaacugucacu

SEQ ID NO: 1919048 - RNA, 23 nt, Human
gaccugauuucugagcauuuaau

SEQ ID NO: 1919049 - RNA, 14 nt, Human
gaccugauccugga

SEQ ID NO: 1919050 - RNA, 15 nt, Human
gaccugauccuggag

SEQ ID NO: 1919051 - RNA, 18 nt, Human
gaccugauccuggaggcc

SEQ ID NO: 1919052 - RNA, 21 nt, Human
gaccugauccuggaggcccag

SEQ ID NO: 1919053 - RNA, 23 nt, Human
gaccugcccccgcauccccugcc

SEQ ID NO: 1919054 - RNA, 17 nt, Human
gaccugcagacgcccag

SEQ ID NO: 1919055 - RNA, 18 nt, Human
gaccugaggcccuucucu

SEQ ID NO: 1919056 - RNA, 21 nt, Human
gaccugaggcccuucucucca

SEQ ID NO: 1919057 - RNA, 11 nt, Human
gaccucaggcc

SEQ ID NO: 1919058 - RNA, 12 nt, Human
gaccucaggccu

SEQ ID NO: 1919059 - RNA, 13 nt, Human
gaccucaggccug

SEQ ID NO: 1919060 - RNA, 15 nt, Human
gaccugaggcccuuc

SEQ ID NO: 1919061 - RNA, 14 nt, Human
gaccgugaggccag

SEQ ID NO: 1919062 - RNA, 15 nt, Human
gaccgugaggccaga

SEQ ID NO: 1919063 - RNA, 15 nt, Human
gaccggcggcucgga

SEQ ID NO: 1919064 - RNA, 14 nt, Human
gacccuguggaagc

SEQ ID NO: 1919065 - RNA, 14 nt, Human
gaccuaaugcuccu

SEQ ID NO: 1919066 - RNA, 15 nt, Human
gaccuaaugcuccuu

SEQ ID NO: 1919067 - RNA, 22 nt, Human
gaccuaaugcuccuuguuccua

SEQ ID NO: 1919068 - RNA, 15 nt, Human
gacgccacagcccag

SEQ ID NO: 1919069 - RNA, 14 nt, Human
gacgccacagccca

SEQ ID NO: 1919070 - RNA, 22 nt, Human
gacggcugggcacacgccuccc

SEQ ID NO: 1919071 - RNA, 21 nt, Human
gacggagucccaccuuggcug

SEQ ID NO: 1919072 - RNA, 23 nt, Human
gacggagucccaccuuggcugca

SEQ ID NO: 1919073 - RNA, 18 nt, Human
gacggagucccaccuugg

SEQ ID NO: 1919074 - RNA, 14 nt, Human
gacggagucccacc

SEQ ID NO: 1919075 - RNA, 18 nt, Human
gacgaagaagagccacag

SEQ ID NO: 1919076 - RNA, 17 nt, Human
gacguguuaugacucca

SEQ ID NO: 1919077 - RNA, 20 nt, Human
gacguguuaugacuccagaa

SEQ ID NO: 1919078 - RNA, 20 nt, Human
gacguacuccaacagaagaa

SEQ ID NO: 1919079 - RNA, 12 nt, Human
gacguagcugca

SEQ ID NO: 1919080 - RNA, 21 nt, Human
gacguagcugcaaaggacaga

SEQ ID NO: 1919081 - RNA, 18 nt, Human
gaccuggacacaggccug

SEQ ID NO: 1919082 - RNA, 23 nt, Human
gaccuugaacuggguacuugugg

SEQ ID NO: 1919083 - RNA, 21 nt, Human
gaccuuucaauaggaaaaacu

SEQ ID NO: 1919084 - RNA, 13 nt, Human
gaccuugaugagc

SEQ ID NO: 1919085 - RNA, 15 nt, Human
gaccuugaugagcug

SEQ ID NO: 1919086 - RNA, 14 nt, Human
gaccuugaugagcu

SEQ ID NO: 1919087 - RNA, 16 nt, Human
gacgaagaagagccac

SEQ ID NO: 1919088 - RNA, 21 nt, Human
gacgaacauccaaccuuccca

SEQ ID NO: 1919089 - RNA, 17 nt, Human
gaccuuuccugaggaag

SEQ ID NO: 1919090 - RNA, 14 nt, Human
gacuccugcaggca

SEQ ID NO: 1919091 - RNA, 15 nt, Human
gacuccugcaggcag

SEQ ID NO: 1919092 - RNA, 16 nt, Human
gacuccugcaggcagc

SEQ ID NO: 1919093 - RNA, 13 nt, Human
gacucccauuccu

SEQ ID NO: 1919094 - RNA, 22 nt, Human
gacucccauuccugaagaacca

SEQ ID NO: 1919095 - RNA, 23 nt, Human
gacucccauuccugaagaaccag

SEQ ID NO: 1919096 - RNA, 12 nt, Human
gacuacaggcac

SEQ ID NO: 1919097 - RNA, 17 nt, Human
gacuacucccccaggug

SEQ ID NO: 1919098 - RNA, 22 nt, Human
gacguguuaugacuccagaauu

SEQ ID NO: 1919099 - RNA, 14 nt, Human
gacguguuuguguu

SEQ ID NO: 1919100 - RNA, 18 nt, Human
gacuaauucuugcauauu

SEQ ID NO: 1919101 - RNA, 12 nt, Human
gacuaauuucaa

SEQ ID NO: 1919102 - RNA, 12 nt, Human
gacuaauucuug

SEQ ID NO: 1919103 - RNA, 13 nt, Human
gacuaauuucaaa

SEQ ID NO: 1919104 - RNA, 22 nt, Human
gacuaauuucaaaaugcuuuuu

SEQ ID NO: 1919105 - RNA, 17 nt, Human
gacucagggcagcgcca

SEQ ID NO: 1919106 - RNA, 18 nt, Human
gacucagggcagcgccag

SEQ ID NO: 1919107 - RNA, 23 nt, Human
gacucagggcagcgccaggcuga

SEQ ID NO: 1919108 - RNA, 12 nt, Human
gacucagggcag

SEQ ID NO: 1919109 - RNA, 13 nt, Human
gacucagggcagc

SEQ ID NO: 1919110 - RNA, 16 nt, Human
gacucagggcagcgcc

SEQ ID NO: 1919111 - RNA, 18 nt, Human
gcagaccccuuggccagc

SEQ ID NO: 1919112 - RNA, 21 nt, Human
gcagaguugaagacagagcua

SEQ ID NO: 1919113 - RNA, 18 nt, Human
gcagauaaacaguaguga

SEQ ID NO: 1919114 - RNA, 20 nt, Human
gcagaguugaagacagagcu

SEQ ID NO: 1919115 - RNA, 17 nt, Human
gcagacaguuaagagaa

SEQ ID NO: 1919116 - RNA, 22 nt, Human
gcagauacaggaaaagcugcug

SEQ ID NO: 1919117 - RNA, 15 nt, Human
gcagauacugucucu

SEQ ID NO: 1919118 - RNA, 24 nt, Human
gcagccccauucugccugcccagg

SEQ ID NO: 1919119 - RNA, 21 nt, Human
gcagccccauucugccugccc

SEQ ID NO: 1919120 - RNA, 19 nt, Human
gcagccccauucugccugc

SEQ ID NO: 1919121 - RNA, 18 nt, Human
gcagccccauucugccug

SEQ ID NO: 1919122 - RNA, 17 nt, Human
gcagccccauucugccu

SEQ ID NO: 1919123 - RNA, 23 nt, Human
gcagcaauaaagcagcguuucua

SEQ ID NO: 1919124 - RNA, 16 nt, Human
gcagcaauaaagcagc

SEQ ID NO: 1919125 - RNA, 13 nt, Human
gcagcccugcaga

SEQ ID NO: 1919126 - RNA, 20 nt, Human
gcagccccuguucuggcaga

SEQ ID NO: 1919127 - RNA, 21 nt, Human
gcagccccuguucuggcagag

SEQ ID NO: 1919128 - RNA, 20 nt, Human
gcagccccgugggguuccuc

SEQ ID NO: 1919129 - RNA, 23 nt, Human
gcaggaggaucacuugaguccag

SEQ ID NO: 1919130 - RNA, 13 nt, Human
gcaggacaggaaa

SEQ ID NO: 1919131 - RNA, 20 nt, Human
gcaggaggaucacuugaguc

SEQ ID NO: 1919132 - RNA, 23 nt, Human
gcaggaaaaggugauauccauuc

SEQ ID NO: 1919133 - RNA, 12 nt, Human
gcaggcagccag

SEQ ID NO: 1919134 - RNA, 13 nt, Human
gcaggcagccagg

SEQ ID NO: 1919135 - RNA, 14 nt, Human
gcaggcagccaggc

SEQ ID NO: 1919136 - RNA, 15 nt, Human
gcagccuuggcaaac

SEQ ID NO: 1919137 - RNA, 15 nt, Human
gcagccuuuaaugca

SEQ ID NO: 1919138 - RNA, 15 nt, Human
gcagcgccuuuccca

SEQ ID NO: 1919139 - RNA, 14 nt, Human
gcagcucaccucuc

SEQ ID NO: 1919140 - RNA, 22 nt, Human
gcagcgggagccucccugccuc

SEQ ID NO: 1919141 - RNA, 15 nt, Human
gcagcucaccucucc

SEQ ID NO: 1919142 - RNA, 21 nt, Human
gcagccuggcucccaggacac

SEQ ID NO: 1919143 - RNA, 10 nt, Human
gcagccuggg

SEQ ID NO: 1919144 - RNA, 14 nt, Human
gcagccuggggcug

SEQ ID NO: 1919145 - RNA, 17 nt, Human
gcagccuggggcuggcc

SEQ ID NO: 1919146 - RNA, 14 nt, Human
gcagcccugcagag

SEQ ID NO: 1919147 - RNA, 15 nt, Human
gcagcccugcagagg

SEQ ID NO: 1919148 - RNA, 16 nt, Human
gcagcccugcagaggg

SEQ ID NO: 1919149 - RNA, 17 nt, Human
gcagcccugcagagggc

SEQ ID NO: 1919150 - RNA, 17 nt, Human
gcacccaagaccucagg

SEQ ID NO: 1919151 - RNA, 21 nt, Human
gcacccaagaccucagggcac

SEQ ID NO: 1919152 - RNA, 20 nt, Human
gcaccauuuaaaaacaggca

SEQ ID NO: 1919153 - RNA, 22 nt, Human
gcacccaccaucaugucuggcu

SEQ ID NO: 1919154 - RNA, 19 nt, Human
gcacccggccccugcuggu

SEQ ID NO: 1919155 - RNA, 16 nt, Human
gcaccagcagccugga

SEQ ID NO: 1919156 - RNA, 14 nt, Human
gcaauggcagccuu

SEQ ID NO: 1919157 - RNA, 20 nt, Human
gcaccacugcacuccagccu

SEQ ID NO: 1919158 - RNA, 13 nt, Human
gcaauggcagccu

SEQ ID NO: 1919159 - RNA, 12 nt, Human
gcaauggcagcc

SEQ ID NO: 1919160 - RNA, 15 nt, Human
gcaccagcagccugg

SEQ ID NO: 1919161 - RNA, 14 nt, Human
gcaccagacaccca

SEQ ID NO: 1919162 - RNA, 21 nt, Human
gcaccacugcacuccagccug

SEQ ID NO: 1919163 - RNA, 22 nt, Human
gcaccacugcacuccagccugg

SEQ ID NO: 1919164 - RNA, 15 nt, Human
gcacgaaauguuauu

SEQ ID NO: 1919165 - RNA, 22 nt, Human
gcaccuugugucuguacacgug

SEQ ID NO: 1919166 - RNA, 19 nt, Human
gcaccuuagacagucccug

SEQ ID NO: 1919167 - RNA, 18 nt, Human
gcaccuuagacagucccu

SEQ ID NO: 1919168 - RNA, 21 nt, Human
gcacggaccaugcgacacugg

SEQ ID NO: 1919169 - RNA, 12 nt, Human
gcacgauuucug

SEQ ID NO: 1919170 - RNA, 20 nt, Human
gcacgguggacccagacaca

SEQ ID NO: 1919171 - RNA, 15 nt, Human
gcacccucaggcagg

SEQ ID NO: 1919172 - RNA, 21 nt, Human
gcaccuggaauauauaaccag

SEQ ID NO: 1919173 - RNA, 18 nt, Human
gcaccuggaauauauaac

SEQ ID NO: 1919174 - RNA, 22 nt, Human
gcaccuggaauauauaaccagu

SEQ ID NO: 1919175 - RNA, 14 nt, Human
gcaccuuagacagu

SEQ ID NO: 1919176 - RNA, 17 nt, Human
gcaccuuagacaguccc

SEQ ID NO: 1919177 - RNA, 19 nt, Human
gcagacaggcaagcaccuc

SEQ ID NO: 1919178 - RNA, 18 nt, Human
gcagacaggaccagggau

SEQ ID NO: 1919179 - RNA, 23 nt, Human
gcagacaggcaagcaccuccugc

SEQ ID NO: 1919180 - RNA, 15 nt, Human
gcagacagcuccacc

SEQ ID NO: 1919181 - RNA, 20 nt, Human
gcagacaggccccgugaggc

SEQ ID NO: 1919182 - RNA, 12 nt, Human
gcagacaggacc

SEQ ID NO: 1919183 - RNA, 13 nt, Human
gcagacaggacca

SEQ ID NO: 1919184 - RNA, 15 nt, Human
gcagacaggaccagg

SEQ ID NO: 1919185 - RNA, 16 nt, Human
gcacuuaugauuucau

SEQ ID NO: 1919186 - RNA, 18 nt, Human
gcacuuauuuaaugccga

SEQ ID NO: 1919187 - RNA, 16 nt, Human
gcacugcuuccaguga

SEQ ID NO: 1919188 - RNA, 18 nt, Human
gcacugcuuccagugagg

SEQ ID NO: 1919189 - RNA, 13 nt, Human
gcacugccucuca

SEQ ID NO: 1919190 - RNA, 14 nt, Human
gcacugccucucac

SEQ ID NO: 1919191 - RNA, 16 nt, Human
gcacugccucucacag

SEQ ID NO: 1919192 - RNA, 21 nt, Human
gcacugccucucacagcugag

SEQ ID NO: 1919193 - RNA, 19 nt, Human
gcacugccucucacagcug

SEQ ID NO: 1919194 - RNA, 22 nt, Human
gcacugcuuccagugaggcucu

SEQ ID NO: 1919195 - RNA, 20 nt, Human
gcacugcuuccagugaggcu

SEQ ID NO: 1919196 - RNA, 15 nt, Human
gcacguauuuuaaua

SEQ ID NO: 1919197 - RNA, 14 nt, Human
gcacguauuuuaau

SEQ ID NO: 1919198 - RNA, 21 nt, Human
gcacugcccauggacaggcug

SEQ ID NO: 1919199 - RNA, 16 nt, Human
gcaggugaaacccagu

SEQ ID NO: 1919200 - RNA, 14 nt, Human
gcagguccccagac

SEQ ID NO: 1919201 - RNA, 13 nt, Human
gcagguccccaga

SEQ ID NO: 1919202 - RNA, 17 nt, Human
gcaggugaaacccaguc

SEQ ID NO: 1919203 - RNA, 20 nt, Human
gcaggugaaacccagucacu

SEQ ID NO: 1919204 - RNA, 15 nt, Human
gcaggugaauuguuu

SEQ ID NO: 1919205 - RNA, 20 nt, Human
gcaggucuugaacuccuggc

SEQ ID NO: 1919206 - RNA, 19 nt, Human
gcaggucuugaacuccugg

SEQ ID NO: 1919207 - RNA, 22 nt, Human
gcagguccaggguuugaguuca

SEQ ID NO: 1919208 - RNA, 19 nt, Human
gcagguagaccugucuccu

SEQ ID NO: 1919209 - RNA, 22 nt, Human
gcagggugcaguaucaugcccu

SEQ ID NO: 1919210 - RNA, 17 nt, Human
gcagguagaccugucuc

SEQ ID NO: 1919211 - RNA, 15 nt, Human
gcagugcaugcuguc

SEQ ID NO: 1919212 - RNA, 16 nt, Human
gcagugcaugcugucc

SEQ ID NO: 1919213 - RNA, 18 nt, Human
gcaguggagguagaauga

SEQ ID NO: 1919214 - RNA, 20 nt, Human
gcaguggagguagaaugacu

SEQ ID NO: 1919215 - RNA, 15 nt, Human
gcagugccugauaag

SEQ ID NO: 1919216 - RNA, 23 nt, Human
gcagggccgcccgggcccagagg

SEQ ID NO: 1919217 - RNA, 15 nt, Human
gcagggccgccaggg

SEQ ID NO: 1919218 - RNA, 22 nt, Human
gcagggccgcccgggcccagag

SEQ ID NO: 1919219 - RNA, 21 nt, Human
gcagggccgcccgggcccaga

SEQ ID NO: 1919220 - RNA, 23 nt, Human
gcagggccgccagggagaccugg

SEQ ID NO: 1919221 - RNA, 21 nt, Human
gcagggcucagcggggacagc

SEQ ID NO: 1919222 - RNA, 19 nt, Human
gcagggcucagcggggaca

SEQ ID NO: 1919223 - RNA, 15 nt, Human
gcaggcagccaggcc

SEQ ID NO: 1919224 - RNA, 16 nt, Human
gcaggcagccaggcca

SEQ ID NO: 1919225 - RNA, 13 nt, Human
gcagggcagucau

SEQ ID NO: 1919226 - RNA, 19 nt, Human
gcagggccaacccuucucc

SEQ ID NO: 1919227 - RNA, 18 nt, Human
gcagggucucacucuguc

SEQ ID NO: 1919228 - RNA, 17 nt, Human
gcagggucucacucugu

SEQ ID NO: 1919229 - RNA, 22 nt, Human
gcagggcucagcggggacagcu

SEQ ID NO: 1919230 - RNA, 19 nt, Human
gcaggggagggucagccag

SEQ ID NO: 1919231 - RNA, 21 nt, Human
gcaggggagggucagccaggg

SEQ ID NO: 1919232 - RNA, 20 nt, Human
gcaggggagggucagccagg

SEQ ID NO: 1919233 - RNA, 20 nt, Human
gcauaguaccaaucauuuua

SEQ ID NO: 1919234 - RNA, 17 nt, Human
gcauagguuuaauaauu

SEQ ID NO: 1919235 - RNA, 14 nt, Human
gcauauuuuguaac

SEQ ID NO: 1919236 - RNA, 13 nt, Human
gcauagaaguaaa

SEQ ID NO: 1919237 - RNA, 17 nt, Human
gcaguuauuaacacuaa

SEQ ID NO: 1919238 - RNA, 15 nt, Human
gcagugggagcugcc

SEQ ID NO: 1919239 - RNA, 14 nt, Human
gcagugggagcugc

SEQ ID NO: 1919240 - RNA, 13 nt, Human
gcagugggagcug

SEQ ID NO: 1919241 - RNA, 23 nt, Human
gcaguggugguuuucuguucuuu

SEQ ID NO: 1919242 - RNA, 22 nt, Human
gcaguggugguuuucuguucuu

SEQ ID NO: 1919243 - RNA, 12 nt, Human
gcagugugaaaa

SEQ ID NO: 1919244 - RNA, 18 nt, Human
gcagugguguggagaagc

SEQ ID NO: 1919245 - RNA, 20 nt, Human
gcaucuuugaauacaaagaa

SEQ ID NO: 1919246 - RNA, 20 nt, Human
gcaucuuguggcuuugcaac

SEQ ID NO: 1919247 - RNA, 18 nt, Human
gcaugaaguaauaugcac

SEQ ID NO: 1919248 - RNA, 13 nt, Human
gcaugaagguuuc

SEQ ID NO: 1919249 - RNA, 16 nt, Human
gcaucugaaaauugau

SEQ ID NO: 1919250 - RNA, 14 nt, Human
gcaucugaccagca

SEQ ID NO: 1919251 - RNA, 15 nt, Human
gcaucugaccagcag

SEQ ID NO: 1919252 - RNA, 17 nt, Human
gcaucugaccagcagcg

SEQ ID NO: 1919253 - RNA, 18 nt, Human
gcaucugaccagcagcgc

SEQ ID NO: 1919254 - RNA, 20 nt, Human
gcaucugaccagcagcgccu

SEQ ID NO: 1919255 - RNA, 18 nt, Human
gcaugauccaagcaagac

SEQ ID NO: 1919256 - RNA, 19 nt, Human
gcaugauccaagcaagacu

SEQ ID NO: 1919257 - RNA, 22 nt, Human
gcaugauccaagcaagacugag

SEQ ID NO: 1919258 - RNA, 23 nt, Human
gcaugauccaagcaagacugagg

SEQ ID NO: 1919259 - RNA, 23 nt, Human
gcaugauagacacauaugagggg

SEQ ID NO: 1919260 - RNA, 16 nt, Human
gcaugaucugaaaaau

SEQ ID NO: 1919261 - RNA, 18 nt, Human
gcaugaucugaaaaauac

SEQ ID NO: 1919262 - RNA, 18 nt, Human
gcaugcgggcuuccuccu

SEQ ID NO: 1919263 - RNA, 15 nt, Human
gcaugauuuuguaac

SEQ ID NO: 1919264 - RNA, 22 nt, Human
gcauguucucugaggacacuaa

SEQ ID NO: 1919265 - RNA, 21 nt, Human
gcauguucucugaggacacua

SEQ ID NO: 1919266 - RNA, 15 nt, Human
gcauguucucugagg

SEQ ID NO: 1919267 - RNA, 16 nt, Human
gcaugcugcuggacag

SEQ ID NO: 1919268 - RNA, 16 nt, Human
gcauuuuuuaaaacaa

SEQ ID NO: 1919269 - RNA, 15 nt, Human
gcauuuuuuaaaaca

SEQ ID NO: 1919270 - RNA, 14 nt, Human
gccaaaaaaagaca

SEQ ID NO: 1919271 - RNA, 18 nt, Human
gcauuuguuugaacugau

SEQ ID NO: 1919272 - RNA, 18 nt, Human
gcauuuuuuaaaacaaga

SEQ ID NO: 1919273 - RNA, 17 nt, Human
gcauuuuuuaaaacaag

SEQ ID NO: 1919274 - RNA, 16 nt, Human
gccaaaaaaagacagg

SEQ ID NO: 1919275 - RNA, 14 nt, Human
gccaaacucaccug

SEQ ID NO: 1919276 - RNA, 16 nt, Human
gccaaacucaccugcc

SEQ ID NO: 1919277 - RNA, 12 nt, Human
gccaaaggaagc

SEQ ID NO: 1919278 - RNA, 22 nt, Human
gccaaagcuaggccuggccaga

SEQ ID NO: 1919279 - RNA, 16 nt, Human
gccaaagcuaggccug

SEQ ID NO: 1919280 - RNA, 20 nt, Human
gccaaagccaaagcuaggcc

SEQ ID NO: 1919281 - RNA, 13 nt, Human
gccaaagccaaag

SEQ ID NO: 1919282 - RNA, 16 nt, Human
gccaaagccuccucca

SEQ ID NO: 1919283 - RNA, 19 nt, Human
gccaaagccuccuccagcc

SEQ ID NO: 1919284 - RNA, 17 nt, Human
gcauuaucuagauacug

SEQ ID NO: 1919285 - RNA, 18 nt, Human
gcauuauauuuguaaauu

SEQ ID NO: 1919286 - RNA, 19 nt, Human
gcauucaaauguauuacag

SEQ ID NO: 1919287 - RNA, 21 nt, Human
gcauuugaggucuguucuuuc

SEQ ID NO: 1919288 - RNA, 13 nt, Human
gcauuugcugaau

SEQ ID NO: 1919289 - RNA, 12 nt, Human
gcauugaacaca

SEQ ID NO: 1919290 - RNA, 16 nt, Human
gcauugaacacaaacu

SEQ ID NO: 1919291 - RNA, 18 nt, Human
gcauugaacacaaacugu

SEQ ID NO: 1919292 - RNA, 19 nt, Human
gcauugaacacaaacugua

SEQ ID NO: 1919293 - RNA, 16 nt, Human
gcauuuguuugaacug

SEQ ID NO: 1919294 - RNA, 16 nt, Human
gcauuuguguugaaga

SEQ ID NO: 1919295 - RNA, 14 nt, Human
gcauuugcugaaua

SEQ ID NO: 1919296 - RNA, 17 nt, Human
gcauuugcugaauacag

SEQ ID NO: 1919297 - RNA, 14 nt, Human
gauaguagcuuccu

SEQ ID NO: 1919298 - RNA, 14 nt, Human
gauagcacuuucua

SEQ ID NO: 1919299 - RNA, 16 nt, Human
gauaguauugugcaua

SEQ ID NO: 1919300 - RNA, 23 nt, Human
gaucaagucggaucuaguccagc

SEQ ID NO: 1919301 - RNA, 13 nt, Human
gaucaaugaaaug

SEQ ID NO: 1919302 - RNA, 21 nt, Human
gaucaaguuauuuuuaauuug

SEQ ID NO: 1919303 - RNA, 18 nt, Human
gaucacgccacugcacua

SEQ ID NO: 1919304 - RNA, 16 nt, Human
gaucacgccacugcac

SEQ ID NO: 1919305 - RNA, 22 nt, Human
gaucagucugauucccaagcuc

SEQ ID NO: 1919306 - RNA, 11 nt, Human
gaucaggucau

SEQ ID NO: 1919307 - RNA, 12 nt, Human
gaucagccuggg

SEQ ID NO: 1919308 - RNA, 15 nt, Human
gaucagccugggcaa

SEQ ID NO: 1919309 - RNA, 12 nt, Human
gaucacggcuca

SEQ ID NO: 1919310 - RNA, 21 nt, Human
gaucauccacugugccaugug

SEQ ID NO: 1919311 - RNA, 16 nt, Human
gaucauccacugugcc

SEQ ID NO: 1919312 - RNA, 19 nt, Human
gaucauccacugugccaug

SEQ ID NO: 1919313 - RNA, 17 nt, Human
gaucauccacugugcca

SEQ ID NO: 1919314 - RNA, 20 nt, Human
gaucaguguaccauuugccu

SEQ ID NO: 1919315 - RNA, 14 nt, Human
gaucauugugaaau

SEQ ID NO: 1919316 - RNA, 14 nt, Human
gaucauuaucagcc

SEQ ID NO: 1919317 - RNA, 20 nt, Human
gaucauugugaaauuauuca

SEQ ID NO: 1919318 - RNA, 23 nt, Human
gauagauaggucagugcaaauac

SEQ ID NO: 1919319 - RNA, 11 nt, Human
gauacagaaaa

SEQ ID NO: 1919320 - RNA, 16 nt, Human
gauaaguguauuuuuc

SEQ ID NO: 1919321 - RNA, 22 nt, Human
gauaauacaccacuacauucug

SEQ ID NO: 1919322 - RNA, 21 nt, Human
gauaauacaccacuacauucu

SEQ ID NO: 1919323 - RNA, 18 nt, Human
gauaauacaccacuacau

SEQ ID NO: 1919324 - RNA, 14 nt, Human
gauaauacaccacu

SEQ ID NO: 1919325 - RNA, 19 nt, Human
gauacaggaaaagcugcug

SEQ ID NO: 1919326 - RNA, 18 nt, Human
gauacaggaaaagcugcu

SEQ ID NO: 1919327 - RNA, 20 nt, Human
gauagaugcuggcccagggc

SEQ ID NO: 1919328 - RNA, 21 nt, Human
gauagaugcuggcccagggcc

SEQ ID NO: 1919329 - RNA, 13 nt, Human
gauagaugugugg

SEQ ID NO: 1919330 - RNA, 12 nt, Human
gauagaugcugg

SEQ ID NO: 1919331 - RNA, 16 nt, Human
gauagaugcuggccca

SEQ ID NO: 1919332 - RNA, 17 nt, Human
gauagaugcuggcccag

SEQ ID NO: 1919333 - RNA, 18 nt, Human
gauagaugcuggcccagg

SEQ ID NO: 1919334 - RNA, 21 nt, Human
gauagcacagacccugcccug

SEQ ID NO: 1919335 - RNA, 22 nt, Human
gauagcacagacccugcccugu

SEQ ID NO: 1919336 - RNA, 12 nt, Human
gauagcacuuuc

SEQ ID NO: 1919337 - RNA, 20 nt, Human
gauagcacuuucuacaaugu

SEQ ID NO: 1919338 - RNA, 21 nt, Human
gauaaauaacuuuuuuuuaag

SEQ ID NO: 1919339 - RNA, 16 nt, Human
gauaaauaacuuuuuu

SEQ ID NO: 1919340 - RNA, 22 nt, Human
gauaaauaguuuaugauuccac

SEQ ID NO: 1919341 - RNA, 16 nt, Human
gauaaauacaaggccc

SEQ ID NO: 1919342 - RNA, 22 nt, Human
gauaaauauuauauuauauaua

SEQ ID NO: 1919343 - RNA, 15 nt, Human
gauaaauauuauauu

SEQ ID NO: 1919344 - RNA, 16 nt, Human
gauaagcuucaaagcu

SEQ ID NO: 1919345 - RNA, 19 nt, Human
gauaaaguugguaaaccuu

SEQ ID NO: 1919346 - RNA, 13 nt, Human
gaggaaggaaacc

SEQ ID NO: 1919347 - RNA, 19 nt, Human
gaggaaggaaacccagcuc

SEQ ID NO: 1919348 - RNA, 20 nt, Human
gaggaaggaaacccagcucu

SEQ ID NO: 1919349 - RNA, 21 nt, Human
gaggaaggaaacccagcucug

SEQ ID NO: 1919350 - RNA, 13 nt, Human
gaugcaccagccc

SEQ ID NO: 1919351 - RNA, 22 nt, Human
gaugcacagaguuguuacauuu

SEQ ID NO: 1919352 - RNA, 21 nt, Human
gaugcacagaguuguuacauu

SEQ ID NO: 1919353 - RNA, 16 nt, Human
gaugaaguuuuacauu

SEQ ID NO: 1919354 - RNA, 17 nt, Human
gaugaaguuuuacauug

SEQ ID NO: 1919355 - RNA, 19 nt, Human
gaugacaacuacagaaaaa

SEQ ID NO: 1919356 - RNA, 20 nt, Human
gaugacaugcacucagcucu

SEQ ID NO: 1919357 - RNA, 19 nt, Human
gaugcagccucacaguccu

SEQ ID NO: 1919358 - RNA, 14 nt, Human
gaugcagccucaca

SEQ ID NO: 1919359 - RNA, 12 nt, Human
gaugcagccuca

SEQ ID NO: 1919360 - RNA, 16 nt, Human
gaugcagcauuaugau

SEQ ID NO: 1919361 - RNA, 21 nt, Human
gaugcagcauuuuguauuugu

SEQ ID NO: 1919362 - RNA, 19 nt, Human
gaugccaauauuaaaucug

SEQ ID NO: 1919363 - RNA, 15 nt, Human
gaugccacacaagga

SEQ ID NO: 1919364 - RNA, 19 nt, Human
gaugccugguggcagcugc

SEQ ID NO: 1919365 - RNA, 18 nt, Human
gaugccugguggcagcug

SEQ ID NO: 1919366 - RNA, 20 nt, Human
gaugccugguggcagcugcg

SEQ ID NO: 1919367 - RNA, 23 nt, Human
gauggaugccaauauuaaaucug

SEQ ID NO: 1919368 - RNA, 22 nt, Human
gauggauuuccagccaaagccu

SEQ ID NO: 1919369 - RNA, 17 nt, Human
gauggauucuccacuca

SEQ ID NO: 1919370 - RNA, 15 nt, Human
gauggauuuguauca

SEQ ID NO: 1919371 - RNA, 20 nt, Human
gauggcaaagaaggagagca

SEQ ID NO: 1919372 - RNA, 14 nt, Human
gauggcuccucuca

SEQ ID NO: 1919373 - RNA, 13 nt, Human
gauggggcccugc

SEQ ID NO: 1919374 - RNA, 14 nt, Human
gauggggcccugcc

SEQ ID NO: 1919375 - RNA, 22 nt, Human
gauggggcccugccuccuuugu

SEQ ID NO: 1919376 - RNA, 21 nt, Human
gauggcuaguaucaaaagaaa

SEQ ID NO: 1919377 - RNA, 12 nt, Human
gauggcuccucu

SEQ ID NO: 1919378 - RNA, 13 nt, Human
gauggcuccucuc

SEQ ID NO: 1919379 - RNA, 14 nt, Human
gauccccagcuguu

SEQ ID NO: 1919380 - RNA, 15 nt, Human
gaucccucauccuca

SEQ ID NO: 1919381 - RNA, 16 nt, Human
gaucccucauccucau

SEQ ID NO: 1919382 - RNA, 21 nt, Human
gauccugagccagauuucacu

SEQ ID NO: 1919383 - RNA, 22 nt, Human
gauccugagccagauuucacuc

SEQ ID NO: 1919384 - RNA, 21 nt, Human
gaucgcggcggagcuggcccc

SEQ ID NO: 1919385 - RNA, 16 nt, Human
gaucuauacuugcuuu

SEQ ID NO: 1919386 - RNA, 23 nt, Human
gaucuauacuugcuuuguguucu

SEQ ID NO: 1919387 - RNA, 17 nt, Human
gaucuuugcagacaggc

SEQ ID NO: 1919388 - RNA, 18 nt, Human
gaucuuugcagacaggca

SEQ ID NO: 1919389 - RNA, 21 nt, Human
gaucuuuggacagaagcagcu

SEQ ID NO: 1919390 - RNA, 11 nt, Human
gaucuuugugg

SEQ ID NO: 1919391 - RNA, 14 nt, Human
gaucuuuguggcca

SEQ ID NO: 1919392 - RNA, 16 nt, Human
gaucuuuguggccaag

SEQ ID NO: 1919393 - RNA, 13 nt, Human
gaucuuuggacag

SEQ ID NO: 1919394 - RNA, 18 nt, Human
gaucuguuuugaaggcaa

SEQ ID NO: 1919395 - RNA, 19 nt, Human
gaucuguuuugaaggcaaa

SEQ ID NO: 1919396 - RNA, 21 nt, Human
gaucugugaggggcucucuca

SEQ ID NO: 1919397 - RNA, 23 nt, Human
gaucucagugguuaagauuccua

SEQ ID NO: 1919398 - RNA, 13 nt, Human
gaucuguuuugaa

SEQ ID NO: 1919399 - RNA, 17 nt, Human
gaucuguuuugaaggca

SEQ ID NO: 1919400 - RNA, 17 nt, Human
gaugaaaauauuuaaag

SEQ ID NO: 1919401 - RNA, 16 nt, Human
gaucuuuucaaguuaa

SEQ ID NO: 1919402 - RNA, 15 nt, Human
gaucuuuguggccaa

SEQ ID NO: 1919403 - RNA, 14 nt, Human
gaugaaaauauuua

SEQ ID NO: 1919404 - RNA, 16 nt, Human
gaugaaaauauuuaaa

SEQ ID NO: 1919405 - RNA, 15 nt, Human
gaugaaaauauuuaa

SEQ ID NO: 1919406 - RNA, 15 nt, Human
gaugaagcauuuaca

SEQ ID NO: 1919407 - RNA, 15 nt, Human
gaugaagcaaacaca

SEQ ID NO: 1919408 - RNA, 16 nt, Human
gaugaagcaaacacau

SEQ ID NO: 1919409 - RNA, 19 nt, Human
gaugaagcaaacacauuaa

SEQ ID NO: 1919410 - RNA, 21 nt, Human
gauugcaauuugcacaaguuu

SEQ ID NO: 1919411 - RNA, 14 nt, Human
gauugcaauuugca

SEQ ID NO: 1919412 - RNA, 21 nt, Human
gauugcaacaggcugggcuuc

SEQ ID NO: 1919413 - RNA, 16 nt, Human
gauugcaccacugcac

SEQ ID NO: 1919414 - RNA, 23 nt, Human
gauugcaccacugcacuccagcc

SEQ ID NO: 1919415 - RNA, 20 nt, Human
gauugcaacaggcugggcuu

SEQ ID NO: 1919416 - RNA, 18 nt, Human
gauucuuuccugaggcug

SEQ ID NO: 1919417 - RNA, 16 nt, Human
gauucuuuccugaggc

SEQ ID NO: 1919418 - RNA, 17 nt, Human
gauucuuuccugaggcu

SEQ ID NO: 1919419 - RNA, 20 nt, Human
gauucccaagcucugcuccu

SEQ ID NO: 1919420 - RNA, 19 nt, Human
gauucccaagcucugcucc

SEQ ID NO: 1919421 - RNA, 21 nt, Human
gauucccaagcucugcuccuc

SEQ ID NO: 1919422 - RNA, 13 nt, Human
gauuccuuccugu

SEQ ID NO: 1919423 - RNA, 15 nt, Human
gauuccuuccuguuc

SEQ ID NO: 1919424 - RNA, 12 nt, Human
gauucuuuccug

SEQ ID NO: 1919425 - RNA, 23 nt, Human
gauggggcugcaccggcuggccu

SEQ ID NO: 1919426 - RNA, 16 nt, Human
gaugggggaacucaga

SEQ ID NO: 1919427 - RNA, 19 nt, Human
gaugggggaacucagaucc

SEQ ID NO: 1919428 - RNA, 20 nt, Human
gaugggggaacucagaucca

SEQ ID NO: 1919429 - RNA, 22 nt, Human
gaugggggaacucagauccagg

SEQ ID NO: 1919430 - RNA, 19 nt, Human
gauucagacagcugccugg

SEQ ID NO: 1919431 - RNA, 13 nt, Human
gauucagcucugc

SEQ ID NO: 1919432 - RNA, 15 nt, Human
gauucagcucugcaa

SEQ ID NO: 1919433 - RNA, 17 nt, Human
gauuccagguggcauca

SEQ ID NO: 1919434 - RNA, 17 nt, Human
gauucauauuuacuucu

SEQ ID NO: 1919435 - RNA, 19 nt, Human
gauucauaguaacuucuua

SEQ ID NO: 1919436 - RNA, 18 nt, Human
gauucauauuuacuucuu

SEQ ID NO: 1919437 - RNA, 19 nt, Human
gauucauauuuacuucuua

SEQ ID NO: 1919438 - RNA, 22 nt, Human
gauugcaauuugcacaaguuuu

SEQ ID NO: 1919439 - RNA, 16 nt, Human
gauuuccccuuuugca

SEQ ID NO: 1919440 - RNA, 20 nt, Human
gauuucccauccccuguggg

SEQ ID NO: 1919441 - RNA, 22 nt, Human
gauuucccauccccugugggaa

SEQ ID NO: 1919442 - RNA, 22 nt, Human
gauuuccagucuccaccaggaa

SEQ ID NO: 1919443 - RNA, 18 nt, Human
gauuuccguuaaaauacc

SEQ ID NO: 1919444 - RNA, 15 nt, Human
gauuuccguuaaaau

SEQ ID NO: 1919445 - RNA, 17 nt, Human
gauuuccccuuuugcau

SEQ ID NO: 1919446 - RNA, 19 nt, Human
gauuuccccuuuugcauuc

SEQ ID NO: 1919447 - RNA, 23 nt, Human
gauuuccccuuuugcauucuccc

SEQ ID NO: 1919448 - RNA, 22 nt, Human
gauuuccccuuuugcauucucc

SEQ ID NO: 1919449 - RNA, 19 nt, Human
gauuugguguacaauucag

SEQ ID NO: 1919450 - RNA, 13 nt, Human
gauuuggggugga

SEQ ID NO: 1919451 - RNA, 22 nt, Human
gauuuggucaacacuaacauga

SEQ ID NO: 1919452 - RNA, 20 nt, Human
gauuuggggcucagaguggg

SEQ ID NO: 1919453 - RNA, 23 nt, Human
gauuugcucagugucuggcugca

SEQ ID NO: 1919454 - RNA, 19 nt, Human
gauuucuguuuagauaaua

SEQ ID NO: 1919455 - RNA, 11 nt, Human
gauuucuguuu

SEQ ID NO: 1919456 - RNA, 21 nt, Human
gauuugcauugaacacaaacu

SEQ ID NO: 1919457 - RNA, 17 nt, Human
gauuugcauugaacaca

SEQ ID NO: 1919458 - RNA, 19 nt, Human
gauuuguuaaugauagcua

SEQ ID NO: 1919459 - RNA, 22 nt, Human
gauuugucuuuggugaacauug

SEQ ID NO: 1919460 - RNA, 20 nt, Human
gauuugucuuuggugaacau

SEQ ID NO: 1919461 - RNA, 22 nt, Human
gauuuuuacguuugaagacauu

SEQ ID NO: 1919462 - RNA, 18 nt, Human
gcaaaggguccagaagga

SEQ ID NO: 1919463 - RNA, 22 nt, Human
gcaaaggguccagaaggagaca

SEQ ID NO: 1919464 - RNA, 16 nt, Human
gcaaaguaucccuacu

SEQ ID NO: 1919465 - RNA, 20 nt, Human
gcaaauccuugugggaaaag

SEQ ID NO: 1919466 - RNA, 15 nt, Human
gauuuuugucuugug

SEQ ID NO: 1919467 - RNA, 13 nt, Human
gcaaaauugcaaa

SEQ ID NO: 1919468 - RNA, 17 nt, Human
gcaaaauugcaaaucuu

SEQ ID NO: 1919469 - RNA, 17 nt, Human
gcaagaauugaagcagg

SEQ ID NO: 1919470 - RNA, 14 nt, Human
gcaacagaucugga

SEQ ID NO: 1919471 - RNA, 16 nt, Human
gcaacagaucuggaac

SEQ ID NO: 1919472 - RNA, 17 nt, Human
gcaacagaucuggaacc

SEQ ID NO: 1919473 - RNA, 18 nt, Human
gcaacagaucuggaaccu

SEQ ID NO: 1919474 - RNA, 20 nt, Human
gcaacagaucuggaaccuca

SEQ ID NO: 1919475 - RNA, 22 nt, Human
gcaacagaucuggaaccucagc

SEQ ID NO: 1919476 - RNA, 22 nt, Human
gcaaauccuugugggaaaagaa

SEQ ID NO: 1919477 - RNA, 15 nt, Human
gcaacagaaaaaugg

SEQ ID NO: 1919478 - RNA, 17 nt, Human
gcaacagaaaaauggag

SEQ ID NO: 1919479 - RNA, 12 nt, Human
gcaacagaucug

SEQ ID NO: 1919480 - RNA, 13 nt, Human
gcaacagaucugg

SEQ ID NO: 1919481 - RNA, 23 nt, Human
gcaagacgcugugcugcccugcc

SEQ ID NO: 1919482 - RNA, 19 nt, Human
gcaagagaauugcuugaac

SEQ ID NO: 1919483 - RNA, 14 nt, Human
gcaagacgcugugc

SEQ ID NO: 1919484 - RNA, 20 nt, Human
gcaagacgcugugcugcccu

SEQ ID NO: 1919485 - RNA, 21 nt, Human
gcaagacgcugugcugcccug

SEQ ID NO: 1919486 - RNA, 22 nt, Human
gcaagacgcugugcugcccugc

SEQ ID NO: 1919487 - RNA, 18 nt, Human
gcaaggagauuuacaacu

SEQ ID NO: 1919488 - RNA, 15 nt, Human
gcaagcccuguugac

SEQ ID NO: 1919489 - RNA, 23 nt, Human
gcaagcccuguugacacaggucu

SEQ ID NO: 1919490 - RNA, 15 nt, Human
gcaagccccugcucc

SEQ ID NO: 1919491 - RNA, 13 nt, Human
gcaaggcugucaa

SEQ ID NO: 1919492 - RNA, 16 nt, Human
gcaaggguucccucaa

SEQ ID NO: 1919493 - RNA, 18 nt, Human
gcaaggguucccucaaga

SEQ ID NO: 1919494 - RNA, 11 nt, Human
gcaaggcuguc

SEQ ID NO: 1919495 - RNA, 23 nt, Human
gcaaugcuggcuguuggcugggg

SEQ ID NO: 1919496 - RNA, 22 nt, Human
gcaaugcuggcuguuggcuggg

SEQ ID NO: 1919497 - RNA, 14 nt, Human
gcaaugcuggcugu

SEQ ID NO: 1919498 - RNA, 13 nt, Human
gcaaugcuggcug

SEQ ID NO: 1919499 - RNA, 23 nt, Human
gcaaugaccuuucaauaggaaaa

SEQ ID NO: 1919500 - RNA, 16 nt, Human
gcaaugaugaaugaga

SEQ ID NO: 1919501 - RNA, 17 nt, Human
gcaaugaugaaugagaa

SEQ ID NO: 1919502 - RNA, 14 nt, Human
gcaaggucauuuuu

SEQ ID NO: 1919503 - RNA, 15 nt, Human
gcaaucaaaucugcu

SEQ ID NO: 1919504 - RNA, 17 nt, Human
gcaaucaaaucugcuuu

SEQ ID NO: 1919505 - RNA, 15 nt, Human
gcaaugaccuuucaa

SEQ ID NO: 1919506 - RNA, 17 nt, Human
gcaaugaccuuucaaua

SEQ ID NO: 1919507 - RNA, 20 nt, Human
gcaaugaccuuucaauagga

SEQ ID NO: 1919508 - RNA, 22 nt, Human
gcaaugaccuuucaauaggaaa

SEQ ID NO: 1919509 - RNA, 16 nt, Human
gccucugccacugacu

SEQ ID NO: 1919510 - RNA, 18 nt, Human
gccucugccucugacaca

SEQ ID NO: 1919511 - RNA, 13 nt, Human
gccucugccucug

SEQ ID NO: 1919512 - RNA, 12 nt, Human
gccucugccucu

SEQ ID NO: 1919513 - RNA, 15 nt, Human
gccucugcacucccc

SEQ ID NO: 1919514 - RNA, 13 nt, Human
gccugcaagggag

SEQ ID NO: 1919515 - RNA, 15 nt, Human
gccugcaagggagug

SEQ ID NO: 1919516 - RNA, 21 nt, Human
gccucugacacacagcucugu

SEQ ID NO: 1919517 - RNA, 20 nt, Human
gccucugacacacagcucug

SEQ ID NO: 1919518 - RNA, 19 nt, Human
gccucugacacacagcucu

SEQ ID NO: 1919519 - RNA, 14 nt, Human
gccucugcacuccc

SEQ ID NO: 1919520 - RNA, 18 nt, Human
gccucugacacacagcuc

SEQ ID NO: 1919521 - RNA, 17 nt, Human
gccucugacacacagcu

SEQ ID NO: 1919522 - RNA, 16 nt, Human
gccucucucaggccaa

SEQ ID NO: 1919523 - RNA, 13 nt, Human
gccucucucaggc

SEQ ID NO: 1919524 - RNA, 14 nt, Human
gccucucucaggcc

SEQ ID NO: 1919525 - RNA, 20 nt, Human
gccucucauuccagaggaag

SEQ ID NO: 1919526 - RNA, 21 nt, Human
gccuccgagggacgcggcucc

SEQ ID NO: 1919527 - RNA, 13 nt, Human
gccuccgagggac

SEQ ID NO: 1919528 - RNA, 19 nt, Human
gccucucauuccagaggaa

SEQ ID NO: 1919529 - RNA, 20 nt, Human
gccuccuacagcccaccugg

SEQ ID NO: 1919530 - RNA, 19 nt, Human
gccucccgaguagcuggga

SEQ ID NO: 1919531 - RNA, 18 nt, Human
gccucccgaguagcuggg

SEQ ID NO: 1919532 - RNA, 20 nt, Human
gccucccgaguagcugggac

SEQ ID NO: 1919533 - RNA, 13 nt, Human
gccucccugguga

SEQ ID NO: 1919534 - RNA, 15 nt, Human
gccucccuggugaga

SEQ ID NO: 1919535 - RNA, 17 nt, Human
gccucccaucacccgcu

SEQ ID NO: 1919536 - RNA, 14 nt, Human
gccucccaucaccc

SEQ ID NO: 1919537 - RNA, 16 nt, Human
gccucccaucacccgc

SEQ ID NO: 1919538 - RNA, 15 nt, Human
gccucccaaaugagc

SEQ ID NO: 1919539 - RNA, 14 nt, Human
gccucccacugggg

SEQ ID NO: 1919540 - RNA, 16 nt, Human
gccucccaacucaccc

SEQ ID NO: 1919541 - RNA, 17 nt, Human
gccucccaacucacccc

SEQ ID NO: 1919542 - RNA, 18 nt, Human
gccucccaacucacccca

SEQ ID NO: 1919543 - RNA, 19 nt, Human
gccucccaacucaccccag

SEQ ID NO: 1919544 - RNA, 19 nt, Human
gccucccaaagugcuggga

SEQ ID NO: 1919545 - RNA, 13 nt, Human
gccucccaacuca

SEQ ID NO: 1919546 - RNA, 18 nt, Human
gccucccaaagugcuggg

SEQ ID NO: 1919547 - RNA, 16 nt, Human
gccucagcauccuggc

SEQ ID NO: 1919548 - RNA, 15 nt, Human
gccucagcauccugg

SEQ ID NO: 1919549 - RNA, 21 nt, Human
gccucacaguccuuaccagca

SEQ ID NO: 1919550 - RNA, 18 nt, Human
gccucacaguccuuacca

SEQ ID NO: 1919551 - RNA, 16 nt, Human
gccgucaccccugccu

SEQ ID NO: 1919552 - RNA, 22 nt, Human
gccguaguagauguucuacuuu

SEQ ID NO: 1919553 - RNA, 15 nt, Human
gccguaguagauguu

SEQ ID NO: 1919554 - RNA, 15 nt, Human
gccgguggugcaggu

SEQ ID NO: 1919555 - RNA, 15 nt, Human
gccgucuaccugagg

SEQ ID NO: 1919556 - RNA, 16 nt, Human
gccgucuaccugaggg

SEQ ID NO: 1919557 - RNA, 17 nt, Human
gccgucuaccugagggg

SEQ ID NO: 1919558 - RNA, 17 nt, Human
gccgugcucgccccagc

SEQ ID NO: 1919559 - RNA, 21 nt, Human
gccgugcucgccccagcaggu

SEQ ID NO: 1919560 - RNA, 20 nt, Human
gccgugcucgccccagcagg

SEQ ID NO: 1919561 - RNA, 20 nt, Human
gccguguaaccauggaccca

SEQ ID NO: 1919562 - RNA, 18 nt, Human
gccguguguugcaugcag

SEQ ID NO: 1919563 - RNA, 22 nt, Human
gccuaugcacauauggacucug

SEQ ID NO: 1919564 - RNA, 20 nt, Human
gccuaugcacauauggacuc

SEQ ID NO: 1919565 - RNA, 23 nt, Human
gccuaugcacauauggacucugc

SEQ ID NO: 1919566 - RNA, 14 nt, Human
gccuaugcacauau

SEQ ID NO: 1919567 - RNA, 13 nt, Human
gccucacaguccu

SEQ ID NO: 1919568 - RNA, 17 nt, Human
gccucacaguccuuacc

SEQ ID NO: 1919569 - RNA, 19 nt, Human
gccucaaccuccugggcua

SEQ ID NO: 1919570 - RNA, 18 nt, Human
gccucaaccuccugggcu

SEQ ID NO: 1919571 - RNA, 21 nt, Human
gccgcaccuaaagcagccagc

SEQ ID NO: 1919572 - RNA, 12 nt, Human
gccgcagagcug

SEQ ID NO: 1919573 - RNA, 13 nt, Human
gccgcagcccugc

SEQ ID NO: 1919574 - RNA, 12 nt, Human
gccgcagcccug

SEQ ID NO: 1919575 - RNA, 20 nt, Human
gccgcaccuaaagcagccag

SEQ ID NO: 1919576 - RNA, 19 nt, Human
gccgcaccauugaacugua

SEQ ID NO: 1919577 - RNA, 11 nt, Human
gccgcagcccu

SEQ ID NO: 1919578 - RNA, 21 nt, Human
gccgagaucacgccacugcac

SEQ ID NO: 1919579 - RNA, 20 nt, Human
gccgagaucacgccacugca

SEQ ID NO: 1919580 - RNA, 22 nt, Human
gccgagaucacgccacugcacu

SEQ ID NO: 1919581 - RNA, 20 nt, Human
gccgggcgugguggugagug

SEQ ID NO: 1919582 - RNA, 21 nt, Human
gccgggcgcgguggcucacgc

SEQ ID NO: 1919583 - RNA, 15 nt, Human
gccgggccgcagacu

SEQ ID NO: 1919584 - RNA, 19 nt, Human
gccgggaccccgagccugg

SEQ ID NO: 1919585 - RNA, 23 nt, Human
gccgggaccccgagccuggcucc

SEQ ID NO: 1919586 - RNA, 18 nt, Human
gccgggaccccgagccug

SEQ ID NO: 1919587 - RNA, 14 nt, Human
gcccuucucuccag

SEQ ID NO: 1919588 - RNA, 16 nt, Human
gcccuucucuccagcc

SEQ ID NO: 1919589 - RNA, 17 nt, Human
gcccuucucuccagccc

SEQ ID NO: 1919590 - RNA, 18 nt, Human
gcccuucucuccagcccc

SEQ ID NO: 1919591 - RNA, 18 nt, Human
gcgacacugggaggccag

SEQ ID NO: 1919592 - RNA, 12 nt, Human
gcgacagugaga

SEQ ID NO: 1919593 - RNA, 22 nt, Human
gcgacagugagacucugucuca

SEQ ID NO: 1919594 - RNA, 19 nt, Human
gcgccgcaaaccacacugg

SEQ ID NO: 1919595 - RNA, 21 nt, Human
gcgccgcaaaccacacuggac

SEQ ID NO: 1919596 - RNA, 15 nt, Human
gcgccuacaggagug

SEQ ID NO: 1919597 - RNA, 14 nt, Human
gcgccuuucccaac

SEQ ID NO: 1919598 - RNA, 15 nt, Human
gcgccuuucccaacu

SEQ ID NO: 1919599 - RNA, 16 nt, Human
gcgccuuucccaacuc

SEQ ID NO: 1919600 - RNA, 13 nt, Human
gcggacagccacg

SEQ ID NO: 1919601 - RNA, 11 nt, Human
gcggacagcca

SEQ ID NO: 1919602 - RNA, 19 nt, Human
gcgucucauacucaccuca

SEQ ID NO: 1919603 - RNA, 19 nt, Human
gcgguuccucguucucccu

SEQ ID NO: 1919604 - RNA, 22 nt, Human
gcgggugaacaaagcagccacg

SEQ ID NO: 1919605 - RNA, 21 nt, Human
gcgggugaacaaagcagccac

SEQ ID NO: 1919606 - RNA, 18 nt, Human
gcggugggcacccacccu

SEQ ID NO: 1919607 - RNA, 15 nt, Human
gcggacagccacggc

SEQ ID NO: 1919608 - RNA, 22 nt, Human
gcgggcgcacugccucucacag

SEQ ID NO: 1919609 - RNA, 18 nt, Human
gcgggcaggggaggguca

SEQ ID NO: 1919610 - RNA, 17 nt, Human
gcgggcgcacugccucu

SEQ ID NO: 1919611 - RNA, 23 nt, Human
gcgggcgcacugccucucacagc

SEQ ID NO: 1919612 - RNA, 13 nt, Human
gcuaagagggagg

SEQ ID NO: 1919613 - RNA, 15 nt, Human
gcuaaagcccagaga

SEQ ID NO: 1919614 - RNA, 17 nt, Human
gcuaagaauauuugaau

SEQ ID NO: 1919615 - RNA, 16 nt, Human
gcgucuguucccccuu

SEQ ID NO: 1919616 - RNA, 21 nt, Human
gcgucuggaaguccaaugugg

SEQ ID NO: 1919617 - RNA, 17 nt, Human
gcgucuguucccccuuc

SEQ ID NO: 1919618 - RNA, 20 nt, Human
gcuaagagggagggagggcu

SEQ ID NO: 1919619 - RNA, 20 nt, Human
gcuacacacugcauguuugu

SEQ ID NO: 1919620 - RNA, 13 nt, Human
gcuacacacugca

SEQ ID NO: 1919621 - RNA, 14 nt, Human
gcuacacaggggaa

SEQ ID NO: 1919622 - RNA, 15 nt, Human
gcuaggaacacuccu

SEQ ID NO: 1919623 - RNA, 16 nt, Human
gcuaggaacacuccuu

SEQ ID NO: 1919624 - RNA, 17 nt, Human
gcuauagccuggggugg

SEQ ID NO: 1919625 - RNA, 20 nt, Human
gcuaccuuuguauucucucc

SEQ ID NO: 1919626 - RNA, 16 nt, Human
gcuaccuuuguauucu

SEQ ID NO: 1919627 - RNA, 19 nt, Human
gcuagaacucccuuucaac

SEQ ID NO: 1919628 - RNA, 20 nt, Human
gcuacaguuuugugaaucuu

SEQ ID NO: 1919629 - RNA, 15 nt, Human
gcuacaggggccaga

SEQ ID NO: 1919630 - RNA, 13 nt, Human
gccuggugcugcu

SEQ ID NO: 1919631 - RNA, 14 nt, Human
gccugguggcagcu

SEQ ID NO: 1919632 - RNA, 18 nt, Human
gccugguggcagcugcgg

SEQ ID NO: 1919633 - RNA, 21 nt, Human
gccugguggcagcugcggucc

SEQ ID NO: 1919634 - RNA, 19 nt, Human
gccugguggcagcugcggu

SEQ ID NO: 1919635 - RNA, 13 nt, Human
gccugguggcagc

SEQ ID NO: 1919636 - RNA, 14 nt, Human
gccuggggucugga

SEQ ID NO: 1919637 - RNA, 14 nt, Human
gccugggguggggu

SEQ ID NO: 1919638 - RNA, 16 nt, Human
gccuggggugggguca

SEQ ID NO: 1919639 - RNA, 17 nt, Human
gccugguccucacacuc

SEQ ID NO: 1919640 - RNA, 22 nt, Human
gccugggguggggucaugcccu

SEQ ID NO: 1919641 - RNA, 16 nt, Human
gccuggguccagggga

SEQ ID NO: 1919642 - RNA, 22 nt, Human
gccugggggcugggcagaggaa

SEQ ID NO: 1919643 - RNA, 18 nt, Human
gccugccagcugcacuga

SEQ ID NO: 1919644 - RNA, 14 nt, Human
gccugccagcugca

SEQ ID NO: 1919645 - RNA, 15 nt, Human
gccugccagcugcac

SEQ ID NO: 1919646 - RNA, 23 nt, Human
gccugccacucaggcccaaagcc

SEQ ID NO: 1919647 - RNA, 15 nt, Human
gccugccacucaggc

SEQ ID NO: 1919648 - RNA, 10 nt, Human
gccuuaugga

SEQ ID NO: 1919649 - RNA, 14 nt, Human
gccuuauggaacac

SEQ ID NO: 1919650 - RNA, 23 nt, Human
gccuuaucuccaagaccagagau

SEQ ID NO: 1919651 - RNA, 18 nt, Human
gccuuagaagucacacag

SEQ ID NO: 1919652 - RNA, 17 nt, Human
gccuuagaagucacaca

SEQ ID NO: 1919653 - RNA, 19 nt, Human
gccuuagaagucacacagu

SEQ ID NO: 1919654 - RNA, 12 nt, Human
gccuguuuaaga

SEQ ID NO: 1919655 - RNA, 13 nt, Human
gccuguuuaagag

SEQ ID NO: 1919656 - RNA, 18 nt, Human
gccuuacccucauguucu

SEQ ID NO: 1919657 - RNA, 21 nt, Human
gccuuacacaaugguuuucuu

SEQ ID NO: 1919658 - RNA, 20 nt, Human
gccuuacacaaugguuuucu

SEQ ID NO: 1919659 - RNA, 21 nt, Human
gccuuccaggggugggacacc

SEQ ID NO: 1919660 - RNA, 15 nt, Human
gccuuccaggggugg

SEQ ID NO: 1919661 - RNA, 16 nt, Human
gccuuccagggguggg

SEQ ID NO: 1919662 - RNA, 12 nt, Human
gccuuccagggg

SEQ ID NO: 1919663 - RNA, 16 nt, Human
gccuuauggaacacuc

SEQ ID NO: 1919664 - RNA, 18 nt, Human
gccuuauggaacacucug

SEQ ID NO: 1919665 - RNA, 19 nt, Human
gccuuauggaacacucuga

SEQ ID NO: 1919666 - RNA, 20 nt, Human
gccuuauggaacacucugag

SEQ ID NO: 1919667 - RNA, 16 nt, Human
gccuuggcucagacau

SEQ ID NO: 1919668 - RNA, 14 nt, Human
gccuuggcucagac

SEQ ID NO: 1919669 - RNA, 15 nt, Human
gccuuggcucagaca

SEQ ID NO: 1919670 - RNA, 12 nt, Human
gccuuggcucag

SEQ ID NO: 1919671 - RNA, 23 nt, Human
gcgacaaugcaaaccaucauuga

SEQ ID NO: 1919672 - RNA, 13 nt, Human
gccuuuggcuuca

SEQ ID NO: 1919673 - RNA, 16 nt, Human
gccuuuggcagaguuc

SEQ ID NO: 1919674 - RNA, 15 nt, Human
gcccgggcccagagg

SEQ ID NO: 1919675 - RNA, 14 nt, Human
gcccgggcccagag

SEQ ID NO: 1919676 - RNA, 13 nt, Human
gcccgggcccaga

SEQ ID NO: 1919677 - RNA, 19 nt, Human
gcccuccaagaccuucucc

SEQ ID NO: 1919678 - RNA, 21 nt, Human
gcccuccaagaccuucuccuu

SEQ ID NO: 1919679 - RNA, 17 nt, Human
gcccuccagcucuuucc

SEQ ID NO: 1919680 - RNA, 21 nt, Human
gcccuccagcucuuuccuccu

SEQ ID NO: 1919681 - RNA, 12 nt, Human
gcccucccaggc

SEQ ID NO: 1919682 - RNA, 21 nt, Human
gcccucccaggcucucaacag

SEQ ID NO: 1919683 - RNA, 22 nt, Human
gcccuccaagaccuucuccuuc

SEQ ID NO: 1919684 - RNA, 23 nt, Human
gcccuccaagaccuucuccuuca

SEQ ID NO: 1919685 - RNA, 18 nt, Human
gcccuccccauggagcca

SEQ ID NO: 1919686 - RNA, 18 nt, Human
gcccucccuguuccccag

SEQ ID NO: 1919687 - RNA, 20 nt, Human
gcccucccuguuccccagag

SEQ ID NO: 1919688 - RNA, 17 nt, Human
gcccuccuacccugcgc

SEQ ID NO: 1919689 - RNA, 22 nt, Human
gcccucccuguuccccagagaa

SEQ ID NO: 1919690 - RNA, 21 nt, Human
gcccucccuguuccccagaga

SEQ ID NO: 1919691 - RNA, 13 nt, Human
gcccucugcccac

SEQ ID NO: 1919692 - RNA, 16 nt, Human
gcccucugcccacucc

SEQ ID NO: 1919693 - RNA, 18 nt, Human
gcccucugcccacucccu

SEQ ID NO: 1919694 - RNA, 19 nt, Human
gcccucugcccacucccug

SEQ ID NO: 1919695 - RNA, 14 nt, Human
gcccugagcuuucu

SEQ ID NO: 1919696 - RNA, 18 nt, Human
gcccuccuacccugcgcc

SEQ ID NO: 1919697 - RNA, 14 nt, Human
gcccugacccugug

SEQ ID NO: 1919698 - RNA, 17 nt, Human
gcccugacccuguggaa

SEQ ID NO: 1919699 - RNA, 16 nt, Human
gcccugcagagggcac

SEQ ID NO: 1919700 - RNA, 15 nt, Human
gcccugcagagggca

SEQ ID NO: 1919701 - RNA, 13 nt, Human
gcccugcagaggg

SEQ ID NO: 1919702 - RNA, 14 nt, Human
gcccugcagagggc

SEQ ID NO: 1919703 - RNA, 22 nt, Human
gccccgaggccuucucugaagg

SEQ ID NO: 1919704 - RNA, 18 nt, Human
gccccgaggccuucucug

SEQ ID NO: 1919705 - RNA, 14 nt, Human
gccccucagggucc

SEQ ID NO: 1919706 - RNA, 15 nt, Human
gccccgaggccuucu

SEQ ID NO: 1919707 - RNA, 16 nt, Human
gccccucagggucccu

SEQ ID NO: 1919708 - RNA, 18 nt, Human
gccccucagggucccugg

SEQ ID NO: 1919709 - RNA, 23 nt, Human
gccccuucugcucagcucugggc

SEQ ID NO: 1919710 - RNA, 19 nt, Human
gccccuucugcucagcucu

SEQ ID NO: 1919711 - RNA, 20 nt, Human
gccccuucugcucagcucug

SEQ ID NO: 1919712 - RNA, 15 nt, Human
gccccuuuacggaca

SEQ ID NO: 1919713 - RNA, 20 nt, Human
gccccuuuacggacaccccc

SEQ ID NO: 1919714 - RNA, 22 nt, Human
gccccuuuacggacacccccuc

SEQ ID NO: 1919715 - RNA, 17 nt, Human
gccccuguucuggcaga

SEQ ID NO: 1919716 - RNA, 14 nt, Human
gccccuucugcuca

SEQ ID NO: 1919717 - RNA, 15 nt, Human
gccccuucugcucag

SEQ ID NO: 1919718 - RNA, 17 nt, Human
gccccuucugcucagcu

SEQ ID NO: 1919719 - RNA, 18 nt, Human
gccccuucugcucagcuc

SEQ ID NO: 1919720 - RNA, 18 nt, Human
gccccugucuagagaggg

SEQ ID NO: 1919721 - RNA, 19 nt, Human
gccccugucuagagaggga

SEQ ID NO: 1919722 - RNA, 20 nt, Human
gccccugagaucucugcagg

SEQ ID NO: 1919723 - RNA, 16 nt, Human
gccccugagaucucug

SEQ ID NO: 1919724 - RNA, 23 nt, Human
gcccccacaauggucccaaacag

SEQ ID NO: 1919725 - RNA, 12 nt, Human
gcccccugcccu

SEQ ID NO: 1919726 - RNA, 14 nt, Human
gcccccugcccucc

SEQ ID NO: 1919727 - RNA, 19 nt, Human
gcccccugcccuccccucu

SEQ ID NO: 1919728 - RNA, 13 nt, Human
gcccccuggccuc

SEQ ID NO: 1919729 - RNA, 14 nt, Human
gcccccuggccucu

SEQ ID NO: 1919730 - RNA, 15 nt, Human
gcccccuggccucug

SEQ ID NO: 1919731 - RNA, 16 nt, Human
gcccccuggccucugu

SEQ ID NO: 1919732 - RNA, 17 nt, Human
gcccccuggccucugug

SEQ ID NO: 1919733 - RNA, 19 nt, Human
gcccccuggccucugugcc

SEQ ID NO: 1919734 - RNA, 14 nt, Human
gccccauucugccu

SEQ ID NO: 1919735 - RNA, 15 nt, Human
gccccauucugccug

SEQ ID NO: 1919736 - RNA, 23 nt, Human
gccccauucuuuuguaauuuaaa

SEQ ID NO: 1919737 - RNA, 13 nt, Human
gccccauccucug

SEQ ID NO: 1919738 - RNA, 14 nt, Human
gccccauccucugu

SEQ ID NO: 1919739 - RNA, 22 nt, Human
gccccauccucuguacagagcc

SEQ ID NO: 1919740 - RNA, 12 nt, Human
gccccagugccc

SEQ ID NO: 1919741 - RNA, 18 nt, Human
gccccaucccaaacccuu

SEQ ID NO: 1919742 - RNA, 14 nt, Human
gccccauccuccag

SEQ ID NO: 1919743 - RNA, 16 nt, Human
gccccauccuccagca

SEQ ID NO: 1919744 - RNA, 17 nt, Human
gccccauccuccagcag

SEQ ID NO: 1919745 - RNA, 18 nt, Human
gccccauccuccagcagg

SEQ ID NO: 1919746 - RNA, 14 nt, Human
gccccagugcccac

SEQ ID NO: 1919747 - RNA, 13 nt, Human
gccccagugccca

SEQ ID NO: 1919748 - RNA, 10 nt, Human
gcccaggccu

SEQ ID NO: 1919749 - RNA, 13 nt, Human
gcccagagcccag

SEQ ID NO: 1919750 - RNA, 15 nt, Human
gcccaggcuggagug

SEQ ID NO: 1919751 - RNA, 13 nt, Human
gcccaggccuccu

SEQ ID NO: 1919752 - RNA, 23 nt, Human
gcccaggccccugccacccuggg

SEQ ID NO: 1919753 - RNA, 21 nt, Human
gcccagagaggguggugaccu

SEQ ID NO: 1919754 - RNA, 12 nt, Human
gcccaggcuggc

SEQ ID NO: 1919755 - RNA, 19 nt, Human
gcccaggcuggagugcagu

SEQ ID NO: 1919756 - RNA, 20 nt, Human
gcccaggcuggagugcagug

SEQ ID NO: 1919757 - RNA, 15 nt, Human
gccaggacaccgggc

SEQ ID NO: 1919758 - RNA, 23 nt, Human
gccaggaauuucccaggacccug

SEQ ID NO: 1919759 - RNA, 21 nt, Human
gccaggaauuucccaggaccc

SEQ ID NO: 1919760 - RNA, 22 nt, Human
gccaggaauuucccaggacccu

SEQ ID NO: 1919761 - RNA, 20 nt, Human
gccaggacaccgggcagggc

SEQ ID NO: 1919762 - RNA, 13 nt, Human
gccagcuggagaa

SEQ ID NO: 1919763 - RNA, 15 nt, Human
gccaggaagccagca

SEQ ID NO: 1919764 - RNA, 17 nt, Human
gccaggaauuucccagg

SEQ ID NO: 1919765 - RNA, 18 nt, Human
gccaggaauuucccagga

SEQ ID NO: 1919766 - RNA, 19 nt, Human
gccaggaauuucccaggac

SEQ ID NO: 1919767 - RNA, 20 nt, Human
gccaggaauuucccaggacc

SEQ ID NO: 1919768 - RNA, 19 nt, Human
gccaggagccuccugcccu

SEQ ID NO: 1919769 - RNA, 20 nt, Human
gccaggagccuccugcccuu

SEQ ID NO: 1919770 - RNA, 14 nt, Human
gccaggagccuccu

SEQ ID NO: 1919771 - RNA, 16 nt, Human
gccaggagccuccugc

SEQ ID NO: 1919772 - RNA, 17 nt, Human
gccagcugcuugggcuu

SEQ ID NO: 1919773 - RNA, 18 nt, Human
gccagcugcuugggcuuc

SEQ ID NO: 1919774 - RNA, 13 nt, Human
gccagcugccucc

SEQ ID NO: 1919775 - RNA, 20 nt, Human
gccagcugcuugggcuucau

SEQ ID NO: 1919776 - RNA, 12 nt, Human
gccaggaagcca

SEQ ID NO: 1919777 - RNA, 13 nt, Human
gccaggaagccag

SEQ ID NO: 1919778 - RNA, 14 nt, Human
gccaggaagccagc

SEQ ID NO: 1919779 - RNA, 14 nt, Human
gccagcugaugacu

SEQ ID NO: 1919780 - RNA, 16 nt, Human
gccagcugaugacuca

SEQ ID NO: 1919781 - RNA, 17 nt, Human
gccagcugaugacucaa

SEQ ID NO: 1919782 - RNA, 14 nt, Human
gccagcugcacuga

SEQ ID NO: 1919783 - RNA, 18 nt, Human
gccagcugaugacucaag

SEQ ID NO: 1919784 - RNA, 19 nt, Human
gccagcugaugacucaaga

SEQ ID NO: 1919785 - RNA, 20 nt, Human
gccagcugcacugaugcugc

SEQ ID NO: 1919786 - RNA, 21 nt, Human
gccagagagccuggugcugcu

SEQ ID NO: 1919787 - RNA, 13 nt, Human
gccagagauccaa

SEQ ID NO: 1919788 - RNA, 16 nt, Human
gccagagauccaaaag

SEQ ID NO: 1919789 - RNA, 20 nt, Human
gccagagauccaaaagaagc

SEQ ID NO: 1919790 - RNA, 13 nt, Human
gccagaggcaccu

SEQ ID NO: 1919791 - RNA, 21 nt, Human
gccagagauccaaaagaagcc

SEQ ID NO: 1919792 - RNA, 22 nt, Human
gccagagauccaaaagaagccc

SEQ ID NO: 1919793 - RNA, 17 nt, Human
gccagagggagugacag

SEQ ID NO: 1919794 - RNA, 15 nt, Human
gccagauccagccug

SEQ ID NO: 1919795 - RNA, 16 nt, Human
gccagauccagccugg

SEQ ID NO: 1919796 - RNA, 17 nt, Human
gccagauccagccuggg

SEQ ID NO: 1919797 - RNA, 20 nt, Human
gccagauccagccugggguc

SEQ ID NO: 1919798 - RNA, 14 nt, Human
gccagaugcaccag

SEQ ID NO: 1919799 - RNA, 15 nt, Human
gccagaugcaccagc

SEQ ID NO: 1919800 - RNA, 20 nt, Human
gccagauucuuuccugaggc

SEQ ID NO: 1919801 - RNA, 24 nt, Human
gccagauucuuuccugaggcuggg

SEQ ID NO: 1919802 - RNA, 13 nt, Human
gccagauuucacu

SEQ ID NO: 1919803 - RNA, 22 nt, Human
gccagccgagauagccaaggcc

SEQ ID NO: 1919804 - RNA, 19 nt, Human
gccagauucuuuccugagg

SEQ ID NO: 1919805 - RNA, 22 nt, Human
gccacugcaccgggccacagag

SEQ ID NO: 1919806 - RNA, 21 nt, Human
gccagagacacaagccuucgg

SEQ ID NO: 1919807 - RNA, 22 nt, Human
gccagagacacaagccuucggc

SEQ ID NO: 1919808 - RNA, 21 nt, Human
gccacugcaccgggccacaga

SEQ ID NO: 1919809 - RNA, 20 nt, Human
gccacugcaccgggccacag

SEQ ID NO: 1919810 - RNA, 20 nt, Human
gccaaggccaaaggaagcac

SEQ ID NO: 1919811 - RNA, 21 nt, Human
gccaacacgcaccugccucag

SEQ ID NO: 1919812 - RNA, 23 nt, Human
gccaacacgcaccugccucagga

SEQ ID NO: 1919813 - RNA, 17 nt, Human
gccaacagaagcuucca

SEQ ID NO: 1919814 - RNA, 17 nt, Human
gccaacacgcaccugcc

SEQ ID NO: 1919815 - RNA, 20 nt, Human
gccaacacgcaccugccuca

SEQ ID NO: 1919816 - RNA, 17 nt, Human
gccaaggcucuguuuau

SEQ ID NO: 1919817 - RNA, 24 nt, Human
gccaaggccaaaggaagcacaugc

SEQ ID NO: 1919818 - RNA, 19 nt, Human
gccaacagaagcuuccauu

SEQ ID NO: 1919819 - RNA, 23 nt, Human
gccaucugguuaggauggcagga

SEQ ID NO: 1919820 - RNA, 21 nt, Human
gccaucugggcuccuccaggg

SEQ ID NO: 1919821 - RNA, 14 nt, Human
gccauccagguuca

SEQ ID NO: 1919822 - RNA, 21 nt, Human
gccaucauguuuacagaggac

SEQ ID NO: 1919823 - RNA, 17 nt, Human
gccaucauguuuacaga

SEQ ID NO: 1919824 - RNA, 14 nt, Human
gccaugcuccuggc

SEQ ID NO: 1919825 - RNA, 17 nt, Human
gccaugccucagcccug

SEQ ID NO: 1919826 - RNA, 21 nt, Human
gccaugccucagcccugaccc

SEQ ID NO: 1919827 - RNA, 13 nt, Human
gccaugccucagc

SEQ ID NO: 1919828 - RNA, 14 nt, Human
gccaugccucagcc

SEQ ID NO: 1919829 - RNA, 17 nt, Human
gccaugauggcaacaga

SEQ ID NO: 1919830 - RNA, 19 nt, Human
gccaugauggcaacagauc

SEQ ID NO: 1919831 - RNA, 21 nt, Human
gccaugauggcaacagaucug

SEQ ID NO: 1919832 - RNA, 23 nt, Human
gccaugauggcaacagaucugga

SEQ ID NO: 1919833 - RNA, 23 nt, Human
gccaugaagaggaugcugugaaa

SEQ ID NO: 1919834 - RNA, 21 nt, Human
gccagucaccccggccaccug

SEQ ID NO: 1919835 - RNA, 22 nt, Human
gccagucccugaggcagguccc

SEQ ID NO: 1919836 - RNA, 16 nt, Human
gccagucccugaggca

SEQ ID NO: 1919837 - RNA, 15 nt, Human
gccaggcuggucuca

SEQ ID NO: 1919838 - RNA, 18 nt, Human
gccaggcugaccacagca

SEQ ID NO: 1919839 - RNA, 19 nt, Human
gccaggcugaccacagcac

SEQ ID NO: 1919840 - RNA, 20 nt, Human
gccaggcugaccacagcaca

SEQ ID NO: 1919841 - RNA, 23 nt, Human
gccaguaaaugggggugcauuug

SEQ ID NO: 1919842 - RNA, 13 nt, Human
gccaggcuggucu

SEQ ID NO: 1919843 - RNA, 23 nt, Human
gccaggcugggucgcccuggacu

SEQ ID NO: 1919844 - RNA, 17 nt, Human
gccaggcugggucgccc

SEQ ID NO: 1919845 - RNA, 15 nt, Human
gccaggcugaccaca

SEQ ID NO: 1919846 - RNA, 16 nt, Human
gccaggcugaccacag

SEQ ID NO: 1919847 - RNA, 17 nt, Human
gccaggcugaccacagc

SEQ ID NO: 1919848 - RNA, 16 nt, Human
gccaugggccuccugu

SEQ ID NO: 1919849 - RNA, 15 nt, Human
gccaugggccuccug

SEQ ID NO: 1919850 - RNA, 24 nt, Human
gccaugcuccuggcccacugcauc

SEQ ID NO: 1919851 - RNA, 20 nt, Human
gcccaagguuaaaaaguuca

SEQ ID NO: 1919852 - RNA, 15 nt, Human
gcccaagggaucugg

SEQ ID NO: 1919853 - RNA, 18 nt, Human
gcccaagggaucuggucc

SEQ ID NO: 1919854 - RNA, 19 nt, Human
gcccaagggaucugguccu

SEQ ID NO: 1919855 - RNA, 17 nt, Human
gcccaccuuggcucaag

SEQ ID NO: 1919856 - RNA, 16 nt, Human
gcccaccuuggcucaa

SEQ ID NO: 1919857 - RNA, 15 nt, Human
gcccaccuuggcuca

SEQ ID NO: 1919858 - RNA, 13 nt, Human
gcccaccuuggcu

SEQ ID NO: 1919859 - RNA, 14 nt, Human
gcccacuucugcca

SEQ ID NO: 1919860 - RNA, 16 nt, Human
gcccagaaugaggcug

SEQ ID NO: 1919861 - RNA, 17 nt, Human
gcccagaaugaggcugc

SEQ ID NO: 1919862 - RNA, 15 nt, Human
gcccaccuggccucu

SEQ ID NO: 1919863 - RNA, 16 nt, Human
gcccaccuggccucug

SEQ ID NO: 1919864 - RNA, 17 nt, Human
gcccaccuggccucugc

SEQ ID NO: 1919865 - RNA, 20 nt, Human
gcccaccuggccucugcacu

SEQ ID NO: 1919866 - RNA, 21 nt, Human
gcccaccuggccucugcacuc

SEQ ID NO: 1919867 - RNA, 24 nt, Human
gcccaccuggccucugcacucccc

SEQ ID NO: 1919868 - RNA, 23 nt, Human
uuuuaauuauuauuuauauaugu

SEQ ID NO: 1919869 - RNA, 20 nt, Human
uuuuaauuauuauuuauaua

SEQ ID NO: 1919870 - RNA, 17 nt, Human
uuuuaauuauuauucuu

SEQ ID NO: 1919871 - RNA, 16 nt, Human
uuuuaauuauuauucu

SEQ ID NO: 1919872 - RNA, 11 nt, Human
uuuuaauuauu

SEQ ID NO: 1919873 - RNA, 18 nt, Human
uuuucuaaaguaaaaaca

SEQ ID NO: 1919874 - RNA, 21 nt, Human
uuuugguccaaguugugcuua

SEQ ID NO: 1919875 - RNA, 15 nt, Human
uuuuggucuguguga

SEQ ID NO: 1919876 - RNA, 14 nt, Human
uuuuggcugcugaa

SEQ ID NO: 1919877 - RNA, 20 nt, Human
uuuugacaaggggcaguggu

SEQ ID NO: 1919878 - RNA, 16 nt, Human
uuuuggauuguauauu

SEQ ID NO: 1919879 - RNA, 19 nt, Human
uuuuguagagccagggucu

SEQ ID NO: 1919880 - RNA, 14 nt, Human
uuuuguaauuuaaa

SEQ ID NO: 1919881 - RNA, 15 nt, Human
uuuuguaacaaauga

SEQ ID NO: 1919882 - RNA, 18 nt, Human
uuuuguaacuuccaugug

SEQ ID NO: 1919883 - RNA, 19 nt, Human
uuuugguuaagcuuugaca

SEQ ID NO: 1919884 - RNA, 21 nt, Human
uuuugguuaagcuuugacacu

SEQ ID NO: 1919885 - RNA, 22 nt, Human
uuuugguuaagcuuugacacug

SEQ ID NO: 1919886 - RNA, 14 nt, Human
uuuugguuuuguuc

SEQ ID NO: 1919887 - RNA, 16 nt, Human
uuuugguuuuguuccc

SEQ ID NO: 1919888 - RNA, 20 nt, Human
uuuugguuuuguuccccucc

SEQ ID NO: 1919889 - RNA, 16 nt, Human
uuuugucauauaagau

SEQ ID NO: 1919890 - RNA, 13 nt, Human
uuuugucuugugu

SEQ ID NO: 1919891 - RNA, 11 nt, Human
uuuuuaaaagu

SEQ ID NO: 1919892 - RNA, 18 nt, Human
uuuuuaaaaacuaaaaaa

SEQ ID NO: 1919893 - RNA, 17 nt, Human
uuuuuaaagacagaguc

SEQ ID NO: 1919894 - RNA, 20 nt, Human
uuuuuaaagaaaaguuuugu

SEQ ID NO: 1919895 - RNA, 12 nt, Human
uuuuuaaagaaa

SEQ ID NO: 1919896 - RNA, 16 nt, Human
uuuuuaaaauauuuau

SEQ ID NO: 1919897 - RNA, 12 nt, Human
uuuuuaaagacu

SEQ ID NO: 1919898 - RNA, 13 nt, Human
uuuuuaaagacuu

SEQ ID NO: 1919899 - RNA, 18 nt, Human
uuuuuaaagacuuuuaug

SEQ ID NO: 1919900 - RNA, 15 nt, Human
uuuuuaaagcuacaa

SEQ ID NO: 1919901 - RNA, 11 nt, Human
uuuuuccuuca

SEQ ID NO: 1919902 - RNA, 15 nt, Human
uuuuuccuuaaucca

SEQ ID NO: 1919903 - RNA, 20 nt, Human
uuuuuccuuaauccagcuga

SEQ ID NO: 1919904 - RNA, 11 nt, Human
uuuuuaaaugc

SEQ ID NO: 1919905 - RNA, 18 nt, Human
uuuuuaagcuguuuccau

SEQ ID NO: 1919906 - RNA, 15 nt, Human
uuuuuccuucucugg

SEQ ID NO: 1919907 - RNA, 19 nt, Human
uuuuuccuucagugccuua

SEQ ID NO: 1919908 - RNA, 23 nt, Human
uuuuucucugauacagaaaaguu

SEQ ID NO: 1919909 - RNA, 13 nt, Human
uuuuuuguuucau

SEQ ID NO: 1919910 - RNA, 12 nt, Human
uuuuuuguuuca

SEQ ID NO: 1919911 - RNA, 21 nt, Human
uuuuugaaaaagaaaacacuu

SEQ ID NO: 1919912 - RNA, 18 nt, Human
uuugaaucaucaagucuu

SEQ ID NO: 1919913 - RNA, 22 nt, Human
uuugaagaugccgcauuuggau

SEQ ID NO: 1919914 - RNA, 19 nt, Human
uuugaacugauaaagauga

SEQ ID NO: 1919915 - RNA, 17 nt, Human
uuugaacugauaaagau

SEQ ID NO: 1919916 - RNA, 12 nt, Human
uuucuugccucu

SEQ ID NO: 1919917 - RNA, 17 nt, Human
uuugaagaacaugugag

SEQ ID NO: 1919918 - RNA, 18 nt, Human
uuugaagaacaugugaga

SEQ ID NO: 1919919 - RNA, 15 nt, Human
uuugaacugauaaag

SEQ ID NO: 1919920 - RNA, 14 nt, Human
uuugaacucuucaa

SEQ ID NO: 1919921 - RNA, 21 nt, Human
uuucuugaucaacaucuuuuc

SEQ ID NO: 1919922 - RNA, 23 nt, Human
uuucuucaccucugcuacucaag

SEQ ID NO: 1919923 - RNA, 13 nt, Human
uuucuucucccuc

SEQ ID NO: 1919924 - RNA, 12 nt, Human
uuucuucucccu

SEQ ID NO: 1919925 - RNA, 23 nt, Human
uuucuuagggaaggauacaaaag

SEQ ID NO: 1919926 - RNA, 18 nt, Human
uuucuuagggaaggauac

SEQ ID NO: 1919927 - RNA, 23 nt, Human
uuucuuaucacaaaaaagaaaau

SEQ ID NO: 1919928 - RNA, 16 nt, Human
uuucuuaaacaaaugu

SEQ ID NO: 1919929 - RNA, 17 nt, Human
uuaccacagacauacua

SEQ ID NO: 1919930 - RNA, 14 nt, Human
uuaccacagacaua

SEQ ID NO: 1919931 - RNA, 14 nt, Human
uuaccaaucauauu

SEQ ID NO: 1919932 - RNA, 16 nt, Human
uuuccugaggcugggc

SEQ ID NO: 1919933 - RNA, 19 nt, Human
uuuccucccuucugcuacu

SEQ ID NO: 1919934 - RNA, 11 nt, Human
uuuccucccuu

SEQ ID NO: 1919935 - RNA, 12 nt, Human
uuuccucccuuc

SEQ ID NO: 1919936 - RNA, 13 nt, Human
uuuccucccuucu

SEQ ID NO: 1919937 - RNA, 14 nt, Human
uuuccucccuucug

SEQ ID NO: 1919938 - RNA, 17 nt, Human
uuuccucccuucugcua

SEQ ID NO: 1919939 - RNA, 23 nt, Human
uuucuacucgaguuacagacaaa

SEQ ID NO: 1919940 - RNA, 19 nt, Human
uuucuacuuguuauaaacu

SEQ ID NO: 1919941 - RNA, 12 nt, Human
uuucuaaaguaa

SEQ ID NO: 1919942 - RNA, 14 nt, Human
uuucuaaaguaaaa

SEQ ID NO: 1919943 - RNA, 21 nt, Human
uuucuaaaggcuaccuuugua

SEQ ID NO: 1919944 - RNA, 20 nt, Human
uuucuaaaggcuaccuuugu

SEQ ID NO: 1919945 - RNA, 20 nt, Human
uuucuguucuuucuggcuau

SEQ ID NO: 1919946 - RNA, 18 nt, Human
uuucugaagcuuuaccag

SEQ ID NO: 1919947 - RNA, 15 nt, Human
uuucugaagcuuuac

SEQ ID NO: 1919948 - RNA, 19 nt, Human
uuucugaaauuuccuggga

SEQ ID NO: 1919949 - RNA, 21 nt, Human
uuucugaaauuuccugggagc

SEQ ID NO: 1919950 - RNA, 18 nt, Human
uuucucugauacagaaaa

SEQ ID NO: 1919951 - RNA, 17 nt, Human
uuucucugauacagaaa

SEQ ID NO: 1919952 - RNA, 16 nt, Human
uuucucugauacagaa

SEQ ID NO: 1919953 - RNA, 15 nt, Human
uuucucugauacaga

SEQ ID NO: 1919954 - RNA, 18 nt, Human
uuuggagaguuuccugaa

SEQ ID NO: 1919955 - RNA, 21 nt, Human
uuuggaauuuugugcccccau

SEQ ID NO: 1919956 - RNA, 22 nt, Human
uuuggugaacauugcaauagaa

SEQ ID NO: 1919957 - RNA, 23 nt, Human
uuuggugaacauugcaauagaaa

SEQ ID NO: 1919958 - RNA, 19 nt, Human
uuugguuuucacauuggaa

SEQ ID NO: 1919959 - RNA, 15 nt, Human
uuugguuuuguuccc

SEQ ID NO: 1919960 - RNA, 14 nt, Human
uuugguuuuguucc

SEQ ID NO: 1919961 - RNA, 21 nt, Human
uuugguuuuguuccccuccuc

SEQ ID NO: 1919962 - RNA, 19 nt, Human
uuugguuuuguuccccucc

SEQ ID NO: 1919963 - RNA, 16 nt, Human
uuugguuuuguucccc

SEQ ID NO: 1919964 - RNA, 15 nt, Human
uuugcaucugaaaau

SEQ ID NO: 1919965 - RNA, 20 nt, Human
uuugaaucuauuuaucuuca

SEQ ID NO: 1919966 - RNA, 17 nt, Human
uuugaauguaugcuuca

SEQ ID NO: 1919967 - RNA, 22 nt, Human
uuugaauguaugcuucauacag

SEQ ID NO: 1919968 - RNA, 16 nt, Human
uuugcuuugugauuuu

SEQ ID NO: 1919969 - RNA, 15 nt, Human
uuugcuuugugauuu

SEQ ID NO: 1919970 - RNA, 14 nt, Human
uuuggaauuuugug

SEQ ID NO: 1919971 - RNA, 15 nt, Human
uuugcuuugcuuucu

SEQ ID NO: 1919972 - RNA, 18 nt, Human
uuugcuuugcuuucugcu

SEQ ID NO: 1919973 - RNA, 21 nt, Human
uuuguucuggcucuuccaggc

SEQ ID NO: 1919974 - RNA, 14 nt, Human
uuuguucuuuuuau

SEQ ID NO: 1919975 - RNA, 20 nt, Human
uuuguucgcauggucacaca

SEQ ID NO: 1919976 - RNA, 19 nt, Human
uuuguuccccuccuccacu

SEQ ID NO: 1919977 - RNA, 15 nt, Human
uuuuaaagaaaaguu

SEQ ID NO: 1919978 - RNA, 18 nt, Human
uuuuaaagacuuuuauga

SEQ ID NO: 1919979 - RNA, 14 nt, Human
uuuuaaagaaaagu

SEQ ID NO: 1919980 - RNA, 18 nt, Human
uuuuaaaaguaaauguac

SEQ ID NO: 1919981 - RNA, 22 nt, Human
uuuuaaaaguuacuccuuuuag

SEQ ID NO: 1919982 - RNA, 17 nt, Human
uuuuaaagaaugcucuu

SEQ ID NO: 1919983 - RNA, 20 nt, Human
uuuuaaaagaugcaauguag

SEQ ID NO: 1919984 - RNA, 21 nt, Human
uuuuaaaugcaccuggaauau

SEQ ID NO: 1919985 - RNA, 12 nt, Human
uuuuaaaugcac

SEQ ID NO: 1919986 - RNA, 11 nt, Human
uuuuaaaugca

SEQ ID NO: 1919987 - RNA, 21 nt, Human
uuuuaaagaccugacaccuuu

SEQ ID NO: 1919988 - RNA, 13 nt, Human
uuuuaauuaaaua

SEQ ID NO: 1919989 - RNA, 13 nt, Human
guauuaaagacag

SEQ ID NO: 1919990 - RNA, 23 nt, Human
guauguuuuuguguauuuguuaa

SEQ ID NO: 1919991 - RNA, 19 nt, Human
guauguuuuuguguauuug

SEQ ID NO: 1919992 - RNA, 20 nt, Human
guaugaucacggcucacugc

SEQ ID NO: 1919993 - RNA, 20 nt, Human
guaugaggcauuuguuugaa

SEQ ID NO: 1919994 - RNA, 17 nt, Human
guaugaggcauuuguuu

SEQ ID NO: 1919995 - RNA, 21 nt, Human
guaugaucacggcucacugca

SEQ ID NO: 1919996 - RNA, 15 nt, Human
guaugaggcauuugu

SEQ ID NO: 1919997 - RNA, 13 nt, Human
guaugaggcauuu

SEQ ID NO: 1919998 - RNA, 12 nt, Human
guaucugagcag

SEQ ID NO: 1919999 - RNA, 12 nt, Human
guaucuggugac

SEQ ID NO: 1920000 - RNA, 19 nt, Human
guaucuggugacuuuccuc

SEQ ID NO: 1920001 - RNA, 20 nt, Human
guaucuagacccaucuucuu

SEQ ID NO: 1920002 - RNA, 18 nt, Human
guaucuacuuuaauaaau

SEQ ID NO: 1920003 - RNA, 18 nt, Human
guauccugggggacccaa

SEQ ID NO: 1920004 - RNA, 22 nt, Human
guauaugucaagccauaauugu

SEQ ID NO: 1920005 - RNA, 21 nt, Human
guauauauuuuuuaaaaaucu

SEQ ID NO: 1920006 - RNA, 23 nt, Human
guauagaaaugcugguuuuucag

SEQ ID NO: 1920007 - RNA, 13 nt, Human
guauacuuccuua

SEQ ID NO: 1920008 - RNA, 14 nt, Human
guauagaaaugcug

SEQ ID NO: 1920009 - RNA, 19 nt, Human
guauacuuccuuaugcuuc

SEQ ID NO: 1920010 - RNA, 22 nt, Human
guauagaaaugcugguuuuuca

SEQ ID NO: 1920011 - RNA, 15 nt, Human
guauagaaaugcugg

SEQ ID NO: 1920012 - RNA, 13 nt, Human
guauauacuuuuu

SEQ ID NO: 1920013 - RNA, 12 nt, Human
guauauacuuuu

SEQ ID NO: 1920014 - RNA, 15 nt, Human
guauauagcccagcc

SEQ ID NO: 1920015 - RNA, 16 nt, Human
guaggguuauaauaau

SEQ ID NO: 1920016 - RNA, 14 nt, Human
guagucaggugccu

SEQ ID NO: 1920017 - RNA, 14 nt, Human
guagguugggagaa

SEQ ID NO: 1920018 - RNA, 15 nt, Human
guaguaauugacaug

SEQ ID NO: 1920019 - RNA, 17 nt, Human
guauaauucacauugua

SEQ ID NO: 1920020 - RNA, 22 nt, Human
guagucagaauuagcugcuucu

SEQ ID NO: 1920021 - RNA, 21 nt, Human
guagucagaauuagcugcuuc

SEQ ID NO: 1920022 - RNA, 22 nt, Human
guaguccucauaaaaagcaaaa

SEQ ID NO: 1920023 - RNA, 16 nt, Human
guaguccgugcugaca

SEQ ID NO: 1920024 - RNA, 22 nt, Human
guaguccgugcugacagcugcu

SEQ ID NO: 1920025 - RNA, 23 nt, Human
guaguccgugcugacagcugcuc

SEQ ID NO: 1920026 - RNA, 12 nt, Human
guagucuugaug

SEQ ID NO: 1920027 - RNA, 16 nt, Human
guagucuugaugacca

SEQ ID NO: 1920028 - RNA, 15 nt, Human
guagagugugccuga

SEQ ID NO: 1920029 - RNA, 17 nt, Human
guagaugggagggaggc

SEQ ID NO: 1920030 - RNA, 21 nt, Human
guagaugggagggaggcucag

SEQ ID NO: 1920031 - RNA, 16 nt, Human
guagauguucuacuuu

SEQ ID NO: 1920032 - RNA, 16 nt, Human
guagcauccuggaaua

SEQ ID NO: 1920033 - RNA, 15 nt, Human
guagcaguagaugca

SEQ ID NO: 1920034 - RNA, 16 nt, Human
guagcacauguaugcu

SEQ ID NO: 1920035 - RNA, 16 nt, Human
guagggcgggaggaug

SEQ ID NO: 1920036 - RNA, 23 nt, Human
guagcccccuggccucugugccu

SEQ ID NO: 1920037 - RNA, 18 nt, Human
guagcccccuggccucug

SEQ ID NO: 1920038 - RNA, 19 nt, Human
guagcccccuggccucugu

SEQ ID NO: 1920039 - RNA, 22 nt, Human
guagggcgggaggauguucugg

SEQ ID NO: 1920040 - RNA, 21 nt, Human
guagggcgggaggauguucug

SEQ ID NO: 1920041 - RNA, 23 nt, Human
guagggcgggaggauguucuggg

SEQ ID NO: 1920042 - RNA, 16 nt, Human
guagcccccuggccuc

SEQ ID NO: 1920043 - RNA, 17 nt, Human
guagcccccuggccucu

SEQ ID NO: 1920044 - RNA, 19 nt, Human
guagccagcacacagggca

SEQ ID NO: 1920045 - RNA, 21 nt, Human
guagccagcacacagggcagu

SEQ ID NO: 1920046 - RNA, 21 nt, Human
guagcauuuguguugaagagg

SEQ ID NO: 1920047 - RNA, 20 nt, Human
guagcauuuacugugucuuu

SEQ ID NO: 1920048 - RNA, 14 nt, Human
guagcauuuacugu

SEQ ID NO: 1920049 - RNA, 15 nt, Human
guagccagcacacag

SEQ ID NO: 1920050 - RNA, 18 nt, Human
guagccagcacacagggc

SEQ ID NO: 1920051 - RNA, 13 nt, Human
guccacagggcac

SEQ ID NO: 1920052 - RNA, 13 nt, Human
guccacccaggag

SEQ ID NO: 1920053 - RNA, 12 nt, Human
guccacccagga

SEQ ID NO: 1920054 - RNA, 23 nt, Human
guccacccaggagccccgaggcc

SEQ ID NO: 1920055 - RNA, 21 nt, Human
gucccaccuuggcugcaggga

SEQ ID NO: 1920056 - RNA, 18 nt, Human
guccaggggaggccuucc

SEQ ID NO: 1920057 - RNA, 15 nt, Human
gucauucaauaaauu

SEQ ID NO: 1920058 - RNA, 21 nt, Human
gucauucagauaugauucaaa

SEQ ID NO: 1920059 - RNA, 16 nt, Human
gucauucguucugugg

SEQ ID NO: 1920060 - RNA, 21 nt, Human
guccacaguggaaccagccca

SEQ ID NO: 1920061 - RNA, 19 nt, Human
guccacaguggaaccagcc

SEQ ID NO: 1920062 - RNA, 16 nt, Human
guccacaguggaacca

SEQ ID NO: 1920063 - RNA, 23 nt, Human
gucccaccuuggcugcagggagu

SEQ ID NO: 1920064 - RNA, 20 nt, Human
gucccaccuuggcugcaggg

SEQ ID NO: 1920065 - RNA, 16 nt, Human
gucccuaauaaagcug

SEQ ID NO: 1920066 - RNA, 17 nt, Human
gucccuaauaaagcugu

SEQ ID NO: 1920067 - RNA, 17 nt, Human
guccccaccgcagacag

SEQ ID NO: 1920068 - RNA, 21 nt, Human
gucccugcacuugcagacucu

SEQ ID NO: 1920069 - RNA, 19 nt, Human
gucccugcacuugcagacu

SEQ ID NO: 1920070 - RNA, 16 nt, Human
gucccugcacuugcag

SEQ ID NO: 1920071 - RNA, 22 nt, Human
gucccugaggcagguccccaga

SEQ ID NO: 1920072 - RNA, 16 nt, Human
gucccugaagagaagg

SEQ ID NO: 1920073 - RNA, 18 nt, Human
gucccugaggcagguccc

SEQ ID NO: 1920074 - RNA, 11 nt, Human
gucccucugcc

SEQ ID NO: 1920075 - RNA, 14 nt, Human
gucccucugcccca

SEQ ID NO: 1920076 - RNA, 20 nt, Human
gucccucugccccauccucc

SEQ ID NO: 1920077 - RNA, 21 nt, Human
gucccucugccccauccucca

SEQ ID NO: 1920078 - RNA, 18 nt, Human
gucccuaauaaagcugug

SEQ ID NO: 1920079 - RNA, 20 nt, Human
gucccuaauaaagcugugug

SEQ ID NO: 1920080 - RNA, 14 nt, Human
gucagauuuccagu

SEQ ID NO: 1920081 - RNA, 21 nt, Human
gucagauuuccagucuccacc

SEQ ID NO: 1920082 - RNA, 14 nt, Human
gucagagccugcag

SEQ ID NO: 1920083 - RNA, 16 nt, Human
gucagagccugcaguu

SEQ ID NO: 1920084 - RNA, 15 nt, Human
gucagagccugcagu

SEQ ID NO: 1920085 - RNA, 22 nt, Human
gucacucuggcagcucagagag

SEQ ID NO: 1920086 - RNA, 17 nt, Human
gucacucuggcagcuca

SEQ ID NO: 1920087 - RNA, 19 nt, Human
gucacucuggcagcucaga

SEQ ID NO: 1920088 - RNA, 12 nt, Human
gucacucuggca

SEQ ID NO: 1920089 - RNA, 13 nt, Human
gucacucuggcag

SEQ ID NO: 1920090 - RNA, 14 nt, Human
gucacucuggcagc

SEQ ID NO: 1920091 - RNA, 16 nt, Human
gucacucuggcagcuc

SEQ ID NO: 1920092 - RNA, 22 nt, Human
gucaccccggccaccugcggug

SEQ ID NO: 1920093 - RNA, 17 nt, Human
gucaccccggccaccug

SEQ ID NO: 1920094 - RNA, 18 nt, Human
gucaccccggccaccugc

SEQ ID NO: 1920095 - RNA, 14 nt, Human
gucacucauugcug

SEQ ID NO: 1920096 - RNA, 18 nt, Human
gucacucauugcugagcc

SEQ ID NO: 1920097 - RNA, 19 nt, Human
gucacucauugcugagccu

SEQ ID NO: 1920098 - RNA, 20 nt, Human
gucacucauugcugagccuc

SEQ ID NO: 1920099 - RNA, 21 nt, Human
gucacucauugcugagccucu

SEQ ID NO: 1920100 - RNA, 22 nt, Human
gucacucauugcugagccucug

SEQ ID NO: 1920101 - RNA, 23 nt, Human
gucacucauugcugagccucugc

SEQ ID NO: 1920102 - RNA, 24 nt, Human
gucacucauugcugagccucugcu

SEQ ID NO: 1920103 - RNA, 13 nt, Human
guauuuuaaucac

SEQ ID NO: 1920104 - RNA, 22 nt, Human
guauuaaguuguuaauaaaagu

SEQ ID NO: 1920105 - RNA, 14 nt, Human
guauuuuacuaaua

SEQ ID NO: 1920106 - RNA, 21 nt, Human
guauuuuaguaagagauuccu

SEQ ID NO: 1920107 - RNA, 23 nt, Human
guauuuuaucuuugauucuccuu

SEQ ID NO: 1920108 - RNA, 22 nt, Human
guauuuuaucuuugauucuccu

SEQ ID NO: 1920109 - RNA, 19 nt, Human
guauuuuauaauucuggga

SEQ ID NO: 1920110 - RNA, 13 nt, Human
guauuuugaaaau

SEQ ID NO: 1920111 - RNA, 20 nt, Human
guauuuucuucaccucugcu

SEQ ID NO: 1920112 - RNA, 15 nt, Human
gucaaugcagccccc

SEQ ID NO: 1920113 - RNA, 15 nt, Human
gucaagugaaaaagg

SEQ ID NO: 1920114 - RNA, 19 nt, Human
guauuuuguuuuugucuua

SEQ ID NO: 1920115 - RNA, 19 nt, Human
gucucuucugggcacccuc

SEQ ID NO: 1920116 - RNA, 21 nt, Human
gucucuggauuauauuaugaa

SEQ ID NO: 1920117 - RNA, 17 nt, Human
gucucuggaauuugaaa

SEQ ID NO: 1920118 - RNA, 22 nt, Human
gucucacucugucgcccagucu

SEQ ID NO: 1920119 - RNA, 19 nt, Human
gucucacucugucgcccag

SEQ ID NO: 1920120 - RNA, 18 nt, Human
gucucacucugucgccca

SEQ ID NO: 1920121 - RNA, 16 nt, Human
gucucacucugucgcc

SEQ ID NO: 1920122 - RNA, 15 nt, Human
gucucacucugucgc

SEQ ID NO: 1920123 - RNA, 19 nt, Human
gucucgugguaggacugua

SEQ ID NO: 1920124 - RNA, 18 nt, Human
gucgucaaagcugaaaug

SEQ ID NO: 1920125 - RNA, 19 nt, Human
gucucacuauguugcccag

SEQ ID NO: 1920126 - RNA, 11 nt, Human
gucucacucug

SEQ ID NO: 1920127 - RNA, 18 nt, Human
gucucacuauguugccca

SEQ ID NO: 1920128 - RNA, 15 nt, Human
gucccugccaaugga

SEQ ID NO: 1920129 - RNA, 11 nt, Human
gucccugccaa

SEQ ID NO: 1920130 - RNA, 14 nt, Human
gucccugccaaugg

SEQ ID NO: 1920131 - RNA, 21 nt, Human
guccuuaccagcagagcaccu

SEQ ID NO: 1920132 - RNA, 15 nt, Human
guccuuagaacauuu

SEQ ID NO: 1920133 - RNA, 18 nt, Human
guccuuaccagcagagca

SEQ ID NO: 1920134 - RNA, 19 nt, Human
guccuuaccagcagagcac

SEQ ID NO: 1920135 - RNA, 21 nt, Human
gucggaaaacaugcuacacac

SEQ ID NO: 1920136 - RNA, 17 nt, Human
guccuuagaacauuuua

SEQ ID NO: 1920137 - RNA, 16 nt, Human
gucgggcaugacacga

SEQ ID NO: 1920138 - RNA, 18 nt, Human
gucuuggacacuguacaa

SEQ ID NO: 1920139 - RNA, 16 nt, Human
gucuugguuccagccu

SEQ ID NO: 1920140 - RNA, 16 nt, Human
gucuuuuuucacuaca

SEQ ID NO: 1920141 - RNA, 19 nt, Human
gucuugguuccagccugcc

SEQ ID NO: 1920142 - RNA, 17 nt, Human
gucuugguuccagccug

SEQ ID NO: 1920143 - RNA, 15 nt, Human
gucuuggacacugua

SEQ ID NO: 1920144 - RNA, 14 nt, Human
gucuuggacacugu

SEQ ID NO: 1920145 - RNA, 21 nt, Human
gucuugcaauggcagccuugg

SEQ ID NO: 1920146 - RNA, 20 nt, Human
gucuugcaauggcagccuug

SEQ ID NO: 1920147 - RNA, 23 nt, Human
gucuugcaauggcagccuuggca

SEQ ID NO: 1920148 - RNA, 18 nt, Human
gucuugaugaccaaaguc

SEQ ID NO: 1920149 - RNA, 17 nt, Human
gucuugaacuccuggcc

SEQ ID NO: 1920150 - RNA, 16 nt, Human
gucuugaacuccuggc

SEQ ID NO: 1920151 - RNA, 21 nt, Human
gucuuaaaaaguggaaaaaua

SEQ ID NO: 1920152 - RNA, 14 nt, Human
gucuguuuuguaaa

SEQ ID NO: 1920153 - RNA, 15 nt, Human
gucuguuuuguaaag

SEQ ID NO: 1920154 - RNA, 19 nt, Human
gucuugcaauggcagccuu

SEQ ID NO: 1920155 - RNA, 18 nt, Human
gucuugcaauggcagccu

SEQ ID NO: 1920156 - RNA, 17 nt, Human
gucuugcaauggcagcc

SEQ ID NO: 1920157 - RNA, 16 nt, Human
gucuugcaauggcagc

SEQ ID NO: 1920158 - RNA, 20 nt, Human
gucuugaacuccuggccuca

SEQ ID NO: 1920159 - RNA, 18 nt, Human
gucuugaacuccuggccu

SEQ ID NO: 1920160 - RNA, 21 nt, Human
gucuugaacuccuggccucaa

SEQ ID NO: 1920161 - RNA, 17 nt, Human
gucuguucuuuccaaag

SEQ ID NO: 1920162 - RNA, 14 nt, Human
gucuguucuuucca

SEQ ID NO: 1920163 - RNA, 23 nt, Human
gucuguuuuguaaaguccccaga

SEQ ID NO: 1920164 - RNA, 20 nt, Human
gucuguguguguguaugugg

SEQ ID NO: 1920165 - RNA, 16 nt, Human
gucuguguguguguau

SEQ ID NO: 1920166 - RNA, 12 nt, Human
gucugugugugu

SEQ ID NO: 1920167 - RNA, 11 nt, Human
gucugugugug

SEQ ID NO: 1920168 - RNA, 14 nt, Human
gucuguguuuuaau

SEQ ID NO: 1920169 - RNA, 20 nt, Human
gucuguguuuuuuuggcagu

SEQ ID NO: 1920170 - RNA, 22 nt, Human
gucuguguguuuaugugugugu

SEQ ID NO: 1920171 - RNA, 21 nt, Human
gucuguguguuuaugugugug

SEQ ID NO: 1920172 - RNA, 11 nt, Human
gucuguguguu

SEQ ID NO: 1920173 - RNA, 21 nt, Human
gucugugagaugcuagaacuc

SEQ ID NO: 1920174 - RNA, 17 nt, Human
gucugugagaugcuaga

SEQ ID NO: 1920175 - RNA, 16 nt, Human
gucugugagaugcuag

SEQ ID NO: 1920176 - RNA, 15 nt, Human
gucugugagaugcua

SEQ ID NO: 1920177 - RNA, 18 nt, Human
gucugugccauuuuguau

SEQ ID NO: 1920178 - RNA, 23 nt, Human
gucugugagaugcuagaacuccc

SEQ ID NO: 1920179 - RNA, 22 nt, Human
gucugugagaugcuagaacucc

SEQ ID NO: 1920180 - RNA, 11 nt, Human
gucugccaggg

SEQ ID NO: 1920181 - RNA, 12 nt, Human
gucugccagggc

SEQ ID NO: 1920182 - RNA, 13 nt, Human
gucugccagggcc

SEQ ID NO: 1920183 - RNA, 22 nt, Human
gugaaugaaagucuugugacua

SEQ ID NO: 1920184 - RNA, 21 nt, Human
gugaaugaugauccuaggcau

SEQ ID NO: 1920185 - RNA, 20 nt, Human
gugacaaggauugcuacugu

SEQ ID NO: 1920186 - RNA, 14 nt, Human
gugaauuguuugaa

SEQ ID NO: 1920187 - RNA, 17 nt, Human
gugaauuguuugaaccu

SEQ ID NO: 1920188 - RNA, 15 nt, Human
gucuuguacaugugu

SEQ ID NO: 1920189 - RNA, 19 nt, Human
gugaacaagcaaacccaga

SEQ ID NO: 1920190 - RNA, 18 nt, Human
gugaacaaagcagccacg

SEQ ID NO: 1920191 - RNA, 17 nt, Human
gugaacaaagcagccac

SEQ ID NO: 1920192 - RNA, 21 nt, Human
gugaacaaauuuacagagaca

SEQ ID NO: 1920193 - RNA, 13 nt, Human
gugaaugaacacu

SEQ ID NO: 1920194 - RNA, 15 nt, Human
gugaccucugccuga

SEQ ID NO: 1920195 - RNA, 22 nt, Human
gugaccuuccaagagccugaga

SEQ ID NO: 1920196 - RNA, 21 nt, Human
gugaccuuccaagagccugag

SEQ ID NO: 1920197 - RNA, 22 nt, Human
gugacagagcaagacucugucu

SEQ ID NO: 1920198 - RNA, 14 nt, Human
gugaccucugccug

SEQ ID NO: 1920199 - RNA, 13 nt, Human
gugaccucugccu

SEQ ID NO: 1920200 - RNA, 15 nt, Human
gugacagaggcagcc

SEQ ID NO: 1920201 - RNA, 12 nt, Human
gugaccucugcc

SEQ ID NO: 1920202 - RNA, 14 nt, Human
gugacagaggcagc

SEQ ID NO: 1920203 - RNA, 13 nt, Human
gugacagaggcag

SEQ ID NO: 1920204 - RNA, 12 nt, Human
gugacagaggca

SEQ ID NO: 1920205 - RNA, 20 nt, Human
gugaucagaccauaauguua

SEQ ID NO: 1920206 - RNA, 22 nt, Human
gugauccacccaccucagccuc

SEQ ID NO: 1920207 - RNA, 13 nt, Human
gugaucaaagcca

SEQ ID NO: 1920208 - RNA, 19 nt, Human
gugauauaaguguguguuu

SEQ ID NO: 1920209 - RNA, 13 nt, Human
gugauagcacuuu

SEQ ID NO: 1920210 - RNA, 14 nt, Human
gugauagcacuuuc

SEQ ID NO: 1920211 - RNA, 13 nt, Human
gugauauauuuaa

SEQ ID NO: 1920212 - RNA, 17 nt, Human
gugauacaaugcugugc

SEQ ID NO: 1920213 - RNA, 15 nt, Human
gugauacaaugcugu

SEQ ID NO: 1920214 - RNA, 17 nt, Human
gugaguugauagcacag

SEQ ID NO: 1920215 - RNA, 22 nt, Human
gugacuagugcugaagcuuauu

SEQ ID NO: 1920216 - RNA, 18 nt, Human
gugacuagugcugaagcu

SEQ ID NO: 1920217 - RNA, 17 nt, Human
gugacuagugcugaagc

SEQ ID NO: 1920218 - RNA, 15 nt, Human
gugacuagugcugaa

SEQ ID NO: 1920219 - RNA, 14 nt, Human
gugacuagugcuga

SEQ ID NO: 1920220 - RNA, 13 nt, Human
gugacuagugcug

SEQ ID NO: 1920221 - RNA, 11 nt, Human
gugacuagugc

SEQ ID NO: 1920222 - RNA, 21 nt, Human
gugacuagugcugaagcuuau

SEQ ID NO: 1920223 - RNA, 21 nt, Human
gugacuauggagcugagcagg

SEQ ID NO: 1920224 - RNA, 20 nt, Human
gugagccacugcaccgggcc

SEQ ID NO: 1920225 - RNA, 15 nt, Human
gugagccacugcacc

SEQ ID NO: 1920226 - RNA, 15 nt, Human
gugagcccagcuggg

SEQ ID NO: 1920227 - RNA, 18 nt, Human
gugagcccagcuggguca

SEQ ID NO: 1920228 - RNA, 20 nt, Human
gugagcccagcugggucagg

SEQ ID NO: 1920229 - RNA, 19 nt, Human
gugagccgagaucacgcca

SEQ ID NO: 1920230 - RNA, 13 nt, Human
gugaggagcuggg

SEQ ID NO: 1920231 - RNA, 18 nt, Human
gugaggagcuugaaaccc

SEQ ID NO: 1920232 - RNA, 17 nt, Human
gugaggaugaaaaaaua

SEQ ID NO: 1920233 - RNA, 15 nt, Human
gugaggaugucuggg

SEQ ID NO: 1920234 - RNA, 17 nt, Human
gugcccucaccacccac

SEQ ID NO: 1920235 - RNA, 21 nt, Human
gugcgaucuggguucacugca

SEQ ID NO: 1920236 - RNA, 14 nt, Human
gugccuuuugccau

SEQ ID NO: 1920237 - RNA, 16 nt, Human
gugccaugugccaggu

SEQ ID NO: 1920238 - RNA, 14 nt, Human
gugccaugugccag

SEQ ID NO: 1920239 - RNA, 21 nt, Human
gugccaggauggaaugauggg

SEQ ID NO: 1920240 - RNA, 17 nt, Human
gugccauuuugcauuuu

SEQ ID NO: 1920241 - RNA, 14 nt, Human
gugcgccuacagga

SEQ ID NO: 1920242 - RNA, 14 nt, Human
gugcggccuuuggc

SEQ ID NO: 1920243 - RNA, 12 nt, Human
gugcagccagag

SEQ ID NO: 1920244 - RNA, 13 nt, Human
gugcagccagagg

SEQ ID NO: 1920245 - RNA, 14 nt, Human
gugcagccagaggc

SEQ ID NO: 1920246 - RNA, 23 nt, Human
gugcaguggugcgaucuggguuc

SEQ ID NO: 1920247 - RNA, 20 nt, Human
gugcaguggugcgaucuggg

SEQ ID NO: 1920248 - RNA, 22 nt, Human
gugcauaccacuuuuguucuug

SEQ ID NO: 1920249 - RNA, 20 nt, Human
gugcagaccccuuggccagc

SEQ ID NO: 1920250 - RNA, 22 nt, Human
gugcacuaauguguaagacaaa

SEQ ID NO: 1920251 - RNA, 15 nt, Human
gugcacugcccaugg

SEQ ID NO: 1920252 - RNA, 21 nt, Human
gugcacugcccauggacaggc

SEQ ID NO: 1920253 - RNA, 19 nt, Human
gugcacugcccauggacag

SEQ ID NO: 1920254 - RNA, 20 nt, Human
gugcacugcccauggacagg

SEQ ID NO: 1920255 - RNA, 12 nt, Human
gugauuuucauu

SEQ ID NO: 1920256 - RNA, 18 nt, Human
gugauuuuuguaauuuuu

SEQ ID NO: 1920257 - RNA, 13 nt, Human
gugauuuuuguaa

SEQ ID NO: 1920258 - RNA, 24 nt, Human
gugauccacccaccucagccuccc

SEQ ID NO: 1920259 - RNA, 23 nt, Human
gugauccacccaccucagccucc

SEQ ID NO: 1920260 - RNA, 14 nt, Human
gugucugcccccuc

SEQ ID NO: 1920261 - RNA, 14 nt, Human
gugucuggcugcag

SEQ ID NO: 1920262 - RNA, 22 nt, Human
gugucucuugguccugcugcag

SEQ ID NO: 1920263 - RNA, 17 nt, Human
gugucugaguggcuuca

SEQ ID NO: 1920264 - RNA, 21 nt, Human
gugucucggagggauuccccu

SEQ ID NO: 1920265 - RNA, 18 nt, Human
gugucucuugguccugcu

SEQ ID NO: 1920266 - RNA, 19 nt, Human
gugucucuugguccugcug

SEQ ID NO: 1920267 - RNA, 20 nt, Human
gugucucuugguccugcugc

SEQ ID NO: 1920268 - RNA, 21 nt, Human
gugucucuugguccugcugca

SEQ ID NO: 1920269 - RNA, 20 nt, Human
gugugagucaccaagcccag

SEQ ID NO: 1920270 - RNA, 16 nt, Human
gugugauugacagcuu

SEQ ID NO: 1920271 - RNA, 21 nt, Human
gugugauugacagcuuugcug

SEQ ID NO: 1920272 - RNA, 23 nt, Human
gugugauugacagcuuugcugcu

SEQ ID NO: 1920273 - RNA, 17 nt, Human
gugugcacuaaggggcc

SEQ ID NO: 1920274 - RNA, 19 nt, Human
gugugcaaugucugaguga

SEQ ID NO: 1920275 - RNA, 23 nt, Human
gugugcacuaaggggcccggcca

SEQ ID NO: 1920276 - RNA, 21 nt, Human
guguccuguaguugcguggac

SEQ ID NO: 1920277 - RNA, 16 nt, Human
guguccuuagaacauu

SEQ ID NO: 1920278 - RNA, 15 nt, Human
gugucgggcaugaca

SEQ ID NO: 1920279 - RNA, 23 nt, Human
gugucccugcacuugcagacucu

SEQ ID NO: 1920280 - RNA, 14 nt, Human
guguccggucccug

SEQ ID NO: 1920281 - RNA, 19 nt, Human
gugucuaggcaggaccugu

SEQ ID NO: 1920282 - RNA, 17 nt, Human
gugucgagucaaaaugu

SEQ ID NO: 1920283 - RNA, 17 nt, Human
gugucucccuucauccu

SEQ ID NO: 1920284 - RNA, 17 nt, Human
gugucuccaacccccca

SEQ ID NO: 1920285 - RNA, 13 nt, Human
gugucuccaaccc

SEQ ID NO: 1920286 - RNA, 14 nt, Human
gugucucuuggucc

SEQ ID NO: 1920287 - RNA, 21 nt, Human
gugucuccaaccccccagcac

SEQ ID NO: 1920288 - RNA, 19 nt, Human
gugucuccaaccccccagc

SEQ ID NO: 1920289 - RNA, 18 nt, Human
gugucuccaaccccccag

SEQ ID NO: 1920290 - RNA, 22 nt, Human
gugugcucugaucauccacugu

SEQ ID NO: 1920291 - RNA, 15 nt, Human
gugugcucugaucau

SEQ ID NO: 1920292 - RNA, 15 nt, Human
gugugcucugcuuca

SEQ ID NO: 1920293 - RNA, 18 nt, Human
gugugcuuuaugcugaaa

SEQ ID NO: 1920294 - RNA, 22 nt, Human
gugugcuuuaugcugaaacaga

SEQ ID NO: 1920295 - RNA, 12 nt, Human
gugugcucugau

SEQ ID NO: 1920296 - RNA, 18 nt, Human
gugugcucaggagcccug

SEQ ID NO: 1920297 - RNA, 19 nt, Human
gugugcucaggagcccugg

SEQ ID NO: 1920298 - RNA, 16 nt, Human
gugugcucaggagccc

SEQ ID NO: 1920299 - RNA, 17 nt, Human
gugugcucaggagcccu

SEQ ID NO: 1920300 - RNA, 15 nt, Human
guguguuuaugugug

SEQ ID NO: 1920301 - RNA, 14 nt, Human
guguguuuaugugu

SEQ ID NO: 1920302 - RNA, 12 nt, Human
guguguuuuaaa

SEQ ID NO: 1920303 - RNA, 16 nt, Human
guguguuuaugugugu

SEQ ID NO: 1920304 - RNA, 15 nt, Human
guguguugccacagg

SEQ ID NO: 1920305 - RNA, 17 nt, Human
guguguuguguguggga

SEQ ID NO: 1920306 - RNA, 14 nt, Human
guguguugugugug

SEQ ID NO: 1920307 - RNA, 12 nt, Human
guguguugugug

SEQ ID NO: 1920308 - RNA, 21 nt, Human
guguggagaagcggcuggcag

SEQ ID NO: 1920309 - RNA, 22 nt, Human
guguggagaagccacaggccug

SEQ ID NO: 1920310 - RNA, 23 nt, Human
guguggagaagccacaggccuga

SEQ ID NO: 1920311 - RNA, 13 nt, Human
guguggagaagcg

SEQ ID NO: 1920312 - RNA, 17 nt, Human
gugugggaguguguaau

SEQ ID NO: 1920313 - RNA, 16 nt, Human
guguuaaucauuucau

SEQ ID NO: 1920314 - RNA, 14 nt, Human
guguguuuuucaua

SEQ ID NO: 1920315 - RNA, 13 nt, Human
guguguuuuaaaa

SEQ ID NO: 1920316 - RNA, 16 nt, Human
guguguuuuaaaauga

SEQ ID NO: 1920317 - RNA, 19 nt, Human
guguguuuuaaaaugagaa

SEQ ID NO: 1920318 - RNA, 14 nt, Human
guguuacuaaguuu

SEQ ID NO: 1920319 - RNA, 12 nt, Human
guguuacuaagu

SEQ ID NO: 1920320 - RNA, 18 nt, Human
guguuaugacuccagaau

SEQ ID NO: 1920321 - RNA, 19 nt, Human
guguuacuguaauuccuca

SEQ ID NO: 1920322 - RNA, 15 nt, Human
guguuacuguaauuc

SEQ ID NO: 1920323 - RNA, 18 nt, Human
guguuuuucauaaagcag

SEQ ID NO: 1920324 - RNA, 15 nt, Human
guguuuuuaacucaa

SEQ ID NO: 1920325 - RNA, 19 nt, Human
guguuccuggcaguuuaaa

SEQ ID NO: 1920326 - RNA, 23 nt, Human
guguucaaggccauccuucccug

SEQ ID NO: 1920327 - RNA, 19 nt, Human
guuaaacuuacuuaguguu

SEQ ID NO: 1920328 - RNA, 17 nt, Human
guuaaacucgcucacug

SEQ ID NO: 1920329 - RNA, 13 nt, Human
guuaaaggaaaaa

SEQ ID NO: 1920330 - RNA, 22 nt, Human
guuaaaauaccagccaguaaau

SEQ ID NO: 1920331 - RNA, 16 nt, Human
guuacacauuuuucag

SEQ ID NO: 1920332 - RNA, 15 nt, Human
guuacacuaaaaggu

SEQ ID NO: 1920333 - RNA, 16 nt, Human
guuacacuaaaaggug

SEQ ID NO: 1920334 - RNA, 17 nt, Human
guuacacauuuuucaga

SEQ ID NO: 1920335 - RNA, 13 nt, Human
guuacagacaaag

SEQ ID NO: 1920336 - RNA, 21 nt, Human
guuaacuauuuuauuuucuaa

SEQ ID NO: 1920337 - RNA, 14 nt, Human
guguagccugugca

SEQ ID NO: 1920338 - RNA, 22 nt, Human
guguacauggaauaacauguaa

SEQ ID NO: 1920339 - RNA, 17 nt, Human
guguaccauuugccucc

SEQ ID NO: 1920340 - RNA, 21 nt, Human
guguacucccagggcuuacgg

SEQ ID NO: 1920341 - RNA, 13 nt, Human
guguacucccagg

SEQ ID NO: 1920342 - RNA, 22 nt, Human
guguacagucuuguauuaaguu

SEQ ID NO: 1920343 - RNA, 16 nt, Human
guguacagucuuguau

SEQ ID NO: 1920344 - RNA, 13 nt, Human
guguacagucuug

SEQ ID NO: 1920345 - RNA, 17 nt, Human
guguacauggaauaaca

SEQ ID NO: 1920346 - RNA, 20 nt, Human
guguaauuuaaaauugugau

SEQ ID NO: 1920347 - RNA, 23 nt, Human
guguaauuuaaaauugugaugug

SEQ ID NO: 1920348 - RNA, 22 nt, Human
guguaauuuaaaauugugaugu

SEQ ID NO: 1920349 - RNA, 18 nt, Human
gugucccugcacuugcag

SEQ ID NO: 1920350 - RNA, 16 nt, Human
gugucccugcacuugc

SEQ ID NO: 1920351 - RNA, 13 nt, Human
gugucccugcacu

SEQ ID NO: 1920352 - RNA, 20 nt, Human
guguauggagagaaaacaga

SEQ ID NO: 1920353 - RNA, 14 nt, Human
gugguauagaaaug

SEQ ID NO: 1920354 - RNA, 19 nt, Human
gugguaugaucacggcuca

SEQ ID NO: 1920355 - RNA, 17 nt, Human
gugguagagugugccug

SEQ ID NO: 1920356 - RNA, 14 nt, Human
guggucccacccca

SEQ ID NO: 1920357 - RNA, 15 nt, Human
guggucccaccccac

SEQ ID NO: 1920358 - RNA, 16 nt, Human
guggucccaccccaca

SEQ ID NO: 1920359 - RNA, 17 nt, Human
guggucccaccccacac

SEQ ID NO: 1920360 - RNA, 18 nt, Human
gugguccuaaucuucuga

SEQ ID NO: 1920361 - RNA, 18 nt, Human
guggucuccacuggggau

SEQ ID NO: 1920362 - RNA, 17 nt, Human
guggugaccucugccug

SEQ ID NO: 1920363 - RNA, 14 nt, Human
guggugaccucugc

SEQ ID NO: 1920364 - RNA, 21 nt, Human
guggugagaggcauccaguau

SEQ ID NO: 1920365 - RNA, 19 nt, Human
guggugcgaucuggguuca

SEQ ID NO: 1920366 - RNA, 17 nt, Human
guguaagacaaaaagcu

SEQ ID NO: 1920367 - RNA, 21 nt, Human
guguaaguauucuuauuuaau

SEQ ID NO: 1920368 - RNA, 23 nt, Human
guggguuucuaaagcugccagcc

SEQ ID NO: 1920369 - RNA, 12 nt, Human
gugguaacccug

SEQ ID NO: 1920370 - RNA, 17 nt, Human
guggggcagcuugaggg

SEQ ID NO: 1920371 - RNA, 13 nt, Human
guggggcagcuug

SEQ ID NO: 1920372 - RNA, 15 nt, Human
guggggaccucaggc

SEQ ID NO: 1920373 - RNA, 18 nt, Human
guggggaccucaggccug

SEQ ID NO: 1920374 - RNA, 16 nt, Human
guggggaggaaauaga

SEQ ID NO: 1920375 - RNA, 14 nt, Human
gugggcuugauucu

SEQ ID NO: 1920376 - RNA, 17 nt, Human
guggggaagugaucuuu

SEQ ID NO: 1920377 - RNA, 15 nt, Human
gugggcuaguugggc

SEQ ID NO: 1920378 - RNA, 12 nt, Human
gugggcuaagca

SEQ ID NO: 1920379 - RNA, 23 nt, Human
gugggcgggcaggggagggucag

SEQ ID NO: 1920380 - RNA, 17 nt, Human
gugggcccaaugcacuu

SEQ ID NO: 1920381 - RNA, 15 nt, Human
gugggcauucaaaug

SEQ ID NO: 1920382 - RNA, 17 nt, Human
gugggccaacaaagaac

SEQ ID NO: 1920383 - RNA, 13 nt, Human
gugggccuggcca

SEQ ID NO: 1920384 - RNA, 22 nt, Human
guggcuuaaaacaacacucaca

SEQ ID NO: 1920385 - RNA, 16 nt, Human
guggcuucacuccugc

SEQ ID NO: 1920386 - RNA, 17 nt, Human
guggcuucacuccugcu

SEQ ID NO: 1920387 - RNA, 23 nt, Human
guggcuucacuccugcuguaaau

SEQ ID NO: 1920388 - RNA, 13 nt, Human
gugggcaggaaaa

SEQ ID NO: 1920389 - RNA, 14 nt, Human
gugggcaggaaaag

SEQ ID NO: 1920390 - RNA, 16 nt, Human
gugggcacccacccug

SEQ ID NO: 1920391 - RNA, 20 nt, Human
gugggcacccacccugggac

SEQ ID NO: 1920392 - RNA, 19 nt, Human
guggcuggguuggagggug

SEQ ID NO: 1920393 - RNA, 23 nt, Human
guggcugcuucaaggauccugag

SEQ ID NO: 1920394 - RNA, 17 nt, Human
guggcuggaucugugag

SEQ ID NO: 1920395 - RNA, 15 nt, Human
guggcugcuucaagg

SEQ ID NO: 1920396 - RNA, 16 nt, Human
guggcugcuucaagga

SEQ ID NO: 1920397 - RNA, 19 nt, Human
guggcugcuucaaggaucc

SEQ ID NO: 1920398 - RNA, 22 nt, Human
guggcugcuucaaggauccuga

SEQ ID NO: 1920399 - RNA, 15 nt, Human
guggcucagccagca

SEQ ID NO: 1920400 - RNA, 17 nt, Human
guggcuauuaaaacucu

SEQ ID NO: 1920401 - RNA, 19 nt, Human
guggcuauuaaaacucuuu

SEQ ID NO: 1920402 - RNA, 20 nt, Human
guggcuauuaaaacucuuuu

SEQ ID NO: 1920403 - RNA, 12 nt, Human
guggcugcuuca

SEQ ID NO: 1920404 - RNA, 14 nt, Human
guggcugcuucaag

SEQ ID NO: 1920405 - RNA, 16 nt, Human
guggcugccucauuua

SEQ ID NO: 1920406 - RNA, 20 nt, Human
guggcugccucauuuagaga

SEQ ID NO: 1920407 - RNA, 13 nt, Human
gugcuaauuuuga

SEQ ID NO: 1920408 - RNA, 15 nt, Human
gugcuaauuuugaaa

SEQ ID NO: 1920409 - RNA, 14 nt, Human
guggcucacgccug

SEQ ID NO: 1920410 - RNA, 19 nt, Human
guggcuagucaagcuccuc

SEQ ID NO: 1920411 - RNA, 20 nt, Human
guggcuagucaagcuccucc

SEQ ID NO: 1920412 - RNA, 21 nt, Human
guggcuagucaagcuccuccu

SEQ ID NO: 1920413 - RNA, 22 nt, Human
guggcuagucaagcuccuccuc

SEQ ID NO: 1920414 - RNA, 23 nt, Human
guggcuagucaagcuccuccucc

SEQ ID NO: 1920415 - RNA, 18 nt, Human
guggcuagucaagcuccu

SEQ ID NO: 1920416 - RNA, 17 nt, Human
guuauuauauuuacaaa

SEQ ID NO: 1920417 - RNA, 19 nt, Human
guucaagcgauucuucugc

SEQ ID NO: 1920418 - RNA, 19 nt, Human
guuauuaaaaaucucaaau

SEQ ID NO: 1920419 - RNA, 22 nt, Human
guuaugcaagggacuguguguu

SEQ ID NO: 1920420 - RNA, 19 nt, Human
guucaaggccauccuuccc

SEQ ID NO: 1920421 - RNA, 20 nt, Human
guucaagcgauucuucugcu

SEQ ID NO: 1920422 - RNA, 18 nt, Human
guucaaggccauccuucc

SEQ ID NO: 1920423 - RNA, 16 nt, Human
guucaauucucauuug

SEQ ID NO: 1920424 - RNA, 23 nt, Human
guucaauucucauuugucacaca

SEQ ID NO: 1920425 - RNA, 13 nt, Human
guucaauuagaau

SEQ ID NO: 1920426 - RNA, 21 nt, Human
guuaugacuccagaauuuccc

SEQ ID NO: 1920427 - RNA, 19 nt, Human
guuauccauuuaaaaaugg

SEQ ID NO: 1920428 - RNA, 15 nt, Human
guuaucuaaaagaaa

SEQ ID NO: 1920429 - RNA, 16 nt, Human
guuaucuaaaagaaau

SEQ ID NO: 1920430 - RNA, 14 nt, Human
guuacuaucugcuu

SEQ ID NO: 1920431 - RNA, 20 nt, Human
guuacuagguaacuucauau

SEQ ID NO: 1920432 - RNA, 15 nt, Human
guuacucagaauucu

SEQ ID NO: 1920433 - RNA, 22 nt, Human
guuacuaaguuuuuauggcuuu

SEQ ID NO: 1920434 - RNA, 16 nt, Human
guuacuagguaacuuc

SEQ ID NO: 1920435 - RNA, 13 nt, Human
guuacuauaugcc

SEQ ID NO: 1920436 - RNA, 22 nt, Human
guuaguuucuccaagcaggaca

SEQ ID NO: 1920437 - RNA, 16 nt, Human
guuaguuucuccaagc

SEQ ID NO: 1920438 - RNA, 19 nt, Human
guuaguuucuccaagcagg

SEQ ID NO: 1920439 - RNA, 23 nt, Human
guuaccauuuugggguacccacu

SEQ ID NO: 1920440 - RNA, 16 nt, Human
guuacccaaauuaaga

SEQ ID NO: 1920441 - RNA, 21 nt, Human
guuacauuuuuaagugcugca

SEQ ID NO: 1920442 - RNA, 15 nt, Human
guuacagacaaagcg

SEQ ID NO: 1920443 - RNA, 17 nt, Human
guuacagacaaagcgug

SEQ ID NO: 1920444 - RNA, 18 nt, Human
guuacagccuguuaguaa

SEQ ID NO: 1920445 - RNA, 21 nt, Human
guuacagccuguuaguaacau

SEQ ID NO: 1920446 - RNA, 18 nt, Human
guuacauaagauaaaugu

SEQ ID NO: 1920447 - RNA, 19 nt, Human
guuacauaagauaaaugug

SEQ ID NO: 1920448 - RNA, 22 nt, Human
guucaccuugaagaaccucuca

SEQ ID NO: 1920449 - RNA, 19 nt, Human
guucacugcaaccuccgcc

SEQ ID NO: 1920450 - RNA, 24 nt, Human
guucacucuuggagccugcagagc

SEQ ID NO: 1920451 - RNA, 20 nt, Human
guucacucuuggagccugca

SEQ ID NO: 1920452 - RNA, 17 nt, Human
guucacucuuggagccu

SEQ ID NO: 1920453 - RNA, 19 nt, Human
guucacucuuggagccugc

SEQ ID NO: 1920454 - RNA, 18 nt, Human
guucacucuuggagccug

SEQ ID NO: 1920455 - RNA, 13 nt, Human
guucacucuucuc

SEQ ID NO: 1920456 - RNA, 20 nt, Human
guucacucuucucagccacu

SEQ ID NO: 1920457 - RNA, 14 nt, Human
guucagaagaaauu

SEQ ID NO: 1920458 - RNA, 17 nt, Human
guucaucauccuaagcu

SEQ ID NO: 1920459 - RNA, 16 nt, Human
guucaucaaugaauga

SEQ ID NO: 1920460 - RNA, 23 nt, Human
guucagccacccugaggccucug

SEQ ID NO: 1920461 - RNA, 18 nt, Human
guucaucuugaauuguaa

SEQ ID NO: 1920462 - RNA, 20 nt, Human
guucauccuauucuuucgaa

SEQ ID NO: 1920463 - RNA, 12 nt, Human
guucaugaaaga

SEQ ID NO: 1920464 - RNA, 12 nt, Human
guucaucuugaa

SEQ ID NO: 1920465 - RNA, 13 nt, Human
guucaucuugaau

SEQ ID NO: 1920466 - RNA, 12 nt, Human
guucaugacaau

SEQ ID NO: 1920467 - RNA, 14 nt, Human
guuccucguucucc

SEQ ID NO: 1920468 - RNA, 17 nt, Human
guuccucguucucccug

SEQ ID NO: 1920469 - RNA, 20 nt, Human
guuccucguucucccuggga

SEQ ID NO: 1920470 - RNA, 18 nt, Human
guuccucguucucccugg

SEQ ID NO: 1920471 - RNA, 23 nt, Human
guuccuggcaguuuaaaaaaauu

SEQ ID NO: 1920472 - RNA, 14 nt, Human
guuccuggcaguuu

SEQ ID NO: 1920473 - RNA, 14 nt, Human
guuccuaauccucu

SEQ ID NO: 1920474 - RNA, 15 nt, Human
guuccagccugccac

SEQ ID NO: 1920475 - RNA, 22 nt, Human
guuccucauuagcauuuugcua

SEQ ID NO: 1920476 - RNA, 15 nt, Human
guuccuagaguagag

SEQ ID NO: 1920477 - RNA, 16 nt, Human
guuccuagccaccgcc

SEQ ID NO: 1920478 - RNA, 14 nt, Human
guuccagcaccaca

SEQ ID NO: 1920479 - RNA, 14 nt, Human
guuccagccugcca

SEQ ID NO: 1920480 - RNA, 13 nt, Human
guuccagccugcc

SEQ ID NO: 1920481 - RNA, 17 nt, Human
guuccaccaucaagcca

SEQ ID NO: 1920482 - RNA, 20 nt, Human
guuccaccaucaagccacca

SEQ ID NO: 1920483 - RNA, 19 nt, Human
guucuaaaaauugugauca

SEQ ID NO: 1920484 - RNA, 14 nt, Human
guucuaaagaugga

SEQ ID NO: 1920485 - RNA, 20 nt, Human
guucuaaagauggaaaaacc

SEQ ID NO: 1920486 - RNA, 17 nt, Human
guucuaaagauggaaaa

SEQ ID NO: 1920487 - RNA, 23 nt, Human
guucuaaagauggaaaaaccacc

SEQ ID NO: 1920488 - RNA, 18 nt, Human
guucgacagugaauauuc

SEQ ID NO: 1920489 - RNA, 20 nt, Human
guucgagaccagccuggcca

SEQ ID NO: 1920490 - RNA, 16 nt, Human
guucgagaccagccug

SEQ ID NO: 1920491 - RNA, 18 nt, Human
guucggauuuggggugga

SEQ ID NO: 1920492 - RNA, 16 nt, Human
guucgggugugcaaug

SEQ ID NO: 1920493 - RNA, 14 nt, Human
guucgcauggucac

SEQ ID NO: 1920494 - RNA, 20 nt, Human
guucgcauggucacacacug

SEQ ID NO: 1920495 - RNA, 16 nt, Human
guucugcaaaaauauu

SEQ ID NO: 1920496 - RNA, 19 nt, Human
guucugauccuaguuccac

SEQ ID NO: 1920497 - RNA, 13 nt, Human
guucugccugcca

SEQ ID NO: 1920498 - RNA, 15 nt, Human
guucugccugccagc

SEQ ID NO: 1920499 - RNA, 17 nt, Human
guucugccugccagcug

SEQ ID NO: 1920500 - RNA, 19 nt, Human
guucugccugccagcugca

SEQ ID NO: 1920501 - RNA, 22 nt, Human
guucugccugccagcugcacug

SEQ ID NO: 1920502 - RNA, 23 nt, Human
guucugccugccagcugcacuga

SEQ ID NO: 1920503 - RNA, 16 nt, Human
guucucuuaaaaggua

SEQ ID NO: 1920504 - RNA, 17 nt, Human
guucugagagaaaaaga

SEQ ID NO: 1920505 - RNA, 23 nt, Human
guucugggacacaguucaauucu

SEQ ID NO: 1920506 - RNA, 18 nt, Human
guucuuucacccuuuucu

SEQ ID NO: 1920507 - RNA, 16 nt, Human
guucugggacacaguu

SEQ ID NO: 1920508 - RNA, 15 nt, Human
guucugggacacagu

SEQ ID NO: 1920509 - RNA, 14 nt, Human
guucugggacacag

SEQ ID NO: 1920510 - RNA, 12 nt, Human
guucugggacac

SEQ ID NO: 1920511 - RNA, 11 nt, Human
guucugggaca

SEQ ID NO: 1920512 - RNA, 16 nt, Human
guucuggccagaaugc

SEQ ID NO: 1920513 - RNA, 23 nt, Human
guucuggcagaguugaagacaga

SEQ ID NO: 1920514 - RNA, 22 nt, Human
guucugcaaaaauauuuauaaa

SEQ ID NO: 1920515 - RNA, 12 nt, Human
guucuggcucuu

SEQ ID NO: 1920516 - RNA, 12 nt, Human
guucuggccaga

SEQ ID NO: 1920517 - RNA, 13 nt, Human
guucuggccagaa

SEQ ID NO: 1920518 - RNA, 16 nt, Human
guucuggcucuuccag

SEQ ID NO: 1920519 - RNA, 20 nt, Human
guucuggcucuuccaggcug

SEQ ID NO: 1920520 - RNA, 20 nt, Human
guucuuuccaaaguacacug

SEQ ID NO: 1920521 - RNA, 18 nt, Human
guucuuuccaaaguacac

SEQ ID NO: 1920522 - RNA, 14 nt, Human
guucuuuccaaagu

SEQ ID NO: 1920523 - RNA, 13 nt, Human
guucuuuccaaag

SEQ ID NO: 1920524 - RNA, 17 nt, Human
guugaaaaacagcugag

SEQ ID NO: 1920525 - RNA, 15 nt, Human
guucuuugggccaga

SEQ ID NO: 1920526 - RNA, 16 nt, Human
guucuuugggccagac

SEQ ID NO: 1920527 - RNA, 17 nt, Human
guucuuugggccagaca

SEQ ID NO: 1920528 - RNA, 22 nt, Human
guucuuugggccagacaugcca

SEQ ID NO: 1920529 - RNA, 16 nt, Human
guugcaacuuuguaua

SEQ ID NO: 1920530 - RNA, 23 nt, Human
guugauuucagcaccuacagugu

SEQ ID NO: 1920531 - RNA, 14 nt, Human
guugcaacuuugua

SEQ ID NO: 1920532 - RNA, 15 nt, Human
guugcaggaccucag

SEQ ID NO: 1920533 - RNA, 19 nt, Human
guugcacuuaugauuucau

SEQ ID NO: 1920534 - RNA, 15 nt, Human
guugcagugagcuga

SEQ ID NO: 1920535 - RNA, 16 nt, Human
guugaagacagagcua

SEQ ID NO: 1920536 - RNA, 15 nt, Human
guugaaccuauuucu

SEQ ID NO: 1920537 - RNA, 16 nt, Human
guugaaccuauuucuc

SEQ ID NO: 1920538 - RNA, 18 nt, Human
guugaagagguuuuaaag

SEQ ID NO: 1920539 - RNA, 18 nt, Human
guugaaccuauuucucuu

SEQ ID NO: 1920540 - RNA, 13 nt, Human
guugaauacuuuu

SEQ ID NO: 1920541 - RNA, 17 nt, Human
guugaauacuuuuuaca

SEQ ID NO: 1920542 - RNA, 14 nt, Human
guuggauuuuuguc

SEQ ID NO: 1920543 - RNA, 14 nt, Human
guuggcaaaaaggc

SEQ ID NO: 1920544 - RNA, 20 nt, Human
guuggauuuuugucuugugu

SEQ ID NO: 1920545 - RNA, 18 nt, Human
guuggcaaaaaggcagga

SEQ ID NO: 1920546 - RNA, 23 nt, Human
guuggccaaagccaaagcuaggc

SEQ ID NO: 1920547 - RNA, 14 nt, Human
guuggccaguguga

SEQ ID NO: 1920548 - RNA, 19 nt, Human
guuggccaggcuggucuca

SEQ ID NO: 1920549 - RNA, 17 nt, Human
guuggccaggcuggucu

SEQ ID NO: 1920550 - RNA, 14 nt, Human
guuggccaggcugg

SEQ ID NO: 1920551 - RNA, 15 nt, Human
guuggccaggcuggu

SEQ ID NO: 1920552 - RNA, 13 nt, Human
guuggccaggcug

SEQ ID NO: 1920553 - RNA, 14 nt, Human
guugcccaggcagg

SEQ ID NO: 1920554 - RNA, 15 nt, Human
guugcccaggcaggu

SEQ ID NO: 1920555 - RNA, 12 nt, Human
guugcccaggca

SEQ ID NO: 1920556 - RNA, 13 nt, Human
guugccagucacc

SEQ ID NO: 1920557 - RNA, 14 nt, Human
guugccagucaccc

SEQ ID NO: 1920558 - RNA, 13 nt, Human
guugccacaggac

SEQ ID NO: 1920559 - RNA, 14 nt, Human
guugccacaggaca

SEQ ID NO: 1920560 - RNA, 15 nt, Human
guugccacaggacac

SEQ ID NO: 1920561 - RNA, 16 nt, Human
guugccacaggacaca

SEQ ID NO: 1920562 - RNA, 16 nt, Human
guugccagucaccccg

SEQ ID NO: 1920563 - RNA, 17 nt, Human
guugccagucaccccgg

SEQ ID NO: 1920564 - RNA, 18 nt, Human
guugccagucaccccggc

SEQ ID NO: 1920565 - RNA, 23 nt, Human
guugccagucaccccggccaccu

SEQ ID NO: 1920566 - RNA, 20 nt, Human
guuuccccaccagugaauga

SEQ ID NO: 1920567 - RNA, 15 nt, Human
guuuccccaccagug

SEQ ID NO: 1920568 - RNA, 17 nt, Human
guuuccccaccagugaa

SEQ ID NO: 1920569 - RNA, 14 nt, Human
guuucuguuuaacu

SEQ ID NO: 1920570 - RNA, 19 nt, Human
guuucuguuuaacuucuua

SEQ ID NO: 1920571 - RNA, 16 nt, Human
guuucuuuaguuuuug

SEQ ID NO: 1920572 - RNA, 18 nt, Human
guuucuuuguaaugaaaa

SEQ ID NO: 1920573 - RNA, 16 nt, Human
guuucuuuagcaguuu

SEQ ID NO: 1920574 - RNA, 19 nt, Human
guuucuuuguaaugaaaac

SEQ ID NO: 1920575 - RNA, 17 nt, Human
guuugagaucagccugg

SEQ ID NO: 1920576 - RNA, 16 nt, Human
guuugacuagaugaug

SEQ ID NO: 1920577 - RNA, 18 nt, Human
guuugacuagaugaugga

SEQ ID NO: 1920578 - RNA, 23 nt, Human
guuugauuaaauucuugcaaagu

SEQ ID NO: 1920579 - RNA, 18 nt, Human
guuugagaucagccuggg

SEQ ID NO: 1920580 - RNA, 19 nt, Human
guuugacuagaugauggau

SEQ ID NO: 1920581 - RNA, 18 nt, Human
guuuguuucugaaaggga

SEQ ID NO: 1920582 - RNA, 22 nt, Human
guuuguguauuuacgcuuugau

SEQ ID NO: 1920583 - RNA, 15 nt, Human
guuuguggcuauuaa

SEQ ID NO: 1920584 - RNA, 18 nt, Human
guuuguggcuauuaaaac

SEQ ID NO: 1920585 - RNA, 20 nt, Human
guuuguaaauuaacuuuuau

SEQ ID NO: 1920586 - RNA, 16 nt, Human
guuugguccagccugg

SEQ ID NO: 1920587 - RNA, 16 nt, Human
guuugauucagacagc

SEQ ID NO: 1920588 - RNA, 20 nt, Human
guuugauucagacagcugcc

SEQ ID NO: 1920589 - RNA, 21 nt, Human
guuugauucagacagcugccu

SEQ ID NO: 1920590 - RNA, 20 nt, Human
guuugagaagaaaacaucua

SEQ ID NO: 1920591 - RNA, 12 nt, Human
guuuucacucuu

SEQ ID NO: 1920592 - RNA, 11 nt, Human
guuuucacucu

SEQ ID NO: 1920593 - RNA, 24 nt, Human
guuuucaggaguggguugauuuca

SEQ ID NO: 1920594 - RNA, 17 nt, Human
guuuuaaaaugagaaau

SEQ ID NO: 1920595 - RNA, 13 nt, Human
guuuucaagucaa

SEQ ID NO: 1920596 - RNA, 15 nt, Human
guuuucaagucaaau

SEQ ID NO: 1920597 - RNA, 17 nt, Human
guuuucaagucaaauua

SEQ ID NO: 1920598 - RNA, 18 nt, Human
guuuucaagucaaauuaa

SEQ ID NO: 1920599 - RNA, 20 nt, Human
guuuucaaaauuguuacaaa

SEQ ID NO: 1920600 - RNA, 17 nt, Human
guuuucaaaauaaaaau

SEQ ID NO: 1920601 - RNA, 20 nt, Human
guuuguuucugaaagggacg

SEQ ID NO: 1920602 - RNA, 13 nt, Human
guuuguuuuccuu

SEQ ID NO: 1920603 - RNA, 18 nt, Human
guuuguuuuccuuuuauu

SEQ ID NO: 1920604 - RNA, 15 nt, Human
guuuuaaaaugagaa

SEQ ID NO: 1920605 - RNA, 16 nt, Human
guuuuaaaaugagaaa

SEQ ID NO: 1920606 - RNA, 14 nt, Human
guuuuguaaauuuc

SEQ ID NO: 1920607 - RNA, 12 nt, Human
guuuuguaaauu

SEQ ID NO: 1920608 - RNA, 13 nt, Human
guuuuguaaaguc

SEQ ID NO: 1920609 - RNA, 17 nt, Human
guuuuguaaagucccca

SEQ ID NO: 1920610 - RNA, 17 nt, Human
guuuuguuccccuccuc

SEQ ID NO: 1920611 - RNA, 16 nt, Human
guuuuguuccccuccu

SEQ ID NO: 1920612 - RNA, 15 nt, Human
guuuuguuccccucc

SEQ ID NO: 1920613 - RNA, 14 nt, Human
guuuuguuccccuc

SEQ ID NO: 1920614 - RNA, 21 nt, Human
guuuuguuccccuccuccacu

SEQ ID NO: 1920615 - RNA, 20 nt, Human
guuuuguuccccuccuccac

SEQ ID NO: 1920616 - RNA, 22 nt, Human
guuuuguuccccuccuccacuc

SEQ ID NO: 1920617 - RNA, 13 nt, Human
guuuuccugaaga

SEQ ID NO: 1920618 - RNA, 14 nt, Human
guuuuccucccuuc

SEQ ID NO: 1920619 - RNA, 13 nt, Human
guuuuccucccuu

SEQ ID NO: 1920620 - RNA, 15 nt, Human
guuuuccucccuucu

SEQ ID NO: 1920621 - RNA, 18 nt, Human
guuuuccucccuucugcu

SEQ ID NO: 1920622 - RNA, 22 nt, Human
guuuuccucccuucugcuacug

SEQ ID NO: 1920623 - RNA, 21 nt, Human
guuuucccugaccucccucua

SEQ ID NO: 1920624 - RNA, 20 nt, Human
guuuucccuugaggaaacaa

SEQ ID NO: 1920625 - RNA, 20 nt, Human
guuuuccagguuuaagcugu

SEQ ID NO: 1920626 - RNA, 19 nt, Human
guuuucagcauugauauuu

SEQ ID NO: 1920627 - RNA, 19 nt, Human
guuuuccaugaguccccug

SEQ ID NO: 1920628 - RNA, 20 nt, Human
guuuuccaugaguccccugu

SEQ ID NO: 1920629 - RNA, 12 nt, Human
guuggcuggggg

SEQ ID NO: 1920630 - RNA, 14 nt, Human
guuggccccugccc

SEQ ID NO: 1920631 - RNA, 13 nt, Human
guuggccccugcc

SEQ ID NO: 1920632 - RNA, 20 nt, Human
guuggccccugcccggcugc

SEQ ID NO: 1920633 - RNA, 19 nt, Human
guuggcugggggccucagu

SEQ ID NO: 1920634 - RNA, 14 nt, Human
guugucaccuucac

SEQ ID NO: 1920635 - RNA, 12 nt, Human
guugucagcuga

SEQ ID NO: 1920636 - RNA, 12 nt, Human
guugucccugca

SEQ ID NO: 1920637 - RNA, 15 nt, Human
guuguuaauaaaagu

SEQ ID NO: 1920638 - RNA, 22 nt, Human
guugugugugggaguguguaau

SEQ ID NO: 1920639 - RNA, 16 nt, Human
guugugugugggagug

SEQ ID NO: 1920640 - RNA, 14 nt, Human
guugugugugggag

SEQ ID NO: 1920641 - RNA, 13 nt, Human
guuguguguggga

SEQ ID NO: 1920642 - RNA, 12 nt, Human
guuguguguggg

SEQ ID NO: 1920643 - RNA, 22 nt, Human
guuguggauuuaacagaaaugu

SEQ ID NO: 1920644 - RNA, 14 nt, Human
guugugguuaaucu

SEQ ID NO: 1920645 - RNA, 19 nt, Human
guugucugcaacucugaag

SEQ ID NO: 1920646 - RNA, 23 nt, Human
guugugacaacuuccugagggau

SEQ ID NO: 1920647 - RNA, 16 nt, Human
guugugccucccuggu

SEQ ID NO: 1920648 - RNA, 18 nt, Human
guugugccucccugguga

SEQ ID NO: 1920649 - RNA, 15 nt, Human
guuuagauaauacac

SEQ ID NO: 1920650 - RNA, 14 nt, Human
guuuagauaauaca

SEQ ID NO: 1920651 - RNA, 16 nt, Human
guuuagaagaagugug

SEQ ID NO: 1920652 - RNA, 20 nt, Human
guuguuugauucagacagcu

SEQ ID NO: 1920653 - RNA, 15 nt, Human
guuguuacauuuuua

SEQ ID NO: 1920654 - RNA, 14 nt, Human
guuguuacauuuuu

SEQ ID NO: 1920655 - RNA, 19 nt, Human
guuuaggaacuacugagga

SEQ ID NO: 1920656 - RNA, 18 nt, Human
guuucauguaauccucaa

SEQ ID NO: 1920657 - RNA, 14 nt, Human
uaaaagauugagaa

SEQ ID NO: 1920658 - RNA, 21 nt, Human
uaaaagauacaguuacucaga

SEQ ID NO: 1920659 - RNA, 20 nt, Human
uaaaagauacaguuacucag

SEQ ID NO: 1920660 - RNA, 17 nt, Human
uaaaagauacaguuacu

SEQ ID NO: 1920661 - RNA, 14 nt, Human
uaaaagauacaguu

SEQ ID NO: 1920662 - RNA, 17 nt, Human
uaaaagauaaauauuau

SEQ ID NO: 1920663 - RNA, 22 nt, Human
uaaaacagguagaauuaucuaa

SEQ ID NO: 1920664 - RNA, 18 nt, Human
uaaaacauuuucacacaa

SEQ ID NO: 1920665 - RNA, 15 nt, Human
uaaaacauuuucaca

SEQ ID NO: 1920666 - RNA, 17 nt, Human
uaaaacauuuucacaca

SEQ ID NO: 1920667 - RNA, 21 nt, Human
uaaaagguaugcaaucaaauc

SEQ ID NO: 1920668 - RNA, 12 nt, Human
uaaaaggagcca

SEQ ID NO: 1920669 - RNA, 14 nt, Human
uaaaaggaagccaa

SEQ ID NO: 1920670 - RNA, 19 nt, Human
uaaaaggaagccaaagagu

SEQ ID NO: 1920671 - RNA, 11 nt, Human
uaaaagcacac

SEQ ID NO: 1920672 - RNA, 19 nt, Human
uaaaaggugaccaaugaug

SEQ ID NO: 1920673 - RNA, 12 nt, Human
uaaaaggugacc

SEQ ID NO: 1920674 - RNA, 19 nt, Human
uaaaacaagaaaguuuccc

SEQ ID NO: 1920675 - RNA, 18 nt, Human
uaaaacaagaaaguuucc

SEQ ID NO: 1920676 - RNA, 20 nt, Human
uaaaacaagaaaguuucccc

SEQ ID NO: 1920677 - RNA, 17 nt, Human
uaaaacacaacaucuuu

SEQ ID NO: 1920678 - RNA, 22 nt, Human
uaaaacacaacaucuuuuucua

SEQ ID NO: 1920679 - RNA, 23 nt, Human
uaaaacacaacaucuuuuucuac

SEQ ID NO: 1920680 - RNA, 14 nt, Human
uaaaacagaagccu

SEQ ID NO: 1920681 - RNA, 23 nt, Human
uaaaacaccuaaauaaccaaucu

SEQ ID NO: 1920682 - RNA, 21 nt, Human
uaaaacagguagaauuaucua

SEQ ID NO: 1920683 - RNA, 17 nt, Human
uaaaaauugugaucaga

SEQ ID NO: 1920684 - RNA, 22 nt, Human
uaaaacaagcacuaaacaaaga

SEQ ID NO: 1920685 - RNA, 17 nt, Human
uaaaacaagaaaguuuc

SEQ ID NO: 1920686 - RNA, 15 nt, Human
uaaaacaacacucac

SEQ ID NO: 1920687 - RNA, 19 nt, Human
uaaaaaugguuuaaauggu

SEQ ID NO: 1920688 - RNA, 18 nt, Human
uaaaaaugguuuaaaugg

SEQ ID NO: 1920689 - RNA, 17 nt, Human
guuuuuaauaaagacag

SEQ ID NO: 1920690 - RNA, 13 nt, Human
guuuuuaagcugu

SEQ ID NO: 1920691 - RNA, 14 nt, Human
guuuuuaagcuguu

SEQ ID NO: 1920692 - RNA, 15 nt, Human
guuuuuaagcuguuu

SEQ ID NO: 1920693 - RNA, 19 nt, Human
guuuuuaagcuguuuccau

SEQ ID NO: 1920694 - RNA, 21 nt, Human
uaaaaacaaagaaauuaugug

SEQ ID NO: 1920695 - RNA, 17 nt, Human
uaaaaacaaagaaauua

SEQ ID NO: 1920696 - RNA, 13 nt, Human
uaaagcagccagc

SEQ ID NO: 1920697 - RNA, 18 nt, Human
uaaagcaggcagaacuca

SEQ ID NO: 1920698 - RNA, 19 nt, Human
uaaagcagcguuucuauga

SEQ ID NO: 1920699 - RNA, 17 nt, Human
uaaagcagcguuucuau

SEQ ID NO: 1920700 - RNA, 16 nt, Human
uaaagcagcguuucua

SEQ ID NO: 1920701 - RNA, 12 nt, Human
uaaagaaaacug

SEQ ID NO: 1920702 - RNA, 22 nt, Human
uaaagaaaaguuuuguaaauuu

SEQ ID NO: 1920703 - RNA, 18 nt, Human
uaaagaaaaucucuguga

SEQ ID NO: 1920704 - RNA, 16 nt, Human
uaaagaaaaguuuugu

SEQ ID NO: 1920705 - RNA, 19 nt, Human
uaaagcuugcaacaaaauu

SEQ ID NO: 1920706 - RNA, 20 nt, Human
uaaagccugaguuugcuuuc

SEQ ID NO: 1920707 - RNA, 15 nt, Human
uaaaggcuaccuuug

SEQ ID NO: 1920708 - RNA, 21 nt, Human
uaaaggcccuaucuguuuaca

SEQ ID NO: 1920709 - RNA, 14 nt, Human
uaaaguguuugaaa

SEQ ID NO: 1920710 - RNA, 17 nt, Human
uaaaggcuaccuuugua

SEQ ID NO: 1920711 - RNA, 19 nt, Human
uaaaguuauucuugaaguc

SEQ ID NO: 1920712 - RNA, 13 nt, Human
uaaaguuauucuu

SEQ ID NO: 1920713 - RNA, 14 nt, Human
uaaaguuauucuug

SEQ ID NO: 1920714 - RNA, 18 nt, Human
uaaacacucuugaaaaau

SEQ ID NO: 1920715 - RNA, 20 nt, Human
uaaacauccaauauuuucuu

SEQ ID NO: 1920716 - RNA, 17 nt, Human
uaaacauccaauauuuu

SEQ ID NO: 1920717 - RNA, 15 nt, Human
uaaacacucuugaaa

SEQ ID NO: 1920718 - RNA, 17 nt, Human
uaaacacucuugaaaaa

SEQ ID NO: 1920719 - RNA, 20 nt, Human
uaaacaagaccacguuucua

SEQ ID NO: 1920720 - RNA, 22 nt, Human
uaaacaagaccacguuucuaaa

SEQ ID NO: 1920721 - RNA, 21 nt, Human
uaaacaagaccacguuucuaa

SEQ ID NO: 1920722 - RNA, 22 nt, Human
uaaacuugguuuuuaaaaaacu

SEQ ID NO: 1920723 - RNA, 18 nt, Human
uaaacuuccccaucuucu

SEQ ID NO: 1920724 - RNA, 16 nt, Human
uaaaccaaaaacugaa

SEQ ID NO: 1920725 - RNA, 18 nt, Human
uaacaccugauuaacuga

SEQ ID NO: 1920726 - RNA, 19 nt, Human
uaacaccugauuaacugag

SEQ ID NO: 1920727 - RNA, 14 nt, Human
uaacaccagcauug

SEQ ID NO: 1920728 - RNA, 18 nt, Human
uaacaccaugauuaacca

SEQ ID NO: 1920729 - RNA, 14 nt, Human
uaaauuuggcuucu

SEQ ID NO: 1920730 - RNA, 17 nt, Human
uaaauuuggcuucuguu

SEQ ID NO: 1920731 - RNA, 23 nt, Human
uaaauugacacuuaaaaaugguu

SEQ ID NO: 1920732 - RNA, 22 nt, Human
uaaauuuaguauuuuguuucag

SEQ ID NO: 1920733 - RNA, 13 nt, Human
uaaauuuauguga

SEQ ID NO: 1920734 - RNA, 20 nt, Human
uaaauugacacuuaaaaaug

SEQ ID NO: 1920735 - RNA, 13 nt, Human
uaaauucuuucau

SEQ ID NO: 1920736 - RNA, 19 nt, Human
uaaauugaaucaguauaaa

SEQ ID NO: 1920737 - RNA, 22 nt, Human
uaaauugaaucaguauaaacaa

SEQ ID NO: 1920738 - RNA, 12 nt, Human
uaaaugucuguu

SEQ ID NO: 1920739 - RNA, 11 nt, Human
uaaauuauuuu

SEQ ID NO: 1920740 - RNA, 18 nt, Human
uaaauucacaaacuuuua

SEQ ID NO: 1920741 - RNA, 16 nt, Human
uaaauucacaaacuuu

SEQ ID NO: 1920742 - RNA, 16 nt, Human
uaaauucuugcaaagu

SEQ ID NO: 1920743 - RNA, 20 nt, Human
uaaauuccucuuugcuuugc

SEQ ID NO: 1920744 - RNA, 16 nt, Human
uaaauuccucuuugcu

SEQ ID NO: 1920745 - RNA, 17 nt, Human
uaaauuccucuuugcuu

SEQ ID NO: 1920746 - RNA, 18 nt, Human
uaaauuccucuuugcuuu

SEQ ID NO: 1920747 - RNA, 19 nt, Human
uaaauuccucuuugcuuug

SEQ ID NO: 1920748 - RNA, 12 nt, Human
uaaauuccucuu

SEQ ID NO: 1920749 - RNA, 14 nt, Human
uaaauuccucuuug

SEQ ID NO: 1920750 - RNA, 22 nt, Human
uaaauucuugcaaaguaucccu

SEQ ID NO: 1920751 - RNA, 18 nt, Human
uaaauucuugcaaaguau

SEQ ID NO: 1920752 - RNA, 17 nt, Human
uaaauucuugcaaagua

SEQ ID NO: 1920753 - RNA, 22 nt, Human
uaaaugucucuuuaaugucaca

SEQ ID NO: 1920754 - RNA, 20 nt, Human
uaaaugucuaguuguaacac

SEQ ID NO: 1920755 - RNA, 19 nt, Human
uaaauguaucuuauucaca

SEQ ID NO: 1920756 - RNA, 15 nt, Human
uaaauguagaaagug

SEQ ID NO: 1920757 - RNA, 21 nt, Human
uaaauguaccuucagaauaag

SEQ ID NO: 1920758 - RNA, 17 nt, Human
uaaaugggggugcauuu

SEQ ID NO: 1920759 - RNA, 14 nt, Human
uaaaugggggugca

SEQ ID NO: 1920760 - RNA, 11 nt, Human
uaaauggcugc

SEQ ID NO: 1920761 - RNA, 22 nt, Human
uaaauggaaacugaaacuacug

SEQ ID NO: 1920762 - RNA, 19 nt, Human
uaaaugggggugcauuuga

SEQ ID NO: 1920763 - RNA, 18 nt, Human
uaaaugggggugcauuug

SEQ ID NO: 1920764 - RNA, 17 nt, Human
uaaaguugguaaaccuu

SEQ ID NO: 1920765 - RNA, 16 nt, Human
uaaaguugguaaaccu

SEQ ID NO: 1920766 - RNA, 13 nt, Human
uaaaugcccagcc

SEQ ID NO: 1920767 - RNA, 17 nt, Human
uaaaugcugcuuuuucu

SEQ ID NO: 1920768 - RNA, 11 nt, Human
uaaaugcugcu

SEQ ID NO: 1920769 - RNA, 16 nt, Human
uaaauggaaccacucu

SEQ ID NO: 1920770 - RNA, 16 nt, Human
uaaauggaaacugaaa

SEQ ID NO: 1920771 - RNA, 18 nt, Human
uaaauggaaacugaaacu

SEQ ID NO: 1920772 - RNA, 14 nt, Human
uaaaugcccagccc

SEQ ID NO: 1920773 - RNA, 15 nt, Human
uaaaugcccagcccc

SEQ ID NO: 1920774 - RNA, 16 nt, Human
uaaaugcccagccccu

SEQ ID NO: 1920775 - RNA, 17 nt, Human
uaaaugcccagccccuu

SEQ ID NO: 1920776 - RNA, 18 nt, Human
uaacccccacuggacuga

SEQ ID NO: 1920777 - RNA, 16 nt, Human
uaaccccgucaacaaa

SEQ ID NO: 1920778 - RNA, 17 nt, Human
uaaccccgucaacaaau

SEQ ID NO: 1920779 - RNA, 18 nt, Human
uaaccccgucaacaaauc

SEQ ID NO: 1920780 - RNA, 20 nt, Human
uaacccuggugguugcuguu

SEQ ID NO: 1920781 - RNA, 22 nt, Human
uaacucaauauuuuccaugaaa

SEQ ID NO: 1920782 - RNA, 14 nt, Human
uaacucaauauuuu

SEQ ID NO: 1920783 - RNA, 19 nt, Human
uaacuauuuuauuuucuaa

SEQ ID NO: 1920784 - RNA, 17 nt, Human
uaacuccucaauuccaa

SEQ ID NO: 1920785 - RNA, 11 nt, Human
uaacagaaaug

SEQ ID NO: 1920786 - RNA, 12 nt, Human
uaacagaaaugu

SEQ ID NO: 1920787 - RNA, 13 nt, Human
uaaccagaucauu

SEQ ID NO: 1920788 - RNA, 16 nt, Human
uaaccacuucagcuga

SEQ ID NO: 1920789 - RNA, 23 nt, Human
uaaccaguguuguggauuuaaca

SEQ ID NO: 1920790 - RNA, 17 nt, Human
uaaccaucacugguugc

SEQ ID NO: 1920791 - RNA, 17 nt, Human
uaaccauggugcuuguu

SEQ ID NO: 1920792 - RNA, 22 nt, Human
uaaccaugugaaaaggcaaaaa

SEQ ID NO: 1920793 - RNA, 13 nt, Human
uaacccagauuuu

SEQ ID NO: 1920794 - RNA, 23 nt, Human
uaagaaaaaggaugcacagaguu

SEQ ID NO: 1920795 - RNA, 19 nt, Human
uaagaaaaaggaugcacag

SEQ ID NO: 1920796 - RNA, 18 nt, Human
uaagaaaaaggaugcaca

SEQ ID NO: 1920797 - RNA, 16 nt, Human
uaagaaaaaggaugca

SEQ ID NO: 1920798 - RNA, 19 nt, Human
uaagaaccuuuugagugcc

SEQ ID NO: 1920799 - RNA, 14 nt, Human
uaagaaccuggaac

SEQ ID NO: 1920800 - RNA, 21 nt, Human
uaagaggacauaauggggucc

SEQ ID NO: 1920801 - RNA, 24 nt, Human
uaagaaagacuaucuaaauguuga

SEQ ID NO: 1920802 - RNA, 12 nt, Human
uaagaaaagauu

SEQ ID NO: 1920803 - RNA, 14 nt, Human
uaagaaaagauuuu

SEQ ID NO: 1920804 - RNA, 19 nt, Human
uaagaaaagauuuuaauca

SEQ ID NO: 1920805 - RNA, 18 nt, Human
uaauguuguuauuuaaag

SEQ ID NO: 1920806 - RNA, 14 nt, Human
uaauguuguuauuu

SEQ ID NO: 1920807 - RNA, 15 nt, Human
uaaugggguccuggc

SEQ ID NO: 1920808 - RNA, 17 nt, Human
uaaugggguccuggcca

SEQ ID NO: 1920809 - RNA, 18 nt, Human
uaaugggguccuggccau

SEQ ID NO: 1920810 - RNA, 22 nt, Human
uaaugggguccuggccauccca

SEQ ID NO: 1920811 - RNA, 11 nt, Human
uaauguuuccu

SEQ ID NO: 1920812 - RNA, 23 nt, Human
uaauguuguuccuuuugaaagaa

SEQ ID NO: 1920813 - RNA, 14 nt, Human
uaauuaaguacuau

SEQ ID NO: 1920814 - RNA, 17 nt, Human
uaauuaaguacuaugua

SEQ ID NO: 1920815 - RNA, 20 nt, Human
uaauuaaguacuauguauca

SEQ ID NO: 1920816 - RNA, 16 nt, Human
uaauuagcaucucagg

SEQ ID NO: 1920817 - RNA, 15 nt, Human
uaauggggcggugag

SEQ ID NO: 1920818 - RNA, 14 nt, Human
uaaugcuuuuauau

SEQ ID NO: 1920819 - RNA, 13 nt, Human
uaaugcuccuugu

SEQ ID NO: 1920820 - RNA, 18 nt, Human
uaaugcuccuuguuccua

SEQ ID NO: 1920821 - RNA, 23 nt, Human
uaaugcgugcauaccacuuuugu

SEQ ID NO: 1920822 - RNA, 22 nt, Human
uaaugcgugcauaccacuuuug

SEQ ID NO: 1920823 - RNA, 19 nt, Human
uaaugcgugcauaccacuu

SEQ ID NO: 1920824 - RNA, 15 nt, Human
uaaugcgugcauacc

SEQ ID NO: 1920825 - RNA, 19 nt, Human
uaauaugcacacauuuuuu

SEQ ID NO: 1920826 - RNA, 22 nt, Human
uaauauggccacaguagucuug

SEQ ID NO: 1920827 - RNA, 18 nt, Human
uaauaugcacacauuuuu

SEQ ID NO: 1920828 - RNA, 17 nt, Human
uaauaugcacacauuuu

SEQ ID NO: 1920829 - RNA, 16 nt, Human
uaauaugcacacauuu

SEQ ID NO: 1920830 - RNA, 15 nt, Human
uaauaugcacacauu

SEQ ID NO: 1920831 - RNA, 14 nt, Human
uaauaugaaaacuu

SEQ ID NO: 1920832 - RNA, 15 nt, Human
uaauaugaaaacuua

SEQ ID NO: 1920833 - RNA, 16 nt, Human
uaauaugaaaacuuau

SEQ ID NO: 1920834 - RNA, 20 nt, Human
uaauaaucuuauuagggaga

SEQ ID NO: 1920835 - RNA, 23 nt, Human
uaauaaucauuggauucugagag

SEQ ID NO: 1920836 - RNA, 23 nt, Human
uaauaaucuuauuagggagaaaa

SEQ ID NO: 1920837 - RNA, 20 nt, Human
uaauauuaaggaagacaaug

SEQ ID NO: 1920838 - RNA, 13 nt, Human
uaaucuaaaugga

SEQ ID NO: 1920839 - RNA, 12 nt, Human
uaaucuaaaugg

SEQ ID NO: 1920840 - RNA, 20 nt, Human
uaauccucuaggaggucucu

SEQ ID NO: 1920841 - RNA, 15 nt, Human
uaaggugugcucuga

SEQ ID NO: 1920842 - RNA, 20 nt, Human
uaagguggguacgggagggu

SEQ ID NO: 1920843 - RNA, 18 nt, Human
uaaggugauauauuuaaa

SEQ ID NO: 1920844 - RNA, 20 nt, Human
uaaggugauauauuuaaaaa

SEQ ID NO: 1920845 - RNA, 17 nt, Human
uaaggguaucuggugac

SEQ ID NO: 1920846 - RNA, 18 nt, Human
uaaggucauuaccacagg

SEQ ID NO: 1920847 - RNA, 16 nt, Human
uaaggggcccggccag

SEQ ID NO: 1920848 - RNA, 14 nt, Human
uaagcuauucagua

SEQ ID NO: 1920849 - RNA, 16 nt, Human
uaaggauguucuagca

SEQ ID NO: 1920850 - RNA, 14 nt, Human
uaaggcaaucaugg

SEQ ID NO: 1920851 - RNA, 21 nt, Human
uaaggcugcaagguuuaggcu

SEQ ID NO: 1920852 - RNA, 15 nt, Human
uaagaggcagggucu

SEQ ID NO: 1920853 - RNA, 12 nt, Human
uaagaggcaggg

SEQ ID NO: 1920854 - RNA, 15 nt, Human
uaagccaugggagac

SEQ ID NO: 1920855 - RNA, 16 nt, Human
uaagccuaaaaguggg

SEQ ID NO: 1920856 - RNA, 12 nt, Human
uaauaaagcugu

SEQ ID NO: 1920857 - RNA, 23 nt, Human
uaaguguauuuuucaauaaagca

SEQ ID NO: 1920858 - RNA, 12 nt, Human
uaauaaauauuu

SEQ ID NO: 1920859 - RNA, 18 nt, Human
uaaguguauuuuucaaua

SEQ ID NO: 1920860 - RNA, 20 nt, Human
uaaguguauuuuucaauaaa

SEQ ID NO: 1920861 - RNA, 13 nt, Human
uaaguguauuuuu

SEQ ID NO: 1920862 - RNA, 22 nt, Human
uaagugcugcauuuaaaagaua

SEQ ID NO: 1920863 - RNA, 18 nt, Human
uaagugcugcauuuaaaa

SEQ ID NO: 1920864 - RNA, 16 nt, Human
uaagugcugcauuuaa

SEQ ID NO: 1920865 - RNA, 15 nt, Human
uaagugcugcauuua

SEQ ID NO: 1920866 - RNA, 13 nt, Human
uaagugaaauaag

SEQ ID NO: 1920867 - RNA, 22 nt, Human
uaagugauugcugguuuuaguu

SEQ ID NO: 1920868 - RNA, 12 nt, Human
uaagugagagag

SEQ ID NO: 1920869 - RNA, 23 nt, Human
uaagugaggaugaaaaaauaaca

SEQ ID NO: 1920870 - RNA, 14 nt, Human
uaagugcugcauuu

SEQ ID NO: 1920871 - RNA, 22 nt, Human
uaagugccaggauggaaugaug

SEQ ID NO: 1920872 - RNA, 22 nt, Human
uaucagucauaacuaaauaaag

SEQ ID NO: 1920873 - RNA, 20 nt, Human
uaucagucaauauuuuuaga

SEQ ID NO: 1920874 - RNA, 21 nt, Human
uaucagucaauauuuuuagau

SEQ ID NO: 1920875 - RNA, 20 nt, Human
uaucaggugcugccauccag

SEQ ID NO: 1920876 - RNA, 19 nt, Human
uaucaggugcugccaucca

SEQ ID NO: 1920877 - RNA, 14 nt, Human
uaucaaaagaaaga

SEQ ID NO: 1920878 - RNA, 17 nt, Human
uaucaugacaaagacug

SEQ ID NO: 1920879 - RNA, 12 nt, Human
uaucauggucuc

SEQ ID NO: 1920880 - RNA, 18 nt, Human
uaucaugccccuguacuc

SEQ ID NO: 1920881 - RNA, 14 nt, Human
uaucaugcccugug

SEQ ID NO: 1920882 - RNA, 17 nt, Human
uaucauggucucaguca

SEQ ID NO: 1920883 - RNA, 19 nt, Human
uaucaaaacuuucuuuucu

SEQ ID NO: 1920884 - RNA, 20 nt, Human
uauauuuuuuucugaaauuu

SEQ ID NO: 1920885 - RNA, 19 nt, Human
uauauuuuuuucugaaauu

SEQ ID NO: 1920886 - RNA, 16 nt, Human
uauauuuuuuucugaa

SEQ ID NO: 1920887 - RNA, 21 nt, Human
uauauuuuuuguuaaaugauu

SEQ ID NO: 1920888 - RNA, 22 nt, Human
uauauuugugauagcacuuucu

SEQ ID NO: 1920889 - RNA, 21 nt, Human
uauauuugugauagcacuuuc

SEQ ID NO: 1920890 - RNA, 22 nt, Human
uauauuugggccugcuccagac

SEQ ID NO: 1920891 - RNA, 20 nt, Human
uauauuuguaaauuuaugug

SEQ ID NO: 1920892 - RNA, 11 nt, Human
uauagaaaugc

SEQ ID NO: 1920893 - RNA, 15 nt, Human
uauagaauauuuauu

SEQ ID NO: 1920894 - RNA, 21 nt, Human
uauagaauauuuauuaccucu

SEQ ID NO: 1920895 - RNA, 11 nt, Human
uauagacucua

SEQ ID NO: 1920896 - RNA, 11 nt, Human
uauacuuuuuu

SEQ ID NO: 1920897 - RNA, 12 nt, Human
uagguucuaaaa

SEQ ID NO: 1920898 - RNA, 18 nt, Human
uaguaugaggcauuuguu

SEQ ID NO: 1920899 - RNA, 17 nt, Human
uaguaugaggcauuugu

SEQ ID NO: 1920900 - RNA, 23 nt, Human
uaguagauguucuacuuuguucu

SEQ ID NO: 1920901 - RNA, 23 nt, Human
uaggugugacugaauuucuuuug

SEQ ID NO: 1920902 - RNA, 21 nt, Human
uaggugugacugaauuucuuu

SEQ ID NO: 1920903 - RNA, 19 nt, Human
uaggugugacugaauuucu

SEQ ID NO: 1920904 - RNA, 13 nt, Human
uagguguggggga

SEQ ID NO: 1920905 - RNA, 17 nt, Human
uaggugugggggaagca

SEQ ID NO: 1920906 - RNA, 16 nt, Human
uaggugacagagugag

SEQ ID NO: 1920907 - RNA, 11 nt, Human
uaggugacaga

SEQ ID NO: 1920908 - RNA, 11 nt, Human
uagggaaaaac

SEQ ID NO: 1920909 - RNA, 22 nt, Human
uagcuggucuuauuuguaaagc

SEQ ID NO: 1920910 - RNA, 20 nt, Human
uagcugggggugggccaggc

SEQ ID NO: 1920911 - RNA, 15 nt, Human
uaggcugguggccca

SEQ ID NO: 1920912 - RNA, 16 nt, Human
uaggcugguggcccag

SEQ ID NO: 1920913 - RNA, 18 nt, Human
uaggcugguggcccagga

SEQ ID NO: 1920914 - RNA, 19 nt, Human
uaggcugguggcccaggac

SEQ ID NO: 1920915 - RNA, 20 nt, Human
uaguggcuuaaaacaacacu

SEQ ID NO: 1920916 - RNA, 16 nt, Human
uaguaugguggcuggg

SEQ ID NO: 1920917 - RNA, 15 nt, Human
uaguaugaggcauuu

SEQ ID NO: 1920918 - RNA, 21 nt, Human
uaguuguuugauucagacagc

SEQ ID NO: 1920919 - RNA, 22 nt, Human
uaguuguuugauucagacagcu

SEQ ID NO: 1920920 - RNA, 20 nt, Human
uaguuguuugauucagacag

SEQ ID NO: 1920921 - RNA, 19 nt, Human
uaguugaaacgcagacacu

SEQ ID NO: 1920922 - RNA, 17 nt, Human
uaguugaaccuauuucu

SEQ ID NO: 1920923 - RNA, 15 nt, Human
uaguuugauuaaauu

SEQ ID NO: 1920924 - RNA, 21 nt, Human
uaguuugauuaaauucuugca

SEQ ID NO: 1920925 - RNA, 16 nt, Human
uaguuugauuaaauuc

SEQ ID NO: 1920926 - RNA, 22 nt, Human
uauaaacaugcuugcauuauau

SEQ ID NO: 1920927 - RNA, 14 nt, Human
uauaaacacuauau

SEQ ID NO: 1920928 - RNA, 11 nt, Human
uauaaacuuua

SEQ ID NO: 1920929 - RNA, 18 nt, Human
uauaaaccgaacugaugu

SEQ ID NO: 1920930 - RNA, 14 nt, Human
uauaaacuuuaccu

SEQ ID NO: 1920931 - RNA, 13 nt, Human
uauaaacuuuacc

SEQ ID NO: 1920932 - RNA, 17 nt, Human
uauaaacuuuaccuuuu

SEQ ID NO: 1920933 - RNA, 16 nt, Human
uauaaacuuuaccuuu

SEQ ID NO: 1920934 - RNA, 15 nt, Human
uauaaacuuuaccuu

SEQ ID NO: 1920935 - RNA, 12 nt, Human
uagacuaaaaga

SEQ ID NO: 1920936 - RNA, 13 nt, Human
uagacuaaaugaa

SEQ ID NO: 1920937 - RNA, 14 nt, Human
uagaccugucuccu

SEQ ID NO: 1920938 - RNA, 16 nt, Human
uagaccugucuccugg

SEQ ID NO: 1920939 - RNA, 14 nt, Human
uagacuaaaugaaa

SEQ ID NO: 1920940 - RNA, 15 nt, Human
uagacccaucuucuu

SEQ ID NO: 1920941 - RNA, 17 nt, Human
uagaguugauacuacag

SEQ ID NO: 1920942 - RNA, 14 nt, Human
uagaguugauacua

SEQ ID NO: 1920943 - RNA, 12 nt, Human
uagagugggagc

SEQ ID NO: 1920944 - RNA, 15 nt, Human
uagagguucaaagau

SEQ ID NO: 1920945 - RNA, 14 nt, Human
uagagguucaaaga

SEQ ID NO: 1920946 - RNA, 11 nt, Human
uagagacaggg

SEQ ID NO: 1920947 - RNA, 14 nt, Human
uacuuguggacaca

SEQ ID NO: 1920948 - RNA, 14 nt, Human
uacuuguuauaaac

SEQ ID NO: 1920949 - RNA, 12 nt, Human
uagaauauuuau

SEQ ID NO: 1920950 - RNA, 15 nt, Human
uagaauauuuauuac

SEQ ID NO: 1920951 - RNA, 19 nt, Human
uagaauauuuauuaccucu

SEQ ID NO: 1920952 - RNA, 20 nt, Human
uagaauauuuauuaccucug

SEQ ID NO: 1920953 - RNA, 14 nt, Human
uagaauccaaacuu

SEQ ID NO: 1920954 - RNA, 16 nt, Human
uagaauaauaaauauu

SEQ ID NO: 1920955 - RNA, 17 nt, Human
uagaauaauaaauauuu

SEQ ID NO: 1920956 - RNA, 23 nt, Human
uagaauaguguucugcaaaaaua

SEQ ID NO: 1920957 - RNA, 23 nt, Human
uagaauuaguggcacuugcuuuu

SEQ ID NO: 1920958 - RNA, 18 nt, Human
uagaauuaacacaugauc

SEQ ID NO: 1920959 - RNA, 16 nt, Human
uagaauuaacacauga

SEQ ID NO: 1920960 - RNA, 15 nt, Human
uagaauuaacacaug

SEQ ID NO: 1920961 - RNA, 23 nt, Human
uagaauuaucuaauuuauaaaaa

SEQ ID NO: 1920962 - RNA, 22 nt, Human
uagaauuaucuaauuuauaaaa

SEQ ID NO: 1920963 - RNA, 21 nt, Human
uagaauuaucuaauuuauaaa

SEQ ID NO: 1920964 - RNA, 19 nt, Human
uagaauuaucuaauuuaua

SEQ ID NO: 1920965 - RNA, 16 nt, Human
uagaauuaucuaauuu

SEQ ID NO: 1920966 - RNA, 15 nt, Human
uagaauuaucuaauu

SEQ ID NO: 1920967 - RNA, 15 nt, Human
uagaauccaaacuug

SEQ ID NO: 1920968 - RNA, 23 nt, Human
uagaauccaaacuuggauuuuug

SEQ ID NO: 1920969 - RNA, 19 nt, Human
uagcugggacuacaggcac

SEQ ID NO: 1920970 - RNA, 17 nt, Human
uagcugggacuacaggc

SEQ ID NO: 1920971 - RNA, 15 nt, Human
uagcugggacuacag

SEQ ID NO: 1920972 - RNA, 21 nt, Human
uagcugacccagccccuugag

SEQ ID NO: 1920973 - RNA, 23 nt, Human
uagcugacccagccccuugagaa

SEQ ID NO: 1920974 - RNA, 16 nt, Human
uagcugcaaaggacag

SEQ ID NO: 1920975 - RNA, 17 nt, Human
uagcugcaaaggacaga

SEQ ID NO: 1920976 - RNA, 21 nt, Human
uagcucaggugucccugcacu

SEQ ID NO: 1920977 - RNA, 20 nt, Human
uagcucaggugucccugcac

SEQ ID NO: 1920978 - RNA, 12 nt, Human
uagcucauucuc

SEQ ID NO: 1920979 - RNA, 18 nt, Human
uagccugugccucuggga

SEQ ID NO: 1920980 - RNA, 20 nt, Human
uagccugugccucugggacu

SEQ ID NO: 1920981 - RNA, 14 nt, Human
uagccugggguggg

SEQ ID NO: 1920982 - RNA, 16 nt, Human
uagccuaggugacaga

SEQ ID NO: 1920983 - RNA, 16 nt, Human
uagccggccacuuugg

SEQ ID NO: 1920984 - RNA, 16 nt, Human
uagccccucuccugga

SEQ ID NO: 1920985 - RNA, 15 nt, Human
uagcccccuggccuc

SEQ ID NO: 1920986 - RNA, 18 nt, Human
uagcccccuggccucugu

SEQ ID NO: 1920987 - RNA, 16 nt, Human
uagcccccuggccucu

SEQ ID NO: 1920988 - RNA, 17 nt, Human
uagcccccuggccucug

SEQ ID NO: 1920989 - RNA, 15 nt, Human
uagcaugacauuucu

SEQ ID NO: 1920990 - RNA, 16 nt, Human
uagcaugacauuucuu

SEQ ID NO: 1920991 - RNA, 16 nt, Human
uagauacuguaucaug

SEQ ID NO: 1920992 - RNA, 20 nt, Human
uagauacuuugcuagccggc

SEQ ID NO: 1920993 - RNA, 16 nt, Human
uagauuauggagcuuu

SEQ ID NO: 1920994 - RNA, 17 nt, Human
uagauuauggagcuuuu

SEQ ID NO: 1920995 - RNA, 11 nt, Human
uagcagggaaa

SEQ ID NO: 1920996 - RNA, 19 nt, Human
uagcauacguacacauuuu

SEQ ID NO: 1920997 - RNA, 18 nt, Human
uagcauacguacacauuu

SEQ ID NO: 1920998 - RNA, 17 nt, Human
uagcauacguacacauu

SEQ ID NO: 1920999 - RNA, 16 nt, Human
uagcauacguacacau

SEQ ID NO: 1921000 - RNA, 18 nt, Human
uagcauauaauucuauau

SEQ ID NO: 1921001 - RNA, 18 nt, Human
uagcauccuggaauaucu

SEQ ID NO: 1921002 - RNA, 16 nt, Human
uagcauccuggaauau

SEQ ID NO: 1921003 - RNA, 15 nt, Human
uagcauccuggaaua

SEQ ID NO: 1921004 - RNA, 13 nt, Human
uagcauccuggaa

SEQ ID NO: 1921005 - RNA, 14 nt, Human
uaccucugugugcu

SEQ ID NO: 1921006 - RNA, 12 nt, Human
uaccucugugug

SEQ ID NO: 1921007 - RNA, 21 nt, Human
uaccucuugagccuugaacuu

SEQ ID NO: 1921008 - RNA, 17 nt, Human
uaccucucuuauagaau

SEQ ID NO: 1921009 - RNA, 21 nt, Human
uaccucucuuauagaauauuu

SEQ ID NO: 1921010 - RNA, 23 nt, Human
uaccucucuuauagaauauuuau

SEQ ID NO: 1921011 - RNA, 14 nt, Human
uaccucugauaccu

SEQ ID NO: 1921012 - RNA, 15 nt, Human
uaccucugauaccuc

SEQ ID NO: 1921013 - RNA, 17 nt, Human
uaccucugauaccucaa

SEQ ID NO: 1921014 - RNA, 18 nt, Human
uaccucggugccuuccuc

SEQ ID NO: 1921015 - RNA, 22 nt, Human
uaccuuuuuuagaguugauacu

SEQ ID NO: 1921016 - RNA, 19 nt, Human
uaccuuuuuuagaguugau

SEQ ID NO: 1921017 - RNA, 13 nt, Human
uaccuuuuuuaga

SEQ ID NO: 1921018 - RNA, 16 nt, Human
uaccuucauaugcagu

SEQ ID NO: 1921019 - RNA, 14 nt, Human
uacuaaggaaucuu

SEQ ID NO: 1921020 - RNA, 21 nt, Human
uacuaauagacaauuuauuau

SEQ ID NO: 1921021 - RNA, 20 nt, Human
uacuaauagacaauuuauua

SEQ ID NO: 1921022 - RNA, 17 nt, Human
uaccuuuuuuauacaua

SEQ ID NO: 1921023 - RNA, 16 nt, Human
uaccuuuuuuauacau

SEQ ID NO: 1921024 - RNA, 13 nt, Human
uaccuuuuuuaua

SEQ ID NO: 1921025 - RNA, 18 nt, Human
uacgaaaagaggggaaga

SEQ ID NO: 1921026 - RNA, 21 nt, Human
uacgaaaagaggggaagagac

SEQ ID NO: 1921027 - RNA, 15 nt, Human
uaccuacauacaauu

SEQ ID NO: 1921028 - RNA, 22 nt, Human
uaccucaacccccauuucuauu

SEQ ID NO: 1921029 - RNA, 22 nt, Human
uaccuaacgaaguauccuucag

SEQ ID NO: 1921030 - RNA, 15 nt, Human
uacccacugcucugg

SEQ ID NO: 1921031 - RNA, 23 nt, Human
uacauuuuuaagugcugcauuua

SEQ ID NO: 1921032 - RNA, 16 nt, Human
uacucuacccucuuag

SEQ ID NO: 1921033 - RNA, 14 nt, Human
uacugcaagaaaau

SEQ ID NO: 1921034 - RNA, 20 nt, Human
uacugcaccauuuaaaaaca

SEQ ID NO: 1921035 - RNA, 15 nt, Human
uacugcaagaaaaug

SEQ ID NO: 1921036 - RNA, 21 nt, Human
uacugccuauuuuaauaaaca

SEQ ID NO: 1921037 - RNA, 14 nt, Human
uacugccuauuuua

SEQ ID NO: 1921038 - RNA, 23 nt, Human
uacugcccuccagcucuuuccuc

SEQ ID NO: 1921039 - RNA, 22 nt, Human
uacugcccuccagcucuuuccu

SEQ ID NO: 1921040 - RNA, 15 nt, Human
uacuccccuccuuga

SEQ ID NO: 1921041 - RNA, 23 nt, Human
uacucccagggcuuacggcccug

SEQ ID NO: 1921042 - RNA, 22 nt, Human
uacucgaguuacagacaaagcg

SEQ ID NO: 1921043 - RNA, 18 nt, Human
uacucgaguuacagacaa

SEQ ID NO: 1921044 - RNA, 14 nt, Human
uacuacaguuuguu

SEQ ID NO: 1921045 - RNA, 13 nt, Human
uacuacaguuugu

SEQ ID NO: 1921046 - RNA, 17 nt, Human
uacucauuuaaaguauu

SEQ ID NO: 1921047 - RNA, 22 nt, Human
uacuacaguccucccaucucac

SEQ ID NO: 1921048 - RNA, 16 nt, Human
uacuaauuccacaccu

SEQ ID NO: 1921049 - RNA, 13 nt, Human
uacuaauuccaca

SEQ ID NO: 1921050 - RNA, 13 nt, Human
uacuuguggacac

SEQ ID NO: 1921051 - RNA, 20 nt, Human
uacuugcucuugaugccugg

SEQ ID NO: 1921052 - RNA, 18 nt, Human
uacuugaagggccagagc

SEQ ID NO: 1921053 - RNA, 19 nt, Human
uacuugaagggccagagcc

SEQ ID NO: 1921054 - RNA, 20 nt, Human
uacuugaagggccagagcca

SEQ ID NO: 1921055 - RNA, 13 nt, Human
uacuugcucuuga

SEQ ID NO: 1921056 - RNA, 14 nt, Human
uacuugcucuugau

SEQ ID NO: 1921057 - RNA, 18 nt, Human
uacuugcucuugaugccu

SEQ ID NO: 1921058 - RNA, 19 nt, Human
uacuugcucuugaugccug

SEQ ID NO: 1921059 - RNA, 11 nt, Human
uacuugaaggg

SEQ ID NO: 1921060 - RNA, 12 nt, Human
uacuugaagggc

SEQ ID NO: 1921061 - RNA, 14 nt, Human
uacuugaagggcca

SEQ ID NO: 1921062 - RNA, 15 nt, Human
uacuugaagggccag

SEQ ID NO: 1921063 - RNA, 16 nt, Human
uacuugaagggccaga

SEQ ID NO: 1921064 - RNA, 17 nt, Human
uacuugaagggccagag

SEQ ID NO: 1921065 - RNA, 16 nt, Human
uacuguccuacccacc

SEQ ID NO: 1921066 - RNA, 15 nt, Human
uacugcuacuguaau

SEQ ID NO: 1921067 - RNA, 20 nt, Human
uacugcuacuguaauuuuau

SEQ ID NO: 1921068 - RNA, 21 nt, Human
uacugucuucaguaagccgug

SEQ ID NO: 1921069 - RNA, 22 nt, Human
uacugugugugugaaugaacac

SEQ ID NO: 1921070 - RNA, 23 nt, Human
uacugugugugugaaugaacacu

SEQ ID NO: 1921071 - RNA, 18 nt, Human
uacuguggaaaagaaaca

SEQ ID NO: 1921072 - RNA, 15 nt, Human
uacuguuaaaggaaa

SEQ ID NO: 1921073 - RNA, 16 nt, Human
uacuguuaaaggaaaa

SEQ ID NO: 1921074 - RNA, 16 nt, Human
uacacucuuuguaaga

SEQ ID NO: 1921075 - RNA, 21 nt, Human
uacacugugcugagucugaag

SEQ ID NO: 1921076 - RNA, 11 nt, Human
uacacagugug

SEQ ID NO: 1921077 - RNA, 22 nt, Human
uacacagugugaauaaagugcu

SEQ ID NO: 1921078 - RNA, 15 nt, Human
uacacacugcauguu

SEQ ID NO: 1921079 - RNA, 16 nt, Human
uacacaaugugucuuu

SEQ ID NO: 1921080 - RNA, 13 nt, Human
uacacaauguguc

SEQ ID NO: 1921081 - RNA, 11 nt, Human
uacacacacac

SEQ ID NO: 1921082 - RNA, 23 nt, Human
uacaacugccucgaaacacagaa

SEQ ID NO: 1921083 - RNA, 23 nt, Human
uacaacccgguucacucuucuca

SEQ ID NO: 1921084 - RNA, 15 nt, Human
uacaacacaaagaga

SEQ ID NO: 1921085 - RNA, 17 nt, Human
uacaacacaaagagaaa

SEQ ID NO: 1921086 - RNA, 21 nt, Human
uacaaauggacauaggacuca

SEQ ID NO: 1921087 - RNA, 13 nt, Human
uacaaauuagaaa

SEQ ID NO: 1921088 - RNA, 15 nt, Human
uacaaauuagaaaau

SEQ ID NO: 1921089 - RNA, 14 nt, Human
uacaaauuagaaaa

SEQ ID NO: 1921090 - RNA, 18 nt, Human
uaauucuaaaugaauguu

SEQ ID NO: 1921091 - RNA, 11 nt, Human
uaauucuaaau

SEQ ID NO: 1921092 - RNA, 19 nt, Human
uaauuccuuuccagguauu

SEQ ID NO: 1921093 - RNA, 18 nt, Human
uacaaacaaaauuucuau

SEQ ID NO: 1921094 - RNA, 19 nt, Human
uacaaagaaccaagaaaaa

SEQ ID NO: 1921095 - RNA, 17 nt, Human
uacaaacaugugguuaa

SEQ ID NO: 1921096 - RNA, 14 nt, Human
uacaaaguagaagu

SEQ ID NO: 1921097 - RNA, 18 nt, Human
uacaaaguagaagucuua

SEQ ID NO: 1921098 - RNA, 12 nt, Human
uacaaauacucu

SEQ ID NO: 1921099 - RNA, 17 nt, Human
uacaaauacucuuagga

SEQ ID NO: 1921100 - RNA, 19 nt, Human
uacaaauacucuuaggaag

SEQ ID NO: 1921101 - RNA, 23 nt, Human
uacaaauacucuuaggaagagaa

SEQ ID NO: 1921102 - RNA, 16 nt, Human
uacaaaucaaguauuu

SEQ ID NO: 1921103 - RNA, 23 nt, Human
uacaguucggugagcuacaaaug

SEQ ID NO: 1921104 - RNA, 20 nt, Human
uacaggaugaugacuaugga

SEQ ID NO: 1921105 - RNA, 15 nt, Human
uacaggagugagcac

SEQ ID NO: 1921106 - RNA, 22 nt, Human
uacaggaaguacuggagaaaau

SEQ ID NO: 1921107 - RNA, 14 nt, Human
uacaggaaguacug

SEQ ID NO: 1921108 - RNA, 15 nt, Human
uacaggaaguacugg

SEQ ID NO: 1921109 - RNA, 18 nt, Human
uacaguuuguuaguauga

SEQ ID NO: 1921110 - RNA, 20 nt, Human
uacaguugaaaaacagcuga

SEQ ID NO: 1921111 - RNA, 17 nt, Human
uacaguugaaaaacagc

SEQ ID NO: 1921112 - RNA, 19 nt, Human
uacaguugaaaaacagcug

SEQ ID NO: 1921113 - RNA, 22 nt, Human
uacacuguuucaaacuuuacua

SEQ ID NO: 1921114 - RNA, 16 nt, Human
uacacuuacacuuuau

SEQ ID NO: 1921115 - RNA, 20 nt, Human
uacacuguuucaaacuuuac

SEQ ID NO: 1921116 - RNA, 22 nt, Human
uacacugugcugagucugaagg

SEQ ID NO: 1921117 - RNA, 23 nt, Human
uacacugugcugagucugaaggc

SEQ ID NO: 1921118 - RNA, 20 nt, Human
uacagcuugaccgugaggcc

SEQ ID NO: 1921119 - RNA, 18 nt, Human
uacaggaagguagaaaua

SEQ ID NO: 1921120 - RNA, 13 nt, Human
uacaggaaguacu

SEQ ID NO: 1921121 - RNA, 16 nt, Human
uacauaaacaaguccu

SEQ ID NO: 1921122 - RNA, 21 nt, Human
uacaguuuguuaguaugaggc

SEQ ID NO: 1921123 - RNA, 19 nt, Human
uacaguuuguuaguaugag

SEQ ID NO: 1921124 - RNA, 23 nt, Human
uacaugaaaacacauuuuucuua

SEQ ID NO: 1921125 - RNA, 19 nt, Human
uacaugaaaacacauuuuu

SEQ ID NO: 1921126 - RNA, 18 nt, Human
uacaugaaaacacauuuu

SEQ ID NO: 1921127 - RNA, 17 nt, Human
uacaugaaaacacauuu

SEQ ID NO: 1921128 - RNA, 16 nt, Human
uacaugaaaacacauu

SEQ ID NO: 1921129 - RNA, 16 nt, Human
uacauaagauaaaugu

SEQ ID NO: 1921130 - RNA, 17 nt, Human
uacauaagauaaaugug

SEQ ID NO: 1921131 - RNA, 14 nt, Human
uacauuuuuaagug

SEQ ID NO: 1921132 - RNA, 21 nt, Human
uacauggcuggagcuagaauu

SEQ ID NO: 1921133 - RNA, 22 nt, Human
uacauuuuuaagugcugcauuu

SEQ ID NO: 1921134 - RNA, 19 nt, Human
uacauuuuuaagugcugca

SEQ ID NO: 1921135 - RNA, 14 nt, Human
uacauggaauaaca

SEQ ID NO: 1921136 - RNA, 18 nt, Human
uacauggaauaacaugua

SEQ ID NO: 1921137 - RNA, 19 nt, Human
uacauggaauaacauguaa

SEQ ID NO: 1921138 - RNA, 22 nt, Human
uacauggaauaacauguaauua

SEQ ID NO: 1921139 - RNA, 19 nt, Human
ugacaaccaugagaccacu

SEQ ID NO: 1921140 - RNA, 15 nt, Human
ugacaacuacagaaa

SEQ ID NO: 1921141 - RNA, 16 nt, Human
ugacaacuacagaaaa

SEQ ID NO: 1921142 - RNA, 22 nt, Human
ugacaacuacagaaaaaccaga

SEQ ID NO: 1921143 - RNA, 23 nt, Human
ugacaaggauugcuacuguccua

SEQ ID NO: 1921144 - RNA, 13 nt, Human
ugacagacacagg

SEQ ID NO: 1921145 - RNA, 16 nt, Human
ugacagacacaggccc

SEQ ID NO: 1921146 - RNA, 14 nt, Human
ugacagacacaggc

SEQ ID NO: 1921147 - RNA, 15 nt, Human
ugacacacagcucug

SEQ ID NO: 1921148 - RNA, 17 nt, Human
ugacacaaguggaccuu

SEQ ID NO: 1921149 - RNA, 19 nt, Human
ugacacaaguggaccuuag

SEQ ID NO: 1921150 - RNA, 14 nt, Human
ugacacacagcucu

SEQ ID NO: 1921151 - RNA, 16 nt, Human
ugacacaaguggaccu

SEQ ID NO: 1921152 - RNA, 21 nt, Human
ugaauuguaaggaaugauuaa

SEQ ID NO: 1921153 - RNA, 13 nt, Human
ugaauuguaagga

SEQ ID NO: 1921154 - RNA, 20 nt, Human
ugacaaagguaaaucagacu

SEQ ID NO: 1921155 - RNA, 16 nt, Human
ugaauuuaaauagcuu

SEQ ID NO: 1921156 - RNA, 15 nt, Human
ugaauuguuugaacc

SEQ ID NO: 1921157 - RNA, 13 nt, Human
ugacaacacucau

SEQ ID NO: 1921158 - RNA, 12 nt, Human
ugacaacaucug

SEQ ID NO: 1921159 - RNA, 23 nt, Human
ugacaacacucauugaccugagg

SEQ ID NO: 1921160 - RNA, 18 nt, Human
ugacagacacaggcccgg

SEQ ID NO: 1921161 - RNA, 17 nt, Human
ugacagacacaggcccg

SEQ ID NO: 1921162 - RNA, 18 nt, Human
ugacagagcaagacucug

SEQ ID NO: 1921163 - RNA, 22 nt, Human
ugacagagcaagugagacccug

SEQ ID NO: 1921164 - RNA, 21 nt, Human
ugacagagcaagacucugucu

SEQ ID NO: 1921165 - RNA, 22 nt, Human
ugacagagcaagacucugucua

SEQ ID NO: 1921166 - RNA, 23 nt, Human
ugacaucaacugcaucaagaugu

SEQ ID NO: 1921167 - RNA, 15 nt, Human
ugacaugauuccuuc

SEQ ID NO: 1921168 - RNA, 14 nt, Human
ugacaucuggaauc

SEQ ID NO: 1921169 - RNA, 19 nt, Human
ugacaugauuccuuccugu

SEQ ID NO: 1921170 - RNA, 16 nt, Human
ugacaugauuccuucc

SEQ ID NO: 1921171 - RNA, 18 nt, Human
ugacaugauuccuuccug

SEQ ID NO: 1921172 - RNA, 22 nt, Human
ugacaugauuccuuccuguucu

SEQ ID NO: 1921173 - RNA, 18 nt, Human
ugacaugcacucagcucu

SEQ ID NO: 1921174 - RNA, 11 nt, Human
ugaccagcagc

SEQ ID NO: 1921175 - RNA, 14 nt, Human
ugaccagcagcgcc

SEQ ID NO: 1921176 - RNA, 15 nt, Human
ugaccagcagcgccu

SEQ ID NO: 1921177 - RNA, 13 nt, Human
ugacauguuuuau

SEQ ID NO: 1921178 - RNA, 18 nt, Human
ugaccacugcagaagaca

SEQ ID NO: 1921179 - RNA, 17 nt, Human
ugaccacugcagaagac

SEQ ID NO: 1921180 - RNA, 16 nt, Human
ugaccacugcagaaga

SEQ ID NO: 1921181 - RNA, 22 nt, Human
ugaauguuuacacucuuuguaa

SEQ ID NO: 1921182 - RNA, 22 nt, Human
ugaaugcagucuguccaggcuc

SEQ ID NO: 1921183 - RNA, 19 nt, Human
ugaauguuuacacucuuug

SEQ ID NO: 1921184 - RNA, 23 nt, Human
ugaaugcagucuguccaggcucg

SEQ ID NO: 1921185 - RNA, 20 nt, Human
ugaaugaauggcuaagcaaa

SEQ ID NO: 1921186 - RNA, 15 nt, Human
ugaaugaauggcuaa

SEQ ID NO: 1921187 - RNA, 11 nt, Human
ugaaugaacac

SEQ ID NO: 1921188 - RNA, 12 nt, Human
ugaaugaacacu

SEQ ID NO: 1921189 - RNA, 15 nt, Human
ugaaugaacacucuu

SEQ ID NO: 1921190 - RNA, 15 nt, Human
ugaaugaaccuucug

SEQ ID NO: 1921191 - RNA, 16 nt, Human
ugaaugaaccuucugg

SEQ ID NO: 1921192 - RNA, 18 nt, Human
ugaaucuauuuaucuuca

SEQ ID NO: 1921193 - RNA, 14 nt, Human
ugaaucuauuuaag

SEQ ID NO: 1921194 - RNA, 16 nt, Human
ugaaucuauuuaagua

SEQ ID NO: 1921195 - RNA, 20 nt, Human
ugaaggcuggguucugaucc

SEQ ID NO: 1921196 - RNA, 21 nt, Human
ugaaggcuggguucugauccu

SEQ ID NO: 1921197 - RNA, 23 nt, Human
ugaaucacguaaagcuagaaaug

SEQ ID NO: 1921198 - RNA, 16 nt, Human
ugaaucaguauaaaca

SEQ ID NO: 1921199 - RNA, 19 nt, Human
ugaaucaguauaaacaaag

SEQ ID NO: 1921200 - RNA, 20 nt, Human
ugaaucaguauaaacaaagu

SEQ ID NO: 1921201 - RNA, 21 nt, Human
ugaaucaguauaaacaaaguu

SEQ ID NO: 1921202 - RNA, 22 nt, Human
ugaaucaguauaaacaaaguua

SEQ ID NO: 1921203 - RNA, 17 nt, Human
ugaaucacguaaagcua

SEQ ID NO: 1921204 - RNA, 14 nt, Human
ugaaguuuuacauu

SEQ ID NO: 1921205 - RNA, 15 nt, Human
ugaaguuuuacauug

SEQ ID NO: 1921206 - RNA, 16 nt, Human
ugaaguuuuacauugu

SEQ ID NO: 1921207 - RNA, 17 nt, Human
ugaaguuuuacauuguu

SEQ ID NO: 1921208 - RNA, 21 nt, Human
ugaagauaaguguauuuuuca

SEQ ID NO: 1921209 - RNA, 20 nt, Human
ugaagacucauucuucugua

SEQ ID NO: 1921210 - RNA, 19 nt, Human
ugaagacucauucuucugu

SEQ ID NO: 1921211 - RNA, 13 nt, Human
ugaaacauguuuc

SEQ ID NO: 1921212 - RNA, 16 nt, Human
ugaaacacuuugcaua

SEQ ID NO: 1921213 - RNA, 19 nt, Human
ugaaggccccgcccaggcu

SEQ ID NO: 1921214 - RNA, 20 nt, Human
ugaaggccccgcccaggcuu

SEQ ID NO: 1921215 - RNA, 16 nt, Human
ugaaggaaccaaagcg

SEQ ID NO: 1921216 - RNA, 16 nt, Human
ugaaggccucgcagga

SEQ ID NO: 1921217 - RNA, 18 nt, Human
ugaaggccucgcaggaag

SEQ ID NO: 1921218 - RNA, 21 nt, Human
ugaagcuuuuaugugaaacau

SEQ ID NO: 1921219 - RNA, 16 nt, Human
ugaagcuuuuauguga

SEQ ID NO: 1921220 - RNA, 18 nt, Human
ugaaggccccgcccaggc

SEQ ID NO: 1921221 - RNA, 23 nt, Human
ugaagaguccucugaaugaaccu

SEQ ID NO: 1921222 - RNA, 17 nt, Human
ugaagaguccucugaau

SEQ ID NO: 1921223 - RNA, 19 nt, Human
ugaagagguuuuaaagcuu

SEQ ID NO: 1921224 - RNA, 21 nt, Human
ugaagagguuuuaaagcuucc

SEQ ID NO: 1921225 - RNA, 20 nt, Human
ugaagagguuuuaaagcuuc

SEQ ID NO: 1921226 - RNA, 15 nt, Human
ugaagacuggaagcu

SEQ ID NO: 1921227 - RNA, 17 nt, Human
ugaagacuggaagcuaa

SEQ ID NO: 1921228 - RNA, 22 nt, Human
ugaagagaagggcagggcugag

SEQ ID NO: 1921229 - RNA, 20 nt, Human
ugaagagaagggcagggcug

SEQ ID NO: 1921230 - RNA, 13 nt, Human
ugagaccacagag

SEQ ID NO: 1921231 - RNA, 14 nt, Human
ugagaccaaccugg

SEQ ID NO: 1921232 - RNA, 14 nt, Human
ugagaggggaacag

SEQ ID NO: 1921233 - RNA, 18 nt, Human
ugagaggggaacagacug

SEQ ID NO: 1921234 - RNA, 19 nt, Human
ugagaggggaacagacugg

SEQ ID NO: 1921235 - RNA, 14 nt, Human
ugagagggccgggc

SEQ ID NO: 1921236 - RNA, 17 nt, Human
ugagagggccgggcaga

SEQ ID NO: 1921237 - RNA, 22 nt, Human
ugacuuuucuguccgagcuuug

SEQ ID NO: 1921238 - RNA, 11 nt, Human
ugacuuugucu

SEQ ID NO: 1921239 - RNA, 14 nt, Human
ugagaaaaaaagaa

SEQ ID NO: 1921240 - RNA, 15 nt, Human
ugagaaauaaaguuu

SEQ ID NO: 1921241 - RNA, 23 nt, Human
ugagaaaccuuauuguaccucuc

SEQ ID NO: 1921242 - RNA, 15 nt, Human
ugagaaauauggaca

SEQ ID NO: 1921243 - RNA, 17 nt, Human
ugagaaauauggacacu

SEQ ID NO: 1921244 - RNA, 21 nt, Human
ugagaaauauggacacuuaau

SEQ ID NO: 1921245 - RNA, 14 nt, Human
ugaccauucuccac

SEQ ID NO: 1921246 - RNA, 13 nt, Human
ugaccauucucca

SEQ ID NO: 1921247 - RNA, 15 nt, Human
ugacuaauucuugca

SEQ ID NO: 1921248 - RNA, 17 nt, Human
ugacuaauucuugcaua

SEQ ID NO: 1921249 - RNA, 22 nt, Human
ugacuaauucuugcauauuuug

SEQ ID NO: 1921250 - RNA, 23 nt, Human
ugacuaauucuugcauauuuugu

SEQ ID NO: 1921251 - RNA, 14 nt, Human
ugacucuuggcaca

SEQ ID NO: 1921252 - RNA, 19 nt, Human
ugacucuuggcacagcaug

SEQ ID NO: 1921253 - RNA, 21 nt, Human
ugacucuuucuauuguuucuu

SEQ ID NO: 1921254 - RNA, 16 nt, Human
ugacuuuccucuuugg

SEQ ID NO: 1921255 - RNA, 15 nt, Human
ugacuuucauuggaa

SEQ ID NO: 1921256 - RNA, 17 nt, Human
ugacuuucauuggaaau

SEQ ID NO: 1921257 - RNA, 15 nt, Human
ugagcucuuugcacu

SEQ ID NO: 1921258 - RNA, 16 nt, Human
ugagcucuuugcacua

SEQ ID NO: 1921259 - RNA, 11 nt, Human
ugagcucagga

SEQ ID NO: 1921260 - RNA, 19 nt, Human
ugagcucaggaguuugaga

SEQ ID NO: 1921261 - RNA, 22 nt, Human
ugagccgagaucacgccacugc

SEQ ID NO: 1921262 - RNA, 23 nt, Human
ugagcagggcucagcggggacag

SEQ ID NO: 1921263 - RNA, 22 nt, Human
ugagcagggcucagcggggaca

SEQ ID NO: 1921264 - RNA, 20 nt, Human
ugagcagggcucagcgggga

SEQ ID NO: 1921265 - RNA, 23 nt, Human
ugagccgagaucacgccacugca

SEQ ID NO: 1921266 - RNA, 16 nt, Human
ugagcuauugcuguuc

SEQ ID NO: 1921267 - RNA, 13 nt, Human
ugaggaucagagu

SEQ ID NO: 1921268 - RNA, 17 nt, Human
ugaggaucagaguaauc

SEQ ID NO: 1921269 - RNA, 19 nt, Human
ugaggaucagaguaaucca

SEQ ID NO: 1921270 - RNA, 22 nt, Human
ugaggaugaaaaaauaacacug

SEQ ID NO: 1921271 - RNA, 14 nt, Human
ugaggcaagagaau

SEQ ID NO: 1921272 - RNA, 11 nt, Human
ugagcuguuuu

SEQ ID NO: 1921273 - RNA, 12 nt, Human
ugagcugucacu

SEQ ID NO: 1921274 - RNA, 20 nt, Human
ugagcugugcacaaaguggc

SEQ ID NO: 1921275 - RNA, 14 nt, Human
ugagcugcagaaac

SEQ ID NO: 1921276 - RNA, 15 nt, Human
ugagcugcagaaacg

SEQ ID NO: 1921277 - RNA, 17 nt, Human
ugagcugcagaaacgaa

SEQ ID NO: 1921278 - RNA, 15 nt, Human
ugagcuucucuguga

SEQ ID NO: 1921279 - RNA, 16 nt, Human
ugagcuucucugugaa

SEQ ID NO: 1921280 - RNA, 19 nt, Human
ugaggucagagccugcagu

SEQ ID NO: 1921281 - RNA, 18 nt, Human
ugaggucagagccugcag

SEQ ID NO: 1921282 - RNA, 21 nt, Human
ugaggcugggcucccuuccca

SEQ ID NO: 1921283 - RNA, 18 nt, Human
ugaggucauagcagugcu

SEQ ID NO: 1921284 - RNA, 16 nt, Human
ugaggucaggaguucc

SEQ ID NO: 1921285 - RNA, 16 nt, Human
ugaggcucugcccuug

SEQ ID NO: 1921286 - RNA, 15 nt, Human
ugaggcucugcccuu

SEQ ID NO: 1921287 - RNA, 18 nt, Human
ugaggcucugcccuuggu

SEQ ID NO: 1921288 - RNA, 15 nt, Human
ugaggcugggcuccc

SEQ ID NO: 1921289 - RNA, 16 nt, Human
ugaggcugggcucccu

SEQ ID NO: 1921290 - RNA, 13 nt, Human
ugaggcagguccc

SEQ ID NO: 1921291 - RNA, 24 nt, Human
ucuuguacauguguagccugugca

SEQ ID NO: 1921292 - RNA, 19 nt, Human
ucuuguacauguguagccu

SEQ ID NO: 1921293 - RNA, 16 nt, Human
ucuuguauuaaacucu

SEQ ID NO: 1921294 - RNA, 19 nt, Human
ucuuguauuaaacucuuca

SEQ ID NO: 1921295 - RNA, 17 nt, Human
ucuuguacauguguagc

SEQ ID NO: 1921296 - RNA, 14 nt, Human
ucuuguacaugugu

SEQ ID NO: 1921297 - RNA, 23 nt, Human
ucuugcucugcugacagacacag

SEQ ID NO: 1921298 - RNA, 15 nt, Human
ucuugcucugcugac

SEQ ID NO: 1921299 - RNA, 19 nt, Human
ucuugccaaauauaaauaa

SEQ ID NO: 1921300 - RNA, 14 nt, Human
ucuugcucugcuga

SEQ ID NO: 1921301 - RNA, 21 nt, Human
ucuucuuuuugaaaucagcau

SEQ ID NO: 1921302 - RNA, 21 nt, Human
ucuucuuuuagcaguaaaaua

SEQ ID NO: 1921303 - RNA, 16 nt, Human
ucuucuuggucucagu

SEQ ID NO: 1921304 - RNA, 13 nt, Human
ucuugaagacuuu

SEQ ID NO: 1921305 - RNA, 22 nt, Human
ucuugaagacuuuucuuucagc

SEQ ID NO: 1921306 - RNA, 21 nt, Human
ucuugaaauuaagaaggcaaa

SEQ ID NO: 1921307 - RNA, 18 nt, Human
ucuugaacugagcuugga

SEQ ID NO: 1921308 - RNA, 21 nt, Human
ucuugaaauauaggaacuuaa

SEQ ID NO: 1921309 - RNA, 20 nt, Human
ucuugaaauauaggaacuua

SEQ ID NO: 1921310 - RNA, 22 nt, Human
ucuugaaauuaagaaggcaaaa

SEQ ID NO: 1921311 - RNA, 17 nt, Human
ucuugaacugagcuugg

SEQ ID NO: 1921312 - RNA, 14 nt, Human
ucuugaaauuaaga

SEQ ID NO: 1921313 - RNA, 20 nt, Human
ucuugaaauuaagaaggcaa

SEQ ID NO: 1921314 - RNA, 14 nt, Human
ucuuauaauuuaaa

SEQ ID NO: 1921315 - RNA, 13 nt, Human
ucuuauaauuuaa

SEQ ID NO: 1921316 - RNA, 20 nt, Human
ucuuagguuggcaaaaaggc

SEQ ID NO: 1921317 - RNA, 23 nt, Human
ucuuagguuggcaaaaaggcagg

SEQ ID NO: 1921318 - RNA, 20 nt, Human
ucugugucagguggggcagc

SEQ ID NO: 1921319 - RNA, 17 nt, Human
ucugugucagguggggc

SEQ ID NO: 1921320 - RNA, 15 nt, Human
ucuuagauguauaua

SEQ ID NO: 1921321 - RNA, 13 nt, Human
ucugugugugugu

SEQ ID NO: 1921322 - RNA, 11 nt, Human
ucugugugugu

SEQ ID NO: 1921323 - RNA, 20 nt, Human
ucuucauaacaauuuuagga

SEQ ID NO: 1921324 - RNA, 22 nt, Human
ucuucauuaccucagugagaag

SEQ ID NO: 1921325 - RNA, 20 nt, Human
ucuucauuugaaugucuucu

SEQ ID NO: 1921326 - RNA, 15 nt, Human
ucuucagaucucuaa

SEQ ID NO: 1921327 - RNA, 14 nt, Human
ucuucagaucucua

SEQ ID NO: 1921328 - RNA, 21 nt, Human
ucuucagagacuccugcaggc

SEQ ID NO: 1921329 - RNA, 20 nt, Human
ucuuaucauggucucaguca

SEQ ID NO: 1921330 - RNA, 22 nt, Human
ucuuauccaacaucaacaucuu

SEQ ID NO: 1921331 - RNA, 21 nt, Human
ucuuaucacaaaaaagaaaau

SEQ ID NO: 1921332 - RNA, 23 nt, Human
ucuuaucaagaguugugacaacu

SEQ ID NO: 1921333 - RNA, 16 nt, Human
ucuuagcuccccucca

SEQ ID NO: 1921334 - RNA, 14 nt, Human
ucuuagcuccccuc

SEQ ID NO: 1921335 - RNA, 13 nt, Human
ucuuagcuccccu

SEQ ID NO: 1921336 - RNA, 18 nt, Human
ucuuugaauacaaagaac

SEQ ID NO: 1921337 - RNA, 13 nt, Human
ucuuucccucccu

SEQ ID NO: 1921338 - RNA, 23 nt, Human
ucuuucccucccuuccucuuucc

SEQ ID NO: 1921339 - RNA, 12 nt, Human
ucuuucccuccc

SEQ ID NO: 1921340 - RNA, 23 nt, Human
ucuugugacuagugcugaagcuu

SEQ ID NO: 1921341 - RNA, 22 nt, Human
ucuuguggcuuugcaaccauuu

SEQ ID NO: 1921342 - RNA, 23 nt, Human
ucuuuccaaaguacacuguuuca

SEQ ID NO: 1921343 - RNA, 13 nt, Human
ucuuguguguuua

SEQ ID NO: 1921344 - RNA, 13 nt, Human
ucuuuggacccug

SEQ ID NO: 1921345 - RNA, 11 nt, Human
ucuuugcuuug

SEQ ID NO: 1921346 - RNA, 16 nt, Human
ucuuuggacccugagg

SEQ ID NO: 1921347 - RNA, 14 nt, Human
ucuuuggacccuga

SEQ ID NO: 1921348 - RNA, 15 nt, Human
ucuuuggacccugag

SEQ ID NO: 1921349 - RNA, 13 nt, Human
ucuuugcagacag

SEQ ID NO: 1921350 - RNA, 23 nt, Human
ucuuugagugaagcugggagaac

SEQ ID NO: 1921351 - RNA, 17 nt, Human
ucuuugcagacaggcaa

SEQ ID NO: 1921352 - RNA, 14 nt, Human
ucuuugcagacagg

SEQ ID NO: 1921353 - RNA, 21 nt, Human
ugaaaacacauuuuucuuagg

SEQ ID NO: 1921354 - RNA, 20 nt, Human
ucuuuuguucgcauggucac

SEQ ID NO: 1921355 - RNA, 16 nt, Human
ucuuuucauugaacag

SEQ ID NO: 1921356 - RNA, 17 nt, Human
ugaaaacacuguucucu

SEQ ID NO: 1921357 - RNA, 20 nt, Human
ugaaaacacuguucucugcc

SEQ ID NO: 1921358 - RNA, 21 nt, Human
ugaaaacacuguucucugccc

SEQ ID NO: 1921359 - RNA, 22 nt, Human
ugaaaacacuguucucugcccu

SEQ ID NO: 1921360 - RNA, 23 nt, Human
ugaaaacacuguucucugcccuc

SEQ ID NO: 1921361 - RNA, 18 nt, Human
ugaaaaccacauuggaga

SEQ ID NO: 1921362 - RNA, 20 nt, Human
ugaaaacggagcugaacaau

SEQ ID NO: 1921363 - RNA, 19 nt, Human
ugaaaagaaaaaugagccu

SEQ ID NO: 1921364 - RNA, 20 nt, Human
ugaaaagaaaaaugagccug

SEQ ID NO: 1921365 - RNA, 22 nt, Human
ugaaaagaaaaaugagccuggc

SEQ ID NO: 1921366 - RNA, 14 nt, Human
ugaaaauucagugg

SEQ ID NO: 1921367 - RNA, 12 nt, Human
ugaaaauuuuga

SEQ ID NO: 1921368 - RNA, 15 nt, Human
ugaaacacuuugcau

SEQ ID NO: 1921369 - RNA, 22 nt, Human
ucuggaauguaaucaauguuuc

SEQ ID NO: 1921370 - RNA, 18 nt, Human
ucuggaauguaaucaaug

SEQ ID NO: 1921371 - RNA, 16 nt, Human
ucuggaauguaaucaa

SEQ ID NO: 1921372 - RNA, 15 nt, Human
ucuggaauguaauca

SEQ ID NO: 1921373 - RNA, 23 nt, Human
ucugcuggaguuucauguacaag

SEQ ID NO: 1921374 - RNA, 19 nt, Human
ucugcuggaguuucaugua

SEQ ID NO: 1921375 - RNA, 14 nt, Human
ucuggaauuugaaa

SEQ ID NO: 1921376 - RNA, 18 nt, Human
ucuggacagccccacccu

SEQ ID NO: 1921377 - RNA, 19 nt, Human
ucuggacagccccacccug

SEQ ID NO: 1921378 - RNA, 17 nt, Human
ucugcugcuggcugguu

SEQ ID NO: 1921379 - RNA, 13 nt, Human
ucugcuggaguuu

SEQ ID NO: 1921380 - RNA, 14 nt, Human
ucugcugcuggcug

SEQ ID NO: 1921381 - RNA, 15 nt, Human
ucugcugcuggcugg

SEQ ID NO: 1921382 - RNA, 20 nt, Human
ucuggacagccccacccugg

SEQ ID NO: 1921383 - RNA, 12 nt, Human
ucuggaccugcc

SEQ ID NO: 1921384 - RNA, 13 nt, Human
ucuggaccugccc

SEQ ID NO: 1921385 - RNA, 20 nt, Human
ucugccugcccaggccccug

SEQ ID NO: 1921386 - RNA, 18 nt, Human
ucugccugcccaggcccc

SEQ ID NO: 1921387 - RNA, 17 nt, Human
ucugccugcccaggccc

SEQ ID NO: 1921388 - RNA, 18 nt, Human
ucugccugccagcugcac

SEQ ID NO: 1921389 - RNA, 21 nt, Human
ucugccugccagcugcacuga

SEQ ID NO: 1921390 - RNA, 22 nt, Human
ucugccugccagcugcacugau

SEQ ID NO: 1921391 - RNA, 20 nt, Human
ucugcucuccuuccuggagc

SEQ ID NO: 1921392 - RNA, 19 nt, Human
ucugcucuccuuccuggag

SEQ ID NO: 1921393 - RNA, 15 nt, Human
ucugcucuccuuccu

SEQ ID NO: 1921394 - RNA, 14 nt, Human
ucugcucuccuucc

SEQ ID NO: 1921395 - RNA, 13 nt, Human
ucugcucuccuuc

SEQ ID NO: 1921396 - RNA, 12 nt, Human
ucugcucuccuu

SEQ ID NO: 1921397 - RNA, 11 nt, Human
ucugcugcugg

SEQ ID NO: 1921398 - RNA, 13 nt, Human
ucugcugcuggcu

SEQ ID NO: 1921399 - RNA, 13 nt, Human
ucuguacacgugu

SEQ ID NO: 1921400 - RNA, 15 nt, Human
ucuguacagagccca

SEQ ID NO: 1921401 - RNA, 14 nt, Human
ucuguacagagccc

SEQ ID NO: 1921402 - RNA, 17 nt, Human
ucuguaauuguguguga

SEQ ID NO: 1921403 - RNA, 17 nt, Human
ucuguacacguguccug

SEQ ID NO: 1921404 - RNA, 13 nt, Human
ucuguccucagcc

SEQ ID NO: 1921405 - RNA, 14 nt, Human
ucuguccucagccu

SEQ ID NO: 1921406 - RNA, 15 nt, Human
ucuguccucagccuu

SEQ ID NO: 1921407 - RNA, 19 nt, Human
ucuguccucagccuugcca

SEQ ID NO: 1921408 - RNA, 21 nt, Human
ucuguccucagccuugccaga

SEQ ID NO: 1921409 - RNA, 23 nt, Human
ucuguccucagccuugccagaga

SEQ ID NO: 1921410 - RNA, 17 nt, Human
ucugucgcccagucugg

SEQ ID NO: 1921411 - RNA, 12 nt, Human
ucuguccuggga

SEQ ID NO: 1921412 - RNA, 14 nt, Human
ucugucucagucca

SEQ ID NO: 1921413 - RNA, 13 nt, Human
ucugucuaggaau

SEQ ID NO: 1921414 - RNA, 21 nt, Human
ucugucucaaaaaauaaaaau

SEQ ID NO: 1921415 - RNA, 14 nt, Human
ucugucuaaaaaac

SEQ ID NO: 1921416 - RNA, 15 nt, Human
ucugucuaaaaaaca

SEQ ID NO: 1921417 - RNA, 16 nt, Human
ucuggugacuuuccuc

SEQ ID NO: 1921418 - RNA, 23 nt, Human
ucuggugaccuuccaagagccug

SEQ ID NO: 1921419 - RNA, 18 nt, Human
ucuggugaccuuccaaga

SEQ ID NO: 1921420 - RNA, 16 nt, Human
ucuggugaccuuccaa

SEQ ID NO: 1921421 - RNA, 12 nt, Human
ucuggagcccac

SEQ ID NO: 1921422 - RNA, 16 nt, Human
ucuggagcccacugua

SEQ ID NO: 1921423 - RNA, 22 nt, Human
ucuggagcccacuguacuugcu

SEQ ID NO: 1921424 - RNA, 15 nt, Human
ucuggcugcagagca

SEQ ID NO: 1921425 - RNA, 20 nt, Human
ucugccucacauagcuuaca

SEQ ID NO: 1921426 - RNA, 18 nt, Human
ucugccucugacacacag

SEQ ID NO: 1921427 - RNA, 15 nt, Human
ucugccucugacaca

SEQ ID NO: 1921428 - RNA, 16 nt, Human
ucugccucccaucacc

SEQ ID NO: 1921429 - RNA, 17 nt, Human
ucugccucccaucaccc

SEQ ID NO: 1921430 - RNA, 20 nt, Human
ucugccucccaucacccgcu

SEQ ID NO: 1921431 - RNA, 21 nt, Human
ucugccucccaucacccgcua

SEQ ID NO: 1921432 - RNA, 20 nt, Human
ucugccugaagucacacagu

SEQ ID NO: 1921433 - RNA, 16 nt, Human
ucugccugccagcugc

SEQ ID NO: 1921434 - RNA, 17 nt, Human
ucugccugccagcugca

SEQ ID NO: 1921435 - RNA, 19 nt, Human
ucugccugaagucacacag

SEQ ID NO: 1921436 - RNA, 22 nt, Human
ucugccucugacacacagcucu

SEQ ID NO: 1921437 - RNA, 21 nt, Human
ucugccucugacacacagcuc

SEQ ID NO: 1921438 - RNA, 23 nt, Human
ucugccucugacacacagcucug

SEQ ID NO: 1921439 - RNA, 18 nt, Human
ucugccauauucuguugg

SEQ ID NO: 1921440 - RNA, 15 nt, Human
ucugcauauguugaa

SEQ ID NO: 1921441 - RNA, 16 nt, Human
ucugcauauguugaau

SEQ ID NO: 1921442 - RNA, 18 nt, Human
ucugcauauguugaauac

SEQ ID NO: 1921443 - RNA, 23 nt, Human
ucugccauauucuguuggccagu

SEQ ID NO: 1921444 - RNA, 22 nt, Human
ucugccauauucuguuggccag

SEQ ID NO: 1921445 - RNA, 12 nt, Human
ucugcccacucc

SEQ ID NO: 1921446 - RNA, 12 nt, Human
ucugcccaaccc

SEQ ID NO: 1921447 - RNA, 19 nt, Human
ucugcauauguugaauacu

SEQ ID NO: 1921448 - RNA, 21 nt, Human
ucugcauauguugaauacuuu

SEQ ID NO: 1921449 - RNA, 13 nt, Human
ucugccucccauc

SEQ ID NO: 1921450 - RNA, 15 nt, Human
ucugccucccaucac

SEQ ID NO: 1921451 - RNA, 12 nt, Human
ucugccucccau

SEQ ID NO: 1921452 - RNA, 13 nt, Human
ucugcccacuccc

SEQ ID NO: 1921453 - RNA, 14 nt, Human
ucugcccacucccu

SEQ ID NO: 1921454 - RNA, 16 nt, Human
ucugcccacucccugc

SEQ ID NO: 1921455 - RNA, 21 nt, Human
ucugaggaauccagacccggc

SEQ ID NO: 1921456 - RNA, 18 nt, Human
ucugaggaauccagaccc

SEQ ID NO: 1921457 - RNA, 22 nt, Human
ucugaggaauccagacccggcu

SEQ ID NO: 1921458 - RNA, 14 nt, Human
ucugcaaaaauauu

SEQ ID NO: 1921459 - RNA, 19 nt, Human
ucugcaaaaauauuuauaa

SEQ ID NO: 1921460 - RNA, 20 nt, Human
ucugcaaaaauauuuauaaa

SEQ ID NO: 1921461 - RNA, 13 nt, Human
ucugcacuccccu

SEQ ID NO: 1921462 - RNA, 16 nt, Human
ucugcaguaaaucuuu

SEQ ID NO: 1921463 - RNA, 18 nt, Human
ucugcaccguacugugga

SEQ ID NO: 1921464 - RNA, 19 nt, Human
ucugacccaugcugcccug

SEQ ID NO: 1921465 - RNA, 20 nt, Human
ucugacccaugcugcccugu

SEQ ID NO: 1921466 - RNA, 22 nt, Human
ucugacccaugcugcccuguga

SEQ ID NO: 1921467 - RNA, 23 nt, Human
ucugacccaugcugcccugugag

SEQ ID NO: 1921468 - RNA, 18 nt, Human
ucugagaggacuuuucuu

SEQ ID NO: 1921469 - RNA, 24 nt, Human
ucugagaucaaaacgguuuuacug

SEQ ID NO: 1921470 - RNA, 18 nt, Human
ucaggaccuccaagccac

SEQ ID NO: 1921471 - RNA, 20 nt, Human
ucaggaccuccaagccacug

SEQ ID NO: 1921472 - RNA, 15 nt, Human
ucaggacagaugcca

SEQ ID NO: 1921473 - RNA, 14 nt, Human
ucaggacagaugcc

SEQ ID NO: 1921474 - RNA, 15 nt, Human
ucagcugcuacuacu

SEQ ID NO: 1921475 - RNA, 17 nt, Human
ucaggaggcaggaccuu

SEQ ID NO: 1921476 - RNA, 23 nt, Human
ucaggaggaaggcuuacacccac

SEQ ID NO: 1921477 - RNA, 16 nt, Human
ucaggaggaaggcuua

SEQ ID NO: 1921478 - RNA, 22 nt, Human
ucagcuccagcucaccagcccc

SEQ ID NO: 1921479 - RNA, 21 nt, Human
ucagcuccagcucaccagccc

SEQ ID NO: 1921480 - RNA, 18 nt, Human
ucagcuccagcucaccag

SEQ ID NO: 1921481 - RNA, 20 nt, Human
ucagccucccgaauagcugg

SEQ ID NO: 1921482 - RNA, 12 nt, Human
ucagccucccga

SEQ ID NO: 1921483 - RNA, 22 nt, Human
ucagccucccaaagugcuggga

SEQ ID NO: 1921484 - RNA, 20 nt, Human
ucagccucccaaguagcugg

SEQ ID NO: 1921485 - RNA, 16 nt, Human
ucagccugcuccagcu

SEQ ID NO: 1921486 - RNA, 13 nt, Human
uaucauucagcaa

SEQ ID NO: 1921487 - RNA, 14 nt, Human
uaucauucagcaac

SEQ ID NO: 1921488 - RNA, 12 nt, Human
uaucauucagca

SEQ ID NO: 1921489 - RNA, 18 nt, Human
ucagauaugauucaaaug

SEQ ID NO: 1921490 - RNA, 16 nt, Human
ucagauaugauucaaa

SEQ ID NO: 1921491 - RNA, 17 nt, Human
ucagauaugauucaaau

SEQ ID NO: 1921492 - RNA, 19 nt, Human
ucagcacaaggccaucugg

SEQ ID NO: 1921493 - RNA, 20 nt, Human
ucagaucauuaucagccugu

SEQ ID NO: 1921494 - RNA, 14 nt, Human
ucagauccagggac

SEQ ID NO: 1921495 - RNA, 15 nt, Human
ucagauccagggaca

SEQ ID NO: 1921496 - RNA, 16 nt, Human
ucagauccagggacag

SEQ ID NO: 1921497 - RNA, 23 nt, Human
ucagaucaguguaccauuugccu

SEQ ID NO: 1921498 - RNA, 18 nt, Human
ucagcauccuggcacccg

SEQ ID NO: 1921499 - RNA, 17 nt, Human
ucagcauccuggcaccc

SEQ ID NO: 1921500 - RNA, 16 nt, Human
ucagcauccuggcacc

SEQ ID NO: 1921501 - RNA, 15 nt, Human
ucagcauccuggcac

SEQ ID NO: 1921502 - RNA, 13 nt, Human
ucagccucccaaa

SEQ ID NO: 1921503 - RNA, 12 nt, Human
ucagccucccaa

SEQ ID NO: 1921504 - RNA, 17 nt, Human
ucagcacgauuucuguu

SEQ ID NO: 1921505 - RNA, 22 nt, Human
ucagcaccuacaguguacaguc

SEQ ID NO: 1921506 - RNA, 21 nt, Human
ucagcaccuacaguguacagu

SEQ ID NO: 1921507 - RNA, 20 nt, Human
ucagcaccuacaguguacag

SEQ ID NO: 1921508 - RNA, 16 nt, Human
ucagcacgauuucugu

SEQ ID NO: 1921509 - RNA, 15 nt, Human
ucagcacgauuucug

SEQ ID NO: 1921510 - RNA, 24 nt, Human
ucauggacuucugccagcauaaua

SEQ ID NO: 1921511 - RNA, 23 nt, Human
ucauggaugggggaacucagauc

SEQ ID NO: 1921512 - RNA, 15 nt, Human
ucaugaaagauucaa

SEQ ID NO: 1921513 - RNA, 13 nt, Human
ucaugaaagauuc

SEQ ID NO: 1921514 - RNA, 22 nt, Human
ucaucuuucuugaucaacaucu

SEQ ID NO: 1921515 - RNA, 14 nt, Human
ucaucuuugugaag

SEQ ID NO: 1921516 - RNA, 13 nt, Human
ucaucuuucuuga

SEQ ID NO: 1921517 - RNA, 14 nt, Human
ucaucauuuuuccu

SEQ ID NO: 1921518 - RNA, 17 nt, Human
ucaucaacccuaaaaag

SEQ ID NO: 1921519 - RNA, 19 nt, Human
ucauagaaagugccagaaa

SEQ ID NO: 1921520 - RNA, 16 nt, Human
ucauacuuaagcaaaa

SEQ ID NO: 1921521 - RNA, 17 nt, Human
ucaguucucuucacuca

SEQ ID NO: 1921522 - RNA, 14 nt, Human
ucaguucucuucac

SEQ ID NO: 1921523 - RNA, 15 nt, Human
ucaguccauagcaga

SEQ ID NO: 1921524 - RNA, 18 nt, Human
ucaguccaugaagaugua

SEQ ID NO: 1921525 - RNA, 21 nt, Human
ucagguggggucacucuggca

SEQ ID NO: 1921526 - RNA, 13 nt, Human
ucagguggccaug

SEQ ID NO: 1921527 - RNA, 17 nt, Human
ucagguggggucacucu

SEQ ID NO: 1921528 - RNA, 20 nt, Human
ucagguggggucacucuggc

SEQ ID NO: 1921529 - RNA, 17 nt, Human
ucagguggggcagcuug

SEQ ID NO: 1921530 - RNA, 21 nt, Human
ucagguggggcagcuugaggg

SEQ ID NO: 1921531 - RNA, 16 nt, Human
ucagguggggcagcuu

SEQ ID NO: 1921532 - RNA, 15 nt, Human
ucagguggggcagcu

SEQ ID NO: 1921533 - RNA, 20 nt, Human
ucaggugcugccauccaggu

SEQ ID NO: 1921534 - RNA, 18 nt, Human
ucaggugcugccauccag

SEQ ID NO: 1921535 - RNA, 14 nt, Human
ucagguggggcagc

SEQ ID NO: 1921536 - RNA, 11 nt, Human
ucagguggcca

SEQ ID NO: 1921537 - RNA, 19 nt, Human
ucagucugauucccaagcu

SEQ ID NO: 1921538 - RNA, 17 nt, Human
ucagucugauucccaag

SEQ ID NO: 1921539 - RNA, 18 nt, Human
ucagugugacugaucucu

SEQ ID NO: 1921540 - RNA, 18 nt, Human
ucaguuaaguuuuucccu

SEQ ID NO: 1921541 - RNA, 17 nt, Human
ucaguuaaguuuuuccc

SEQ ID NO: 1921542 - RNA, 22 nt, Human
uccacccuggccgaguccaagc

SEQ ID NO: 1921543 - RNA, 21 nt, Human
uccacccugcucuccgaccag

SEQ ID NO: 1921544 - RNA, 14 nt, Human
uccacccugcucuc

SEQ ID NO: 1921545 - RNA, 13 nt, Human
uccacccugcucu

SEQ ID NO: 1921546 - RNA, 22 nt, Human
uccacugugccaugugccaggu

SEQ ID NO: 1921547 - RNA, 15 nt, Human
uccacuuuaucuuga

SEQ ID NO: 1921548 - RNA, 15 nt, Human
uccagaugcagggca

SEQ ID NO: 1921549 - RNA, 17 nt, Human
uccacuuuaucuugaau

SEQ ID NO: 1921550 - RNA, 14 nt, Human
uccacuuucuagcc

SEQ ID NO: 1921551 - RNA, 18 nt, Human
uccacuuucagugaaagc

SEQ ID NO: 1921552 - RNA, 18 nt, Human
uccaggaaccacaccaca

SEQ ID NO: 1921553 - RNA, 17 nt, Human
uccagggcccccaucuc

SEQ ID NO: 1921554 - RNA, 20 nt, Human
uccaggacuauauuugggcc

SEQ ID NO: 1921555 - RNA, 23 nt, Human
uccaggacuauauuugggccugc

SEQ ID NO: 1921556 - RNA, 18 nt, Human
uccagauguuuccagacu

SEQ ID NO: 1921557 - RNA, 19 nt, Human
uccagauguuuccagacuu

SEQ ID NO: 1921558 - RNA, 16 nt, Human
uccagaugcagggcag

SEQ ID NO: 1921559 - RNA, 17 nt, Human
uccagaugcagggcagu

SEQ ID NO: 1921560 - RNA, 18 nt, Human
uccagaugcagggcaguc

SEQ ID NO: 1921561 - RNA, 19 nt, Human
uccagaugcagggcaguca

SEQ ID NO: 1921562 - RNA, 17 nt, Human
uccaagccacugagcaa

SEQ ID NO: 1921563 - RNA, 23 nt, Human
uccaagcagccugagcaacucuu

SEQ ID NO: 1921564 - RNA, 15 nt, Human
uccaagccagcggga

SEQ ID NO: 1921565 - RNA, 22 nt, Human
uccaagcccaguucagcuuggg

SEQ ID NO: 1921566 - RNA, 21 nt, Human
uccacaagagcccaggccucc

SEQ ID NO: 1921567 - RNA, 20 nt, Human
uccacaagagcccaggccuc

SEQ ID NO: 1921568 - RNA, 19 nt, Human
uccacaagagcccaggccu

SEQ ID NO: 1921569 - RNA, 19 nt, Human
uccacagcaaccccaggcu

SEQ ID NO: 1921570 - RNA, 23 nt, Human
uccacacucaccucuaaaacagu

SEQ ID NO: 1921571 - RNA, 20 nt, Human
uccacagcaaccccaggcug

SEQ ID NO: 1921572 - RNA, 15 nt, Human
uccacaccuuuuauu

SEQ ID NO: 1921573 - RNA, 21 nt, Human
uccacaccuuuuauugacaca

SEQ ID NO: 1921574 - RNA, 15 nt, Human
uccaagcaaauguga

SEQ ID NO: 1921575 - RNA, 17 nt, Human
uccaagcaaaugugaau

SEQ ID NO: 1921576 - RNA, 14 nt, Human
uccaagcaggacau

SEQ ID NO: 1921577 - RNA, 22 nt, Human
uccaagcaggacauggacaagg

SEQ ID NO: 1921578 - RNA, 19 nt, Human
uccaagaagcccaggaaag

SEQ ID NO: 1921579 - RNA, 20 nt, Human
uccaagaccuucuccuucac

SEQ ID NO: 1921580 - RNA, 12 nt, Human
uccaagagcuga

SEQ ID NO: 1921581 - RNA, 14 nt, Human
uccaagagccugag

SEQ ID NO: 1921582 - RNA, 13 nt, Human
uccaagagccuga

SEQ ID NO: 1921583 - RNA, 14 nt, Human
uccaagaagcccag

SEQ ID NO: 1921584 - RNA, 19 nt, Human
ucauguauguucagaagaa

SEQ ID NO: 1921585 - RNA, 21 nt, Human
ucauguauguucagaagaaau

SEQ ID NO: 1921586 - RNA, 15 nt, Human
uccaagaagcccagg

SEQ ID NO: 1921587 - RNA, 16 nt, Human
uccaagaagcccagga

SEQ ID NO: 1921588 - RNA, 22 nt, Human
ucauguauguucagaagaaauu

SEQ ID NO: 1921589 - RNA, 16 nt, Human
ucauguacaagaugaa

SEQ ID NO: 1921590 - RNA, 17 nt, Human
ucauguacaagaugaag

SEQ ID NO: 1921591 - RNA, 18 nt, Human
ucauguacaagaugaagg

SEQ ID NO: 1921592 - RNA, 12 nt, Human
uccaugauucua

SEQ ID NO: 1921593 - RNA, 21 nt, Human
uccaugugaggguuuucagca

SEQ ID NO: 1921594 - RNA, 14 nt, Human
ucccaacucuagcu

SEQ ID NO: 1921595 - RNA, 15 nt, Human
ucccaacucuagcug

SEQ ID NO: 1921596 - RNA, 16 nt, Human
ucccaacucuagcugg

SEQ ID NO: 1921597 - RNA, 17 nt, Human
ucccaacucuagcuggg

SEQ ID NO: 1921598 - RNA, 19 nt, Human
ucccaacucaccccagccc

SEQ ID NO: 1921599 - RNA, 21 nt, Human
ucccaacucaccccagcccca

SEQ ID NO: 1921600 - RNA, 17 nt, Human
ucccaacucaccccagc

SEQ ID NO: 1921601 - RNA, 18 nt, Human
ucccaacucaccccagcc

SEQ ID NO: 1921602 - RNA, 20 nt, Human
uccauagagagcaagacgcu

SEQ ID NO: 1921603 - RNA, 23 nt, Human
uccagggcuggacugaggccuga

SEQ ID NO: 1921604 - RNA, 22 nt, Human
uccagggcuggacugaggccug

SEQ ID NO: 1921605 - RNA, 21 nt, Human
uccagggcuggacugaggccu

SEQ ID NO: 1921606 - RNA, 19 nt, Human
uccagggcuggacugaggc

SEQ ID NO: 1921607 - RNA, 17 nt, Human
uccagggcuggacugag

SEQ ID NO: 1921608 - RNA, 14 nt, Human
uccagggcuggacu

SEQ ID NO: 1921609 - RNA, 17 nt, Human
uccauagagagcaagac

SEQ ID NO: 1921610 - RNA, 14 nt, Human
ucccacucagucca

SEQ ID NO: 1921611 - RNA, 21 nt, Human
ucccaccuuggcugcagggag

SEQ ID NO: 1921612 - RNA, 19 nt, Human
ucccaccuuggcugcaggg

SEQ ID NO: 1921613 - RNA, 20 nt, Human
ucccaccucucucacuccuu

SEQ ID NO: 1921614 - RNA, 18 nt, Human
ucccaccucagccucccg

SEQ ID NO: 1921615 - RNA, 16 nt, Human
ucccaccucagccucc

SEQ ID NO: 1921616 - RNA, 14 nt, Human
ucccaccucucuca

SEQ ID NO: 1921617 - RNA, 17 nt, Human
ucccaccucucucacuc

SEQ ID NO: 1921618 - RNA, 18 nt, Human
ucccaccucucucacucc

SEQ ID NO: 1921619 - RNA, 16 nt, Human
ucccaugagccucagc

SEQ ID NO: 1921620 - RNA, 15 nt, Human
ucccaugagccucag

SEQ ID NO: 1921621 - RNA, 14 nt, Human
ucccagggcuuacg

SEQ ID NO: 1921622 - RNA, 19 nt, Human
ucccaggcauuccccagga

SEQ ID NO: 1921623 - RNA, 17 nt, Human
ucccaggcauuccccag

SEQ ID NO: 1921624 - RNA, 18 nt, Human
ucccaggcauuccccagg

SEQ ID NO: 1921625 - RNA, 22 nt, Human
ucccacugggguccagggagca

SEQ ID NO: 1921626 - RNA, 14 nt, Human
ucuagguucuaaaa

SEQ ID NO: 1921627 - RNA, 23 nt, Human
ucuagguucuaaaaauugugauc

SEQ ID NO: 1921628 - RNA, 13 nt, Human
ucuauauuuuaca

SEQ ID NO: 1921629 - RNA, 20 nt, Human
ucuaggccuccuggcccagg

SEQ ID NO: 1921630 - RNA, 19 nt, Human
ucuagggaaaaaccagcgu

SEQ ID NO: 1921631 - RNA, 12 nt, Human
ucuagggaaaaa

SEQ ID NO: 1921632 - RNA, 15 nt, Human
ucuagguaaauuaca

SEQ ID NO: 1921633 - RNA, 18 nt, Human
ucuaggaggucucuaaga

SEQ ID NO: 1921634 - RNA, 18 nt, Human
ucuacucuagggaaaaac

SEQ ID NO: 1921635 - RNA, 20 nt, Human
ucuacucuccucaucucuaa

SEQ ID NO: 1921636 - RNA, 20 nt, Human
ucuacucgaguuacagacaa

SEQ ID NO: 1921637 - RNA, 21 nt, Human
ucuacucgaguuacagacaaa

SEQ ID NO: 1921638 - RNA, 18 nt, Human
ucuacuaauuccacaccu

SEQ ID NO: 1921639 - RNA, 22 nt, Human
ucuacucauuuaaaguauuuua

SEQ ID NO: 1921640 - RNA, 15 nt, Human
ucuacuaauuccaca

SEQ ID NO: 1921641 - RNA, 19 nt, Human
ucuacuaaaaauacaaaaa

SEQ ID NO: 1921642 - RNA, 15 nt, Human
ucuacuaaaaauaca

SEQ ID NO: 1921643 - RNA, 12 nt, Human
ucuacuaaaaau

SEQ ID NO: 1921644 - RNA, 22 nt, Human
ucuaauuuaucuugucucuggg

SEQ ID NO: 1921645 - RNA, 23 nt, Human
ucuaauuuaucuugucucugggc

SEQ ID NO: 1921646 - RNA, 14 nt, Human
ucuaauuuauaaaa

SEQ ID NO: 1921647 - RNA, 13 nt, Human
ucuaauuuauaaa

SEQ ID NO: 1921648 - RNA, 16 nt, Human
ucuaaugauggcccau

SEQ ID NO: 1921649 - RNA, 22 nt, Human
ucuaaugauggcccauucuacu

SEQ ID NO: 1921650 - RNA, 23 nt, Human
ucuaaugauggcccauucuacuu

SEQ ID NO: 1921651 - RNA, 12 nt, Human
ucguccagggag

SEQ ID NO: 1921652 - RNA, 23 nt, Human
ucucacucugucgcccagucugg

SEQ ID NO: 1921653 - RNA, 21 nt, Human
ucucacacaugagcaucaggc

SEQ ID NO: 1921654 - RNA, 20 nt, Human
ucucacugccaugccagcuu

SEQ ID NO: 1921655 - RNA, 23 nt, Human
ucucacacaugagcaucaggcca

SEQ ID NO: 1921656 - RNA, 16 nt, Human
ucucacacaugagcau

SEQ ID NO: 1921657 - RNA, 12 nt, Human
ucucacaaacau

SEQ ID NO: 1921658 - RNA, 18 nt, Human
ucucaaauuucuaaaucu

SEQ ID NO: 1921659 - RNA, 16 nt, Human
ucucaaauuucuaaau

SEQ ID NO: 1921660 - RNA, 14 nt, Human
ucucaaauuucuaa

SEQ ID NO: 1921661 - RNA, 13 nt, Human
ucucaaauuucua

SEQ ID NO: 1921662 - RNA, 15 nt, Human
ucucacuguugccca

SEQ ID NO: 1921663 - RNA, 14 nt, Human
ucucacuguugccc

SEQ ID NO: 1921664 - RNA, 17 nt, Human
ucucacuguugcccagg

SEQ ID NO: 1921665 - RNA, 18 nt, Human
uccuuggugccuggccug

SEQ ID NO: 1921666 - RNA, 22 nt, Human
uccuuggugucgggcaugacac

SEQ ID NO: 1921667 - RNA, 17 nt, Human
uccuuugugaggaagcc

SEQ ID NO: 1921668 - RNA, 13 nt, Human
uccuuuguacuuu

SEQ ID NO: 1921669 - RNA, 18 nt, Human
uccuuuguacuuugugcu

SEQ ID NO: 1921670 - RNA, 18 nt, Human
uccuuugugaggaagccg

SEQ ID NO: 1921671 - RNA, 22 nt, Human
uccuuugugaggaagccgcugg

SEQ ID NO: 1921672 - RNA, 14 nt, Human
uccuuggugccugg

SEQ ID NO: 1921673 - RNA, 18 nt, Human
uccuuggugucgggcaug

SEQ ID NO: 1921674 - RNA, 21 nt, Human
uccuuggugucgggcaugaca

SEQ ID NO: 1921675 - RNA, 21 nt, Human
uccuuaccagcagagcaccuu

SEQ ID NO: 1921676 - RNA, 17 nt, Human
uccuguccagcuccaac

SEQ ID NO: 1921677 - RNA, 19 nt, Human
uccugucccucauccauag

SEQ ID NO: 1921678 - RNA, 16 nt, Human
uccugaggcuuuggau

SEQ ID NO: 1921679 - RNA, 17 nt, Human
uccugaggcuuuggauu

SEQ ID NO: 1921680 - RNA, 18 nt, Human
uccugaggcuuuggauuu

SEQ ID NO: 1921681 - RNA, 13 nt, Human
uccuguccagcuc

SEQ ID NO: 1921682 - RNA, 14 nt, Human
uccuguccagcucc

SEQ ID NO: 1921683 - RNA, 15 nt, Human
uccuguccagcucca

SEQ ID NO: 1921684 - RNA, 16 nt, Human
uccuguccagcuccaa

SEQ ID NO: 1921685 - RNA, 22 nt, Human
uccuugaaaacacuguucucug

SEQ ID NO: 1921686 - RNA, 23 nt, Human
uccuugaaaacacuguucucugc

SEQ ID NO: 1921687 - RNA, 22 nt, Human
uccuuuucgcaggauucuuccu

SEQ ID NO: 1921688 - RNA, 17 nt, Human
ucgcaggauucuuccuc

SEQ ID NO: 1921689 - RNA, 20 nt, Human
ucgcaggaagacccaacaca

SEQ ID NO: 1921690 - RNA, 17 nt, Human
ucgauucauauugaaua

SEQ ID NO: 1921691 - RNA, 15 nt, Human
ucgauucauauugaa

SEQ ID NO: 1921692 - RNA, 21 nt, Human
ucgcaggauucuuccucccuc

SEQ ID NO: 1921693 - RNA, 23 nt, Human
ucgcaggauucuuccucccuccc

SEQ ID NO: 1921694 - RNA, 19 nt, Human
ucgcauggucacacacuga

SEQ ID NO: 1921695 - RNA, 20 nt, Human
ucgcauggucacacacugau

SEQ ID NO: 1921696 - RNA, 17 nt, Human
ucggccuccauccugag

SEQ ID NO: 1921697 - RNA, 16 nt, Human
ucggccuccauccuga

SEQ ID NO: 1921698 - RNA, 15 nt, Human
ucggccuccauccug

SEQ ID NO: 1921699 - RNA, 12 nt, Human
ucggaggaagcc

SEQ ID NO: 1921700 - RNA, 13 nt, Human
ucggaggaagccc

SEQ ID NO: 1921701 - RNA, 23 nt, Human
ucgcccagucuggaaugcagugg

SEQ ID NO: 1921702 - RNA, 19 nt, Human
ucgcccagucuggaaugca

SEQ ID NO: 1921703 - RNA, 14 nt, Human
ucgcccagucugga

SEQ ID NO: 1921704 - RNA, 18 nt, Human
ucggaaaacaugcuacac

SEQ ID NO: 1921705 - RNA, 15 nt, Human
ucggaaaacaugcua

SEQ ID NO: 1921706 - RNA, 21 nt, Human
ucgccagcugaugacucaaga

SEQ ID NO: 1921707 - RNA, 16 nt, Human
ucgccagcugaugacu

SEQ ID NO: 1921708 - RNA, 18 nt, Human
ucgccagcugaugacuca

SEQ ID NO: 1921709 - RNA, 19 nt, Human
ucgccagcugaugacucaa

SEQ ID NO: 1921710 - RNA, 20 nt, Human
ucgccagcugaugacucaag

SEQ ID NO: 1921711 - RNA, 22 nt, Human
ucccaugagccucagcauccug

SEQ ID NO: 1921712 - RNA, 17 nt, Human
ucccaugagccucagca

SEQ ID NO: 1921713 - RNA, 18 nt, Human
ucccucccuuccucuuuc

SEQ ID NO: 1921714 - RNA, 22 nt, Human
ucccucuacugggagccuaccc

SEQ ID NO: 1921715 - RNA, 18 nt, Human
ucccucuacugggagccu

SEQ ID NO: 1921716 - RNA, 20 nt, Human
ucccugcacuugcagacucu

SEQ ID NO: 1921717 - RNA, 17 nt, Human
ucccucuggggcuguuc

SEQ ID NO: 1921718 - RNA, 13 nt, Human
ucccucuggggcu

SEQ ID NO: 1921719 - RNA, 14 nt, Human
ucccugccaaugga

SEQ ID NO: 1921720 - RNA, 16 nt, Human
ucccugccaauggacu

SEQ ID NO: 1921721 - RNA, 22 nt, Human
ucccugcaucugaccagcagcg

SEQ ID NO: 1921722 - RNA, 16 nt, Human
ucccugcaucugacca

SEQ ID NO: 1921723 - RNA, 18 nt, Human
ucccugcaucugaccagc

SEQ ID NO: 1921724 - RNA, 20 nt, Human
ucccugcaucugaccagcag

SEQ ID NO: 1921725 - RNA, 21 nt, Human
ucccugcaucugaccagcagc

SEQ ID NO: 1921726 - RNA, 13 nt, Human
ucccucugcccca

SEQ ID NO: 1921727 - RNA, 13 nt, Human
ucccucuauuuau

SEQ ID NO: 1921728 - RNA, 19 nt, Human
ucccucuauuuauguuugc

SEQ ID NO: 1921729 - RNA, 23 nt, Human
ucccucuacugggagccuaccca

SEQ ID NO: 1921730 - RNA, 17 nt, Human
ucccuucccaccucucu

SEQ ID NO: 1921731 - RNA, 21 nt, Human
ucccuucccacuggaggcaug

SEQ ID NO: 1921732 - RNA, 14 nt, Human
ucccuucugcuacu

SEQ ID NO: 1921733 - RNA, 15 nt, Human
ucccuucugcuacug

SEQ ID NO: 1921734 - RNA, 13 nt, Human
ucccuucugcuac

SEQ ID NO: 1921735 - RNA, 20 nt, Human
ucccuggggcuagggggagc

SEQ ID NO: 1921736 - RNA, 16 nt, Human
ucccuucccaccucuc

SEQ ID NO: 1921737 - RNA, 21 nt, Human
uccgcuuucuacccagcgagc

SEQ ID NO: 1921738 - RNA, 21 nt, Human
uccgaaagggacuuggaagcu

SEQ ID NO: 1921739 - RNA, 20 nt, Human
ucccuucugcuacuggcaaa

SEQ ID NO: 1921740 - RNA, 22 nt, Human
uccgaaagggacuuggaagcuc

SEQ ID NO: 1921741 - RNA, 22 nt, Human
uccuaguuccaccaucaagcca

SEQ ID NO: 1921742 - RNA, 21 nt, Human
uccuaguuccaccaucaagcc

SEQ ID NO: 1921743 - RNA, 14 nt, Human
uccuauuuagaugg

SEQ ID NO: 1921744 - RNA, 16 nt, Human
uccuaagcuauucagu

SEQ ID NO: 1921745 - RNA, 18 nt, Human
uccuaagcuauucaguaa

SEQ ID NO: 1921746 - RNA, 14 nt, Human
uccuaagccuaaaa

SEQ ID NO: 1921747 - RNA, 14 nt, Human
uccuaguuccacca

SEQ ID NO: 1921748 - RNA, 17 nt, Human
uccuaguuccaccauca

SEQ ID NO: 1921749 - RNA, 12 nt, Human
uccuccucagau

SEQ ID NO: 1921750 - RNA, 19 nt, Human
uccuauuuugcauaauaaa

SEQ ID NO: 1921751 - RNA, 14 nt, Human
uccuccaggugcac

SEQ ID NO: 1921752 - RNA, 18 nt, Human
uccuccaggugcacaagc

SEQ ID NO: 1921753 - RNA, 20 nt, Human
uccuccaggugcacaagcuc

SEQ ID NO: 1921754 - RNA, 22 nt, Human
uccuccaggugcacaagcucca

SEQ ID NO: 1921755 - RNA, 12 nt, Human
uccuccaggugc

SEQ ID NO: 1921756 - RNA, 13 nt, Human
uccuccaggugca

SEQ ID NO: 1921757 - RNA, 20 nt, Human
uccucaaaacuucagacaua

SEQ ID NO: 1921758 - RNA, 21 nt, Human
uccuccuuuucacaguucucu

SEQ ID NO: 1921759 - RNA, 17 nt, Human
uccucuaggaggucucu

SEQ ID NO: 1921760 - RNA, 21 nt, Human
uccucuaggaggucucuaaga

SEQ ID NO: 1921761 - RNA, 15 nt, Human
uccucuguacagagc

SEQ ID NO: 1921762 - RNA, 13 nt, Human
uccucuguacaga

SEQ ID NO: 1921763 - RNA, 15 nt, Human
uccucuggccugugu

SEQ ID NO: 1921764 - RNA, 17 nt, Human
uccucugcugcuggcug

SEQ ID NO: 1921765 - RNA, 15 nt, Human
uccugaggcugggcu

SEQ ID NO: 1921766 - RNA, 16 nt, Human
uccugaggcugggcuc

SEQ ID NO: 1921767 - RNA, 17 nt, Human
uccugaggcugggcucc

SEQ ID NO: 1921768 - RNA, 19 nt, Human
uccugaggcugggcucccu

SEQ ID NO: 1921769 - RNA, 12 nt, Human
uccugaggcugg

SEQ ID NO: 1921770 - RNA, 17 nt, Human
uccugaggcuccacuug

SEQ ID NO: 1921771 - RNA, 16 nt, Human
uccugaggcuccacuu

SEQ ID NO: 1921772 - RNA, 21 nt, Human
uccucugucagucacagccac

SEQ ID NO: 1921773 - RNA, 22 nt, Human
uccucugucagucacagccacc

SEQ ID NO: 1921774 - RNA, 17 nt, Human
uccugagccagauuuca

SEQ ID NO: 1921775 - RNA, 23 nt, Human
uccucuguacagagcccacgccc

SEQ ID NO: 1921776 - RNA, 19 nt, Human
uccucugucagucacagcc

SEQ ID NO: 1921777 - RNA, 19 nt, Human
uccucuguacagagcccac

SEQ ID NO: 1921778 - RNA, 18 nt, Human
uccugagccagauuucac

SEQ ID NO: 1921779 - RNA, 19 nt, Human
uccugagccagauuucacu

SEQ ID NO: 1921780 - RNA, 21 nt, Human
uccugagccagauuucacucu

SEQ ID NO: 1921781 - RNA, 15 nt, Human
uccugaggcuccacu

SEQ ID NO: 1921782 - RNA, 13 nt, Human
uggaaccaggcuu

SEQ ID NO: 1921783 - RNA, 21 nt, Human
uggaacguuuuuccuguucuu

SEQ ID NO: 1921784 - RNA, 14 nt, Human
uggaauaacaugua

SEQ ID NO: 1921785 - RNA, 15 nt, Human
uggaauaacauguaa

SEQ ID NO: 1921786 - RNA, 19 nt, Human
uggaauaacauguaauuaa

SEQ ID NO: 1921787 - RNA, 22 nt, Human
uggaauaauccuaaacauauga

SEQ ID NO: 1921788 - RNA, 17 nt, Human
uggaauaaggagaauga

SEQ ID NO: 1921789 - RNA, 16 nt, Human
uggaauauauaaccag

SEQ ID NO: 1921790 - RNA, 15 nt, Human
uggaauauauaacca

SEQ ID NO: 1921791 - RNA, 13 nt, Human
uggacaugcacag

SEQ ID NO: 1921792 - RNA, 19 nt, Human
uggacaugcacagcuaaca

SEQ ID NO: 1921793 - RNA, 12 nt, Human
uggacagcccca

SEQ ID NO: 1921794 - RNA, 14 nt, Human
uggacagccccacc

SEQ ID NO: 1921795 - RNA, 21 nt, Human
uggacuagagggaccucuccc

SEQ ID NO: 1921796 - RNA, 17 nt, Human
uggacagaagcagcucu

SEQ ID NO: 1921797 - RNA, 18 nt, Human
uggacagaagcagcucuu

SEQ ID NO: 1921798 - RNA, 15 nt, Human
uggacagaagcagcu

SEQ ID NO: 1921799 - RNA, 16 nt, Human
uggacagaagcagcuc

SEQ ID NO: 1921800 - RNA, 12 nt, Human
uggacagaagaa

SEQ ID NO: 1921801 - RNA, 20 nt, Human
uggaaugaugggucaguugu

SEQ ID NO: 1921802 - RNA, 18 nt, Human
uggaaacauucaggagcu

SEQ ID NO: 1921803 - RNA, 21 nt, Human
uggaaagacuuuuccaacccu

SEQ ID NO: 1921804 - RNA, 19 nt, Human
uggaaagacagcuucucau

SEQ ID NO: 1921805 - RNA, 17 nt, Human
uggaaacaagucaguca

SEQ ID NO: 1921806 - RNA, 14 nt, Human
uggaaagaguacuc

SEQ ID NO: 1921807 - RNA, 20 nt, Human
uggaaagaguaggaagacuu

SEQ ID NO: 1921808 - RNA, 23 nt, Human
uggaaagacagcuucucauccug

SEQ ID NO: 1921809 - RNA, 18 nt, Human
uggaaagauaacuaggaa

SEQ ID NO: 1921810 - RNA, 23 nt, Human
uggaaagauaacuaggaaaucca

SEQ ID NO: 1921811 - RNA, 12 nt, Human
uggaaagcaaag

SEQ ID NO: 1921812 - RNA, 15 nt, Human
uggaaagcaaagggc

SEQ ID NO: 1921813 - RNA, 17 nt, Human
uggaaaaauagccugcc

SEQ ID NO: 1921814 - RNA, 23 nt, Human
ugcuuugaaagccccagaaauca

SEQ ID NO: 1921815 - RNA, 20 nt, Human
uggaaaaauagccugccucu

SEQ ID NO: 1921816 - RNA, 22 nt, Human
ugcuuugaaagccccagaaauc

SEQ ID NO: 1921817 - RNA, 12 nt, Human
ugcuuucugcuc

SEQ ID NO: 1921818 - RNA, 13 nt, Human
ugcuuucugcuca

SEQ ID NO: 1921819 - RNA, 14 nt, Human
ugcuuucugcucag

SEQ ID NO: 1921820 - RNA, 15 nt, Human
ugcuuucugcucagc

SEQ ID NO: 1921821 - RNA, 19 nt, Human
ugcuuucugcucagcuucu

SEQ ID NO: 1921822 - RNA, 20 nt, Human
ugcuuucugcucagcuucuc

SEQ ID NO: 1921823 - RNA, 16 nt, Human
ugcuggacaguaucac

SEQ ID NO: 1921824 - RNA, 20 nt, Human
uggcaggacgugggcugggc

SEQ ID NO: 1921825 - RNA, 13 nt, Human
uggcaggacagga

SEQ ID NO: 1921826 - RNA, 13 nt, Human
uggcagcugcuuu

SEQ ID NO: 1921827 - RNA, 21 nt, Human
uggcacccggccccugcuggu

SEQ ID NO: 1921828 - RNA, 22 nt, Human
uggcaacagaucuggaaccuca

SEQ ID NO: 1921829 - RNA, 20 nt, Human
uggcaccuaauccaggcaga

SEQ ID NO: 1921830 - RNA, 13 nt, Human
uggcagugggagc

SEQ ID NO: 1921831 - RNA, 17 nt, Human
uggcagucacugaauuc

SEQ ID NO: 1921832 - RNA, 21 nt, Human
uggcagggguggcugccucau

SEQ ID NO: 1921833 - RNA, 23 nt, Human
uggcagggguggcugccucauuu

SEQ ID NO: 1921834 - RNA, 16 nt, Human
uggccacgcagccagg

SEQ ID NO: 1921835 - RNA, 15 nt, Human
uggccacgcagccag

SEQ ID NO: 1921836 - RNA, 14 nt, Human
uggccacgcagcca

SEQ ID NO: 1921837 - RNA, 20 nt, Human
uggccacgcagccaggacac

SEQ ID NO: 1921838 - RNA, 12 nt, Human
uggccacuaagc

SEQ ID NO: 1921839 - RNA, 19 nt, Human
uggccacgcagccaggaca

SEQ ID NO: 1921840 - RNA, 17 nt, Human
uggccacgcagccagga

SEQ ID NO: 1921841 - RNA, 18 nt, Human
uggccacuaagcagagga

SEQ ID NO: 1921842 - RNA, 19 nt, Human
uggccacuaagcagaggag

SEQ ID NO: 1921843 - RNA, 21 nt, Human
uggccagaugcaccagcccuu

SEQ ID NO: 1921844 - RNA, 20 nt, Human
uggccagaugcaccagcccu

SEQ ID NO: 1921845 - RNA, 14 nt, Human
uggacucugcacau

SEQ ID NO: 1921846 - RNA, 13 nt, Human
uggacucugcaca

SEQ ID NO: 1921847 - RNA, 20 nt, Human
uggaggaaggaaacccagcu

SEQ ID NO: 1921848 - RNA, 12 nt, Human
uggaggaaggaa

SEQ ID NO: 1921849 - RNA, 18 nt, Human
uggaggaaggaaacccag

SEQ ID NO: 1921850 - RNA, 22 nt, Human
uggagggacaaguggacucagg

SEQ ID NO: 1921851 - RNA, 19 nt, Human
uggaggagcucaggacacu

SEQ ID NO: 1921852 - RNA, 24 nt, Human
uggauuuaacagaaauguacagca

SEQ ID NO: 1921853 - RNA, 20 nt, Human
uggauuuaacagaaauguac

SEQ ID NO: 1921854 - RNA, 23 nt, Human
uggauuucccauccccuguggga

SEQ ID NO: 1921855 - RNA, 20 nt, Human
uggauccugaaauagaggcu

SEQ ID NO: 1921856 - RNA, 13 nt, Human
uggauuugacauu

SEQ ID NO: 1921857 - RNA, 14 nt, Human
uggauuugacauug

SEQ ID NO: 1921858 - RNA, 22 nt, Human
uggauuuugguuuuguuccccu

SEQ ID NO: 1921859 - RNA, 13 nt, Human
uggcaacagaucu

SEQ ID NO: 1921860 - RNA, 15 nt, Human
uggcaacagaucugg

SEQ ID NO: 1921861 - RNA, 16 nt, Human
uggcaacagaucugga

SEQ ID NO: 1921862 - RNA, 17 nt, Human
uggcaacagaucuggaa

SEQ ID NO: 1921863 - RNA, 18 nt, Human
uggcaacagaucuggaac

SEQ ID NO: 1921864 - RNA, 20 nt, Human
uggcaacagaucuggaaccu

SEQ ID NO: 1921865 - RNA, 22 nt, Human
ugguaucuagacccaucuucuu

SEQ ID NO: 1921866 - RNA, 18 nt, Human
ugguaugaucacggcuca

SEQ ID NO: 1921867 - RNA, 23 nt, Human
ugguauuggcuagagguucaaag

SEQ ID NO: 1921868 - RNA, 19 nt, Human
ugguauucgcuugagaaaa

SEQ ID NO: 1921869 - RNA, 13 nt, Human
ugguauagaaaug

SEQ ID NO: 1921870 - RNA, 16 nt, Human
ugguauagaaaugcug

SEQ ID NO: 1921871 - RNA, 14 nt, Human
ugguauagaaaugc

SEQ ID NO: 1921872 - RNA, 22 nt, Human
ugguauagaaaugcugguuuuu

SEQ ID NO: 1921873 - RNA, 21 nt, Human
uggguuucuaaagcugccagc

SEQ ID NO: 1921874 - RNA, 16 nt, Human
uggguucugccugcca

SEQ ID NO: 1921875 - RNA, 19 nt, Human
uggguucugccugccagcu

SEQ ID NO: 1921876 - RNA, 17 nt, Human
uggguuucuaaagcugc

SEQ ID NO: 1921877 - RNA, 18 nt, Human
uggguuucuaaagcugcc

SEQ ID NO: 1921878 - RNA, 16 nt, Human
uggguaacuagggaag

SEQ ID NO: 1921879 - RNA, 19 nt, Human
ugggguuuaucagaauucu

SEQ ID NO: 1921880 - RNA, 18 nt, Human
uggguggggggcuucaua

SEQ ID NO: 1921881 - RNA, 21 nt, Human
uggguggggggcuucauacac

SEQ ID NO: 1921882 - RNA, 20 nt, Human
uggguggggggcuucauaca

SEQ ID NO: 1921883 - RNA, 14 nt, Human
uggguucugccugc

SEQ ID NO: 1921884 - RNA, 22 nt, Human
uggguucuacccaggugcuagg

SEQ ID NO: 1921885 - RNA, 15 nt, Human
uggguucuacccagg

SEQ ID NO: 1921886 - RNA, 16 nt, Human
uggguucuacccaggu

SEQ ID NO: 1921887 - RNA, 20 nt, Human
uggguguuccuggcaguuua

SEQ ID NO: 1921888 - RNA, 19 nt, Human
uggguguuccuggcaguuu

SEQ ID NO: 1921889 - RNA, 15 nt, Human
uggguguuccuggca

SEQ ID NO: 1921890 - RNA, 17 nt, Human
ugggcuucaguggcagc

SEQ ID NO: 1921891 - RNA, 15 nt, Human
ugggcuucaguggca

SEQ ID NO: 1921892 - RNA, 17 nt, Human
ugggcuggugucaccug

SEQ ID NO: 1921893 - RNA, 23 nt, Human
ugggcuggguucuacccaggugc

SEQ ID NO: 1921894 - RNA, 16 nt, Human
ugggcuaguugggcuu

SEQ ID NO: 1921895 - RNA, 22 nt, Human
ugggcuaagugauccucccacc

SEQ ID NO: 1921896 - RNA, 16 nt, Human
ugggcagaggaaagca

SEQ ID NO: 1921897 - RNA, 15 nt, Human
ugggggugcauuuga

SEQ ID NO: 1921898 - RNA, 12 nt, Human
ugggggugcauu

SEQ ID NO: 1921899 - RNA, 19 nt, Human
ugggggcugggcagaggaa

SEQ ID NO: 1921900 - RNA, 15 nt, Human
ugggggucugugugu

SEQ ID NO: 1921901 - RNA, 18 nt, Human
ugggggucuguguguuua

SEQ ID NO: 1921902 - RNA, 17 nt, Human
ugggggcugggcagagg

SEQ ID NO: 1921903 - RNA, 18 nt, Human
ugggggcugggcagagga

SEQ ID NO: 1921904 - RNA, 21 nt, Human
ugggggcggggugggaaagau

SEQ ID NO: 1921905 - RNA, 11 nt, Human
ugggggaugua

SEQ ID NO: 1921906 - RNA, 21 nt, Human
ugggggaucacagccucugaa

SEQ ID NO: 1921907 - RNA, 20 nt, Human
uggggauugggccccugcca

SEQ ID NO: 1921908 - RNA, 23 nt, Human
uggggauugggugggcaggaaaa

SEQ ID NO: 1921909 - RNA, 20 nt, Human
ugggggaucacagccucuga

SEQ ID NO: 1921910 - RNA, 21 nt, Human
uggcuugaguuuaaauuguaa

SEQ ID NO: 1921911 - RNA, 14 nt, Human
uggcuuuaaugaau

SEQ ID NO: 1921912 - RNA, 14 nt, Human
uggcuuuugugcau

SEQ ID NO: 1921913 - RNA, 17 nt, Human
uggcuuuggcuucuugg

SEQ ID NO: 1921914 - RNA, 19 nt, Human
uggcuucuguugucaccuu

SEQ ID NO: 1921915 - RNA, 15 nt, Human
uggcuugagaaauau

SEQ ID NO: 1921916 - RNA, 15 nt, Human
uggcuucucugagga

SEQ ID NO: 1921917 - RNA, 16 nt, Human
uggcuucucugaggaa

SEQ ID NO: 1921918 - RNA, 18 nt, Human
uggcuucucugaggaagc

SEQ ID NO: 1921919 - RNA, 17 nt, Human
uggcucucccauuuccu

SEQ ID NO: 1921920 - RNA, 23 nt, Human
uggcccauucuacuugcucugga

SEQ ID NO: 1921921 - RNA, 17 nt, Human
uggcccauucuacuugc

SEQ ID NO: 1921922 - RNA, 20 nt, Human
uggcccauucuacuugcucu

SEQ ID NO: 1921923 - RNA, 21 nt, Human
uggcccauucuacuugcucug

SEQ ID NO: 1921924 - RNA, 22 nt, Human
uggcccauucuacuugcucugg

SEQ ID NO: 1921925 - RNA, 14 nt, Human
uggcccagggccca

SEQ ID NO: 1921926 - RNA, 15 nt, Human
uggcccagggcccag

SEQ ID NO: 1921927 - RNA, 16 nt, Human
uggcccagggcccaga

SEQ ID NO: 1921928 - RNA, 15 nt, Human
uggcccauucuacuu

SEQ ID NO: 1921929 - RNA, 16 nt, Human
uggcccauucuacuug

SEQ ID NO: 1921930 - RNA, 21 nt, Human
uggcugggggccucagugcca

SEQ ID NO: 1921931 - RNA, 21 nt, Human
uggcugcuucaaggauccuga

SEQ ID NO: 1921932 - RNA, 14 nt, Human
ugggaguacaaaag

SEQ ID NO: 1921933 - RNA, 22 nt, Human
ugggagcugccuguucagcucc

SEQ ID NO: 1921934 - RNA, 21 nt, Human
ugggagcugccuguucagcuc

SEQ ID NO: 1921935 - RNA, 17 nt, Human
ugggagcugccuguuca

SEQ ID NO: 1921936 - RNA, 15 nt, Human
ugggagugagcuggu

SEQ ID NO: 1921937 - RNA, 15 nt, Human
ugggauccuccaggu

SEQ ID NO: 1921938 - RNA, 21 nt, Human
ugggagugaggaugucugggc

SEQ ID NO: 1921939 - RNA, 16 nt, Human
ugggauuacaggugug

SEQ ID NO: 1921940 - RNA, 18 nt, Human
ugggauccuccaggugca

SEQ ID NO: 1921941 - RNA, 13 nt, Human
ugggauccuggag

SEQ ID NO: 1921942 - RNA, 21 nt, Human
ugggauuacagggaugagcca

SEQ ID NO: 1921943 - RNA, 15 nt, Human
ugggcagaggaaagc

SEQ ID NO: 1921944 - RNA, 23 nt, Human
ugggaccucaguuuuaucauuuu

SEQ ID NO: 1921945 - RNA, 24 nt, Human
ugggaccuccaccguugguguuca

SEQ ID NO: 1921946 - RNA, 19 nt, Human
ugggaccuaggggcgccgc

SEQ ID NO: 1921947 - RNA, 23 nt, Human
ugggaccuauaacugcccagcgg

SEQ ID NO: 1921948 - RNA, 13 nt, Human
ugggacacccugu

SEQ ID NO: 1921949 - RNA, 15 nt, Human
ugggacguggcucag

SEQ ID NO: 1921950 - RNA, 12 nt, Human
ugggacacccug

SEQ ID NO: 1921951 - RNA, 20 nt, Human
ugggaauguuacauuguuug

SEQ ID NO: 1921952 - RNA, 14 nt, Human
ugggagcugccugu

SEQ ID NO: 1921953 - RNA, 13 nt, Human
ugggagcugccug

SEQ ID NO: 1921954 - RNA, 12 nt, Human
ugggagcugccu

SEQ ID NO: 1921955 - RNA, 23 nt, Human
ugggagauucaagggacccauga

SEQ ID NO: 1921956 - RNA, 20 nt, Human
ugggagcugaggccacacuc

SEQ ID NO: 1921957 - RNA, 22 nt, Human
ugggagcugaggccacacucag

SEQ ID NO: 1921958 - RNA, 13 nt, Human
ugggagcaaaaga

SEQ ID NO: 1921959 - RNA, 14 nt, Human
ugggagauguggaa

SEQ ID NO: 1921960 - RNA, 16 nt, Human
ugggacguggcucagc

SEQ ID NO: 1921961 - RNA, 20 nt, Human
ugggacguggcucagccagc

SEQ ID NO: 1921962 - RNA, 18 nt, Human
ugccaaauauaaauaaaa

SEQ ID NO: 1921963 - RNA, 17 nt, Human
ugccaaauauaaauaaa

SEQ ID NO: 1921964 - RNA, 20 nt, Human
ugcauauuuauaaaaauaaa

SEQ ID NO: 1921965 - RNA, 13 nt, Human
ugcauauguugaa

SEQ ID NO: 1921966 - RNA, 21 nt, Human
ugcauauuuauaaaaauaaaa

SEQ ID NO: 1921967 - RNA, 15 nt, Human
ugcauauguugaaua

SEQ ID NO: 1921968 - RNA, 17 nt, Human
ugcauauguugaauacu

SEQ ID NO: 1921969 - RNA, 24 nt, Human
ugcauauuuuguaacuuccaugug

SEQ ID NO: 1921970 - RNA, 22 nt, Human
ugccaaauauaaauaaaaauaa

SEQ ID NO: 1921971 - RNA, 19 nt, Human
ugccaaauauaaauaaaaa

SEQ ID NO: 1921972 - RNA, 19 nt, Human
ugcaucaagaugugacaug

SEQ ID NO: 1921973 - RNA, 14 nt, Human
ugcaucaagaugug

SEQ ID NO: 1921974 - RNA, 20 nt, Human
ugccacccuggggagaaagu

SEQ ID NO: 1921975 - RNA, 22 nt, Human
ugccacuacggaauaguuggcu

SEQ ID NO: 1921976 - RNA, 19 nt, Human
ugccacccuggggagaaag

SEQ ID NO: 1921977 - RNA, 20 nt, Human
ugccacuaaauugacacuua

SEQ ID NO: 1921978 - RNA, 13 nt, Human
ugccacccaccuc

SEQ ID NO: 1921979 - RNA, 16 nt, Human
ugccacccaccucccu

SEQ ID NO: 1921980 - RNA, 22 nt, Human
ugccagguuuuuggucugaccc

SEQ ID NO: 1921981 - RNA, 19 nt, Human
ugccagguuuuuggucuga

SEQ ID NO: 1921982 - RNA, 18 nt, Human
ugccagguuuuuggucug

SEQ ID NO: 1921983 - RNA, 10 nt, Human
ugccaggcau

SEQ ID NO: 1921984 - RNA, 18 nt, Human
ugccaggauggaaugaug

SEQ ID NO: 1921985 - RNA, 20 nt, Human
ugccauccagguucagcuug

SEQ ID NO: 1921986 - RNA, 21 nt, Human
ugccauccagguucagcuugu

SEQ ID NO: 1921987 - RNA, 17 nt, Human
ugcccacccuccacucu

SEQ ID NO: 1921988 - RNA, 13 nt, Human
ugcccaccuggcc

SEQ ID NO: 1921989 - RNA, 14 nt, Human
ugcccaccuggccu

SEQ ID NO: 1921990 - RNA, 13 nt, Human
ugcccaggcuggc

SEQ ID NO: 1921991 - RNA, 20 nt, Human
ugcccaggcuggagugcaau

SEQ ID NO: 1921992 - RNA, 18 nt, Human
ugcccaggcuggagugca

SEQ ID NO: 1921993 - RNA, 13 nt, Human
ugcccaggcugga

SEQ ID NO: 1921994 - RNA, 21 nt, Human
ugcccacucccugcaaccuga

SEQ ID NO: 1921995 - RNA, 11 nt, Human
ugcccaggcug

SEQ ID NO: 1921996 - RNA, 16 nt, Human
ugcccacucccugcaa

SEQ ID NO: 1921997 - RNA, 14 nt, Human
ugcccacucccugc

SEQ ID NO: 1921998 - RNA, 15 nt, Human
ugcccacucccugca

SEQ ID NO: 1921999 - RNA, 23 nt, Human
ugccccucaacucuccuccagag

SEQ ID NO: 1922000 - RNA, 14 nt, Human
ugccccaggaccag

SEQ ID NO: 1922001 - RNA, 18 nt, Human
ugccccaggaccagcuca

SEQ ID NO: 1922002 - RNA, 19 nt, Human
ugccccaggaccagcucag

SEQ ID NO: 1922003 - RNA, 20 nt, Human
ugccccaggaccagcucagg

SEQ ID NO: 1922004 - RNA, 17 nt, Human
ugccccuggcagccccu

SEQ ID NO: 1922005 - RNA, 17 nt, Human
ugccccauccuccagca

SEQ ID NO: 1922006 - RNA, 18 nt, Human
ugccccauccuccagcag

SEQ ID NO: 1922007 - RNA, 19 nt, Human
ugccccauccuccagcagg

SEQ ID NO: 1922008 - RNA, 24 nt, Human
ugcccauggacaggcuggcuccag

SEQ ID NO: 1922009 - RNA, 13 nt, Human
ugccccaggacca

SEQ ID NO: 1922010 - RNA, 15 nt, Human
ugcaguugccaguca

SEQ ID NO: 1922011 - RNA, 17 nt, Human
ugcauauauacauauau

SEQ ID NO: 1922012 - RNA, 13 nt, Human
ugcaguugccagu

SEQ ID NO: 1922013 - RNA, 14 nt, Human
ugcaguugccaguc

SEQ ID NO: 1922014 - RNA, 22 nt, Human
ugcagugguaugaucacggcuc

SEQ ID NO: 1922015 - RNA, 16 nt, Human
ugcagugcuuccaagg

SEQ ID NO: 1922016 - RNA, 15 nt, Human
ugcaggccaggccag

SEQ ID NO: 1922017 - RNA, 15 nt, Human
ugcaggcagccaggc

SEQ ID NO: 1922018 - RNA, 13 nt, Human
ugcaggcagccag

SEQ ID NO: 1922019 - RNA, 14 nt, Human
ugcaggcagccagg

SEQ ID NO: 1922020 - RNA, 14 nt, Human
ugcagcagggaugc

SEQ ID NO: 1922021 - RNA, 16 nt, Human
ugcagcagggaugccc

SEQ ID NO: 1922022 - RNA, 17 nt, Human
ugcagcagggaugcccu

SEQ ID NO: 1922023 - RNA, 18 nt, Human
ugcagcagggaugcccug

SEQ ID NO: 1922024 - RNA, 19 nt, Human
ugcagcagggaugcccugg

SEQ ID NO: 1922025 - RNA, 22 nt, Human
ugcagcagggaugcccuggagg

SEQ ID NO: 1922026 - RNA, 15 nt, Human
ugcaccgggccacag

SEQ ID NO: 1922027 - RNA, 14 nt, Human
ugcaccgggccaca

SEQ ID NO: 1922028 - RNA, 19 nt, Human
ugaguccccuguuuguuuc

SEQ ID NO: 1922029 - RNA, 23 nt, Human
ugcaccggcuggccuggccccuc

SEQ ID NO: 1922030 - RNA, 22 nt, Human
ugcaccgggccacagagaaagu

SEQ ID NO: 1922031 - RNA, 17 nt, Human
ugcaccgggccacagag

SEQ ID NO: 1922032 - RNA, 20 nt, Human
ugaguccccuguuuguuucu

SEQ ID NO: 1922033 - RNA, 19 nt, Human
ugcacugcccauggacagg

SEQ ID NO: 1922034 - RNA, 21 nt, Human
ugcacugcccauggacaggcu

SEQ ID NO: 1922035 - RNA, 16 nt, Human
ugcacugaugcugccc

SEQ ID NO: 1922036 - RNA, 17 nt, Human
ugcacugaugcugcccc

SEQ ID NO: 1922037 - RNA, 21 nt, Human
ugcacugaugcugccccucau

SEQ ID NO: 1922038 - RNA, 22 nt, Human
ugcacugaugcugccccucauc

SEQ ID NO: 1922039 - RNA, 14 nt, Human
ugcacugaugcugc

SEQ ID NO: 1922040 - RNA, 22 nt, Human
ugcagagcagugggccuggcca

SEQ ID NO: 1922041 - RNA, 11 nt, Human
ugcagagcugc

SEQ ID NO: 1922042 - RNA, 23 nt, Human
ugcagcaauaaagcagcguuucu

SEQ ID NO: 1922043 - RNA, 20 nt, Human
ugcagcaauaaagcagcguu

SEQ ID NO: 1922044 - RNA, 12 nt, Human
ugcacuuuguuc

SEQ ID NO: 1922045 - RNA, 14 nt, Human
ugcacuuuguucug

SEQ ID NO: 1922046 - RNA, 22 nt, Human
ugcacuuucucaugauuuacag

SEQ ID NO: 1922047 - RNA, 16 nt, Human
ugccuucuacuuuuaa

SEQ ID NO: 1922048 - RNA, 15 nt, Human
ugccuucuaaaggug

SEQ ID NO: 1922049 - RNA, 16 nt, Human
ugccuucuaaaggugu

SEQ ID NO: 1922050 - RNA, 16 nt, Human
ugccuucuuuugauua

SEQ ID NO: 1922051 - RNA, 21 nt, Human
ugcgaucuggguucacugcaa

SEQ ID NO: 1922052 - RNA, 20 nt, Human
ugcgaucuggguucacugca

SEQ ID NO: 1922053 - RNA, 19 nt, Human
ugcgaucuggguucacugc

SEQ ID NO: 1922054 - RNA, 15 nt, Human
ugcgaucuggguuca

SEQ ID NO: 1922055 - RNA, 14 nt, Human
ugcgaucuggguuc

SEQ ID NO: 1922056 - RNA, 22 nt, Human
ugcgccuacaggagugagcacu

SEQ ID NO: 1922057 - RNA, 16 nt, Human
ugcgccuacaggagug

SEQ ID NO: 1922058 - RNA, 14 nt, Human
ugcgccuacaggag

SEQ ID NO: 1922059 - RNA, 15 nt, Human
ugcuaaaugugaaug

SEQ ID NO: 1922060 - RNA, 17 nt, Human
ugcuaaagccuuccuau

SEQ ID NO: 1922061 - RNA, 16 nt, Human
ugccugguggcagcug

SEQ ID NO: 1922062 - RNA, 18 nt, Human
ugccuguaaucacagcua

SEQ ID NO: 1922063 - RNA, 15 nt, Human
ugccugguggcagcu

SEQ ID NO: 1922064 - RNA, 14 nt, Human
ugccugguggcagc

SEQ ID NO: 1922065 - RNA, 15 nt, Human
ugccuggcggggugg

SEQ ID NO: 1922066 - RNA, 21 nt, Human
ugccugggaucccucauccuc

SEQ ID NO: 1922067 - RNA, 18 nt, Human
ugccugggcagaaggaag

SEQ ID NO: 1922068 - RNA, 19 nt, Human
ugccucgaacuggcugcaa

SEQ ID NO: 1922069 - RNA, 18 nt, Human
ugccucgaacuggcugca

SEQ ID NO: 1922070 - RNA, 20 nt, Human
ugccucgaacuggcugcaaa

SEQ ID NO: 1922071 - RNA, 14 nt, Human
ugccucucacagcu

SEQ ID NO: 1922072 - RNA, 17 nt, Human
ugccucucacagcugag

SEQ ID NO: 1922073 - RNA, 18 nt, Human
ugccccuggcagccccug

SEQ ID NO: 1922074 - RNA, 13 nt, Human
ugccccuggcugg

SEQ ID NO: 1922075 - RNA, 23 nt, Human
ugccucgaaacacagaaaccuuu

SEQ ID NO: 1922076 - RNA, 9 nt, Human
ugccucucu

SEQ ID NO: 1922077 - RNA, 18 nt, Human
ugccucucacagcugagu

SEQ ID NO: 1922078 - RNA, 21 nt, Human
ugccucucacagcugaguugu

SEQ ID NO: 1922079 - RNA, 19 nt, Human
ugcugaagcuuauuaaugc

SEQ ID NO: 1922080 - RNA, 18 nt, Human
ugcugaagcuuauuaaug

SEQ ID NO: 1922081 - RNA, 13 nt, Human
ugcugaagcuuau

SEQ ID NO: 1922082 - RNA, 23 nt, Human
ugcugaagcuuauuaaugcuaag

SEQ ID NO: 1922083 - RNA, 22 nt, Human
ugcugaagcuuauuaaugcuaa

SEQ ID NO: 1922084 - RNA, 21 nt, Human
ugcugaagcuuauuaaugcua

SEQ ID NO: 1922085 - RNA, 20 nt, Human
ugcugaagcuuauuaaugcu

SEQ ID NO: 1922086 - RNA, 12 nt, Human
ugcugaaggcuc

SEQ ID NO: 1922087 - RNA, 23 nt, Human
ugcugacagacacaggcccggcu

SEQ ID NO: 1922088 - RNA, 22 nt, Human
ugcugacagacacaggcccggc

SEQ ID NO: 1922089 - RNA, 13 nt, Human
ugcugaaggcucg

SEQ ID NO: 1922090 - RNA, 21 nt, Human
ugcugaaggcucgagcaugcc

SEQ ID NO: 1922091 - RNA, 18 nt, Human
ugcugauggugcaaugac

SEQ ID NO: 1922092 - RNA, 18 nt, Human
ugcugauuuggugaccaa

SEQ ID NO: 1922093 - RNA, 13 nt, Human
ugcugauggugca

SEQ ID NO: 1922094 - RNA, 14 nt, Human
ugcugacagcugcu

SEQ ID NO: 1922095 - RNA, 15 nt, Human
ugcugacagcugcuc

SEQ ID NO: 1922096 - RNA, 16 nt, Human
ugcugacagcugcucc

SEQ ID NO: 1922097 - RNA, 17 nt, Human
ugcugacagcugcuccu

SEQ ID NO: 1922098 - RNA, 18 nt, Human
ugcugacagcugcuccua

SEQ ID NO: 1922099 - RNA, 15 nt, Human
ugcugauggugcaau

SEQ ID NO: 1922100 - RNA, 17 nt, Human
ugcugauggugcaauga

SEQ ID NO: 1922101 - RNA, 23 nt, Human
ugcugcaguugccagucaccccg

SEQ ID NO: 1922102 - RNA, 14 nt, Human
ugcugcauacauuc

SEQ ID NO: 1922103 - RNA, 18 nt, Human
ugcugcaguugccaguca

SEQ ID NO: 1922104 - RNA, 15 nt, Human
ugcugcggagcaaga

SEQ ID NO: 1922105 - RNA, 16 nt, Human
ugcugcggagcaagag

SEQ ID NO: 1922106 - RNA, 20 nt, Human
ugcugcggagcaagaggagg

SEQ ID NO: 1922107 - RNA, 23 nt, Human
ugcugcgucauuacagggcacag

SEQ ID NO: 1922108 - RNA, 13 nt, Human
ugcugcuggcugg

SEQ ID NO: 1922109 - RNA, 13 nt, Human
ugcugcuggacag

SEQ ID NO: 1922110 - RNA, 23 nt, Human
ugcugcuggacaguaucacuguc

SEQ ID NO: 1922111 - RNA, 23 nt, Human
ugcuccuccuuggugccuggccu

SEQ ID NO: 1922112 - RNA, 19 nt, Human
ugcucagugucuggcugca

SEQ ID NO: 1922113 - RNA, 14 nt, Human
ugcuccucucccca

SEQ ID NO: 1922114 - RNA, 21 nt, Human
ugcucagggaaaagcagcucu

SEQ ID NO: 1922115 - RNA, 22 nt, Human
ugcucagggaaaagcagcucuc

SEQ ID NO: 1922116 - RNA, 17 nt, Human
ugcucagcucugggcca

SEQ ID NO: 1922117 - RNA, 16 nt, Human
ugcucacauaucuguc

SEQ ID NO: 1922118 - RNA, 15 nt, Human
ugcucacauaucugu

SEQ ID NO: 1922119 - RNA, 17 nt, Human
ugcucagagcaguguuu

SEQ ID NO: 1922120 - RNA, 16 nt, Human
ugcucagaccagcucu

SEQ ID NO: 1922121 - RNA, 17 nt, Human
ugcucagaccagcucuu

SEQ ID NO: 1922122 - RNA, 18 nt, Human
ugcuccucuccccagcaa

SEQ ID NO: 1922123 - RNA, 17 nt, Human
ugcuccuuguuccuaga

SEQ ID NO: 1922124 - RNA, 17 nt, Human
ugcuccucuccccagca

SEQ ID NO: 1922125 - RNA, 18 nt, Human
ugcuccuuucuuguuuua

SEQ ID NO: 1922126 - RNA, 14 nt, Human
ugcucgccccagca

SEQ ID NO: 1922127 - RNA, 16 nt, Human
ugcucgccccagcagg

SEQ ID NO: 1922128 - RNA, 23 nt, Human
ugcuccuuguuccuagaguagag

SEQ ID NO: 1922129 - RNA, 13 nt, Human
ugcucgcccugcg

SEQ ID NO: 1922130 - RNA, 14 nt, Human
ugcucgcccugcgg

SEQ ID NO: 1922131 - RNA, 17 nt, Human
ugcucuccaagcccagu

SEQ ID NO: 1922132 - RNA, 17 nt, Human
ugcucuccuuccuggag

SEQ ID NO: 1922133 - RNA, 12 nt, Human
ugcucuccuucc

SEQ ID NO: 1922134 - RNA, 23 nt, Human
ugcucuccuuccuggagcccaga

SEQ ID NO: 1922135 - RNA, 18 nt, Human
ugcucuccuuccuggagc

SEQ ID NO: 1922136 - RNA, 21 nt, Human
ugucuguacacguguccugua

SEQ ID NO: 1922137 - RNA, 20 nt, Human
ugucuguacacguguccugu

SEQ ID NO: 1922138 - RNA, 19 nt, Human
ugucuguacacguguccug

SEQ ID NO: 1922139 - RNA, 15 nt, Human
ugucuguacacgugu

SEQ ID NO: 1922140 - RNA, 13 nt, Human
ugucuguacacgu

SEQ ID NO: 1922141 - RNA, 13 nt, Human
ugucuuuccuaga

SEQ ID NO: 1922142 - RNA, 14 nt, Human
ugucuuuggacccu

SEQ ID NO: 1922143 - RNA, 16 nt, Human
ugucuuuggacccuga

SEQ ID NO: 1922144 - RNA, 21 nt, Human
ugucuuuucuugcaugaggcu

SEQ ID NO: 1922145 - RNA, 13 nt, Human
ugugaaggacccu

SEQ ID NO: 1922146 - RNA, 14 nt, Human
ugugaaggacccuu

SEQ ID NO: 1922147 - RNA, 23 nt, Human
ugugaaaagaaaaaugagccugg

SEQ ID NO: 1922148 - RNA, 23 nt, Human
ugucuuuucuugcaugaggcuag

SEQ ID NO: 1922149 - RNA, 18 nt, Human
uguccucagguggccaug

SEQ ID NO: 1922150 - RNA, 19 nt, Human
uguccucagguggccaugc

SEQ ID NO: 1922151 - RNA, 17 nt, Human
uguccucagccuugcca

SEQ ID NO: 1922152 - RNA, 20 nt, Human
uguccucagccuugccagag

SEQ ID NO: 1922153 - RNA, 21 nt, Human
uguccucagccuugccagaga

SEQ ID NO: 1922154 - RNA, 22 nt, Human
uguccucagccuugccagagau

SEQ ID NO: 1922155 - RNA, 14 nt, Human
uguccucagguggc

SEQ ID NO: 1922156 - RNA, 15 nt, Human
ugugaucagaccaua

SEQ ID NO: 1922157 - RNA, 13 nt, Human
ugugcacaucucu

SEQ ID NO: 1922158 - RNA, 14 nt, Human
ugugcacaucucug

SEQ ID NO: 1922159 - RNA, 15 nt, Human
ugugcacaucucugc

SEQ ID NO: 1922160 - RNA, 19 nt, Human
ugugcacaucucugcuuga

SEQ ID NO: 1922161 - RNA, 16 nt, Human
ugugauauaagugugu

SEQ ID NO: 1922162 - RNA, 21 nt, Human
ugugagucaccaagcccaguu

SEQ ID NO: 1922163 - RNA, 19 nt, Human
ugugagucaccaagcccag

SEQ ID NO: 1922164 - RNA, 17 nt, Human
ugugagucaccaagccc

SEQ ID NO: 1922165 - RNA, 15 nt, Human
ugugagucaccaagc

SEQ ID NO: 1922166 - RNA, 12 nt, Human
ugugaggaagcc

SEQ ID NO: 1922167 - RNA, 20 nt, Human
ugugaggaagccgcuggggc

SEQ ID NO: 1922168 - RNA, 13 nt, Human
ugugaggaagccg

SEQ ID NO: 1922169 - RNA, 18 nt, Human
ugugaggaagccgcuggg

SEQ ID NO: 1922170 - RNA, 18 nt, Human
ugugaauugagcugcaga

SEQ ID NO: 1922171 - RNA, 23 nt, Human
uguguagccugugcauguauguc

SEQ ID NO: 1922172 - RNA, 16 nt, Human
uguguagccugugcau

SEQ ID NO: 1922173 - RNA, 15 nt, Human
uguguagccugugca

SEQ ID NO: 1922174 - RNA, 12 nt, Human
uguguagggcgg

SEQ ID NO: 1922175 - RNA, 16 nt, Human
uguguagggcgggagg

SEQ ID NO: 1922176 - RNA, 23 nt, Human
uguguaauuuaaaauugugaugu

SEQ ID NO: 1922177 - RNA, 22 nt, Human
uguguaauuuaaaauugugaug

SEQ ID NO: 1922178 - RNA, 19 nt, Human
uguguaauuuaaaauugug

SEQ ID NO: 1922179 - RNA, 22 nt, Human
ugugggcuaguugggcuuccuc

SEQ ID NO: 1922180 - RNA, 18 nt, Human
uguguaauuuaaaauugu

SEQ ID NO: 1922181 - RNA, 11 nt, Human
uguguaauuua

SEQ ID NO: 1922182 - RNA, 23 nt, Human
uguggcgcagcauauucaggaag

SEQ ID NO: 1922183 - RNA, 11 nt, Human
uguggccugca

SEQ ID NO: 1922184 - RNA, 17 nt, Human
uguggccugcacaguga

SEQ ID NO: 1922185 - RNA, 22 nt, Human
uguggcuauuaaaacucuuuua

SEQ ID NO: 1922186 - RNA, 15 nt, Human
ugugggaguguguaa

SEQ ID NO: 1922187 - RNA, 14 nt, Human
ugugggagugugua

SEQ ID NO: 1922188 - RNA, 19 nt, Human
uguggacacagcucuucuc

SEQ ID NO: 1922189 - RNA, 18 nt, Human
uguggacacagcucuucu

SEQ ID NO: 1922190 - RNA, 15 nt, Human
uguggaagugugggu

SEQ ID NO: 1922191 - RNA, 19 nt, Human
ugugcgccuacaggaguga

SEQ ID NO: 1922192 - RNA, 14 nt, Human
ugugcgccuacagg

SEQ ID NO: 1922193 - RNA, 16 nt, Human
ugugccuuuugccauc

SEQ ID NO: 1922194 - RNA, 17 nt, Human
ugugcucaggagcccug

SEQ ID NO: 1922195 - RNA, 15 nt, Human
ugugcucaggagccc

SEQ ID NO: 1922196 - RNA, 16 nt, Human
ugugcucaggagcccu

SEQ ID NO: 1922197 - RNA, 13 nt, Human
ugugcuuuaugcu

SEQ ID NO: 1922198 - RNA, 17 nt, Human
ugugcuuuaugcugaaa

SEQ ID NO: 1922199 - RNA, 18 nt, Human
ugugcuuuaugcugaaac

SEQ ID NO: 1922200 - RNA, 20 nt, Human
ugugcuuuaugcugaaacag

SEQ ID NO: 1922201 - RNA, 19 nt, Human
ugugcuuuaugcugaaaca

SEQ ID NO: 1922202 - RNA, 14 nt, Human
ugugcacguacaca

SEQ ID NO: 1922203 - RNA, 20 nt, Human
ugugcacaucucugcuugag

SEQ ID NO: 1922204 - RNA, 13 nt, Human
ugugcacaucuuc

SEQ ID NO: 1922205 - RNA, 12 nt, Human
ugugcacuaagg

SEQ ID NO: 1922206 - RNA, 13 nt, Human
ugugcacugccca

SEQ ID NO: 1922207 - RNA, 16 nt, Human
ugugcacuaaggggcc

SEQ ID NO: 1922208 - RNA, 17 nt, Human
ugugcacuaaggggccc

SEQ ID NO: 1922209 - RNA, 23 nt, Human
ugugcacuaaggggcccggccag

SEQ ID NO: 1922210 - RNA, 21 nt, Human
ugugcacugcccauggacagg

SEQ ID NO: 1922211 - RNA, 19 nt, Human
ugugcauuaucuagauacu

SEQ ID NO: 1922212 - RNA, 16 nt, Human
ugugcauuaucuagau

SEQ ID NO: 1922213 - RNA, 14 nt, Human
ugugcauuaucuag

SEQ ID NO: 1922214 - RNA, 23 nt, Human
ugugcauuuggugguuucagaaa

SEQ ID NO: 1922215 - RNA, 17 nt, Human
ugugccuuggugugcug

SEQ ID NO: 1922216 - RNA, 16 nt, Human
ugugccuucuuuugau

SEQ ID NO: 1922217 - RNA, 23 nt, Human
ugugcauuaucuagauacuguau

SEQ ID NO: 1922218 - RNA, 21 nt, Human
ugugcauuaucuagauacugu

SEQ ID NO: 1922219 - RNA, 20 nt, Human
ugugcauuaucuagauacug

SEQ ID NO: 1922220 - RNA, 15 nt, Human
uguagccugugcaug

SEQ ID NO: 1922221 - RNA, 14 nt, Human
uguagccugugcau

SEQ ID NO: 1922222 - RNA, 13 nt, Human
uguagccugugca

SEQ ID NO: 1922223 - RNA, 20 nt, Human
uguagccugugcauguaugu

SEQ ID NO: 1922224 - RNA, 16 nt, Human
uguagccugugcaugu

SEQ ID NO: 1922225 - RNA, 22 nt, Human
uguagccugugcauguaugucu

SEQ ID NO: 1922226 - RNA, 18 nt, Human
uguagccccucuccugga

SEQ ID NO: 1922227 - RNA, 19 nt, Human
uguagcccccuggccucug

SEQ ID NO: 1922228 - RNA, 20 nt, Human
uguagcccccuggccucugu

SEQ ID NO: 1922229 - RNA, 16 nt, Human
uguagcccccuggccu

SEQ ID NO: 1922230 - RNA, 17 nt, Human
uguagcccccuggccuc

SEQ ID NO: 1922231 - RNA, 18 nt, Human
uguagcccccuggccucu

SEQ ID NO: 1922232 - RNA, 18 nt, Human
uguagccuuuugacuuuc

SEQ ID NO: 1922233 - RNA, 15 nt, Human
uguacgucugacagg

SEQ ID NO: 1922234 - RNA, 14 nt, Human
uguaccucugccuc

SEQ ID NO: 1922235 - RNA, 19 nt, Human
uguacugcauaugaaagga

SEQ ID NO: 1922236 - RNA, 15 nt, Human
uguacugggccaugu

SEQ ID NO: 1922237 - RNA, 18 nt, Human
uguagcauccuggaauau

SEQ ID NO: 1922238 - RNA, 17 nt, Human
uguagcauccuggaaua

SEQ ID NO: 1922239 - RNA, 16 nt, Human
uguagcauccuggaau

SEQ ID NO: 1922240 - RNA, 14 nt, Human
uguagcauccugga

SEQ ID NO: 1922241 - RNA, 14 nt, Human
uguaaucaauguuu

SEQ ID NO: 1922242 - RNA, 20 nt, Human
uguaaucaauguuucuucua

SEQ ID NO: 1922243 - RNA, 14 nt, Human
uguaaucacagcua

SEQ ID NO: 1922244 - RNA, 22 nt, Human
uguaaucccagcuacuugggag

SEQ ID NO: 1922245 - RNA, 19 nt, Human
uguaaucccagcuacucgg

SEQ ID NO: 1922246 - RNA, 20 nt, Human
uguaaucccagcuacucggg

SEQ ID NO: 1922247 - RNA, 17 nt, Human
uggucacaggaaguaga

SEQ ID NO: 1922248 - RNA, 14 nt, Human
uggucacacacuga

SEQ ID NO: 1922249 - RNA, 15 nt, Human
uggucacacacugau

SEQ ID NO: 1922250 - RNA, 16 nt, Human
uggucacacacugaug

SEQ ID NO: 1922251 - RNA, 17 nt, Human
uguaauuaaguacuaug

SEQ ID NO: 1922252 - RNA, 16 nt, Human
uguacagagcccacgc

SEQ ID NO: 1922253 - RNA, 17 nt, Human
uguacagagcccacgcc

SEQ ID NO: 1922254 - RNA, 13 nt, Human
uguacagagccca

SEQ ID NO: 1922255 - RNA, 18 nt, Human
uguacagagcccacgccc

SEQ ID NO: 1922256 - RNA, 21 nt, Human
uguacagucuuguauuaaguu

SEQ ID NO: 1922257 - RNA, 16 nt, Human
uguaccgcaaugugac

SEQ ID NO: 1922258 - RNA, 20 nt, Human
uguaguugcguggacucugc

SEQ ID NO: 1922259 - RNA, 15 nt, Human
uguaguugcguggac

SEQ ID NO: 1922260 - RNA, 21 nt, Human
uguaguugcguggacucugca

SEQ ID NO: 1922261 - RNA, 22 nt, Human
uguauaaaagggacugagaaau

SEQ ID NO: 1922262 - RNA, 22 nt, Human
uguauucucuccuguaccucuu

SEQ ID NO: 1922263 - RNA, 17 nt, Human
ugucacacacuuuggcu

SEQ ID NO: 1922264 - RNA, 22 nt, Human
uguauuuucuucaccucugcua

SEQ ID NO: 1922265 - RNA, 12 nt, Human
ugucacaggcag

SEQ ID NO: 1922266 - RNA, 13 nt, Human
ugucacaggcagg

SEQ ID NO: 1922267 - RNA, 22 nt, Human
ugucacccuuaggccagcacca

SEQ ID NO: 1922268 - RNA, 16 nt, Human
uguauuuaaaaaaauc

SEQ ID NO: 1922269 - RNA, 19 nt, Human
ugucauguuguaaacauuu

SEQ ID NO: 1922270 - RNA, 13 nt, Human
ugucaccugaaga

SEQ ID NO: 1922271 - RNA, 14 nt, Human
ugucaccuucaccu

SEQ ID NO: 1922272 - RNA, 13 nt, Human
ugucaccuucacc

SEQ ID NO: 1922273 - RNA, 13 nt, Human
ugucaucugugca

SEQ ID NO: 1922274 - RNA, 16 nt, Human
ugucauuugagcaggg

SEQ ID NO: 1922275 - RNA, 19 nt, Human
ugucauuugagcagggcuc

SEQ ID NO: 1922276 - RNA, 18 nt, Human
uguccccaccgcagacag

SEQ ID NO: 1922277 - RNA, 19 nt, Human
uguccccaccgcagacagg

SEQ ID NO: 1922278 - RNA, 22 nt, Human
uguccccaccgcagacaggacc

SEQ ID NO: 1922279 - RNA, 20 nt, Human
uguccuacccacccuccuuu

SEQ ID NO: 1922280 - RNA, 17 nt, Human
uguccccgacccuugcc

SEQ ID NO: 1922281 - RNA, 16 nt, Human
uguccccgacccuugc

SEQ ID NO: 1922282 - RNA, 17 nt, Human
uguccuacucuguguca

SEQ ID NO: 1922283 - RNA, 12 nt, Human
uguccuacucug

SEQ ID NO: 1922284 - RNA, 12 nt, Human
uguccucagccu

SEQ ID NO: 1922285 - RNA, 13 nt, Human
uguccucagccuu

SEQ ID NO: 1922286 - RNA, 16 nt, Human
uguccucagccuugcc

SEQ ID NO: 1922287 - RNA, 14 nt, Human
uuaagauaauuaua

SEQ ID NO: 1922288 - RNA, 16 nt, Human
uuaagauaauuauaau

SEQ ID NO: 1922289 - RNA, 12 nt, Human
uuaagaguaaaa

SEQ ID NO: 1922290 - RNA, 14 nt, Human
uuaacuuuuauaaa

SEQ ID NO: 1922291 - RNA, 16 nt, Human
uuaacuugucaaaaaa

SEQ ID NO: 1922292 - RNA, 13 nt, Human
uuaacuuuuauaa

SEQ ID NO: 1922293 - RNA, 12 nt, Human
uuaacuuuuaua

SEQ ID NO: 1922294 - RNA, 22 nt, Human
uuaacuugucaaaaaacaaaaa

SEQ ID NO: 1922295 - RNA, 15 nt, Human
uuaaauguagaaagu

SEQ ID NO: 1922296 - RNA, 20 nt, Human
uuaauagcgucauaacuaga

SEQ ID NO: 1922297 - RNA, 15 nt, Human
uuaauacuaccuuga

SEQ ID NO: 1922298 - RNA, 17 nt, Human
uuaauacuaccuugaaa

SEQ ID NO: 1922299 - RNA, 21 nt, Human
uuaauacaaugaugcuauuug

SEQ ID NO: 1922300 - RNA, 15 nt, Human
uuacacucuuuguaa

SEQ ID NO: 1922301 - RNA, 14 nt, Human
uuacacucuuugua

SEQ ID NO: 1922302 - RNA, 23 nt, Human
uuacacauuuuucagauauaaaa

SEQ ID NO: 1922303 - RNA, 17 nt, Human
uuacacauuuuucagau

SEQ ID NO: 1922304 - RNA, 13 nt, Human
uuacacuuuaugc

SEQ ID NO: 1922305 - RNA, 20 nt, Human
uuacacuuuaugcacaaaau

SEQ ID NO: 1922306 - RNA, 19 nt, Human
uuacauuauuaucaacaau

SEQ ID NO: 1922307 - RNA, 13 nt, Human
uuacauuguucaa

SEQ ID NO: 1922308 - RNA, 17 nt, Human
uuacauuguuugucugu

SEQ ID NO: 1922309 - RNA, 17 nt, Human
uuacauuuuuaagugcu

SEQ ID NO: 1922310 - RNA, 12 nt, Human
uuacauuuuuaa

SEQ ID NO: 1922311 - RNA, 16 nt, Human
uuacauuguucaauua

SEQ ID NO: 1922312 - RNA, 22 nt, Human
uuaauuaaaacacaacaucuuu

SEQ ID NO: 1922313 - RNA, 15 nt, Human
uuaauuaaauagcuu

SEQ ID NO: 1922314 - RNA, 19 nt, Human
uuaauuaaauagcuuuugu

SEQ ID NO: 1922315 - RNA, 20 nt, Human
uuaauuaaauagcuuuugug

SEQ ID NO: 1922316 - RNA, 15 nt, Human
uuacacauuuuucag

SEQ ID NO: 1922317 - RNA, 17 nt, Human
uuacacagugugaauaa

SEQ ID NO: 1922318 - RNA, 22 nt, Human
uuacaacugccucgaaacacag

SEQ ID NO: 1922319 - RNA, 23 nt, Human
uuacaacugccucgaaacacaga

SEQ ID NO: 1922320 - RNA, 19 nt, Human
uuacaacccgguucacucu

SEQ ID NO: 1922321 - RNA, 15 nt, Human
uguuuccuggcacug

SEQ ID NO: 1922322 - RNA, 16 nt, Human
uguuuccugcaggcca

SEQ ID NO: 1922323 - RNA, 21 nt, Human
uguuuccaguacaccuuucag

SEQ ID NO: 1922324 - RNA, 22 nt, Human
uguuuagaacacugguuuaaag

SEQ ID NO: 1922325 - RNA, 16 nt, Human
uguuuuaagaggcagg

SEQ ID NO: 1922326 - RNA, 14 nt, Human
uguuuguguauuua

SEQ ID NO: 1922327 - RNA, 11 nt, Human
uguuugugugu

SEQ ID NO: 1922328 - RNA, 12 nt, Human
uguuuguguauu

SEQ ID NO: 1922329 - RNA, 17 nt, Human
uguuuuaagaggcaggg

SEQ ID NO: 1922330 - RNA, 23 nt, Human
uguuuuaaggaugcuuguacaua

SEQ ID NO: 1922331 - RNA, 22 nt, Human
uguuuuaaggaugcuuguacau

SEQ ID NO: 1922332 - RNA, 12 nt, Human
uguuuuuaacuc

SEQ ID NO: 1922333 - RNA, 14 nt, Human
uguuuuuaagcugu

SEQ ID NO: 1922334 - RNA, 12 nt, Human
uguuuuuaaaag

SEQ ID NO: 1922335 - RNA, 22 nt, Human
uuaaaaaaaaaccugagcccca

SEQ ID NO: 1922336 - RNA, 13 nt, Human
uuaaaaaaaaaga

SEQ ID NO: 1922337 - RNA, 15 nt, Human
uguuuuuaagcuguu

SEQ ID NO: 1922338 - RNA, 17 nt, Human
uguuuuuaagcuguuuc

SEQ ID NO: 1922339 - RNA, 20 nt, Human
uguuuuuaagcuguuuccau

SEQ ID NO: 1922340 - RNA, 22 nt, Human
uguuuuuaagcuguuuccauag

SEQ ID NO: 1922341 - RNA, 14 nt, Human
uuaaaacccaagug

SEQ ID NO: 1922342 - RNA, 18 nt, Human
uuaaaaaaaaagaucugu

SEQ ID NO: 1922343 - RNA, 20 nt, Human
uuaaacuaaggcccucuuga

SEQ ID NO: 1922344 - RNA, 11 nt, Human
uuaaaugcacc

SEQ ID NO: 1922345 - RNA, 14 nt, Human
uuaaaugcccagcc

SEQ ID NO: 1922346 - RNA, 15 nt, Human
uuaaaugcccagccc

SEQ ID NO: 1922347 - RNA, 16 nt, Human
uuaaaugcccagcccc

SEQ ID NO: 1922348 - RNA, 18 nt, Human
uuaaagaaaaguuuugua

SEQ ID NO: 1922349 - RNA, 22 nt, Human
uuaaagccacaaccacauacaa

SEQ ID NO: 1922350 - RNA, 17 nt, Human
uguugacaguucauaug

SEQ ID NO: 1922351 - RNA, 16 nt, Human
uguugacacaggucuu

SEQ ID NO: 1922352 - RNA, 13 nt, Human
uguugaauacuuu

SEQ ID NO: 1922353 - RNA, 18 nt, Human
uguugaauacuuuuuaca

SEQ ID NO: 1922354 - RNA, 22 nt, Human
uguugagaaucccaaauuugau

SEQ ID NO: 1922355 - RNA, 23 nt, Human
uguugagaaucccaaauuugauu

SEQ ID NO: 1922356 - RNA, 14 nt, Human
uguugacaugugcu

SEQ ID NO: 1922357 - RNA, 21 nt, Human
uguucuggcucuuccaggcug

SEQ ID NO: 1922358 - RNA, 17 nt, Human
uguucuggcucuuccag

SEQ ID NO: 1922359 - RNA, 20 nt, Human
uguucuggcucuuccaggcu

SEQ ID NO: 1922360 - RNA, 23 nt, Human
uguucuuucuggcuaugcauuug

SEQ ID NO: 1922361 - RNA, 13 nt, Human
uguucuuugggga

SEQ ID NO: 1922362 - RNA, 16 nt, Human
uguucuuuugucccag

SEQ ID NO: 1922363 - RNA, 14 nt, Human
uguucuuuuuauug

SEQ ID NO: 1922364 - RNA, 17 nt, Human
uguucuuuuuauugaau

SEQ ID NO: 1922365 - RNA, 15 nt, Human
uguucucucuucucc

SEQ ID NO: 1922366 - RNA, 16 nt, Human
uguucucucuucucca

SEQ ID NO: 1922367 - RNA, 19 nt, Human
uguucaucauccuaagcua

SEQ ID NO: 1922368 - RNA, 14 nt, Human
uguucaugaaagau

SEQ ID NO: 1922369 - RNA, 13 nt, Human
uguucaugaaaga

SEQ ID NO: 1922370 - RNA, 14 nt, Human
uguucugcuguucu

SEQ ID NO: 1922371 - RNA, 18 nt, Human
uguucugcuguucucuag

SEQ ID NO: 1922372 - RNA, 12 nt, Human
uguucuggcucu

SEQ ID NO: 1922373 - RNA, 13 nt, Human
uguucuggcucuu

SEQ ID NO: 1922374 - RNA, 16 nt, Human
uguucuggcucuucca

SEQ ID NO: 1922375 - RNA, 13 nt, Human
uguucucugcccu

SEQ ID NO: 1922376 - RNA, 14 nt, Human
uguucucugcccuc

SEQ ID NO: 1922377 - RNA, 15 nt, Human
uguucucugcccucc

SEQ ID NO: 1922378 - RNA, 16 nt, Human
uguucucugcccucca

SEQ ID NO: 1922379 - RNA, 16 nt, Human
uguuggccaggcuggu

SEQ ID NO: 1922380 - RNA, 15 nt, Human
uguuggccaggcugg

SEQ ID NO: 1922381 - RNA, 15 nt, Human
uguuggccaaagcca

SEQ ID NO: 1922382 - RNA, 19 nt, Human
uguuggcugggggccucag

SEQ ID NO: 1922383 - RNA, 17 nt, Human
uguuggcugggggccuc

SEQ ID NO: 1922384 - RNA, 12 nt, Human
uguuuaagagac

SEQ ID NO: 1922385 - RNA, 12 nt, Human
uguuuacagugu

SEQ ID NO: 1922386 - RNA, 16 nt, Human
uguuuaacuucuuaua

SEQ ID NO: 1922387 - RNA, 16 nt, Human
uguuacuaucugcuuu

SEQ ID NO: 1922388 - RNA, 15 nt, Human
uguuacuaucugcuu

SEQ ID NO: 1922389 - RNA, 14 nt, Human
uguuacuaaguuuu

SEQ ID NO: 1922390 - RNA, 21 nt, Human
uguuagcccaagguuaaaaag

SEQ ID NO: 1922391 - RNA, 12 nt, Human
uguuacuguaau

SEQ ID NO: 1922392 - RNA, 14 nt, Human
uguuagcagacagg

SEQ ID NO: 1922393 - RNA, 14 nt, Human
uguuacuguaauuc

SEQ ID NO: 1922394 - RNA, 15 nt, Human
uguuagucauuugcu

SEQ ID NO: 1922395 - RNA, 15 nt, Human
uguucagaagaaauu

SEQ ID NO: 1922396 - RNA, 22 nt, Human
uguucagaagaaauucugucau

SEQ ID NO: 1922397 - RNA, 20 nt, Human
uguuaguaugaggcauuugu

SEQ ID NO: 1922398 - RNA, 19 nt, Human
uguuaguaugaggcauuug

SEQ ID NO: 1922399 - RNA, 17 nt, Human
uguuaguaugaggcauu

SEQ ID NO: 1922400 - RNA, 13 nt, Human
uguuaguaacaug

SEQ ID NO: 1922401 - RNA, 22 nt, Human
uguucagcuccagcucaccagc

SEQ ID NO: 1922402 - RNA, 21 nt, Human
uguucagcuccagcucaccag

SEQ ID NO: 1922403 - RNA, 20 nt, Human
uguucagcuccagcucacca

SEQ ID NO: 1922404 - RNA, 17 nt, Human
uguucauaaauaaaguu

SEQ ID NO: 1922405 - RNA, 19 nt, Human
ugugugcacguacacacac

SEQ ID NO: 1922406 - RNA, 15 nt, Human
ugugugauugacagc

SEQ ID NO: 1922407 - RNA, 18 nt, Human
ugugugauugacagcuuu

SEQ ID NO: 1922408 - RNA, 19 nt, Human
ugugugauugacagcuuug

SEQ ID NO: 1922409 - RNA, 21 nt, Human
ugugugauugacagcuuugcu

SEQ ID NO: 1922410 - RNA, 13 nt, Human
ugugugcucucca

SEQ ID NO: 1922411 - RNA, 22 nt, Human
uguguggagcucgcuaaaguca

SEQ ID NO: 1922412 - RNA, 11 nt, Human
uguguggccug

SEQ ID NO: 1922413 - RNA, 15 nt, Human
ugugugggagugugu

SEQ ID NO: 1922414 - RNA, 14 nt, Human
ugugugggagugug

SEQ ID NO: 1922415 - RNA, 13 nt, Human
uguguaugugggg

SEQ ID NO: 1922416 - RNA, 12 nt, Human
uguguauguggg

SEQ ID NO: 1922417 - RNA, 11 nt, Human
uguguaugugg

SEQ ID NO: 1922418 - RNA, 16 nt, Human
ugugugugaaugaaca

SEQ ID NO: 1922419 - RNA, 20 nt, Human
ugugugugaaugaacacucu

SEQ ID NO: 1922420 - RNA, 22 nt, Human
ugugugucuaggcaggaccugu

SEQ ID NO: 1922421 - RNA, 16 nt, Human
ugugugggagugugua

SEQ ID NO: 1922422 - RNA, 18 nt, Human
ugugugugcagacuucag

SEQ ID NO: 1922423 - RNA, 15 nt, Human
uguguuucaaguuca

SEQ ID NO: 1922424 - RNA, 16 nt, Human
uguguuuauugucaaa

SEQ ID NO: 1922425 - RNA, 15 nt, Human
uguguuuuuaauaaa

SEQ ID NO: 1922426 - RNA, 15 nt, Human
uguguuuuucauaaa

SEQ ID NO: 1922427 - RNA, 20 nt, Human
uguguuuuuaauaaagacag

SEQ ID NO: 1922428 - RNA, 14 nt, Human
uguguuuuuaaaag

SEQ ID NO: 1922429 - RNA, 18 nt, Human
uguguuuuucauaaagca

SEQ ID NO: 1922430 - RNA, 13 nt, Human
uguguuugaagca

SEQ ID NO: 1922431 - RNA, 17 nt, Human
aaaacacauuuuucuua

SEQ ID NO: 1922432 - RNA, 19 nt, Human
aaaacacuguucucugccc

SEQ ID NO: 1922433 - RNA, 13 nt, Human
aaaacagaagccu

SEQ ID NO: 1922434 - RNA, 11 nt, Human
aaaagaaaaag

SEQ ID NO: 1922435 - RNA, 17 nt, Human
aaaacuuuuuauauuuu

SEQ ID NO: 1922436 - RNA, 20 nt, Human
aaaacuuuuuauauuuuaua

SEQ ID NO: 1922437 - RNA, 17 nt, Human
aaaacagguagaauuau

SEQ ID NO: 1922438 - RNA, 12 nt, Human
aaaacagguaga

SEQ ID NO: 1922439 - RNA, 13 nt, Human
aaaacaggcagcu

SEQ ID NO: 1922440 - RNA, 20 nt, Human
aaaagacaaggaaaaaauaa

SEQ ID NO: 1922441 - RNA, 13 nt, Human
aaaagacagggcu

SEQ ID NO: 1922442 - RNA, 17 nt, Human
aaaagaaagaaaaucag

SEQ ID NO: 1922443 - RNA, 12 nt, Human
aaaagaaaugaa

SEQ ID NO: 1922444 - RNA, 17 nt, Human
aaaagaacaauauugac

SEQ ID NO: 1922445 - RNA, 17 nt, Human
aaaagauaaauauuaua

SEQ ID NO: 1922446 - RNA, 23 nt, Human
aaaagaucuguuuugaaggcaaa

SEQ ID NO: 1922447 - RNA, 19 nt, Human
aaaagagaugaugaaaaua

SEQ ID NO: 1922448 - RNA, 16 nt, Human
aaaagagaugaugaaa

SEQ ID NO: 1922449 - RNA, 12 nt, Human
aaaagagggggg

SEQ ID NO: 1922450 - RNA, 14 nt, Human
aaaagauaaauauu

SEQ ID NO: 1922451 - RNA, 16 nt, Human
aaaauaaaacuuuuua

SEQ ID NO: 1922452 - RNA, 13 nt, Human
aaaaucagccugc

SEQ ID NO: 1922453 - RNA, 17 nt, Human
aaaaucagccugcucca

SEQ ID NO: 1922454 - RNA, 21 nt, Human
aaaaucagccugcuccagcug

SEQ ID NO: 1922455 - RNA, 14 nt, Human
aaaauaaaacuuuu

SEQ ID NO: 1922456 - RNA, 18 nt, Human
aaaaguugaauuuuacau

SEQ ID NO: 1922457 - RNA, 22 nt, Human
aaaagucauaaaauguaucuuc

SEQ ID NO: 1922458 - RNA, 22 nt, Human
aaaccgaacugauguaaguaaa

SEQ ID NO: 1922459 - RNA, 12 nt, Human
aaacccagcucu

SEQ ID NO: 1922460 - RNA, 16 nt, Human
aaacccagcucugguc

SEQ ID NO: 1922461 - RNA, 15 nt, Human
aaaccgccaaggcug

SEQ ID NO: 1922462 - RNA, 16 nt, Human
aaaccgccaaggcugg

SEQ ID NO: 1922463 - RNA, 19 nt, Human
aaacucuguugcaagugca

SEQ ID NO: 1922464 - RNA, 12 nt, Human
aaacucuuaaaa

SEQ ID NO: 1922465 - RNA, 23 nt, Human
aaacucuuaaaacccaagugccu

SEQ ID NO: 1922466 - RNA, 22 nt, Human
aaacugauuuuuuuuuccuuca

SEQ ID NO: 1922467 - RNA, 23 nt, Human
aaacugauuuuuuuuuccuucag

SEQ ID NO: 1922468 - RNA, 20 nt, Human
aaacucuguugcaagugcaa

SEQ ID NO: 1922469 - RNA, 15 nt, Human
aaacccaauccaaau

SEQ ID NO: 1922470 - RNA, 12 nt, Human
aaaccagggagc

SEQ ID NO: 1922471 - RNA, 18 nt, Human
aaaaucucaaauuucuaa

SEQ ID NO: 1922472 - RNA, 16 nt, Human
aaaaucucaaauuucu

SEQ ID NO: 1922473 - RNA, 15 nt, Human
aaaaucucaaauuuc

SEQ ID NO: 1922474 - RNA, 15 nt, Human
aaaaucuauauuuug

SEQ ID NO: 1922475 - RNA, 15 nt, Human
aaagcccaaaguggu

SEQ ID NO: 1922476 - RNA, 16 nt, Human
aaagccauuuuaggcu

SEQ ID NO: 1922477 - RNA, 18 nt, Human
aaagaucuguccucagcc

SEQ ID NO: 1922478 - RNA, 19 nt, Human
aaagaucuguccucagccu

SEQ ID NO: 1922479 - RNA, 20 nt, Human
aaagaucuguccucagccuu

SEQ ID NO: 1922480 - RNA, 16 nt, Human
aaagaucuguuuugaa

SEQ ID NO: 1922481 - RNA, 21 nt, Human
aaagaucuguccucagccuug

SEQ ID NO: 1922482 - RNA, 13 nt, Human
aaagaucuguuuu

SEQ ID NO: 1922483 - RNA, 20 nt, Human
aaauguuauuuuuuaauuau

SEQ ID NO: 1922484 - RNA, 21 nt, Human
aaauguuauuuuuuaauuauu

SEQ ID NO: 1922485 - RNA, 13 nt, Human
aaauguucaucaa

SEQ ID NO: 1922486 - RNA, 17 nt, Human
aaauguucaucaaugaa

SEQ ID NO: 1922487 - RNA, 19 nt, Human
aaauguugagaaucccaaa

SEQ ID NO: 1922488 - RNA, 10 nt, Human
aaaugcugcu

SEQ ID NO: 1922489 - RNA, 23 nt, Human
aaaugcugcuuuuucucaaaaug

SEQ ID NO: 1922490 - RNA, 11 nt, Human
aaaucuuuuac

SEQ ID NO: 1922491 - RNA, 14 nt, Human
aaaugaaaaaauau

SEQ ID NO: 1922492 - RNA, 22 nt, Human
aaaugcugguuuuucaguuuuc

SEQ ID NO: 1922493 - RNA, 19 nt, Human
aaaugcuguaacuuucuga

SEQ ID NO: 1922494 - RNA, 14 nt, Human
aaaugcuuuagaaa

SEQ ID NO: 1922495 - RNA, 18 nt, Human
aaaugcuuuuuauuucug

SEQ ID NO: 1922496 - RNA, 19 nt, Human
aaaucuccaaaauaaaacu

SEQ ID NO: 1922497 - RNA, 13 nt, Human
aaaucuuuuugcu

SEQ ID NO: 1922498 - RNA, 14 nt, Human
aaaucuuuuugcuu

SEQ ID NO: 1922499 - RNA, 12 nt, Human
aaauauuuuugg

SEQ ID NO: 1922500 - RNA, 19 nt, Human
aaauauuuauaaaacuucu

SEQ ID NO: 1922501 - RNA, 12 nt, Human
aaauauuuaucu

SEQ ID NO: 1922502 - RNA, 22 nt, Human
aaauauuuugaucuucaacaaa

SEQ ID NO: 1922503 - RNA, 23 nt, Human
aaauauuuugaucuucaacaaau

SEQ ID NO: 1922504 - RNA, 17 nt, Human
aaauauuuugaucuuca

SEQ ID NO: 1922505 - RNA, 20 nt, Human
aaauagauggauuuguauca

SEQ ID NO: 1922506 - RNA, 20 nt, Human
aaaggaugcccaaagaugca

SEQ ID NO: 1922507 - RNA, 14 nt, Human
aaaggaugcacaga

SEQ ID NO: 1922508 - RNA, 13 nt, Human
aaaggaugugauu

SEQ ID NO: 1922509 - RNA, 22 nt, Human
aacauggccuuugcuugaaaga

SEQ ID NO: 1922510 - RNA, 21 nt, Human
aacaugaggggacauuuuggu

SEQ ID NO: 1922511 - RNA, 18 nt, Human
aacaugaggggacauuuu

SEQ ID NO: 1922512 - RNA, 15 nt, Human
aacaugaacaaauuu

SEQ ID NO: 1922513 - RNA, 15 nt, Human
aacaucuuuucuugc

SEQ ID NO: 1922514 - RNA, 11 nt, Human
aacaucuuuuc

SEQ ID NO: 1922515 - RNA, 12 nt, Human
aacagccugugu

SEQ ID NO: 1922516 - RNA, 11 nt, Human
aacaggcagau

SEQ ID NO: 1922517 - RNA, 18 nt, Human
aacagccacuacauuacu

SEQ ID NO: 1922518 - RNA, 18 nt, Human
aaauucuugcaaaguauc

SEQ ID NO: 1922519 - RNA, 15 nt, Human
aaauucuugcaaagu

SEQ ID NO: 1922520 - RNA, 23 nt, Human
aaauucuucuccacuuucuagcc

SEQ ID NO: 1922521 - RNA, 23 nt, Human
aacauggccuuugcuugaaagaa

SEQ ID NO: 1922522 - RNA, 22 nt, Human
aacaugguaaacgcugucccua

SEQ ID NO: 1922523 - RNA, 22 nt, Human
aaccuaaauuugguucuaggcc

SEQ ID NO: 1922524 - RNA, 17 nt, Human
aaccguuuugaagcuac

SEQ ID NO: 1922525 - RNA, 18 nt, Human
aaccguuuugaagcuacu

SEQ ID NO: 1922526 - RNA, 18 nt, Human
aaccuuuguuugcaucug

SEQ ID NO: 1922527 - RNA, 16 nt, Human
aaccuuuugagugccu

SEQ ID NO: 1922528 - RNA, 23 nt, Human
aaccuuuugagugccuuacacaa

SEQ ID NO: 1922529 - RNA, 12 nt, Human
aaccuuuuuaaa

SEQ ID NO: 1922530 - RNA, 20 nt, Human
aaugaauacuuuauaaagga

SEQ ID NO: 1922531 - RNA, 22 nt, Human
aaugauggcccauucuacuugc

SEQ ID NO: 1922532 - RNA, 13 nt, Human
aaugauggcccau

SEQ ID NO: 1922533 - RNA, 14 nt, Human
aaugauggcccauu

SEQ ID NO: 1922534 - RNA, 20 nt, Human
aaugauggcccauucuacuu

SEQ ID NO: 1922535 - RNA, 21 nt, Human
aaugauggcccauucuacuug

SEQ ID NO: 1922536 - RNA, 20 nt, Human
aaugaugccaugaggaacaa

SEQ ID NO: 1922537 - RNA, 19 nt, Human
aaugaugcuauuugcaauu

SEQ ID NO: 1922538 - RNA, 14 nt, Human
aaugaagcaaugcu

SEQ ID NO: 1922539 - RNA, 21 nt, Human
aaugaaagacuguacaaagua

SEQ ID NO: 1922540 - RNA, 20 nt, Human
aaugaagauacugaaauaaa

SEQ ID NO: 1922541 - RNA, 18 nt, Human
aaugaaagacuguacaaa

SEQ ID NO: 1922542 - RNA, 20 nt, Human
aaugaaagacuguacaaagu

SEQ ID NO: 1922543 - RNA, 12 nt, Human
aaucugacccag

SEQ ID NO: 1922544 - RNA, 13 nt, Human
aaucugacccagu

SEQ ID NO: 1922545 - RNA, 14 nt, Human
aaucugacccagug

SEQ ID NO: 1922546 - RNA, 15 nt, Human
aaucugacccagugc

SEQ ID NO: 1922547 - RNA, 17 nt, Human
aaucugacccagugccc

SEQ ID NO: 1922548 - RNA, 20 nt, Human
aaucugauauguauuguuug

SEQ ID NO: 1922549 - RNA, 23 nt, Human
aauauguggaguucaucuugaau

SEQ ID NO: 1922550 - RNA, 13 nt, Human
aauauuaagaaag

SEQ ID NO: 1922551 - RNA, 13 nt, Human
aauauuaaaucug

SEQ ID NO: 1922552 - RNA, 21 nt, Human
aauauuaaaucugcuggaguu

SEQ ID NO: 1922553 - RNA, 15 nt, Human
aaucacguaaagcua

SEQ ID NO: 1922554 - RNA, 23 nt, Human
aaucaccgaaaacguggcugcuu

SEQ ID NO: 1922555 - RNA, 21 nt, Human
aaucaccgaaaacguggcugc

SEQ ID NO: 1922556 - RNA, 12 nt, Human
aauaaagacagg

SEQ ID NO: 1922557 - RNA, 11 nt, Human
aauaaagacag

SEQ ID NO: 1922558 - RNA, 22 nt, Human
aauaaugugaaacuggauuaaa

SEQ ID NO: 1922559 - RNA, 17 nt, Human
aauaaugugaaacugga

SEQ ID NO: 1922560 - RNA, 14 nt, Human
aauaaagcagcguu

SEQ ID NO: 1922561 - RNA, 11 nt, Human
aauaaagcccu

SEQ ID NO: 1922562 - RNA, 19 nt, Human
aauaauguuaacauggaca

SEQ ID NO: 1922563 - RNA, 15 nt, Human
aauaaagcccuggga

SEQ ID NO: 1922564 - RNA, 12 nt, Human
aagugcugggau

SEQ ID NO: 1922565 - RNA, 17 nt, Human
aaguggacucagggcag

SEQ ID NO: 1922566 - RNA, 22 nt, Human
aaguggaccuuaggccuuccuc

SEQ ID NO: 1922567 - RNA, 16 nt, Human
aaguggaggcacuuua

SEQ ID NO: 1922568 - RNA, 14 nt, Human
aaguggcauaaaaa

SEQ ID NO: 1922569 - RNA, 23 nt, Human
aaguugaauugaggggauuaaua

SEQ ID NO: 1922570 - RNA, 22 nt, Human
aagugcugcauuuaaaagauac

SEQ ID NO: 1922571 - RNA, 13 nt, Human
aagugcugcggag

SEQ ID NO: 1922572 - RNA, 19 nt, Human
aagugcugcggagcaagag

SEQ ID NO: 1922573 - RNA, 22 nt, Human
aagugcuggcaaccacuaagaa

SEQ ID NO: 1922574 - RNA, 23 nt, Human
aagugcuggcaaccacuaagaau

SEQ ID NO: 1922575 - RNA, 21 nt, Human
aagugcugcggagcaagagga

SEQ ID NO: 1922576 - RNA, 22 nt, Human
aaguuguaggcauaaagucagg

SEQ ID NO: 1922577 - RNA, 16 nt, Human
aaguugggacucugga

SEQ ID NO: 1922578 - RNA, 19 nt, Human
aauaaacacucuugaaaaa

SEQ ID NO: 1922579 - RNA, 11 nt, Human
aauaaacacuc

SEQ ID NO: 1922580 - RNA, 16 nt, Human
aauaaacacucuugaa

SEQ ID NO: 1922581 - RNA, 18 nt, Human
aagcgaucacuuccuaua

SEQ ID NO: 1922582 - RNA, 14 nt, Human
aagcgauucuccug

SEQ ID NO: 1922583 - RNA, 14 nt, Human
aagcggcuggcagc

SEQ ID NO: 1922584 - RNA, 15 nt, Human
aagcgugagccacug

SEQ ID NO: 1922585 - RNA, 16 nt, Human
aagcgugagccacugc

SEQ ID NO: 1922586 - RNA, 13 nt, Human
aagcuagaaauga

SEQ ID NO: 1922587 - RNA, 23 nt, Human
aagcuacugugugugugaaugaa

SEQ ID NO: 1922588 - RNA, 13 nt, Human
aagcuacuuauug

SEQ ID NO: 1922589 - RNA, 22 nt, Human
aagcuacugugugugugaauga

SEQ ID NO: 1922590 - RNA, 19 nt, Human
aagcuacugugugugugaa

SEQ ID NO: 1922591 - RNA, 16 nt, Human
aagccagggugugucu

SEQ ID NO: 1922592 - RNA, 24 nt, Human
aagccaggaauuucccaggacccu

SEQ ID NO: 1922593 - RNA, 12 nt, Human
aagauaauuaua

SEQ ID NO: 1922594 - RNA, 23 nt, Human
aagauacaguuacucagaauucu

SEQ ID NO: 1922595 - RNA, 23 nt, Human
aagccaggaauuucccaggaccc

SEQ ID NO: 1922596 - RNA, 17 nt, Human
aagauacaguuacucag

SEQ ID NO: 1922597 - RNA, 19 nt, Human
aagauaauauuaaggaaga

SEQ ID NO: 1922598 - RNA, 21 nt, Human
aagauaauauuaaggaagaca

SEQ ID NO: 1922599 - RNA, 21 nt, Human
aagauaaguguauuuuucaau

SEQ ID NO: 1922600 - RNA, 13 nt, Human
aaggcaaggcugu

SEQ ID NO: 1922601 - RNA, 12 nt, Human
aaggcaacuggg

SEQ ID NO: 1922602 - RNA, 16 nt, Human
aaggcaaggcugucaa

SEQ ID NO: 1922603 - RNA, 15 nt, Human
aaggcaaggcuguca

SEQ ID NO: 1922604 - RNA, 22 nt, Human
aagcuagacgagcaggcuucuu

SEQ ID NO: 1922605 - RNA, 13 nt, Human
aagcugcacccuc

SEQ ID NO: 1922606 - RNA, 19 nt, Human
aagcugcacccucaggcag

SEQ ID NO: 1922607 - RNA, 21 nt, Human
aagacaaggaaaaaauaacaa

SEQ ID NO: 1922608 - RNA, 22 nt, Human
aagacaaugacuuacuguacau

SEQ ID NO: 1922609 - RNA, 19 nt, Human
aagacaaugugaaaagaaa

SEQ ID NO: 1922610 - RNA, 20 nt, Human
aagacaaugugaaaagaaaa

SEQ ID NO: 1922611 - RNA, 23 nt, Human
aagacaauggcuuacuccaggag

SEQ ID NO: 1922612 - RNA, 14 nt, Human
aagacacugaaaua

SEQ ID NO: 1922613 - RNA, 21 nt, Human
aagacacugaaauauacacac

SEQ ID NO: 1922614 - RNA, 22 nt, Human
aagacacugaaauauacacaca

SEQ ID NO: 1922615 - RNA, 21 nt, Human
aagaacuacaaacaaaauuuc

SEQ ID NO: 1922616 - RNA, 20 nt, Human
aagaacuacaaacaaaauuu

SEQ ID NO: 1922617 - RNA, 23 nt, Human
aagaacggggcucuucucauuuc

SEQ ID NO: 1922618 - RNA, 22 nt, Human
aagaacggggcucuucucauuu

SEQ ID NO: 1922619 - RNA, 21 nt, Human
aagaacggggcucuucucauu

SEQ ID NO: 1922620 - RNA, 18 nt, Human
aagaacggggcucuucuc

SEQ ID NO: 1922621 - RNA, 14 nt, Human
aagaaccuggaacu

SEQ ID NO: 1922622 - RNA, 17 nt, Human
aagaacggggcucuucu

SEQ ID NO: 1922623 - RNA, 11 nt, Human
aagaacaugug

SEQ ID NO: 1922624 - RNA, 17 nt, Human
aagaaccagucccccca

SEQ ID NO: 1922625 - RNA, 20 nt, Human
aagaaccaguccccccaccc

SEQ ID NO: 1922626 - RNA, 17 nt, Human
aacgccuccccugcccc

SEQ ID NO: 1922627 - RNA, 18 nt, Human
aacgccuccccugcccca

SEQ ID NO: 1922628 - RNA, 20 nt, Human
aagaacuguguuucaaguuc

SEQ ID NO: 1922629 - RNA, 17 nt, Human
aagaacuucuauaauug

SEQ ID NO: 1922630 - RNA, 17 nt, Human
aagacuuuuccaacccu

SEQ ID NO: 1922631 - RNA, 17 nt, Human
aagagaaaaagaaaugc

SEQ ID NO: 1922632 - RNA, 23 nt, Human
aagaccagagauaguggggagac

SEQ ID NO: 1922633 - RNA, 18 nt, Human
aagagaaaaagaaaugca

SEQ ID NO: 1922634 - RNA, 12 nt, Human
aagacagagucu

SEQ ID NO: 1922635 - RNA, 16 nt, Human
aagacagagcugggau

SEQ ID NO: 1922636 - RNA, 15 nt, Human
aagacagagcuggga

SEQ ID NO: 1922637 - RNA, 23 nt, Human
aagacagauacuccuccaagguu

SEQ ID NO: 1922638 - RNA, 14 nt, Human
aagacaugauuucc

SEQ ID NO: 1922639 - RNA, 15 nt, Human
aagacaugauuuccu

SEQ ID NO: 1922640 - RNA, 16 nt, Human
aagacaugauuuccuu

SEQ ID NO: 1922641 - RNA, 20 nt, Human
aagacaugauuuccuugaau

SEQ ID NO: 1922642 - RNA, 17 nt, Human
aagaccacguuucuaaa

SEQ ID NO: 1922643 - RNA, 15 nt, Human
aagaccacguuucua

SEQ ID NO: 1922644 - RNA, 21 nt, Human
aagacaugauuuccuugaaug

SEQ ID NO: 1922645 - RNA, 18 nt, Human
aagaccaccacuucgaaa

SEQ ID NO: 1922646 - RNA, 21 nt, Human
aagacuuuuccaacccucauc

SEQ ID NO: 1922647 - RNA, 12 nt, Human
aagacuuuucuu

SEQ ID NO: 1922648 - RNA, 19 nt, Human
aagacuuuucuuucagcca

SEQ ID NO: 1922649 - RNA, 13 nt, Human
aagagaaaaaaua

SEQ ID NO: 1922650 - RNA, 12 nt, Human
aagaguguggca

SEQ ID NO: 1922651 - RNA, 22 nt, Human
aagaguguggagucauucucau

SEQ ID NO: 1922652 - RNA, 23 nt, Human
aagaguguggagucauucucauu

SEQ ID NO: 1922653 - RNA, 21 nt, Human
aagaguguggagucauucuca

SEQ ID NO: 1922654 - RNA, 15 nt, Human
aagaguccucugaau

SEQ ID NO: 1922655 - RNA, 18 nt, Human
acugaucaggaccuccaa

SEQ ID NO: 1922656 - RNA, 17 nt, Human
acugauccagcccugag

SEQ ID NO: 1922657 - RNA, 16 nt, Human
acugauccagcccuga

SEQ ID NO: 1922658 - RNA, 23 nt, Human
acugaugggcaacccccagccug

SEQ ID NO: 1922659 - RNA, 20 nt, Human
acugauguaugaggaauuuc

SEQ ID NO: 1922660 - RNA, 14 nt, Human
acugauuacugccu

SEQ ID NO: 1922661 - RNA, 17 nt, Human
acugauuuuuuuuuccu

SEQ ID NO: 1922662 - RNA, 18 nt, Human
acugauuuuuuuuuccuu

SEQ ID NO: 1922663 - RNA, 19 nt, Human
acugauuuuuuuuuccuuc

SEQ ID NO: 1922664 - RNA, 20 nt, Human
acugauuuuuuuuuccuuca

SEQ ID NO: 1922665 - RNA, 16 nt, Human
acugauuuuuuuuucc

SEQ ID NO: 1922666 - RNA, 22 nt, Human
acugauuuccccuuuugcauuc

SEQ ID NO: 1922667 - RNA, 20 nt, Human
acugauuuccccuuuugcau

SEQ ID NO: 1922668 - RNA, 21 nt, Human
acugauuuccccuuuugcauu

SEQ ID NO: 1922669 - RNA, 23 nt, Human
acugauuuccccuuuugcauucu

SEQ ID NO: 1922670 - RNA, 12 nt, Human
acugauuucccc

SEQ ID NO: 1922671 - RNA, 17 nt, Human
acugauuuccccuuuug

SEQ ID NO: 1922672 - RNA, 19 nt, Human
acugauuuccccuuuugca

SEQ ID NO: 1922673 - RNA, 19 nt, Human
acucuacccauauuacaga

SEQ ID NO: 1922674 - RNA, 17 nt, Human
acucuacccauauuaca

SEQ ID NO: 1922675 - RNA, 12 nt, Human
acugaauuucuu

SEQ ID NO: 1922676 - RNA, 20 nt, Human
acugaauuaugaaacuuuug

SEQ ID NO: 1922677 - RNA, 15 nt, Human
acugaauuaugaaac

SEQ ID NO: 1922678 - RNA, 14 nt, Human
acugaauuaugaaa

SEQ ID NO: 1922679 - RNA, 13 nt, Human
acugaauuaugaa

SEQ ID NO: 1922680 - RNA, 18 nt, Human
acugacauuguuggccaa

SEQ ID NO: 1922681 - RNA, 17 nt, Human
acugacauuguuggcca

SEQ ID NO: 1922682 - RNA, 23 nt, Human
acugaauuucuuuugccguuauu

SEQ ID NO: 1922683 - RNA, 15 nt, Human
acucuacagaggcca

SEQ ID NO: 1922684 - RNA, 14 nt, Human
acucccuuucaaca

SEQ ID NO: 1922685 - RNA, 13 nt, Human
acuccggcccucc

SEQ ID NO: 1922686 - RNA, 22 nt, Human
acucccauuccugaagaaccag

SEQ ID NO: 1922687 - RNA, 22 nt, Human
acucccaucugugaaaggaaag

SEQ ID NO: 1922688 - RNA, 13 nt, Human
acucccauuccug

SEQ ID NO: 1922689 - RNA, 16 nt, Human
acucccauuccugaag

SEQ ID NO: 1922690 - RNA, 20 nt, Human
acucccauuccugaagaacc

SEQ ID NO: 1922691 - RNA, 14 nt, Human
acuccggcccuccu

SEQ ID NO: 1922692 - RNA, 15 nt, Human
acuccggcccuccua

SEQ ID NO: 1922693 - RNA, 17 nt, Human
acuguaaaauaauaacu

SEQ ID NO: 1922694 - RNA, 15 nt, Human
acugccuauuuuaau

SEQ ID NO: 1922695 - RNA, 12 nt, Human
acuggaacucuc

SEQ ID NO: 1922696 - RNA, 14 nt, Human
acugccaugccagc

SEQ ID NO: 1922697 - RNA, 16 nt, Human
acugcccauggacagg

SEQ ID NO: 1922698 - RNA, 16 nt, Human
acugcccagcggacag

SEQ ID NO: 1922699 - RNA, 23 nt, Human
acugcccagcggacaguggcagg

SEQ ID NO: 1922700 - RNA, 14 nt, Human
acugcccagcggac

SEQ ID NO: 1922701 - RNA, 18 nt, Human
acugugccaugugccagg

SEQ ID NO: 1922702 - RNA, 17 nt, Human
acugugccaugugccag

SEQ ID NO: 1922703 - RNA, 21 nt, Human
acugucuuuuuuucccuacca

SEQ ID NO: 1922704 - RNA, 22 nt, Human
acugucuuuuuucuaaaguaaa

SEQ ID NO: 1922705 - RNA, 23 nt, Human
acugucuuuuuucuaaaguaaaa

SEQ ID NO: 1922706 - RNA, 16 nt, Human
acugugaagagaacca

SEQ ID NO: 1922707 - RNA, 16 nt, Human
acugucuuuuuucuaa

SEQ ID NO: 1922708 - RNA, 18 nt, Human
acuguaaauaaaaagaaa

SEQ ID NO: 1922709 - RNA, 19 nt, Human
acuguuucaaacuuuacua

SEQ ID NO: 1922710 - RNA, 18 nt, Human
acuguuucaaacuuuacu

SEQ ID NO: 1922711 - RNA, 15 nt, Human
acuguuucaaacuuu

SEQ ID NO: 1922712 - RNA, 22 nt, Human
acuuaaaaaugguuuaaauggu

SEQ ID NO: 1922713 - RNA, 21 nt, Human
acuucagacauagaauuaaca

SEQ ID NO: 1922714 - RNA, 16 nt, Human
acuucaaacugagauc

SEQ ID NO: 1922715 - RNA, 20 nt, Human
acuucuugaaggugcugacg

SEQ ID NO: 1922716 - RNA, 22 nt, Human
acuucuuggcuuggugaggaaa

SEQ ID NO: 1922717 - RNA, 12 nt, Human
acuugaaaauua

SEQ ID NO: 1922718 - RNA, 14 nt, Human
acuugaaaauuaac

SEQ ID NO: 1922719 - RNA, 23 nt, Human
acuuggggggcugaggugggagg

SEQ ID NO: 1922720 - RNA, 13 nt, Human
acuuggucuguga

SEQ ID NO: 1922721 - RNA, 17 nt, Human
accuccaagccacugag

SEQ ID NO: 1922722 - RNA, 21 nt, Human
accucaggugauccacccacc

SEQ ID NO: 1922723 - RNA, 20 nt, Human
accucaggugauccacccac

SEQ ID NO: 1922724 - RNA, 11 nt, Human
accucaggccu

SEQ ID NO: 1922725 - RNA, 11 nt, Human
accucagccug

SEQ ID NO: 1922726 - RNA, 13 nt, Human
accucagccuggc

SEQ ID NO: 1922727 - RNA, 14 nt, Human
accucagccuggcc

SEQ ID NO: 1922728 - RNA, 15 nt, Human
accucagccuggcca

SEQ ID NO: 1922729 - RNA, 16 nt, Human
accucagccuggccag

SEQ ID NO: 1922730 - RNA, 17 nt, Human
accucagccuggccaga

SEQ ID NO: 1922731 - RNA, 19 nt, Human
accucagccuggccagaca

SEQ ID NO: 1922732 - RNA, 20 nt, Human
accucagccuggccagacac

SEQ ID NO: 1922733 - RNA, 21 nt, Human
accucagccuggccagacaca

SEQ ID NO: 1922734 - RNA, 16 nt, Human
accgggcacucagaag

SEQ ID NO: 1922735 - RNA, 20 nt, Human
accgggccacagagaaagua

SEQ ID NO: 1922736 - RNA, 14 nt, Human
accgggcacucaga

SEQ ID NO: 1922737 - RNA, 12 nt, Human
accgggcacuca

SEQ ID NO: 1922738 - RNA, 17 nt, Human
acccugugauggggccc

SEQ ID NO: 1922739 - RNA, 19 nt, Human
acccugugauggggcccug

SEQ ID NO: 1922740 - RNA, 20 nt, Human
acccugugauggggcccugc

SEQ ID NO: 1922741 - RNA, 21 nt, Human
acccugugauggggcccugcc

SEQ ID NO: 1922742 - RNA, 11 nt, Human
accucagccuc

SEQ ID NO: 1922743 - RNA, 12 nt, Human
accucagccucc

SEQ ID NO: 1922744 - RNA, 23 nt, Human
accgugaggccagagacacaagc

SEQ ID NO: 1922745 - RNA, 18 nt, Human
accgugaggccagagaca

SEQ ID NO: 1922746 - RNA, 23 nt, Human
acccuauauuuugcauaguacca

SEQ ID NO: 1922747 - RNA, 13 nt, Human
acccuauugcugc

SEQ ID NO: 1922748 - RNA, 21 nt, Human
acccucaaccucuucuggcuc

SEQ ID NO: 1922749 - RNA, 14 nt, Human
acccuauugcugcu

SEQ ID NO: 1922750 - RNA, 19 nt, Human
acccuauugcugcuugagg

SEQ ID NO: 1922751 - RNA, 19 nt, Human
acccuaaaaagcagagcuu

SEQ ID NO: 1922752 - RNA, 22 nt, Human
acccuaaggucauuaccacagg

SEQ ID NO: 1922753 - RNA, 21 nt, Human
acccuaauagacuaaaugaaa

SEQ ID NO: 1922754 - RNA, 13 nt, Human
acccuggagccca

SEQ ID NO: 1922755 - RNA, 23 nt, Human
acccuggcacuauaauguaagcu

SEQ ID NO: 1922756 - RNA, 23 nt, Human
acccucaucaccaacgucugugc

SEQ ID NO: 1922757 - RNA, 13 nt, Human
acccucaggcagg

SEQ ID NO: 1922758 - RNA, 14 nt, Human
acccucaggcaggu

SEQ ID NO: 1922759 - RNA, 13 nt, Human
acccucaucacca

SEQ ID NO: 1922760 - RNA, 15 nt, Human
acccucaggcaggug

SEQ ID NO: 1922761 - RNA, 16 nt, Human
acccucaggcaggugg

SEQ ID NO: 1922762 - RNA, 15 nt, Human
acccugggccuggca

SEQ ID NO: 1922763 - RNA, 22 nt, Human
acccugggccuggcagcucagc

SEQ ID NO: 1922764 - RNA, 16 nt, Human
acccuggggagaaagu

SEQ ID NO: 1922765 - RNA, 18 nt, Human
acccuggccgaguccaag

SEQ ID NO: 1922766 - RNA, 21 nt, Human
acccuggccgaguccaagcug

SEQ ID NO: 1922767 - RNA, 22 nt, Human
acccuggccgaguccaagcugg

SEQ ID NO: 1922768 - RNA, 16 nt, Human
acccuggccugagaag

SEQ ID NO: 1922769 - RNA, 23 nt, Human
acccugggaccuaggggcgccgc

SEQ ID NO: 1922770 - RNA, 12 nt, Human
acccugggaccu

SEQ ID NO: 1922771 - RNA, 16 nt, Human
acccugugauggggcc

SEQ ID NO: 1922772 - RNA, 21 nt, Human
acccugucucuacuaaaaaua

SEQ ID NO: 1922773 - RNA, 15 nt, Human
acccuggugggccaa

SEQ ID NO: 1922774 - RNA, 17 nt, Human
acccuggugguugcugu

SEQ ID NO: 1922775 - RNA, 18 nt, Human
acccuggugguugcuguu

SEQ ID NO: 1922776 - RNA, 19 nt, Human
acccuggugguugcuguuu

SEQ ID NO: 1922777 - RNA, 20 nt, Human
acccuguauauagcccagcc

SEQ ID NO: 1922778 - RNA, 15 nt, Human
acccuguauauagcc

SEQ ID NO: 1922779 - RNA, 18 nt, Human
acccuguauauagcccag

SEQ ID NO: 1922780 - RNA, 11 nt, Human
accuguaauca

SEQ ID NO: 1922781 - RNA, 14 nt, Human
accuguaaucccag

SEQ ID NO: 1922782 - RNA, 15 nt, Human
accuguaaucccagc

SEQ ID NO: 1922783 - RNA, 16 nt, Human
accuguaaucccagca

SEQ ID NO: 1922784 - RNA, 19 nt, Human
accuguaaucccagcacuu

SEQ ID NO: 1922785 - RNA, 19 nt, Human
accuguaaucccagcuacu

SEQ ID NO: 1922786 - RNA, 20 nt, Human
accuguaaucccagcuacuu

SEQ ID NO: 1922787 - RNA, 17 nt, Human
accuguggccaaguucu

SEQ ID NO: 1922788 - RNA, 21 nt, Human
accugccaggaagccagcagg

SEQ ID NO: 1922789 - RNA, 22 nt, Human
accugccaggaagccagcaggc

SEQ ID NO: 1922790 - RNA, 23 nt, Human
accugccaggaagccagcaggcu

SEQ ID NO: 1922791 - RNA, 12 nt, Human
accugccccuca

SEQ ID NO: 1922792 - RNA, 15 nt, Human
accugccccucaacu

SEQ ID NO: 1922793 - RNA, 20 nt, Human
accugccccucaacucuccu

SEQ ID NO: 1922794 - RNA, 12 nt, Human
accucugugugc

SEQ ID NO: 1922795 - RNA, 11 nt, Human
accucugugug

SEQ ID NO: 1922796 - RNA, 15 nt, Human
accucugugugcucc

SEQ ID NO: 1922797 - RNA, 23 nt, Human
accucugccugaagucacacagu

SEQ ID NO: 1922798 - RNA, 20 nt, Human
accucugccugaagucacac

SEQ ID NO: 1922799 - RNA, 12 nt, Human
accucugccuga

SEQ ID NO: 1922800 - RNA, 22 nt, Human
accuuggcaccagacacccagg

SEQ ID NO: 1922801 - RNA, 14 nt, Human
accuuggcaccaga

SEQ ID NO: 1922802 - RNA, 16 nt, Human
accuuggcaccagaca

SEQ ID NO: 1922803 - RNA, 17 nt, Human
accuuggcaccagacac

SEQ ID NO: 1922804 - RNA, 18 nt, Human
accuuggcaccagacacc

SEQ ID NO: 1922805 - RNA, 15 nt, Human
acgcacaugcgaccc

SEQ ID NO: 1922806 - RNA, 18 nt, Human
acgcaaacuuugagccuu

SEQ ID NO: 1922807 - RNA, 19 nt, Human
acgauuucuguuuagauaa

SEQ ID NO: 1922808 - RNA, 23 nt, Human
acgauuucuguuuagauaauaca

SEQ ID NO: 1922809 - RNA, 20 nt, Human
acgauuucuguuuagauaau

SEQ ID NO: 1922810 - RNA, 19 nt, Human
acggaauaguuggcuagga

SEQ ID NO: 1922811 - RNA, 17 nt, Human
acggacacucaaaagcu

SEQ ID NO: 1922812 - RNA, 19 nt, Human
acggacacucaaaagcugg

SEQ ID NO: 1922813 - RNA, 15 nt, Human
acggacacccccucg

SEQ ID NO: 1922814 - RNA, 16 nt, Human
acggacacccccucgc

SEQ ID NO: 1922815 - RNA, 12 nt, Human
acgucugugcca

SEQ ID NO: 1922816 - RNA, 13 nt, Human
acgucugugccau

SEQ ID NO: 1922817 - RNA, 14 nt, Human
acgucuuaaauauu

SEQ ID NO: 1922818 - RNA, 13 nt, Human
acgucuuaaauau

SEQ ID NO: 1922819 - RNA, 12 nt, Human
acgucuucuaaa

SEQ ID NO: 1922820 - RNA, 14 nt, Human
acgcaccugccuca

SEQ ID NO: 1922821 - RNA, 15 nt, Human
acgcaccugccucag

SEQ ID NO: 1922822 - RNA, 16 nt, Human
acgcaccugccucagg

SEQ ID NO: 1922823 - RNA, 15 nt, Human
acgcagccaggacac

SEQ ID NO: 1922824 - RNA, 22 nt, Human
acgcugugcugcccugcccacc

SEQ ID NO: 1922825 - RNA, 19 nt, Human
acgcugugcugcccugccc

SEQ ID NO: 1922826 - RNA, 18 nt, Human
acuaauggggcggugaga

SEQ ID NO: 1922827 - RNA, 20 nt, Human
acuaauguguaagacaaaaa

SEQ ID NO: 1922828 - RNA, 13 nt, Human
acuaauuccacac

SEQ ID NO: 1922829 - RNA, 13 nt, Human
acaggcagagcug

SEQ ID NO: 1922830 - RNA, 23 nt, Human
acagugaucaaguuauuuuuaau

SEQ ID NO: 1922831 - RNA, 23 nt, Human
acaggcacccaccaucaugucug

SEQ ID NO: 1922832 - RNA, 19 nt, Human
acagugauuaccagggacu

SEQ ID NO: 1922833 - RNA, 18 nt, Human
acaguggaaccagcccag

SEQ ID NO: 1922834 - RNA, 12 nt, Human
acaguggcagga

SEQ ID NO: 1922835 - RNA, 13 nt, Human
acaguggcaggac

SEQ ID NO: 1922836 - RNA, 18 nt, Human
acaguggcaggacaggaa

SEQ ID NO: 1922837 - RNA, 20 nt, Human
acaguggcaggacaggaaaa

SEQ ID NO: 1922838 - RNA, 17 nt, Human
acaggcaaugcuggcug

SEQ ID NO: 1922839 - RNA, 14 nt, Human
acaggcacccacca

SEQ ID NO: 1922840 - RNA, 16 nt, Human
acaggcaaugcuggcu

SEQ ID NO: 1922841 - RNA, 15 nt, Human
acaggcaaugcuggc

SEQ ID NO: 1922842 - RNA, 20 nt, Human
acagcucuucuccaggcugu

SEQ ID NO: 1922843 - RNA, 16 nt, Human
acagcugaauuaucua

SEQ ID NO: 1922844 - RNA, 19 nt, Human
acagcucuucuccaggcug

SEQ ID NO: 1922845 - RNA, 14 nt, Human
acaugcgaccccga

SEQ ID NO: 1922846 - RNA, 20 nt, Human
acaugccucucucaggccaa

SEQ ID NO: 1922847 - RNA, 17 nt, Human
acaugcgguagccagca

SEQ ID NO: 1922848 - RNA, 22 nt, Human
acaugugccagggcaaugauga

SEQ ID NO: 1922849 - RNA, 23 nt, Human
acaugugguuacacagugugaau

SEQ ID NO: 1922850 - RNA, 13 nt, Human
acaugcacgugug

SEQ ID NO: 1922851 - RNA, 18 nt, Human
acaugcacucagcucuug

SEQ ID NO: 1922852 - RNA, 17 nt, Human
acaugcacucagcucuu

SEQ ID NO: 1922853 - RNA, 19 nt, Human
acauccaaagcagacagcu

SEQ ID NO: 1922854 - RNA, 18 nt, Human
acauccccccgccaaaag

SEQ ID NO: 1922855 - RNA, 16 nt, Human
acauacaauuccaaac

SEQ ID NO: 1922856 - RNA, 20 nt, Human
acauacaggaagguagaaau

SEQ ID NO: 1922857 - RNA, 13 nt, Human
acauacaccagca

SEQ ID NO: 1922858 - RNA, 14 nt, Human
acauacaccagcau

SEQ ID NO: 1922859 - RNA, 15 nt, Human
acauacaccagcauu

SEQ ID NO: 1922860 - RNA, 21 nt, Human
acauccaaaauaguuaagaca

SEQ ID NO: 1922861 - RNA, 15 nt, Human
acauccaaagcagac

SEQ ID NO: 1922862 - RNA, 16 nt, Human
acauccaaagcagaca

SEQ ID NO: 1922863 - RNA, 17 nt, Human
acauccaaagcagacag

SEQ ID NO: 1922864 - RNA, 18 nt, Human
acauccaaagcagacagc

SEQ ID NO: 1922865 - RNA, 20 nt, Human
acauaaguauuuaauucaug

SEQ ID NO: 1922866 - RNA, 15 nt, Human
acauaagauaaaugu

SEQ ID NO: 1922867 - RNA, 20 nt, Human
acauaaauuuaguauuuugu

SEQ ID NO: 1922868 - RNA, 18 nt, Human
acauguguagccugugca

SEQ ID NO: 1922869 - RNA, 17 nt, Human
acauguguagccugugc

SEQ ID NO: 1922870 - RNA, 20 nt, Human
acauguguagccugugcaug

SEQ ID NO: 1922871 - RNA, 17 nt, Human
acauguuaaacuuacuu

SEQ ID NO: 1922872 - RNA, 19 nt, Human
acauguuuuucuucucccu

SEQ ID NO: 1922873 - RNA, 14 nt, Human
accaacgucugugc

SEQ ID NO: 1922874 - RNA, 17 nt, Human
accaacgucugugccau

SEQ ID NO: 1922875 - RNA, 19 nt, Human
acauuucuuugugcuuugg

SEQ ID NO: 1922876 - RNA, 16 nt, Human
accacgcuggaccuug

SEQ ID NO: 1922877 - RNA, 14 nt, Human
accacgcuggaccu

SEQ ID NO: 1922878 - RNA, 18 nt, Human
accacgcuggaccuugaa

SEQ ID NO: 1922879 - RNA, 14 nt, Human
accacguuucuaaa

SEQ ID NO: 1922880 - RNA, 13 nt, Human
accacguuucuaa

SEQ ID NO: 1922881 - RNA, 21 nt, Human
accaacgucugugccauuuug

SEQ ID NO: 1922882 - RNA, 17 nt, Human
accaccagaagcccaga

SEQ ID NO: 1922883 - RNA, 16 nt, Human
accaccagaagcccag

SEQ ID NO: 1922884 - RNA, 15 nt, Human
accaccagaagccca

SEQ ID NO: 1922885 - RNA, 18 nt, Human
accaagccuggucagccc

SEQ ID NO: 1922886 - RNA, 13 nt, Human
accagagcugcca

SEQ ID NO: 1922887 - RNA, 12 nt, Human
accagagcugcc

SEQ ID NO: 1922888 - RNA, 14 nt, Human
accagagcugccac

SEQ ID NO: 1922889 - RNA, 16 nt, Human
accagagcugccaccu

SEQ ID NO: 1922890 - RNA, 13 nt, Human
aauucuaaaugaa

SEQ ID NO: 1922891 - RNA, 19 nt, Human
aauucuaaaugaauguuua

SEQ ID NO: 1922892 - RNA, 14 nt, Human
aauucuaacuuuuu

SEQ ID NO: 1922893 - RNA, 14 nt, Human
aauucuacuuugag

SEQ ID NO: 1922894 - RNA, 19 nt, Human
aauucucagaaucucaaau

SEQ ID NO: 1922895 - RNA, 22 nt, Human
aauucuauaaggccauaaaaca

SEQ ID NO: 1922896 - RNA, 16 nt, Human
aauucuauaaggccau

SEQ ID NO: 1922897 - RNA, 21 nt, Human
aauucucauuugucacacacu

SEQ ID NO: 1922898 - RNA, 17 nt, Human
aauucucuaguuugauu

SEQ ID NO: 1922899 - RNA, 15 nt, Human
aauucucuaguuuga

SEQ ID NO: 1922900 - RNA, 15 nt, Human
aauucucuuauccaa

SEQ ID NO: 1922901 - RNA, 14 nt, Human
aauucuguuuuucu

SEQ ID NO: 1922902 - RNA, 18 nt, Human
aauucuguuuuucuaggc

SEQ ID NO: 1922903 - RNA, 22 nt, Human
aauuggauacgacaacuugcac

SEQ ID NO: 1922904 - RNA, 13 nt, Human
aauucuuaaauau

SEQ ID NO: 1922905 - RNA, 22 nt, Human
aauuguaaggaaugauuaauua

SEQ ID NO: 1922906 - RNA, 19 nt, Human
aauuaucaagcuaauaaaa

SEQ ID NO: 1922907 - RNA, 19 nt, Human
aauuaucuaauuuauaaaa

SEQ ID NO: 1922908 - RNA, 14 nt, Human
aauuaucuauacau

SEQ ID NO: 1922909 - RNA, 16 nt, Human
aauuaucuauacauau

SEQ ID NO: 1922910 - RNA, 18 nt, Human
aauuaucuaauuuauaaa

SEQ ID NO: 1922911 - RNA, 15 nt, Human
aauuaucuaauuuau

SEQ ID NO: 1922912 - RNA, 14 nt, Human
aauuaucuaauuua

SEQ ID NO: 1922913 - RNA, 19 nt, Human
aauuaugaguuauuuuuau

SEQ ID NO: 1922914 - RNA, 18 nt, Human
aauuaugaaacuuuugga

SEQ ID NO: 1922915 - RNA, 15 nt, Human
aauuaugaaacuuuu

SEQ ID NO: 1922916 - RNA, 13 nt, Human
aauuaugaaacuu

SEQ ID NO: 1922917 - RNA, 12 nt, Human
aauuaugaaacu

SEQ ID NO: 1922918 - RNA, 17 nt, Human
aauuccucuuugcuuug

SEQ ID NO: 1922919 - RNA, 18 nt, Human
aauuccucuuugcuuugc

SEQ ID NO: 1922920 - RNA, 19 nt, Human
aauuccucuuugcuuugcu

SEQ ID NO: 1922921 - RNA, 22 nt, Human
aauuaucuauacauaucuuuau

SEQ ID NO: 1922922 - RNA, 16 nt, Human
aauuaucaagcuaaua

SEQ ID NO: 1922923 - RNA, 15 nt, Human
aauuaucaagcuaau

SEQ ID NO: 1922924 - RNA, 11 nt, Human
aauuguaauag

SEQ ID NO: 1922925 - RNA, 21 nt, Human
aauuuccacucaggucuguuu

SEQ ID NO: 1922926 - RNA, 15 nt, Human
aauuucccaaagcag

SEQ ID NO: 1922927 - RNA, 17 nt, Human
aauuucccaaagcagug

SEQ ID NO: 1922928 - RNA, 12 nt, Human
aauuucccagga

SEQ ID NO: 1922929 - RNA, 14 nt, Human
aauuucccaggacc

SEQ ID NO: 1922930 - RNA, 15 nt, Human
aauuucccaggaccc

SEQ ID NO: 1922931 - RNA, 16 nt, Human
aauuucccaggacccu

SEQ ID NO: 1922932 - RNA, 17 nt, Human
aauuucccaggacccug

SEQ ID NO: 1922933 - RNA, 21 nt, Human
aauuucccaggacccugaagg

SEQ ID NO: 1922934 - RNA, 22 nt, Human
aauuucccaggacccugaaggg

SEQ ID NO: 1922935 - RNA, 15 nt, Human
aauuuccugggagcu

SEQ ID NO: 1922936 - RNA, 12 nt, Human
aauuuccuggga

SEQ ID NO: 1922937 - RNA, 13 nt, Human
acacgcaggagca

SEQ ID NO: 1922938 - RNA, 14 nt, Human
acacgcaggagcac

SEQ ID NO: 1922939 - RNA, 15 nt, Human
acacgcaggagcaca

SEQ ID NO: 1922940 - RNA, 13 nt, Human
acacgcaccugcc

SEQ ID NO: 1922941 - RNA, 19 nt, Human
acaccagcauuccuuuuga

SEQ ID NO: 1922942 - RNA, 14 nt, Human
acaccagcauuccu

SEQ ID NO: 1922943 - RNA, 16 nt, Human
acaccagcauuccuuu

SEQ ID NO: 1922944 - RNA, 14 nt, Human
acacgcaccugccu

SEQ ID NO: 1922945 - RNA, 16 nt, Human
acacgcaccugccuca

SEQ ID NO: 1922946 - RNA, 17 nt, Human
acacgcaccugccucag

SEQ ID NO: 1922947 - RNA, 12 nt, Human
acacguguccug

SEQ ID NO: 1922948 - RNA, 13 nt, Human
acaccagagccca

SEQ ID NO: 1922949 - RNA, 15 nt, Human
acaccaauauucaua

SEQ ID NO: 1922950 - RNA, 23 nt, Human
acaccagagcccaccuuggcuca

SEQ ID NO: 1922951 - RNA, 18 nt, Human
acaccagagcccaccuug

SEQ ID NO: 1922952 - RNA, 18 nt, Human
acacagcucuucuccagg

SEQ ID NO: 1922953 - RNA, 16 nt, Human
acaccaagcacagcag

SEQ ID NO: 1922954 - RNA, 18 nt, Human
acaccaagcacagcagcc

SEQ ID NO: 1922955 - RNA, 19 nt, Human
acaccaagcacagcagccu

SEQ ID NO: 1922956 - RNA, 20 nt, Human
acaccaagcacagcagccug

SEQ ID NO: 1922957 - RNA, 21 nt, Human
acaccaagcacagcagccugg

SEQ ID NO: 1922958 - RNA, 16 nt, Human
acacagcucuucucca

SEQ ID NO: 1922959 - RNA, 14 nt, Human
acacagcucuucuc

SEQ ID NO: 1922960 - RNA, 18 nt, Human
acacagaaaauguugaga

SEQ ID NO: 1922961 - RNA, 19 nt, Human
acacagaaaauguugagaa

SEQ ID NO: 1922962 - RNA, 20 nt, Human
acacagaaaauguugagaau

SEQ ID NO: 1922963 - RNA, 21 nt, Human
acaagguaccccuuucuggcu

SEQ ID NO: 1922964 - RNA, 23 nt, Human
acaagguccucugucagucacag

SEQ ID NO: 1922965 - RNA, 15 nt, Human
acaaguuaaauaaau

SEQ ID NO: 1922966 - RNA, 18 nt, Human
acaaguggcaaccugcuu

SEQ ID NO: 1922967 - RNA, 13 nt, Human
acaagugguggua

SEQ ID NO: 1922968 - RNA, 18 nt, Human
acaaguggacucagggca

SEQ ID NO: 1922969 - RNA, 19 nt, Human
acaaguggacucagggcag

SEQ ID NO: 1922970 - RNA, 15 nt, Human
acaaguggacucagg

SEQ ID NO: 1922971 - RNA, 16 nt, Human
acaaggcaaggcuguc

SEQ ID NO: 1922972 - RNA, 17 nt, Human
acaaggcaaggcuguca

SEQ ID NO: 1922973 - RNA, 19 nt, Human
acaaggcaaggcugucaau

SEQ ID NO: 1922974 - RNA, 20 nt, Human
acaaggcaaggcugucaauu

SEQ ID NO: 1922975 - RNA, 22 nt, Human
acaacugccucgaaacacagaa

SEQ ID NO: 1922976 - RNA, 21 nt, Human
acaacugccucgaaacacaga

SEQ ID NO: 1922977 - RNA, 22 nt, Human
acaacauguauaauauuuuuaa

SEQ ID NO: 1922978 - RNA, 18 nt, Human
acaaccacauacaacaca

SEQ ID NO: 1922979 - RNA, 15 nt, Human
acaaacucucugaac

SEQ ID NO: 1922980 - RNA, 22 nt, Human
acaaacucucugaaccccuccc

SEQ ID NO: 1922981 - RNA, 13 nt, Human
acaaacuguaaau

SEQ ID NO: 1922982 - RNA, 19 nt, Human
acaaacaugugguuaaugc

SEQ ID NO: 1922983 - RNA, 14 nt, Human
acaaacauaagugc

SEQ ID NO: 1922984 - RNA, 21 nt, Human
aucaaaacuuucuuuucugga

SEQ ID NO: 1922985 - RNA, 15 nt, Human
aucaaaacuuucuuu

SEQ ID NO: 1922986 - RNA, 14 nt, Human
aucaaaagaaagaa

SEQ ID NO: 1922987 - RNA, 19 nt, Human
auauuuuuuucugaaauuu

SEQ ID NO: 1922988 - RNA, 18 nt, Human
auauuuuuuucuuuucuu

SEQ ID NO: 1922989 - RNA, 18 nt, Human
auauuuuuuucugaaauu

SEQ ID NO: 1922990 - RNA, 16 nt, Human
auauuuuuuucugaaa

SEQ ID NO: 1922991 - RNA, 14 nt, Human
auauuuuuuucuga

SEQ ID NO: 1922992 - RNA, 24 nt, Human
aucaaaagguuaauaaaguaauua

SEQ ID NO: 1922993 - RNA, 20 nt, Human
aucaaaagguuaauaaagua

SEQ ID NO: 1922994 - RNA, 19 nt, Human
aucaaagagguuuuaaaaa

SEQ ID NO: 1922995 - RNA, 14 nt, Human
auagcacagacccu

SEQ ID NO: 1922996 - RNA, 14 nt, Human
aucauccagaaguu

SEQ ID NO: 1922997 - RNA, 15 nt, Human
aucauccuaagcuau

SEQ ID NO: 1922998 - RNA, 20 nt, Human
aucaugacaaagacugagua

SEQ ID NO: 1922999 - RNA, 12 nt, Human
aucauccuacug

SEQ ID NO: 1923000 - RNA, 19 nt, Human
aucauggagguuugaagau

SEQ ID NO: 1923001 - RNA, 17 nt, Human
aucaugaccagcaaaua

SEQ ID NO: 1923002 - RNA, 12 nt, Human
aucaugcccugu

SEQ ID NO: 1923003 - RNA, 14 nt, Human
auccacuucuuuca

SEQ ID NO: 1923004 - RNA, 22 nt, Human
auccacuucuuucagcagacug

SEQ ID NO: 1923005 - RNA, 23 nt, Human
auccacuuuaucuugaauaaugu

SEQ ID NO: 1923006 - RNA, 21 nt, Human
auccacugugccaugugccag

SEQ ID NO: 1923007 - RNA, 12 nt, Human
auccagccuggg

SEQ ID NO: 1923008 - RNA, 21 nt, Human
auccagcccugaguuccuagc

SEQ ID NO: 1923009 - RNA, 12 nt, Human
auccagggacag

SEQ ID NO: 1923010 - RNA, 13 nt, Human
auccagggacaga

SEQ ID NO: 1923011 - RNA, 14 nt, Human
auccagggacagag

SEQ ID NO: 1923012 - RNA, 16 nt, Human
auccagggacagaggc

SEQ ID NO: 1923013 - RNA, 19 nt, Human
auccagggacagaggcccc

SEQ ID NO: 1923014 - RNA, 20 nt, Human
auccagggacagaggcccca

SEQ ID NO: 1923015 - RNA, 21 nt, Human
auccagggacagaggccccag

SEQ ID NO: 1923016 - RNA, 17 nt, Human
auccagccuggggucug

SEQ ID NO: 1923017 - RNA, 22 nt, Human
auccaggcagauccaggacuau

SEQ ID NO: 1923018 - RNA, 19 nt, Human
auccaggcagauccaggac

SEQ ID NO: 1923019 - RNA, 18 nt, Human
aucgaaucuacuaauucc

SEQ ID NO: 1923020 - RNA, 20 nt, Human
aucgaaucuacuaauuccac

SEQ ID NO: 1923021 - RNA, 13 nt, Human
auccuuuuuuaaa

SEQ ID NO: 1923022 - RNA, 22 nt, Human
auccuuuuuuaaaaguaaaugu

SEQ ID NO: 1923023 - RNA, 16 nt, Human
auccuuuuuuaaaagu

SEQ ID NO: 1923024 - RNA, 15 nt, Human
aucgaaccguuuuga

SEQ ID NO: 1923025 - RNA, 19 nt, Human
aucccccccaccucucccu

SEQ ID NO: 1923026 - RNA, 17 nt, Human
auccuuccucacaccag

SEQ ID NO: 1923027 - RNA, 18 nt, Human
auccccgcagugugcacu

SEQ ID NO: 1923028 - RNA, 22 nt, Human
aucuaggaagacuuuggaaaga

SEQ ID NO: 1923029 - RNA, 15 nt, Human
auggaguucuugugc

SEQ ID NO: 1923030 - RNA, 15 nt, Human
augggacagggagga

SEQ ID NO: 1923031 - RNA, 22 nt, Human
augggacaaaguuccaaaaugc

SEQ ID NO: 1923032 - RNA, 13 nt, Human
augggaaaguauu

SEQ ID NO: 1923033 - RNA, 21 nt, Human
augggaaaguauucuguacuc

SEQ ID NO: 1923034 - RNA, 16 nt, Human
augcuuugaucccuuc

SEQ ID NO: 1923035 - RNA, 18 nt, Human
auggagagaaaacagacc

SEQ ID NO: 1923036 - RNA, 22 nt, Human
augcuuucugaagcuuuaccag

SEQ ID NO: 1923037 - RNA, 11 nt, Human
auggagccagc

SEQ ID NO: 1923038 - RNA, 20 nt, Human
auggagauucaguuuucauu

SEQ ID NO: 1923039 - RNA, 23 nt, Human
auggagccagcucccucuauuua

SEQ ID NO: 1923040 - RNA, 15 nt, Human
auggagccagcuccc

SEQ ID NO: 1923041 - RNA, 18 nt, Human
auggagccagcucccucu

SEQ ID NO: 1923042 - RNA, 19 nt, Human
auggagauucaguuuucau

SEQ ID NO: 1923043 - RNA, 23 nt, Human
auggagauagccccacaggaggu

SEQ ID NO: 1923044 - RNA, 14 nt, Human
augcuucuucagag

SEQ ID NO: 1923045 - RNA, 17 nt, Human
augcuucuucagagacu

SEQ ID NO: 1923046 - RNA, 20 nt, Human
augcuucuucagagacuccu

SEQ ID NO: 1923047 - RNA, 22 nt, Human
augcuucuucagagacuccugc

SEQ ID NO: 1923048 - RNA, 18 nt, Human
augcucugcauguuacau

SEQ ID NO: 1923049 - RNA, 19 nt, Human
augcucugcauguuacaua

SEQ ID NO: 1923050 - RNA, 24 nt, Human
augcauauuauuuuauguugcaua

SEQ ID NO: 1923051 - RNA, 16 nt, Human
augcauggugccccag

SEQ ID NO: 1923052 - RNA, 17 nt, Human
augcauggugccccagg

SEQ ID NO: 1923053 - RNA, 18 nt, Human
augcauggugccccagga

SEQ ID NO: 1923054 - RNA, 19 nt, Human
augcauggugccccaggac

SEQ ID NO: 1923055 - RNA, 20 nt, Human
augcauggugccccaggacc

SEQ ID NO: 1923056 - RNA, 14 nt, Human
augcaucuagauua

SEQ ID NO: 1923057 - RNA, 21 nt, Human
augccugguggcagcugcggu

SEQ ID NO: 1923058 - RNA, 18 nt, Human
augccugguggcagcugc

SEQ ID NO: 1923059 - RNA, 19 nt, Human
augccugguggcagcugcg

SEQ ID NO: 1923060 - RNA, 14 nt, Human
augccugguggcag

SEQ ID NO: 1923061 - RNA, 13 nt, Human
augccugguggca

SEQ ID NO: 1923062 - RNA, 12 nt, Human
augccugguggc

SEQ ID NO: 1923063 - RNA, 11 nt, Human
augccuggugg

SEQ ID NO: 1923064 - RNA, 21 nt, Human
augcauggugccccaggacca

SEQ ID NO: 1923065 - RNA, 22 nt, Human
augcauggugccccaggaccag

SEQ ID NO: 1923066 - RNA, 23 nt, Human
augaaguuuuuuuuauacaggau

SEQ ID NO: 1923067 - RNA, 21 nt, Human
augaaguaauaugcacacauu

SEQ ID NO: 1923068 - RNA, 14 nt, Human
augaaguaauaugc

SEQ ID NO: 1923069 - RNA, 23 nt, Human
augaaguaauaugcacacauuuu

SEQ ID NO: 1923070 - RNA, 13 nt, Human
augaaguacucau

SEQ ID NO: 1923071 - RNA, 23 nt, Human
augaagcauuuacuuuguguuca

SEQ ID NO: 1923072 - RNA, 12 nt, Human
augaaagacugu

SEQ ID NO: 1923073 - RNA, 16 nt, Human
augaaacuuuuggaag

SEQ ID NO: 1923074 - RNA, 13 nt, Human
augaaacuuggau

SEQ ID NO: 1923075 - RNA, 19 nt, Human
augagccucagcauccugg

SEQ ID NO: 1923076 - RNA, 21 nt, Human
augagccucagcauccuggca

SEQ ID NO: 1923077 - RNA, 11 nt, Human
augagccuggc

SEQ ID NO: 1923078 - RNA, 12 nt, Human
augagccuggca

SEQ ID NO: 1923079 - RNA, 13 nt, Human
augaccuuucaau

SEQ ID NO: 1923080 - RNA, 18 nt, Human
augaccuucuaggaagcu

SEQ ID NO: 1923081 - RNA, 17 nt, Human
augaccuucuaggaagc

SEQ ID NO: 1923082 - RNA, 15 nt, Human
augaccuuucaauag

SEQ ID NO: 1923083 - RNA, 18 nt, Human
augaccuuucaauaggaa

SEQ ID NO: 1923084 - RNA, 18 nt, Human
augagcugugcacaaagu

SEQ ID NO: 1923085 - RNA, 22 nt, Human
augagcugugcacaaaguggca

SEQ ID NO: 1923086 - RNA, 22 nt, Human
augaggcugcuuuccaaagcca

SEQ ID NO: 1923087 - RNA, 19 nt, Human
aucuaggauuuuaagggaa

SEQ ID NO: 1923088 - RNA, 11 nt, Human
aucuaggauuu

SEQ ID NO: 1923089 - RNA, 23 nt, Human
aucuaggaagacuuuggaaagag

SEQ ID NO: 1923090 - RNA, 22 nt, Human
agucauuugcugagcauguacu

SEQ ID NO: 1923091 - RNA, 19 nt, Human
agucauuugcugagcaugu

SEQ ID NO: 1923092 - RNA, 12 nt, Human
aguccucugaau

SEQ ID NO: 1923093 - RNA, 14 nt, Human
aguccucugaauga

SEQ ID NO: 1923094 - RNA, 14 nt, Human
aguccucuuuucug

SEQ ID NO: 1923095 - RNA, 16 nt, Human
aguccuuaccagcaga

SEQ ID NO: 1923096 - RNA, 18 nt, Human
aguccuuaccagcagagc

SEQ ID NO: 1923097 - RNA, 15 nt, Human
agucuguccaggcuc

SEQ ID NO: 1923098 - RNA, 18 nt, Human
agucuggcccuuccuuuu

SEQ ID NO: 1923099 - RNA, 16 nt, Human
agucgaggacagggag

SEQ ID NO: 1923100 - RNA, 16 nt, Human
aguccuuuuuuuccau

SEQ ID NO: 1923101 - RNA, 21 nt, Human
aguccuuuuuuuccaucuuua

SEQ ID NO: 1923102 - RNA, 22 nt, Human
agucugauucccaagcucugcu

SEQ ID NO: 1923103 - RNA, 21 nt, Human
agucugauucccaagcucugc

SEQ ID NO: 1923104 - RNA, 19 nt, Human
aguaucaugcccugugcaa

SEQ ID NO: 1923105 - RNA, 15 nt, Human
aguaucaugcccugu

SEQ ID NO: 1923106 - RNA, 13 nt, Human
aguaucacugucu

SEQ ID NO: 1923107 - RNA, 17 nt, Human
aguaucacugucuuucc

SEQ ID NO: 1923108 - RNA, 22 nt, Human
aguaucacugucuuuccuagau

SEQ ID NO: 1923109 - RNA, 20 nt, Human
agugauucuccugccucagc

SEQ ID NO: 1923110 - RNA, 19 nt, Human
agugauucuccugccucag

SEQ ID NO: 1923111 - RNA, 18 nt, Human
agugauucuccugccuca

SEQ ID NO: 1923112 - RNA, 19 nt, Human
agugccuuauggaacacuc

SEQ ID NO: 1923113 - RNA, 20 nt, Human
agugccuuauggaacacucu

SEQ ID NO: 1923114 - RNA, 21 nt, Human
agugccuuauggaacacucug

SEQ ID NO: 1923115 - RNA, 22 nt, Human
agugccuuauggaacacucuga

SEQ ID NO: 1923116 - RNA, 16 nt, Human
agugccuucuaaaggu

SEQ ID NO: 1923117 - RNA, 13 nt, Human
agugauuaccagg

SEQ ID NO: 1923118 - RNA, 23 nt, Human
agugauccucccaccucagccuc

SEQ ID NO: 1923119 - RNA, 22 nt, Human
agugauccucccaccucagccu

SEQ ID NO: 1923120 - RNA, 20 nt, Human
agugauccucccaccucagc

SEQ ID NO: 1923121 - RNA, 19 nt, Human
agugauccucccaccucag

SEQ ID NO: 1923122 - RNA, 14 nt, Human
agugacagaggcag

SEQ ID NO: 1923123 - RNA, 12 nt, Human
agugaauauuca

SEQ ID NO: 1923124 - RNA, 18 nt, Human
agugaauaacugcaaagu

SEQ ID NO: 1923125 - RNA, 19 nt, Human
agugacagaggcagcccca

SEQ ID NO: 1923126 - RNA, 16 nt, Human
agugacagaggcagcc

SEQ ID NO: 1923127 - RNA, 20 nt, Human
aguaacccccacuggacuga

SEQ ID NO: 1923128 - RNA, 21 nt, Human
aguaaaugggggugcauuuga

SEQ ID NO: 1923129 - RNA, 20 nt, Human
aguaaaugggggugcauuug

SEQ ID NO: 1923130 - RNA, 19 nt, Human
aguaaaugggggugcauuu

SEQ ID NO: 1923131 - RNA, 17 nt, Human
aguaacuuacuuaggug

SEQ ID NO: 1923132 - RNA, 17 nt, Human
aguaacuucuuauggaa

SEQ ID NO: 1923133 - RNA, 19 nt, Human
aguaacuucuuauggaauu

SEQ ID NO: 1923134 - RNA, 22 nt, Human
aguacuucuccacccugcucuc

SEQ ID NO: 1923135 - RNA, 21 nt, Human
aguacuucuccacccugcucu

SEQ ID NO: 1923136 - RNA, 19 nt, Human
aguacuucuccacccugcu

SEQ ID NO: 1923137 - RNA, 20 nt, Human
aguacuucuccacccugcuc

SEQ ID NO: 1923138 - RNA, 22 nt, Human
aguauauugauccagaaagaaa

SEQ ID NO: 1923139 - RNA, 15 nt, Human
aguacuggagaaaau

SEQ ID NO: 1923140 - RNA, 13 nt, Human
aggggccagaaga

SEQ ID NO: 1923141 - RNA, 17 nt, Human
aggggccagaagaugaa

SEQ ID NO: 1923142 - RNA, 13 nt, Human
auaaguaaguuug

SEQ ID NO: 1923143 - RNA, 18 nt, Human
auaaguggaggcacuuua

SEQ ID NO: 1923144 - RNA, 19 nt, Human
auaaguggaggcacuuuag

SEQ ID NO: 1923145 - RNA, 20 nt, Human
auaaguggaggcacuuuagg

SEQ ID NO: 1923146 - RNA, 23 nt, Human
auacaaugcugugcccuaaagug

SEQ ID NO: 1923147 - RNA, 12 nt, Human
auaauguuaaca

SEQ ID NO: 1923148 - RNA, 15 nt, Human
auacaccacuacauu

SEQ ID NO: 1923149 - RNA, 21 nt, Human
auaagcuaacaccagacagac

SEQ ID NO: 1923150 - RNA, 21 nt, Human
auaaagaugagugagcaugcc

SEQ ID NO: 1923151 - RNA, 19 nt, Human
auacuugaaaauuaacaug

SEQ ID NO: 1923152 - RNA, 15 nt, Human
auacuguugugcgca

SEQ ID NO: 1923153 - RNA, 17 nt, Human
auacugucucuuucaug

SEQ ID NO: 1923154 - RNA, 16 nt, Human
auacuugaagggccag

SEQ ID NO: 1923155 - RNA, 17 nt, Human
auacuugaagggccaga

SEQ ID NO: 1923156 - RNA, 22 nt, Human
auacuugaagggccagagccag

SEQ ID NO: 1923157 - RNA, 18 nt, Human
auacuugaagggccagag

SEQ ID NO: 1923158 - RNA, 19 nt, Human
auacuugaagggccagagc

SEQ ID NO: 1923159 - RNA, 20 nt, Human
auacuugaagggccagagcc

SEQ ID NO: 1923160 - RNA, 21 nt, Human
auacuugaagggccagagcca

SEQ ID NO: 1923161 - RNA, 13 nt, Human
auacuuuuuacaa

SEQ ID NO: 1923162 - RNA, 20 nt, Human
auacuuuuuacaauuaaaaa

SEQ ID NO: 1923163 - RNA, 21 nt, Human
auacuuuuuuuucuuuaaaaa

SEQ ID NO: 1923164 - RNA, 17 nt, Human
auacaccagcauuccuu

SEQ ID NO: 1923165 - RNA, 18 nt, Human
auacaccagcauuccuuu

SEQ ID NO: 1923166 - RNA, 17 nt, Human
auacaccacuacauucu

SEQ ID NO: 1923167 - RNA, 17 nt, Human
aguuucugggaccucag

SEQ ID NO: 1923168 - RNA, 14 nt, Human
aguuugauuaaauu

SEQ ID NO: 1923169 - RNA, 11 nt, Human
aguuugcaguu

SEQ ID NO: 1923170 - RNA, 15 nt, Human
auaaaagacagugaa

SEQ ID NO: 1923171 - RNA, 16 nt, Human
auaaaagacagugaaa

SEQ ID NO: 1923172 - RNA, 12 nt, Human
auaaaacaggua

SEQ ID NO: 1923173 - RNA, 17 nt, Human
auaaaaaaaagaaauga

SEQ ID NO: 1923174 - RNA, 19 nt, Human
auaaaaaaaagaaaugaaa

SEQ ID NO: 1923175 - RNA, 22 nt, Human
aguucauauguaccauguacau

SEQ ID NO: 1923176 - RNA, 18 nt, Human
aguucauauguaccaugu

SEQ ID NO: 1923177 - RNA, 18 nt, Human
aguuccaccaucaagcca

SEQ ID NO: 1923178 - RNA, 21 nt, Human
aguuccaccaucaagccacca

SEQ ID NO: 1923179 - RNA, 14 nt, Human
aguucauacccugu

SEQ ID NO: 1923180 - RNA, 19 nt, Human
aguuacacauuuuucagau

SEQ ID NO: 1923181 - RNA, 16 nt, Human
aguuacacauuuuuca

SEQ ID NO: 1923182 - RNA, 13 nt, Human
aguuacacauuuu

SEQ ID NO: 1923183 - RNA, 17 nt, Human
aguugaaaaacagcuga

SEQ ID NO: 1923184 - RNA, 21 nt, Human
aguucuuugggccagacaugc

SEQ ID NO: 1923185 - RNA, 16 nt, Human
aguugaagacagagcu

SEQ ID NO: 1923186 - RNA, 17 nt, Human
aguugaagacagagcua

SEQ ID NO: 1923187 - RNA, 18 nt, Human
aguugaaaaacagcugag

SEQ ID NO: 1923188 - RNA, 13 nt, Human
aguguuuucuggg

SEQ ID NO: 1923189 - RNA, 20 nt, Human
aguguuuuaagauaaauuau

SEQ ID NO: 1923190 - RNA, 15 nt, Human
aguguuuucugggau

SEQ ID NO: 1923191 - RNA, 12 nt, Human
agugcuccagcc

SEQ ID NO: 1923192 - RNA, 14 nt, Human
aguggccacuaagc

SEQ ID NO: 1923193 - RNA, 19 nt, Human
aguggccacuaagcagagg

SEQ ID NO: 1923194 - RNA, 20 nt, Human
aguggccacuaagcagagga

SEQ ID NO: 1923195 - RNA, 22 nt, Human
aguggccacuaagcagaggagg

SEQ ID NO: 1923196 - RNA, 17 nt, Human
aguuguuagugugucuu

SEQ ID NO: 1923197 - RNA, 22 nt, Human
aguuguuagugugucuuagugu

SEQ ID NO: 1923198 - RNA, 17 nt, Human
agaucucugcagggccg

SEQ ID NO: 1923199 - RNA, 21 nt, Human
agaucugacaugauuccuucc

SEQ ID NO: 1923200 - RNA, 16 nt, Human
agaucucugcagggcc

SEQ ID NO: 1923201 - RNA, 17 nt, Human
agaugggugaaggcugg

SEQ ID NO: 1923202 - RNA, 21 nt, Human
agaugggugaaggcuggcaug

SEQ ID NO: 1923203 - RNA, 20 nt, Human
agaugggugcuuggaggaag

SEQ ID NO: 1923204 - RNA, 22 nt, Human
agaugggugcuuggaggaagga

SEQ ID NO: 1923205 - RNA, 14 nt, Human
agauucuuuccuga

SEQ ID NO: 1923206 - RNA, 18 nt, Human
agaugacaucugucuagg

SEQ ID NO: 1923207 - RNA, 23 nt, Human
agaucugacaugauuccuuccug

SEQ ID NO: 1923208 - RNA, 19 nt, Human
agcaaauucuguuuuucua

SEQ ID NO: 1923209 - RNA, 19 nt, Human
agauugcaacaggcugggc

SEQ ID NO: 1923210 - RNA, 17 nt, Human
agauugcaacaggcugg

SEQ ID NO: 1923211 - RNA, 16 nt, Human
agauugcaccacugca

SEQ ID NO: 1923212 - RNA, 16 nt, Human
agauugcaacaggcug

SEQ ID NO: 1923213 - RNA, 17 nt, Human
agauugagauguguuca

SEQ ID NO: 1923214 - RNA, 18 nt, Human
agauucuuuccugaggcu

SEQ ID NO: 1923215 - RNA, 15 nt, Human
agauucuuuccugag

SEQ ID NO: 1923216 - RNA, 16 nt, Human
agauucuuuccugagg

SEQ ID NO: 1923217 - RNA, 20 nt, Human
agauagauaggucagugcaa

SEQ ID NO: 1923218 - RNA, 20 nt, Human
agauagccaaggccaaagga

SEQ ID NO: 1923219 - RNA, 19 nt, Human
agauagccccacaggaggu

SEQ ID NO: 1923220 - RNA, 15 nt, Human
agauauaaaagacug

SEQ ID NO: 1923221 - RNA, 14 nt, Human
agaguugaagacag

SEQ ID NO: 1923222 - RNA, 15 nt, Human
agaguugaagacaga

SEQ ID NO: 1923223 - RNA, 13 nt, Human
agaguugagcucu

SEQ ID NO: 1923224 - RNA, 13 nt, Human
agaguugaagaca

SEQ ID NO: 1923225 - RNA, 23 nt, Human
agaggggguggccucccaacuca

SEQ ID NO: 1923226 - RNA, 20 nt, Human
agagggucugaggaauccag

SEQ ID NO: 1923227 - RNA, 19 nt, Human
agagugggguagguuggga

SEQ ID NO: 1923228 - RNA, 16 nt, Human
agauaugauucaaaug

SEQ ID NO: 1923229 - RNA, 15 nt, Human
agauaugauucaaau

SEQ ID NO: 1923230 - RNA, 14 nt, Human
agauaugauucaaa

SEQ ID NO: 1923231 - RNA, 16 nt, Human
agcaucuaugugagac

SEQ ID NO: 1923232 - RNA, 22 nt, Human
agccagcaggcucucaggccag

SEQ ID NO: 1923233 - RNA, 21 nt, Human
agccagcaggcucucaggcca

SEQ ID NO: 1923234 - RNA, 23 nt, Human
agccagcaggcucucaggccagc

SEQ ID NO: 1923235 - RNA, 22 nt, Human
agcccaaaccaccagaagccca

SEQ ID NO: 1923236 - RNA, 20 nt, Human
agcccaaaccaccagaagcc

SEQ ID NO: 1923237 - RNA, 19 nt, Human
agcccaaaccaccagaagc

SEQ ID NO: 1923238 - RNA, 17 nt, Human
agcccaaaccaccagaa

SEQ ID NO: 1923239 - RNA, 13 nt, Human
agcccaccuuggc

SEQ ID NO: 1923240 - RNA, 23 nt, Human
agcccaccccucaacaccucugc

SEQ ID NO: 1923241 - RNA, 14 nt, Human
agcccaaagaagga

SEQ ID NO: 1923242 - RNA, 13 nt, Human
agcccaaagaagg

SEQ ID NO: 1923243 - RNA, 15 nt, Human
agccauuuuuacugu

SEQ ID NO: 1923244 - RNA, 17 nt, Human
agcccacgcccccacug

SEQ ID NO: 1923245 - RNA, 18 nt, Human
agcccacgcccccacugg

SEQ ID NO: 1923246 - RNA, 19 nt, Human
agcccacgcccccacuggu

SEQ ID NO: 1923247 - RNA, 20 nt, Human
agcccacgcccccacuggug

SEQ ID NO: 1923248 - RNA, 17 nt, Human
agccaacuauggccugu

SEQ ID NO: 1923249 - RNA, 13 nt, Human
agcaucucccagu

SEQ ID NO: 1923250 - RNA, 14 nt, Human
agccagauuucacu

SEQ ID NO: 1923251 - RNA, 17 nt, Human
agccagauuucacucuc

SEQ ID NO: 1923252 - RNA, 20 nt, Human
agccagauuucacucuccuu

SEQ ID NO: 1923253 - RNA, 22 nt, Human
agccagauuucacucuccuugg

SEQ ID NO: 1923254 - RNA, 15 nt, Human
agccaagaggcugca

SEQ ID NO: 1923255 - RNA, 14 nt, Human
agccaagaggcugc

SEQ ID NO: 1923256 - RNA, 16 nt, Human
agcagccuggacccug

SEQ ID NO: 1923257 - RNA, 21 nt, Human
agcacugaggaagaacggggc

SEQ ID NO: 1923258 - RNA, 10 nt, Human
agcacugagg

SEQ ID NO: 1923259 - RNA, 14 nt, Human
agcacugaggaaga

SEQ ID NO: 1923260 - RNA, 11 nt, Human
agcacugagga

SEQ ID NO: 1923261 - RNA, 13 nt, Human
agcagugcaugcu

SEQ ID NO: 1923262 - RNA, 16 nt, Human
agcagugcaugcuguc

SEQ ID NO: 1923263 - RNA, 16 nt, Human
agcagccuuuaaugca

SEQ ID NO: 1923264 - RNA, 18 nt, Human
agcagccuuuaaugcauc

SEQ ID NO: 1923265 - RNA, 20 nt, Human
agcagccuggacccugugga

SEQ ID NO: 1923266 - RNA, 23 nt, Human
agcagccugagcaacucuugauu

SEQ ID NO: 1923267 - RNA, 18 nt, Human
agcagcguuucuaugaca

SEQ ID NO: 1923268 - RNA, 19 nt, Human
agcagcguuucuaugacac

SEQ ID NO: 1923269 - RNA, 17 nt, Human
agcagugcaugcugucc

SEQ ID NO: 1923270 - RNA, 14 nt, Human
agcagugggccugg

SEQ ID NO: 1923271 - RNA, 21 nt, Human
agcacagacccugcccugugg

SEQ ID NO: 1923272 - RNA, 19 nt, Human
agaagggagcuagccagag

SEQ ID NO: 1923273 - RNA, 18 nt, Human
agaagggagcuagccaga

SEQ ID NO: 1923274 - RNA, 19 nt, Human
agaagauggcacuuauaac

SEQ ID NO: 1923275 - RNA, 18 nt, Human
agaagaugaaugagcaaa

SEQ ID NO: 1923276 - RNA, 14 nt, Human
agaagucacacagu

SEQ ID NO: 1923277 - RNA, 17 nt, Human
agaagucuuagauguau

SEQ ID NO: 1923278 - RNA, 19 nt, Human
agaagucuuagauguauau

SEQ ID NO: 1923279 - RNA, 16 nt, Human
agaaccagucccccca

SEQ ID NO: 1923280 - RNA, 19 nt, Human
agaaccaguccccccaccc

SEQ ID NO: 1923281 - RNA, 20 nt, Human
agaaccaguccccccacccu

SEQ ID NO: 1923282 - RNA, 21 nt, Human
agaaccaaaaagaggcuaugu

SEQ ID NO: 1923283 - RNA, 19 nt, Human
agaacauugguauucgcuu

SEQ ID NO: 1923284 - RNA, 13 nt, Human
agaacauuuuaau

SEQ ID NO: 1923285 - RNA, 16 nt, Human
agaacauuuuaauuca

SEQ ID NO: 1923286 - RNA, 15 nt, Human
agaagagaaugcaca

SEQ ID NO: 1923287 - RNA, 23 nt, Human
agaagagaaugcacaaacagagg

SEQ ID NO: 1923288 - RNA, 11 nt, Human
agaagagccac

SEQ ID NO: 1923289 - RNA, 13 nt, Human
agaagagccacag
